United States Patent 8,969,254 (OLIGONUCLEOTIDE ARRAY FOR TISSUE TYPING) - sequence listing, part 6

SEQ ID NO: 120442 - DNA, 32 bp, Artificial Sequence
  Description of Artificial Sequence: Synthetic oligonucleotide
gcaggcgtgatgaccaacaaagatgaagttcc

SEQ ID NO: 120443 - DNA, 32 bp, Artificial Sequence
  Description of Artificial Sequence: Synthetic oligonucleotide
caggcgtgatgaccaacaaagatgaagttccc

SEQ ID NO: 120444 - DNA, 35 bp, Artificial Sequence
  Description of Artificial Sequence: Synthetic oligonucleotide
aggcgtgatgaccaacaaagatgaagttccctatc

SEQ ID NO: 120445 - DNA, 34 bp, Artificial Sequence
  Description of Artificial Sequence: Synthetic oligonucleotide
ggcgtgatgaccaacaaagatgaagttccctatc

SEQ ID NO: 120446 - DNA, 36 bp, Artificial Sequence
  Description of Artificial Sequence: Synthetic oligonucleotide
gcgtgatgaccaacaaagatgaagttccctatctac

SEQ ID NO: 120447 - DNA, 36 bp, Artificial Sequence
  Description of Artificial Sequence: Synthetic oligonucleotide
cgtgatgaccaacaaagatgaagttccctatctacg

SEQ ID NO: 120448 - DNA, 36 bp, Artificial Sequence
  Description of Artificial Sequence: Synthetic oligonucleotide
gtgatgaccaacaaagatgaagttccctatctacgg

SEQ ID NO: 120449 - DNA, 39 bp, Artificial Sequence
  Description of Artificial Sequence: Synthetic oligonucleotide
tgatgaccaacaaagatgaagttccctatctacggaaag

SEQ ID NO: 120450 - DNA, 38 bp, Artificial Sequence
  Description of Artificial Sequence: Synthetic oligonucleotide
gatgaccaacaaagatgaagttccctatctacggaaag

SEQ ID NO: 120451 - DNA, 38 bp, Artificial Sequence
  Description of Artificial Sequence: Synthetic oligonucleotide
atgaccaacaaagatgaagttccctatctacggaaagg

SEQ ID NO: 120452 - DNA, 37 bp, Artificial Sequence
  Description of Artificial Sequence: Synthetic oligonucleotide
tgaccaacaaagatgaagttccctatctacggaaagg

SEQ ID NO: 120453 - DNA, 36 bp, Artificial Sequence
  Description of Artificial Sequence: Synthetic oligonucleotide
gaccaacaaagatgaagttccctatctacggaaagg

SEQ ID NO: 120454 - DNA, 36 bp, Artificial Sequence
  Description of Artificial Sequence: Synthetic oligonucleotide
accaacaaagatgaagttccctatctacggaaaggc

SEQ ID NO: 120455 - DNA, 35 bp, Artificial Sequence
  Description of Artificial Sequence: Synthetic oligonucleotide
ccaacaaagatgaagttccctatctacggaaaggc

SEQ ID NO: 120456 - DNA, 37 bp, Artificial Sequence
  Description of Artificial Sequence: Synthetic oligonucleotide
caacaaagatgaagttccctatctacggaaaggcatg

SEQ ID NO: 120457 - DNA, 38 bp, Artificial Sequence
  Description of Artificial Sequence: Synthetic oligonucleotide
aacaaagatgaagttccctatctacggaaaggcatgac

SEQ ID NO: 120458 - DNA, 37 bp, Artificial Sequence
  Description of Artificial Sequence: Synthetic oligonucleotide
acaaagatgaagttccctatctacggaaaggcatgac

SEQ ID NO: 120459 - DNA, 36 bp, Artificial Sequence
  Description of Artificial Sequence: Synthetic oligonucleotide
caaagatgaagttccctatctacggaaaggcatgac

SEQ ID NO: 120460 - DNA, 37 bp, Artificial Sequence
  Description of Artificial Sequence: Synthetic oligonucleotide
aaagatgaagttccctatctacggaaaggcatgactg

SEQ ID NO: 120461 - DNA, 36 bp, Artificial Sequence
  Description of Artificial Sequence: Synthetic oligonucleotide
aagatgaagttccctatctacggaaaggcatgactg

SEQ ID NO: 120462 - DNA, 35 bp, Artificial Sequence
  Description of Artificial Sequence: Synthetic oligonucleotide
agatgaagttccctatctacggaaaggcatgactg

SEQ ID NO: 120463 - DNA, 34 bp, Artificial Sequence
  Description of Artificial Sequence: Synthetic oligonucleotide
gatgaagttccctatctacggaaaggcatgactg

SEQ ID NO: 120464 - DNA, 34 bp, Artificial Sequence
  Description of Artificial Sequence: Synthetic oligonucleotide
atgaagttccctatctacggaaaggcatgactgg

SEQ ID NO: 120465 - DNA, 33 bp, Artificial Sequence
  Description of Artificial Sequence: Synthetic oligonucleotide
tgaagttccctatctacggaaaggcatgactgg

SEQ ID NO: 120466 - DNA, 32 bp, Artificial Sequence
  Description of Artificial Sequence: Synthetic oligonucleotide
gaagttccctatctacggaaaggcatgactgg

SEQ ID NO: 120467 - DNA, 32 bp, Artificial Sequence
  Description of Artificial Sequence: Synthetic oligonucleotide
aagttccctatctacggaaaggcatgactggg

SEQ ID NO: 120468 - DNA, 31 bp, Artificial Sequence
  Description of Artificial Sequence: Synthetic oligonucleotide
agttccctatctacggaaaggcatgactggg

SEQ ID NO: 120469 - DNA, 30 bp, Artificial Sequence
  Description of Artificial Sequence: Synthetic oligonucleotide
gttccctatctacggaaaggcatgactggg

SEQ ID NO: 120470 - DNA, 31 bp, Artificial Sequence
  Description of Artificial Sequence: Synthetic oligonucleotide
ttccctatctacggaaaggcatgactgggag

SEQ ID NO: 120471 - DNA, 30 bp, Artificial Sequence
  Description of Artificial Sequence: Synthetic oligonucleotide
tccctatctacggaaaggcatgactgggag

SEQ ID NO: 120472 - DNA, 29 bp, Artificial Sequence
  Description of Artificial Sequence: Synthetic oligonucleotide
ccctatctacggaaaggcatgactgggag

SEQ ID NO: 120473 - DNA, 29 bp, Artificial Sequence
  Description of Artificial Sequence: Synthetic oligonucleotide
cctatctacggaaaggcatgactgggagg

SEQ ID NO: 120474 - DNA, 29 bp, Artificial Sequence
  Description of Artificial Sequence: Synthetic oligonucleotide
ctatctacggaaaggcatgactgggaggc

SEQ ID NO: 120475 - DNA, 29 bp, Artificial Sequence
  Description of Artificial Sequence: Synthetic oligonucleotide
tatctacggaaaggcatgactgggaggcc

SEQ ID NO: 120476 - DNA, 28 bp, Artificial Sequence
  Description of Artificial Sequence: Synthetic oligonucleotide
atctacggaaaggcatgactgggaggcc

SEQ ID NO: 120477 - DNA, 27 bp, Artificial Sequence
  Description of Artificial Sequence: Synthetic oligonucleotide
tctacggaaaggcatgactgggaggcc

SEQ ID NO: 120478 - DNA, 26 bp, Artificial Sequence
  Description of Artificial Sequence: Synthetic oligonucleotide
ctacggaaaggcatgactgggaggcc

SEQ ID NO: 120479 - DNA, 27 bp, Artificial Sequence
  Description of Artificial Sequence: Synthetic oligonucleotide
tacggaaaggcatgactgggaggccca

SEQ ID NO: 120480 - DNA, 26 bp, Artificial Sequence
  Description of Artificial Sequence: Synthetic oligonucleotide
acggaaaggcatgactgggaggccca

SEQ ID NO: 120481 - DNA, 25 bp, Artificial Sequence
  Description of Artificial Sequence: Synthetic oligonucleotide
cggaaaggcatgactgggaggccca

SEQ ID NO: 120482 - DNA, 27 bp, Artificial Sequence
  Description of Artificial Sequence: Synthetic oligonucleotide
ggaaaggcatgactgggaggcccacaa

SEQ ID NO: 120483 - DNA, 27 bp, Artificial Sequence
  Description of Artificial Sequence: Synthetic oligonucleotide
gaaaggcatgactgggaggcccacaag

SEQ ID NO: 120484 - DNA, 27 bp, Artificial Sequence
  Description of Artificial Sequence: Synthetic oligonucleotide
aaaggcatgactgggaggcccacaagg

SEQ ID NO: 120485 - DNA, 27 bp, Artificial Sequence
  Description of Artificial Sequence: Synthetic oligonucleotide
aaggcatgactgggaggcccacaagga

SEQ ID NO: 120486 - DNA, 26 bp, Artificial Sequence
  Description of Artificial Sequence: Synthetic oligonucleotide
aggcatgactgggaggcccacaagga

SEQ ID NO: 120487 - DNA, 25 bp, Artificial Sequence
  Description of Artificial Sequence: Synthetic oligonucleotide
ggcatgactgggaggcccacaagga

SEQ ID NO: 120488 - DNA, 26 bp, Artificial Sequence
  Description of Artificial Sequence: Synthetic oligonucleotide
gcatgactgggaggcccacaaggact

SEQ ID NO: 120489 - DNA, 27 bp, Artificial Sequence
  Description of Artificial Sequence: Synthetic oligonucleotide
catgactgggaggcccacaaggactct

SEQ ID NO: 120490 - DNA, 27 bp, Artificial Sequence
  Description of Artificial Sequence: Synthetic oligonucleotide
atgactgggaggcccacaaggactctc

SEQ ID NO: 120491 - DNA, 27 bp, Artificial Sequence
  Description of Artificial Sequence: Synthetic oligonucleotide
tgactgggaggcccacaaggactctca

SEQ ID NO: 120492 - DNA, 27 bp, Artificial Sequence
  Description of Artificial Sequence: Synthetic oligonucleotide
gactgggaggcccacaaggactctcat

SEQ ID NO: 120493 - DNA, 28 bp, Artificial Sequence
  Description of Artificial Sequence: Synthetic oligonucleotide
actgggaggcccacaaggactctcattg

SEQ ID NO: 120494 - DNA, 27 bp, Artificial Sequence
  Description of Artificial Sequence: Synthetic oligonucleotide
ctgggaggcccacaaggactctcattg

SEQ ID NO: 120495 - DNA, 28 bp, Artificial Sequence
  Description of Artificial Sequence: Synthetic oligonucleotide
tgggaggcccacaaggactctcattgag

SEQ ID NO: 120496 - DNA, 27 bp, Artificial Sequence
  Description of Artificial Sequence: Synthetic oligonucleotide
gggaggcccacaaggactctcattgag

SEQ ID NO: 120497 - DNA, 29 bp, Artificial Sequence
  Description of Artificial Sequence: Synthetic oligonucleotide
ggaggcccacaaggactctcattgagttc

SEQ ID NO: 120498 - DNA, 32 bp, Artificial Sequence
  Description of Artificial Sequence: Synthetic oligonucleotide
gaggcccacaaggactctcattgagttcttac

SEQ ID NO: 120499 - DNA, 34 bp, Artificial Sequence
  Description of Artificial Sequence: Synthetic oligonucleotide
aggcccacaaggactctcattgagttcttacttc

SEQ ID NO: 120500 - DNA, 33 bp, Artificial Sequence
  Description of Artificial Sequence: Synthetic oligonucleotide
ggcccacaaggactctcattgagttcttacttc

SEQ ID NO: 120501 - DNA, 33 bp, Artificial Sequence
  Description of Artificial Sequence: Synthetic oligonucleotide
gcccacaaggactctcattgagttcttacttcg

SEQ ID NO: 120502 - DNA, 36 bp, Artificial Sequence
  Description of Artificial Sequence: Synthetic oligonucleotide
cccacaaggactctcattgagttcttacttcgtttc

SEQ ID NO: 120503 - DNA, 37 bp, Artificial Sequence
  Description of Artificial Sequence: Synthetic oligonucleotide
ccacaaggactctcattgagttcttacttcgtttcag

SEQ ID NO: 120504 - DNA, 38 bp, Artificial Sequence
  Description of Artificial Sequence: Synthetic oligonucleotide
cacaaggactctcattgagttcttacttcgtttcagtc

SEQ ID NO: 120505 - DNA, 40 bp, Artificial Sequence
  Description of Artificial Sequence: Synthetic oligonucleotide
acaaggactctcattgagttcttacttcgtttcagtcaag

SEQ ID NO: 120506 - DNA, 39 bp, Artificial Sequence
  Description of Artificial Sequence: Synthetic oligonucleotide
caaggactctcattgagttcttacttcgtttcagtcaag

SEQ ID NO: 120507 - DNA, 40 bp, Artificial Sequence
  Description of Artificial Sequence: Synthetic oligonucleotide
aaggactctcattgagttcttacttcgtttcagtcaagac

SEQ ID NO: 120508 - DNA, 39 bp, Artificial Sequence
  Description of Artificial Sequence: Synthetic oligonucleotide
aggactctcattgagttcttacttcgtttcagtcaagac

SEQ ID NO: 120509 - DNA, 38 bp, Artificial Sequence
  Description of Artificial Sequence: Synthetic oligonucleotide
ggactctcattgagttcttacttcgtttcagtcaagac

SEQ ID NO: 120510 - DNA, 41 bp, Artificial Sequence
  Description of Artificial Sequence: Synthetic oligonucleotide
gactctcattgagttcttacttcgtttcagtcaagacaatg

SEQ ID NO: 120511 - DNA, 41 bp, Artificial Sequence
  Description of Artificial Sequence: Synthetic oligonucleotide
actctcattgagttcttacttcgtttcagtcaagacaatgc

SEQ ID NO: 120512 - DNA, 40 bp, Artificial Sequence
  Description of Artificial Sequence: Synthetic oligonucleotide
ctctcattgagttcttacttcgtttcagtcaagacaatgc

SEQ ID NO: 120513 - DNA, 43 bp, Artificial Sequence
  Description of Artificial Sequence: Synthetic oligonucleotide
tctcattgagttcttacttcgtttcagtcaagacaatgcttag

SEQ ID NO: 120514 - DNA, 26 bp, Artificial Sequence
  Description of Artificial Sequence: Synthetic oligonucleotide
atggcggagcgcgggtacagcttttc

SEQ ID NO: 120515 - DNA, 25 bp, Artificial Sequence
  Description of Artificial Sequence: Synthetic oligonucleotide
tggcggagcgcgggtacagcttttc

SEQ ID NO: 120516 - DNA, 24 bp, Artificial Sequence
  Description of Artificial Sequence: Synthetic oligonucleotide
ggcggagcgcgggtacagcttttc

SEQ ID NO: 120517 - DNA, 24 bp, Artificial Sequence
  Description of Artificial Sequence: Synthetic oligonucleotide
gcggagcgcgggtacagcttttcg

SEQ ID NO: 120518 - DNA, 25 bp, Artificial Sequence
  Description of Artificial Sequence: Synthetic oligonucleotide
cggagcgcgggtacagcttttcgct

SEQ ID NO: 120519 - DNA, 26 bp, Artificial Sequence
  Description of Artificial Sequence: Synthetic oligonucleotide
ggagcgcgggtacagcttttcgctga

SEQ ID NO: 120520 - DNA, 27 bp, Artificial Sequence
  Description of Artificial Sequence: Synthetic oligonucleotide
gagcgcgggtacagcttttcgctgact

SEQ ID NO: 120521 - DNA, 28 bp, Artificial Sequence
  Description of Artificial Sequence: Synthetic oligonucleotide
agcgcgggtacagcttttcgctgactac

SEQ ID NO: 120522 - DNA, 27 bp, Artificial Sequence
  Description of Artificial Sequence: Synthetic oligonucleotide
gcgcgggtacagcttttcgctgactac

SEQ ID NO: 120523 - DNA, 30 bp, Artificial Sequence
  Description of Artificial Sequence: Synthetic oligonucleotide
cgcgggtacagcttttcgctgactacattc

SEQ ID NO: 120524 - DNA, 31 bp, Artificial Sequence
  Description of Artificial Sequence: Synthetic oligonucleotide
gcgggtacagcttttcgctgactacattcag

SEQ ID NO: 120525 - DNA, 31 bp, Artificial Sequence
  Description of Artificial Sequence: Synthetic oligonucleotide
cgggtacagcttttcgctgactacattcagc

SEQ ID NO: 120526 - DNA, 31 bp, Artificial Sequence
  Description of Artificial Sequence: Synthetic oligonucleotide
gggtacagcttttcgctgactacattcagcc

SEQ ID NO: 120527 - DNA, 31 bp, Artificial Sequence
  Description of Artificial Sequence: Synthetic oligonucleotide
ggtacagcttttcgctgactacattcagccc

SEQ ID NO: 120528 - DNA, 31 bp, Artificial Sequence
  Description of Artificial Sequence: Synthetic oligonucleotide
gtacagcttttcgctgactacattcagcccg

SEQ ID NO: 120529 - DNA, 32 bp, Artificial Sequence
  Description of Artificial Sequence: Synthetic oligonucleotide
tacagcttttcgctgactacattcagcccgtc

SEQ ID NO: 120530 - DNA, 31 bp, Artificial Sequence
  Description of Artificial Sequence: Synthetic oligonucleotide
acagcttttcgctgactacattcagcccgtc

SEQ ID NO: 120531 - DNA, 30 bp, Artificial Sequence
  Description of Artificial Sequence: Synthetic oligonucleotide
cagcttttcgctgactacattcagcccgtc

SEQ ID NO: 120532 - DNA, 31 bp, Artificial Sequence
  Description of Artificial Sequence: Synthetic oligonucleotide
agcttttcgctgactacattcagcccgtctg

SEQ ID NO: 120533 - DNA, 30 bp, Artificial Sequence
  Description of Artificial Sequence: Synthetic oligonucleotide
gcttttcgctgactacattcagcccgtctg

SEQ ID NO: 120534 - DNA, 30 bp, Artificial Sequence
  Description of Artificial Sequence: Synthetic oligonucleotide
cttttcgctgactacattcagcccgtctgg

SEQ ID NO: 120535 - DNA, 34 bp, Artificial Sequence
  Description of Artificial Sequence: Synthetic oligonucleotide
ttttcgctgactacattcagcccgtctggtaaac

SEQ ID NO: 120536 - DNA, 33 bp, Artificial Sequence
  Description of Artificial Sequence: Synthetic oligonucleotide
tttcgctgactacattcagcccgtctggtaaac

SEQ ID NO: 120537 - DNA, 32 bp, Artificial Sequence
  Description of Artificial Sequence: Synthetic oligonucleotide
ttcgctgactacattcagcccgtctggtaaac

SEQ ID NO: 120538 - DNA, 31 bp, Artificial Sequence
  Description of Artificial Sequence: Synthetic oligonucleotide
tcgctgactacattcagcccgtctggtaaac

SEQ ID NO: 120539 - DNA, 30 bp, Artificial Sequence
  Description of Artificial Sequence: Synthetic oligonucleotide
cgctgactacattcagcccgtctggtaaac

SEQ ID NO: 120540 - DNA, 32 bp, Artificial Sequence
  Description of Artificial Sequence: Synthetic oligonucleotide
gctgactacattcagcccgtctggtaaacttg

SEQ ID NO: 120541 - DNA, 33 bp, Artificial Sequence
  Description of Artificial Sequence: Synthetic oligonucleotide
ctgactacattcagcccgtctggtaaacttgtc

SEQ ID NO: 120542 - DNA, 33 bp, Artificial Sequence
  Description of Artificial Sequence: Synthetic oligonucleotide
tgactacattcagcccgtctggtaaacttgtcc

SEQ ID NO: 120543 - DNA, 32 bp, Artificial Sequence
  Description of Artificial Sequence: Synthetic oligonucleotide
gactacattcagcccgtctggtaaacttgtcc

SEQ ID NO: 120544 - DNA, 33 bp, Artificial Sequence
  Description of Artificial Sequence: Synthetic oligonucleotide
actacattcagcccgtctggtaaacttgtccag

SEQ ID NO: 120545 - DNA, 32 bp, Artificial Sequence
  Description of Artificial Sequence: Synthetic oligonucleotide
ctacattcagcccgtctggtaaacttgtccag

SEQ ID NO: 120546 - DNA, 35 bp, Artificial Sequence
  Description of Artificial Sequence: Synthetic oligonucleotide
tacattcagcccgtctggtaaacttgtccagattg

SEQ ID NO: 120547 - DNA, 34 bp, Artificial Sequence
  Description of Artificial Sequence: Synthetic oligonucleotide
acattcagcccgtctggtaaacttgtccagattg

SEQ ID NO: 120548 - DNA, 33 bp, Artificial Sequence
  Description of Artificial Sequence: Synthetic oligonucleotide
cattcagcccgtctggtaaacttgtccagattg

SEQ ID NO: 120549 - DNA, 38 bp, Artificial Sequence
  Description of Artificial Sequence: Synthetic oligonucleotide
attcagcccgtctggtaaacttgtccagattgaatatg

SEQ ID NO: 120550 - DNA, 37 bp, Artificial Sequence
  Description of Artificial Sequence: Synthetic oligonucleotide
ttcagcccgtctggtaaacttgtccagattgaatatg

SEQ ID NO: 120551 - DNA, 36 bp, Artificial Sequence
  Description of Artificial Sequence: Synthetic oligonucleotide
tcagcccgtctggtaaacttgtccagattgaatatg

SEQ ID NO: 120552 - DNA, 35 bp, Artificial Sequence
  Description of Artificial Sequence: Synthetic oligonucleotide
cagcccgtctggtaaacttgtccagattgaatatg

SEQ ID NO: 120553 - DNA, 35 bp, Artificial Sequence
  Description of Artificial Sequence: Synthetic oligonucleotide
agcccgtctggtaaacttgtccagattgaatatgc

SEQ ID NO: 120554 - DNA, 34 bp, Artificial Sequence
  Description of Artificial Sequence: Synthetic oligonucleotide
gcccgtctggtaaacttgtccagattgaatatgc

SEQ ID NO: 120555 - DNA, 37 bp, Artificial Sequence
  Description of Artificial Sequence: Synthetic oligonucleotide
cccgtctggtaaacttgtccagattgaatatgctttg

SEQ ID NO: 120556 - DNA, 37 bp, Artificial Sequence
  Description of Artificial Sequence: Synthetic oligonucleotide
ccgtctggtaaacttgtccagattgaatatgctttgg

SEQ ID NO: 120557 - DNA, 37 bp, Artificial Sequence
  Description of Artificial Sequence: Synthetic oligonucleotide
cgtctggtaaacttgtccagattgaatatgctttggc

SEQ ID NO: 120558 - DNA, 38 bp, Artificial Sequence
  Description of Artificial Sequence: Synthetic oligonucleotide
gtctggtaaacttgtccagattgaatatgctttggctg

SEQ ID NO: 120559 - DNA, 38 bp, Artificial Sequence
  Description of Artificial Sequence: Synthetic oligonucleotide
tctggtaaacttgtccagattgaatatgctttggctgc

SEQ ID NO: 120560 - DNA, 37 bp, Artificial Sequence
  Description of Artificial Sequence: Synthetic oligonucleotide
ctggtaaacttgtccagattgaatatgctttggctgc

SEQ ID NO: 120561 - DNA, 38 bp, Artificial Sequence
  Description of Artificial Sequence: Synthetic oligonucleotide
tggtaaacttgtccagattgaatatgctttggctgctg

SEQ ID NO: 120562 - DNA, 37 bp, Artificial Sequence
  Description of Artificial Sequence: Synthetic oligonucleotide
ggtaaacttgtccagattgaatatgctttggctgctg

SEQ ID NO: 120563 - DNA, 39 bp, Artificial Sequence
  Description of Artificial Sequence: Synthetic oligonucleotide
gtaaacttgtccagattgaatatgctttggctgctgtag

SEQ ID NO: 120564 - DNA, 39 bp, Artificial Sequence
  Description of Artificial Sequence: Synthetic oligonucleotide
taaacttgtccagattgaatatgctttggctgctgtagc

SEQ ID NO: 120565 - DNA, 38 bp, Artificial Sequence
  Description of Artificial Sequence: Synthetic oligonucleotide
aaacttgtccagattgaatatgctttggctgctgtagc

SEQ ID NO: 120566 - DNA, 37 bp, Artificial Sequence
  Description of Artificial Sequence: Synthetic oligonucleotide
aacttgtccagattgaatatgctttggctgctgtagc

SEQ ID NO: 120567 - DNA, 36 bp, Artificial Sequence
  Description of Artificial Sequence: Synthetic oligonucleotide
acttgtccagattgaatatgctttggctgctgtagc

SEQ ID NO: 120568 - DNA, 35 bp, Artificial Sequence
  Description of Artificial Sequence: Synthetic oligonucleotide
cttgtccagattgaatatgctttggctgctgtagc

SEQ ID NO: 120569 - DNA, 36 bp, Artificial Sequence
  Description of Artificial Sequence: Synthetic oligonucleotide
ttgtccagattgaatatgctttggctgctgtagctg

SEQ ID NO: 120570 - DNA, 35 bp, Artificial Sequence
  Description of Artificial Sequence: Synthetic oligonucleotide
tgtccagattgaatatgctttggctgctgtagctg

SEQ ID NO: 120571 - DNA, 34 bp, Artificial Sequence
  Description of Artificial Sequence: Synthetic oligonucleotide
gtccagattgaatatgctttggctgctgtagctg

SEQ ID NO: 120572 - DNA, 34 bp, Artificial Sequence
  Description of Artificial Sequence: Synthetic oligonucleotide
tccagattgaatatgctttggctgctgtagctgg

SEQ ID NO: 120573 - DNA, 33 bp, Artificial Sequence
  Description of Artificial Sequence: Synthetic oligonucleotide
ccagattgaatatgctttggctgctgtagctgg

SEQ ID NO: 120574 - DNA, 34 bp, Artificial Sequence
  Description of Artificial Sequence: Synthetic oligonucleotide
cagattgaatatgctttggctgctgtagctggag

SEQ ID NO: 120575 - DNA, 34 bp, Artificial Sequence
  Description of Artificial Sequence: Synthetic oligonucleotide
agattgaatatgctttggctgctgtagctggagg

SEQ ID NO: 120576 - DNA, 33 bp, Artificial Sequence
  Description of Artificial Sequence: Synthetic oligonucleotide
gattgaatatgctttggctgctgtagctggagg

SEQ ID NO: 120577 - DNA, 34 bp, Artificial Sequence
  Description of Artificial Sequence: Synthetic oligonucleotide
attgaatatgctttggctgctgtagctggaggag

SEQ ID NO: 120578 - DNA, 33 bp, Artificial Sequence
  Description of Artificial Sequence: Synthetic oligonucleotide
ttgaatatgctttggctgctgtagctggaggag

SEQ ID NO: 120579 - DNA, 32 bp, Artificial Sequence
  Description of Artificial Sequence: Synthetic oligonucleotide
tgaatatgctttggctgctgtagctggaggag

SEQ ID NO: 120580 - DNA, 31 bp, Artificial Sequence
  Description of Artificial Sequence: Synthetic oligonucleotide
gaatatgctttggctgctgtagctggaggag

SEQ ID NO: 120581 - DNA, 31 bp, Artificial Sequence
  Description of Artificial Sequence: Synthetic oligonucleotide
aatatgctttggctgctgtagctggaggagc

SEQ ID NO: 120582 - DNA, 30 bp, Artificial Sequence
  Description of Artificial Sequence: Synthetic oligonucleotide
atatgctttggctgctgtagctggaggagc

SEQ ID NO: 120583 - DNA, 29 bp, Artificial Sequence
  Description of Artificial Sequence: Synthetic oligonucleotide
tatgctttggctgctgtagctggaggagc

SEQ ID NO: 120584 - DNA, 28 bp, Artificial Sequence
  Description of Artificial Sequence: Synthetic oligonucleotide
atgctttggctgctgtagctggaggagc

SEQ ID NO: 120585 - DNA, 27 bp, Artificial Sequence
  Description of Artificial Sequence: Synthetic oligonucleotide
tgctttggctgctgtagctggaggagc

SEQ ID NO: 120586 - DNA, 26 bp, Artificial Sequence
  Description of Artificial Sequence: Synthetic oligonucleotide
gctttggctgctgtagctggaggagc

SEQ ID NO: 120587 - DNA, 26 bp, Artificial Sequence
  Description of Artificial Sequence: Synthetic oligonucleotide
ctttggctgctgtagctggaggagcc

SEQ ID NO: 120588 - DNA, 26 bp, Artificial Sequence
  Description of Artificial Sequence: Synthetic oligonucleotide
tttggctgctgtagctggaggagccc

SEQ ID NO: 120589 - DNA, 25 bp, Artificial Sequence
  Description of Artificial Sequence: Synthetic oligonucleotide
ttggctgctgtagctggaggagccc

SEQ ID NO: 120590 - DNA, 24 bp, Artificial Sequence
  Description of Artificial Sequence: Synthetic oligonucleotide
tggctgctgtagctggaggagccc

SEQ ID NO: 120591 - DNA, 23 bp, Artificial Sequence
  Description of Artificial Sequence: Synthetic oligonucleotide
ggctgctgtagctggaggagccc

SEQ ID NO: 120592 - DNA, 23 bp, Artificial Sequence
  Description of Artificial Sequence: Synthetic oligonucleotide
gctgctgtagctggaggagcccc

SEQ ID NO: 120593 - DNA, 24 bp, Artificial Sequence
  Description of Artificial Sequence: Synthetic oligonucleotide
ctgctgtagctggaggagccccgt

SEQ ID NO: 120594 - DNA, 24 bp, Artificial Sequence
  Description of Artificial Sequence: Synthetic oligonucleotide
tgctgtagctggaggagccccgtc

SEQ ID NO: 120595 - DNA, 23 bp, Artificial Sequence
  Description of Artificial Sequence: Synthetic oligonucleotide
gctgtagctggaggagccccgtc

SEQ ID NO: 120596 - DNA, 23 bp, Artificial Sequence
  Description of Artificial Sequence: Synthetic oligonucleotide
ctgtagctggaggagccccgtcc

SEQ ID NO: 120597 - DNA, 24 bp, Artificial Sequence
  Description of Artificial Sequence: Synthetic oligonucleotide
tgtagctggaggagccccgtccgt

SEQ ID NO: 120598 - DNA, 23 bp, Artificial Sequence
  Description of Artificial Sequence: Synthetic oligonucleotide
gtagctggaggagccccgtccgt

SEQ ID NO: 120599 - DNA, 23 bp, Artificial Sequence
  Description of Artificial Sequence: Synthetic oligonucleotide
tagctggaggagccccgtccgtg

SEQ ID NO: 120600 - DNA, 22 bp, Artificial Sequence
  Description of Artificial Sequence: Synthetic oligonucleotide
agctggaggagccccgtccgtg

SEQ ID NO: 120601 - DNA, 21 bp, Artificial Sequence
  Description of Artificial Sequence: Synthetic oligonucleotide
gctggaggagccccgtccgtg

SEQ ID NO: 120602 - DNA, 21 bp, Artificial Sequence
  Description of Artificial Sequence: Synthetic oligonucleotide
ctggaggagccccgtccgtgg

SEQ ID NO: 120603 - DNA, 27 bp, Artificial Sequence
  Description of Artificial Sequence: Synthetic oligonucleotide
tggaggagccccgtccgtgggaattaa

SEQ ID NO: 120604 - DNA, 27 bp, Artificial Sequence
  Description of Artificial Sequence: Synthetic oligonucleotide
ggaggagccccgtccgtgggaattaaa

SEQ ID NO: 120605 - DNA, 27 bp, Artificial Sequence
  Description of Artificial Sequence: Synthetic oligonucleotide
gaggagccccgtccgtgggaattaaag

SEQ ID NO: 120606 - DNA, 27 bp, Artificial Sequence
  Description of Artificial Sequence: Synthetic oligonucleotide
aggagccccgtccgtgggaattaaagc

SEQ ID NO: 120607 - DNA, 27 bp, Artificial Sequence
  Description of Artificial Sequence: Synthetic oligonucleotide
ggagccccgtccgtgggaattaaagct

SEQ ID NO: 120608 - DNA, 27 bp, Artificial Sequence
  Description of Artificial Sequence: Synthetic oligonucleotide
gagccccgtccgtgggaattaaagctg

SEQ ID NO: 120609 - DNA, 27 bp, Artificial Sequence
  Description of Artificial Sequence: Synthetic oligonucleotide
agccccgtccgtgggaattaaagctgc

SEQ ID NO: 120610 - DNA, 27 bp, Artificial Sequence
  Description of Artificial Sequence: Synthetic oligonucleotide
gccccgtccgtgggaattaaagctgca

SEQ ID NO: 120611 - DNA, 30 bp, Artificial Sequence
  Description of Artificial Sequence: Synthetic oligonucleotide
ccccgtccgtgggaattaaagctgcaaatg

SEQ ID NO: 120612 - DNA, 30 bp, Artificial Sequence
  Description of Artificial Sequence: Synthetic oligonucleotide
cccgtccgtgggaattaaagctgcaaatgg

SEQ ID NO: 120613 - DNA, 31 bp, Artificial Sequence
  Description of Artificial Sequence: Synthetic oligonucleotide
ccgtccgtgggaattaaagctgcaaatggtg

SEQ ID NO: 120614 - DNA, 32 bp, Artificial Sequence
  Description of Artificial Sequence: Synthetic oligonucleotide
cgtccgtgggaattaaagctgcaaatggtgtg

SEQ ID NO: 120615 - DNA, 32 bp, Artificial Sequence
  Description of Artificial Sequence: Synthetic oligonucleotide
gtccgtgggaattaaagctgcaaatggtgtgg

SEQ ID NO: 120616 - DNA, 37 bp, Artificial Sequence
  Description of Artificial Sequence: Synthetic oligonucleotide
tccgtgggaattaaagctgcaaatggtgtggtattag

SEQ ID NO: 120617 - DNA, 36 bp, Artificial Sequence
  Description of Artificial Sequence: Synthetic oligonucleotide
ccgtgggaattaaagctgcaaatggtgtggtattag

SEQ ID NO: 120618 - DNA, 36 bp, Artificial Sequence
  Description of Artificial Sequence: Synthetic oligonucleotide
cgtgggaattaaagctgcaaatggtgtggtattagc

SEQ ID NO: 120619 - DNA, 38 bp, Artificial Sequence
  Description of Artificial Sequence: Synthetic oligonucleotide
gtgggaattaaagctgcaaatggtgtggtattagcaac

SEQ ID NO: 120620 - DNA, 39 bp, Artificial Sequence
  Description of Artificial Sequence: Synthetic oligonucleotide
tgggaattaaagctgcaaatggtgtggtattagcaactg

SEQ ID NO: 120621 - DNA, 38 bp, Artificial Sequence
  Description of Artificial Sequence: Synthetic oligonucleotide
gggaattaaagctgcaaatggtgtggtattagcaactg

SEQ ID NO: 120622 - DNA, 39 bp, Artificial Sequence
  Description of Artificial Sequence: Synthetic oligonucleotide
ggaattaaagctgcaaatggtgtggtattagcaactgag

SEQ ID NO: 120623 - DNA, 45 bp, Artificial Sequence
  Description of Artificial Sequence: Synthetic oligonucleotide
gaattaaagctgcaaatggtgtggtattagcaactgagaaaaaac

SEQ ID NO: 120624 - DNA, 46 bp, Artificial Sequence
  Description of Artificial Sequence: Synthetic oligonucleotide
aattaaagctgcaaatggtgtggtattagcaactgagaaaaaacag

SEQ ID NO: 120625 - DNA, 45 bp, Artificial Sequence
  Description of Artificial Sequence: Synthetic oligonucleotide
attaaagctgcaaatggtgtggtattagcaactgagaaaaaacag

SEQ ID NO: 120626 - DNA, 44 bp, Artificial Sequence
  Description of Artificial Sequence: Synthetic oligonucleotide
ttaaagctgcaaatggtgtggtattagcaactgagaaaaaacag

SEQ ID NO: 120627 - DNA, 43 bp, Artificial Sequence
  Description of Artificial Sequence: Synthetic oligonucleotide
taaagctgcaaatggtgtggtattagcaactgagaaaaaacag

SEQ ID NO: 120628 - DNA, 42 bp, Artificial Sequence
  Description of Artificial Sequence: Synthetic oligonucleotide
aaagctgcaaatggtgtggtattagcaactgagaaaaaacag

SEQ ID NO: 120629 - DNA, 41 bp, Artificial Sequence
  Description of Artificial Sequence: Synthetic oligonucleotide
aagctgcaaatggtgtggtattagcaactgagaaaaaacag

SEQ ID NO: 120630 - DNA, 40 bp, Artificial Sequence
  Description of Artificial Sequence: Synthetic oligonucleotide
agctgcaaatggtgtggtattagcaactgagaaaaaacag

SEQ ID NO: 120631 - DNA, 39 bp, Artificial Sequence
  Description of Artificial Sequence: Synthetic oligonucleotide
gctgcaaatggtgtggtattagcaactgagaaaaaacag

SEQ ID NO: 120632 - DNA, 43 bp, Artificial Sequence
  Description of Artificial Sequence: Synthetic oligonucleotide
ctgcaaatggtgtggtattagcaactgagaaaaaacagaaatc

SEQ ID NO: 120633 - DNA, 43 bp, Artificial Sequence
  Description of Artificial Sequence: Synthetic oligonucleotide
tgcaaatggtgtggtattagcaactgagaaaaaacagaaatcc

SEQ ID NO: 120634 - DNA, 42 bp, Artificial Sequence
  Description of Artificial Sequence: Synthetic oligonucleotide
gcaaatggtgtggtattagcaactgagaaaaaacagaaatcc

SEQ ID NO: 120635 - DNA, 45 bp, Artificial Sequence
  Description of Artificial Sequence: Synthetic oligonucleotide
caaatggtgtggtattagcaactgagaaaaaacagaaatccattc

SEQ ID NO: 120636 - DNA, 46 bp, Artificial Sequence
  Description of Artificial Sequence: Synthetic oligonucleotide
aaatggtgtggtattagcaactgagaaaaaacagaaatccattctg

SEQ ID NO: 120637 - DNA, 45 bp, Artificial Sequence
  Description of Artificial Sequence: Synthetic oligonucleotide
aatggtgtggtattagcaactgagaaaaaacagaaatccattctg

SEQ ID NO: 120638 - DNA, 44 bp, Artificial Sequence
  Description of Artificial Sequence: Synthetic oligonucleotide
atggtgtggtattagcaactgagaaaaaacagaaatccattctg

SEQ ID NO: 120639 - DNA, 43 bp, Artificial Sequence
  Description of Artificial Sequence: Synthetic oligonucleotide
tggtgtggtattagcaactgagaaaaaacagaaatccattctg

SEQ ID NO: 120640 - DNA, 42 bp, Artificial Sequence
  Description of Artificial Sequence: Synthetic oligonucleotide
ggtgtggtattagcaactgagaaaaaacagaaatccattctg

SEQ ID NO: 120641 - DNA, 45 bp, Artificial Sequence
  Description of Artificial Sequence: Synthetic oligonucleotide
gtgtggtattagcaactgagaaaaaacagaaatccattctgtatg

SEQ ID NO: 120642 - DNA, 47 bp, Artificial Sequence
  Description of Artificial Sequence: Synthetic oligonucleotide
tgtggtattagcaactgagaaaaaacagaaatccattctgtatgatg

SEQ ID NO: 120643 - DNA, 46 bp, Artificial Sequence
  Description of Artificial Sequence: Synthetic oligonucleotide
gtggtattagcaactgagaaaaaacagaaatccattctgtatgatg

SEQ ID NO: 120644 - DNA, 47 bp, Artificial Sequence
  Description of Artificial Sequence: Synthetic oligonucleotide
tggtattagcaactgagaaaaaacagaaatccattctgtatgatgag

SEQ ID NO: 120645 - DNA, 46 bp, Artificial Sequence
  Description of Artificial Sequence: Synthetic oligonucleotide
ggtattagcaactgagaaaaaacagaaatccattctgtatgatgag

SEQ ID NO: 120646 - DNA, 46 bp, Artificial Sequence
  Description of Artificial Sequence: Synthetic oligonucleotide
gtattagcaactgagaaaaaacagaaatccattctgtatgatgagc

SEQ ID NO: 120647 - DNA, 46 bp, Artificial Sequence
  Description of Artificial Sequence: Synthetic oligonucleotide
tattagcaactgagaaaaaacagaaatccattctgtatgatgagcg

SEQ ID NO: 120648 - DNA, 45 bp, Artificial Sequence
  Description of Artificial Sequence: Synthetic oligonucleotide
attagcaactgagaaaaaacagaaatccattctgtatgatgagcg

SEQ ID NO: 120649 - DNA, 44 bp, Artificial Sequence
  Description of Artificial Sequence: Synthetic oligonucleotide
ttagcaactgagaaaaaacagaaatccattctgtatgatgagcg

SEQ ID NO: 120650 - DNA, 43 bp, Artificial Sequence
  Description of Artificial Sequence: Synthetic oligonucleotide
tagcaactgagaaaaaacagaaatccattctgtatgatgagcg

SEQ ID NO: 120651 - DNA, 42 bp, Artificial Sequence
  Description of Artificial Sequence: Synthetic oligonucleotide
agcaactgagaaaaaacagaaatccattctgtatgatgagcg

SEQ ID NO: 120652 - DNA, 41 bp, Artificial Sequence
  Description of Artificial Sequence: Synthetic oligonucleotide
gcaactgagaaaaaacagaaatccattctgtatgatgagcg

SEQ ID NO: 120653 - DNA, 43 bp, Artificial Sequence
  Description of Artificial Sequence: Synthetic oligonucleotide
caactgagaaaaaacagaaatccattctgtatgatgagcgaag

SEQ ID NO: 120654 - DNA, 44 bp, Artificial Sequence
  Description of Artificial Sequence: Synthetic oligonucleotide
aactgagaaaaaacagaaatccattctgtatgatgagcgaagtg

SEQ ID NO: 120655 - DNA, 43 bp, Artificial Sequence
  Description of Artificial Sequence: Synthetic oligonucleotide
actgagaaaaaacagaaatccattctgtatgatgagcgaagtg

SEQ ID NO: 120656 - DNA, 42 bp, Artificial Sequence
  Description of Artificial Sequence: Synthetic oligonucleotide
ctgagaaaaaacagaaatccattctgtatgatgagcgaagtg

SEQ ID NO: 120657 - DNA, 44 bp, Artificial Sequence
  Description of Artificial Sequence: Synthetic oligonucleotide
tgagaaaaaacagaaatccattctgtatgatgagcgaagtgtac

SEQ ID NO: 120658 - DNA, 43 bp, Artificial Sequence
  Description of Artificial Sequence: Synthetic oligonucleotide
gagaaaaaacagaaatccattctgtatgatgagcgaagtgtac

SEQ ID NO: 120659 - DNA, 44 bp, Artificial Sequence
  Description of Artificial Sequence: Synthetic oligonucleotide
agaaaaaacagaaatccattctgtatgatgagcgaagtgtacac

SEQ ID NO: 120660 - DNA, 43 bp, Artificial Sequence
  Description of Artificial Sequence: Synthetic oligonucleotide
gaaaaaacagaaatccattctgtatgatgagcgaagtgtacac

SEQ ID NO: 120661 - DNA, 46 bp, Artificial Sequence
  Description of Artificial Sequence: Synthetic oligonucleotide
aaaaaacagaaatccattctgtatgatgagcgaagtgtacacaaag

SEQ ID NO: 120662 - DNA, 45 bp, Artificial Sequence
  Description of Artificial Sequence: Synthetic oligonucleotide
aaaaacagaaatccattctgtatgatgagcgaagtgtacacaaag

SEQ ID NO: 120663 - DNA, 44 bp, Artificial Sequence
  Description of Artificial Sequence: Synthetic oligonucleotide
aaaacagaaatccattctgtatgatgagcgaagtgtacacaaag

SEQ ID NO: 120664 - DNA, 43 bp, Artificial Sequence
  Description of Artificial Sequence: Synthetic oligonucleotide
aaacagaaatccattctgtatgatgagcgaagtgtacacaaag

SEQ ID NO: 120665 - DNA, 42 bp, Artificial Sequence
  Description of Artificial Sequence: Synthetic oligonucleotide
aacagaaatccattctgtatgatgagcgaagtgtacacaaag

SEQ ID NO: 120666 - DNA, 41 bp, Artificial Sequence
  Description of Artificial Sequence: Synthetic oligonucleotide
acagaaatccattctgtatgatgagcgaagtgtacacaaag

SEQ ID NO: 120667 - DNA, 40 bp, Artificial Sequence
  Description of Artificial Sequence: Synthetic oligonucleotide
cagaaatccattctgtatgatgagcgaagtgtacacaaag

SEQ ID NO: 120668 - DNA, 42 bp, Artificial Sequence
  Description of Artificial Sequence: Synthetic oligonucleotide
agaaatccattctgtatgatgagcgaagtgtacacaaagtag

SEQ ID NO: 120669 - DNA, 41 bp, Artificial Sequence
  Description of Artificial Sequence: Synthetic oligonucleotide
gaaatccattctgtatgatgagcgaagtgtacacaaagtag

SEQ ID NO: 120670 - DNA, 43 bp, Artificial Sequence
  Description of Artificial Sequence: Synthetic oligonucleotide
aaatccattctgtatgatgagcgaagtgtacacaaagtagaac

SEQ ID NO: 120671 - DNA, 42 bp, Artificial Sequence
  Description of Artificial Sequence: Synthetic oligonucleotide
aatccattctgtatgatgagcgaagtgtacacaaagtagaac

SEQ ID NO: 120672 - DNA, 41 bp, Artificial Sequence
  Description of Artificial Sequence: Synthetic oligonucleotide
atccattctgtatgatgagcgaagtgtacacaaagtagaac

SEQ ID NO: 120673 - DNA, 40 bp, Artificial Sequence
  Description of Artificial Sequence: Synthetic oligonucleotide
tccattctgtatgatgagcgaagtgtacacaaagtagaac

SEQ ID NO: 120674 - DNA, 39 bp, Artificial Sequence
  Description of Artificial Sequence: Synthetic oligonucleotide
ccattctgtatgatgagcgaagtgtacacaaagtagaac

SEQ ID NO: 120675 - DNA, 39 bp, Artificial Sequence
  Description of Artificial Sequence: Synthetic oligonucleotide
cattctgtatgatgagcgaagtgtacacaaagtagaacc

SEQ ID NO: 120676 - DNA, 44 bp, Artificial Sequence
  Description of Artificial Sequence: Synthetic oligonucleotide
attctgtatgatgagcgaagtgtacacaaagtagaaccaattac

SEQ ID NO: 120677 - DNA, 43 bp, Artificial Sequence
  Description of Artificial Sequence: Synthetic oligonucleotide
ttctgtatgatgagcgaagtgtacacaaagtagaaccaattac

SEQ ID NO: 120678 - DNA, 42 bp, Artificial Sequence
  Description of Artificial Sequence: Synthetic oligonucleotide
tctgtatgatgagcgaagtgtacacaaagtagaaccaattac

SEQ ID NO: 120679 - DNA, 41 bp, Artificial Sequence
  Description of Artificial Sequence: Synthetic oligonucleotide
ctgtatgatgagcgaagtgtacacaaagtagaaccaattac

SEQ ID NO: 120680 - DNA, 41 bp, Artificial Sequence
  Description of Artificial Sequence: Synthetic oligonucleotide
tgtatgatgagcgaagtgtacacaaagtagaaccaattacc

SEQ ID NO: 120681 - DNA, 40 bp, Artificial Sequence
  Description of Artificial Sequence: Synthetic oligonucleotide
gtatgatgagcgaagtgtacacaaagtagaaccaattacc

SEQ ID NO: 120682 - DNA, 42 bp, Artificial Sequence
  Description of Artificial Sequence: Synthetic oligonucleotide
tatgatgagcgaagtgtacacaaagtagaaccaattaccaag

SEQ ID NO: 120683 - DNA, 41 bp, Artificial Sequence
  Description of Artificial Sequence: Synthetic oligonucleotide
atgatgagcgaagtgtacacaaagtagaaccaattaccaag

SEQ ID NO: 120684 - DNA, 40 bp, Artificial Sequence
  Description of Artificial Sequence: Synthetic oligonucleotide
tgatgagcgaagtgtacacaaagtagaaccaattaccaag

SEQ ID NO: 120685 - DNA, 39 bp, Artificial Sequence
  Description of Artificial Sequence: Synthetic oligonucleotide
gatgagcgaagtgtacacaaagtagaaccaattaccaag

SEQ ID NO: 120686 - DNA, 39 bp, Artificial Sequence
  Description of Artificial Sequence: Synthetic oligonucleotide
atgagcgaagtgtacacaaagtagaaccaattaccaagc

SEQ ID NO: 120687 - DNA, 38 bp, Artificial Sequence
  Description of Artificial Sequence: Synthetic oligonucleotide
tgagcgaagtgtacacaaagtagaaccaattaccaagc

SEQ ID NO: 120688 - DNA, 37 bp, Artificial Sequence
  Description of Artificial Sequence: Synthetic oligonucleotide
gagcgaagtgtacacaaagtagaaccaattaccaagc

SEQ ID NO: 120689 - DNA, 42 bp, Artificial Sequence
  Description of Artificial Sequence: Synthetic oligonucleotide
agcgaagtgtacacaaagtagaaccaattaccaagcatatag

SEQ ID NO: 120690 - DNA, 41 bp, Artificial Sequence
  Description of Artificial Sequence: Synthetic oligonucleotide
gcgaagtgtacacaaagtagaaccaattaccaagcatatag

SEQ ID NO: 120691 - DNA, 41 bp, Artificial Sequence
  Description of Artificial Sequence: Synthetic oligonucleotide
cgaagtgtacacaaagtagaaccaattaccaagcatatagg

SEQ ID NO: 120692 - DNA, 44 bp, Artificial Sequence
  Description of Artificial Sequence: Synthetic oligonucleotide
gaagtgtacacaaagtagaaccaattaccaagcatataggtttg

SEQ ID NO: 120693 - DNA, 44 bp, Artificial Sequence
  Description of Artificial Sequence: Synthetic oligonucleotide
aagtgtacacaaagtagaaccaattaccaagcatataggtttgg

SEQ ID NO: 120694 - DNA, 43 bp, Artificial Sequence
  Description of Artificial Sequence: Synthetic oligonucleotide
agtgtacacaaagtagaaccaattaccaagcatataggtttgg

SEQ ID NO: 120695 - DNA, 42 bp, Artificial Sequence
  Description of Artificial Sequence: Synthetic oligonucleotide
gtgtacacaaagtagaaccaattaccaagcatataggtttgg

SEQ ID NO: 120696 - DNA, 43 bp, Artificial Sequence
  Description of Artificial Sequence: Synthetic oligonucleotide
tgtacacaaagtagaaccaattaccaagcatataggtttggtg

SEQ ID NO: 120697 - DNA, 42 bp, Artificial Sequence
  Description of Artificial Sequence: Synthetic oligonucleotide
gtacacaaagtagaaccaattaccaagcatataggtttggtg

SEQ ID NO: 120698 - DNA, 44 bp, Artificial Sequence
  Description of Artificial Sequence: Synthetic oligonucleotide
tacacaaagtagaaccaattaccaagcatataggtttggtgtac

SEQ ID NO: 120699 - DNA, 43 bp, Artificial Sequence
  Description of Artificial Sequence: Synthetic oligonucleotide
acacaaagtagaaccaattaccaagcatataggtttggtgtac

SEQ ID NO: 120700 - DNA, 42 bp, Artificial Sequence
  Description of Artificial Sequence: Synthetic oligonucleotide
cacaaagtagaaccaattaccaagcatataggtttggtgtac

SEQ ID NO: 120701 - DNA, 43 bp, Artificial Sequence
  Description of Artificial Sequence: Synthetic oligonucleotide
acaaagtagaaccaattaccaagcatataggtttggtgtacag

SEQ ID NO: 120702 - DNA, 42 bp, Artificial Sequence
  Description of Artificial Sequence: Synthetic oligonucleotide
caaagtagaaccaattaccaagcatataggtttggtgtacag

SEQ ID NO: 120703 - DNA, 43 bp, Artificial Sequence
  Description of Artificial Sequence: Synthetic oligonucleotide
aaagtagaaccaattaccaagcatataggtttggtgtacagtg

SEQ ID NO: 120704 - DNA, 42 bp, Artificial Sequence
  Description of Artificial Sequence: Synthetic oligonucleotide
aagtagaaccaattaccaagcatataggtttggtgtacagtg

SEQ ID NO: 120705 - DNA, 41 bp, Artificial Sequence
  Description of Artificial Sequence: Synthetic oligonucleotide
agtagaaccaattaccaagcatataggtttggtgtacagtg

SEQ ID NO: 120706 - DNA, 40 bp, Artificial Sequence
  Description of Artificial Sequence: Synthetic oligonucleotide
gtagaaccaattaccaagcatataggtttggtgtacagtg

SEQ ID NO: 120707 - DNA, 40 bp, Artificial Sequence
  Description of Artificial Sequence: Synthetic oligonucleotide
tagaaccaattaccaagcatataggtttggtgtacagtgg

SEQ ID NO: 120708 - DNA, 39 bp, Artificial Sequence
  Description of Artificial Sequence: Synthetic oligonucleotide
agaaccaattaccaagcatataggtttggtgtacagtgg

SEQ ID NO: 120709 - DNA, 38 bp, Artificial Sequence
  Description of Artificial Sequence: Synthetic oligonucleotide
gaaccaattaccaagcatataggtttggtgtacagtgg

SEQ ID NO: 120710 - DNA, 38 bp, Artificial Sequence
  Description of Artificial Sequence: Synthetic oligonucleotide
aaccaattaccaagcatataggtttggtgtacagtggc

SEQ ID NO: 120711 - DNA, 37 bp, Artificial Sequence
  Description of Artificial Sequence: Synthetic oligonucleotide
accaattaccaagcatataggtttggtgtacagtggc

SEQ ID NO: 120712 - DNA, 36 bp, Artificial Sequence
  Description of Artificial Sequence: Synthetic oligonucleotide
ccaattaccaagcatataggtttggtgtacagtggc

SEQ ID NO: 120713 - DNA, 38 bp, Artificial Sequence
  Description of Artificial Sequence: Synthetic oligonucleotide
caattaccaagcatataggtttggtgtacagtggcatg

SEQ ID NO: 120714 - DNA, 38 bp, Artificial Sequence
  Description of Artificial Sequence: Synthetic oligonucleotide
aattaccaagcatataggtttggtgtacagtggcatgg

SEQ ID NO: 120715 - DNA, 37 bp, Artificial Sequence
  Description of Artificial Sequence: Synthetic oligonucleotide
attaccaagcatataggtttggtgtacagtggcatgg

SEQ ID NO: 120716 - DNA, 36 bp, Artificial Sequence
  Description of Artificial Sequence: Synthetic oligonucleotide
ttaccaagcatataggtttggtgtacagtggcatgg

SEQ ID NO: 120717 - DNA, 35 bp, Artificial Sequence
  Description of Artificial Sequence: Synthetic oligonucleotide
taccaagcatataggtttggtgtacagtggcatgg

SEQ ID NO: 120718 - DNA, 34 bp, Artificial Sequence
  Description of Artificial Sequence: Synthetic oligonucleotide
accaagcatataggtttggtgtacagtggcatgg

SEQ ID NO: 120719 - DNA, 33 bp, Artificial Sequence
  Description of Artificial Sequence: Synthetic oligonucleotide
ccaagcatataggtttggtgtacagtggcatgg

SEQ ID NO: 120720 - DNA, 33 bp, Artificial Sequence
  Description of Artificial Sequence: Synthetic oligonucleotide
caagcatataggtttggtgtacagtggcatggg

SEQ ID NO: 120721 - DNA, 33 bp, Artificial Sequence
  Description of Artificial Sequence: Synthetic oligonucleotide
aagcatataggtttggtgtacagtggcatgggc

SEQ ID NO: 120722 - DNA, 32 bp, Artificial Sequence
  Description of Artificial Sequence: Synthetic oligonucleotide
agcatataggtttggtgtacagtggcatgggc

SEQ ID NO: 120723 - DNA, 31 bp, Artificial Sequence
  Description of Artificial Sequence: Synthetic oligonucleotide
gcatataggtttggtgtacagtggcatgggc

SEQ ID NO: 120724 - DNA, 31 bp, Artificial Sequence
  Description of Artificial Sequence: Synthetic oligonucleotide
catataggtttggtgtacagtggcatgggcc

SEQ ID NO: 120725 - DNA, 31 bp, Artificial Sequence
  Description of Artificial Sequence: Synthetic oligonucleotide
atataggtttggtgtacagtggcatgggccc

SEQ ID NO: 120726 - DNA, 30 bp, Artificial Sequence
  Description of Artificial Sequence: Synthetic oligonucleotide
tataggtttggtgtacagtggcatgggccc

SEQ ID NO: 120727 - DNA, 29 bp, Artificial Sequence
  Description of Artificial Sequence: Synthetic oligonucleotide
ataggtttggtgtacagtggcatgggccc

SEQ ID NO: 120728 - DNA, 28 bp, Artificial Sequence
  Description of Artificial Sequence: Synthetic oligonucleotide
taggtttggtgtacagtggcatgggccc

SEQ ID NO: 120729 - DNA, 27 bp, Artificial Sequence
  Description of Artificial Sequence: Synthetic oligonucleotide
aggtttggtgtacagtggcatgggccc

SEQ ID NO: 120730 - DNA, 26 bp, Artificial Sequence
  Description of Artificial Sequence: Synthetic oligonucleotide
ggtttggtgtacagtggcatgggccc

SEQ ID NO: 120731 - DNA, 26 bp, Artificial Sequence
  Description of Artificial Sequence: Synthetic oligonucleotide
gtttggtgtacagtggcatgggcccc

SEQ ID NO: 120732 - DNA, 27 bp, Artificial Sequence
  Description of Artificial Sequence: Synthetic oligonucleotide
tttggtgtacagtggcatgggccccga

SEQ ID NO: 120733 - DNA, 27 bp, Artificial Sequence
  Description of Artificial Sequence: Synthetic oligonucleotide
ttggtgtacagtggcatgggccccgat

SEQ ID NO: 120734 - DNA, 27 bp, Artificial Sequence
  Description of Artificial Sequence: Synthetic oligonucleotide
tggtgtacagtggcatgggccccgatt

SEQ ID NO: 120735 - DNA, 27 bp, Artificial Sequence
  Description of Artificial Sequence: Synthetic oligonucleotide
ggtgtacagtggcatgggccccgatta

SEQ ID NO: 120736 - DNA, 27 bp, Artificial Sequence
  Description of Artificial Sequence: Synthetic oligonucleotide
gtgtacagtggcatgggccccgattac

SEQ ID NO: 120737 - DNA, 28 bp, Artificial Sequence
  Description of Artificial Sequence: Synthetic oligonucleotide
tgtacagtggcatgggccccgattacag

SEQ ID NO: 120738 - DNA, 27 bp, Artificial Sequence
  Description of Artificial Sequence: Synthetic oligonucleotide
gtacagtggcatgggccccgattacag

SEQ ID NO: 120739 - DNA, 28 bp, Artificial Sequence
  Description of Artificial Sequence: Synthetic oligonucleotide
tacagtggcatgggccccgattacagag

SEQ ID NO: 120740 - DNA, 27 bp, Artificial Sequence
  Description of Artificial Sequence: Synthetic oligonucleotide
acagtggcatgggccccgattacagag

SEQ ID NO: 120741 - DNA, 27 bp, Artificial Sequence
  Description of Artificial Sequence: Synthetic oligonucleotide
cagtggcatgggccccgattacagagt

SEQ ID NO: 120742 - DNA, 27 bp, Artificial Sequence
  Description of Artificial Sequence: Synthetic oligonucleotide
agtggcatgggccccgattacagagtg

SEQ ID NO: 120743 - DNA, 26 bp, Artificial Sequence
  Description of Artificial Sequence: Synthetic oligonucleotide
gtggcatgggccccgattacagagtg

SEQ ID NO: 120744 - DNA, 27 bp, Artificial Sequence
  Description of Artificial Sequence: Synthetic oligonucleotide
tggcatgggccccgattacagagtgct

SEQ ID NO: 120745 - DNA, 27 bp, Artificial Sequence
  Description of Artificial Sequence: Synthetic oligonucleotide
ggcatgggccccgattacagagtgctt

SEQ ID NO: 120746 - DNA, 27 bp, Artificial Sequence
  Description of Artificial Sequence: Synthetic oligonucleotide
gcatgggccccgattacagagtgcttg

SEQ ID NO: 120747 - DNA, 28 bp, Artificial Sequence
  Description of Artificial Sequence: Synthetic oligonucleotide
catgggccccgattacagagtgcttgtg

SEQ ID NO: 120748 - DNA, 28 bp, Artificial Sequence
  Description of Artificial Sequence: Synthetic oligonucleotide
atgggccccgattacagagtgcttgtgc

SEQ ID NO: 120749 - DNA, 27 bp, Artificial Sequence
  Description of Artificial Sequence: Synthetic oligonucleotide
tgggccccgattacagagtgcttgtgc

SEQ ID NO: 120750 - DNA, 27 bp, Artificial Sequence
  Description of Artificial Sequence: Synthetic oligonucleotide
gggccccgattacagagtgcttgtgca

SEQ ID NO: 120751 - DNA, 27 bp, Artificial Sequence
  Description of Artificial Sequence: Synthetic oligonucleotide
ggccccgattacagagtgcttgtgcac

SEQ ID NO: 120752 - DNA, 28 bp, Artificial Sequence
  Description of Artificial Sequence: Synthetic oligonucleotide
gccccgattacagagtgcttgtgcacag

SEQ ID NO: 120753 - DNA, 29 bp, Artificial Sequence
  Description of Artificial Sequence: Synthetic oligonucleotide
ccccgattacagagtgcttgtgcacagag

SEQ ID NO: 120754 - DNA, 29 bp, Artificial Sequence
  Description of Artificial Sequence: Synthetic oligonucleotide
cccgattacagagtgcttgtgcacagagc

SEQ ID NO: 120755 - DNA, 30 bp, Artificial Sequence
  Description of Artificial Sequence: Synthetic oligonucleotide
ccgattacagagtgcttgtgcacagagctc

SEQ ID NO: 120756 - DNA, 30 bp, Artificial Sequence
  Description of Artificial Sequence: Synthetic oligonucleotide
cgattacagagtgcttgtgcacagagctcg

SEQ ID NO: 120757 - DNA, 34 bp, Artificial Sequence
  Description of Artificial Sequence: Synthetic oligonucleotide
gattacagagtgcttgtgcacagagctcgaaaac

SEQ ID NO: 120758 - DNA, 36 bp, Artificial Sequence
  Description of Artificial Sequence: Synthetic oligonucleotide
attacagagtgcttgtgcacagagctcgaaaactag

SEQ ID NO: 120759 - DNA, 35 bp, Artificial Sequence
  Description of Artificial Sequence: Synthetic oligonucleotide
ttacagagtgcttgtgcacagagctcgaaaactag

SEQ ID NO: 120760 - DNA, 34 bp, Artificial Sequence
  Description of Artificial Sequence: Synthetic oligonucleotide
tacagagtgcttgtgcacagagctcgaaaactag

SEQ ID NO: 120761 - DNA, 33 bp, Artificial Sequence
  Description of Artificial Sequence: Synthetic oligonucleotide
acagagtgcttgtgcacagagctcgaaaactag

SEQ ID NO: 120762 - DNA, 32 bp, Artificial Sequence
  Description of Artificial Sequence: Synthetic oligonucleotide
cagagtgcttgtgcacagagctcgaaaactag

SEQ ID NO: 120763 - DNA, 32 bp, Artificial Sequence
  Description of Artificial Sequence: Synthetic oligonucleotide
agagtgcttgtgcacagagctcgaaaactagc

SEQ ID NO: 120764 - DNA, 31 bp, Artificial Sequence
  Description of Artificial Sequence: Synthetic oligonucleotide
gagtgcttgtgcacagagctcgaaaactagc

SEQ ID NO: 120765 - DNA, 32 bp, Artificial Sequence
  Description of Artificial Sequence: Synthetic oligonucleotide
agtgcttgtgcacagagctcgaaaactagctc

SEQ ID NO: 120766 - DNA, 31 bp, Artificial Sequence
  Description of Artificial Sequence: Synthetic oligonucleotide
gtgcttgtgcacagagctcgaaaactagctc

SEQ ID NO: 120767 - DNA, 33 bp, Artificial Sequence
  Description of Artificial Sequence: Synthetic oligonucleotide
tgcttgtgcacagagctcgaaaactagctcaac

SEQ ID NO: 120768 - DNA, 32 bp, Artificial Sequence
  Description of Artificial Sequence: Synthetic oligonucleotide
gcttgtgcacagagctcgaaaactagctcaac

SEQ ID NO: 120769 - DNA, 36 bp, Artificial Sequence
  Description of Artificial Sequence: Synthetic oligonucleotide
cttgtgcacagagctcgaaaactagctcaacaatac

SEQ ID NO: 120770 - DNA, 39 bp, Artificial Sequence
  Description of Artificial Sequence: Synthetic oligonucleotide
ttgtgcacagagctcgaaaactagctcaacaatactatc

SEQ ID NO: 120771 - DNA, 38 bp, Artificial Sequence
  Description of Artificial Sequence: Synthetic oligonucleotide
tgtgcacagagctcgaaaactagctcaacaatactatc

SEQ ID NO: 120772 - DNA, 37 bp, Artificial Sequence
  Description of Artificial Sequence: Synthetic oligonucleotide
gtgcacagagctcgaaaactagctcaacaatactatc

SEQ ID NO: 120773 - DNA, 39 bp, Artificial Sequence
  Description of Artificial Sequence: Synthetic oligonucleotide
tgcacagagctcgaaaactagctcaacaatactatcttg

SEQ ID NO: 120774 - DNA, 38 bp, Artificial Sequence
  Description of Artificial Sequence: Synthetic oligonucleotide
gcacagagctcgaaaactagctcaacaatactatcttg

SEQ ID NO: 120775 - DNA, 39 bp, Artificial Sequence
  Description of Artificial Sequence: Synthetic oligonucleotide
cacagagctcgaaaactagctcaacaatactatcttgtg

SEQ ID NO: 120776 - DNA, 41 bp, Artificial Sequence
  Description of Artificial Sequence: Synthetic oligonucleotide
acagagctcgaaaactagctcaacaatactatcttgtgtac

SEQ ID NO: 120777 - DNA, 40 bp, Artificial Sequence
  Description of Artificial Sequence: Synthetic oligonucleotide
cagagctcgaaaactagctcaacaatactatcttgtgtac

SEQ ID NO: 120778 - DNA, 40 bp, Artificial Sequence
  Description of Artificial Sequence: Synthetic oligonucleotide
agagctcgaaaactagctcaacaatactatcttgtgtacc

SEQ ID NO: 120779 - DNA, 39 bp, Artificial Sequence
  Description of Artificial Sequence: Synthetic oligonucleotide
gagctcgaaaactagctcaacaatactatcttgtgtacc

SEQ ID NO: 120780 - DNA, 41 bp, Artificial Sequence
  Description of Artificial Sequence: Synthetic oligonucleotide
agctcgaaaactagctcaacaatactatcttgtgtaccaag

SEQ ID NO: 120781 - DNA, 40 bp, Artificial Sequence
  Description of Artificial Sequence: Synthetic oligonucleotide
gctcgaaaactagctcaacaatactatcttgtgtaccaag

SEQ ID NO: 120782 - DNA, 42 bp, Artificial Sequence
  Description of Artificial Sequence: Synthetic oligonucleotide
ctcgaaaactagctcaacaatactatcttgtgtaccaagaac

SEQ ID NO: 120783 - DNA, 42 bp, Artificial Sequence
  Description of Artificial Sequence: Synthetic oligonucleotide
tcgaaaactagctcaacaatactatcttgtgtaccaagaacc

SEQ ID NO: 120784 - DNA, 41 bp, Artificial Sequence
  Description of Artificial Sequence: Synthetic oligonucleotide
cgaaaactagctcaacaatactatcttgtgtaccaagaacc

SEQ ID NO: 120785 - DNA, 41 bp, Artificial Sequence
  Description of Artificial Sequence: Synthetic oligonucleotide
gaaaactagctcaacaatactatcttgtgtaccaagaaccc

SEQ ID NO: 120786 - DNA, 44 bp, Artificial Sequence
  Description of Artificial Sequence: Synthetic oligonucleotide
aaaactagctcaacaatactatcttgtgtaccaagaacccattc

SEQ ID NO: 120787 - DNA, 43 bp, Artificial Sequence
  Description of Artificial Sequence: Synthetic oligonucleotide
aaactagctcaacaatactatcttgtgtaccaagaacccattc

SEQ ID NO: 120788 - DNA, 42 bp, Artificial Sequence
  Description of Artificial Sequence: Synthetic oligonucleotide
aactagctcaacaatactatcttgtgtaccaagaacccattc

SEQ ID NO: 120789 - DNA, 41 bp, Artificial Sequence
  Description of Artificial Sequence: Synthetic oligonucleotide
actagctcaacaatactatcttgtgtaccaagaacccattc

SEQ ID NO: 120790 - DNA, 40 bp, Artificial Sequence
  Description of Artificial Sequence: Synthetic oligonucleotide
ctagctcaacaatactatcttgtgtaccaagaacccattc

SEQ ID NO: 120791 - DNA, 40 bp, Artificial Sequence
  Description of Artificial Sequence: Synthetic oligonucleotide
tagctcaacaatactatcttgtgtaccaagaacccattcc

SEQ ID NO: 120792 - DNA, 39 bp, Artificial Sequence
  Description of Artificial Sequence: Synthetic oligonucleotide
agctcaacaatactatcttgtgtaccaagaacccattcc

SEQ ID NO: 120793 - DNA, 38 bp, Artificial Sequence
  Description of Artificial Sequence: Synthetic oligonucleotide
gctcaacaatactatcttgtgtaccaagaacccattcc

SEQ ID NO: 120794 - DNA, 40 bp, Artificial Sequence
  Description of Artificial Sequence: Synthetic oligonucleotide
ctcaacaatactatcttgtgtaccaagaacccattcctac

SEQ ID NO: 120795 - DNA, 41 bp, Artificial Sequence
  Description of Artificial Sequence: Synthetic oligonucleotide
tcaacaatactatcttgtgtaccaagaacccattcctacag

SEQ ID NO: 120796 - DNA, 40 bp, Artificial Sequence
  Description of Artificial Sequence: Synthetic oligonucleotide
caacaatactatcttgtgtaccaagaacccattcctacag

SEQ ID NO: 120797 - DNA, 40 bp, Artificial Sequence
  Description of Artificial Sequence: Synthetic oligonucleotide
aacaatactatcttgtgtaccaagaacccattcctacagc

SEQ ID NO: 120798 - DNA, 39 bp, Artificial Sequence
  Description of Artificial Sequence: Synthetic oligonucleotide
acaatactatcttgtgtaccaagaacccattcctacagc

SEQ ID NO: 120799 - DNA, 38 bp, Artificial Sequence
  Description of Artificial Sequence: Synthetic oligonucleotide
caatactatcttgtgtaccaagaacccattcctacagc

SEQ ID NO: 120800 - DNA, 39 bp, Artificial Sequence
  Description of Artificial Sequence: Synthetic oligonucleotide
aatactatcttgtgtaccaagaacccattcctacagctc

SEQ ID NO: 120801 - DNA, 38 bp, Artificial Sequence
  Description of Artificial Sequence: Synthetic oligonucleotide
atactatcttgtgtaccaagaacccattcctacagctc

SEQ ID NO: 120802 - DNA, 37 bp, Artificial Sequence
  Description of Artificial Sequence: Synthetic oligonucleotide
tactatcttgtgtaccaagaacccattcctacagctc

SEQ ID NO: 120803 - DNA, 36 bp, Artificial Sequence
  Description of Artificial Sequence: Synthetic oligonucleotide
actatcttgtgtaccaagaacccattcctacagctc

SEQ ID NO: 120804 - DNA, 35 bp, Artificial Sequence
  Description of Artificial Sequence: Synthetic oligonucleotide
ctatcttgtgtaccaagaacccattcctacagctc

SEQ ID NO: 120805 - DNA, 36 bp, Artificial Sequence
  Description of Artificial Sequence: Synthetic oligonucleotide
tatcttgtgtaccaagaacccattcctacagctcag

SEQ ID NO: 120806 - DNA, 35 bp, Artificial Sequence
  Description of Artificial Sequence: Synthetic oligonucleotide
atcttgtgtaccaagaacccattcctacagctcag

SEQ ID NO: 120807 - DNA, 34 bp, Artificial Sequence
  Description of Artificial Sequence: Synthetic oligonucleotide
tcttgtgtaccaagaacccattcctacagctcag

SEQ ID NO: 120808 - DNA, 33 bp, Artificial Sequence
  Description of Artificial Sequence: Synthetic oligonucleotide
cttgtgtaccaagaacccattcctacagctcag

SEQ ID NO: 120809 - DNA, 33 bp, Artificial Sequence
  Description of Artificial Sequence: Synthetic oligonucleotide
ttgtgtaccaagaacccattcctacagctcagc

SEQ ID NO: 120810 - DNA, 32 bp, Artificial Sequence
  Description of Artificial Sequence: Synthetic oligonucleotide
tgtgtaccaagaacccattcctacagctcagc

SEQ ID NO: 120811 - DNA, 31 bp, Artificial Sequence
  Description of Artificial Sequence: Synthetic oligonucleotide
gtgtaccaagaacccattcctacagctcagc

SEQ ID NO: 120812 - DNA, 32 bp, Artificial Sequence
  Description of Artificial Sequence: Synthetic oligonucleotide
tgtaccaagaacccattcctacagctcagctg

SEQ ID NO: 120813 - DNA, 31 bp, Artificial Sequence
  Description of Artificial Sequence: Synthetic oligonucleotide
gtaccaagaacccattcctacagctcagctg

SEQ ID NO: 120814 - DNA, 31 bp, Artificial Sequence
  Description of Artificial Sequence: Synthetic oligonucleotide
taccaagaacccattcctacagctcagctgg

SEQ ID NO: 120815 - DNA, 30 bp, Artificial Sequence
  Description of Artificial Sequence: Synthetic oligonucleotide
accaagaacccattcctacagctcagctgg

SEQ ID NO: 120816 - DNA, 29 bp, Artificial Sequence
  Description of Artificial Sequence: Synthetic oligonucleotide
ccaagaacccattcctacagctcagctgg

SEQ ID NO: 120817 - DNA, 31 bp, Artificial Sequence
  Description of Artificial Sequence: Synthetic oligonucleotide
caagaacccattcctacagctcagctggtac

SEQ ID NO: 120818 - DNA, 32 bp, Artificial Sequence
  Description of Artificial Sequence: Synthetic oligonucleotide
aagaacccattcctacagctcagctggtacag

SEQ ID NO: 120819 - DNA, 31 bp, Artificial Sequence
  Description of Artificial Sequence: Synthetic oligonucleotide
agaacccattcctacagctcagctggtacag

SEQ ID NO: 120820 - DNA, 30 bp, Artificial Sequence
  Description of Artificial Sequence: Synthetic oligonucleotide
gaacccattcctacagctcagctggtacag

SEQ ID NO: 120821 - DNA, 31 bp, Artificial Sequence
  Description of Artificial Sequence: Synthetic oligonucleotide
aacccattcctacagctcagctggtacagag

SEQ ID NO: 120822 - DNA, 30 bp, Artificial Sequence
  Description of Artificial Sequence: Synthetic oligonucleotide
acccattcctacagctcagctggtacagag

SEQ ID NO: 120823 - DNA, 29 bp, Artificial Sequence
  Description of Artificial Sequence: Synthetic oligonucleotide
cccattcctacagctcagctggtacagag

SEQ ID NO: 120824 - DNA, 30 bp, Artificial Sequence
  Description of Artificial Sequence: Synthetic oligonucleotide
ccattcctacagctcagctggtacagagag

SEQ ID NO: 120825 - DNA, 32 bp, Artificial Sequence
  Description of Artificial Sequence: Synthetic oligonucleotide
cattcctacagctcagctggtacagagagtag

SEQ ID NO: 120826 - DNA, 32 bp, Artificial Sequence
  Description of Artificial Sequence: Synthetic oligonucleotide
attcctacagctcagctggtacagagagtagc

SEQ ID NO: 120827 - DNA, 31 bp, Artificial Sequence
  Description of Artificial Sequence: Synthetic oligonucleotide
ttcctacagctcagctggtacagagagtagc

SEQ ID NO: 120828 - DNA, 30 bp, Artificial Sequence
  Description of Artificial Sequence: Synthetic oligonucleotide
tcctacagctcagctggtacagagagtagc

SEQ ID NO: 120829 - DNA, 29 bp, Artificial Sequence
  Description of Artificial Sequence: Synthetic oligonucleotide
cctacagctcagctggtacagagagtagc

SEQ ID NO: 120830 - DNA, 31 bp, Artificial Sequence
  Description of Artificial Sequence: Synthetic oligonucleotide
ctacagctcagctggtacagagagtagcttc

SEQ ID NO: 120831 - DNA, 32 bp, Artificial Sequence
  Description of Artificial Sequence: Synthetic oligonucleotide
tacagctcagctggtacagagagtagcttctg

SEQ ID NO: 120832 - DNA, 31 bp, Artificial Sequence
  Description of Artificial Sequence: Synthetic oligonucleotide
acagctcagctggtacagagagtagcttctg

SEQ ID NO: 120833 - DNA, 30 bp, Artificial Sequence
  Description of Artificial Sequence: Synthetic oligonucleotide
cagctcagctggtacagagagtagcttctg

SEQ ID NO: 120834 - DNA, 31 bp, Artificial Sequence
  Description of Artificial Sequence: Synthetic oligonucleotide
agctcagctggtacagagagtagcttctgtg

SEQ ID NO: 120835 - DNA, 30 bp, Artificial Sequence
  Description of Artificial Sequence: Synthetic oligonucleotide
gctcagctggtacagagagtagcttctgtg

SEQ ID NO: 120836 - DNA, 32 bp, Artificial Sequence
  Description of Artificial Sequence: Synthetic oligonucleotide
ctcagctggtacagagagtagcttctgtgatg

SEQ ID NO: 120837 - DNA, 32 bp, Artificial Sequence
  Description of Artificial Sequence: Synthetic oligonucleotide
tcagctggtacagagagtagcttctgtgatgc

SEQ ID NO: 120838 - DNA, 31 bp, Artificial Sequence
  Description of Artificial Sequence: Synthetic oligonucleotide
cagctggtacagagagtagcttctgtgatgc

SEQ ID NO: 120839 - DNA, 33 bp, Artificial Sequence
  Description of Artificial Sequence: Synthetic oligonucleotide
agctggtacagagagtagcttctgtgatgcaag

SEQ ID NO: 120840 - DNA, 32 bp, Artificial Sequence
  Description of Artificial Sequence: Synthetic oligonucleotide
gctggtacagagagtagcttctgtgatgcaag

SEQ ID NO: 120841 - DNA, 38 bp, Artificial Sequence
  Description of Artificial Sequence: Synthetic oligonucleotide
ctggtacagagagtagcttctgtgatgcaagaatatac

SEQ ID NO: 120842 - DNA, 39 bp, Artificial Sequence
  Description of Artificial Sequence: Synthetic oligonucleotide
tggtacagagagtagcttctgtgatgcaagaatatactc

SEQ ID NO: 120843 - DNA, 38 bp, Artificial Sequence
  Description of Artificial Sequence: Synthetic oligonucleotide
ggtacagagagtagcttctgtgatgcaagaatatactc

SEQ ID NO: 120844 - DNA, 39 bp, Artificial Sequence
  Description of Artificial Sequence: Synthetic oligonucleotide
gtacagagagtagcttctgtgatgcaagaatatactcag

SEQ ID NO: 120845 - DNA, 40 bp, Artificial Sequence
  Description of Artificial Sequence: Synthetic oligonucleotide
tacagagagtagcttctgtgatgcaagaatatactcagtc

SEQ ID NO: 120846 - DNA, 39 bp, Artificial Sequence
  Description of Artificial Sequence: Synthetic oligonucleotide
acagagagtagcttctgtgatgcaagaatatactcagtc

SEQ ID NO: 120847 - DNA, 38 bp, Artificial Sequence
  Description of Artificial Sequence: Synthetic oligonucleotide
cagagagtagcttctgtgatgcaagaatatactcagtc

SEQ ID NO: 120848 - DNA, 39 bp, Artificial Sequence
  Description of Artificial Sequence: Synthetic oligonucleotide
agagagtagcttctgtgatgcaagaatatactcagtcag

SEQ ID NO: 120849 - DNA, 38 bp, Artificial Sequence
  Description of Artificial Sequence: Synthetic oligonucleotide
gagagtagcttctgtgatgcaagaatatactcagtcag

SEQ ID NO: 120850 - DNA, 38 bp, Artificial Sequence
  Description of Artificial Sequence: Synthetic oligonucleotide
agagtagcttctgtgatgcaagaatatactcagtcagg

SEQ ID NO: 120851 - DNA, 37 bp, Artificial Sequence
  Description of Artificial Sequence: Synthetic oligonucleotide
gagtagcttctgtgatgcaagaatatactcagtcagg

SEQ ID NO: 120852 - DNA, 38 bp, Artificial Sequence
  Description of Artificial Sequence: Synthetic oligonucleotide
agtagcttctgtgatgcaagaatatactcagtcaggtg

SEQ ID NO: 120853 - DNA, 37 bp, Artificial Sequence
  Description of Artificial Sequence: Synthetic oligonucleotide
gtagcttctgtgatgcaagaatatactcagtcaggtg

SEQ ID NO: 120854 - DNA, 37 bp, Artificial Sequence
  Description of Artificial Sequence: Synthetic oligonucleotide
tagcttctgtgatgcaagaatatactcagtcaggtgg

SEQ ID NO: 120855 - DNA, 36 bp, Artificial Sequence
  Description of Artificial Sequence: Synthetic oligonucleotide
agcttctgtgatgcaagaatatactcagtcaggtgg

SEQ ID NO: 120856 - DNA, 35 bp, Artificial Sequence
  Description of Artificial Sequence: Synthetic oligonucleotide
gcttctgtgatgcaagaatatactcagtcaggtgg

SEQ ID NO: 120857 - DNA, 36 bp, Artificial Sequence
  Description of Artificial Sequence: Synthetic oligonucleotide
cttctgtgatgcaagaatatactcagtcaggtggtg

SEQ ID NO: 120858 - DNA, 38 bp, Artificial Sequence
  Description of Artificial Sequence: Synthetic oligonucleotide
ttctgtgatgcaagaatatactcagtcaggtggtgttc

SEQ ID NO: 120859 - DNA, 37 bp, Artificial Sequence
  Description of Artificial Sequence: Synthetic oligonucleotide
tctgtgatgcaagaatatactcagtcaggtggtgttc

SEQ ID NO: 120860 - DNA, 36 bp, Artificial Sequence
  Description of Artificial Sequence: Synthetic oligonucleotide
ctgtgatgcaagaatatactcagtcaggtggtgttc

SEQ ID NO: 120861 - DNA, 36 bp, Artificial Sequence
  Description of Artificial Sequence: Synthetic oligonucleotide
tgtgatgcaagaatatactcagtcaggtggtgttcg

SEQ ID NO: 120862 - DNA, 35 bp, Artificial Sequence
  Description of Artificial Sequence: Synthetic oligonucleotide
gtgatgcaagaatatactcagtcaggtggtgttcg

SEQ ID NO: 120863 - DNA, 36 bp, Artificial Sequence
  Description of Artificial Sequence: Synthetic oligonucleotide
tgatgcaagaatatactcagtcaggtggtgttcgtc

SEQ ID NO: 120864 - DNA, 35 bp, Artificial Sequence
  Description of Artificial Sequence: Synthetic oligonucleotide
gatgcaagaatatactcagtcaggtggtgttcgtc

SEQ ID NO: 120865 - DNA, 35 bp, Artificial Sequence
  Description of Artificial Sequence: Synthetic oligonucleotide
atgcaagaatatactcagtcaggtggtgttcgtcc

SEQ ID NO: 120866 - DNA, 34 bp, Artificial Sequence
  Description of Artificial Sequence: Synthetic oligonucleotide
tgcaagaatatactcagtcaggtggtgttcgtcc

SEQ ID NO: 120867 - DNA, 33 bp, Artificial Sequence
  Description of Artificial Sequence: Synthetic oligonucleotide
gcaagaatatactcagtcaggtggtgttcgtcc

SEQ ID NO: 120868 - DNA, 37 bp, Artificial Sequence
  Description of Artificial Sequence: Synthetic oligonucleotide
caagaatatactcagtcaggtggtgttcgtccatttg

SEQ ID NO: 120869 - DNA, 37 bp, Artificial Sequence
  Description of Artificial Sequence: Synthetic oligonucleotide
aagaatatactcagtcaggtggtgttcgtccatttgg

SEQ ID NO: 120870 - DNA, 36 bp, Artificial Sequence
  Description of Artificial Sequence: Synthetic oligonucleotide
agaatatactcagtcaggtggtgttcgtccatttgg

SEQ ID NO: 120871 - DNA, 35 bp, Artificial Sequence
  Description of Artificial Sequence: Synthetic oligonucleotide
gaatatactcagtcaggtggtgttcgtccatttgg

SEQ ID NO: 120872 - DNA, 36 bp, Artificial Sequence
  Description of Artificial Sequence: Synthetic oligonucleotide
aatatactcagtcaggtggtgttcgtccatttggag

SEQ ID NO: 120873 - DNA, 35 bp, Artificial Sequence
  Description of Artificial Sequence: Synthetic oligonucleotide
atatactcagtcaggtggtgttcgtccatttggag

SEQ ID NO: 120874 - DNA, 34 bp, Artificial Sequence
  Description of Artificial Sequence: Synthetic oligonucleotide
tatactcagtcaggtggtgttcgtccatttggag

SEQ ID NO: 120875 - DNA, 33 bp, Artificial Sequence
  Description of Artificial Sequence: Synthetic oligonucleotide
atactcagtcaggtggtgttcgtccatttggag

SEQ ID NO: 120876 - DNA, 32 bp, Artificial Sequence
  Description of Artificial Sequence: Synthetic oligonucleotide
tactcagtcaggtggtgttcgtccatttggag

SEQ ID NO: 120877 - DNA, 31 bp, Artificial Sequence
  Description of Artificial Sequence: Synthetic oligonucleotide
actcagtcaggtggtgttcgtccatttggag

SEQ ID NO: 120878 - DNA, 30 bp, Artificial Sequence
  Description of Artificial Sequence: Synthetic oligonucleotide
ctcagtcaggtggtgttcgtccatttggag

SEQ ID NO: 120879 - DNA, 33 bp, Artificial Sequence
  Description of Artificial Sequence: Synthetic oligonucleotide
tcagtcaggtggtgttcgtccatttggagtttc

SEQ ID NO: 120880 - DNA, 32 bp, Artificial Sequence
  Description of Artificial Sequence: Synthetic oligonucleotide
cagtcaggtggtgttcgtccatttggagtttc

SEQ ID NO: 120881 - DNA, 36 bp, Artificial Sequence
  Description of Artificial Sequence: Synthetic oligonucleotide
agtcaggtggtgttcgtccatttggagtttctttac

SEQ ID NO: 120882 - DNA, 35 bp, Artificial Sequence
  Description of Artificial Sequence: Synthetic oligonucleotide
gtcaggtggtgttcgtccatttggagtttctttac

SEQ ID NO: 120883 - DNA, 41 bp, Artificial Sequence
  Description of Artificial Sequence: Synthetic oligonucleotide
tcaggtggtgttcgtccatttggagtttctttacttatttg

SEQ ID NO: 120884 - DNA, 40 bp, Artificial Sequence
  Description of Artificial Sequence: Synthetic oligonucleotide
caggtggtgttcgtccatttggagtttctttacttatttg

SEQ ID NO: 120885 - DNA, 41 bp, Artificial Sequence
  Description of Artificial Sequence: Synthetic oligonucleotide
aggtggtgttcgtccatttggagtttctttacttatttgtg

SEQ ID NO: 120886 - DNA, 40 bp, Artificial Sequence
  Description of Artificial Sequence: Synthetic oligonucleotide
ggtggtgttcgtccatttggagtttctttacttatttgtg

SEQ ID NO: 120887 - DNA, 40 bp, Artificial Sequence
  Description of Artificial Sequence: Synthetic oligonucleotide
gtggtgttcgtccatttggagtttctttacttatttgtgg

SEQ ID NO: 120888 - DNA, 42 bp, Artificial Sequence
  Description of Artificial Sequence: Synthetic oligonucleotide
tggtgttcgtccatttggagtttctttacttatttgtggttg

SEQ ID NO: 120889 - DNA, 41 bp, Artificial Sequence
  Description of Artificial Sequence: Synthetic oligonucleotide
ggtgttcgtccatttggagtttctttacttatttgtggttg

SEQ ID NO: 120890 - DNA, 41 bp, Artificial Sequence
  Description of Artificial Sequence: Synthetic oligonucleotide
gtgttcgtccatttggagtttctttacttatttgtggttgg

SEQ ID NO: 120891 - DNA, 44 bp, Artificial Sequence
  Description of Artificial Sequence: Synthetic oligonucleotide
tgttcgtccatttggagtttctttacttatttgtggttggaatg

SEQ ID NO: 120892 - DNA, 43 bp, Artificial Sequence
  Description of Artificial Sequence: Synthetic oligonucleotide
gttcgtccatttggagtttctttacttatttgtggttggaatg

SEQ ID NO: 120893 - DNA, 44 bp, Artificial Sequence
  Description of Artificial Sequence: Synthetic oligonucleotide
ttcgtccatttggagtttctttacttatttgtggttggaatgag

SEQ ID NO: 120894 - DNA, 43 bp, Artificial Sequence
  Description of Artificial Sequence: Synthetic oligonucleotide
tcgtccatttggagtttctttacttatttgtggttggaatgag

SEQ ID NO: 120895 - DNA, 42 bp, Artificial Sequence
  Description of Artificial Sequence: Synthetic oligonucleotide
cgtccatttggagtttctttacttatttgtggttggaatgag

SEQ ID NO: 120896 - DNA, 42 bp, Artificial Sequence
  Description of Artificial Sequence: Synthetic oligonucleotide
gtccatttggagtttctttacttatttgtggttggaatgagg

SEQ ID NO: 120897 - DNA, 42 bp, Artificial Sequence
  Description of Artificial Sequence: Synthetic oligonucleotide
tccatttggagtttctttacttatttgtggttggaatgaggg

SEQ ID NO: 120898 - DNA, 41 bp, Artificial Sequence
  Description of Artificial Sequence: Synthetic oligonucleotide
ccatttggagtttctttacttatttgtggttggaatgaggg

SEQ ID NO: 120899 - DNA, 42 bp, Artificial Sequence
  Description of Artificial Sequence: Synthetic oligonucleotide
catttggagtttctttacttatttgtggttggaatgagggac

SEQ ID NO: 120900 - DNA, 42 bp, Artificial Sequence
  Description of Artificial Sequence: Synthetic oligonucleotide
atttggagtttctttacttatttgtggttggaatgagggacg

SEQ ID NO: 120901 - DNA, 41 bp, Artificial Sequence
  Description of Artificial Sequence: Synthetic oligonucleotide
tttggagtttctttacttatttgtggttggaatgagggacg

SEQ ID NO: 120902 - DNA, 40 bp, Artificial Sequence
  Description of Artificial Sequence: Synthetic oligonucleotide
ttggagtttctttacttatttgtggttggaatgagggacg

SEQ ID NO: 120903 - DNA, 39 bp, Artificial Sequence
  Description of Artificial Sequence: Synthetic oligonucleotide
tggagtttctttacttatttgtggttggaatgagggacg

SEQ ID NO: 120904 - DNA, 38 bp, Artificial Sequence
  Description of Artificial Sequence: Synthetic oligonucleotide
ggagtttctttacttatttgtggttggaatgagggacg

SEQ ID NO: 120905 - DNA, 39 bp, Artificial Sequence
  Description of Artificial Sequence: Synthetic oligonucleotide
gagtttctttacttatttgtggttggaatgagggacgac

SEQ ID NO: 120906 - DNA, 39 bp, Artificial Sequence
  Description of Artificial Sequence: Synthetic oligonucleotide
agtttctttacttatttgtggttggaatgagggacgacc

SEQ ID NO: 120907 - DNA, 38 bp, Artificial Sequence
  Description of Artificial Sequence: Synthetic oligonucleotide
gtttctttacttatttgtggttggaatgagggacgacc

SEQ ID NO: 120908 - DNA, 48 bp, Artificial Sequence
  Description of Artificial Sequence: Synthetic oligonucleotide
tttctttacttatttgtggttggaatgagggacgaccatatttatttc

SEQ ID NO: 120909 - DNA, 47 bp, Artificial Sequence
  Description of Artificial Sequence: Synthetic oligonucleotide
ttctttacttatttgtggttggaatgagggacgaccatatttatttc

SEQ ID NO: 120910 - DNA, 46 bp, Artificial Sequence
  Description of Artificial Sequence: Synthetic oligonucleotide
tctttacttatttgtggttggaatgagggacgaccatatttatttc

SEQ ID NO: 120911 - DNA, 45 bp, Artificial Sequence
  Description of Artificial Sequence: Synthetic oligonucleotide
ctttacttatttgtggttggaatgagggacgaccatatttatttc

SEQ ID NO: 120912 - DNA, 46 bp, Artificial Sequence
  Description of Artificial Sequence: Synthetic oligonucleotide
tttacttatttgtggttggaatgagggacgaccatatttatttcag

SEQ ID NO: 120913 - DNA, 45 bp, Artificial Sequence
  Description of Artificial Sequence: Synthetic oligonucleotide
ttacttatttgtggttggaatgagggacgaccatatttatttcag

SEQ ID NO: 120914 - DNA, 44 bp, Artificial Sequence
  Description of Artificial Sequence: Synthetic oligonucleotide
tacttatttgtggttggaatgagggacgaccatatttatttcag

SEQ ID NO: 120915 - DNA, 43 bp, Artificial Sequence
  Description of Artificial Sequence: Synthetic oligonucleotide
acttatttgtggttggaatgagggacgaccatatttatttcag

SEQ ID NO: 120916 - DNA, 42 bp, Artificial Sequence
  Description of Artificial Sequence: Synthetic oligonucleotide
cttatttgtggttggaatgagggacgaccatatttatttcag

SEQ ID NO: 120917 - DNA, 43 bp, Artificial Sequence
  Description of Artificial Sequence: Synthetic oligonucleotide
ttatttgtggttggaatgagggacgaccatatttatttcagtc

SEQ ID NO: 120918 - DNA, 42 bp, Artificial Sequence
  Description of Artificial Sequence: Synthetic oligonucleotide
tatttgtggttggaatgagggacgaccatatttatttcagtc

SEQ ID NO: 120919 - DNA, 41 bp, Artificial Sequence
  Description of Artificial Sequence: Synthetic oligonucleotide
atttgtggttggaatgagggacgaccatatttatttcagtc

SEQ ID NO: 120920 - DNA, 40 bp, Artificial Sequence
  Description of Artificial Sequence: Synthetic oligonucleotide
tttgtggttggaatgagggacgaccatatttatttcagtc

SEQ ID NO: 120921 - DNA, 39 bp, Artificial Sequence
  Description of Artificial Sequence: Synthetic oligonucleotide
ttgtggttggaatgagggacgaccatatttatttcagtc

SEQ ID NO: 120922 - DNA, 38 bp, Artificial Sequence
  Description of Artificial Sequence: Synthetic oligonucleotide
tgtggttggaatgagggacgaccatatttatttcagtc

SEQ ID NO: 120923 - DNA, 37 bp, Artificial Sequence
  Description of Artificial Sequence: Synthetic oligonucleotide
gtggttggaatgagggacgaccatatttatttcagtc

SEQ ID NO: 120924 - DNA, 38 bp, Artificial Sequence
  Description of Artificial Sequence: Synthetic oligonucleotide
tggttggaatgagggacgaccatatttatttcagtcag

SEQ ID NO: 120925 - DNA, 37 bp, Artificial Sequence
  Description of Artificial Sequence: Synthetic oligonucleotide
ggttggaatgagggacgaccatatttatttcagtcag

SEQ ID NO: 120926 - DNA, 39 bp, Artificial Sequence
  Description of Artificial Sequence: Synthetic oligonucleotide
gttggaatgagggacgaccatatttatttcagtcagatc

SEQ ID NO: 120927 - DNA, 39 bp, Artificial Sequence
  Description of Artificial Sequence: Synthetic oligonucleotide
ttggaatgagggacgaccatatttatttcagtcagatcc

SEQ ID NO: 120928 - DNA, 38 bp, Artificial Sequence
  Description of Artificial Sequence: Synthetic oligonucleotide
tggaatgagggacgaccatatttatttcagtcagatcc

SEQ ID NO: 120929 - DNA, 37 bp, Artificial Sequence
  Description of Artificial Sequence: Synthetic oligonucleotide
ggaatgagggacgaccatatttatttcagtcagatcc

SEQ ID NO: 120930 - DNA, 39 bp, Artificial Sequence
  Description of Artificial Sequence: Synthetic oligonucleotide
gaatgagggacgaccatatttatttcagtcagatccatc

SEQ ID NO: 120931 - DNA, 40 bp, Artificial Sequence
  Description of Artificial Sequence: Synthetic oligonucleotide
aatgagggacgaccatatttatttcagtcagatccatctg

SEQ ID NO: 120932 - DNA, 39 bp, Artificial Sequence
  Description of Artificial Sequence: Synthetic oligonucleotide
atgagggacgaccatatttatttcagtcagatccatctg

SEQ ID NO: 120933 - DNA, 38 bp, Artificial Sequence
  Description of Artificial Sequence: Synthetic oligonucleotide
tgagggacgaccatatttatttcagtcagatccatctg

SEQ ID NO: 120934 - DNA, 37 bp, Artificial Sequence
  Description of Artificial Sequence: Synthetic oligonucleotide
gagggacgaccatatttatttcagtcagatccatctg

SEQ ID NO: 120935 - DNA, 37 bp, Artificial Sequence
  Description of Artificial Sequence: Synthetic oligonucleotide
agggacgaccatatttatttcagtcagatccatctgg

SEQ ID NO: 120936 - DNA, 36 bp, Artificial Sequence
  Description of Artificial Sequence: Synthetic oligonucleotide
gggacgaccatatttatttcagtcagatccatctgg

SEQ ID NO: 120937 - DNA, 37 bp, Artificial Sequence
  Description of Artificial Sequence: Synthetic oligonucleotide
ggacgaccatatttatttcagtcagatccatctggag

SEQ ID NO: 120938 - DNA, 37 bp, Artificial Sequence
  Description of Artificial Sequence: Synthetic oligonucleotide
gacgaccatatttatttcagtcagatccatctggagc

SEQ ID NO: 120939 - DNA, 40 bp, Artificial Sequence
  Description of Artificial Sequence: Synthetic oligonucleotide
acgaccatatttatttcagtcagatccatctggagcttac

SEQ ID NO: 120940 - DNA, 39 bp, Artificial Sequence
  Description of Artificial Sequence: Synthetic oligonucleotide
cgaccatatttatttcagtcagatccatctggagcttac

SEQ ID NO: 120941 - DNA, 42 bp, Artificial Sequence
  Description of Artificial Sequence: Synthetic oligonucleotide
gaccatatttatttcagtcagatccatctggagcttactttg

SEQ ID NO: 120942 - DNA, 42 bp, Artificial Sequence
  Description of Artificial Sequence: Synthetic oligonucleotide
accatatttatttcagtcagatccatctggagcttactttgc

SEQ ID NO: 120943 - DNA, 41 bp, Artificial Sequence
  Description of Artificial Sequence: Synthetic oligonucleotide
ccatatttatttcagtcagatccatctggagcttactttgc

SEQ ID NO: 120944 - DNA, 41 bp, Artificial Sequence
  Description of Artificial Sequence: Synthetic oligonucleotide
catatttatttcagtcagatccatctggagcttactttgcc

SEQ ID NO: 120945 - DNA, 42 bp, Artificial Sequence
  Description of Artificial Sequence: Synthetic oligonucleotide
atatttatttcagtcagatccatctggagcttactttgcctg

SEQ ID NO: 120946 - DNA, 41 bp, Artificial Sequence
  Description of Artificial Sequence: Synthetic oligonucleotide
tatttatttcagtcagatccatctggagcttactttgcctg

SEQ ID NO: 120947 - DNA, 40 bp, Artificial Sequence
  Description of Artificial Sequence: Synthetic oligonucleotide
atttatttcagtcagatccatctggagcttactttgcctg

SEQ ID NO: 120948 - DNA, 39 bp, Artificial Sequence
  Description of Artificial Sequence: Synthetic oligonucleotide
tttatttcagtcagatccatctggagcttactttgcctg

SEQ ID NO: 120949 - DNA, 38 bp, Artificial Sequence
  Description of Artificial Sequence: Synthetic oligonucleotide
ttatttcagtcagatccatctggagcttactttgcctg

SEQ ID NO: 120950 - DNA, 37 bp, Artificial Sequence
  Description of Artificial Sequence: Synthetic oligonucleotide
tatttcagtcagatccatctggagcttactttgcctg

SEQ ID NO: 120951 - DNA, 36 bp, Artificial Sequence
  Description of Artificial Sequence: Synthetic oligonucleotide
atttcagtcagatccatctggagcttactttgcctg

SEQ ID NO: 120952 - DNA, 35 bp, Artificial Sequence
  Description of Artificial Sequence: Synthetic oligonucleotide
tttcagtcagatccatctggagcttactttgcctg

SEQ ID NO: 120953 - DNA, 34 bp, Artificial Sequence
  Description of Artificial Sequence: Synthetic oligonucleotide
ttcagtcagatccatctggagcttactttgcctg

SEQ ID NO: 120954 - DNA, 33 bp, Artificial Sequence
  Description of Artificial Sequence: Synthetic oligonucleotide
tcagtcagatccatctggagcttactttgcctg

SEQ ID NO: 120955 - DNA, 32 bp, Artificial Sequence
  Description of Artificial Sequence: Synthetic oligonucleotide
cagtcagatccatctggagcttactttgcctg

SEQ ID NO: 120956 - DNA, 32 bp, Artificial Sequence
  Description of Artificial Sequence: Synthetic oligonucleotide
agtcagatccatctggagcttactttgcctgg

SEQ ID NO: 120957 - DNA, 31 bp, Artificial Sequence
  Description of Artificial Sequence: Synthetic oligonucleotide
gtcagatccatctggagcttactttgcctgg

SEQ ID NO: 120958 - DNA, 34 bp, Artificial Sequence
  Description of Artificial Sequence: Synthetic oligonucleotide
tcagatccatctggagcttactttgcctggaaag

SEQ ID NO: 120959 - DNA, 33 bp, Artificial Sequence
  Description of Artificial Sequence: Synthetic oligonucleotide
cagatccatctggagcttactttgcctggaaag

SEQ ID NO: 120960 - DNA, 33 bp, Artificial Sequence
  Description of Artificial Sequence: Synthetic oligonucleotide
agatccatctggagcttactttgcctggaaagc

SEQ ID NO: 120961 - DNA, 32 bp, Artificial Sequence
  Description of Artificial Sequence: Synthetic oligonucleotide
gatccatctggagcttactttgcctggaaagc

SEQ ID NO: 120962 - DNA, 34 bp, Artificial Sequence
  Description of Artificial Sequence: Synthetic oligonucleotide
atccatctggagcttactttgcctggaaagctac

SEQ ID NO: 120963 - DNA, 33 bp, Artificial Sequence
  Description of Artificial Sequence: Synthetic oligonucleotide
tccatctggagcttactttgcctggaaagctac

SEQ ID NO: 120964 - DNA, 32 bp, Artificial Sequence
  Description of Artificial Sequence: Synthetic oligonucleotide
ccatctggagcttactttgcctggaaagctac

SEQ ID NO: 120965 - DNA, 33 bp, Artificial Sequence
  Description of Artificial Sequence: Synthetic oligonucleotide
catctggagcttactttgcctggaaagctacag

SEQ ID NO: 120966 - DNA, 33 bp, Artificial Sequence
  Description of Artificial Sequence: Synthetic oligonucleotide
atctggagcttactttgcctggaaagctacagc

SEQ ID NO: 120967 - DNA, 32 bp, Artificial Sequence
  Description of Artificial Sequence: Synthetic oligonucleotide
tctggagcttactttgcctggaaagctacagc

SEQ ID NO: 120968 - DNA, 31 bp, Artificial Sequence
  Description of Artificial Sequence: Synthetic oligonucleotide
ctggagcttactttgcctggaaagctacagc

SEQ ID NO: 120969 - DNA, 34 bp, Artificial Sequence
  Description of Artificial Sequence: Synthetic oligonucleotide
tggagcttactttgcctggaaagctacagcaatg

SEQ ID NO: 120970 - DNA, 33 bp, Artificial Sequence
  Description of Artificial Sequence: Synthetic oligonucleotide
ggagcttactttgcctggaaagctacagcaatg

SEQ ID NO: 120971 - DNA, 33 bp, Artificial Sequence
  Description of Artificial Sequence: Synthetic oligonucleotide
gagcttactttgcctggaaagctacagcaatgg

SEQ ID NO: 120972 - DNA, 33 bp, Artificial Sequence
  Description of Artificial Sequence: Synthetic oligonucleotide
agcttactttgcctggaaagctacagcaatggg

SEQ ID NO: 120973 - DNA, 32 bp, Artificial Sequence
  Description of Artificial Sequence: Synthetic oligonucleotide
gcttactttgcctggaaagctacagcaatggg

SEQ ID NO: 120974 - DNA, 35 bp, Artificial Sequence
  Description of Artificial Sequence: Synthetic oligonucleotide
cttactttgcctggaaagctacagcaatgggaaag

SEQ ID NO: 120975 - DNA, 37 bp, Artificial Sequence
  Description of Artificial Sequence: Synthetic oligonucleotide
ttactttgcctggaaagctacagcaatgggaaagaac

SEQ ID NO: 120976 - DNA, 36 bp, Artificial Sequence
  Description of Artificial Sequence: Synthetic oligonucleotide
tactttgcctggaaagctacagcaatgggaaagaac

SEQ ID NO: 120977 - DNA, 35 bp, Artificial Sequence
  Description of Artificial Sequence: Synthetic oligonucleotide
actttgcctggaaagctacagcaatgggaaagaac

SEQ ID NO: 120978 - DNA, 34 bp, Artificial Sequence
  Description of Artificial Sequence: Synthetic oligonucleotide
ctttgcctggaaagctacagcaatgggaaagaac

SEQ ID NO: 120979 - DNA, 37 bp, Artificial Sequence
  Description of Artificial Sequence: Synthetic oligonucleotide
tttgcctggaaagctacagcaatgggaaagaactatg

SEQ ID NO: 120980 - DNA, 36 bp, Artificial Sequence
  Description of Artificial Sequence: Synthetic oligonucleotide
ttgcctggaaagctacagcaatgggaaagaactatg

SEQ ID NO: 120981 - DNA, 35 bp, Artificial Sequence
  Description of Artificial Sequence: Synthetic oligonucleotide
tgcctggaaagctacagcaatgggaaagaactatg

SEQ ID NO: 120982 - DNA, 34 bp, Artificial Sequence
  Description of Artificial Sequence: Synthetic oligonucleotide
gcctggaaagctacagcaatgggaaagaactatg

SEQ ID NO: 120983 - DNA, 35 bp, Artificial Sequence
  Description of Artificial Sequence: Synthetic oligonucleotide
cctggaaagctacagcaatgggaaagaactatgtg

SEQ ID NO: 120984 - DNA, 38 bp, Artificial Sequence
  Description of Artificial Sequence: Synthetic oligonucleotide
ctggaaagctacagcaatgggaaagaactatgtgaatg

SEQ ID NO: 120985 - DNA, 38 bp, Artificial Sequence
  Description of Artificial Sequence: Synthetic oligonucleotide
tggaaagctacagcaatgggaaagaactatgtgaatgg

SEQ ID NO: 120986 - DNA, 37 bp, Artificial Sequence
  Description of Artificial Sequence: Synthetic oligonucleotide
ggaaagctacagcaatgggaaagaactatgtgaatgg

SEQ ID NO: 120987 - DNA, 37 bp, Artificial Sequence
  Description of Artificial Sequence: Synthetic oligonucleotide
gaaagctacagcaatgggaaagaactatgtgaatggg

SEQ ID NO: 120988 - DNA, 39 bp, Artificial Sequence
  Description of Artificial Sequence: Synthetic oligonucleotide
aaagctacagcaatgggaaagaactatgtgaatgggaag

SEQ ID NO: 120989 - DNA, 38 bp, Artificial Sequence
  Description of Artificial Sequence: Synthetic oligonucleotide
aagctacagcaatgggaaagaactatgtgaatgggaag

SEQ ID NO: 120990 - DNA, 37 bp, Artificial Sequence
  Description of Artificial Sequence: Synthetic oligonucleotide
agctacagcaatgggaaagaactatgtgaatgggaag

SEQ ID NO: 120991 - DNA, 36 bp, Artificial Sequence
  Description of Artificial Sequence: Synthetic oligonucleotide
gctacagcaatgggaaagaactatgtgaatgggaag

SEQ ID NO: 120992 - DNA, 37 bp, Artificial Sequence
  Description of Artificial Sequence: Synthetic oligonucleotide
ctacagcaatgggaaagaactatgtgaatgggaagac

SEQ ID NO: 120993 - DNA, 40 bp, Artificial Sequence
  Description of Artificial Sequence: Synthetic oligonucleotide
tacagcaatgggaaagaactatgtgaatgggaagactttc

SEQ ID NO: 120994 - DNA, 39 bp, Artificial Sequence
  Description of Artificial Sequence: Synthetic oligonucleotide
acagcaatgggaaagaactatgtgaatgggaagactttc

SEQ ID NO: 120995 - DNA, 38 bp, Artificial Sequence
  Description of Artificial Sequence: Synthetic oligonucleotide
cagcaatgggaaagaactatgtgaatgggaagactttc

SEQ ID NO: 120996 - DNA, 38 bp, Artificial Sequence
  Description of Artificial Sequence: Synthetic oligonucleotide
agcaatgggaaagaactatgtgaatgggaagactttcc

SEQ ID NO: 120997 - DNA, 37 bp, Artificial Sequence
  Description of Artificial Sequence: Synthetic oligonucleotide
gcaatgggaaagaactatgtgaatgggaagactttcc

SEQ ID NO: 120998 - DNA, 39 bp, Artificial Sequence
  Description of Artificial Sequence: Synthetic oligonucleotide
caatgggaaagaactatgtgaatgggaagactttccttg

SEQ ID NO: 120999 - DNA, 40 bp, Artificial Sequence
  Description of Artificial Sequence: Synthetic oligonucleotide
aatgggaaagaactatgtgaatgggaagactttccttgag

SEQ ID NO: 121000 - DNA, 39 bp, Artificial Sequence
  Description of Artificial Sequence: Synthetic oligonucleotide
atgggaaagaactatgtgaatgggaagactttccttgag

SEQ ID NO: 121001 - DNA, 38 bp, Artificial Sequence
  Description of Artificial Sequence: Synthetic oligonucleotide
tgggaaagaactatgtgaatgggaagactttccttgag

SEQ ID NO: 121002 - DNA, 37 bp, Artificial Sequence
  Description of Artificial Sequence: Synthetic oligonucleotide
gggaaagaactatgtgaatgggaagactttccttgag

SEQ ID NO: 121003 - DNA, 41 bp, Artificial Sequence
  Description of Artificial Sequence: Synthetic oligonucleotide
ggaaagaactatgtgaatgggaagactttccttgagaaaag

SEQ ID NO: 121004 - DNA, 48 bp, Artificial Sequence
  Description of Artificial Sequence: Synthetic oligonucleotide
gaaagaactatgtgaatgggaagactttccttgagaaaagatataatg

SEQ ID NO: 121005 - DNA, 50 bp, Artificial Sequence
  Description of Artificial Sequence: Synthetic oligonucleotide
aaagaactatgtgaatgggaagactttccttgagaaaagatataatgaag

SEQ ID NO: 121006 - DNA, 49 bp, Artificial Sequence
  Description of Artificial Sequence: Synthetic oligonucleotide
aagaactatgtgaatgggaagactttccttgagaaaagatataatgaag

SEQ ID NO: 121007 - DNA, 48 bp, Artificial Sequence
  Description of Artificial Sequence: Synthetic oligonucleotide
agaactatgtgaatgggaagactttccttgagaaaagatataatgaag

SEQ ID NO: 121008 - DNA, 47 bp, Artificial Sequence
  Description of Artificial Sequence: Synthetic oligonucleotide
gaactatgtgaatgggaagactttccttgagaaaagatataatgaag

SEQ ID NO: 121009 - DNA, 49 bp, Artificial Sequence
  Description of Artificial Sequence: Synthetic oligonucleotide
aactatgtgaatgggaagactttccttgagaaaagatataatgaagatc

SEQ ID NO: 121010 - DNA, 48 bp, Artificial Sequence
  Description of Artificial Sequence: Synthetic oligonucleotide
actatgtgaatgggaagactttccttgagaaaagatataatgaagatc

SEQ ID NO: 121011 - DNA, 47 bp, Artificial Sequence
  Description of Artificial Sequence: Synthetic oligonucleotide
ctatgtgaatgggaagactttccttgagaaaagatataatgaagatc

SEQ ID NO: 121012 - DNA, 48 bp, Artificial Sequence
  Description of Artificial Sequence: Synthetic oligonucleotide
tatgtgaatgggaagactttccttgagaaaagatataatgaagatctg

SEQ ID NO: 121013 - DNA, 47 bp, Artificial Sequence
  Description of Artificial Sequence: Synthetic oligonucleotide
atgtgaatgggaagactttccttgagaaaagatataatgaagatctg

SEQ ID NO: 121014 - DNA, 46 bp, Artificial Sequence
  Description of Artificial Sequence: Synthetic oligonucleotide
tgtgaatgggaagactttccttgagaaaagatataatgaagatctg

SEQ ID NO: 121015 - DNA, 45 bp, Artificial Sequence
  Description of Artificial Sequence: Synthetic oligonucleotide
gtgaatgggaagactttccttgagaaaagatataatgaagatctg

SEQ ID NO: 121016 - DNA, 45 bp, Artificial Sequence
  Description of Artificial Sequence: Synthetic oligonucleotide
tgaatgggaagactttccttgagaaaagatataatgaagatctgg

SEQ ID NO: 121017 - DNA, 44 bp, Artificial Sequence
  Description of Artificial Sequence: Synthetic oligonucleotide
gaatgggaagactttccttgagaaaagatataatgaagatctgg

SEQ ID NO: 121018 - DNA, 46 bp, Artificial Sequence
  Description of Artificial Sequence: Synthetic oligonucleotide
aatgggaagactttccttgagaaaagatataatgaagatctggaac

SEQ ID NO: 121019 - DNA, 45 bp, Artificial Sequence
  Description of Artificial Sequence: Synthetic oligonucleotide
atgggaagactttccttgagaaaagatataatgaagatctggaac

SEQ ID NO: 121020 - DNA, 44 bp, Artificial Sequence
  Description of Artificial Sequence: Synthetic oligonucleotide
tgggaagactttccttgagaaaagatataatgaagatctggaac

SEQ ID NO: 121021 - DNA, 43 bp, Artificial Sequence
  Description of Artificial Sequence: Synthetic oligonucleotide
gggaagactttccttgagaaaagatataatgaagatctggaac

SEQ ID NO: 121022 - DNA, 45 bp, Artificial Sequence
  Description of Artificial Sequence: Synthetic oligonucleotide
ggaagactttccttgagaaaagatataatgaagatctggaacttg

SEQ ID NO: 121023 - DNA, 47 bp, Artificial Sequence
  Description of Artificial Sequence: Synthetic oligonucleotide
gaagactttccttgagaaaagatataatgaagatctggaacttgaag

SEQ ID NO: 121024 - DNA, 49 bp, Artificial Sequence
  Description of Artificial Sequence: Synthetic oligonucleotide
aagactttccttgagaaaagatataatgaagatctggaacttgaagatg

SEQ ID NO: 121025 - DNA, 48 bp, Artificial Sequence
  Description of Artificial Sequence: Synthetic oligonucleotide
agactttccttgagaaaagatataatgaagatctggaacttgaagatg

SEQ ID NO: 121026 - DNA, 47 bp, Artificial Sequence
  Description of Artificial Sequence: Synthetic oligonucleotide
gactttccttgagaaaagatataatgaagatctggaacttgaagatg

SEQ ID NO: 121027 - DNA, 47 bp, Artificial Sequence
  Description of Artificial Sequence: Synthetic oligonucleotide
actttccttgagaaaagatataatgaagatctggaacttgaagatgc

SEQ ID NO: 121028 - DNA, 46 bp, Artificial Sequence
  Description of Artificial Sequence: Synthetic oligonucleotide
ctttccttgagaaaagatataatgaagatctggaacttgaagatgc

SEQ ID NO: 121029 - DNA, 46 bp, Artificial Sequence
  Description of Artificial Sequence: Synthetic oligonucleotide
tttccttgagaaaagatataatgaagatctggaacttgaagatgcc

SEQ ID NO: 121030 - DNA, 45 bp, Artificial Sequence
  Description of Artificial Sequence: Synthetic oligonucleotide
ttccttgagaaaagatataatgaagatctggaacttgaagatgcc

SEQ ID NO: 121031 - DNA, 44 bp, Artificial Sequence
  Description of Artificial Sequence: Synthetic oligonucleotide
tccttgagaaaagatataatgaagatctggaacttgaagatgcc

SEQ ID NO: 121032 - DNA, 43 bp, Artificial Sequence
  Description of Artificial Sequence: Synthetic oligonucleotide
ccttgagaaaagatataatgaagatctggaacttgaagatgcc

SEQ ID NO: 121033 - DNA, 46 bp, Artificial Sequence
  Description of Artificial Sequence: Synthetic oligonucleotide
cttgagaaaagatataatgaagatctggaacttgaagatgccattc

SEQ ID NO: 121034 - DNA, 49 bp, Artificial Sequence
  Description of Artificial Sequence: Synthetic oligonucleotide
ttgagaaaagatataatgaagatctggaacttgaagatgccattcatac

SEQ ID NO: 121035 - DNA, 48 bp, Artificial Sequence
  Description of Artificial Sequence: Synthetic oligonucleotide
tgagaaaagatataatgaagatctggaacttgaagatgccattcatac

SEQ ID NO: 121036 - DNA, 47 bp, Artificial Sequence
  Description of Artificial Sequence: Synthetic oligonucleotide
gagaaaagatataatgaagatctggaacttgaagatgccattcatac

SEQ ID NO: 121037 - DNA, 48 bp, Artificial Sequence
  Description of Artificial Sequence: Synthetic oligonucleotide
agaaaagatataatgaagatctggaacttgaagatgccattcatacag

SEQ ID NO: 121038 - DNA, 47 bp, Artificial Sequence
  Description of Artificial Sequence: Synthetic oligonucleotide
gaaaagatataatgaagatctggaacttgaagatgccattcatacag

SEQ ID NO: 121039 - DNA, 47 bp, Artificial Sequence
  Description of Artificial Sequence: Synthetic oligonucleotide
aaaagatataatgaagatctggaacttgaagatgccattcatacagc

SEQ ID NO: 121040 - DNA, 46 bp, Artificial Sequence
  Description of Artificial Sequence: Synthetic oligonucleotide
aaagatataatgaagatctggaacttgaagatgccattcatacagc

SEQ ID NO: 121041 - DNA, 45 bp, Artificial Sequence
  Description of Artificial Sequence: Synthetic oligonucleotide
aagatataatgaagatctggaacttgaagatgccattcatacagc

SEQ ID NO: 121042 - DNA, 44 bp, Artificial Sequence
  Description of Artificial Sequence: Synthetic oligonucleotide
agatataatgaagatctggaacttgaagatgccattcatacagc

SEQ ID NO: 121043 - DNA, 43 bp, Artificial Sequence
  Description of Artificial Sequence: Synthetic oligonucleotide
gatataatgaagatctggaacttgaagatgccattcatacagc

SEQ ID NO: 121044 - DNA, 43 bp, Artificial Sequence
  Description of Artificial Sequence: Synthetic oligonucleotide
atataatgaagatctggaacttgaagatgccattcatacagcc

SEQ ID NO: 121045 - DNA, 42 bp, Artificial Sequence
  Description of Artificial Sequence: Synthetic oligonucleotide
tataatgaagatctggaacttgaagatgccattcatacagcc

SEQ ID NO: 121046 - DNA, 41 bp, Artificial Sequence
  Description of Artificial Sequence: Synthetic oligonucleotide
ataatgaagatctggaacttgaagatgccattcatacagcc

SEQ ID NO: 121047 - DNA, 40 bp, Artificial Sequence
  Description of Artificial Sequence: Synthetic oligonucleotide
taatgaagatctggaacttgaagatgccattcatacagcc

SEQ ID NO: 121048 - DNA, 39 bp, Artificial Sequence
  Description of Artificial Sequence: Synthetic oligonucleotide
aatgaagatctggaacttgaagatgccattcatacagcc

SEQ ID NO: 121049 - DNA, 38 bp, Artificial Sequence
  Description of Artificial Sequence: Synthetic oligonucleotide
atgaagatctggaacttgaagatgccattcatacagcc

SEQ ID NO: 121050 - DNA, 37 bp, Artificial Sequence
  Description of Artificial Sequence: Synthetic oligonucleotide
tgaagatctggaacttgaagatgccattcatacagcc

SEQ ID NO: 121051 - DNA, 36 bp, Artificial Sequence
  Description of Artificial Sequence: Synthetic oligonucleotide
gaagatctggaacttgaagatgccattcatacagcc

SEQ ID NO: 121052 - DNA, 38 bp, Artificial Sequence
  Description of Artificial Sequence: Synthetic oligonucleotide
aagatctggaacttgaagatgccattcatacagccatc

SEQ ID NO: 121053 - DNA, 37 bp, Artificial Sequence
  Description of Artificial Sequence: Synthetic oligonucleotide
agatctggaacttgaagatgccattcatacagccatc

SEQ ID NO: 121054 - DNA, 36 bp, Artificial Sequence
  Description of Artificial Sequence: Synthetic oligonucleotide
gatctggaacttgaagatgccattcatacagccatc

SEQ ID NO: 121055 - DNA, 40 bp, Artificial Sequence
  Description of Artificial Sequence: Synthetic oligonucleotide
atctggaacttgaagatgccattcatacagccatcttaac

SEQ ID NO: 121056 - DNA, 39 bp, Artificial Sequence
  Description of Artificial Sequence: Synthetic oligonucleotide
tctggaacttgaagatgccattcatacagccatcttaac

SEQ ID NO: 121057 - DNA, 38 bp, Artificial Sequence
  Description of Artificial Sequence: Synthetic oligonucleotide
ctggaacttgaagatgccattcatacagccatcttaac

SEQ ID NO: 121058 - DNA, 38 bp, Artificial Sequence
  Description of Artificial Sequence: Synthetic oligonucleotide
tggaacttgaagatgccattcatacagccatcttaacc

SEQ ID NO: 121059 - DNA, 37 bp, Artificial Sequence
  Description of Artificial Sequence: Synthetic oligonucleotide
ggaacttgaagatgccattcatacagccatcttaacc

SEQ ID NO: 121060 - DNA, 37 bp, Artificial Sequence
  Description of Artificial Sequence: Synthetic oligonucleotide
gaacttgaagatgccattcatacagccatcttaaccc

SEQ ID NO: 121061 - DNA, 41 bp, Artificial Sequence
  Description of Artificial Sequence: Synthetic oligonucleotide
aacttgaagatgccattcatacagccatcttaaccctaaag

SEQ ID NO: 121062 - DNA, 40 bp, Artificial Sequence
  Description of Artificial Sequence: Synthetic oligonucleotide
acttgaagatgccattcatacagccatcttaaccctaaag

SEQ ID NO: 121063 - DNA, 39 bp, Artificial Sequence
  Description of Artificial Sequence: Synthetic oligonucleotide
cttgaagatgccattcatacagccatcttaaccctaaag

SEQ ID NO: 121064 - DNA, 39 bp, Artificial Sequence
  Description of Artificial Sequence: Synthetic oligonucleotide
ttgaagatgccattcatacagccatcttaaccctaaagg

SEQ ID NO: 121065 - DNA, 38 bp, Artificial Sequence
  Description of Artificial Sequence: Synthetic oligonucleotide
tgaagatgccattcatacagccatcttaaccctaaagg

SEQ ID NO: 121066 - DNA, 37 bp, Artificial Sequence
  Description of Artificial Sequence: Synthetic oligonucleotide
gaagatgccattcatacagccatcttaaccctaaagg

SEQ ID NO: 121067 - DNA, 40 bp, Artificial Sequence
  Description of Artificial Sequence: Synthetic oligonucleotide
aagatgccattcatacagccatcttaaccctaaaggaaag

SEQ ID NO: 121068 - DNA, 39 bp, Artificial Sequence
  Description of Artificial Sequence: Synthetic oligonucleotide
agatgccattcatacagccatcttaaccctaaaggaaag

SEQ ID NO: 121069 - DNA, 38 bp, Artificial Sequence
  Description of Artificial Sequence: Synthetic oligonucleotide
gatgccattcatacagccatcttaaccctaaaggaaag

SEQ ID NO: 121070 - DNA, 38 bp, Artificial Sequence
  Description of Artificial Sequence: Synthetic oligonucleotide
atgccattcatacagccatcttaaccctaaaggaaagc

SEQ ID NO: 121071 - DNA, 37 bp, Artificial Sequence
  Description of Artificial Sequence: Synthetic oligonucleotide
tgccattcatacagccatcttaaccctaaaggaaagc

SEQ ID NO: 121072 - DNA, 36 bp, Artificial Sequence
  Description of Artificial Sequence: Synthetic oligonucleotide
gccattcatacagccatcttaaccctaaaggaaagc

SEQ ID NO: 121073 - DNA, 39 bp, Artificial Sequence
  Description of Artificial Sequence: Synthetic oligonucleotide
ccattcatacagccatcttaaccctaaaggaaagctttg

SEQ ID NO: 121074 - DNA, 41 bp, Artificial Sequence
  Description of Artificial Sequence: Synthetic oligonucleotide
cattcatacagccatcttaaccctaaaggaaagctttgaag

SEQ ID NO: 121075 - DNA, 41 bp, Artificial Sequence
  Description of Artificial Sequence: Synthetic oligonucleotide
attcatacagccatcttaaccctaaaggaaagctttgaagg

SEQ ID NO: 121076 - DNA, 40 bp, Artificial Sequence
  Description of Artificial Sequence: Synthetic oligonucleotide
ttcatacagccatcttaaccctaaaggaaagctttgaagg

SEQ ID NO: 121077 - DNA, 39 bp, Artificial Sequence
  Description of Artificial Sequence: Synthetic oligonucleotide
tcatacagccatcttaaccctaaaggaaagctttgaagg

SEQ ID NO: 121078 - DNA, 38 bp, Artificial Sequence
  Description of Artificial Sequence: Synthetic oligonucleotide
catacagccatcttaaccctaaaggaaagctttgaagg

SEQ ID NO: 121079 - DNA, 38 bp, Artificial Sequence
  Description of Artificial Sequence: Synthetic oligonucleotide
atacagccatcttaaccctaaaggaaagctttgaaggg

SEQ ID NO: 121080 - DNA, 37 bp, Artificial Sequence
  Description of Artificial Sequence: Synthetic oligonucleotide
tacagccatcttaaccctaaaggaaagctttgaaggg

SEQ ID NO: 121081 - DNA, 36 bp, Artificial Sequence
  Description of Artificial Sequence: Synthetic oligonucleotide
acagccatcttaaccctaaaggaaagctttgaaggg

SEQ ID NO: 121082 - DNA, 35 bp, Artificial Sequence
  Description of Artificial Sequence: Synthetic oligonucleotide
cagccatcttaaccctaaaggaaagctttgaaggg

SEQ ID NO: 121083 - DNA, 35 bp, Artificial Sequence
  Description of Artificial Sequence: Synthetic oligonucleotide
agccatcttaaccctaaaggaaagctttgaagggc

SEQ ID NO: 121084 - DNA, 34 bp, Artificial Sequence
  Description of Artificial Sequence: Synthetic oligonucleotide
gccatcttaaccctaaaggaaagctttgaagggc

SEQ ID NO: 121085 - DNA, 38 bp, Artificial Sequence
  Description of Artificial Sequence: Synthetic oligonucleotide
ccatcttaaccctaaaggaaagctttgaagggcaaatg

SEQ ID NO: 121086 - DNA, 39 bp, Artificial Sequence
  Description of Artificial Sequence: Synthetic oligonucleotide
catcttaaccctaaaggaaagctttgaagggcaaatgac

SEQ ID NO: 121087 - DNA, 40 bp, Artificial Sequence
  Description of Artificial Sequence: Synthetic oligonucleotide
atcttaaccctaaaggaaagctttgaagggcaaatgacag

SEQ ID NO: 121088 - DNA, 39 bp, Artificial Sequence
  Description of Artificial Sequence: Synthetic oligonucleotide
tcttaaccctaaaggaaagctttgaagggcaaatgacag

SEQ ID NO: 121089 - DNA, 38 bp, Artificial Sequence
  Description of Artificial Sequence: Synthetic oligonucleotide
cttaaccctaaaggaaagctttgaagggcaaatgacag

SEQ ID NO: 121090 - DNA, 39 bp, Artificial Sequence
  Description of Artificial Sequence: Synthetic oligonucleotide
ttaaccctaaaggaaagctttgaagggcaaatgacagag

SEQ ID NO: 121091 - DNA, 38 bp, Artificial Sequence
  Description of Artificial Sequence: Synthetic oligonucleotide
taaccctaaaggaaagctttgaagggcaaatgacagag

SEQ ID NO: 121092 - DNA, 37 bp, Artificial Sequence
  Description of Artificial Sequence: Synthetic oligonucleotide
aaccctaaaggaaagctttgaagggcaaatgacagag

SEQ ID NO: 121093 - DNA, 36 bp, Artificial Sequence
  Description of Artificial Sequence: Synthetic oligonucleotide
accctaaaggaaagctttgaagggcaaatgacagag

SEQ ID NO: 121094 - DNA, 35 bp, Artificial Sequence
  Description of Artificial Sequence: Synthetic oligonucleotide
ccctaaaggaaagctttgaagggcaaatgacagag

SEQ ID NO: 121095 - DNA, 35 bp, Artificial Sequence
  Description of Artificial Sequence: Synthetic oligonucleotide
cctaaaggaaagctttgaagggcaaatgacagagg

SEQ ID NO: 121096 - DNA, 39 bp, Artificial Sequence
  Description of Artificial Sequence: Synthetic oligonucleotide
ctaaaggaaagctttgaagggcaaatgacagaggataac

SEQ ID NO: 121097 - DNA, 42 bp, Artificial Sequence
  Description of Artificial Sequence: Synthetic oligonucleotide
taaaggaaagctttgaagggcaaatgacagaggataacatag

SEQ ID NO: 121098 - DNA, 41 bp, Artificial Sequence
  Description of Artificial Sequence: Synthetic oligonucleotide
aaaggaaagctttgaagggcaaatgacagaggataacatag

SEQ ID NO: 121099 - DNA, 40 bp, Artificial Sequence
  Description of Artificial Sequence: Synthetic oligonucleotide
aaggaaagctttgaagggcaaatgacagaggataacatag

SEQ ID NO: 121100 - DNA, 39 bp, Artificial Sequence
  Description of Artificial Sequence: Synthetic oligonucleotide
aggaaagctttgaagggcaaatgacagaggataacatag

SEQ ID NO: 121101 - DNA, 38 bp, Artificial Sequence
  Description of Artificial Sequence: Synthetic oligonucleotide
ggaaagctttgaagggcaaatgacagaggataacatag

SEQ ID NO: 121102 - DNA, 40 bp, Artificial Sequence
  Description of Artificial Sequence: Synthetic oligonucleotide
gaaagctttgaagggcaaatgacagaggataacatagaag

SEQ ID NO: 121103 - DNA, 42 bp, Artificial Sequence
  Description of Artificial Sequence: Synthetic oligonucleotide
aaagctttgaagggcaaatgacagaggataacatagaagttg

SEQ ID NO: 121104 - DNA, 41 bp, Artificial Sequence
  Description of Artificial Sequence: Synthetic oligonucleotide
aagctttgaagggcaaatgacagaggataacatagaagttg

SEQ ID NO: 121105 - DNA, 40 bp, Artificial Sequence
  Description of Artificial Sequence: Synthetic oligonucleotide
agctttgaagggcaaatgacagaggataacatagaagttg

SEQ ID NO: 121106 - DNA, 39 bp, Artificial Sequence
  Description of Artificial Sequence: Synthetic oligonucleotide
gctttgaagggcaaatgacagaggataacatagaagttg

SEQ ID NO: 121107 - DNA, 39 bp, Artificial Sequence
  Description of Artificial Sequence: Synthetic oligonucleotide
ctttgaagggcaaatgacagaggataacatagaagttgg

SEQ ID NO: 121108 - DNA, 42 bp, Artificial Sequence
  Description of Artificial Sequence: Synthetic oligonucleotide
tttgaagggcaaatgacagaggataacatagaagttggaatc

SEQ ID NO: 121109 - DNA, 41 bp, Artificial Sequence
  Description of Artificial Sequence: Synthetic oligonucleotide
ttgaagggcaaatgacagaggataacatagaagttggaatc

SEQ ID NO: 121110 - DNA, 40 bp, Artificial Sequence
  Description of Artificial Sequence: Synthetic oligonucleotide
tgaagggcaaatgacagaggataacatagaagttggaatc

SEQ ID NO: 121111 - DNA, 39 bp, Artificial Sequence
  Description of Artificial Sequence: Synthetic oligonucleotide
gaagggcaaatgacagaggataacatagaagttggaatc

SEQ ID NO: 121112 - DNA, 40 bp, Artificial Sequence
  Description of Artificial Sequence: Synthetic oligonucleotide
aagggcaaatgacagaggataacatagaagttggaatctg

SEQ ID NO: 121113 - DNA, 39 bp, Artificial Sequence
  Description of Artificial Sequence: Synthetic oligonucleotide
agggcaaatgacagaggataacatagaagttggaatctg

SEQ ID NO: 121114 - DNA, 38 bp, Artificial Sequence
  Description of Artificial Sequence: Synthetic oligonucleotide
gggcaaatgacagaggataacatagaagttggaatctg

SEQ ID NO: 121115 - DNA, 38 bp, Artificial Sequence
  Description of Artificial Sequence: Synthetic oligonucleotide
ggcaaatgacagaggataacatagaagttggaatctgc

SEQ ID NO: 121116 - DNA, 41 bp, Artificial Sequence
  Description of Artificial Sequence: Synthetic oligonucleotide
gcaaatgacagaggataacatagaagttggaatctgcaatg

SEQ ID NO: 121117 - DNA, 43 bp, Artificial Sequence
  Description of Artificial Sequence: Synthetic oligonucleotide
caaatgacagaggataacatagaagttggaatctgcaatgaag

SEQ ID NO: 121118 - DNA, 43 bp, Artificial Sequence
  Description of Artificial Sequence: Synthetic oligonucleotide
aaatgacagaggataacatagaagttggaatctgcaatgaagc

SEQ ID NO: 121119 - DNA, 42 bp, Artificial Sequence
  Description of Artificial Sequence: Synthetic oligonucleotide
aatgacagaggataacatagaagttggaatctgcaatgaagc

SEQ ID NO: 121120 - DNA, 41 bp, Artificial Sequence
  Description of Artificial Sequence: Synthetic oligonucleotide
atgacagaggataacatagaagttggaatctgcaatgaagc

SEQ ID NO: 121121 - DNA, 40 bp, Artificial Sequence
  Description of Artificial Sequence: Synthetic oligonucleotide
tgacagaggataacatagaagttggaatctgcaatgaagc

SEQ ID NO: 121122 - DNA, 39 bp, Artificial Sequence
  Description of Artificial Sequence: Synthetic oligonucleotide
gacagaggataacatagaagttggaatctgcaatgaagc

SEQ ID NO: 121123 - DNA, 40 bp, Artificial Sequence
  Description of Artificial Sequence: Synthetic oligonucleotide
acagaggataacatagaagttggaatctgcaatgaagctg

SEQ ID NO: 121124 - DNA, 39 bp, Artificial Sequence
  Description of Artificial Sequence: Synthetic oligonucleotide
cagaggataacatagaagttggaatctgcaatgaagctg

SEQ ID NO: 121125 - DNA, 39 bp, Artificial Sequence
  Description of Artificial Sequence: Synthetic oligonucleotide
agaggataacatagaagttggaatctgcaatgaagctgg

SEQ ID NO: 121126 - DNA, 38 bp, Artificial Sequence
  Description of Artificial Sequence: Synthetic oligonucleotide
gaggataacatagaagttggaatctgcaatgaagctgg

SEQ ID NO: 121127 - DNA, 43 bp, Artificial Sequence
  Description of Artificial Sequence: Synthetic oligonucleotide
aggataacatagaagttggaatctgcaatgaagctggatttag

SEQ ID NO: 121128 - DNA, 42 bp, Artificial Sequence
  Description of Artificial Sequence: Synthetic oligonucleotide
ggataacatagaagttggaatctgcaatgaagctggatttag

SEQ ID NO: 121129 - DNA, 42 bp, Artificial Sequence
  Description of Artificial Sequence: Synthetic oligonucleotide
gataacatagaagttggaatctgcaatgaagctggatttagg

SEQ ID NO: 121130 - DNA, 43 bp, Artificial Sequence
  Description of Artificial Sequence: Synthetic oligonucleotide
ataacatagaagttggaatctgcaatgaagctggatttaggag

SEQ ID NO: 121131 - DNA, 42 bp, Artificial Sequence
  Description of Artificial Sequence: Synthetic oligonucleotide
taacatagaagttggaatctgcaatgaagctggatttaggag

SEQ ID NO: 121132 - DNA, 41 bp, Artificial Sequence
  Description of Artificial Sequence: Synthetic oligonucleotide
aacatagaagttggaatctgcaatgaagctggatttaggag

SEQ ID NO: 121133 - DNA, 40 bp, Artificial Sequence
  Description of Artificial Sequence: Synthetic oligonucleotide
acatagaagttggaatctgcaatgaagctggatttaggag

SEQ ID NO: 121134 - DNA, 39 bp, Artificial Sequence
  Description of Artificial Sequence: Synthetic oligonucleotide
catagaagttggaatctgcaatgaagctggatttaggag

SEQ ID NO: 121135 - DNA, 39 bp, Artificial Sequence
  Description of Artificial Sequence: Synthetic oligonucleotide
atagaagttggaatctgcaatgaagctggatttaggagg

SEQ ID NO: 121136 - DNA, 38 bp, Artificial Sequence
  Description of Artificial Sequence: Synthetic oligonucleotide
tagaagttggaatctgcaatgaagctggatttaggagg

SEQ ID NO: 121137 - DNA, 37 bp, Artificial Sequence
  Description of Artificial Sequence: Synthetic oligonucleotide
agaagttggaatctgcaatgaagctggatttaggagg

SEQ ID NO: 121138 - DNA, 36 bp, Artificial Sequence
  Description of Artificial Sequence: Synthetic oligonucleotide
gaagttggaatctgcaatgaagctggatttaggagg

SEQ ID NO: 121139 - DNA, 36 bp, Artificial Sequence
  Description of Artificial Sequence: Synthetic oligonucleotide
aagttggaatctgcaatgaagctggatttaggaggc

SEQ ID NO: 121140 - DNA, 35 bp, Artificial Sequence
  Description of Artificial Sequence: Synthetic oligonucleotide
agttggaatctgcaatgaagctggatttaggaggc

SEQ ID NO: 121141 - DNA, 34 bp, Artificial Sequence
  Description of Artificial Sequence: Synthetic oligonucleotide
gttggaatctgcaatgaagctggatttaggaggc

SEQ ID NO: 121142 - DNA, 37 bp, Artificial Sequence
  Description of Artificial Sequence: Synthetic oligonucleotide
ttggaatctgcaatgaagctggatttaggaggcttac

SEQ ID NO: 121143 - DNA, 36 bp, Artificial Sequence
  Description of Artificial Sequence: Synthetic oligonucleotide
tggaatctgcaatgaagctggatttaggaggcttac

SEQ ID NO: 121144 - DNA, 35 bp, Artificial Sequence
  Description of Artificial Sequence: Synthetic oligonucleotide
ggaatctgcaatgaagctggatttaggaggcttac

SEQ ID NO: 121145 - DNA, 36 bp, Artificial Sequence
  Description of Artificial Sequence: Synthetic oligonucleotide
gaatctgcaatgaagctggatttaggaggcttactc

SEQ ID NO: 121146 - DNA, 36 bp, Artificial Sequence
  Description of Artificial Sequence: Synthetic oligonucleotide
aatctgcaatgaagctggatttaggaggcttactcc

SEQ ID NO: 121147 - DNA, 35 bp, Artificial Sequence
  Description of Artificial Sequence: Synthetic oligonucleotide
atctgcaatgaagctggatttaggaggcttactcc

SEQ ID NO: 121148 - DNA, 34 bp, Artificial Sequence
  Description of Artificial Sequence: Synthetic oligonucleotide
tctgcaatgaagctggatttaggaggcttactcc

SEQ ID NO: 121149 - DNA, 33 bp, Artificial Sequence
  Description of Artificial Sequence: Synthetic oligonucleotide
ctgcaatgaagctggatttaggaggcttactcc

SEQ ID NO: 121150 - DNA, 35 bp, Artificial Sequence
  Description of Artificial Sequence: Synthetic oligonucleotide
tgcaatgaagctggatttaggaggcttactccaac

SEQ ID NO: 121151 - DNA, 34 bp, Artificial Sequence
  Description of Artificial Sequence: Synthetic oligonucleotide
gcaatgaagctggatttaggaggcttactccaac

SEQ ID NO: 121152 - DNA, 35 bp, Artificial Sequence
  Description of Artificial Sequence: Synthetic oligonucleotide
caatgaagctggatttaggaggcttactccaactg

SEQ ID NO: 121153 - DNA, 37 bp, Artificial Sequence
  Description of Artificial Sequence: Synthetic oligonucleotide
aatgaagctggatttaggaggcttactccaactgaag

SEQ ID NO: 121154 - DNA, 36 bp, Artificial Sequence
  Description of Artificial Sequence: Synthetic oligonucleotide
atgaagctggatttaggaggcttactccaactgaag

SEQ ID NO: 121155 - DNA, 35 bp, Artificial Sequence
  Description of Artificial Sequence: Synthetic oligonucleotide
tgaagctggatttaggaggcttactccaactgaag

SEQ ID NO: 121156 - DNA, 34 bp, Artificial Sequence
  Description of Artificial Sequence: Synthetic oligonucleotide
gaagctggatttaggaggcttactccaactgaag

SEQ ID NO: 121157 - DNA, 38 bp, Artificial Sequence
  Description of Artificial Sequence: Synthetic oligonucleotide
aagctggatttaggaggcttactccaactgaagttaag

SEQ ID NO: 121158 - DNA, 37 bp, Artificial Sequence
  Description of Artificial Sequence: Synthetic oligonucleotide
agctggatttaggaggcttactccaactgaagttaag

SEQ ID NO: 121159 - DNA, 36 bp, Artificial Sequence
  Description of Artificial Sequence: Synthetic oligonucleotide
gctggatttaggaggcttactccaactgaagttaag

SEQ ID NO: 121160 - DNA, 36 bp, Artificial Sequence
  Description of Artificial Sequence: Synthetic oligonucleotide
ctggatttaggaggcttactccaactgaagttaagg

SEQ ID NO: 121161 - DNA, 40 bp, Artificial Sequence
  Description of Artificial Sequence: Synthetic oligonucleotide
tggatttaggaggcttactccaactgaagttaaggattac

SEQ ID NO: 121162 - DNA, 39 bp, Artificial Sequence
  Description of Artificial Sequence: Synthetic oligonucleotide
ggatttaggaggcttactccaactgaagttaaggattac

SEQ ID NO: 121163 - DNA, 41 bp, Artificial Sequence
  Description of Artificial Sequence: Synthetic oligonucleotide
gatttaggaggcttactccaactgaagttaaggattacttg

SEQ ID NO: 121164 - DNA, 41 bp, Artificial Sequence
  Description of Artificial Sequence: Synthetic oligonucleotide
atttaggaggcttactccaactgaagttaaggattacttgg

SEQ ID NO: 121165 - DNA, 40 bp, Artificial Sequence
  Description of Artificial Sequence: Synthetic oligonucleotide
tttaggaggcttactccaactgaagttaaggattacttgg

SEQ ID NO: 121166 - DNA, 39 bp, Artificial Sequence
  Description of Artificial Sequence: Synthetic oligonucleotide
ttaggaggcttactccaactgaagttaaggattacttgg

SEQ ID NO: 121167 - DNA, 38 bp, Artificial Sequence
  Description of Artificial Sequence: Synthetic oligonucleotide
taggaggcttactccaactgaagttaaggattacttgg

SEQ ID NO: 121168 - DNA, 37 bp, Artificial Sequence
  Description of Artificial Sequence: Synthetic oligonucleotide
aggaggcttactccaactgaagttaaggattacttgg

SEQ ID NO: 121169 - DNA, 36 bp, Artificial Sequence
  Description of Artificial Sequence: Synthetic oligonucleotide
ggaggcttactccaactgaagttaaggattacttgg

SEQ ID NO: 121170 - DNA, 36 bp, Artificial Sequence
  Description of Artificial Sequence: Synthetic oligonucleotide
gaggcttactccaactgaagttaaggattacttggc

SEQ ID NO: 121171 - DNA, 37 bp, Artificial Sequence
  Description of Artificial Sequence: Synthetic oligonucleotide
aggcttactccaactgaagttaaggattacttggctg

SEQ ID NO: 121172 - DNA, 36 bp, Artificial Sequence
  Description of Artificial Sequence: Synthetic oligonucleotide
ggcttactccaactgaagttaaggattacttggctg

SEQ ID NO: 121173 - DNA, 36 bp, Artificial Sequence
  Description of Artificial Sequence: Synthetic oligonucleotide
gcttactccaactgaagttaaggattacttggctgc

SEQ ID NO: 121174 - DNA, 36 bp, Artificial Sequence
  Description of Artificial Sequence: Synthetic oligonucleotide
cttactccaactgaagttaaggattacttggctgcc

SEQ ID NO: 121175 - DNA, 39 bp, Artificial Sequence
  Description of Artificial Sequence: Synthetic oligonucleotide
ttactccaactgaagttaaggattacttggctgccatag

SEQ ID NO: 121176 - DNA, 38 bp, Artificial Sequence
  Description of Artificial Sequence: Synthetic oligonucleotide
tactccaactgaagttaaggattacttggctgccatag

SEQ ID NO: 121177 - DNA, 37 bp, Artificial Sequence
  Description of Artificial Sequence: Synthetic oligonucleotide
actccaactgaagttaaggattacttggctgccatag

SEQ ID NO: 121178 - DNA, 36 bp, Artificial Sequence
  Description of Artificial Sequence: Synthetic oligonucleotide
ctccaactgaagttaaggattacttggctgccatag

SEQ ID NO: 121179 - DNA, 36 bp, Artificial Sequence
  Description of Artificial Sequence: Synthetic oligonucleotide
tccaactgaagttaaggattacttggctgccatagc

SEQ ID NO: 121180 - DNA, 35 bp, Artificial Sequence
  Description of Artificial Sequence: Synthetic oligonucleotide
ccaactgaagttaaggattacttggctgccatagc

SEQ ID NO: 121181 - DNA, 31 bp, Artificial Sequence
  Description of Artificial Sequence: Synthetic oligonucleotide
atgtttcttacccggtctgagtacgacaggg

SEQ ID NO: 121182 - DNA, 30 bp, Artificial Sequence
  Description of Artificial Sequence: Synthetic oligonucleotide
tgtttcttacccggtctgagtacgacaggg

SEQ ID NO: 121183 - DNA, 29 bp, Artificial Sequence
  Description of Artificial Sequence: Synthetic oligonucleotide
gtttcttacccggtctgagtacgacaggg

SEQ ID NO: 121184 - DNA, 29 bp, Artificial Sequence
  Description of Artificial Sequence: Synthetic oligonucleotide
tttcttacccggtctgagtacgacagggg

SEQ ID NO: 121185 - DNA, 28 bp, Artificial Sequence
  Description of Artificial Sequence: Synthetic oligonucleotide
ttcttacccggtctgagtacgacagggg

SEQ ID NO: 121186 - DNA, 27 bp, Artificial Sequence
  Description of Artificial Sequence: Synthetic oligonucleotide
tcttacccggtctgagtacgacagggg

SEQ ID NO: 121187 - DNA, 26 bp, Artificial Sequence
  Description of Artificial Sequence: Synthetic oligonucleotide
cttacccggtctgagtacgacagggg

SEQ ID NO: 121188 - DNA, 26 bp, Artificial Sequence
  Description of Artificial Sequence: Synthetic oligonucleotide
ttacccggtctgagtacgacaggggc

SEQ ID NO: 121189 - DNA, 25 bp, Artificial Sequence
  Description of Artificial Sequence: Synthetic oligonucleotide
tacccggtctgagtacgacaggggc

SEQ ID NO: 121190 - DNA, 24 bp, Artificial Sequence
  Description of Artificial Sequence: Synthetic oligonucleotide
acccggtctgagtacgacaggggc

SEQ ID NO: 121191 - DNA, 23 bp, Artificial Sequence
  Description of Artificial Sequence: Synthetic oligonucleotide
cccggtctgagtacgacaggggc

SEQ ID NO: 121192 - DNA, 24 bp, Artificial Sequence
  Description of Artificial Sequence: Synthetic oligonucleotide
ccggtctgagtacgacaggggcgt

SEQ ID NO: 121193 - DNA, 27 bp, Artificial Sequence
  Description of Artificial Sequence: Synthetic oligonucleotide
cggtctgagtacgacaggggcgtgaat

SEQ ID NO: 121194 - DNA, 28 bp, Artificial Sequence
  Description of Artificial Sequence: Synthetic oligonucleotide
ggtctgagtacgacaggggcgtgaatac

SEQ ID NO: 121195 - DNA, 33 bp, Artificial Sequence
  Description of Artificial Sequence: Synthetic oligonucleotide
gtctgagtacgacaggggcgtgaatactttttc

SEQ ID NO: 121196 - DNA, 34 bp, Artificial Sequence
  Description of Artificial Sequence: Synthetic oligonucleotide
tctgagtacgacaggggcgtgaatactttttctc

SEQ ID NO: 121197 - DNA, 33 bp, Artificial Sequence
  Description of Artificial Sequence: Synthetic oligonucleotide
ctgagtacgacaggggcgtgaatactttttctc

SEQ ID NO: 121198 - DNA, 33 bp, Artificial Sequence
  Description of Artificial Sequence: Synthetic oligonucleotide
tgagtacgacaggggcgtgaatactttttctcc

SEQ ID NO: 121199 - DNA, 32 bp, Artificial Sequence
  Description of Artificial Sequence: Synthetic oligonucleotide
gagtacgacaggggcgtgaatactttttctcc

SEQ ID NO: 121200 - DNA, 32 bp, Artificial Sequence
  Description of Artificial Sequence: Synthetic oligonucleotide
agtacgacaggggcgtgaatactttttctccc

SEQ ID NO: 121201 - DNA, 31 bp, Artificial Sequence
  Description of Artificial Sequence: Synthetic oligonucleotide
gtacgacaggggcgtgaatactttttctccc

SEQ ID NO: 121202 - DNA, 31 bp, Artificial Sequence
  Description of Artificial Sequence: Synthetic oligonucleotide
tacgacaggggcgtgaatactttttctcccg

SEQ ID NO: 121203 - DNA, 30 bp, Artificial Sequence
  Description of Artificial Sequence: Synthetic oligonucleotide
acgacaggggcgtgaatactttttctcccg

SEQ ID NO: 121204 - DNA, 29 bp, Artificial Sequence
  Description of Artificial Sequence: Synthetic oligonucleotide
cgacaggggcgtgaatactttttctcccg

SEQ ID NO: 121205 - DNA, 31 bp, Artificial Sequence
  Description of Artificial Sequence: Synthetic oligonucleotide
gacaggggcgtgaatactttttctcccgaag

SEQ ID NO: 121206 - DNA, 31 bp, Artificial Sequence
  Description of Artificial Sequence: Synthetic oligonucleotide
acaggggcgtgaatactttttctcccgaagg

SEQ ID NO: 121207 - DNA, 30 bp, Artificial Sequence
  Description of Artificial Sequence: Synthetic oligonucleotide
caggggcgtgaatactttttctcccgaagg

SEQ ID NO: 121208 - DNA, 32 bp, Artificial Sequence
  Description of Artificial Sequence: Synthetic oligonucleotide
aggggcgtgaatactttttctcccgaaggaag

SEQ ID NO: 121209 - DNA, 31 bp, Artificial Sequence
  Description of Artificial Sequence: Synthetic oligonucleotide
ggggcgtgaatactttttctcccgaaggaag

SEQ ID NO: 121210 - DNA, 38 bp, Artificial Sequence
  Description of Artificial Sequence: Synthetic oligonucleotide
gggcgtgaatactttttctcccgaaggaagattatttc

SEQ ID NO: 121211 - DNA, 40 bp, Artificial Sequence
  Description of Artificial Sequence: Synthetic oligonucleotide
ggcgtgaatactttttctcccgaaggaagattatttcaag

SEQ ID NO: 121212 - DNA, 41 bp, Artificial Sequence
  Description of Artificial Sequence: Synthetic oligonucleotide
gcgtgaatactttttctcccgaaggaagattatttcaagtg

SEQ ID NO: 121213 - DNA, 41 bp, Artificial Sequence
  Description of Artificial Sequence: Synthetic oligonucleotide
cgtgaatactttttctcccgaaggaagattatttcaagtgg

SEQ ID NO: 121214 - DNA, 46 bp, Artificial Sequence
  Description of Artificial Sequence: Synthetic oligonucleotide
gtgaatactttttctcccgaaggaagattatttcaagtggaatatg

SEQ ID NO: 121215 - DNA, 46 bp, Artificial Sequence
  Description of Artificial Sequence: Synthetic oligonucleotide
tgaatactttttctcccgaaggaagattatttcaagtggaatatgc

SEQ ID NO: 121216 - DNA, 45 bp, Artificial Sequence
  Description of Artificial Sequence: Synthetic oligonucleotide
gaatactttttctcccgaaggaagattatttcaagtggaatatgc

SEQ ID NO: 121217 - DNA, 45 bp, Artificial Sequence
  Description of Artificial Sequence: Synthetic oligonucleotide
aatactttttctcccgaaggaagattatttcaagtggaatatgcc

SEQ ID NO: 121218 - DNA, 44 bp, Artificial Sequence
  Description of Artificial Sequence: Synthetic oligonucleotide
atactttttctcccgaaggaagattatttcaagtggaatatgcc

SEQ ID NO: 121219 - DNA, 43 bp, Artificial Sequence
  Description of Artificial Sequence: Synthetic oligonucleotide
tactttttctcccgaaggaagattatttcaagtggaatatgcc

SEQ ID NO: 121220 - DNA, 42 bp, Artificial Sequence
  Description of Artificial Sequence: Synthetic oligonucleotide
actttttctcccgaaggaagattatttcaagtggaatatgcc

SEQ ID NO: 121221 - DNA, 41 bp, Artificial Sequence
  Description of Artificial Sequence: Synthetic oligonucleotide
ctttttctcccgaaggaagattatttcaagtggaatatgcc

SEQ ID NO: 121222 - DNA, 44 bp, Artificial Sequence
  Description of Artificial Sequence: Synthetic oligonucleotide
tttttctcccgaaggaagattatttcaagtggaatatgccattg

SEQ ID NO: 121223 - DNA, 43 bp, Artificial Sequence
  Description of Artificial Sequence: Synthetic oligonucleotide
ttttctcccgaaggaagattatttcaagtggaatatgccattg

SEQ ID NO: 121224 - DNA, 42 bp, Artificial Sequence
  Description of Artificial Sequence: Synthetic oligonucleotide
tttctcccgaaggaagattatttcaagtggaatatgccattg

SEQ ID NO: 121225 - DNA, 41 bp, Artificial Sequence
  Description of Artificial Sequence: Synthetic oligonucleotide
ttctcccgaaggaagattatttcaagtggaatatgccattg

SEQ ID NO: 121226 - DNA, 40 bp, Artificial Sequence
  Description of Artificial Sequence: Synthetic oligonucleotide
tctcccgaaggaagattatttcaagtggaatatgccattg

SEQ ID NO: 121227 - DNA, 39 bp, Artificial Sequence
  Description of Artificial Sequence: Synthetic oligonucleotide
ctcccgaaggaagattatttcaagtggaatatgccattg

SEQ ID NO: 121228 - DNA, 40 bp, Artificial Sequence
  Description of Artificial Sequence: Synthetic oligonucleotide
tcccgaaggaagattatttcaagtggaatatgccattgag

SEQ ID NO: 121229 - DNA, 39 bp, Artificial Sequence
  Description of Artificial Sequence: Synthetic oligonucleotide
cccgaaggaagattatttcaagtggaatatgccattgag

SEQ ID NO: 121230 - DNA, 39 bp, Artificial Sequence
  Description of Artificial Sequence: Synthetic oligonucleotide
ccgaaggaagattatttcaagtggaatatgccattgagg

SEQ ID NO: 121231 - DNA, 39 bp, Artificial Sequence
  Description of Artificial Sequence: Synthetic oligonucleotide
cgaaggaagattatttcaagtggaatatgccattgaggc

SEQ ID NO: 121232 - DNA, 42 bp, Artificial Sequence
  Description of Artificial Sequence: Synthetic oligonucleotide
gaaggaagattatttcaagtggaatatgccattgaggctatc

SEQ ID NO: 121233 - DNA, 44 bp, Artificial Sequence
  Description of Artificial Sequence: Synthetic oligonucleotide
aaggaagattatttcaagtggaatatgccattgaggctatcaag

SEQ ID NO: 121234 - DNA, 43 bp, Artificial Sequence
  Description of Artificial Sequence: Synthetic oligonucleotide
aggaagattatttcaagtggaatatgccattgaggctatcaag

SEQ ID NO: 121235 - DNA, 42 bp, Artificial Sequence
  Description of Artificial Sequence: Synthetic oligonucleotide
ggaagattatttcaagtggaatatgccattgaggctatcaag

SEQ ID NO: 121236 - DNA, 42 bp, Artificial Sequence
  Description of Artificial Sequence: Synthetic oligonucleotide
gaagattatttcaagtggaatatgccattgaggctatcaagc

SEQ ID NO: 121237 - DNA, 44 bp, Artificial Sequence
  Description of Artificial Sequence: Synthetic oligonucleotide
aagattatttcaagtggaatatgccattgaggctatcaagcttg

SEQ ID NO: 121238 - DNA, 43 bp, Artificial Sequence
  Description of Artificial Sequence: Synthetic oligonucleotide
agattatttcaagtggaatatgccattgaggctatcaagcttg

SEQ ID NO: 121239 - DNA, 42 bp, Artificial Sequence
  Description of Artificial Sequence: Synthetic oligonucleotide
gattatttcaagtggaatatgccattgaggctatcaagcttg

SEQ ID NO: 121240 - DNA, 42 bp, Artificial Sequence
  Description of Artificial Sequence: Synthetic oligonucleotide
attatttcaagtggaatatgccattgaggctatcaagcttgg

SEQ ID NO: 121241 - DNA, 41 bp, Artificial Sequence
  Description of Artificial Sequence: Synthetic oligonucleotide
ttatttcaagtggaatatgccattgaggctatcaagcttgg

SEQ ID NO: 121242 - DNA, 40 bp, Artificial Sequence
  Description of Artificial Sequence: Synthetic oligonucleotide
tatttcaagtggaatatgccattgaggctatcaagcttgg

SEQ ID NO: 121243 - DNA, 39 bp, Artificial Sequence
  Description of Artificial Sequence: Synthetic oligonucleotide
atttcaagtggaatatgccattgaggctatcaagcttgg

SEQ ID NO: 121244 - DNA, 38 bp, Artificial Sequence
  Description of Artificial Sequence: Synthetic oligonucleotide
tttcaagtggaatatgccattgaggctatcaagcttgg

SEQ ID NO: 121245 - DNA, 37 bp, Artificial Sequence
  Description of Artificial Sequence: Synthetic oligonucleotide
ttcaagtggaatatgccattgaggctatcaagcttgg

SEQ ID NO: 121246 - DNA, 36 bp, Artificial Sequence
  Description of Artificial Sequence: Synthetic oligonucleotide
tcaagtggaatatgccattgaggctatcaagcttgg

SEQ ID NO: 121247 - DNA, 35 bp, Artificial Sequence
  Description of Artificial Sequence: Synthetic oligonucleotide
caagtggaatatgccattgaggctatcaagcttgg

SEQ ID NO: 121248 - DNA, 37 bp, Artificial Sequence
  Description of Artificial Sequence: Synthetic oligonucleotide
aagtggaatatgccattgaggctatcaagcttggttc

SEQ ID NO: 121249 - DNA, 36 bp, Artificial Sequence
  Description of Artificial Sequence: Synthetic oligonucleotide
agtggaatatgccattgaggctatcaagcttggttc

SEQ ID NO: 121250 - DNA, 35 bp, Artificial Sequence
  Description of Artificial Sequence: Synthetic oligonucleotide
gtggaatatgccattgaggctatcaagcttggttc

SEQ ID NO: 121251 - DNA, 37 bp, Artificial Sequence
  Description of Artificial Sequence: Synthetic oligonucleotide
tggaatatgccattgaggctatcaagcttggttctac

SEQ ID NO: 121252 - DNA, 36 bp, Artificial Sequence
  Description of Artificial Sequence: Synthetic oligonucleotide
ggaatatgccattgaggctatcaagcttggttctac

SEQ ID NO: 121253 - DNA, 37 bp, Artificial Sequence
  Description of Artificial Sequence: Synthetic oligonucleotide
gaatatgccattgaggctatcaagcttggttctacag

SEQ ID NO: 121254 - DNA, 37 bp, Artificial Sequence
  Description of Artificial Sequence: Synthetic oligonucleotide
aatatgccattgaggctatcaagcttggttctacagc

SEQ ID NO: 121255 - DNA, 36 bp, Artificial Sequence
  Description of Artificial Sequence: Synthetic oligonucleotide
atatgccattgaggctatcaagcttggttctacagc

SEQ ID NO: 121256 - DNA, 35 bp, Artificial Sequence
  Description of Artificial Sequence: Synthetic oligonucleotide
tatgccattgaggctatcaagcttggttctacagc

SEQ ID NO: 121257 - DNA, 34 bp, Artificial Sequence
  Description of Artificial Sequence: Synthetic oligonucleotide
atgccattgaggctatcaagcttggttctacagc

SEQ ID NO: 121258 - DNA, 33 bp, Artificial Sequence
  Description of Artificial Sequence: Synthetic oligonucleotide
tgccattgaggctatcaagcttggttctacagc

SEQ ID NO: 121259 - DNA, 32 bp, Artificial Sequence
  Description of Artificial Sequence: Synthetic oligonucleotide
gccattgaggctatcaagcttggttctacagc

SEQ ID NO: 121260 - DNA, 32 bp, Artificial Sequence
  Description of Artificial Sequence: Synthetic oligonucleotide
ccattgaggctatcaagcttggttctacagcc

SEQ ID NO: 121261 - DNA, 35 bp, Artificial Sequence
  Description of Artificial Sequence: Synthetic oligonucleotide
cattgaggctatcaagcttggttctacagccattg

SEQ ID NO: 121262 - DNA, 35 bp, Artificial Sequence
  Description of Artificial Sequence: Synthetic oligonucleotide
attgaggctatcaagcttggttctacagccattgg

SEQ ID NO: 121263 - DNA, 34 bp, Artificial Sequence
  Description of Artificial Sequence: Synthetic oligonucleotide
ttgaggctatcaagcttggttctacagccattgg

SEQ ID NO: 121264 - DNA, 33 bp, Artificial Sequence
  Description of Artificial Sequence: Synthetic oligonucleotide
tgaggctatcaagcttggttctacagccattgg

SEQ ID NO: 121265 - DNA, 32 bp, Artificial Sequence
  Description of Artificial Sequence: Synthetic oligonucleotide
gaggctatcaagcttggttctacagccattgg

SEQ ID NO: 121266 - DNA, 32 bp, Artificial Sequence
  Description of Artificial Sequence: Synthetic oligonucleotide
aggctatcaagcttggttctacagccattggg

SEQ ID NO: 121267 - DNA, 31 bp, Artificial Sequence
  Description of Artificial Sequence: Synthetic oligonucleotide
ggctatcaagcttggttctacagccattggg

SEQ ID NO: 121268 - DNA, 33 bp, Artificial Sequence
  Description of Artificial Sequence: Synthetic oligonucleotide
gctatcaagcttggttctacagccattgggatc

SEQ ID NO: 121269 - DNA, 33 bp, Artificial Sequence
  Description of Artificial Sequence: Synthetic oligonucleotide
ctatcaagcttggttctacagccattgggatcc

SEQ ID NO: 121270 - DNA, 34 bp, Artificial Sequence
  Description of Artificial Sequence: Synthetic oligonucleotide
tatcaagcttggttctacagccattgggatccag

SEQ ID NO: 121271 - DNA, 33 bp, Artificial Sequence
  Description of Artificial Sequence: Synthetic oligonucleotide
atcaagcttggttctacagccattgggatccag

SEQ ID NO: 121272 - DNA, 32 bp, Artificial Sequence
  Description of Artificial Sequence: Synthetic oligonucleotide
tcaagcttggttctacagccattgggatccag

SEQ ID NO: 121273 - DNA, 31 bp, Artificial Sequence
  Description of Artificial Sequence: Synthetic oligonucleotide
caagcttggttctacagccattgggatccag

SEQ ID NO: 121274 - DNA, 32 bp, Artificial Sequence
  Description of Artificial Sequence: Synthetic oligonucleotide
aagcttggttctacagccattgggatccagac

SEQ ID NO: 121275 - DNA, 31 bp, Artificial Sequence
  Description of Artificial Sequence: Synthetic oligonucleotide
agcttggttctacagccattgggatccagac

SEQ ID NO: 121276 - DNA, 30 bp, Artificial Sequence
  Description of Artificial Sequence: Synthetic oligonucleotide
gcttggttctacagccattgggatccagac

SEQ ID NO: 121277 - DNA, 32 bp, Artificial Sequence
  Description of Artificial Sequence: Synthetic oligonucleotide
cttggttctacagccattgggatccagacatc

SEQ ID NO: 121278 - DNA, 33 bp, Artificial Sequence
  Description of Artificial Sequence: Synthetic oligonucleotide
ttggttctacagccattgggatccagacatcag

SEQ ID NO: 121279 - DNA, 32 bp, Artificial Sequence
  Description of Artificial Sequence: Synthetic oligonucleotide
tggttctacagccattgggatccagacatcag

SEQ ID NO: 121280 - DNA, 31 bp, Artificial Sequence
  Description of Artificial Sequence: Synthetic oligonucleotide
ggttctacagccattgggatccagacatcag

SEQ ID NO: 121281 - DNA, 32 bp, Artificial Sequence
  Description of Artificial Sequence: Synthetic oligonucleotide
gttctacagccattgggatccagacatcagag

SEQ ID NO: 121282 - DNA, 32 bp, Artificial Sequence
  Description of Artificial Sequence: Synthetic oligonucleotide
ttctacagccattgggatccagacatcagagg

SEQ ID NO: 121283 - DNA, 31 bp, Artificial Sequence
  Description of Artificial Sequence: Synthetic oligonucleotide
tctacagccattgggatccagacatcagagg

SEQ ID NO: 121284 - DNA, 30 bp, Artificial Sequence
  Description of Artificial Sequence: Synthetic oligonucleotide
ctacagccattgggatccagacatcagagg

SEQ ID NO: 121285 - DNA, 30 bp, Artificial Sequence
  Description of Artificial Sequence: Synthetic oligonucleotide
tacagccattgggatccagacatcagaggg

SEQ ID NO: 121286 - DNA, 29 bp, Artificial Sequence
  Description of Artificial Sequence: Synthetic oligonucleotide
acagccattgggatccagacatcagaggg

SEQ ID NO: 121287 - DNA, 28 bp, Artificial Sequence
  Description of Artificial Sequence: Synthetic oligonucleotide
cagccattgggatccagacatcagaggg

SEQ ID NO: 121288 - DNA, 29 bp, Artificial Sequence
  Description of Artificial Sequence: Synthetic oligonucleotide
agccattgggatccagacatcagagggtg

SEQ ID NO: 121289 - DNA, 28 bp, Artificial Sequence
  Description of Artificial Sequence: Synthetic oligonucleotide
gccattgggatccagacatcagagggtg

SEQ ID NO: 121290 - DNA, 29 bp, Artificial Sequence
  Description of Artificial Sequence: Synthetic oligonucleotide
ccattgggatccagacatcagagggtgtg

SEQ ID NO: 121291 - DNA, 30 bp, Artificial Sequence
  Description of Artificial Sequence: Synthetic oligonucleotide
cattgggatccagacatcagagggtgtgtg

SEQ ID NO: 121292 - DNA, 30 bp, Artificial Sequence
  Description of Artificial Sequence: Synthetic oligonucleotide
attgggatccagacatcagagggtgtgtgc

SEQ ID NO: 121293 - DNA, 29 bp, Artificial Sequence
  Description of Artificial Sequence: Synthetic oligonucleotide
ttgggatccagacatcagagggtgtgtgc

SEQ ID NO: 121294 - DNA, 28 bp, Artificial Sequence
  Description of Artificial Sequence: Synthetic oligonucleotide
tgggatccagacatcagagggtgtgtgc

SEQ ID NO: 121295 - DNA, 27 bp, Artificial Sequence
  Description of Artificial Sequence: Synthetic oligonucleotide
gggatccagacatcagagggtgtgtgc

SEQ ID NO: 121296 - DNA, 27 bp, Artificial Sequence
  Description of Artificial Sequence: Synthetic oligonucleotide
ggatccagacatcagagggtgtgtgcc

SEQ ID NO: 121297 - DNA, 29 bp, Artificial Sequence
  Description of Artificial Sequence: Synthetic oligonucleotide
gatccagacatcagagggtgtgtgcctag

SEQ ID NO: 121298 - DNA, 29 bp, Artificial Sequence
  Description of Artificial Sequence: Synthetic oligonucleotide
atccagacatcagagggtgtgtgcctagc

SEQ ID NO: 121299 - DNA, 28 bp, Artificial Sequence
  Description of Artificial Sequence: Synthetic oligonucleotide
tccagacatcagagggtgtgtgcctagc

SEQ ID NO: 121300 - DNA, 27 bp, Artificial Sequence
  Description of Artificial Sequence: Synthetic oligonucleotide
ccagacatcagagggtgtgtgcctagc

SEQ ID NO: 121301 - DNA, 28 bp, Artificial Sequence
  Description of Artificial Sequence: Synthetic oligonucleotide
cagacatcagagggtgtgtgcctagctg

SEQ ID NO: 121302 - DNA, 29 bp, Artificial Sequence
  Description of Artificial Sequence: Synthetic oligonucleotide
agacatcagagggtgtgtgcctagctgtg

SEQ ID NO: 121303 - DNA, 28 bp, Artificial Sequence
  Description of Artificial Sequence: Synthetic oligonucleotide
gacatcagagggtgtgtgcctagctgtg

SEQ ID NO: 121304 - DNA, 28 bp, Artificial Sequence
  Description of Artificial Sequence: Synthetic oligonucleotide
acatcagagggtgtgtgcctagctgtgg

SEQ ID NO: 121305 - DNA, 27 bp, Artificial Sequence
  Description of Artificial Sequence: Synthetic oligonucleotide
catcagagggtgtgtgcctagctgtgg

SEQ ID NO: 121306 - DNA, 28 bp, Artificial Sequence
  Description of Artificial Sequence: Synthetic oligonucleotide
atcagagggtgtgtgcctagctgtggag

SEQ ID NO: 121307 - DNA, 27 bp, Artificial Sequence
  Description of Artificial Sequence: Synthetic oligonucleotide
tcagagggtgtgtgcctagctgtggag

SEQ ID NO: 121308 - DNA, 27 bp, Artificial Sequence
  Description of Artificial Sequence: Synthetic oligonucleotide
cagagggtgtgtgcctagctgtggaga

SEQ ID NO: 121309 - DNA, 28 bp, Artificial Sequence
  Description of Artificial Sequence: Synthetic oligonucleotide
agagggtgtgtgcctagctgtggagaag

SEQ ID NO: 121310 - DNA, 27 bp, Artificial Sequence
  Description of Artificial Sequence: Synthetic oligonucleotide
gagggtgtgtgcctagctgtggagaag

SEQ ID NO: 121311 - DNA, 28 bp, Artificial Sequence
  Description of Artificial Sequence: Synthetic oligonucleotide
agggtgtgtgcctagctgtggagaagag

SEQ ID NO: 121312 - DNA, 27 bp, Artificial Sequence
  Description of Artificial Sequence: Synthetic oligonucleotide
gggtgtgtgcctagctgtggagaagag

SEQ ID NO: 121313 - DNA, 32 bp, Artificial Sequence
  Description of Artificial Sequence: Synthetic oligonucleotide
ggtgtgtgcctagctgtggagaagagaattac

SEQ ID NO: 121314 - DNA, 34 bp, Artificial Sequence
  Description of Artificial Sequence: Synthetic oligonucleotide
gtgtgtgcctagctgtggagaagagaattacttc

SEQ ID NO: 121315 - DNA, 34 bp, Artificial Sequence
  Description of Artificial Sequence: Synthetic oligonucleotide
tgtgtgcctagctgtggagaagagaattacttcc

SEQ ID NO: 121316 - DNA, 33 bp, Artificial Sequence
  Description of Artificial Sequence: Synthetic oligonucleotide
gtgtgcctagctgtggagaagagaattacttcc

SEQ ID NO: 121317 - DNA, 33 bp, Artificial Sequence
  Description of Artificial Sequence: Synthetic oligonucleotide
tgtgcctagctgtggagaagagaattacttccc

SEQ ID NO: 121318 - DNA, 32 bp, Artificial Sequence
  Description of Artificial Sequence: Synthetic oligonucleotide
gtgcctagctgtggagaagagaattacttccc

SEQ ID NO: 121319 - DNA, 32 bp, Artificial Sequence
  Description of Artificial Sequence: Synthetic oligonucleotide
tgcctagctgtggagaagagaattacttcccc

SEQ ID NO: 121320 - DNA, 31 bp, Artificial Sequence
  Description of Artificial Sequence: Synthetic oligonucleotide
gcctagctgtggagaagagaattacttcccc

SEQ ID NO: 121321 - DNA, 32 bp, Artificial Sequence
  Description of Artificial Sequence: Synthetic oligonucleotide
cctagctgtggagaagagaattacttccccac

SEQ ID NO: 121322 - DNA, 33 bp, Artificial Sequence
  Description of Artificial Sequence: Synthetic oligonucleotide
ctagctgtggagaagagaattacttccccactg

SEQ ID NO: 121323 - DNA, 35 bp, Artificial Sequence
  Description of Artificial Sequence: Synthetic oligonucleotide
tagctgtggagaagagaattacttccccactgatg

SEQ ID NO: 121324 - DNA, 34 bp, Artificial Sequence
  Description of Artificial Sequence: Synthetic oligonucleotide
agctgtggagaagagaattacttccccactgatg

SEQ ID NO: 121325 - DNA, 33 bp, Artificial Sequence
  Description of Artificial Sequence: Synthetic oligonucleotide
gctgtggagaagagaattacttccccactgatg

SEQ ID NO: 121326 - DNA, 33 bp, Artificial Sequence
  Description of Artificial Sequence: Synthetic oligonucleotide
ctgtggagaagagaattacttccccactgatgg

SEQ ID NO: 121327 - DNA, 34 bp, Artificial Sequence
  Description of Artificial Sequence: Synthetic oligonucleotide
tgtggagaagagaattacttccccactgatggag

SEQ ID NO: 121328 - DNA, 33 bp, Artificial Sequence
  Description of Artificial Sequence: Synthetic oligonucleotide
gtggagaagagaattacttccccactgatggag

SEQ ID NO: 121329 - DNA, 33 bp, Artificial Sequence
  Description of Artificial Sequence: Synthetic oligonucleotide
tggagaagagaattacttccccactgatggagc

SEQ ID NO: 121330 - DNA, 32 bp, Artificial Sequence
  Description of Artificial Sequence: Synthetic oligonucleotide
ggagaagagaattacttccccactgatggagc

SEQ ID NO: 121331 - DNA, 32 bp, Artificial Sequence
  Description of Artificial Sequence: Synthetic oligonucleotide
gagaagagaattacttccccactgatggagcc

SEQ ID NO: 121332 - DNA, 32 bp, Artificial Sequence
  Description of Artificial Sequence: Synthetic oligonucleotide
agaagagaattacttccccactgatggagccc

SEQ ID NO: 121333 - DNA, 31 bp, Artificial Sequence
  Description of Artificial Sequence: Synthetic oligonucleotide
gaagagaattacttccccactgatggagccc

SEQ ID NO: 121334 - DNA, 32 bp, Artificial Sequence
  Description of Artificial Sequence: Synthetic oligonucleotide
aagagaattacttccccactgatggagcccag

SEQ ID NO: 121335 - DNA, 31 bp, Artificial Sequence
  Description of Artificial Sequence: Synthetic oligonucleotide
agagaattacttccccactgatggagcccag

SEQ ID NO: 121336 - DNA, 30 bp, Artificial Sequence
  Description of Artificial Sequence: Synthetic oligonucleotide
gagaattacttccccactgatggagcccag

SEQ ID NO: 121337 - DNA, 30 bp, Artificial Sequence
  Description of Artificial Sequence: Synthetic oligonucleotide
agaattacttccccactgatggagcccagc

SEQ ID NO: 121338 - DNA, 29 bp, Artificial Sequence
  Description of Artificial Sequence: Synthetic oligonucleotide
gaattacttccccactgatggagcccagc

SEQ ID NO: 121339 - DNA, 30 bp, Artificial Sequence
  Description of Artificial Sequence: Synthetic oligonucleotide
aattacttccccactgatggagcccagcag

SEQ ID NO: 121340 - DNA, 29 bp, Artificial Sequence
  Description of Artificial Sequence: Synthetic oligonucleotide
attacttccccactgatggagcccagcag

SEQ ID NO: 121341 - DNA, 28 bp, Artificial Sequence
  Description of Artificial Sequence: Synthetic oligonucleotide
ttacttccccactgatggagcccagcag

SEQ ID NO: 121342 - DNA, 27 bp, Artificial Sequence
  Description of Artificial Sequence: Synthetic oligonucleotide
tacttccccactgatggagcccagcag

SEQ ID NO: 121343 - DNA, 26 bp, Artificial Sequence
  Description of Artificial Sequence: Synthetic oligonucleotide
acttccccactgatggagcccagcag

SEQ ID NO: 121344 - DNA, 25 bp, Artificial Sequence
  Description of Artificial Sequence: Synthetic oligonucleotide
cttccccactgatggagcccagcag

SEQ ID NO: 121345 - DNA, 27 bp, Artificial Sequence
  Description of Artificial Sequence: Synthetic oligonucleotide
ttccccactgatggagcccagcagcat

SEQ ID NO: 121346 - DNA, 27 bp, Artificial Sequence
  Description of Artificial Sequence: Synthetic oligonucleotide
tccccactgatggagcccagcagcatt

SEQ ID NO: 121347 - DNA, 26 bp, Artificial Sequence
  Description of Artificial Sequence: Synthetic oligonucleotide
ccccactgatggagcccagcagcatt

SEQ ID NO: 121348 - DNA, 27 bp, Artificial Sequence
  Description of Artificial Sequence: Synthetic oligonucleotide
cccactgatggagcccagcagcattga

SEQ ID NO: 121349 - DNA, 27 bp, Artificial Sequence
  Description of Artificial Sequence: Synthetic oligonucleotide
ccactgatggagcccagcagcattgag

SEQ ID NO: 121350 - DNA, 33 bp, Artificial Sequence
  Description of Artificial Sequence: Synthetic oligonucleotide
cactgatggagcccagcagcattgagaaaattg

SEQ ID NO: 121351 - DNA, 35 bp, Artificial Sequence
  Description of Artificial Sequence: Synthetic oligonucleotide
actgatggagcccagcagcattgagaaaattgtag

SEQ ID NO: 121352 - DNA, 34 bp, Artificial Sequence
  Description of Artificial Sequence: Synthetic oligonucleotide
ctgatggagcccagcagcattgagaaaattgtag

SEQ ID NO: 121353 - DNA, 35 bp, Artificial Sequence
  Description of Artificial Sequence: Synthetic oligonucleotide
tgatggagcccagcagcattgagaaaattgtagag

SEQ ID NO: 121354 - DNA, 34 bp, Artificial Sequence
  Description of Artificial Sequence: Synthetic oligonucleotide
gatggagcccagcagcattgagaaaattgtagag

SEQ ID NO: 121355 - DNA, 37 bp, Artificial Sequence
  Description of Artificial Sequence: Synthetic oligonucleotide
atggagcccagcagcattgagaaaattgtagagattg

SEQ ID NO: 121356 - DNA, 36 bp, Artificial Sequence
  Description of Artificial Sequence: Synthetic oligonucleotide
tggagcccagcagcattgagaaaattgtagagattg

SEQ ID NO: 121357 - DNA, 35 bp, Artificial Sequence
  Description of Artificial Sequence: Synthetic oligonucleotide
ggagcccagcagcattgagaaaattgtagagattg

SEQ ID NO: 121358 - DNA, 37 bp, Artificial Sequence
  Description of Artificial Sequence: Synthetic oligonucleotide
gagcccagcagcattgagaaaattgtagagattgatg

SEQ ID NO: 121359 - DNA, 37 bp, Artificial Sequence
  Description of Artificial Sequence: Synthetic oligonucleotide
agcccagcagcattgagaaaattgtagagattgatgc

SEQ ID NO: 121360 - DNA, 36 bp, Artificial Sequence
  Description of Artificial Sequence: Synthetic oligonucleotide
gcccagcagcattgagaaaattgtagagattgatgc

SEQ ID NO: 121361 - DNA, 37 bp, Artificial Sequence
  Description of Artificial Sequence: Synthetic oligonucleotide
cccagcagcattgagaaaattgtagagattgatgctc

SEQ ID NO: 121362 - DNA, 38 bp, Artificial Sequence
  Description of Artificial Sequence: Synthetic oligonucleotide
ccagcagcattgagaaaattgtagagattgatgctcac

SEQ ID NO: 121363 - DNA, 41 bp, Artificial Sequence
  Description of Artificial Sequence: Synthetic oligonucleotide
cagcagcattgagaaaattgtagagattgatgctcacatag

SEQ ID NO: 121364 - DNA, 41 bp, Artificial Sequence
  Description of Artificial Sequence: Synthetic oligonucleotide
agcagcattgagaaaattgtagagattgatgctcacatagg

SEQ ID NO: 121365 - DNA, 40 bp, Artificial Sequence
  Description of Artificial Sequence: Synthetic oligonucleotide
gcagcattgagaaaattgtagagattgatgctcacatagg

SEQ ID NO: 121366 - DNA, 42 bp, Artificial Sequence
  Description of Artificial Sequence: Synthetic oligonucleotide
cagcattgagaaaattgtagagattgatgctcacataggttg

SEQ ID NO: 121367 - DNA, 43 bp, Artificial Sequence
  Description of Artificial Sequence: Synthetic oligonucleotide
agcattgagaaaattgtagagattgatgctcacataggttgtg

SEQ ID NO: 121368 - DNA, 42 bp, Artificial Sequence
  Description of Artificial Sequence: Synthetic oligonucleotide
gcattgagaaaattgtagagattgatgctcacataggttgtg

SEQ ID NO: 121369 - DNA, 42 bp, Artificial Sequence
  Description of Artificial Sequence: Synthetic oligonucleotide
cattgagaaaattgtagagattgatgctcacataggttgtgc

SEQ ID NO: 121370 - DNA, 42 bp, Artificial Sequence
  Description of Artificial Sequence: Synthetic oligonucleotide
attgagaaaattgtagagattgatgctcacataggttgtgcc

SEQ ID NO: 121371 - DNA, 41 bp, Artificial Sequence
  Description of Artificial Sequence: Synthetic oligonucleotide
ttgagaaaattgtagagattgatgctcacataggttgtgcc

SEQ ID NO: 121372 - DNA, 40 bp, Artificial Sequence
  Description of Artificial Sequence: Synthetic oligonucleotide
tgagaaaattgtagagattgatgctcacataggttgtgcc

SEQ ID NO: 121373 - DNA, 39 bp, Artificial Sequence
  Description of Artificial Sequence: Synthetic oligonucleotide
gagaaaattgtagagattgatgctcacataggttgtgcc

SEQ ID NO: 121374 - DNA, 41 bp, Artificial Sequence
  Description of Artificial Sequence: Synthetic oligonucleotide
agaaaattgtagagattgatgctcacataggttgtgccatg

SEQ ID NO: 121375 - DNA, 40 bp, Artificial Sequence
  Description of Artificial Sequence: Synthetic oligonucleotide
gaaaattgtagagattgatgctcacataggttgtgccatg

SEQ ID NO: 121376 - DNA, 41 bp, Artificial Sequence
  Description of Artificial Sequence: Synthetic oligonucleotide
aaaattgtagagattgatgctcacataggttgtgccatgag

SEQ ID NO: 121377 - DNA, 40 bp, Artificial Sequence
  Description of Artificial Sequence: Synthetic oligonucleotide
aaattgtagagattgatgctcacataggttgtgccatgag

SEQ ID NO: 121378 - DNA, 39 bp, Artificial Sequence
  Description of Artificial Sequence: Synthetic oligonucleotide
aattgtagagattgatgctcacataggttgtgccatgag

SEQ ID NO: 121379 - DNA, 38 bp, Artificial Sequence
  Description of Artificial Sequence: Synthetic oligonucleotide
attgtagagattgatgctcacataggttgtgccatgag

SEQ ID NO: 121380 - DNA, 37 bp, Artificial Sequence
  Description of Artificial Sequence: Synthetic oligonucleotide
ttgtagagattgatgctcacataggttgtgccatgag

SEQ ID NO: 121381 - DNA, 36 bp, Artificial Sequence
  Description of Artificial Sequence: Synthetic oligonucleotide
tgtagagattgatgctcacataggttgtgccatgag

SEQ ID NO: 121382 - DNA, 35 bp, Artificial Sequence
  Description of Artificial Sequence: Synthetic oligonucleotide
gtagagattgatgctcacataggttgtgccatgag

SEQ ID NO: 121383 - DNA, 36 bp, Artificial Sequence
  Description of Artificial Sequence: Synthetic oligonucleotide
tagagattgatgctcacataggttgtgccatgagtg

SEQ ID NO: 121384 - DNA, 35 bp, Artificial Sequence
  Description of Artificial Sequence: Synthetic oligonucleotide
agagattgatgctcacataggttgtgccatgagtg

SEQ ID NO: 121385 - DNA, 34 bp, Artificial Sequence
  Description of Artificial Sequence: Synthetic oligonucleotide
gagattgatgctcacataggttgtgccatgagtg

SEQ ID NO: 121386 - DNA, 34 bp, Artificial Sequence
  Description of Artificial Sequence: Synthetic oligonucleotide
agattgatgctcacataggttgtgccatgagtgg

SEQ ID NO: 121387 - DNA, 33 bp, Artificial Sequence
  Description of Artificial Sequence: Synthetic oligonucleotide
gattgatgctcacataggttgtgccatgagtgg

SEQ ID NO: 121388 - DNA, 33 bp, Artificial Sequence
  Description of Artificial Sequence: Synthetic oligonucleotide
attgatgctcacataggttgtgccatgagtggg

SEQ ID NO: 121389 - DNA, 32 bp, Artificial Sequence
  Description of Artificial Sequence: Synthetic oligonucleotide
ttgatgctcacataggttgtgccatgagtggg

SEQ ID NO: 121390 - DNA, 31 bp, Artificial Sequence
  Description of Artificial Sequence: Synthetic oligonucleotide
tgatgctcacataggttgtgccatgagtggg

SEQ ID NO: 121391 - DNA, 30 bp, Artificial Sequence
  Description of Artificial Sequence: Synthetic oligonucleotide
gatgctcacataggttgtgccatgagtggg

SEQ ID NO: 121392 - DNA, 30 bp, Artificial Sequence
  Description of Artificial Sequence: Synthetic oligonucleotide
atgctcacataggttgtgccatgagtgggc

SEQ ID NO: 121393 - DNA, 29 bp, Artificial Sequence
  Description of Artificial Sequence: Synthetic oligonucleotide
tgctcacataggttgtgccatgagtgggc

SEQ ID NO: 121394 - DNA, 28 bp, Artificial Sequence
  Description of Artificial Sequence: Synthetic oligonucleotide
gctcacataggttgtgccatgagtgggc

SEQ ID NO: 121395 - DNA, 33 bp, Artificial Sequence
  Description of Artificial Sequence: Synthetic oligonucleotide
ctcacataggttgtgccatgagtgggctaattg

SEQ ID NO: 121396 - DNA, 33 bp, Artificial Sequence
  Description of Artificial Sequence: Synthetic oligonucleotide
tcacataggttgtgccatgagtgggctaattgc

SEQ ID NO: 121397 - DNA, 32 bp, Artificial Sequence
  Description of Artificial Sequence: Synthetic oligonucleotide
cacataggttgtgccatgagtgggctaattgc

SEQ ID NO: 121398 - DNA, 33 bp, Artificial Sequence
  Description of Artificial Sequence: Synthetic oligonucleotide
acataggttgtgccatgagtgggctaattgctg

SEQ ID NO: 121399 - DNA, 32 bp, Artificial Sequence
  Description of Artificial Sequence: Synthetic oligonucleotide
cataggttgtgccatgagtgggctaattgctg

SEQ ID NO: 121400 - DNA, 34 bp, Artificial Sequence
  Description of Artificial Sequence: Synthetic oligonucleotide
ataggttgtgccatgagtgggctaattgctgatg

SEQ ID NO: 121401 - DNA, 33 bp, Artificial Sequence
  Description of Artificial Sequence: Synthetic oligonucleotide
taggttgtgccatgagtgggctaattgctgatg

SEQ ID NO: 121402 - DNA, 32 bp, Artificial Sequence
  Description of Artificial Sequence: Synthetic oligonucleotide
aggttgtgccatgagtgggctaattgctgatg

SEQ ID NO: 121403 - DNA, 31 bp, Artificial Sequence
  Description of Artificial Sequence: Synthetic oligonucleotide
ggttgtgccatgagtgggctaattgctgatg

SEQ ID NO: 121404 - DNA, 31 bp, Artificial Sequence
  Description of Artificial Sequence: Synthetic oligonucleotide
gttgtgccatgagtgggctaattgctgatgc

SEQ ID NO: 121405 - DNA, 34 bp, Artificial Sequence
  Description of Artificial Sequence: Synthetic oligonucleotide
ttgtgccatgagtgggctaattgctgatgctaag

SEQ ID NO: 121406 - DNA, 33 bp, Artificial Sequence
  Description of Artificial Sequence: Synthetic oligonucleotide
tgtgccatgagtgggctaattgctgatgctaag

SEQ ID NO: 121407 - DNA, 32 bp, Artificial Sequence
  Description of Artificial Sequence: Synthetic oligonucleotide
gtgccatgagtgggctaattgctgatgctaag

SEQ ID NO: 121408 - DNA, 33 bp, Artificial Sequence
  Description of Artificial Sequence: Synthetic oligonucleotide
tgccatgagtgggctaattgctgatgctaagac

SEQ ID NO: 121409 - DNA, 32 bp, Artificial Sequence
  Description of Artificial Sequence: Synthetic oligonucleotide
gccatgagtgggctaattgctgatgctaagac

SEQ ID NO: 121410 - DNA, 39 bp, Artificial Sequence
  Description of Artificial Sequence: Synthetic oligonucleotide
ccatgagtgggctaattgctgatgctaagactttaattg

SEQ ID NO: 121411 - DNA, 44 bp, Artificial Sequence
  Description of Artificial Sequence: Synthetic oligonucleotide
catgagtgggctaattgctgatgctaagactttaattgataaag

SEQ ID NO: 121412 - DNA, 44 bp, Artificial Sequence
  Description of Artificial Sequence: Synthetic oligonucleotide
atgagtgggctaattgctgatgctaagactttaattgataaagc

SEQ ID NO: 121413 - DNA, 43 bp, Artificial Sequence
  Description of Artificial Sequence: Synthetic oligonucleotide
tgagtgggctaattgctgatgctaagactttaattgataaagc

SEQ ID NO: 121414 - DNA, 42 bp, Artificial Sequence
  Description of Artificial Sequence: Synthetic oligonucleotide
gagtgggctaattgctgatgctaagactttaattgataaagc

SEQ ID NO: 121415 - DNA, 42 bp, Artificial Sequence
  Description of Artificial Sequence: Synthetic oligonucleotide
agtgggctaattgctgatgctaagactttaattgataaagcc

SEQ ID NO: 121416 - DNA, 41 bp, Artificial Sequence
  Description of Artificial Sequence: Synthetic oligonucleotide
gtgggctaattgctgatgctaagactttaattgataaagcc

SEQ ID NO: 121417 - DNA, 42 bp, Artificial Sequence
  Description of Artificial Sequence: Synthetic oligonucleotide
tgggctaattgctgatgctaagactttaattgataaagccag

SEQ ID NO: 121418 - DNA, 41 bp, Artificial Sequence
  Description of Artificial Sequence: Synthetic oligonucleotide
gggctaattgctgatgctaagactttaattgataaagccag

SEQ ID NO: 121419 - DNA, 42 bp, Artificial Sequence
  Description of Artificial Sequence: Synthetic oligonucleotide
ggctaattgctgatgctaagactttaattgataaagccagag

SEQ ID NO: 121420 - DNA, 43 bp, Artificial Sequence
  Description of Artificial Sequence: Synthetic oligonucleotide
gctaattgctgatgctaagactttaattgataaagccagagtg

SEQ ID NO: 121421 - DNA, 43 bp, Artificial Sequence
  Description of Artificial Sequence: Synthetic oligonucleotide
ctaattgctgatgctaagactttaattgataaagccagagtgg

SEQ ID NO: 121422 - DNA, 44 bp, Artificial Sequence
  Description of Artificial Sequence: Synthetic oligonucleotide
taattgctgatgctaagactttaattgataaagccagagtggag

SEQ ID NO: 121423 - DNA, 43 bp, Artificial Sequence
  Description of Artificial Sequence: Synthetic oligonucleotide
aattgctgatgctaagactttaattgataaagccagagtggag

SEQ ID NO: 121424 - DNA, 42 bp, Artificial Sequence
  Description of Artificial Sequence: Synthetic oligonucleotide
attgctgatgctaagactttaattgataaagccagagtggag

SEQ ID NO: 121425 - DNA, 41 bp, Artificial Sequence
  Description of Artificial Sequence: Synthetic oligonucleotide
ttgctgatgctaagactttaattgataaagccagagtggag

SEQ ID NO: 121426 - DNA, 40 bp, Artificial Sequence
  Description of Artificial Sequence: Synthetic oligonucleotide
tgctgatgctaagactttaattgataaagccagagtggag

SEQ ID NO: 121427 - DNA, 39 bp, Artificial Sequence
  Description of Artificial Sequence: Synthetic oligonucleotide
gctgatgctaagactttaattgataaagccagagtggag

SEQ ID NO: 121428 - DNA, 40 bp, Artificial Sequence
  Description of Artificial Sequence: Synthetic oligonucleotide
ctgatgctaagactttaattgataaagccagagtggagac

SEQ ID NO: 121429 - DNA, 41 bp, Artificial Sequence
  Description of Artificial Sequence: Synthetic oligonucleotide
tgatgctaagactttaattgataaagccagagtggagacac

SEQ ID NO: 121430 - DNA, 40 bp, Artificial Sequence
  Description of Artificial Sequence: Synthetic oligonucleotide
gatgctaagactttaattgataaagccagagtggagacac

SEQ ID NO: 121431 - DNA, 41 bp, Artificial Sequence
  Description of Artificial Sequence: Synthetic oligonucleotide
atgctaagactttaattgataaagccagagtggagacacag

SEQ ID NO: 121432 - DNA, 40 bp, Artificial Sequence
  Description of Artificial Sequence: Synthetic oligonucleotide
tgctaagactttaattgataaagccagagtggagacacag

SEQ ID NO: 121433 - DNA, 39 bp, Artificial Sequence
  Description of Artificial Sequence: Synthetic oligonucleotide
gctaagactttaattgataaagccagagtggagacacag

SEQ ID NO: 121434 - DNA, 41 bp, Artificial Sequence
  Description of Artificial Sequence: Synthetic oligonucleotide
ctaagactttaattgataaagccagagtggagacacagaac

SEQ ID NO: 121435 - DNA, 41 bp, Artificial Sequence
  Description of Artificial Sequence: Synthetic oligonucleotide
taagactttaattgataaagccagagtggagacacagaacc

SEQ ID NO: 121436 - DNA, 40 bp, Artificial Sequence
  Description of Artificial Sequence: Synthetic oligonucleotide
aagactttaattgataaagccagagtggagacacagaacc

SEQ ID NO: 121437 - DNA, 39 bp, Artificial Sequence
  Description of Artificial Sequence: Synthetic oligonucleotide
agactttaattgataaagccagagtggagacacagaacc

SEQ ID NO: 121438 - DNA, 38 bp, Artificial Sequence
  Description of Artificial Sequence: Synthetic oligonucleotide
gactttaattgataaagccagagtggagacacagaacc

SEQ ID NO: 121439 - DNA, 39 bp, Artificial Sequence
  Description of Artificial Sequence: Synthetic oligonucleotide
actttaattgataaagccagagtggagacacagaaccac

SEQ ID NO: 121440 - DNA, 38 bp, Artificial Sequence
  Description of Artificial Sequence: Synthetic oligonucleotide
ctttaattgataaagccagagtggagacacagaaccac

SEQ ID NO: 121441 - DNA, 39 bp, Artificial Sequence
  Description of Artificial Sequence: Synthetic oligonucleotide
tttaattgataaagccagagtggagacacagaaccactg

SEQ ID NO: 121442 - DNA, 38 bp, Artificial Sequence
  Description of Artificial Sequence: Synthetic oligonucleotide
ttaattgataaagccagagtggagacacagaaccactg

SEQ ID NO: 121443 - DNA, 37 bp, Artificial Sequence
  Description of Artificial Sequence: Synthetic oligonucleotide
taattgataaagccagagtggagacacagaaccactg

SEQ ID NO: 121444 - DNA, 36 bp, Artificial Sequence
  Description of Artificial Sequence: Synthetic oligonucleotide
aattgataaagccagagtggagacacagaaccactg

SEQ ID NO: 121445 - DNA, 35 bp, Artificial Sequence
  Description of Artificial Sequence: Synthetic oligonucleotide
attgataaagccagagtggagacacagaaccactg

SEQ ID NO: 121446 - DNA, 34 bp, Artificial Sequence
  Description of Artificial Sequence: Synthetic oligonucleotide
ttgataaagccagagtggagacacagaaccactg

SEQ ID NO: 121447 - DNA, 33 bp, Artificial Sequence
  Description of Artificial Sequence: Synthetic oligonucleotide
tgataaagccagagtggagacacagaaccactg

SEQ ID NO: 121448 - DNA, 32 bp, Artificial Sequence
  Description of Artificial Sequence: Synthetic oligonucleotide
gataaagccagagtggagacacagaaccactg

SEQ ID NO: 121449 - DNA, 32 bp, Artificial Sequence
  Description of Artificial Sequence: Synthetic oligonucleotide
ataaagccagagtggagacacagaaccactgg

SEQ ID NO: 121450 - DNA, 31 bp, Artificial Sequence
  Description of Artificial Sequence: Synthetic oligonucleotide
taaagccagagtggagacacagaaccactgg

SEQ ID NO: 121451 - DNA, 30 bp, Artificial Sequence
  Description of Artificial Sequence: Synthetic oligonucleotide
aaagccagagtggagacacagaaccactgg

SEQ ID NO: 121452 - DNA, 29 bp, Artificial Sequence
  Description of Artificial Sequence: Synthetic oligonucleotide
aagccagagtggagacacagaaccactgg

SEQ ID NO: 121453 - DNA, 28 bp, Artificial Sequence
  Description of Artificial Sequence: Synthetic oligonucleotide
agccagagtggagacacagaaccactgg

SEQ ID NO: 121454 - DNA, 27 bp, Artificial Sequence
  Description of Artificial Sequence: Synthetic oligonucleotide
gccagagtggagacacagaaccactgg

SEQ ID NO: 121455 - DNA, 29 bp, Artificial Sequence
  Description of Artificial Sequence: Synthetic oligonucleotide
ccagagtggagacacagaaccactggttc

SEQ ID NO: 121456 - DNA, 30 bp, Artificial Sequence
  Description of Artificial Sequence: Synthetic oligonucleotide
cagagtggagacacagaaccactggttcac

SEQ ID NO: 121457 - DNA, 30 bp, Artificial Sequence
  Description of Artificial Sequence: Synthetic oligonucleotide
agagtggagacacagaaccactggttcacc

SEQ ID NO: 121458 - DNA, 29 bp, Artificial Sequence
  Description of Artificial Sequence: Synthetic oligonucleotide
gagtggagacacagaaccactggttcacc

SEQ ID NO: 121459 - DNA, 31 bp, Artificial Sequence
  Description of Artificial Sequence: Synthetic oligonucleotide
agtggagacacagaaccactggttcacctac

SEQ ID NO: 121460 - DNA, 30 bp, Artificial Sequence
  Description of Artificial Sequence: Synthetic oligonucleotide
gtggagacacagaaccactggttcacctac

SEQ ID NO: 121461 - DNA, 33 bp, Artificial Sequence
  Description of Artificial Sequence: Synthetic oligonucleotide
tggagacacagaaccactggttcacctacaatg

SEQ ID NO: 121462 - DNA, 32 bp, Artificial Sequence
  Description of Artificial Sequence: Synthetic oligonucleotide
ggagacacagaaccactggttcacctacaatg

SEQ ID NO: 121463 - DNA, 33 bp, Artificial Sequence
  Description of Artificial Sequence: Synthetic oligonucleotide
gagacacagaaccactggttcacctacaatgag

SEQ ID NO: 121464 - DNA, 34 bp, Artificial Sequence
  Description of Artificial Sequence: Synthetic oligonucleotide
agacacagaaccactggttcacctacaatgagac

SEQ ID NO: 121465 - DNA, 33 bp, Artificial Sequence
  Description of Artificial Sequence: Synthetic oligonucleotide
gacacagaaccactggttcacctacaatgagac

SEQ ID NO: 121466 - DNA, 36 bp, Artificial Sequence
  Description of Artificial Sequence: Synthetic oligonucleotide
acacagaaccactggttcacctacaatgagacaatg

SEQ ID NO: 121467 - DNA, 35 bp, Artificial Sequence
  Description of Artificial Sequence: Synthetic oligonucleotide
cacagaaccactggttcacctacaatgagacaatg

SEQ ID NO: 121468 - DNA, 36 bp, Artificial Sequence
  Description of Artificial Sequence: Synthetic oligonucleotide
acagaaccactggttcacctacaatgagacaatgac

SEQ ID NO: 121469 - DNA, 35 bp, Artificial Sequence
  Description of Artificial Sequence: Synthetic oligonucleotide
cagaaccactggttcacctacaatgagacaatgac

SEQ ID NO: 121470 - DNA, 36 bp, Artificial Sequence
  Description of Artificial Sequence: Synthetic oligonucleotide
agaaccactggttcacctacaatgagacaatgacag

SEQ ID NO: 121471 - DNA, 35 bp, Artificial Sequence
  Description of Artificial Sequence: Synthetic oligonucleotide
gaaccactggttcacctacaatgagacaatgacag

SEQ ID NO: 121472 - DNA, 36 bp, Artificial Sequence
  Description of Artificial Sequence: Synthetic oligonucleotide
aaccactggttcacctacaatgagacaatgacagtg

SEQ ID NO: 121473 - DNA, 35 bp, Artificial Sequence
  Description of Artificial Sequence: Synthetic oligonucleotide
accactggttcacctacaatgagacaatgacagtg

SEQ ID NO: 121474 - DNA, 34 bp, Artificial Sequence
  Description of Artificial Sequence: Synthetic oligonucleotide
ccactggttcacctacaatgagacaatgacagtg

SEQ ID NO: 121475 - DNA, 34 bp, Artificial Sequence
  Description of Artificial Sequence: Synthetic oligonucleotide
cactggttcacctacaatgagacaatgacagtgg

SEQ ID NO: 121476 - DNA, 35 bp, Artificial Sequence
  Description of Artificial Sequence: Synthetic oligonucleotide
actggttcacctacaatgagacaatgacagtggag

SEQ ID NO: 121477 - DNA, 34 bp, Artificial Sequence
  Description of Artificial Sequence: Synthetic oligonucleotide
ctggttcacctacaatgagacaatgacagtggag

SEQ ID NO: 121478 - DNA, 35 bp, Artificial Sequence
  Description of Artificial Sequence: Synthetic oligonucleotide
tggttcacctacaatgagacaatgacagtggagag

SEQ ID NO: 121479 - DNA, 34 bp, Artificial Sequence
  Description of Artificial Sequence: Synthetic oligonucleotide
ggttcacctacaatgagacaatgacagtggagag

SEQ ID NO: 121480 - DNA, 35 bp, Artificial Sequence
  Description of Artificial Sequence: Synthetic oligonucleotide
gttcacctacaatgagacaatgacagtggagagtg

SEQ ID NO: 121481 - DNA, 36 bp, Artificial Sequence
  Description of Artificial Sequence: Synthetic oligonucleotide
ttcacctacaatgagacaatgacagtggagagtgtg

SEQ ID NO: 121482 - DNA, 35 bp, Artificial Sequence
  Description of Artificial Sequence: Synthetic oligonucleotide
tcacctacaatgagacaatgacagtggagagtgtg

SEQ ID NO: 121483 - DNA, 34 bp, Artificial Sequence
  Description of Artificial Sequence: Synthetic oligonucleotide
cacctacaatgagacaatgacagtggagagtgtg

SEQ ID NO: 121484 - DNA, 35 bp, Artificial Sequence
  Description of Artificial Sequence: Synthetic oligonucleotide
acctacaatgagacaatgacagtggagagtgtgac

SEQ ID NO: 121485 - DNA, 34 bp, Artificial Sequence
  Description of Artificial Sequence: Synthetic oligonucleotide
cctacaatgagacaatgacagtggagagtgtgac

SEQ ID NO: 121486 - DNA, 34 bp, Artificial Sequence
  Description of Artificial Sequence: Synthetic oligonucleotide
ctacaatgagacaatgacagtggagagtgtgacc

SEQ ID NO: 121487 - DNA, 34 bp, Artificial Sequence
  Description of Artificial Sequence: Synthetic oligonucleotide
tacaatgagacaatgacagtggagagtgtgaccc

SEQ ID NO: 121488 - DNA, 33 bp, Artificial Sequence
  Description of Artificial Sequence: Synthetic oligonucleotide
acaatgagacaatgacagtggagagtgtgaccc

SEQ ID NO: 121489 - DNA, 32 bp, Artificial Sequence
  Description of Artificial Sequence: Synthetic oligonucleotide
caatgagacaatgacagtggagagtgtgaccc

SEQ ID NO: 121490 - DNA, 34 bp, Artificial Sequence
  Description of Artificial Sequence: Synthetic oligonucleotide
aatgagacaatgacagtggagagtgtgacccaag

SEQ ID NO: 121491 - DNA, 33 bp, Artificial Sequence
  Description of Artificial Sequence: Synthetic oligonucleotide
atgagacaatgacagtggagagtgtgacccaag

SEQ ID NO: 121492 - DNA, 32 bp, Artificial Sequence
  Description of Artificial Sequence: Synthetic oligonucleotide
tgagacaatgacagtggagagtgtgacccaag

SEQ ID NO: 121493 - DNA, 31 bp, Artificial Sequence
  Description of Artificial Sequence: Synthetic oligonucleotide
gagacaatgacagtggagagtgtgacccaag

SEQ ID NO: 121494 - DNA, 31 bp, Artificial Sequence
  Description of Artificial Sequence: Synthetic oligonucleotide
agacaatgacagtggagagtgtgacccaagc

SEQ ID NO: 121495 - DNA, 30 bp, Artificial Sequence
  Description of Artificial Sequence: Synthetic oligonucleotide
gacaatgacagtggagagtgtgacccaagc

SEQ ID NO: 121496 - DNA, 31 bp, Artificial Sequence
  Description of Artificial Sequence: Synthetic oligonucleotide
acaatgacagtggagagtgtgacccaagctg

SEQ ID NO: 121497 - DNA, 30 bp, Artificial Sequence
  Description of Artificial Sequence: Synthetic oligonucleotide
caatgacagtggagagtgtgacccaagctg

SEQ ID NO: 121498 - DNA, 31 bp, Artificial Sequence
  Description of Artificial Sequence: Synthetic oligonucleotide
aatgacagtggagagtgtgacccaagctgtg

SEQ ID NO: 121499 - DNA, 30 bp, Artificial Sequence
  Description of Artificial Sequence: Synthetic oligonucleotide
atgacagtggagagtgtgacccaagctgtg

SEQ ID NO: 121500 - DNA, 29 bp, Artificial Sequence
  Description of Artificial Sequence: Synthetic oligonucleotide
tgacagtggagagtgtgacccaagctgtg

SEQ ID NO: 121501 - DNA, 28 bp, Artificial Sequence
  Description of Artificial Sequence: Synthetic oligonucleotide
gacagtggagagtgtgacccaagctgtg

SEQ ID NO: 121502 - DNA, 29 bp, Artificial Sequence
  Description of Artificial Sequence: Synthetic oligonucleotide
acagtggagagtgtgacccaagctgtgtc

SEQ ID NO: 121503 - DNA, 28 bp, Artificial Sequence
  Description of Artificial Sequence: Synthetic oligonucleotide
cagtggagagtgtgacccaagctgtgtc

SEQ ID NO: 121504 - DNA, 28 bp, Artificial Sequence
  Description of Artificial Sequence: Synthetic oligonucleotide
agtggagagtgtgacccaagctgtgtcc

SEQ ID NO: 121505 - DNA, 27 bp, Artificial Sequence
  Description of Artificial Sequence: Synthetic oligonucleotide
gtggagagtgtgacccaagctgtgtcc

SEQ ID NO: 121506 - DNA, 30 bp, Artificial Sequence
  Description of Artificial Sequence: Synthetic oligonucleotide
tggagagtgtgacccaagctgtgtccaatc

SEQ ID NO: 121507 - DNA, 29 bp, Artificial Sequence
  Description of Artificial Sequence: Synthetic oligonucleotide
ggagagtgtgacccaagctgtgtccaatc

SEQ ID NO: 121508 - DNA, 30 bp, Artificial Sequence
  Description of Artificial Sequence: Synthetic oligonucleotide
gagagtgtgacccaagctgtgtccaatctg

SEQ ID NO: 121509 - DNA, 30 bp, Artificial Sequence
  Description of Artificial Sequence: Synthetic oligonucleotide
agagtgtgacccaagctgtgtccaatctgg

SEQ ID NO: 121510 - DNA, 29 bp, Artificial Sequence
  Description of Artificial Sequence: Synthetic oligonucleotide
gagtgtgacccaagctgtgtccaatctgg

SEQ ID NO: 121511 - DNA, 29 bp, Artificial Sequence
  Description of Artificial Sequence: Synthetic oligonucleotide
agtgtgacccaagctgtgtccaatctggc

SEQ ID NO: 121512 - DNA, 28 bp, Artificial Sequence
  Description of Artificial Sequence: Synthetic oligonucleotide
gtgtgacccaagctgtgtccaatctggc

SEQ ID NO: 121513 - DNA, 31 bp, Artificial Sequence
  Description of Artificial Sequence: Synthetic oligonucleotide
tgtgacccaagctgtgtccaatctggctttg

SEQ ID NO: 121514 - DNA, 30 bp, Artificial Sequence
  Description of Artificial Sequence: Synthetic oligonucleotide
gtgacccaagctgtgtccaatctggctttg

SEQ ID NO: 121515 - DNA, 30 bp, Artificial Sequence
  Description of Artificial Sequence: Synthetic oligonucleotide
tgacccaagctgtgtccaatctggctttgc

SEQ ID NO: 121516 - DNA, 29 bp, Artificial Sequence
  Description of Artificial Sequence: Synthetic oligonucleotide
gacccaagctgtgtccaatctggctttgc

SEQ ID NO: 121517 - DNA, 30 bp, Artificial Sequence
  Description of Artificial Sequence: Synthetic oligonucleotide
acccaagctgtgtccaatctggctttgcag

SEQ ID NO: 121518 - DNA, 29 bp, Artificial Sequence
  Description of Artificial Sequence: Synthetic oligonucleotide
cccaagctgtgtccaatctggctttgcag

SEQ ID NO: 121519 - DNA, 32 bp, Artificial Sequence
  Description of Artificial Sequence: Synthetic oligonucleotide
ccaagctgtgtccaatctggctttgcagtttg

SEQ ID NO: 121520 - DNA, 32 bp, Artificial Sequence
  Description of Artificial Sequence: Synthetic oligonucleotide
caagctgtgtccaatctggctttgcagtttgg

SEQ ID NO: 121521 - DNA, 33 bp, Artificial Sequence
  Description of Artificial Sequence: Synthetic oligonucleotide
aagctgtgtccaatctggctttgcagtttggag

SEQ ID NO: 121522 - DNA, 32 bp, Artificial Sequence
  Description of Artificial Sequence: Synthetic oligonucleotide
agctgtgtccaatctggctttgcagtttggag

SEQ ID NO: 121523 - DNA, 31 bp, Artificial Sequence
  Description of Artificial Sequence: Synthetic oligonucleotide
gctgtgtccaatctggctttgcagtttggag

SEQ ID NO: 121524 - DNA, 33 bp, Artificial Sequence
  Description of Artificial Sequence: Synthetic oligonucleotide
ctgtgtccaatctggctttgcagtttggagaag

SEQ ID NO: 121525 - DNA, 35 bp, Artificial Sequence
  Description of Artificial Sequence: Synthetic oligonucleotide
tgtgtccaatctggctttgcagtttggagaagaag

SEQ ID NO: 121526 - DNA, 34 bp, Artificial Sequence
  Description of Artificial Sequence: Synthetic oligonucleotide
gtgtccaatctggctttgcagtttggagaagaag

SEQ ID NO: 121527 - DNA, 36 bp, Artificial Sequence
  Description of Artificial Sequence: Synthetic oligonucleotide
tgtccaatctggctttgcagtttggagaagaagatg

SEQ ID NO: 121528 - DNA, 35 bp, Artificial Sequence
  Description of Artificial Sequence: Synthetic oligonucleotide
gtccaatctggctttgcagtttggagaagaagatg

SEQ ID NO: 121529 - DNA, 35 bp, Artificial Sequence
  Description of Artificial Sequence: Synthetic oligonucleotide
tccaatctggctttgcagtttggagaagaagatgc

SEQ ID NO: 121530 - DNA, 34 bp, Artificial Sequence
  Description of Artificial Sequence: Synthetic oligonucleotide
ccaatctggctttgcagtttggagaagaagatgc

SEQ ID NO: 121531 - DNA, 35 bp, Artificial Sequence
  Description of Artificial Sequence: Synthetic oligonucleotide
caatctggctttgcagtttggagaagaagatgcag

SEQ ID NO: 121532 - DNA, 37 bp, Artificial Sequence
  Description of Artificial Sequence: Synthetic oligonucleotide
aatctggctttgcagtttggagaagaagatgcagatc

SEQ ID NO: 121533 - DNA, 36 bp, Artificial Sequence
  Description of Artificial Sequence: Synthetic oligonucleotide
atctggctttgcagtttggagaagaagatgcagatc

SEQ ID NO: 121534 - DNA, 35 bp, Artificial Sequence
  Description of Artificial Sequence: Synthetic oligonucleotide
tctggctttgcagtttggagaagaagatgcagatc

SEQ ID NO: 121535 - DNA, 34 bp, Artificial Sequence
  Description of Artificial Sequence: Synthetic oligonucleotide
ctggctttgcagtttggagaagaagatgcagatc

SEQ ID NO: 121536 - DNA, 34 bp, Artificial Sequence
  Description of Artificial Sequence: Synthetic oligonucleotide
tggctttgcagtttggagaagaagatgcagatcc

SEQ ID NO: 121537 - DNA, 33 bp, Artificial Sequence
  Description of Artificial Sequence: Synthetic oligonucleotide
ggctttgcagtttggagaagaagatgcagatcc

SEQ ID NO: 121538 - DNA, 34 bp, Artificial Sequence
  Description of Artificial Sequence: Synthetic oligonucleotide
gctttgcagtttggagaagaagatgcagatccag

SEQ ID NO: 121539 - DNA, 34 bp, Artificial Sequence
  Description of Artificial Sequence: Synthetic oligonucleotide
ctttgcagtttggagaagaagatgcagatccagg

SEQ ID NO: 121540 - DNA, 35 bp, Artificial Sequence
  Description of Artificial Sequence: Synthetic oligonucleotide
tttgcagtttggagaagaagatgcagatccaggtg

SEQ ID NO: 121541 - DNA, 34 bp, Artificial Sequence
  Description of Artificial Sequence: Synthetic oligonucleotide
ttgcagtttggagaagaagatgcagatccaggtg

SEQ ID NO: 121542 - DNA, 33 bp, Artificial Sequence
  Description of Artificial Sequence: Synthetic oligonucleotide
tgcagtttggagaagaagatgcagatccaggtg

SEQ ID NO: 121543 - DNA, 32 bp, Artificial Sequence
  Description of Artificial Sequence: Synthetic oligonucleotide
gcagtttggagaagaagatgcagatccaggtg

SEQ ID NO: 121544 - DNA, 32 bp, Artificial Sequence
  Description of Artificial Sequence: Synthetic oligonucleotide
cagtttggagaagaagatgcagatccaggtgc

SEQ ID NO: 121545 - DNA, 32 bp, Artificial Sequence
  Description of Artificial Sequence: Synthetic oligonucleotide
agtttggagaagaagatgcagatccaggtgcc

SEQ ID NO: 121546 - DNA, 31 bp, Artificial Sequence
  Description of Artificial Sequence: Synthetic oligonucleotide
gtttggagaagaagatgcagatccaggtgcc

SEQ ID NO: 121547 - DNA, 33 bp, Artificial Sequence
  Description of Artificial Sequence: Synthetic oligonucleotide
tttggagaagaagatgcagatccaggtgccatg

SEQ ID NO: 121548 - DNA, 32 bp, Artificial Sequence
  Description of Artificial Sequence: Synthetic oligonucleotide
ttggagaagaagatgcagatccaggtgccatg

SEQ ID NO: 121549 - DNA, 31 bp, Artificial Sequence
  Description of Artificial Sequence: Synthetic oligonucleotide
tggagaagaagatgcagatccaggtgccatg

SEQ ID NO: 121550 - DNA, 30 bp, Artificial Sequence
  Description of Artificial Sequence: Synthetic oligonucleotide
ggagaagaagatgcagatccaggtgccatg

SEQ ID NO: 121551 - DNA, 31 bp, Artificial Sequence
  Description of Artificial Sequence: Synthetic oligonucleotide
gagaagaagatgcagatccaggtgccatgtc

SEQ ID NO: 121552 - DNA, 32 bp, Artificial Sequence
  Description of Artificial Sequence: Synthetic oligonucleotide
agaagaagatgcagatccaggtgccatgtctc

SEQ ID NO: 121553 - DNA, 31 bp, Artificial Sequence
  Description of Artificial Sequence: Synthetic oligonucleotide
gaagaagatgcagatccaggtgccatgtctc

SEQ ID NO: 121554 - DNA, 31 bp, Artificial Sequence
  Description of Artificial Sequence: Synthetic oligonucleotide
aagaagatgcagatccaggtgccatgtctcg

SEQ ID NO: 121555 - DNA, 30 bp, Artificial Sequence
  Description of Artificial Sequence: Synthetic oligonucleotide
agaagatgcagatccaggtgccatgtctcg

SEQ ID NO: 121556 - DNA, 29 bp, Artificial Sequence
  Description of Artificial Sequence: Synthetic oligonucleotide
gaagatgcagatccaggtgccatgtctcg

SEQ ID NO: 121557 - DNA, 30 bp, Artificial Sequence
  Description of Artificial Sequence: Synthetic oligonucleotide
aagatgcagatccaggtgccatgtctcgtc

SEQ ID NO: 121558 - DNA, 29 bp, Artificial Sequence
  Description of Artificial Sequence: Synthetic oligonucleotide
agatgcagatccaggtgccatgtctcgtc

SEQ ID NO: 121559 - DNA, 28 bp, Artificial Sequence
  Description of Artificial Sequence: Synthetic oligonucleotide
gatgcagatccaggtgccatgtctcgtc

SEQ ID NO: 121560 - DNA, 28 bp, Artificial Sequence
  Description of Artificial Sequence: Synthetic oligonucleotide
atgcagatccaggtgccatgtctcgtcc

SEQ ID NO: 121561 - DNA, 27 bp, Artificial Sequence
  Description of Artificial Sequence: Synthetic oligonucleotide
tgcagatccaggtgccatgtctcgtcc

SEQ ID NO: 121562 - DNA, 26 bp, Artificial Sequence
  Description of Artificial Sequence: Synthetic oligonucleotide
gcagatccaggtgccatgtctcgtcc

SEQ ID NO: 121563 - DNA, 27 bp, Artificial Sequence
  Description of Artificial Sequence: Synthetic oligonucleotide
cagatccaggtgccatgtctcgtccct

SEQ ID NO: 121564 - DNA, 29 bp, Artificial Sequence
  Description of Artificial Sequence: Synthetic oligonucleotide
agatccaggtgccatgtctcgtccctttg

SEQ ID NO: 121565 - DNA, 28 bp, Artificial Sequence
  Description of Artificial Sequence: Synthetic oligonucleotide
gatccaggtgccatgtctcgtccctttg

SEQ ID NO: 121566 - DNA, 28 bp, Artificial Sequence
  Description of Artificial Sequence: Synthetic oligonucleotide
atccaggtgccatgtctcgtccctttgg

SEQ ID NO: 121567 - DNA, 27 bp, Artificial Sequence
  Description of Artificial Sequence: Synthetic oligonucleotide
tccaggtgccatgtctcgtccctttgg

SEQ ID NO: 121568 - DNA, 27 bp, Artificial Sequence
  Description of Artificial Sequence: Synthetic oligonucleotide
ccaggtgccatgtctcgtccctttgga

SEQ ID NO: 121569 - DNA, 27 bp, Artificial Sequence
  Description of Artificial Sequence: Synthetic oligonucleotide
caggtgccatgtctcgtccctttggag

SEQ ID NO: 121570 - DNA, 29 bp, Artificial Sequence
  Description of Artificial Sequence: Synthetic oligonucleotide
aggtgccatgtctcgtccctttggagtag

SEQ ID NO: 121571 - DNA, 28 bp, Artificial Sequence
  Description of Artificial Sequence: Synthetic oligonucleotide
ggtgccatgtctcgtccctttggagtag

SEQ ID NO: 121572 - DNA, 28 bp, Artificial Sequence
  Description of Artificial Sequence: Synthetic oligonucleotide
gtgccatgtctcgtccctttggagtagc

SEQ ID NO: 121573 - DNA, 38 bp, Artificial Sequence
  Description of Artificial Sequence: Synthetic oligonucleotide
tgccatgtctcgtccctttggagtagcattattatttg

SEQ ID NO: 121574 - DNA, 37 bp, Artificial Sequence
  Description of Artificial Sequence: Synthetic oligonucleotide
gccatgtctcgtccctttggagtagcattattatttg

SEQ ID NO: 121575 - DNA, 37 bp, Artificial Sequence
  Description of Artificial Sequence: Synthetic oligonucleotide
ccatgtctcgtccctttggagtagcattattatttgg

SEQ ID NO: 121576 - DNA, 38 bp, Artificial Sequence
  Description of Artificial Sequence: Synthetic oligonucleotide
catgtctcgtccctttggagtagcattattatttggag

SEQ ID NO: 121577 - DNA, 38 bp, Artificial Sequence
  Description of Artificial Sequence: Synthetic oligonucleotide
atgtctcgtccctttggagtagcattattatttggagg

SEQ ID NO: 121578 - DNA, 37 bp, Artificial Sequence
  Description of Artificial Sequence: Synthetic oligonucleotide
tgtctcgtccctttggagtagcattattatttggagg

SEQ ID NO: 121579 - DNA, 36 bp, Artificial Sequence
  Description of Artificial Sequence: Synthetic oligonucleotide
gtctcgtccctttggagtagcattattatttggagg

SEQ ID NO: 121580 - DNA, 37 bp, Artificial Sequence
  Description of Artificial Sequence: Synthetic oligonucleotide
tctcgtccctttggagtagcattattatttggaggag

SEQ ID NO: 121581 - DNA, 36 bp, Artificial Sequence
  Description of Artificial Sequence: Synthetic oligonucleotide
ctcgtccctttggagtagcattattatttggaggag

SEQ ID NO: 121582 - DNA, 38 bp, Artificial Sequence
  Description of Artificial Sequence: Synthetic oligonucleotide
tcgtccctttggagtagcattattatttggaggagttg

SEQ ID NO: 121583 - DNA, 37 bp, Artificial Sequence
  Description of Artificial Sequence: Synthetic oligonucleotide
cgtccctttggagtagcattattatttggaggagttg

SEQ ID NO: 121584 - DNA, 39 bp, Artificial Sequence
  Description of Artificial Sequence: Synthetic oligonucleotide
gtccctttggagtagcattattatttggaggagttgatg

SEQ ID NO: 121585 - DNA, 40 bp, Artificial Sequence
  Description of Artificial Sequence: Synthetic oligonucleotide
tccctttggagtagcattattatttggaggagttgatgag

SEQ ID NO: 121586 - DNA, 39 bp, Artificial Sequence
  Description of Artificial Sequence: Synthetic oligonucleotide
ccctttggagtagcattattatttggaggagttgatgag

SEQ ID NO: 121587 - DNA, 42 bp, Artificial Sequence
  Description of Artificial Sequence: Synthetic oligonucleotide
cctttggagtagcattattatttggaggagttgatgagaaag

SEQ ID NO: 121588 - DNA, 42 bp, Artificial Sequence
  Description of Artificial Sequence: Synthetic oligonucleotide
ctttggagtagcattattatttggaggagttgatgagaaagg

SEQ ID NO: 121589 - DNA, 43 bp, Artificial Sequence
  Description of Artificial Sequence: Synthetic oligonucleotide
tttggagtagcattattatttggaggagttgatgagaaaggac

SEQ ID NO: 121590 - DNA, 42 bp, Artificial Sequence
  Description of Artificial Sequence: Synthetic oligonucleotide
ttggagtagcattattatttggaggagttgatgagaaaggac

SEQ ID NO: 121591 - DNA, 41 bp, Artificial Sequence
  Description of Artificial Sequence: Synthetic oligonucleotide
tggagtagcattattatttggaggagttgatgagaaaggac

SEQ ID NO: 121592 - DNA, 40 bp, Artificial Sequence
  Description of Artificial Sequence: Synthetic oligonucleotide
ggagtagcattattatttggaggagttgatgagaaaggac

SEQ ID NO: 121593 - DNA, 40 bp, Artificial Sequence
  Description of Artificial Sequence: Synthetic oligonucleotide
gagtagcattattatttggaggagttgatgagaaaggacc

SEQ ID NO: 121594 - DNA, 40 bp, Artificial Sequence
  Description of Artificial Sequence: Synthetic oligonucleotide
agtagcattattatttggaggagttgatgagaaaggaccc

SEQ ID NO: 121595 - DNA, 39 bp, Artificial Sequence
  Description of Artificial Sequence: Synthetic oligonucleotide
gtagcattattatttggaggagttgatgagaaaggaccc

SEQ ID NO: 121596 - DNA, 39 bp, Artificial Sequence
  Description of Artificial Sequence: Synthetic oligonucleotide
tagcattattatttggaggagttgatgagaaaggacccc

SEQ ID NO: 121597 - DNA, 38 bp, Artificial Sequence
  Description of Artificial Sequence: Synthetic oligonucleotide
agcattattatttggaggagttgatgagaaaggacccc

SEQ ID NO: 121598 - DNA, 37 bp, Artificial Sequence
  Description of Artificial Sequence: Synthetic oligonucleotide
gcattattatttggaggagttgatgagaaaggacccc

SEQ ID NO: 121599 - DNA, 38 bp, Artificial Sequence
  Description of Artificial Sequence: Synthetic oligonucleotide
cattattatttggaggagttgatgagaaaggaccccag

SEQ ID NO: 121600 - DNA, 38 bp, Artificial Sequence
  Description of Artificial Sequence: Synthetic oligonucleotide
attattatttggaggagttgatgagaaaggaccccagc

SEQ ID NO: 121601 - DNA, 37 bp, Artificial Sequence
  Description of Artificial Sequence: Synthetic oligonucleotide
ttattatttggaggagttgatgagaaaggaccccagc

SEQ ID NO: 121602 - DNA, 36 bp, Artificial Sequence
  Description of Artificial Sequence: Synthetic oligonucleotide
tattatttggaggagttgatgagaaaggaccccagc

SEQ ID NO: 121603 - DNA, 35 bp, Artificial Sequence
  Description of Artificial Sequence: Synthetic oligonucleotide
attatttggaggagttgatgagaaaggaccccagc

SEQ ID NO: 121604 - DNA, 34 bp, Artificial Sequence
  Description of Artificial Sequence: Synthetic oligonucleotide
ttatttggaggagttgatgagaaaggaccccagc

SEQ ID NO: 121605 - DNA, 33 bp, Artificial Sequence
  Description of Artificial Sequence: Synthetic oligonucleotide
tatttggaggagttgatgagaaaggaccccagc

SEQ ID NO: 121606 - DNA, 32 bp, Artificial Sequence
  Description of Artificial Sequence: Synthetic oligonucleotide
atttggaggagttgatgagaaaggaccccagc

SEQ ID NO: 121607 - DNA, 31 bp, Artificial Sequence
  Description of Artificial Sequence: Synthetic oligonucleotide
tttggaggagttgatgagaaaggaccccagc

SEQ ID NO: 121608 - DNA, 30 bp, Artificial Sequence
  Description of Artificial Sequence: Synthetic oligonucleotide
ttggaggagttgatgagaaaggaccccagc

SEQ ID NO: 121609 - DNA, 29 bp, Artificial Sequence
  Description of Artificial Sequence: Synthetic oligonucleotide
tggaggagttgatgagaaaggaccccagc

SEQ ID NO: 121610 - DNA, 28 bp, Artificial Sequence
  Description of Artificial Sequence: Synthetic oligonucleotide
ggaggagttgatgagaaaggaccccagc

SEQ ID NO: 121611 - DNA, 29 bp, Artificial Sequence
  Description of Artificial Sequence: Synthetic oligonucleotide
gaggagttgatgagaaaggaccccagctg

SEQ ID NO: 121612 - DNA, 32 bp, Artificial Sequence
  Description of Artificial Sequence: Synthetic oligonucleotide
aggagttgatgagaaaggaccccagctgtttc

SEQ ID NO: 121613 - DNA, 31 bp, Artificial Sequence
  Description of Artificial Sequence: Synthetic oligonucleotide
ggagttgatgagaaaggaccccagctgtttc

SEQ ID NO: 121614 - DNA, 35 bp, Artificial Sequence
  Description of Artificial Sequence: Synthetic oligonucleotide
gagttgatgagaaaggaccccagctgtttcatatg

SEQ ID NO: 121615 - DNA, 35 bp, Artificial Sequence
  Description of Artificial Sequence: Synthetic oligonucleotide
agttgatgagaaaggaccccagctgtttcatatgg

SEQ ID NO: 121616 - DNA, 34 bp, Artificial Sequence
  Description of Artificial Sequence: Synthetic oligonucleotide
gttgatgagaaaggaccccagctgtttcatatgg

SEQ ID NO: 121617 - DNA, 35 bp, Artificial Sequence
  Description of Artificial Sequence: Synthetic oligonucleotide
ttgatgagaaaggaccccagctgtttcatatggac

SEQ ID NO: 121618 - DNA, 34 bp, Artificial Sequence
  Description of Artificial Sequence: Synthetic oligonucleotide
tgatgagaaaggaccccagctgtttcatatggac

SEQ ID NO: 121619 - DNA, 33 bp, Artificial Sequence
  Description of Artificial Sequence: Synthetic oligonucleotide
gatgagaaaggaccccagctgtttcatatggac

SEQ ID NO: 121620 - DNA, 33 bp, Artificial Sequence
  Description of Artificial Sequence: Synthetic oligonucleotide
atgagaaaggaccccagctgtttcatatggacc

SEQ ID NO: 121621 - DNA, 32 bp, Artificial Sequence
  Description of Artificial Sequence: Synthetic oligonucleotide
tgagaaaggaccccagctgtttcatatggacc

SEQ ID NO: 121622 - DNA, 31 bp, Artificial Sequence
  Description of Artificial Sequence: Synthetic oligonucleotide
gagaaaggaccccagctgtttcatatggacc

SEQ ID NO: 121623 - DNA, 31 bp, Artificial Sequence
  Description of Artificial Sequence: Synthetic oligonucleotide
agaaaggaccccagctgtttcatatggaccc

SEQ ID NO: 121624 - DNA, 30 bp, Artificial Sequence
  Description of Artificial Sequence: Synthetic oligonucleotide
gaaaggaccccagctgtttcatatggaccc

SEQ ID NO: 121625 - DNA, 32 bp, Artificial Sequence
  Description of Artificial Sequence: Synthetic oligonucleotide
aaaggaccccagctgtttcatatggacccatc

SEQ ID NO: 121626 - DNA, 31 bp, Artificial Sequence
  Description of Artificial Sequence: Synthetic oligonucleotide
aaggaccccagctgtttcatatggacccatc

SEQ ID NO: 121627 - DNA, 30 bp, Artificial Sequence
  Description of Artificial Sequence: Synthetic oligonucleotide
aggaccccagctgtttcatatggacccatc

SEQ ID NO: 121628 - DNA, 29 bp, Artificial Sequence
  Description of Artificial Sequence: Synthetic oligonucleotide
ggaccccagctgtttcatatggacccatc

SEQ ID NO: 121629 - DNA, 30 bp, Artificial Sequence
  Description of Artificial Sequence: Synthetic oligonucleotide
gaccccagctgtttcatatggacccatctg

SEQ ID NO: 121630 - DNA, 30 bp, Artificial Sequence
  Description of Artificial Sequence: Synthetic oligonucleotide
accccagctgtttcatatggacccatctgg

SEQ ID NO: 121631 - DNA, 29 bp, Artificial Sequence
  Description of Artificial Sequence: Synthetic oligonucleotide
ccccagctgtttcatatggacccatctgg

SEQ ID NO: 121632 - DNA, 29 bp, Artificial Sequence
  Description of Artificial Sequence: Synthetic oligonucleotide
cccagctgtttcatatggacccatctggg

SEQ ID NO: 121633 - DNA, 30 bp, Artificial Sequence
  Description of Artificial Sequence: Synthetic oligonucleotide
ccagctgtttcatatggacccatctgggac

SEQ ID NO: 121634 - DNA, 30 bp, Artificial Sequence
  Description of Artificial Sequence: Synthetic oligonucleotide
cagctgtttcatatggacccatctgggacc

SEQ ID NO: 121635 - DNA, 33 bp, Artificial Sequence
  Description of Artificial Sequence: Synthetic oligonucleotide
agctgtttcatatggacccatctgggacctttg

SEQ ID NO: 121636 - DNA, 32 bp, Artificial Sequence
  Description of Artificial Sequence: Synthetic oligonucleotide
gctgtttcatatggacccatctgggacctttg

SEQ ID NO: 121637 - DNA, 34 bp, Artificial Sequence
  Description of Artificial Sequence: Synthetic oligonucleotide
ctgtttcatatggacccatctgggacctttgtac

SEQ ID NO: 121638 - DNA, 35 bp, Artificial Sequence
  Description of Artificial Sequence: Synthetic oligonucleotide
tgtttcatatggacccatctgggacctttgtacag

SEQ ID NO: 121639 - DNA, 34 bp, Artificial Sequence
  Description of Artificial Sequence: Synthetic oligonucleotide
gtttcatatggacccatctgggacctttgtacag

SEQ ID NO: 121640 - DNA, 35 bp, Artificial Sequence
  Description of Artificial Sequence: Synthetic oligonucleotide
tttcatatggacccatctgggacctttgtacagtg

SEQ ID NO: 121641 - DNA, 34 bp, Artificial Sequence
  Description of Artificial Sequence: Synthetic oligonucleotide
ttcatatggacccatctgggacctttgtacagtg

SEQ ID NO: 121642 - DNA, 33 bp, Artificial Sequence
  Description of Artificial Sequence: Synthetic oligonucleotide
tcatatggacccatctgggacctttgtacagtg

SEQ ID NO: 121643 - DNA, 32 bp, Artificial Sequence
  Description of Artificial Sequence: Synthetic oligonucleotide
catatggacccatctgggacctttgtacagtg

SEQ ID NO: 121644 - DNA, 33 bp, Artificial Sequence
  Description of Artificial Sequence: Synthetic oligonucleotide
atatggacccatctgggacctttgtacagtgtg

SEQ ID NO: 121645 - DNA, 32 bp, Artificial Sequence
  Description of Artificial Sequence: Synthetic oligonucleotide
tatggacccatctgggacctttgtacagtgtg

SEQ ID NO: 121646 - DNA, 31 bp, Artificial Sequence
  Description of Artificial Sequence: Synthetic oligonucleotide
atggacccatctgggacctttgtacagtgtg

SEQ ID NO: 121647 - DNA, 30 bp, Artificial Sequence
  Description of Artificial Sequence: Synthetic oligonucleotide
tggacccatctgggacctttgtacagtgtg

SEQ ID NO: 121648 - DNA, 29 bp, Artificial Sequence
  Description of Artificial Sequence: Synthetic oligonucleotide
ggacccatctgggacctttgtacagtgtg

SEQ ID NO: 121649 - DNA, 31 bp, Artificial Sequence
  Description of Artificial Sequence: Synthetic oligonucleotide
gacccatctgggacctttgtacagtgtgatg

SEQ ID NO: 121650 - DNA, 31 bp, Artificial Sequence
  Description of Artificial Sequence: Synthetic oligonucleotide
acccatctgggacctttgtacagtgtgatgc

SEQ ID NO: 121651 - DNA, 30 bp, Artificial Sequence
  Description of Artificial Sequence: Synthetic oligonucleotide
cccatctgggacctttgtacagtgtgatgc

SEQ ID NO: 121652 - DNA, 31 bp, Artificial Sequence
  Description of Artificial Sequence: Synthetic oligonucleotide
ccatctgggacctttgtacagtgtgatgctc

SEQ ID NO: 121653 - DNA, 31 bp, Artificial Sequence
  Description of Artificial Sequence: Synthetic oligonucleotide
catctgggacctttgtacagtgtgatgctcg

SEQ ID NO: 121654 - DNA, 32 bp, Artificial Sequence
  Description of Artificial Sequence: Synthetic oligonucleotide
atctgggacctttgtacagtgtgatgctcgag

SEQ ID NO: 121655 - DNA, 31 bp, Artificial Sequence
  Description of Artificial Sequence: Synthetic oligonucleotide
tctgggacctttgtacagtgtgatgctcgag

SEQ ID NO: 121656 - DNA, 30 bp, Artificial Sequence
  Description of Artificial Sequence: Synthetic oligonucleotide
ctgggacctttgtacagtgtgatgctcgag

SEQ ID NO: 121657 - DNA, 30 bp, Artificial Sequence
  Description of Artificial Sequence: Synthetic oligonucleotide
tgggacctttgtacagtgtgatgctcgagc

SEQ ID NO: 121658 - DNA, 29 bp, Artificial Sequence
  Description of Artificial Sequence: Synthetic oligonucleotide
gggacctttgtacagtgtgatgctcgagc

SEQ ID NO: 121659 - DNA, 33 bp, Artificial Sequence
  Description of Artificial Sequence: Synthetic oligonucleotide
ggacctttgtacagtgtgatgctcgagcaattg

SEQ ID NO: 121660 - DNA, 33 bp, Artificial Sequence
  Description of Artificial Sequence: Synthetic oligonucleotide
gacctttgtacagtgtgatgctcgagcaattgg

SEQ ID NO: 121661 - DNA, 33 bp, Artificial Sequence
  Description of Artificial Sequence: Synthetic oligonucleotide
acctttgtacagtgtgatgctcgagcaattggc

SEQ ID NO: 121662 - DNA, 32 bp, Artificial Sequence
  Description of Artificial Sequence: Synthetic oligonucleotide
cctttgtacagtgtgatgctcgagcaattggc

SEQ ID NO: 121663 - DNA, 33 bp, Artificial Sequence
  Description of Artificial Sequence: Synthetic oligonucleotide
ctttgtacagtgtgatgctcgagcaattggctc

SEQ ID NO: 121664 - DNA, 34 bp, Artificial Sequence
  Description of Artificial Sequence: Synthetic oligonucleotide
tttgtacagtgtgatgctcgagcaattggctctg

SEQ ID NO: 121665 - DNA, 33 bp, Artificial Sequence
  Description of Artificial Sequence: Synthetic oligonucleotide
ttgtacagtgtgatgctcgagcaattggctctg

SEQ ID NO: 121666 - DNA, 32 bp, Artificial Sequence
  Description of Artificial Sequence: Synthetic oligonucleotide
tgtacagtgtgatgctcgagcaattggctctg

SEQ ID NO: 121667 - DNA, 31 bp, Artificial Sequence
  Description of Artificial Sequence: Synthetic oligonucleotide
gtacagtgtgatgctcgagcaattggctctg

SEQ ID NO: 121668 - DNA, 31 bp, Artificial Sequence
  Description of Artificial Sequence: Synthetic oligonucleotide
tacagtgtgatgctcgagcaattggctctgc

SEQ ID NO: 121669 - DNA, 30 bp, Artificial Sequence
  Description of Artificial Sequence: Synthetic oligonucleotide
acagtgtgatgctcgagcaattggctctgc

SEQ ID NO: 121670 - DNA, 29 bp, Artificial Sequence
  Description of Artificial Sequence: Synthetic oligonucleotide
cagtgtgatgctcgagcaattggctctgc

SEQ ID NO: 121671 - DNA, 31 bp, Artificial Sequence
  Description of Artificial Sequence: Synthetic oligonucleotide
agtgtgatgctcgagcaattggctctgcttc

SEQ ID NO: 121672 - DNA, 30 bp, Artificial Sequence
  Description of Artificial Sequence: Synthetic oligonucleotide
gtgtgatgctcgagcaattggctctgcttc

SEQ ID NO: 121673 - DNA, 31 bp, Artificial Sequence
  Description of Artificial Sequence: Synthetic oligonucleotide
tgtgatgctcgagcaattggctctgcttcag

SEQ ID NO: 121674 - DNA, 30 bp, Artificial Sequence
  Description of Artificial Sequence: Synthetic oligonucleotide
gtgatgctcgagcaattggctctgcttcag

SEQ ID NO: 121675 - DNA, 31 bp, Artificial Sequence
  Description of Artificial Sequence: Synthetic oligonucleotide
tgatgctcgagcaattggctctgcttcagag

SEQ ID NO: 121676 - DNA, 30 bp, Artificial Sequence
  Description of Artificial Sequence: Synthetic oligonucleotide
gatgctcgagcaattggctctgcttcagag

SEQ ID NO: 121677 - DNA, 30 bp, Artificial Sequence
  Description of Artificial Sequence: Synthetic oligonucleotide
atgctcgagcaattggctctgcttcagagg

SEQ ID NO: 121678 - DNA, 29 bp, Artificial Sequence
  Description of Artificial Sequence: Synthetic oligonucleotide
tgctcgagcaattggctctgcttcagagg

SEQ ID NO: 121679 - DNA, 28 bp, Artificial Sequence
  Description of Artificial Sequence: Synthetic oligonucleotide
gctcgagcaattggctctgcttcagagg

SEQ ID NO: 121680 - DNA, 28 bp, Artificial Sequence
  Description of Artificial Sequence: Synthetic oligonucleotide
ctcgagcaattggctctgcttcagaggg

SEQ ID NO: 121681 - DNA, 29 bp, Artificial Sequence
  Description of Artificial Sequence: Synthetic oligonucleotide
tcgagcaattggctctgcttcagagggtg

SEQ ID NO: 121682 - DNA, 28 bp, Artificial Sequence
  Description of Artificial Sequence: Synthetic oligonucleotide
cgagcaattggctctgcttcagagggtg

SEQ ID NO: 121683 - DNA, 28 bp, Artificial Sequence
  Description of Artificial Sequence: Synthetic oligonucleotide
gagcaattggctctgcttcagagggtgc

SEQ ID NO: 121684 - DNA, 28 bp, Artificial Sequence
  Description of Artificial Sequence: Synthetic oligonucleotide
agcaattggctctgcttcagagggtgcc

SEQ ID NO: 121685 - DNA, 27 bp, Artificial Sequence
  Description of Artificial Sequence: Synthetic oligonucleotide
gcaattggctctgcttcagagggtgcc

SEQ ID NO: 121686 - DNA, 27 bp, Artificial Sequence
  Description of Artificial Sequence: Synthetic oligonucleotide
caattggctctgcttcagagggtgccc

SEQ ID NO: 121687 - DNA, 28 bp, Artificial Sequence
  Description of Artificial Sequence: Synthetic oligonucleotide
aattggctctgcttcagagggtgcccag

SEQ ID NO: 121688 - DNA, 27 bp, Artificial Sequence
  Description of Artificial Sequence: Synthetic oligonucleotide
attggctctgcttcagagggtgcccag

SEQ ID NO: 121689 - DNA, 27 bp, Artificial Sequence
  Description of Artificial Sequence: Synthetic oligonucleotide
ttggctctgcttcagagggtgcccaga

SEQ ID NO: 121690 - DNA, 26 bp, Artificial Sequence
  Description of Artificial Sequence: Synthetic oligonucleotide
tggctctgcttcagagggtgcccaga

SEQ ID NO: 121691 - DNA, 25 bp, Artificial Sequence
  Description of Artificial Sequence: Synthetic oligonucleotide
ggctctgcttcagagggtgcccaga

SEQ ID NO: 121692 - DNA, 25 bp, Artificial Sequence
  Description of Artificial Sequence: Synthetic oligonucleotide
gctctgcttcagagggtgcccagag

SEQ ID NO: 121693 - DNA, 26 bp, Artificial Sequence
  Description of Artificial Sequence: Synthetic oligonucleotide
ctctgcttcagagggtgcccagagct

SEQ ID NO: 121694 - DNA, 26 bp, Artificial Sequence
  Description of Artificial Sequence: Synthetic oligonucleotide
tctgcttcagagggtgcccagagctc

SEQ ID NO: 121695 - DNA, 25 bp, Artificial Sequence
  Description of Artificial Sequence: Synthetic oligonucleotide
ctgcttcagagggtgcccagagctc

SEQ ID NO: 121696 - DNA, 27 bp, Artificial Sequence
  Description of Artificial Sequence: Synthetic oligonucleotide
tgcttcagagggtgcccagagctcctt

SEQ ID NO: 121697 - DNA, 26 bp, Artificial Sequence
  Description of Artificial Sequence: Synthetic oligonucleotide
gcttcagagggtgcccagagctcctt

SEQ ID NO: 121698 - DNA, 26 bp, Artificial Sequence
  Description of Artificial Sequence: Synthetic oligonucleotide
cttcagagggtgcccagagctccttg

SEQ ID NO: 121699 - DNA, 27 bp, Artificial Sequence
  Description of Artificial Sequence: Synthetic oligonucleotide
ttcagagggtgcccagagctccttgca

SEQ ID NO: 121700 - DNA, 27 bp, Artificial Sequence
  Description of Artificial Sequence: Synthetic oligonucleotide
tcagagggtgcccagagctccttgcaa

SEQ ID NO: 121701 - DNA, 26 bp, Artificial Sequence
  Description of Artificial Sequence: Synthetic oligonucleotide
cagagggtgcccagagctccttgcaa

SEQ ID NO: 121702 - DNA, 27 bp, Artificial Sequence
  Description of Artificial Sequence: Synthetic oligonucleotide
agagggtgcccagagctccttgcaaga

SEQ ID NO: 121703 - DNA, 27 bp, Artificial Sequence
  Description of Artificial Sequence: Synthetic oligonucleotide
gagggtgcccagagctccttgcaagaa

SEQ ID NO: 121704 - DNA, 27 bp, Artificial Sequence
  Description of Artificial Sequence: Synthetic oligonucleotide
agggtgcccagagctccttgcaagaag

SEQ ID NO: 121705 - DNA, 27 bp, Artificial Sequence
  Description of Artificial Sequence: Synthetic oligonucleotide
gggtgcccagagctccttgcaagaagt

SEQ ID NO: 121706 - DNA, 30 bp, Artificial Sequence
  Description of Artificial Sequence: Synthetic oligonucleotide
ggtgcccagagctccttgcaagaagtttac

SEQ ID NO: 121707 - DNA, 30 bp, Artificial Sequence
  Description of Artificial Sequence: Synthetic oligonucleotide
gtgcccagagctccttgcaagaagtttacc

SEQ ID NO: 121708 - DNA, 31 bp, Artificial Sequence
  Description of Artificial Sequence: Synthetic oligonucleotide
tgcccagagctccttgcaagaagtttaccac

SEQ ID NO: 121709 - DNA, 30 bp, Artificial Sequence
  Description of Artificial Sequence: Synthetic oligonucleotide
gcccagagctccttgcaagaagtttaccac

SEQ ID NO: 121710 - DNA, 32 bp, Artificial Sequence
  Description of Artificial Sequence: Synthetic oligonucleotide
cccagagctccttgcaagaagtttaccacaag

SEQ ID NO: 121711 - DNA, 33 bp, Artificial Sequence
  Description of Artificial Sequence: Synthetic oligonucleotide
ccagagctccttgcaagaagtttaccacaagtc

SEQ ID NO: 121712 - DNA, 36 bp, Artificial Sequence
  Description of Artificial Sequence: Synthetic oligonucleotide
cagagctccttgcaagaagtttaccacaagtctatg

SEQ ID NO: 121713 - DNA, 37 bp, Artificial Sequence
  Description of Artificial Sequence: Synthetic oligonucleotide
agagctccttgcaagaagtttaccacaagtctatgac

SEQ ID NO: 121714 - DNA, 36 bp, Artificial Sequence
  Description of Artificial Sequence: Synthetic oligonucleotide
gagctccttgcaagaagtttaccacaagtctatgac

SEQ ID NO: 121715 - DNA, 39 bp, Artificial Sequence
  Description of Artificial Sequence: Synthetic oligonucleotide
agctccttgcaagaagtttaccacaagtctatgactttg

SEQ ID NO: 121716 - DNA, 38 bp, Artificial Sequence
  Description of Artificial Sequence: Synthetic oligonucleotide
gctccttgcaagaagtttaccacaagtctatgactttg

SEQ ID NO: 121717 - DNA, 41 bp, Artificial Sequence
  Description of Artificial Sequence: Synthetic oligonucleotide
ctccttgcaagaagtttaccacaagtctatgactttgaaag

SEQ ID NO: 121718 - DNA, 43 bp, Artificial Sequence
  Description of Artificial Sequence: Synthetic oligonucleotide
tccttgcaagaagtttaccacaagtctatgactttgaaagaag

SEQ ID NO: 121719 - DNA, 42 bp, Artificial Sequence
  Description of Artificial Sequence: Synthetic oligonucleotide
ccttgcaagaagtttaccacaagtctatgactttgaaagaag

SEQ ID NO: 121720 - DNA, 42 bp, Artificial Sequence
  Description of Artificial Sequence: Synthetic oligonucleotide
cttgcaagaagtttaccacaagtctatgactttgaaagaagc

SEQ ID NO: 121721 - DNA, 42 bp, Artificial Sequence
  Description of Artificial Sequence: Synthetic oligonucleotide
ttgcaagaagtttaccacaagtctatgactttgaaagaagcc

SEQ ID NO: 121722 - DNA, 41 bp, Artificial Sequence
  Description of Artificial Sequence: Synthetic oligonucleotide
tgcaagaagtttaccacaagtctatgactttgaaagaagcc

SEQ ID NO: 121723 - DNA, 40 bp, Artificial Sequence
  Description of Artificial Sequence: Synthetic oligonucleotide
gcaagaagtttaccacaagtctatgactttgaaagaagcc

SEQ ID NO: 121724 - DNA, 42 bp, Artificial Sequence
  Description of Artificial Sequence: Synthetic oligonucleotide
caagaagtttaccacaagtctatgactttgaaagaagccatc

SEQ ID NO: 121725 - DNA, 44 bp, Artificial Sequence
  Description of Artificial Sequence: Synthetic oligonucleotide
aagaagtttaccacaagtctatgactttgaaagaagccatcaag

SEQ ID NO: 121726 - DNA, 43 bp, Artificial Sequence
  Description of Artificial Sequence: Synthetic oligonucleotide
agaagtttaccacaagtctatgactttgaaagaagccatcaag

SEQ ID NO: 121727 - DNA, 42 bp, Artificial Sequence
  Description of Artificial Sequence: Synthetic oligonucleotide
gaagtttaccacaagtctatgactttgaaagaagccatcaag

SEQ ID NO: 121728 - DNA, 43 bp, Artificial Sequence
  Description of Artificial Sequence: Synthetic oligonucleotide
aagtttaccacaagtctatgactttgaaagaagccatcaagtc

SEQ ID NO: 121729 - DNA, 42 bp, Artificial Sequence
  Description of Artificial Sequence: Synthetic oligonucleotide
agtttaccacaagtctatgactttgaaagaagccatcaagtc

SEQ ID NO: 121730 - DNA, 41 bp, Artificial Sequence
  Description of Artificial Sequence: Synthetic oligonucleotide
gtttaccacaagtctatgactttgaaagaagccatcaagtc

SEQ ID NO: 121731 - DNA, 43 bp, Artificial Sequence
  Description of Artificial Sequence: Synthetic oligonucleotide
tttaccacaagtctatgactttgaaagaagccatcaagtcttc

SEQ ID NO: 121732 - DNA, 42 bp, Artificial Sequence
  Description of Artificial Sequence: Synthetic oligonucleotide
ttaccacaagtctatgactttgaaagaagccatcaagtcttc

SEQ ID NO: 121733 - DNA, 41 bp, Artificial Sequence
  Description of Artificial Sequence: Synthetic oligonucleotide
taccacaagtctatgactttgaaagaagccatcaagtcttc

SEQ ID NO: 121734 - DNA, 40 bp, Artificial Sequence
  Description of Artificial Sequence: Synthetic oligonucleotide
accacaagtctatgactttgaaagaagccatcaagtcttc

SEQ ID NO: 121735 - DNA, 39 bp, Artificial Sequence
  Description of Artificial Sequence: Synthetic oligonucleotide
ccacaagtctatgactttgaaagaagccatcaagtcttc

SEQ ID NO: 121736 - DNA, 40 bp, Artificial Sequence
  Description of Artificial Sequence: Synthetic oligonucleotide
cacaagtctatgactttgaaagaagccatcaagtcttcac

SEQ ID NO: 121737 - DNA, 41 bp, Artificial Sequence
  Description of Artificial Sequence: Synthetic oligonucleotide
acaagtctatgactttgaaagaagccatcaagtcttcactc

SEQ ID NO: 121738 - DNA, 40 bp, Artificial Sequence
  Description of Artificial Sequence: Synthetic oligonucleotide
caagtctatgactttgaaagaagccatcaagtcttcactc

SEQ ID NO: 121739 - DNA, 42 bp, Artificial Sequence
  Description of Artificial Sequence: Synthetic oligonucleotide
aagtctatgactttgaaagaagccatcaagtcttcactcatc

SEQ ID NO: 121740 - DNA, 41 bp, Artificial Sequence
  Description of Artificial Sequence: Synthetic oligonucleotide
agtctatgactttgaaagaagccatcaagtcttcactcatc

SEQ ID NO: 121741 - DNA, 40 bp, Artificial Sequence
  Description of Artificial Sequence: Synthetic oligonucleotide
gtctatgactttgaaagaagccatcaagtcttcactcatc

SEQ ID NO: 121742 - DNA, 42 bp, Artificial Sequence
  Description of Artificial Sequence: Synthetic oligonucleotide
tctatgactttgaaagaagccatcaagtcttcactcatcatc

SEQ ID NO: 121743 - DNA, 41 bp, Artificial Sequence
  Description of Artificial Sequence: Synthetic oligonucleotide
ctatgactttgaaagaagccatcaagtcttcactcatcatc

SEQ ID NO: 121744 - DNA, 41 bp, Artificial Sequence
  Description of Artificial Sequence: Synthetic oligonucleotide
tatgactttgaaagaagccatcaagtcttcactcatcatcc

SEQ ID NO: 121745 - DNA, 40 bp, Artificial Sequence
  Description of Artificial Sequence: Synthetic oligonucleotide
atgactttgaaagaagccatcaagtcttcactcatcatcc

SEQ ID NO: 121746 - DNA, 39 bp, Artificial Sequence
  Description of Artificial Sequence: Synthetic oligonucleotide
tgactttgaaagaagccatcaagtcttcactcatcatcc

SEQ ID NO: 121747 - DNA, 38 bp, Artificial Sequence
  Description of Artificial Sequence: Synthetic oligonucleotide
gactttgaaagaagccatcaagtcttcactcatcatcc

SEQ ID NO: 121748 - DNA, 39 bp, Artificial Sequence
  Description of Artificial Sequence: Synthetic oligonucleotide
actttgaaagaagccatcaagtcttcactcatcatcctc

SEQ ID NO: 121749 - DNA, 38 bp, Artificial Sequence
  Description of Artificial Sequence: Synthetic oligonucleotide
ctttgaaagaagccatcaagtcttcactcatcatcctc

SEQ ID NO: 121750 - DNA, 41 bp, Artificial Sequence
  Description of Artificial Sequence: Synthetic oligonucleotide
tttgaaagaagccatcaagtcttcactcatcatcctcaaac

SEQ ID NO: 121751 - DNA, 40 bp, Artificial Sequence
  Description of Artificial Sequence: Synthetic oligonucleotide
ttgaaagaagccatcaagtcttcactcatcatcctcaaac

SEQ ID NO: 121752 - DNA, 39 bp, Artificial Sequence
  Description of Artificial Sequence: Synthetic oligonucleotide
tgaaagaagccatcaagtcttcactcatcatcctcaaac

SEQ ID NO: 121753 - DNA, 38 bp, Artificial Sequence
  Description of Artificial Sequence: Synthetic oligonucleotide
gaaagaagccatcaagtcttcactcatcatcctcaaac

SEQ ID NO: 121754 - DNA, 40 bp, Artificial Sequence
  Description of Artificial Sequence: Synthetic oligonucleotide
aaagaagccatcaagtcttcactcatcatcctcaaacaag

SEQ ID NO: 121755 - DNA, 39 bp, Artificial Sequence
  Description of Artificial Sequence: Synthetic oligonucleotide
aagaagccatcaagtcttcactcatcatcctcaaacaag

SEQ ID NO: 121756 - DNA, 38 bp, Artificial Sequence
  Description of Artificial Sequence: Synthetic oligonucleotide
agaagccatcaagtcttcactcatcatcctcaaacaag

SEQ ID NO: 121757 - DNA, 37 bp, Artificial Sequence
  Description of Artificial Sequence: Synthetic oligonucleotide
gaagccatcaagtcttcactcatcatcctcaaacaag

SEQ ID NO: 121758 - DNA, 41 bp, Artificial Sequence
  Description of Artificial Sequence: Synthetic oligonucleotide
aagccatcaagtcttcactcatcatcctcaaacaagtaatg

SEQ ID NO: 121759 - DNA, 40 bp, Artificial Sequence
  Description of Artificial Sequence: Synthetic oligonucleotide
agccatcaagtcttcactcatcatcctcaaacaagtaatg

SEQ ID NO: 121760 - DNA, 39 bp, Artificial Sequence
  Description of Artificial Sequence: Synthetic oligonucleotide
gccatcaagtcttcactcatcatcctcaaacaagtaatg

SEQ ID NO: 121761 - DNA, 39 bp, Artificial Sequence
  Description of Artificial Sequence: Synthetic oligonucleotide
ccatcaagtcttcactcatcatcctcaaacaagtaatgg

SEQ ID NO: 121762 - DNA, 40 bp, Artificial Sequence
  Description of Artificial Sequence: Synthetic oligonucleotide
catcaagtcttcactcatcatcctcaaacaagtaatggag

SEQ ID NO: 121763 - DNA, 40 bp, Artificial Sequence
  Description of Artificial Sequence: Synthetic oligonucleotide
atcaagtcttcactcatcatcctcaaacaagtaatggagg

SEQ ID NO: 121764 - DNA, 39 bp, Artificial Sequence
  Description of Artificial Sequence: Synthetic oligonucleotide
tcaagtcttcactcatcatcctcaaacaagtaatggagg

SEQ ID NO: 121765 - DNA, 38 bp, Artificial Sequence
  Description of Artificial Sequence: Synthetic oligonucleotide
caagtcttcactcatcatcctcaaacaagtaatggagg

SEQ ID NO: 121766 - DNA, 39 bp, Artificial Sequence
  Description of Artificial Sequence: Synthetic oligonucleotide
aagtcttcactcatcatcctcaaacaagtaatggaggag

SEQ ID NO: 121767 - DNA, 38 bp, Artificial Sequence
  Description of Artificial Sequence: Synthetic oligonucleotide
agtcttcactcatcatcctcaaacaagtaatggaggag

SEQ ID NO: 121768 - DNA, 37 bp, Artificial Sequence
  Description of Artificial Sequence: Synthetic oligonucleotide
gtcttcactcatcatcctcaaacaagtaatggaggag

SEQ ID NO: 121769 - DNA, 39 bp, Artificial Sequence
  Description of Artificial Sequence: Synthetic oligonucleotide
tcttcactcatcatcctcaaacaagtaatggaggagaag

SEQ ID NO: 121770 - DNA, 38 bp, Artificial Sequence
  Description of Artificial Sequence: Synthetic oligonucleotide
cttcactcatcatcctcaaacaagtaatggaggagaag

SEQ ID NO: 121771 - DNA, 38 bp, Artificial Sequence
  Description of Artificial Sequence: Synthetic oligonucleotide
ttcactcatcatcctcaaacaagtaatggaggagaagc

SEQ ID NO: 121772 - DNA, 37 bp, Artificial Sequence
  Description of Artificial Sequence: Synthetic oligonucleotide
tcactcatcatcctcaaacaagtaatggaggagaagc

SEQ ID NO: 121773 - DNA, 36 bp, Artificial Sequence
  Description of Artificial Sequence: Synthetic oligonucleotide
cactcatcatcctcaaacaagtaatggaggagaagc

SEQ ID NO: 121774 - DNA, 37 bp, Artificial Sequence
  Description of Artificial Sequence: Synthetic oligonucleotide
actcatcatcctcaaacaagtaatggaggagaagctg

SEQ ID NO: 121775 - DNA, 36 bp, Artificial Sequence
  Description of Artificial Sequence: Synthetic oligonucleotide
ctcatcatcctcaaacaagtaatggaggagaagctg

SEQ ID NO: 121776 - DNA, 39 bp, Artificial Sequence
  Description of Artificial Sequence: Synthetic oligonucleotide
tcatcatcctcaaacaagtaatggaggagaagctgaatg

SEQ ID NO: 121777 - DNA, 38 bp, Artificial Sequence
  Description of Artificial Sequence: Synthetic oligonucleotide
catcatcctcaaacaagtaatggaggagaagctgaatg

SEQ ID NO: 121778 - DNA, 38 bp, Artificial Sequence
  Description of Artificial Sequence: Synthetic oligonucleotide
atcatcctcaaacaagtaatggaggagaagctgaatgc

SEQ ID NO: 121779 - DNA, 37 bp, Artificial Sequence
  Description of Artificial Sequence: Synthetic oligonucleotide
tcatcctcaaacaagtaatggaggagaagctgaatgc

SEQ ID NO: 121780 - DNA, 36 bp, Artificial Sequence
  Description of Artificial Sequence: Synthetic oligonucleotide
catcctcaaacaagtaatggaggagaagctgaatgc

SEQ ID NO: 121781 - DNA, 38 bp, Artificial Sequence
  Description of Artificial Sequence: Synthetic oligonucleotide
atcctcaaacaagtaatggaggagaagctgaatgcaac

SEQ ID NO: 121782 - DNA, 37 bp, Artificial Sequence
  Description of Artificial Sequence: Synthetic oligonucleotide
tcctcaaacaagtaatggaggagaagctgaatgcaac

SEQ ID NO: 121783 - DNA, 36 bp, Artificial Sequence
  Description of Artificial Sequence: Synthetic oligonucleotide
cctcaaacaagtaatggaggagaagctgaatgcaac

SEQ ID NO: 121784 - DNA, 39 bp, Artificial Sequence
  Description of Artificial Sequence: Synthetic oligonucleotide
ctcaaacaagtaatggaggagaagctgaatgcaacaaac

SEQ ID NO: 121785 - DNA, 42 bp, Artificial Sequence
  Description of Artificial Sequence: Synthetic oligonucleotide
tcaaacaagtaatggaggagaagctgaatgcaacaaacattg

SEQ ID NO: 121786 - DNA, 41 bp, Artificial Sequence
  Description of Artificial Sequence: Synthetic oligonucleotide
caaacaagtaatggaggagaagctgaatgcaacaaacattg

SEQ ID NO: 121787 - DNA, 42 bp, Artificial Sequence
  Description of Artificial Sequence: Synthetic oligonucleotide
aaacaagtaatggaggagaagctgaatgcaacaaacattgag

SEQ ID NO: 121788 - DNA, 41 bp, Artificial Sequence
  Description of Artificial Sequence: Synthetic oligonucleotide
aacaagtaatggaggagaagctgaatgcaacaaacattgag

SEQ ID NO: 121789 - DNA, 40 bp, Artificial Sequence
  Description of Artificial Sequence: Synthetic oligonucleotide
acaagtaatggaggagaagctgaatgcaacaaacattgag

SEQ ID NO: 121790 - DNA, 39 bp, Artificial Sequence
  Description of Artificial Sequence: Synthetic oligonucleotide
caagtaatggaggagaagctgaatgcaacaaacattgag

SEQ ID NO: 121791 - DNA, 39 bp, Artificial Sequence
  Description of Artificial Sequence: Synthetic oligonucleotide
aagtaatggaggagaagctgaatgcaacaaacattgagc

SEQ ID NO: 121792 - DNA, 38 bp, Artificial Sequence
  Description of Artificial Sequence: Synthetic oligonucleotide
agtaatggaggagaagctgaatgcaacaaacattgagc

SEQ ID NO: 121793 - DNA, 37 bp, Artificial Sequence
  Description of Artificial Sequence: Synthetic oligonucleotide
gtaatggaggagaagctgaatgcaacaaacattgagc

SEQ ID NO: 121794 - DNA, 39 bp, Artificial Sequence
  Description of Artificial Sequence: Synthetic oligonucleotide
taatggaggagaagctgaatgcaacaaacattgagctag

SEQ ID NO: 121795 - DNA, 38 bp, Artificial Sequence
  Description of Artificial Sequence: Synthetic oligonucleotide
aatggaggagaagctgaatgcaacaaacattgagctag

SEQ ID NO: 121796 - DNA, 37 bp, Artificial Sequence
  Description of Artificial Sequence: Synthetic oligonucleotide
atggaggagaagctgaatgcaacaaacattgagctag

SEQ ID NO: 121797 - DNA, 36 bp, Artificial Sequence
  Description of Artificial Sequence: Synthetic oligonucleotide
tggaggagaagctgaatgcaacaaacattgagctag

SEQ ID NO: 121798 - DNA, 35 bp, Artificial Sequence
  Description of Artificial Sequence: Synthetic oligonucleotide
ggaggagaagctgaatgcaacaaacattgagctag

SEQ ID NO: 121799 - DNA, 35 bp, Artificial Sequence
  Description of Artificial Sequence: Synthetic oligonucleotide
gaggagaagctgaatgcaacaaacattgagctagc

SEQ ID NO: 121800 - DNA, 35 bp, Artificial Sequence
  Description of Artificial Sequence: Synthetic oligonucleotide
aggagaagctgaatgcaacaaacattgagctagcc

SEQ ID NO: 121801 - DNA, 34 bp, Artificial Sequence
  Description of Artificial Sequence: Synthetic oligonucleotide
ggagaagctgaatgcaacaaacattgagctagcc

SEQ ID NO: 121802 - DNA, 35 bp, Artificial Sequence
  Description of Artificial Sequence: Synthetic oligonucleotide
gagaagctgaatgcaacaaacattgagctagccac

SEQ ID NO: 121803 - DNA, 36 bp, Artificial Sequence
  Description of Artificial Sequence: Synthetic oligonucleotide
agaagctgaatgcaacaaacattgagctagccacag

SEQ ID NO: 121804 - DNA, 35 bp, Artificial Sequence
  Description of Artificial Sequence: Synthetic oligonucleotide
gaagctgaatgcaacaaacattgagctagccacag

SEQ ID NO: 121805 - DNA, 36 bp, Artificial Sequence
  Description of Artificial Sequence: Synthetic oligonucleotide
aagctgaatgcaacaaacattgagctagccacagtg

SEQ ID NO: 121806 - DNA, 35 bp, Artificial Sequence
  Description of Artificial Sequence: Synthetic oligonucleotide
agctgaatgcaacaaacattgagctagccacagtg

SEQ ID NO: 121807 - DNA, 34 bp, Artificial Sequence
  Description of Artificial Sequence: Synthetic oligonucleotide
gctgaatgcaacaaacattgagctagccacagtg

SEQ ID NO: 121808 - DNA, 34 bp, Artificial Sequence
  Description of Artificial Sequence: Synthetic oligonucleotide
ctgaatgcaacaaacattgagctagccacagtgc

SEQ ID NO: 121809 - DNA, 35 bp, Artificial Sequence
  Description of Artificial Sequence: Synthetic oligonucleotide
tgaatgcaacaaacattgagctagccacagtgcag

SEQ ID NO: 121810 - DNA, 34 bp, Artificial Sequence
  Description of Artificial Sequence: Synthetic oligonucleotide
gaatgcaacaaacattgagctagccacagtgcag

SEQ ID NO: 121811 - DNA, 34 bp, Artificial Sequence
  Description of Artificial Sequence: Synthetic oligonucleotide
aatgcaacaaacattgagctagccacagtgcagc

SEQ ID NO: 121812 - DNA, 33 bp, Artificial Sequence
  Description of Artificial Sequence: Synthetic oligonucleotide
atgcaacaaacattgagctagccacagtgcagc

SEQ ID NO: 121813 - DNA, 32 bp, Artificial Sequence
  Description of Artificial Sequence: Synthetic oligonucleotide
tgcaacaaacattgagctagccacagtgcagc

SEQ ID NO: 121814 - DNA, 31 bp, Artificial Sequence
  Description of Artificial Sequence: Synthetic oligonucleotide
gcaacaaacattgagctagccacagtgcagc

SEQ ID NO: 121815 - DNA, 31 bp, Artificial Sequence
  Description of Artificial Sequence: Synthetic oligonucleotide
caacaaacattgagctagccacagtgcagcc

SEQ ID NO: 121816 - DNA, 32 bp, Artificial Sequence
  Description of Artificial Sequence: Synthetic oligonucleotide
aacaaacattgagctagccacagtgcagcctg

SEQ ID NO: 121817 - DNA, 31 bp, Artificial Sequence
  Description of Artificial Sequence: Synthetic oligonucleotide
acaaacattgagctagccacagtgcagcctg

SEQ ID NO: 121818 - DNA, 30 bp, Artificial Sequence
  Description of Artificial Sequence: Synthetic oligonucleotide
caaacattgagctagccacagtgcagcctg

SEQ ID NO: 121819 - DNA, 30 bp, Artificial Sequence
  Description of Artificial Sequence: Synthetic oligonucleotide
aaacattgagctagccacagtgcagcctgg

SEQ ID NO: 121820 - DNA, 29 bp, Artificial Sequence
  Description of Artificial Sequence: Synthetic oligonucleotide
aacattgagctagccacagtgcagcctgg

SEQ ID NO: 121821 - DNA, 28 bp, Artificial Sequence
  Description of Artificial Sequence: Synthetic oligonucleotide
acattgagctagccacagtgcagcctgg

SEQ ID NO: 121822 - DNA, 27 bp, Artificial Sequence
  Description of Artificial Sequence: Synthetic oligonucleotide
cattgagctagccacagtgcagcctgg

SEQ ID NO: 121823 - DNA, 27 bp, Artificial Sequence
  Description of Artificial Sequence: Synthetic oligonucleotide
attgagctagccacagtgcagcctggc

SEQ ID NO: 121824 - DNA, 26 bp, Artificial Sequence
  Description of Artificial Sequence: Synthetic oligonucleotide
ttgagctagccacagtgcagcctggc

SEQ ID NO: 121825 - DNA, 25 bp, Artificial Sequence
  Description of Artificial Sequence: Synthetic oligonucleotide
tgagctagccacagtgcagcctggc

SEQ ID NO: 121826 - DNA, 24 bp, Artificial Sequence
  Description of Artificial Sequence: Synthetic oligonucleotide
gagctagccacagtgcagcctggc

SEQ ID NO: 121827 - DNA, 25 bp, Artificial Sequence
  Description of Artificial Sequence: Synthetic oligonucleotide
agctagccacagtgcagcctggcca

SEQ ID NO: 121828 - DNA, 24 bp, Artificial Sequence
  Description of Artificial Sequence: Synthetic oligonucleotide
gctagccacagtgcagcctggcca

SEQ ID NO: 121829 - DNA, 27 bp, Artificial Sequence
  Description of Artificial Sequence: Synthetic oligonucleotide
ctagccacagtgcagcctggccagaat

SEQ ID NO: 121830 - DNA, 29 bp, Artificial Sequence
  Description of Artificial Sequence: Synthetic oligonucleotide
tagccacagtgcagcctggccagaatttc

SEQ ID NO: 121831 - DNA, 28 bp, Artificial Sequence
  Description of Artificial Sequence: Synthetic oligonucleotide
agccacagtgcagcctggccagaatttc

SEQ ID NO: 121832 - DNA, 27 bp, Artificial Sequence
  Description of Artificial Sequence: Synthetic oligonucleotide
gccacagtgcagcctggccagaatttc

SEQ ID NO: 121833 - DNA, 27 bp, Artificial Sequence
  Description of Artificial Sequence: Synthetic oligonucleotide
ccacagtgcagcctggccagaatttcc

SEQ ID NO: 121834 - DNA, 28 bp, Artificial Sequence
  Description of Artificial Sequence: Synthetic oligonucleotide
cacagtgcagcctggccagaatttccac

SEQ ID NO: 121835 - DNA, 30 bp, Artificial Sequence
  Description of Artificial Sequence: Synthetic oligonucleotide
acagtgcagcctggccagaatttccacatg

SEQ ID NO: 121836 - DNA, 29 bp, Artificial Sequence
  Description of Artificial Sequence: Synthetic oligonucleotide
cagtgcagcctggccagaatttccacatg

SEQ ID NO: 121837 - DNA, 31 bp, Artificial Sequence
  Description of Artificial Sequence: Synthetic oligonucleotide
agtgcagcctggccagaatttccacatgttc

SEQ ID NO: 121838 - DNA, 30 bp, Artificial Sequence
  Description of Artificial Sequence: Synthetic oligonucleotide
gtgcagcctggccagaatttccacatgttc

SEQ ID NO: 121839 - DNA, 31 bp, Artificial Sequence
  Description of Artificial Sequence: Synthetic oligonucleotide
tgcagcctggccagaatttccacatgttcac

SEQ ID NO: 121840 - DNA, 30 bp, Artificial Sequence
  Description of Artificial Sequence: Synthetic oligonucleotide
gcagcctggccagaatttccacatgttcac

SEQ ID NO: 121841 - DNA, 33 bp, Artificial Sequence
  Description of Artificial Sequence: Synthetic oligonucleotide
cagcctggccagaatttccacatgttcacaaag

SEQ ID NO: 121842 - DNA, 33 bp, Artificial Sequence
  Description of Artificial Sequence: Synthetic oligonucleotide
agcctggccagaatttccacatgttcacaaagg

SEQ ID NO: 121843 - DNA, 32 bp, Artificial Sequence
  Description of Artificial Sequence: Synthetic oligonucleotide
gcctggccagaatttccacatgttcacaaagg

SEQ ID NO: 121844 - DNA, 34 bp, Artificial Sequence
  Description of Artificial Sequence: Synthetic oligonucleotide
cctggccagaatttccacatgttcacaaaggaag

SEQ ID NO: 121845 - DNA, 36 bp, Artificial Sequence
  Description of Artificial Sequence: Synthetic oligonucleotide
ctggccagaatttccacatgttcacaaaggaagaac

SEQ ID NO: 121846 - DNA, 38 bp, Artificial Sequence
  Description of Artificial Sequence: Synthetic oligonucleotide
tggccagaatttccacatgttcacaaaggaagaacttg

SEQ ID NO: 121847 - DNA, 37 bp, Artificial Sequence
  Description of Artificial Sequence: Synthetic oligonucleotide
ggccagaatttccacatgttcacaaaggaagaacttg

SEQ ID NO: 121848 - DNA, 39 bp, Artificial Sequence
  Description of Artificial Sequence: Synthetic oligonucleotide
gccagaatttccacatgttcacaaaggaagaacttgaag

SEQ ID NO: 121849 - DNA, 40 bp, Artificial Sequence
  Description of Artificial Sequence: Synthetic oligonucleotide
ccagaatttccacatgttcacaaaggaagaacttgaagag

SEQ ID NO: 121850 - DNA, 40 bp, Artificial Sequence
  Description of Artificial Sequence: Synthetic oligonucleotide
cagaatttccacatgttcacaaaggaagaacttgaagagg

SEQ ID NO: 121851 - DNA, 44 bp, Artificial Sequence
  Description of Artificial Sequence: Synthetic oligonucleotide
agaatttccacatgttcacaaaggaagaacttgaagaggttatc

SEQ ID NO: 121852 - DNA, 43 bp, Artificial Sequence
  Description of Artificial Sequence: Synthetic oligonucleotide
gaatttccacatgttcacaaaggaagaacttgaagaggttatc

SEQ ID NO: 121853 - DNA, 45 bp, Artificial Sequence
  Description of Artificial Sequence: Synthetic oligonucleotide
aatttccacatgttcacaaaggaagaacttgaagaggttatcaag

SEQ ID NO: 121854 - DNA, 44 bp, Artificial Sequence
  Description of Artificial Sequence: Synthetic oligonucleotide
atttccacatgttcacaaaggaagaacttgaagaggttatcaag

SEQ ID NO: 121855 - DNA, 43 bp, Artificial Sequence
  Description of Artificial Sequence: Synthetic oligonucleotide
tttccacatgttcacaaaggaagaacttgaagaggttatcaag

SEQ ID NO: 121856 - DNA, 42 bp, Artificial Sequence
  Description of Artificial Sequence: Synthetic oligonucleotide
ttccacatgttcacaaaggaagaacttgaagaggttatcaag

SEQ ID NO: 121857 - DNA, 41 bp, Artificial Sequence
  Description of Artificial Sequence: Synthetic oligonucleotide
tccacatgttcacaaaggaagaacttgaagaggttatcaag

SEQ ID NO: 121858 - DNA, 40 bp, Artificial Sequence
  Description of Artificial Sequence: Synthetic oligonucleotide
ccacatgttcacaaaggaagaacttgaagaggttatcaag

SEQ ID NO: 121859 - DNA, 40 bp, Artificial Sequence
  Description of Artificial Sequence: Synthetic oligonucleotide
cacatgttcacaaaggaagaacttgaagaggttatcaagg

SEQ ID NO: 121860 - DNA, 41 bp, Artificial Sequence
  Description of Artificial Sequence: Synthetic oligonucleotide
acatgttcacaaaggaagaacttgaagaggttatcaaggac

SEQ ID NO: 121861 - DNA, 40 bp, Artificial Sequence
  Description of Artificial Sequence: Synthetic oligonucleotide
catgttcacaaaggaagaacttgaagaggttatcaaggac

SEQ ID NO: 121862 - DNA, 27 bp, Artificial Sequence
  Description of Artificial Sequence: Synthetic oligonucleotide
atgtcccgtggttccagcgccggtttt

SEQ ID NO: 121863 - DNA, 26 bp, Artificial Sequence
  Description of Artificial Sequence: Synthetic oligonucleotide
tgtcccgtggttccagcgccggtttt

SEQ ID NO: 121864 - DNA, 25 bp, Artificial Sequence
  Description of Artificial Sequence: Synthetic oligonucleotide
gtcccgtggttccagcgccggtttt

SEQ ID NO: 121865 - DNA, 26 bp, Artificial Sequence
  Description of Artificial Sequence: Synthetic oligonucleotide
tcccgtggttccagcgccggttttga

SEQ ID NO: 121866 - DNA, 25 bp, Artificial Sequence
  Description of Artificial Sequence: Synthetic oligonucleotide
cccgtggttccagcgccggttttga

SEQ ID NO: 121867 - DNA, 25 bp, Artificial Sequence
  Description of Artificial Sequence: Synthetic oligonucleotide
ccgtggttccagcgccggttttgac

SEQ ID NO: 121868 - DNA, 25 bp, Artificial Sequence
  Description of Artificial Sequence: Synthetic oligonucleotide
cgtggttccagcgccggttttgacc

SEQ ID NO: 121869 - DNA, 25 bp, Artificial Sequence
  Description of Artificial Sequence: Synthetic oligonucleotide
gtggttccagcgccggttttgaccg

SEQ ID NO: 121870 - DNA, 25 bp, Artificial Sequence
  Description of Artificial Sequence: Synthetic oligonucleotide
tggttccagcgccggttttgaccgc

SEQ ID NO: 121871 - DNA, 24 bp, Artificial Sequence
  Description of Artificial Sequence: Synthetic oligonucleotide
ggttccagcgccggttttgaccgc

SEQ ID NO: 121872 - DNA, 25 bp, Artificial Sequence
  Description of Artificial Sequence: Synthetic oligonucleotide
gttccagcgccggttttgaccgcca

SEQ ID NO: 121873 - DNA, 27 bp, Artificial Sequence
  Description of Artificial Sequence: Synthetic oligonucleotide
ttccagcgccggttttgaccgccacat

SEQ ID NO: 121874 - DNA, 27 bp, Artificial Sequence
  Description of Artificial Sequence: Synthetic oligonucleotide
tccagcgccggttttgaccgccacatt

SEQ ID NO: 121875 - DNA, 27 bp, Artificial Sequence
  Description of Artificial Sequence: Synthetic oligonucleotide
ccagcgccggttttgaccgccacatta

SEQ ID NO: 121876 - DNA, 27 bp, Artificial Sequence
  Description of Artificial Sequence: Synthetic oligonucleotide
cagcgccggttttgaccgccacattac

SEQ ID NO: 121877 - DNA, 27 bp, Artificial Sequence
  Description of Artificial Sequence: Synthetic oligonucleotide
agcgccggttttgaccgccacattacc

SEQ ID NO: 121878 - DNA, 27 bp, Artificial Sequence
  Description of Artificial Sequence: Synthetic oligonucleotide
gcgccggttttgaccgccacattacca

SEQ ID NO: 121879 - DNA, 33 bp, Artificial Sequence
  Description of Artificial Sequence: Synthetic oligonucleotide
cgccggttttgaccgccacattaccattttttc

SEQ ID NO: 121880 - DNA, 34 bp, Artificial Sequence
  Description of Artificial Sequence: Synthetic oligonucleotide
gccggttttgaccgccacattaccattttttcac

SEQ ID NO: 121881 - DNA, 34 bp, Artificial Sequence
  Description of Artificial Sequence: Synthetic oligonucleotide
ccggttttgaccgccacattaccattttttcacc

SEQ ID NO: 121882 - DNA, 34 bp, Artificial Sequence
  Description of Artificial Sequence: Synthetic oligonucleotide
cggttttgaccgccacattaccattttttcaccc

SEQ ID NO: 121883 - DNA, 34 bp, Artificial Sequence
  Description of Artificial Sequence: Synthetic oligonucleotide
ggttttgaccgccacattaccattttttcacccg

SEQ ID NO: 121884 - DNA, 35 bp, Artificial Sequence
  Description of Artificial Sequence: Synthetic oligonucleotide
gttttgaccgccacattaccattttttcacccgag

SEQ ID NO: 121885 - DNA, 35 bp, Artificial Sequence
  Description of Artificial Sequence: Synthetic oligonucleotide
ttttgaccgccacattaccattttttcacccgagg

SEQ ID NO: 121886 - DNA, 34 bp, Artificial Sequence
  Description of Artificial Sequence: Synthetic oligonucleotide
tttgaccgccacattaccattttttcacccgagg

SEQ ID NO: 121887 - DNA, 33 bp, Artificial Sequence
  Description of Artificial Sequence: Synthetic oligonucleotide
ttgaccgccacattaccattttttcacccgagg

SEQ ID NO: 121888 - DNA, 32 bp, Artificial Sequence
  Description of Artificial Sequence: Synthetic oligonucleotide
tgaccgccacattaccattttttcacccgagg

SEQ ID NO: 121889 - DNA, 31 bp, Artificial Sequence
  Description of Artificial Sequence: Synthetic oligonucleotide
gaccgccacattaccattttttcacccgagg

SEQ ID NO: 121890 - DNA, 31 bp, Artificial Sequence
  Description of Artificial Sequence: Synthetic oligonucleotide
accgccacattaccattttttcacccgaggg

SEQ ID NO: 121891 - DNA, 30 bp, Artificial Sequence
  Description of Artificial Sequence: Synthetic oligonucleotide
ccgccacattaccattttttcacccgaggg

SEQ ID NO: 121892 - DNA, 31 bp, Artificial Sequence
  Description of Artificial Sequence: Synthetic oligonucleotide
cgccacattaccattttttcacccgagggtc

SEQ ID NO: 121893 - DNA, 31 bp, Artificial Sequence
  Description of Artificial Sequence: Synthetic oligonucleotide
gccacattaccattttttcacccgagggtcg

SEQ ID NO: 121894 - DNA, 31 bp, Artificial Sequence
  Description of Artificial Sequence: Synthetic oligonucleotide
ccacattaccattttttcacccgagggtcgg

SEQ ID NO: 121895 - DNA, 31 bp, Artificial Sequence
  Description of Artificial Sequence: Synthetic oligonucleotide
cacattaccattttttcacccgagggtcggc

SEQ ID NO: 121896 - DNA, 32 bp, Artificial Sequence
  Description of Artificial Sequence: Synthetic oligonucleotide
acattaccattttttcacccgagggtcggctc

SEQ ID NO: 121897 - DNA, 31 bp, Artificial Sequence
  Description of Artificial Sequence: Synthetic oligonucleotide
cattaccattttttcacccgagggtcggctc

SEQ ID NO: 121898 - DNA, 33 bp, Artificial Sequence
  Description of Artificial Sequence: Synthetic oligonucleotide
attaccattttttcacccgagggtcggctctac

SEQ ID NO: 121899 - DNA, 32 bp, Artificial Sequence
  Description of Artificial Sequence: Synthetic oligonucleotide
ttaccattttttcacccgagggtcggctctac

SEQ ID NO: 121900 - DNA, 31 bp, Artificial Sequence
  Description of Artificial Sequence: Synthetic oligonucleotide
taccattttttcacccgagggtcggctctac

SEQ ID NO: 121901 - DNA, 30 bp, Artificial Sequence
  Description of Artificial Sequence: Synthetic oligonucleotide
accattttttcacccgagggtcggctctac

SEQ ID NO: 121902 - DNA, 29 bp, Artificial Sequence
  Description of Artificial Sequence: Synthetic oligonucleotide
ccattttttcacccgagggtcggctctac

SEQ ID NO: 121903 - DNA, 29 bp, Artificial Sequence
  Description of Artificial Sequence: Synthetic oligonucleotide
cattttttcacccgagggtcggctctacc

SEQ ID NO: 121904 - DNA, 31 bp, Artificial Sequence
  Description of Artificial Sequence: Synthetic oligonucleotide
attttttcacccgagggtcggctctaccaag

SEQ ID NO: 121905 - DNA, 30 bp, Artificial Sequence
  Description of Artificial Sequence: Synthetic oligonucleotide
ttttttcacccgagggtcggctctaccaag

SEQ ID NO: 121906 - DNA, 29 bp, Artificial Sequence
  Description of Artificial Sequence: Synthetic oligonucleotide
tttttcacccgagggtcggctctaccaag

SEQ ID NO: 121907 - DNA, 28 bp, Artificial Sequence
  Description of Artificial Sequence: Synthetic oligonucleotide
ttttcacccgagggtcggctctaccaag

SEQ ID NO: 121908 - DNA, 27 bp, Artificial Sequence
  Description of Artificial Sequence: Synthetic oligonucleotide
tttcacccgagggtcggctctaccaag

SEQ ID NO: 121909 - DNA, 27 bp, Artificial Sequence
  Description of Artificial Sequence: Synthetic oligonucleotide
ttcacccgagggtcggctctaccaagt

SEQ ID NO: 121910 - DNA, 27 bp, Artificial Sequence
  Description of Artificial Sequence: Synthetic oligonucleotide
tcacccgagggtcggctctaccaagta

SEQ ID NO: 121911 - DNA, 26 bp, Artificial Sequence
  Description of Artificial Sequence: Synthetic oligonucleotide
cacccgagggtcggctctaccaagta

SEQ ID NO: 121912 - DNA, 27 bp, Artificial Sequence
  Description of Artificial Sequence: Synthetic oligonucleotide
acccgagggtcggctctaccaagtaga

SEQ ID NO: 121913 - DNA, 27 bp, Artificial Sequence
  Description of Artificial Sequence: Synthetic oligonucleotide
cccgagggtcggctctaccaagtagaa

SEQ ID NO: 121914 - DNA, 30 bp, Artificial Sequence
  Description of Artificial Sequence: Synthetic oligonucleotide
ccgagggtcggctctaccaagtagaatatg

SEQ ID NO: 121915 - DNA, 30 bp, Artificial Sequence
  Description of Artificial Sequence: Synthetic oligonucleotide
cgagggtcggctctaccaagtagaatatgc

SEQ ID NO: 121916 - DNA, 36 bp, Artificial Sequence
  Description of Artificial Sequence: Synthetic oligonucleotide
gagggtcggctctaccaagtagaatatgcttttaag

SEQ ID NO: 121917 - DNA, 36 bp, Artificial Sequence
  Description of Artificial Sequence: Synthetic oligonucleotide
agggtcggctctaccaagtagaatatgcttttaagg

SEQ ID NO: 121918 - DNA, 35 bp, Artificial Sequence
  Description of Artificial Sequence: Synthetic oligonucleotide
gggtcggctctaccaagtagaatatgcttttaagg

SEQ ID NO: 121919 - DNA, 35 bp, Artificial Sequence
  Description of Artificial Sequence: Synthetic oligonucleotide
ggtcggctctaccaagtagaatatgcttttaaggc

SEQ ID NO: 121920 - DNA, 41 bp, Artificial Sequence
  Description of Artificial Sequence: Synthetic oligonucleotide
gtcggctctaccaagtagaatatgcttttaaggctattaac

SEQ ID NO: 121921 - DNA, 41 bp, Artificial Sequence
  Description of Artificial Sequence: Synthetic oligonucleotide
tcggctctaccaagtagaatatgcttttaaggctattaacc

SEQ ID NO: 121922 - DNA, 40 bp, Artificial Sequence
  Description of Artificial Sequence: Synthetic oligonucleotide
cggctctaccaagtagaatatgcttttaaggctattaacc

SEQ ID NO: 121923 - DNA, 41 bp, Artificial Sequence
  Description of Artificial Sequence: Synthetic oligonucleotide
ggctctaccaagtagaatatgcttttaaggctattaaccag

SEQ ID NO: 121924 - DNA, 41 bp, Artificial Sequence
  Description of Artificial Sequence: Synthetic oligonucleotide
gctctaccaagtagaatatgcttttaaggctattaaccagg

SEQ ID NO: 121925 - DNA, 41 bp, Artificial Sequence
  Description of Artificial Sequence: Synthetic oligonucleotide
ctctaccaagtagaatatgcttttaaggctattaaccaggg

SEQ ID NO: 121926 - DNA, 42 bp, Artificial Sequence
  Description of Artificial Sequence: Synthetic oligonucleotide
tctaccaagtagaatatgcttttaaggctattaaccagggtg

SEQ ID NO: 121927 - DNA, 41 bp, Artificial Sequence
  Description of Artificial Sequence: Synthetic oligonucleotide
ctaccaagtagaatatgcttttaaggctattaaccagggtg

SEQ ID NO: 121928 - DNA, 41 bp, Artificial Sequence
  Description of Artificial Sequence: Synthetic oligonucleotide
taccaagtagaatatgcttttaaggctattaaccagggtgg

SEQ ID NO: 121929 - DNA, 40 bp, Artificial Sequence
  Description of Artificial Sequence: Synthetic oligonucleotide
accaagtagaatatgcttttaaggctattaaccagggtgg

SEQ ID NO: 121930 - DNA, 39 bp, Artificial Sequence
  Description of Artificial Sequence: Synthetic oligonucleotide
ccaagtagaatatgcttttaaggctattaaccagggtgg

SEQ ID NO: 121931 - DNA, 39 bp, Artificial Sequence
  Description of Artificial Sequence: Synthetic oligonucleotide
caagtagaatatgcttttaaggctattaaccagggtggc

SEQ ID NO: 121932 - DNA, 39 bp, Artificial Sequence
  Description of Artificial Sequence: Synthetic oligonucleotide
aagtagaatatgcttttaaggctattaaccagggtggcc

SEQ ID NO: 121933 - DNA, 38 bp, Artificial Sequence
  Description of Artificial Sequence: Synthetic oligonucleotide
agtagaatatgcttttaaggctattaaccagggtggcc

SEQ ID NO: 121934 - DNA, 37 bp, Artificial Sequence
  Description of Artificial Sequence: Synthetic oligonucleotide
gtagaatatgcttttaaggctattaaccagggtggcc

SEQ ID NO: 121935 - DNA, 40 bp, Artificial Sequence
  Description of Artificial Sequence: Synthetic oligonucleotide
tagaatatgcttttaaggctattaaccagggtggccttac

SEQ ID NO: 121936 - DNA, 39 bp, Artificial Sequence
  Description of Artificial Sequence: Synthetic oligonucleotide
agaatatgcttttaaggctattaaccagggtggccttac

SEQ ID NO: 121937 - DNA, 38 bp, Artificial Sequence
  Description of Artificial Sequence: Synthetic oligonucleotide
gaatatgcttttaaggctattaaccagggtggccttac

SEQ ID NO: 121938 - DNA, 40 bp, Artificial Sequence
  Description of Artificial Sequence: Synthetic oligonucleotide
aatatgcttttaaggctattaaccagggtggccttacatc

SEQ ID NO: 121939 - DNA, 39 bp, Artificial Sequence
  Description of Artificial Sequence: Synthetic oligonucleotide
atatgcttttaaggctattaaccagggtggccttacatc

SEQ ID NO: 121940 - DNA, 38 bp, Artificial Sequence
  Description of Artificial Sequence: Synthetic oligonucleotide
tatgcttttaaggctattaaccagggtggccttacatc

SEQ ID NO: 121941 - DNA, 37 bp, Artificial Sequence
  Description of Artificial Sequence: Synthetic oligonucleotide
atgcttttaaggctattaaccagggtggccttacatc

SEQ ID NO: 121942 - DNA, 36 bp, Artificial Sequence
  Description of Artificial Sequence: Synthetic oligonucleotide
tgcttttaaggctattaaccagggtggccttacatc

SEQ ID NO: 121943 - DNA, 35 bp, Artificial Sequence
  Description of Artificial Sequence: Synthetic oligonucleotide
gcttttaaggctattaaccagggtggccttacatc

SEQ ID NO: 121944 - DNA, 36 bp, Artificial Sequence
  Description of Artificial Sequence: Synthetic oligonucleotide
cttttaaggctattaaccagggtggccttacatcag

SEQ ID NO: 121945 - DNA, 38 bp, Artificial Sequence
  Description of Artificial Sequence: Synthetic oligonucleotide
ttttaaggctattaaccagggtggccttacatcagtag

SEQ ID NO: 121946 - DNA, 37 bp, Artificial Sequence
  Description of Artificial Sequence: Synthetic oligonucleotide
tttaaggctattaaccagggtggccttacatcagtag

SEQ ID NO: 121947 - DNA, 36 bp, Artificial Sequence
  Description of Artificial Sequence: Synthetic oligonucleotide
ttaaggctattaaccagggtggccttacatcagtag

SEQ ID NO: 121948 - DNA, 35 bp, Artificial Sequence
  Description of Artificial Sequence: Synthetic oligonucleotide
taaggctattaaccagggtggccttacatcagtag

SEQ ID NO: 121949 - DNA, 34 bp, Artificial Sequence
  Description of Artificial Sequence: Synthetic oligonucleotide
aaggctattaaccagggtggccttacatcagtag

SEQ ID NO: 121950 - DNA, 33 bp, Artificial Sequence
  Description of Artificial Sequence: Synthetic oligonucleotide
aggctattaaccagggtggccttacatcagtag

SEQ ID NO: 121951 - DNA, 32 bp, Artificial Sequence
  Description of Artificial Sequence: Synthetic oligonucleotide
ggctattaaccagggtggccttacatcagtag

SEQ ID NO: 121952 - DNA, 32 bp, Artificial Sequence
  Description of Artificial Sequence: Synthetic oligonucleotide
gctattaaccagggtggccttacatcagtagc

SEQ ID NO: 121953 - DNA, 33 bp, Artificial Sequence
  Description of Artificial Sequence: Synthetic oligonucleotide
ctattaaccagggtggccttacatcagtagctg

SEQ ID NO: 121954 - DNA, 34 bp, Artificial Sequence
  Description of Artificial Sequence: Synthetic oligonucleotide
tattaaccagggtggccttacatcagtagctgtc

SEQ ID NO: 121955 - DNA, 33 bp, Artificial Sequence
  Description of Artificial Sequence: Synthetic oligonucleotide
attaaccagggtggccttacatcagtagctgtc

SEQ ID NO: 121956 - DNA, 32 bp, Artificial Sequence
  Description of Artificial Sequence: Synthetic oligonucleotide
ttaaccagggtggccttacatcagtagctgtc

SEQ ID NO: 121957 - DNA, 31 bp, Artificial Sequence
  Description of Artificial Sequence: Synthetic oligonucleotide
taaccagggtggccttacatcagtagctgtc

SEQ ID NO: 121958 - DNA, 30 bp, Artificial Sequence
  Description of Artificial Sequence: Synthetic oligonucleotide
aaccagggtggccttacatcagtagctgtc

SEQ ID NO: 121959 - DNA, 29 bp, Artificial Sequence
  Description of Artificial Sequence: Synthetic oligonucleotide
accagggtggccttacatcagtagctgtc

SEQ ID NO: 121960 - DNA, 28 bp, Artificial Sequence
  Description of Artificial Sequence: Synthetic oligonucleotide
ccagggtggccttacatcagtagctgtc

SEQ ID NO: 121961 - DNA, 29 bp, Artificial Sequence
  Description of Artificial Sequence: Synthetic oligonucleotide
cagggtggccttacatcagtagctgtcag

SEQ ID NO: 121962 - DNA, 30 bp, Artificial Sequence
  Description of Artificial Sequence: Synthetic oligonucleotide
agggtggccttacatcagtagctgtcagag

SEQ ID NO: 121963 - DNA, 29 bp, Artificial Sequence
  Description of Artificial Sequence: Synthetic oligonucleotide
gggtggccttacatcagtagctgtcagag

SEQ ID NO: 121964 - DNA, 29 bp, Artificial Sequence
  Description of Artificial Sequence: Synthetic oligonucleotide
ggtggccttacatcagtagctgtcagagg

SEQ ID NO: 121965 - DNA, 29 bp, Artificial Sequence
  Description of Artificial Sequence: Synthetic oligonucleotide
gtggccttacatcagtagctgtcagaggg

SEQ ID NO: 121966 - DNA, 32 bp, Artificial Sequence
  Description of Artificial Sequence: Synthetic oligonucleotide
tggccttacatcagtagctgtcagagggaaag

SEQ ID NO: 121967 - DNA, 31 bp, Artificial Sequence
  Description of Artificial Sequence: Synthetic oligonucleotide
ggccttacatcagtagctgtcagagggaaag

SEQ ID NO: 121968 - DNA, 32 bp, Artificial Sequence
  Description of Artificial Sequence: Synthetic oligonucleotide
gccttacatcagtagctgtcagagggaaagac

SEQ ID NO: 121969 - DNA, 33 bp, Artificial Sequence
  Description of Artificial Sequence: Synthetic oligonucleotide
ccttacatcagtagctgtcagagggaaagactg

SEQ ID NO: 121970 - DNA, 34 bp, Artificial Sequence
  Description of Artificial Sequence: Synthetic oligonucleotide
cttacatcagtagctgtcagagggaaagactgtg

SEQ ID NO: 121971 - DNA, 34 bp, Artificial Sequence
  Description of Artificial Sequence: Synthetic oligonucleotide
ttacatcagtagctgtcagagggaaagactgtgc

SEQ ID NO: 121972 - DNA, 33 bp, Artificial Sequence
  Description of Artificial Sequence: Synthetic oligonucleotide
tacatcagtagctgtcagagggaaagactgtgc

SEQ ID NO: 121973 - DNA, 32 bp, Artificial Sequence
  Description of Artificial Sequence: Synthetic oligonucleotide
acatcagtagctgtcagagggaaagactgtgc

SEQ ID NO: 121974 - DNA, 31 bp, Artificial Sequence
  Description of Artificial Sequence: Synthetic oligonucleotide
catcagtagctgtcagagggaaagactgtgc

SEQ ID NO: 121975 - DNA, 32 bp, Artificial Sequence
  Description of Artificial Sequence: Synthetic oligonucleotide
atcagtagctgtcagagggaaagactgtgcag

SEQ ID NO: 121976 - DNA, 31 bp, Artificial Sequence
  Description of Artificial Sequence: Synthetic oligonucleotide
tcagtagctgtcagagggaaagactgtgcag

SEQ ID NO: 121977 - DNA, 30 bp, Artificial Sequence
  Description of Artificial Sequence: Synthetic oligonucleotide
cagtagctgtcagagggaaagactgtgcag

SEQ ID NO: 121978 - DNA, 35 bp, Artificial Sequence
  Description of Artificial Sequence: Synthetic oligonucleotide
agtagctgtcagagggaaagactgtgcagtaattg

SEQ ID NO: 121979 - DNA, 34 bp, Artificial Sequence
  Description of Artificial Sequence: Synthetic oligonucleotide
gtagctgtcagagggaaagactgtgcagtaattg

SEQ ID NO: 121980 - DNA, 35 bp, Artificial Sequence
  Description of Artificial Sequence: Synthetic oligonucleotide
tagctgtcagagggaaagactgtgcagtaattgtc

SEQ ID NO: 121981 - DNA, 34 bp, Artificial Sequence
  Description of Artificial Sequence: Synthetic oligonucleotide
agctgtcagagggaaagactgtgcagtaattgtc

SEQ ID NO: 121982 - DNA, 33 bp, Artificial Sequence
  Description of Artificial Sequence: Synthetic oligonucleotide
gctgtcagagggaaagactgtgcagtaattgtc

SEQ ID NO: 121983 - DNA, 34 bp, Artificial Sequence
  Description of Artificial Sequence: Synthetic oligonucleotide
ctgtcagagggaaagactgtgcagtaattgtcac

SEQ ID NO: 121984 - DNA, 35 bp, Artificial Sequence
  Description of Artificial Sequence: Synthetic oligonucleotide
tgtcagagggaaagactgtgcagtaattgtcacac

SEQ ID NO: 121985 - DNA, 34 bp, Artificial Sequence
  Description of Artificial Sequence: Synthetic oligonucleotide
gtcagagggaaagactgtgcagtaattgtcacac

SEQ ID NO: 121986 - DNA, 35 bp, Artificial Sequence
  Description of Artificial Sequence: Synthetic oligonucleotide
tcagagggaaagactgtgcagtaattgtcacacag

SEQ ID NO: 121987 - DNA, 34 bp, Artificial Sequence
  Description of Artificial Sequence: Synthetic oligonucleotide
cagagggaaagactgtgcagtaattgtcacacag

SEQ ID NO: 121988 - DNA, 36 bp, Artificial Sequence
  Description of Artificial Sequence: Synthetic oligonucleotide
agagggaaagactgtgcagtaattgtcacacagaag

SEQ ID NO: 121989 - DNA, 35 bp, Artificial Sequence
  Description of Artificial Sequence: Synthetic oligonucleotide
gagggaaagactgtgcagtaattgtcacacagaag

SEQ ID NO: 121990 - DNA, 38 bp, Artificial Sequence
  Description of Artificial Sequence: Synthetic oligonucleotide
agggaaagactgtgcagtaattgtcacacagaagaaag

SEQ ID NO: 121991 - DNA, 37 bp, Artificial Sequence
  Description of Artificial Sequence: Synthetic oligonucleotide
gggaaagactgtgcagtaattgtcacacagaagaaag

SEQ ID NO: 121992 - DNA, 39 bp, Artificial Sequence
  Description of Artificial Sequence: Synthetic oligonucleotide
ggaaagactgtgcagtaattgtcacacagaagaaagtac

SEQ ID NO: 121993 - DNA, 39 bp, Artificial Sequence
  Description of Artificial Sequence: Synthetic oligonucleotide
gaaagactgtgcagtaattgtcacacagaagaaagtacc

SEQ ID NO: 121994 - DNA, 40 bp, Artificial Sequence
  Description of Artificial Sequence: Synthetic oligonucleotide
aaagactgtgcagtaattgtcacacagaagaaagtacctg

SEQ ID NO: 121995 - DNA, 39 bp, Artificial Sequence
  Description of Artificial Sequence: Synthetic oligonucleotide
aagactgtgcagtaattgtcacacagaagaaagtacctg

SEQ ID NO: 121996 - DNA, 38 bp, Artificial Sequence
  Description of Artificial Sequence: Synthetic oligonucleotide
agactgtgcagtaattgtcacacagaagaaagtacctg

SEQ ID NO: 121997 - DNA, 37 bp, Artificial Sequence
  Description of Artificial Sequence: Synthetic oligonucleotide
gactgtgcagtaattgtcacacagaagaaagtacctg

SEQ ID NO: 121998 - DNA, 38 bp, Artificial Sequence
  Description of Artificial Sequence: Synthetic oligonucleotide
actgtgcagtaattgtcacacagaagaaagtacctgac

SEQ ID NO: 121999 - DNA, 37 bp, Artificial Sequence
  Description of Artificial Sequence: Synthetic oligonucleotide
ctgtgcagtaattgtcacacagaagaaagtacctgac

SEQ ID NO: 122000 - DNA, 45 bp, Artificial Sequence
  Description of Artificial Sequence: Synthetic oligonucleotide
tgtgcagtaattgtcacacagaagaaagtacctgacaaattattg

SEQ ID NO: 122001 - DNA, 44 bp, Artificial Sequence
  Description of Artificial Sequence: Synthetic oligonucleotide
gtgcagtaattgtcacacagaagaaagtacctgacaaattattg

SEQ ID NO: 122002 - DNA, 44 bp, Artificial Sequence
  Description of Artificial Sequence: Synthetic oligonucleotide
tgcagtaattgtcacacagaagaaagtacctgacaaattattgg

SEQ ID NO: 122003 - DNA, 43 bp, Artificial Sequence
  Description of Artificial Sequence: Synthetic oligonucleotide
gcagtaattgtcacacagaagaaagtacctgacaaattattgg

SEQ ID NO: 122004 - DNA, 46 bp, Artificial Sequence
  Description of Artificial Sequence: Synthetic oligonucleotide
cagtaattgtcacacagaagaaagtacctgacaaattattggattc

SEQ ID NO: 122005 - DNA, 46 bp, Artificial Sequence
  Description of Artificial Sequence: Synthetic oligonucleotide
agtaattgtcacacagaagaaagtacctgacaaattattggattcc

SEQ ID NO: 122006 - DNA, 45 bp, Artificial Sequence
  Description of Artificial Sequence: Synthetic oligonucleotide
gtaattgtcacacagaagaaagtacctgacaaattattggattcc

SEQ ID NO: 122007 - DNA, 46 bp, Artificial Sequence
  Description of Artificial Sequence: Synthetic oligonucleotide
taattgtcacacagaagaaagtacctgacaaattattggattccag

SEQ ID NO: 122008 - DNA, 45 bp, Artificial Sequence
  Description of Artificial Sequence: Synthetic oligonucleotide
aattgtcacacagaagaaagtacctgacaaattattggattccag

SEQ ID NO: 122009 - DNA, 44 bp, Artificial Sequence
  Description of Artificial Sequence: Synthetic oligonucleotide
attgtcacacagaagaaagtacctgacaaattattggattccag

SEQ ID NO: 122010 - DNA, 43 bp, Artificial Sequence
  Description of Artificial Sequence: Synthetic oligonucleotide
ttgtcacacagaagaaagtacctgacaaattattggattccag

SEQ ID NO: 122011 - DNA, 42 bp, Artificial Sequence
  Description of Artificial Sequence: Synthetic oligonucleotide
tgtcacacagaagaaagtacctgacaaattattggattccag

SEQ ID NO: 122012 - DNA, 41 bp, Artificial Sequence
  Description of Artificial Sequence: Synthetic oligonucleotide
gtcacacagaagaaagtacctgacaaattattggattccag

SEQ ID NO: 122013 - DNA, 41 bp, Artificial Sequence
  Description of Artificial Sequence: Synthetic oligonucleotide
tcacacagaagaaagtacctgacaaattattggattccagc

SEQ ID NO: 122014 - DNA, 40 bp, Artificial Sequence
  Description of Artificial Sequence: Synthetic oligonucleotide
cacacagaagaaagtacctgacaaattattggattccagc

SEQ ID NO: 122015 - DNA, 41 bp, Artificial Sequence
  Description of Artificial Sequence: Synthetic oligonucleotide
acacagaagaaagtacctgacaaattattggattccagcac

SEQ ID NO: 122016 - DNA, 40 bp, Artificial Sequence
  Description of Artificial Sequence: Synthetic oligonucleotide
cacagaagaaagtacctgacaaattattggattccagcac

SEQ ID NO: 122017 - DNA, 41 bp, Artificial Sequence
  Description of Artificial Sequence: Synthetic oligonucleotide
acagaagaaagtacctgacaaattattggattccagcacag

SEQ ID NO: 122018 - DNA, 40 bp, Artificial Sequence
  Description of Artificial Sequence: Synthetic oligonucleotide
cagaagaaagtacctgacaaattattggattccagcacag

SEQ ID NO: 122019 - DNA, 41 bp, Artificial Sequence
  Description of Artificial Sequence: Synthetic oligonucleotide
agaagaaagtacctgacaaattattggattccagcacagtg

SEQ ID NO: 122020 - DNA, 40 bp, Artificial Sequence
  Description of Artificial Sequence: Synthetic oligonucleotide
gaagaaagtacctgacaaattattggattccagcacagtg

SEQ ID NO: 122021 - DNA, 41 bp, Artificial Sequence
  Description of Artificial Sequence: Synthetic oligonucleotide
aagaaagtacctgacaaattattggattccagcacagtgac

SEQ ID NO: 122022 - DNA, 40 bp, Artificial Sequence
  Description of Artificial Sequence: Synthetic oligonucleotide
agaaagtacctgacaaattattggattccagcacagtgac

SEQ ID NO: 122023 - DNA, 39 bp, Artificial Sequence
  Description of Artificial Sequence: Synthetic oligonucleotide
gaaagtacctgacaaattattggattccagcacagtgac

SEQ ID NO: 122024 - DNA, 40 bp, Artificial Sequence
  Description of Artificial Sequence: Synthetic oligonucleotide
aaagtacctgacaaattattggattccagcacagtgactc

SEQ ID NO: 122025 - DNA, 39 bp, Artificial Sequence
  Description of Artificial Sequence: Synthetic oligonucleotide
aagtacctgacaaattattggattccagcacagtgactc

SEQ ID NO: 122026 - DNA, 38 bp, Artificial Sequence
  Description of Artificial Sequence: Synthetic oligonucleotide
agtacctgacaaattattggattccagcacagtgactc

SEQ ID NO: 122027 - DNA, 37 bp, Artificial Sequence
  Description of Artificial Sequence: Synthetic oligonucleotide
gtacctgacaaattattggattccagcacagtgactc

SEQ ID NO: 122028 - DNA, 38 bp, Artificial Sequence
  Description of Artificial Sequence: Synthetic oligonucleotide
tacctgacaaattattggattccagcacagtgactcac

SEQ ID NO: 122029 - DNA, 37 bp, Artificial Sequence
  Description of Artificial Sequence: Synthetic oligonucleotide
acctgacaaattattggattccagcacagtgactcac

SEQ ID NO: 122030 - DNA, 36 bp, Artificial Sequence
  Description of Artificial Sequence: Synthetic oligonucleotide
cctgacaaattattggattccagcacagtgactcac

SEQ ID NO: 122031 - DNA, 41 bp, Artificial Sequence
  Description of Artificial Sequence: Synthetic oligonucleotide
ctgacaaattattggattccagcacagtgactcacttattc

SEQ ID NO: 122032 - DNA, 43 bp, Artificial Sequence
  Description of Artificial Sequence: Synthetic oligonucleotide
tgacaaattattggattccagcacagtgactcacttattcaag

SEQ ID NO: 122033 - DNA, 42 bp, Artificial Sequence
  Description of Artificial Sequence: Synthetic oligonucleotide
gacaaattattggattccagcacagtgactcacttattcaag

SEQ ID NO: 122034 - DNA, 46 bp, Artificial Sequence
  Description of Artificial Sequence: Synthetic oligonucleotide
acaaattattggattccagcacagtgactcacttattcaagataac

SEQ ID NO: 122035 - DNA, 45 bp, Artificial Sequence
  Description of Artificial Sequence: Synthetic oligonucleotide
caaattattggattccagcacagtgactcacttattcaagataac

SEQ ID NO: 122036 - DNA, 46 bp, Artificial Sequence
  Description of Artificial Sequence: Synthetic oligonucleotide
aaattattggattccagcacagtgactcacttattcaagataactg

SEQ ID NO: 122037 - DNA, 45 bp, Artificial Sequence
  Description of Artificial Sequence: Synthetic oligonucleotide
aattattggattccagcacagtgactcacttattcaagataactg

SEQ ID NO: 122038 - DNA, 44 bp, Artificial Sequence
  Description of Artificial Sequence: Synthetic oligonucleotide
attattggattccagcacagtgactcacttattcaagataactg

SEQ ID NO: 122039 - DNA, 43 bp, Artificial Sequence
  Description of Artificial Sequence: Synthetic oligonucleotide
ttattggattccagcacagtgactcacttattcaagataactg

SEQ ID NO: 122040 - DNA, 42 bp, Artificial Sequence
  Description of Artificial Sequence: Synthetic oligonucleotide
tattggattccagcacagtgactcacttattcaagataactg

SEQ ID NO: 122041 - DNA, 41 bp, Artificial Sequence
  Description of Artificial Sequence: Synthetic oligonucleotide
attggattccagcacagtgactcacttattcaagataactg

SEQ ID NO: 122042 - DNA, 40 bp, Artificial Sequence
  Description of Artificial Sequence: Synthetic oligonucleotide
ttggattccagcacagtgactcacttattcaagataactg

SEQ ID NO: 122043 - DNA, 39 bp, Artificial Sequence
  Description of Artificial Sequence: Synthetic oligonucleotide
tggattccagcacagtgactcacttattcaagataactg

SEQ ID NO: 122044 - DNA, 38 bp, Artificial Sequence
  Description of Artificial Sequence: Synthetic oligonucleotide
ggattccagcacagtgactcacttattcaagataactg

SEQ ID NO: 122045 - DNA, 42 bp, Artificial Sequence
  Description of Artificial Sequence: Synthetic oligonucleotide
gattccagcacagtgactcacttattcaagataactgaaaac

SEQ ID NO: 122046 - DNA, 45 bp, Artificial Sequence
  Description of Artificial Sequence: Synthetic oligonucleotide
attccagcacagtgactcacttattcaagataactgaaaacattg

SEQ ID NO: 122047 - DNA, 44 bp, Artificial Sequence
  Description of Artificial Sequence: Synthetic oligonucleotide
ttccagcacagtgactcacttattcaagataactgaaaacattg

SEQ ID NO: 122048 - DNA, 43 bp, Artificial Sequence
  Description of Artificial Sequence: Synthetic oligonucleotide
tccagcacagtgactcacttattcaagataactgaaaacattg

SEQ ID NO: 122049 - DNA, 42 bp, Artificial Sequence
  Description of Artificial Sequence: Synthetic oligonucleotide
ccagcacagtgactcacttattcaagataactgaaaacattg

SEQ ID NO: 122050 - DNA, 42 bp, Artificial Sequence
  Description of Artificial Sequence: Synthetic oligonucleotide
cagcacagtgactcacttattcaagataactgaaaacattgg

SEQ ID NO: 122051 - DNA, 44 bp, Artificial Sequence
  Description of Artificial Sequence: Synthetic oligonucleotide
agcacagtgactcacttattcaagataactgaaaacattggttg

SEQ ID NO: 122052 - DNA, 43 bp, Artificial Sequence
  Description of Artificial Sequence: Synthetic oligonucleotide
gcacagtgactcacttattcaagataactgaaaacattggttg

SEQ ID NO: 122053 - DNA, 44 bp, Artificial Sequence
  Description of Artificial Sequence: Synthetic oligonucleotide
cacagtgactcacttattcaagataactgaaaacattggttgtg

SEQ ID NO: 122054 - DNA, 45 bp, Artificial Sequence
  Description of Artificial Sequence: Synthetic oligonucleotide
acagtgactcacttattcaagataactgaaaacattggttgtgtg

SEQ ID NO: 122055 - DNA, 44 bp, Artificial Sequence
  Description of Artificial Sequence: Synthetic oligonucleotide
cagtgactcacttattcaagataactgaaaacattggttgtgtg

SEQ ID NO: 122056 - DNA, 46 bp, Artificial Sequence
  Description of Artificial Sequence: Synthetic oligonucleotide
agtgactcacttattcaagataactgaaaacattggttgtgtgatg

SEQ ID NO: 122057 - DNA, 45 bp, Artificial Sequence
  Description of Artificial Sequence: Synthetic oligonucleotide
gtgactcacttattcaagataactgaaaacattggttgtgtgatg

SEQ ID NO: 122058 - DNA, 46 bp, Artificial Sequence
  Description of Artificial Sequence: Synthetic oligonucleotide
tgactcacttattcaagataactgaaaacattggttgtgtgatgac

SEQ ID NO: 122059 - DNA, 45 bp, Artificial Sequence
  Description of Artificial Sequence: Synthetic oligonucleotide
gactcacttattcaagataactgaaaacattggttgtgtgatgac

SEQ ID NO: 122060 - DNA, 45 bp, Artificial Sequence
  Description of Artificial Sequence: Synthetic oligonucleotide
actcacttattcaagataactgaaaacattggttgtgtgatgacc

SEQ ID NO: 122061 - DNA, 44 bp, Artificial Sequence
  Description of Artificial Sequence: Synthetic oligonucleotide
ctcacttattcaagataactgaaaacattggttgtgtgatgacc

SEQ ID NO: 122062 - DNA, 44 bp, Artificial Sequence
  Description of Artificial Sequence: Synthetic oligonucleotide
tcacttattcaagataactgaaaacattggttgtgtgatgaccg

SEQ ID NO: 122063 - DNA, 43 bp, Artificial Sequence
  Description of Artificial Sequence: Synthetic oligonucleotide
cacttattcaagataactgaaaacattggttgtgtgatgaccg

SEQ ID NO: 122064 - DNA, 43 bp, Artificial Sequence
  Description of Artificial Sequence: Synthetic oligonucleotide
acttattcaagataactgaaaacattggttgtgtgatgaccgg

SEQ ID NO: 122065 - DNA, 42 bp, Artificial Sequence
  Description of Artificial Sequence: Synthetic oligonucleotide
cttattcaagataactgaaaacattggttgtgtgatgaccgg

SEQ ID NO: 122066 - DNA, 45 bp, Artificial Sequence
  Description of Artificial Sequence: Synthetic oligonucleotide
ttattcaagataactgaaaacattggttgtgtgatgaccggaatg

SEQ ID NO: 122067 - DNA, 44 bp, Artificial Sequence
  Description of Artificial Sequence: Synthetic oligonucleotide
tattcaagataactgaaaacattggttgtgtgatgaccggaatg

SEQ ID NO: 122068 - DNA, 43 bp, Artificial Sequence
  Description of Artificial Sequence: Synthetic oligonucleotide
attcaagataactgaaaacattggttgtgtgatgaccggaatg

SEQ ID NO: 122069 - DNA, 42 bp, Artificial Sequence
  Description of Artificial Sequence: Synthetic oligonucleotide
ttcaagataactgaaaacattggttgtgtgatgaccggaatg

SEQ ID NO: 122070 - DNA, 41 bp, Artificial Sequence
  Description of Artificial Sequence: Synthetic oligonucleotide
tcaagataactgaaaacattggttgtgtgatgaccggaatg

SEQ ID NO: 122071 - DNA, 40 bp, Artificial Sequence
  Description of Artificial Sequence: Synthetic oligonucleotide
caagataactgaaaacattggttgtgtgatgaccggaatg

SEQ ID NO: 122072 - DNA, 41 bp, Artificial Sequence
  Description of Artificial Sequence: Synthetic oligonucleotide
aagataactgaaaacattggttgtgtgatgaccggaatgac

SEQ ID NO: 122073 - DNA, 40 bp, Artificial Sequence
  Description of Artificial Sequence: Synthetic oligonucleotide
agataactgaaaacattggttgtgtgatgaccggaatgac

SEQ ID NO: 122074 - DNA, 39 bp, Artificial Sequence
  Description of Artificial Sequence: Synthetic oligonucleotide
gataactgaaaacattggttgtgtgatgaccggaatgac

SEQ ID NO: 122075 - DNA, 40 bp, Artificial Sequence
  Description of Artificial Sequence: Synthetic oligonucleotide
ataactgaaaacattggttgtgtgatgaccggaatgacag

SEQ ID NO: 122076 - DNA, 39 bp, Artificial Sequence
  Description of Artificial Sequence: Synthetic oligonucleotide
taactgaaaacattggttgtgtgatgaccggaatgacag

SEQ ID NO: 122077 - DNA, 38 bp, Artificial Sequence
  Description of Artificial Sequence: Synthetic oligonucleotide
aactgaaaacattggttgtgtgatgaccggaatgacag

SEQ ID NO: 122078 - DNA, 37 bp, Artificial Sequence
  Description of Artificial Sequence: Synthetic oligonucleotide
actgaaaacattggttgtgtgatgaccggaatgacag

SEQ ID NO: 122079 - DNA, 36 bp, Artificial Sequence
  Description of Artificial Sequence: Synthetic oligonucleotide
ctgaaaacattggttgtgtgatgaccggaatgacag

SEQ ID NO: 122080 - DNA, 36 bp, Artificial Sequence
  Description of Artificial Sequence: Synthetic oligonucleotide
tgaaaacattggttgtgtgatgaccggaatgacagc

SEQ ID NO: 122081 - DNA, 35 bp, Artificial Sequence
  Description of Artificial Sequence: Synthetic oligonucleotide
gaaaacattggttgtgtgatgaccggaatgacagc

SEQ ID NO: 122082 - DNA, 36 bp, Artificial Sequence
  Description of Artificial Sequence: Synthetic oligonucleotide
aaaacattggttgtgtgatgaccggaatgacagctg

SEQ ID NO: 122083 - DNA, 35 bp, Artificial Sequence
  Description of Artificial Sequence: Synthetic oligonucleotide
aaacattggttgtgtgatgaccggaatgacagctg

SEQ ID NO: 122084 - DNA, 34 bp, Artificial Sequence
  Description of Artificial Sequence: Synthetic oligonucleotide
aacattggttgtgtgatgaccggaatgacagctg

SEQ ID NO: 122085 - DNA, 33 bp, Artificial Sequence
  Description of Artificial Sequence: Synthetic oligonucleotide
acattggttgtgtgatgaccggaatgacagctg

SEQ ID NO: 122086 - DNA, 32 bp, Artificial Sequence
  Description of Artificial Sequence: Synthetic oligonucleotide
cattggttgtgtgatgaccggaatgacagctg

SEQ ID NO: 122087 - DNA, 33 bp, Artificial Sequence
  Description of Artificial Sequence: Synthetic oligonucleotide
attggttgtgtgatgaccggaatgacagctgac

SEQ ID NO: 122088 - DNA, 32 bp, Artificial Sequence
  Description of Artificial Sequence: Synthetic oligonucleotide
ttggttgtgtgatgaccggaatgacagctgac

SEQ ID NO: 122089 - DNA, 31 bp, Artificial Sequence
  Description of Artificial Sequence: Synthetic oligonucleotide
tggttgtgtgatgaccggaatgacagctgac

SEQ ID NO: 122090 - DNA, 30 bp, Artificial Sequence
  Description of Artificial Sequence: Synthetic oligonucleotide
ggttgtgtgatgaccggaatgacagctgac

SEQ ID NO: 122091 - DNA, 31 bp, Artificial Sequence
  Description of Artificial Sequence: Synthetic oligonucleotide
gttgtgtgatgaccggaatgacagctgacag

SEQ ID NO: 122092 - DNA, 31 bp, Artificial Sequence
  Description of Artificial Sequence: Synthetic oligonucleotide
ttgtgtgatgaccggaatgacagctgacagc

SEQ ID NO: 122093 - DNA, 30 bp, Artificial Sequence
  Description of Artificial Sequence: Synthetic oligonucleotide
tgtgtgatgaccggaatgacagctgacagc

SEQ ID NO: 122094 - DNA, 29 bp, Artificial Sequence
  Description of Artificial Sequence: Synthetic oligonucleotide
gtgtgatgaccggaatgacagctgacagc

SEQ ID NO: 122095 - DNA, 30 bp, Artificial Sequence
  Description of Artificial Sequence: Synthetic oligonucleotide
tgtgatgaccggaatgacagctgacagcag

SEQ ID NO: 122096 - DNA, 29 bp, Artificial Sequence
  Description of Artificial Sequence: Synthetic oligonucleotide
gtgatgaccggaatgacagctgacagcag

SEQ ID NO: 122097 - DNA, 31 bp, Artificial Sequence
  Description of Artificial Sequence: Synthetic oligonucleotide
tgatgaccggaatgacagctgacagcagatc

SEQ ID NO: 122098 - DNA, 30 bp, Artificial Sequence
  Description of Artificial Sequence: Synthetic oligonucleotide
gatgaccggaatgacagctgacagcagatc

SEQ ID NO: 122099 - DNA, 30 bp, Artificial Sequence
  Description of Artificial Sequence: Synthetic oligonucleotide
atgaccggaatgacagctgacagcagatcc

SEQ ID NO: 122100 - DNA, 29 bp, Artificial Sequence
  Description of Artificial Sequence: Synthetic oligonucleotide
tgaccggaatgacagctgacagcagatcc

SEQ ID NO: 122101 - DNA, 28 bp, Artificial Sequence
  Description of Artificial Sequence: Synthetic oligonucleotide
gaccggaatgacagctgacagcagatcc

SEQ ID NO: 122102 - DNA, 28 bp, Artificial Sequence
  Description of Artificial Sequence: Synthetic oligonucleotide
accggaatgacagctgacagcagatccc

SEQ ID NO: 122103 - DNA, 27 bp, Artificial Sequence
  Description of Artificial Sequence: Synthetic oligonucleotide
ccggaatgacagctgacagcagatccc

SEQ ID NO: 122104 - DNA, 28 bp, Artificial Sequence
  Description of Artificial Sequence: Synthetic oligonucleotide
cggaatgacagctgacagcagatcccag

SEQ ID NO: 122105 - DNA, 28 bp, Artificial Sequence
  Description of Artificial Sequence: Synthetic oligonucleotide
ggaatgacagctgacagcagatcccagg

SEQ ID NO: 122106 - DNA, 30 bp, Artificial Sequence
  Description of Artificial Sequence: Synthetic oligonucleotide
gaatgacagctgacagcagatcccaggtac

SEQ ID NO: 122107 - DNA, 31 bp, Artificial Sequence
  Description of Artificial Sequence: Synthetic oligonucleotide
aatgacagctgacagcagatcccaggtacag

SEQ ID NO: 122108 - DNA, 30 bp, Artificial Sequence
  Description of Artificial Sequence: Synthetic oligonucleotide
atgacagctgacagcagatcccaggtacag

SEQ ID NO: 122109 - DNA, 29 bp, Artificial Sequence
  Description of Artificial Sequence: Synthetic oligonucleotide
tgacagctgacagcagatcccaggtacag

SEQ ID NO: 122110 - DNA, 28 bp, Artificial Sequence
  Description of Artificial Sequence: Synthetic oligonucleotide
gacagctgacagcagatcccaggtacag

SEQ ID NO: 122111 - DNA, 29 bp, Artificial Sequence
  Description of Artificial Sequence: Synthetic oligonucleotide
acagctgacagcagatcccaggtacagag

SEQ ID NO: 122112 - DNA, 28 bp, Artificial Sequence
  Description of Artificial Sequence: Synthetic oligonucleotide
cagctgacagcagatcccaggtacagag

SEQ ID NO: 122113 - DNA, 28 bp, Artificial Sequence
  Description of Artificial Sequence: Synthetic oligonucleotide
agctgacagcagatcccaggtacagagg

SEQ ID NO: 122114 - DNA, 27 bp, Artificial Sequence
  Description of Artificial Sequence: Synthetic oligonucleotide
gctgacagcagatcccaggtacagagg

SEQ ID NO: 122115 - DNA, 27 bp, Artificial Sequence
  Description of Artificial Sequence: Synthetic oligonucleotide
ctgacagcagatcccaggtacagaggg

SEQ ID NO: 122116 - DNA, 27 bp, Artificial Sequence
  Description of Artificial Sequence: Synthetic oligonucleotide
tgacagcagatcccaggtacagagggc

SEQ ID NO: 122117 - DNA, 27 bp, Artificial Sequence
  Description of Artificial Sequence: Synthetic oligonucleotide
gacagcagatcccaggtacagagggca

SEQ ID NO: 122118 - DNA, 27 bp, Artificial Sequence
  Description of Artificial Sequence: Synthetic oligonucleotide
acagcagatcccaggtacagagggcac

SEQ ID NO: 122119 - DNA, 26 bp, Artificial Sequence
  Description of Artificial Sequence: Synthetic oligonucleotide
cagcagatcccaggtacagagggcac

SEQ ID NO: 122120 - DNA, 26 bp, Artificial Sequence
  Description of Artificial Sequence: Synthetic oligonucleotide
agcagatcccaggtacagagggcacg

SEQ ID NO: 122121 - DNA, 25 bp, Artificial Sequence
  Description of Artificial Sequence: Synthetic oligonucleotide
gcagatcccaggtacagagggcacg

SEQ ID NO: 122122 - DNA, 27 bp, Artificial Sequence
  Description of Artificial Sequence: Synthetic oligonucleotide
cagatcccaggtacagagggcacgcta

SEQ ID NO: 122123 - DNA, 28 bp, Artificial Sequence
  Description of Artificial Sequence: Synthetic oligonucleotide
agatcccaggtacagagggcacgctatg

SEQ ID NO: 122124 - DNA, 27 bp, Artificial Sequence
  Description of Artificial Sequence: Synthetic oligonucleotide
gatcccaggtacagagggcacgctatg

SEQ ID NO: 122125 - DNA, 28 bp, Artificial Sequence
  Description of Artificial Sequence: Synthetic oligonucleotide
atcccaggtacagagggcacgctatgag

SEQ ID NO: 122126 - DNA, 27 bp, Artificial Sequence
  Description of Artificial Sequence: Synthetic oligonucleotide
tcccaggtacagagggcacgctatgag

SEQ ID NO: 122127 - DNA, 26 bp, Artificial Sequence
  Description of Artificial Sequence: Synthetic oligonucleotide
cccaggtacagagggcacgctatgag

SEQ ID NO: 122128 - DNA, 26 bp, Artificial Sequence
  Description of Artificial Sequence: Synthetic oligonucleotide
ccaggtacagagggcacgctatgagg

SEQ ID NO: 122129 - DNA, 27 bp, Artificial Sequence
  Description of Artificial Sequence: Synthetic oligonucleotide
caggtacagagggcacgctatgaggca

SEQ ID NO: 122130 - DNA, 27 bp, Artificial Sequence
  Description of Artificial Sequence: Synthetic oligonucleotide
aggtacagagggcacgctatgaggcag

SEQ ID NO: 122131 - DNA, 26 bp, Artificial Sequence
  Description of Artificial Sequence: Synthetic oligonucleotide
ggtacagagggcacgctatgaggcag

SEQ ID NO: 122132 - DNA, 27 bp, Artificial Sequence
  Description of Artificial Sequence: Synthetic oligonucleotide
gtacagagggcacgctatgaggcagct

SEQ ID NO: 122133 - DNA, 29 bp, Artificial Sequence
  Description of Artificial Sequence: Synthetic oligonucleotide
tacagagggcacgctatgaggcagctaac

SEQ ID NO: 122134 - DNA, 28 bp, Artificial Sequence
  Description of Artificial Sequence: Synthetic oligonucleotide
acagagggcacgctatgaggcagctaac

SEQ ID NO: 122135 - DNA, 27 bp, Artificial Sequence
  Description of Artificial Sequence: Synthetic oligonucleotide
cagagggcacgctatgaggcagctaac

SEQ ID NO: 122136 - DNA, 28 bp, Artificial Sequence
  Description of Artificial Sequence: Synthetic oligonucleotide
agagggcacgctatgaggcagctaactg

SEQ ID NO: 122137 - DNA, 27 bp, Artificial Sequence
  Description of Artificial Sequence: Synthetic oligonucleotide
gagggcacgctatgaggcagctaactg

SEQ ID NO: 122138 - DNA, 27 bp, Artificial Sequence
  Description of Artificial Sequence: Synthetic oligonucleotide
agggcacgctatgaggcagctaactgg

SEQ ID NO: 122139 - DNA, 27 bp, Artificial Sequence
  Description of Artificial Sequence: Synthetic oligonucleotide
gggcacgctatgaggcagctaactgga

SEQ ID NO: 122140 - DNA, 31 bp, Artificial Sequence
  Description of Artificial Sequence: Synthetic oligonucleotide
ggcacgctatgaggcagctaactggaaatac

SEQ ID NO: 122141 - DNA, 33 bp, Artificial Sequence
  Description of Artificial Sequence: Synthetic oligonucleotide
gcacgctatgaggcagctaactggaaatacaag

SEQ ID NO: 122142 - DNA, 36 bp, Artificial Sequence
  Description of Artificial Sequence: Synthetic oligonucleotide
cacgctatgaggcagctaactggaaatacaagtatg

SEQ ID NO: 122143 - DNA, 36 bp, Artificial Sequence
  Description of Artificial Sequence: Synthetic oligonucleotide
acgctatgaggcagctaactggaaatacaagtatgg

SEQ ID NO: 122144 - DNA, 35 bp, Artificial Sequence
  Description of Artificial Sequence: Synthetic oligonucleotide
cgctatgaggcagctaactggaaatacaagtatgg

SEQ ID NO: 122145 - DNA, 35 bp, Artificial Sequence
  Description of Artificial Sequence: Synthetic oligonucleotide
gctatgaggcagctaactggaaatacaagtatggc

SEQ ID NO: 122146 - DNA, 38 bp, Artificial Sequence
  Description of Artificial Sequence: Synthetic oligonucleotide
ctatgaggcagctaactggaaatacaagtatggctatg

SEQ ID NO: 122147 - DNA, 39 bp, Artificial Sequence
  Description of Artificial Sequence: Synthetic oligonucleotide
tatgaggcagctaactggaaatacaagtatggctatgag

SEQ ID NO: 122148 - DNA, 38 bp, Artificial Sequence
  Description of Artificial Sequence: Synthetic oligonucleotide
atgaggcagctaactggaaatacaagtatggctatgag

SEQ ID NO: 122149 - DNA, 37 bp, Artificial Sequence
  Description of Artificial Sequence: Synthetic oligonucleotide
tgaggcagctaactggaaatacaagtatggctatgag

SEQ ID NO: 122150 - DNA, 36 bp, Artificial Sequence
  Description of Artificial Sequence: Synthetic oligonucleotide
gaggcagctaactggaaatacaagtatggctatgag

SEQ ID NO: 122151 - DNA, 39 bp, Artificial Sequence
  Description of Artificial Sequence: Synthetic oligonucleotide
aggcagctaactggaaatacaagtatggctatgagattc

SEQ ID NO: 122152 - DNA, 38 bp, Artificial Sequence
  Description of Artificial Sequence: Synthetic oligonucleotide
ggcagctaactggaaatacaagtatggctatgagattc

SEQ ID NO: 122153 - DNA, 38 bp, Artificial Sequence
  Description of Artificial Sequence: Synthetic oligonucleotide
gcagctaactggaaatacaagtatggctatgagattcc

SEQ ID NO: 122154 - DNA, 39 bp, Artificial Sequence
  Description of Artificial Sequence: Synthetic oligonucleotide
cagctaactggaaatacaagtatggctatgagattcctg

SEQ ID NO: 122155 - DNA, 40 bp, Artificial Sequence
  Description of Artificial Sequence: Synthetic oligonucleotide
agctaactggaaatacaagtatggctatgagattcctgtg

SEQ ID NO: 122156 - DNA, 39 bp, Artificial Sequence
  Description of Artificial Sequence: Synthetic oligonucleotide
gctaactggaaatacaagtatggctatgagattcctgtg

SEQ ID NO: 122157 - DNA, 39 bp, Artificial Sequence
  Description of Artificial Sequence: Synthetic oligonucleotide
ctaactggaaatacaagtatggctatgagattcctgtgg

SEQ ID NO: 122158 - DNA, 40 bp, Artificial Sequence
  Description of Artificial Sequence: Synthetic oligonucleotide
taactggaaatacaagtatggctatgagattcctgtggac

SEQ ID NO: 122159 - DNA, 39 bp, Artificial Sequence
  Description of Artificial Sequence: Synthetic oligonucleotide
aactggaaatacaagtatggctatgagattcctgtggac

SEQ ID NO: 122160 - DNA, 38 bp, Artificial Sequence
  Description of Artificial Sequence: Synthetic oligonucleotide
actggaaatacaagtatggctatgagattcctgtggac

SEQ ID NO: 122161 - DNA, 37 bp, Artificial Sequence
  Description of Artificial Sequence: Synthetic oligonucleotide
ctggaaatacaagtatggctatgagattcctgtggac

SEQ ID NO: 122162 - DNA, 39 bp, Artificial Sequence
  Description of Artificial Sequence: Synthetic oligonucleotide
tggaaatacaagtatggctatgagattcctgtggacatg

SEQ ID NO: 122163 - DNA, 38 bp, Artificial Sequence
  Description of Artificial Sequence: Synthetic oligonucleotide
ggaaatacaagtatggctatgagattcctgtggacatg

SEQ ID NO: 122164 - DNA, 38 bp, Artificial Sequence
  Description of Artificial Sequence: Synthetic oligonucleotide
gaaatacaagtatggctatgagattcctgtggacatgc

SEQ ID NO: 122165 - DNA, 39 bp, Artificial Sequence
  Description of Artificial Sequence: Synthetic oligonucleotide
aaatacaagtatggctatgagattcctgtggacatgctg

SEQ ID NO: 122166 - DNA, 38 bp, Artificial Sequence
  Description of Artificial Sequence: Synthetic oligonucleotide
aatacaagtatggctatgagattcctgtggacatgctg

SEQ ID NO: 122167 - DNA, 37 bp, Artificial Sequence
  Description of Artificial Sequence: Synthetic oligonucleotide
atacaagtatggctatgagattcctgtggacatgctg

SEQ ID NO: 122168 - DNA, 36 bp, Artificial Sequence
  Description of Artificial Sequence: Synthetic oligonucleotide
tacaagtatggctatgagattcctgtggacatgctg

SEQ ID NO: 122169 - DNA, 35 bp, Artificial Sequence
  Description of Artificial Sequence: Synthetic oligonucleotide
acaagtatggctatgagattcctgtggacatgctg

SEQ ID NO: 122170 - DNA, 34 bp, Artificial Sequence
  Description of Artificial Sequence: Synthetic oligonucleotide
caagtatggctatgagattcctgtggacatgctg

SEQ ID NO: 122171 - DNA, 35 bp, Artificial Sequence
  Description of Artificial Sequence: Synthetic oligonucleotide
aagtatggctatgagattcctgtggacatgctgtg

SEQ ID NO: 122172 - DNA, 34 bp, Artificial Sequence
  Description of Artificial Sequence: Synthetic oligonucleotide
agtatggctatgagattcctgtggacatgctgtg

SEQ ID NO: 122173 - DNA, 33 bp, Artificial Sequence
  Description of Artificial Sequence: Synthetic oligonucleotide
gtatggctatgagattcctgtggacatgctgtg

SEQ ID NO: 122174 - DNA, 38 bp, Artificial Sequence
  Description of Artificial Sequence: Synthetic oligonucleotide
tatggctatgagattcctgtggacatgctgtgtaaaag

SEQ ID NO: 122175 - DNA, 37 bp, Artificial Sequence
  Description of Artificial Sequence: Synthetic oligonucleotide
atggctatgagattcctgtggacatgctgtgtaaaag

SEQ ID NO: 122176 - DNA, 36 bp, Artificial Sequence
  Description of Artificial Sequence: Synthetic oligonucleotide
tggctatgagattcctgtggacatgctgtgtaaaag

SEQ ID NO: 122177 - DNA, 35 bp, Artificial Sequence
  Description of Artificial Sequence: Synthetic oligonucleotide
ggctatgagattcctgtggacatgctgtgtaaaag

SEQ ID NO: 122178 - DNA, 39 bp, Artificial Sequence
  Description of Artificial Sequence: Synthetic oligonucleotide
gctatgagattcctgtggacatgctgtgtaaaagaattg

SEQ ID NO: 122179 - DNA, 39 bp, Artificial Sequence
  Description of Artificial Sequence: Synthetic oligonucleotide
ctatgagattcctgtggacatgctgtgtaaaagaattgc

SEQ ID NO: 122180 - DNA, 39 bp, Artificial Sequence
  Description of Artificial Sequence: Synthetic oligonucleotide
tatgagattcctgtggacatgctgtgtaaaagaattgcc

SEQ ID NO: 122181 - DNA, 38 bp, Artificial Sequence
  Description of Artificial Sequence: Synthetic oligonucleotide
atgagattcctgtggacatgctgtgtaaaagaattgcc

SEQ ID NO: 122182 - DNA, 37 bp, Artificial Sequence
  Description of Artificial Sequence: Synthetic oligonucleotide
tgagattcctgtggacatgctgtgtaaaagaattgcc

SEQ ID NO: 122183 - DNA, 36 bp, Artificial Sequence
  Description of Artificial Sequence: Synthetic oligonucleotide
gagattcctgtggacatgctgtgtaaaagaattgcc

SEQ ID NO: 122184 - DNA, 36 bp, Artificial Sequence
  Description of Artificial Sequence: Synthetic oligonucleotide
agattcctgtggacatgctgtgtaaaagaattgccg

SEQ ID NO: 122185 - DNA, 35 bp, Artificial Sequence
  Description of Artificial Sequence: Synthetic oligonucleotide
gattcctgtggacatgctgtgtaaaagaattgccg

SEQ ID NO: 122186 - DNA, 41 bp, Artificial Sequence
  Description of Artificial Sequence: Synthetic oligonucleotide
attcctgtggacatgctgtgtaaaagaattgccgatatttc

SEQ ID NO: 122187 - DNA, 40 bp, Artificial Sequence
  Description of Artificial Sequence: Synthetic oligonucleotide
ttcctgtggacatgctgtgtaaaagaattgccgatatttc

SEQ ID NO: 122188 - DNA, 39 bp, Artificial Sequence
  Description of Artificial Sequence: Synthetic oligonucleotide
tcctgtggacatgctgtgtaaaagaattgccgatatttc

SEQ ID NO: 122189 - DNA, 38 bp, Artificial Sequence
  Description of Artificial Sequence: Synthetic oligonucleotide
cctgtggacatgctgtgtaaaagaattgccgatatttc

SEQ ID NO: 122190 - DNA, 39 bp, Artificial Sequence
  Description of Artificial Sequence: Synthetic oligonucleotide
ctgtggacatgctgtgtaaaagaattgccgatatttctc

SEQ ID NO: 122191 - DNA, 40 bp, Artificial Sequence
  Description of Artificial Sequence: Synthetic oligonucleotide
tgtggacatgctgtgtaaaagaattgccgatatttctcag

SEQ ID NO: 122192 - DNA, 39 bp, Artificial Sequence
  Description of Artificial Sequence: Synthetic oligonucleotide
gtggacatgctgtgtaaaagaattgccgatatttctcag

SEQ ID NO: 122193 - DNA, 39 bp, Artificial Sequence
  Description of Artificial Sequence: Synthetic oligonucleotide
tggacatgctgtgtaaaagaattgccgatatttctcagg

SEQ ID NO: 122194 - DNA, 38 bp, Artificial Sequence
  Description of Artificial Sequence: Synthetic oligonucleotide
ggacatgctgtgtaaaagaattgccgatatttctcagg

SEQ ID NO: 122195 - DNA, 39 bp, Artificial Sequence
  Description of Artificial Sequence: Synthetic oligonucleotide
gacatgctgtgtaaaagaattgccgatatttctcaggtc

SEQ ID NO: 122196 - DNA, 41 bp, Artificial Sequence
  Description of Artificial Sequence: Synthetic oligonucleotide
acatgctgtgtaaaagaattgccgatatttctcaggtctac

SEQ ID NO: 122197 - DNA, 40 bp, Artificial Sequence
  Description of Artificial Sequence: Synthetic oligonucleotide
catgctgtgtaaaagaattgccgatatttctcaggtctac

SEQ ID NO: 122198 - DNA, 41 bp, Artificial Sequence
  Description of Artificial Sequence: Synthetic oligonucleotide
atgctgtgtaaaagaattgccgatatttctcaggtctacac

SEQ ID NO: 122199 - DNA, 40 bp, Artificial Sequence
  Description of Artificial Sequence: Synthetic oligonucleotide
tgctgtgtaaaagaattgccgatatttctcaggtctacac

SEQ ID NO: 122200 - DNA, 39 bp, Artificial Sequence
  Description of Artificial Sequence: Synthetic oligonucleotide
gctgtgtaaaagaattgccgatatttctcaggtctacac

SEQ ID NO: 122201 - DNA, 40 bp, Artificial Sequence
  Description of Artificial Sequence: Synthetic oligonucleotide
ctgtgtaaaagaattgccgatatttctcaggtctacacac

SEQ ID NO: 122202 - DNA, 41 bp, Artificial Sequence
  Description of Artificial Sequence: Synthetic oligonucleotide
tgtgtaaaagaattgccgatatttctcaggtctacacacag

SEQ ID NO: 122203 - DNA, 40 bp, Artificial Sequence
  Description of Artificial Sequence: Synthetic oligonucleotide
gtgtaaaagaattgccgatatttctcaggtctacacacag

SEQ ID NO: 122204 - DNA, 43 bp, Artificial Sequence
  Description of Artificial Sequence: Synthetic oligonucleotide
tgtaaaagaattgccgatatttctcaggtctacacacagaatg

SEQ ID NO: 122205 - DNA, 42 bp, Artificial Sequence
  Description of Artificial Sequence: Synthetic oligonucleotide
gtaaaagaattgccgatatttctcaggtctacacacagaatg

SEQ ID NO: 122206 - DNA, 42 bp, Artificial Sequence
  Description of Artificial Sequence: Synthetic oligonucleotide
taaaagaattgccgatatttctcaggtctacacacagaatgc

SEQ ID NO: 122207 - DNA, 41 bp, Artificial Sequence
  Description of Artificial Sequence: Synthetic oligonucleotide
aaaagaattgccgatatttctcaggtctacacacagaatgc

SEQ ID NO: 122208 - DNA, 40 bp, Artificial Sequence
  Description of Artificial Sequence: Synthetic oligonucleotide
aaagaattgccgatatttctcaggtctacacacagaatgc

SEQ ID NO: 122209 - DNA, 39 bp, Artificial Sequence
  Description of Artificial Sequence: Synthetic oligonucleotide
aagaattgccgatatttctcaggtctacacacagaatgc

SEQ ID NO: 122210 - DNA, 38 bp, Artificial Sequence
  Description of Artificial Sequence: Synthetic oligonucleotide
agaattgccgatatttctcaggtctacacacagaatgc

SEQ ID NO: 122211 - DNA, 37 bp, Artificial Sequence
  Description of Artificial Sequence: Synthetic oligonucleotide
gaattgccgatatttctcaggtctacacacagaatgc

SEQ ID NO: 122212 - DNA, 38 bp, Artificial Sequence
  Description of Artificial Sequence: Synthetic oligonucleotide
aattgccgatatttctcaggtctacacacagaatgctg

SEQ ID NO: 122213 - DNA, 37 bp, Artificial Sequence
  Description of Artificial Sequence: Synthetic oligonucleotide
attgccgatatttctcaggtctacacacagaatgctg

SEQ ID NO: 122214 - DNA, 36 bp, Artificial Sequence
  Description of Artificial Sequence: Synthetic oligonucleotide
ttgccgatatttctcaggtctacacacagaatgctg

SEQ ID NO: 122215 - DNA, 35 bp, Artificial Sequence
  Description of Artificial Sequence: Synthetic oligonucleotide
tgccgatatttctcaggtctacacacagaatgctg

SEQ ID NO: 122216 - DNA, 34 bp, Artificial Sequence
  Description of Artificial Sequence: Synthetic oligonucleotide
gccgatatttctcaggtctacacacagaatgctg

SEQ ID NO: 122217 - DNA, 38 bp, Artificial Sequence
  Description of Artificial Sequence: Synthetic oligonucleotide
ccgatatttctcaggtctacacacagaatgctgaaatg

SEQ ID NO: 122218 - DNA, 39 bp, Artificial Sequence
  Description of Artificial Sequence: Synthetic oligonucleotide
cgatatttctcaggtctacacacagaatgctgaaatgag

SEQ ID NO: 122219 - DNA, 39 bp, Artificial Sequence
  Description of Artificial Sequence: Synthetic oligonucleotide
gatatttctcaggtctacacacagaatgctgaaatgagg

SEQ ID NO: 122220 - DNA, 39 bp, Artificial Sequence
  Description of Artificial Sequence: Synthetic oligonucleotide
atatttctcaggtctacacacagaatgctgaaatgaggc

SEQ ID NO: 122221 - DNA, 38 bp, Artificial Sequence
  Description of Artificial Sequence: Synthetic oligonucleotide
tatttctcaggtctacacacagaatgctgaaatgaggc

SEQ ID NO: 122222 - DNA, 37 bp, Artificial Sequence
  Description of Artificial Sequence: Synthetic oligonucleotide
atttctcaggtctacacacagaatgctgaaatgaggc

SEQ ID NO: 122223 - DNA, 36 bp, Artificial Sequence
  Description of Artificial Sequence: Synthetic oligonucleotide
tttctcaggtctacacacagaatgctgaaatgaggc

SEQ ID NO: 122224 - DNA, 35 bp, Artificial Sequence
  Description of Artificial Sequence: Synthetic oligonucleotide
ttctcaggtctacacacagaatgctgaaatgaggc

SEQ ID NO: 122225 - DNA, 34 bp, Artificial Sequence
  Description of Artificial Sequence: Synthetic oligonucleotide
tctcaggtctacacacagaatgctgaaatgaggc

SEQ ID NO: 122226 - DNA, 33 bp, Artificial Sequence
  Description of Artificial Sequence: Synthetic oligonucleotide
ctcaggtctacacacagaatgctgaaatgaggc

SEQ ID NO: 122227 - DNA, 33 bp, Artificial Sequence
  Description of Artificial Sequence: Synthetic oligonucleotide
tcaggtctacacacagaatgctgaaatgaggcc

SEQ ID NO: 122228 - DNA, 32 bp, Artificial Sequence
  Description of Artificial Sequence: Synthetic oligonucleotide
caggtctacacacagaatgctgaaatgaggcc

SEQ ID NO: 122229 - DNA, 33 bp, Artificial Sequence
  Description of Artificial Sequence: Synthetic oligonucleotide
aggtctacacacagaatgctgaaatgaggcctc

SEQ ID NO: 122230 - DNA, 32 bp, Artificial Sequence
  Description of Artificial Sequence: Synthetic oligonucleotide
ggtctacacacagaatgctgaaatgaggcctc

SEQ ID NO: 122231 - DNA, 34 bp, Artificial Sequence
  Description of Artificial Sequence: Synthetic oligonucleotide
gtctacacacagaatgctgaaatgaggcctcttg

SEQ ID NO: 122232 - DNA, 34 bp, Artificial Sequence
  Description of Artificial Sequence: Synthetic oligonucleotide
tctacacacagaatgctgaaatgaggcctcttgg

SEQ ID NO: 122233 - DNA, 33 bp, Artificial Sequence
  Description of Artificial Sequence: Synthetic oligonucleotide
ctacacacagaatgctgaaatgaggcctcttgg

SEQ ID NO: 122234 - DNA, 35 bp, Artificial Sequence
  Description of Artificial Sequence: Synthetic oligonucleotide
tacacacagaatgctgaaatgaggcctcttggttg

SEQ ID NO: 122235 - DNA, 34 bp, Artificial Sequence
  Description of Artificial Sequence: Synthetic oligonucleotide
acacacagaatgctgaaatgaggcctcttggttg

SEQ ID NO: 122236 - DNA, 33 bp, Artificial Sequence
  Description of Artificial Sequence: Synthetic oligonucleotide
cacacagaatgctgaaatgaggcctcttggttg

SEQ ID NO: 122237 - DNA, 35 bp, Artificial Sequence
  Description of Artificial Sequence: Synthetic oligonucleotide
acacagaatgctgaaatgaggcctcttggttgttg

SEQ ID NO: 122238 - DNA, 34 bp, Artificial Sequence
  Description of Artificial Sequence: Synthetic oligonucleotide
cacagaatgctgaaatgaggcctcttggttgttg

SEQ ID NO: 122239 - DNA, 37 bp, Artificial Sequence
  Description of Artificial Sequence: Synthetic oligonucleotide
acagaatgctgaaatgaggcctcttggttgttgtatg

SEQ ID NO: 122240 - DNA, 36 bp, Artificial Sequence
  Description of Artificial Sequence: Synthetic oligonucleotide
cagaatgctgaaatgaggcctcttggttgttgtatg

SEQ ID NO: 122241 - DNA, 45 bp, Artificial Sequence
  Description of Artificial Sequence: Synthetic oligonucleotide
agaatgctgaaatgaggcctcttggttgttgtatgattttaattg

SEQ ID NO: 122242 - DNA, 44 bp, Artificial Sequence
  Description of Artificial Sequence: Synthetic oligonucleotide
gaatgctgaaatgaggcctcttggttgttgtatgattttaattg

SEQ ID NO: 122243 - DNA, 44 bp, Artificial Sequence
  Description of Artificial Sequence: Synthetic oligonucleotide
aatgctgaaatgaggcctcttggttgttgtatgattttaattgg

SEQ ID NO: 122244 - DNA, 43 bp, Artificial Sequence
  Description of Artificial Sequence: Synthetic oligonucleotide
atgctgaaatgaggcctcttggttgttgtatgattttaattgg

SEQ ID NO: 122245 - DNA, 42 bp, Artificial Sequence
  Description of Artificial Sequence: Synthetic oligonucleotide
tgctgaaatgaggcctcttggttgttgtatgattttaattgg

SEQ ID NO: 122246 - DNA, 41 bp, Artificial Sequence
  Description of Artificial Sequence: Synthetic oligonucleotide
gctgaaatgaggcctcttggttgttgtatgattttaattgg

SEQ ID NO: 122247 - DNA, 45 bp, Artificial Sequence
  Description of Artificial Sequence: Synthetic oligonucleotide
ctgaaatgaggcctcttggttgttgtatgattttaattggtatag

SEQ ID NO: 122248 - DNA, 47 bp, Artificial Sequence
  Description of Artificial Sequence: Synthetic oligonucleotide
tgaaatgaggcctcttggttgttgtatgattttaattggtatagatg

SEQ ID NO: 122249 - DNA, 46 bp, Artificial Sequence
  Description of Artificial Sequence: Synthetic oligonucleotide
gaaatgaggcctcttggttgttgtatgattttaattggtatagatg

SEQ ID NO: 122250 - DNA, 48 bp, Artificial Sequence
  Description of Artificial Sequence: Synthetic oligonucleotide
aaatgaggcctcttggttgttgtatgattttaattggtatagatgaag

SEQ ID NO: 122251 - DNA, 47 bp, Artificial Sequence
  Description of Artificial Sequence: Synthetic oligonucleotide
aatgaggcctcttggttgttgtatgattttaattggtatagatgaag

SEQ ID NO: 122252 - DNA, 46 bp, Artificial Sequence
  Description of Artificial Sequence: Synthetic oligonucleotide
atgaggcctcttggttgttgtatgattttaattggtatagatgaag

SEQ ID NO: 122253 - DNA, 45 bp, Artificial Sequence
  Description of Artificial Sequence: Synthetic oligonucleotide
tgaggcctcttggttgttgtatgattttaattggtatagatgaag

SEQ ID NO: 122254 - DNA, 44 bp, Artificial Sequence
  Description of Artificial Sequence: Synthetic oligonucleotide
gaggcctcttggttgttgtatgattttaattggtatagatgaag

SEQ ID NO: 122255 - DNA, 45 bp, Artificial Sequence
  Description of Artificial Sequence: Synthetic oligonucleotide
aggcctcttggttgttgtatgattttaattggtatagatgaagag

SEQ ID NO: 122256 - DNA, 44 bp, Artificial Sequence
  Description of Artificial Sequence: Synthetic oligonucleotide
ggcctcttggttgttgtatgattttaattggtatagatgaagag

SEQ ID NO: 122257 - DNA, 44 bp, Artificial Sequence
  Description of Artificial Sequence: Synthetic oligonucleotide
gcctcttggttgttgtatgattttaattggtatagatgaagagc

SEQ ID NO: 122258 - DNA, 46 bp, Artificial Sequence
  Description of Artificial Sequence: Synthetic oligonucleotide
cctcttggttgttgtatgattttaattggtatagatgaagagcaag

SEQ ID NO: 122259 - DNA, 46 bp, Artificial Sequence
  Description of Artificial Sequence: Synthetic oligonucleotide
ctcttggttgttgtatgattttaattggtatagatgaagagcaagg

SEQ ID NO: 122260 - DNA, 46 bp, Artificial Sequence
  Description of Artificial Sequence: Synthetic oligonucleotide
tcttggttgttgtatgattttaattggtatagatgaagagcaaggc

SEQ ID NO: 122261 - DNA, 45 bp, Artificial Sequence
  Description of Artificial Sequence: Synthetic oligonucleotide
cttggttgttgtatgattttaattggtatagatgaagagcaaggc

SEQ ID NO: 122262 - DNA, 45 bp, Artificial Sequence
  Description of Artificial Sequence: Synthetic oligonucleotide
ttggttgttgtatgattttaattggtatagatgaagagcaaggcc

SEQ ID NO: 122263 - DNA, 44 bp, Artificial Sequence
  Description of Artificial Sequence: Synthetic oligonucleotide
tggttgttgtatgattttaattggtatagatgaagagcaaggcc

SEQ ID NO: 122264 - DNA, 43 bp, Artificial Sequence
  Description of Artificial Sequence: Synthetic oligonucleotide
ggttgttgtatgattttaattggtatagatgaagagcaaggcc

SEQ ID NO: 122265 - DNA, 43 bp, Artificial Sequence
  Description of Artificial Sequence: Synthetic oligonucleotide
gttgttgtatgattttaattggtatagatgaagagcaaggccc

SEQ ID NO: 122266 - DNA, 44 bp, Artificial Sequence
  Description of Artificial Sequence: Synthetic oligonucleotide
ttgttgtatgattttaattggtatagatgaagagcaaggccctc

SEQ ID NO: 122267 - DNA, 43 bp, Artificial Sequence
  Description of Artificial Sequence: Synthetic oligonucleotide
tgttgtatgattttaattggtatagatgaagagcaaggccctc

SEQ ID NO: 122268 - DNA, 42 bp, Artificial Sequence
  Description of Artificial Sequence: Synthetic oligonucleotide
gttgtatgattttaattggtatagatgaagagcaaggccctc

SEQ ID NO: 122269 - DNA, 43 bp, Artificial Sequence
  Description of Artificial Sequence: Synthetic oligonucleotide
ttgtatgattttaattggtatagatgaagagcaaggccctcag

SEQ ID NO: 122270 - DNA, 42 bp, Artificial Sequence
  Description of Artificial Sequence: Synthetic oligonucleotide
tgtatgattttaattggtatagatgaagagcaaggccctcag

SEQ ID NO: 122271 - DNA, 41 bp, Artificial Sequence
  Description of Artificial Sequence: Synthetic oligonucleotide
gtatgattttaattggtatagatgaagagcaaggccctcag

SEQ ID NO: 122272 - DNA, 41 bp, Artificial Sequence
  Description of Artificial Sequence: Synthetic oligonucleotide
tatgattttaattggtatagatgaagagcaaggccctcagg

SEQ ID NO: 122273 - DNA, 40 bp, Artificial Sequence
  Description of Artificial Sequence: Synthetic oligonucleotide
atgattttaattggtatagatgaagagcaaggccctcagg

SEQ ID NO: 122274 - DNA, 39 bp, Artificial Sequence
  Description of Artificial Sequence: Synthetic oligonucleotide
tgattttaattggtatagatgaagagcaaggccctcagg

SEQ ID NO: 122275 - DNA, 38 bp, Artificial Sequence
  Description of Artificial Sequence: Synthetic oligonucleotide
gattttaattggtatagatgaagagcaaggccctcagg

SEQ ID NO: 122276 - DNA, 45 bp, Artificial Sequence
  Description of Artificial Sequence: Synthetic oligonucleotide
attttaattggtatagatgaagagcaaggccctcaggtatataag

SEQ ID NO: 122277 - DNA, 44 bp, Artificial Sequence
  Description of Artificial Sequence: Synthetic oligonucleotide
ttttaattggtatagatgaagagcaaggccctcaggtatataag

SEQ ID NO: 122278 - DNA, 43 bp, Artificial Sequence
  Description of Artificial Sequence: Synthetic oligonucleotide
tttaattggtatagatgaagagcaaggccctcaggtatataag

SEQ ID NO: 122279 - DNA, 42 bp, Artificial Sequence
  Description of Artificial Sequence: Synthetic oligonucleotide
ttaattggtatagatgaagagcaaggccctcaggtatataag

SEQ ID NO: 122280 - DNA, 41 bp, Artificial Sequence
  Description of Artificial Sequence: Synthetic oligonucleotide
taattggtatagatgaagagcaaggccctcaggtatataag

SEQ ID NO: 122281 - DNA, 40 bp, Artificial Sequence
  Description of Artificial Sequence: Synthetic oligonucleotide
aattggtatagatgaagagcaaggccctcaggtatataag

SEQ ID NO: 122282 - DNA, 39 bp, Artificial Sequence
  Description of Artificial Sequence: Synthetic oligonucleotide
attggtatagatgaagagcaaggccctcaggtatataag

SEQ ID NO: 122283 - DNA, 38 bp, Artificial Sequence
  Description of Artificial Sequence: Synthetic oligonucleotide
ttggtatagatgaagagcaaggccctcaggtatataag

SEQ ID NO: 122284 - DNA, 37 bp, Artificial Sequence
  Description of Artificial Sequence: Synthetic oligonucleotide
tggtatagatgaagagcaaggccctcaggtatataag

SEQ ID NO: 122285 - DNA, 36 bp, Artificial Sequence
  Description of Artificial Sequence: Synthetic oligonucleotide
ggtatagatgaagagcaaggccctcaggtatataag

SEQ ID NO: 122286 - DNA, 37 bp, Artificial Sequence
  Description of Artificial Sequence: Synthetic oligonucleotide
gtatagatgaagagcaaggccctcaggtatataagtg

SEQ ID NO: 122287 - DNA, 38 bp, Artificial Sequence
  Description of Artificial Sequence: Synthetic oligonucleotide
tatagatgaagagcaaggccctcaggtatataagtgtg

SEQ ID NO: 122288 - DNA, 37 bp, Artificial Sequence
  Description of Artificial Sequence: Synthetic oligonucleotide
atagatgaagagcaaggccctcaggtatataagtgtg

SEQ ID NO: 122289 - DNA, 36 bp, Artificial Sequence
  Description of Artificial Sequence: Synthetic oligonucleotide
tagatgaagagcaaggccctcaggtatataagtgtg

SEQ ID NO: 122290 - DNA, 35 bp, Artificial Sequence
  Description of Artificial Sequence: Synthetic oligonucleotide
agatgaagagcaaggccctcaggtatataagtgtg

SEQ ID NO: 122291 - DNA, 34 bp, Artificial Sequence
  Description of Artificial Sequence: Synthetic oligonucleotide
gatgaagagcaaggccctcaggtatataagtgtg

SEQ ID NO: 122292 - DNA, 36 bp, Artificial Sequence
  Description of Artificial Sequence: Synthetic oligonucleotide
atgaagagcaaggccctcaggtatataagtgtgatc

SEQ ID NO: 122293 - DNA, 35 bp, Artificial Sequence
  Description of Artificial Sequence: Synthetic oligonucleotide
tgaagagcaaggccctcaggtatataagtgtgatc

SEQ ID NO: 122294 - DNA, 34 bp, Artificial Sequence
  Description of Artificial Sequence: Synthetic oligonucleotide
gaagagcaaggccctcaggtatataagtgtgatc

SEQ ID NO: 122295 - DNA, 34 bp, Artificial Sequence
  Description of Artificial Sequence: Synthetic oligonucleotide
aagagcaaggccctcaggtatataagtgtgatcc

SEQ ID NO: 122296 - DNA, 33 bp, Artificial Sequence
  Description of Artificial Sequence: Synthetic oligonucleotide
agagcaaggccctcaggtatataagtgtgatcc

SEQ ID NO: 122297 - DNA, 32 bp, Artificial Sequence
  Description of Artificial Sequence: Synthetic oligonucleotide
gagcaaggccctcaggtatataagtgtgatcc

SEQ ID NO: 122298 - DNA, 33 bp, Artificial Sequence
  Description of Artificial Sequence: Synthetic oligonucleotide
agcaaggccctcaggtatataagtgtgatcctg

SEQ ID NO: 122299 - DNA, 32 bp, Artificial Sequence
  Description of Artificial Sequence: Synthetic oligonucleotide
gcaaggccctcaggtatataagtgtgatcctg

SEQ ID NO: 122300 - DNA, 32 bp, Artificial Sequence
  Description of Artificial Sequence: Synthetic oligonucleotide
caaggccctcaggtatataagtgtgatcctgc

SEQ ID NO: 122301 - DNA, 33 bp, Artificial Sequence
  Description of Artificial Sequence: Synthetic oligonucleotide
aaggccctcaggtatataagtgtgatcctgcag

SEQ ID NO: 122302 - DNA, 32 bp, Artificial Sequence
  Description of Artificial Sequence: Synthetic oligonucleotide
aggccctcaggtatataagtgtgatcctgcag

SEQ ID NO: 122303 - DNA, 31 bp, Artificial Sequence
  Description of Artificial Sequence: Synthetic oligonucleotide
ggccctcaggtatataagtgtgatcctgcag

SEQ ID NO: 122304 - DNA, 31 bp, Artificial Sequence
  Description of Artificial Sequence: Synthetic oligonucleotide
gccctcaggtatataagtgtgatcctgcagg

SEQ ID NO: 122305 - DNA, 34 bp, Artificial Sequence
  Description of Artificial Sequence: Synthetic oligonucleotide
ccctcaggtatataagtgtgatcctgcaggttac

SEQ ID NO: 122306 - DNA, 36 bp, Artificial Sequence
  Description of Artificial Sequence: Synthetic oligonucleotide
cctcaggtatataagtgtgatcctgcaggttactac

SEQ ID NO: 122307 - DNA, 37 bp, Artificial Sequence
  Description of Artificial Sequence: Synthetic oligonucleotide
ctcaggtatataagtgtgatcctgcaggttactactg

SEQ ID NO: 122308 - DNA, 38 bp, Artificial Sequence
  Description of Artificial Sequence: Synthetic oligonucleotide
tcaggtatataagtgtgatcctgcaggttactactgtg

SEQ ID NO: 122309 - DNA, 37 bp, Artificial Sequence
  Description of Artificial Sequence: Synthetic oligonucleotide
caggtatataagtgtgatcctgcaggttactactgtg

SEQ ID NO: 122310 - DNA, 37 bp, Artificial Sequence
  Description of Artificial Sequence: Synthetic oligonucleotide
aggtatataagtgtgatcctgcaggttactactgtgg

SEQ ID NO: 122311 - DNA, 36 bp, Artificial Sequence
  Description of Artificial Sequence: Synthetic oligonucleotide
ggtatataagtgtgatcctgcaggttactactgtgg

SEQ ID NO: 122312 - DNA, 36 bp, Artificial Sequence
  Description of Artificial Sequence: Synthetic oligonucleotide
gtatataagtgtgatcctgcaggttactactgtggg

SEQ ID NO: 122313 - DNA, 42 bp, Artificial Sequence
  Description of Artificial Sequence: Synthetic oligonucleotide
tatataagtgtgatcctgcaggttactactgtgggtttaaag

SEQ ID NO: 122314 - DNA, 41 bp, Artificial Sequence
  Description of Artificial Sequence: Synthetic oligonucleotide
atataagtgtgatcctgcaggttactactgtgggtttaaag

SEQ ID NO: 122315 - DNA, 40 bp, Artificial Sequence
  Description of Artificial Sequence: Synthetic oligonucleotide
tataagtgtgatcctgcaggttactactgtgggtttaaag

SEQ ID NO: 122316 - DNA, 39 bp, Artificial Sequence
  Description of Artificial Sequence: Synthetic oligonucleotide
ataagtgtgatcctgcaggttactactgtgggtttaaag

SEQ ID NO: 122317 - DNA, 38 bp, Artificial Sequence
  Description of Artificial Sequence: Synthetic oligonucleotide
taagtgtgatcctgcaggttactactgtgggtttaaag

SEQ ID NO: 122318 - DNA, 37 bp, Artificial Sequence
  Description of Artificial Sequence: Synthetic oligonucleotide
aagtgtgatcctgcaggttactactgtgggtttaaag

SEQ ID NO: 122319 - DNA, 36 bp, Artificial Sequence
  Description of Artificial Sequence: Synthetic oligonucleotide
agtgtgatcctgcaggttactactgtgggtttaaag

SEQ ID NO: 122320 - DNA, 35 bp, Artificial Sequence
  Description of Artificial Sequence: Synthetic oligonucleotide
gtgtgatcctgcaggttactactgtgggtttaaag

SEQ ID NO: 122321 - DNA, 35 bp, Artificial Sequence
  Description of Artificial Sequence: Synthetic oligonucleotide
tgtgatcctgcaggttactactgtgggtttaaagc

SEQ ID NO: 122322 - DNA, 34 bp, Artificial Sequence
  Description of Artificial Sequence: Synthetic oligonucleotide
gtgatcctgcaggttactactgtgggtttaaagc

SEQ ID NO: 122323 - DNA, 34 bp, Artificial Sequence
  Description of Artificial Sequence: Synthetic oligonucleotide
tgatcctgcaggttactactgtgggtttaaagcc

SEQ ID NO: 122324 - DNA, 33 bp, Artificial Sequence
  Description of Artificial Sequence: Synthetic oligonucleotide
gatcctgcaggttactactgtgggtttaaagcc

SEQ ID NO: 122325 - DNA, 34 bp, Artificial Sequence
  Description of Artificial Sequence: Synthetic oligonucleotide
atcctgcaggttactactgtgggtttaaagccac

SEQ ID NO: 122326 - DNA, 33 bp, Artificial Sequence
  Description of Artificial Sequence: Synthetic oligonucleotide
tcctgcaggttactactgtgggtttaaagccac

SEQ ID NO: 122327 - DNA, 32 bp, Artificial Sequence
  Description of Artificial Sequence: Synthetic oligonucleotide
cctgcaggttactactgtgggtttaaagccac

SEQ ID NO: 122328 - DNA, 33 bp, Artificial Sequence
  Description of Artificial Sequence: Synthetic oligonucleotide
ctgcaggttactactgtgggtttaaagccactg

SEQ ID NO: 122329 - DNA, 33 bp, Artificial Sequence
  Description of Artificial Sequence: Synthetic oligonucleotide
tgcaggttactactgtgggtttaaagccactgc

SEQ ID NO: 122330 - DNA, 32 bp, Artificial Sequence
  Description of Artificial Sequence: Synthetic oligonucleotide
gcaggttactactgtgggtttaaagccactgc

SEQ ID NO: 122331 - DNA, 33 bp, Artificial Sequence
  Description of Artificial Sequence: Synthetic oligonucleotide
caggttactactgtgggtttaaagccactgcag

SEQ ID NO: 122332 - DNA, 33 bp, Artificial Sequence
  Description of Artificial Sequence: Synthetic oligonucleotide
aggttactactgtgggtttaaagccactgcagc

SEQ ID NO: 122333 - DNA, 32 bp, Artificial Sequence
  Description of Artificial Sequence: Synthetic oligonucleotide
ggttactactgtgggtttaaagccactgcagc

SEQ ID NO: 122334 - DNA, 32 bp, Artificial Sequence
  Description of Artificial Sequence: Synthetic oligonucleotide
gttactactgtgggtttaaagccactgcagcg

SEQ ID NO: 122335 - DNA, 32 bp, Artificial Sequence
  Description of Artificial Sequence: Synthetic oligonucleotide
ttactactgtgggtttaaagccactgcagcgg

SEQ ID NO: 122336 - DNA, 31 bp, Artificial Sequence
  Description of Artificial Sequence: Synthetic oligonucleotide
tactactgtgggtttaaagccactgcagcgg

SEQ ID NO: 122337 - DNA, 30 bp, Artificial Sequence
  Description of Artificial Sequence: Synthetic oligonucleotide
actactgtgggtttaaagccactgcagcgg

SEQ ID NO: 122338 - DNA, 29 bp, Artificial Sequence
  Description of Artificial Sequence: Synthetic oligonucleotide
ctactgtgggtttaaagccactgcagcgg

SEQ ID NO: 122339 - DNA, 29 bp, Artificial Sequence
  Description of Artificial Sequence: Synthetic oligonucleotide
tactgtgggtttaaagccactgcagcggg

SEQ ID NO: 122340 - DNA, 28 bp, Artificial Sequence
  Description of Artificial Sequence: Synthetic oligonucleotide
actgtgggtttaaagccactgcagcggg

SEQ ID NO: 122341 - DNA, 27 bp, Artificial Sequence
  Description of Artificial Sequence: Synthetic oligonucleotide
ctgtgggtttaaagccactgcagcggg

SEQ ID NO: 122342 - DNA, 28 bp, Artificial Sequence
  Description of Artificial Sequence: Synthetic oligonucleotide
tgtgggtttaaagccactgcagcgggag

SEQ ID NO: 122343 - DNA, 27 bp, Artificial Sequence
  Description of Artificial Sequence: Synthetic oligonucleotide
gtgggtttaaagccactgcagcgggag

SEQ ID NO: 122344 - DNA, 32 bp, Artificial Sequence
  Description of Artificial Sequence: Synthetic oligonucleotide
tgggtttaaagccactgcagcgggagttaaac

SEQ ID NO: 122345 - DNA, 31 bp, Artificial Sequence
  Description of Artificial Sequence: Synthetic oligonucleotide
gggtttaaagccactgcagcgggagttaaac

SEQ ID NO: 122346 - DNA, 34 bp, Artificial Sequence
  Description of Artificial Sequence: Synthetic oligonucleotide
ggtttaaagccactgcagcgggagttaaacaaac

SEQ ID NO: 122347 - DNA, 35 bp, Artificial Sequence
  Description of Artificial Sequence: Synthetic oligonucleotide
gtttaaagccactgcagcgggagttaaacaaactg

SEQ ID NO: 122348 - DNA, 36 bp, Artificial Sequence
  Description of Artificial Sequence: Synthetic oligonucleotide
tttaaagccactgcagcgggagttaaacaaactgag

SEQ ID NO: 122349 - DNA, 35 bp, Artificial Sequence
  Description of Artificial Sequence: Synthetic oligonucleotide
ttaaagccactgcagcgggagttaaacaaactgag

SEQ ID NO: 122350 - DNA, 34 bp, Artificial Sequence
  Description of Artificial Sequence: Synthetic oligonucleotide
taaagccactgcagcgggagttaaacaaactgag

SEQ ID NO: 122351 - DNA, 33 bp, Artificial Sequence
  Description of Artificial Sequence: Synthetic oligonucleotide
aaagccactgcagcgggagttaaacaaactgag

SEQ ID NO: 122352 - DNA, 32 bp, Artificial Sequence
  Description of Artificial Sequence: Synthetic oligonucleotide
aagccactgcagcgggagttaaacaaactgag

SEQ ID NO: 122353 - DNA, 31 bp, Artificial Sequence
  Description of Artificial Sequence: Synthetic oligonucleotide
agccactgcagcgggagttaaacaaactgag

SEQ ID NO: 122354 - DNA, 30 bp, Artificial Sequence
  Description of Artificial Sequence: Synthetic oligonucleotide
gccactgcagcgggagttaaacaaactgag

SEQ ID NO: 122355 - DNA, 31 bp, Artificial Sequence
  Description of Artificial Sequence: Synthetic oligonucleotide
ccactgcagcgggagttaaacaaactgagtc

SEQ ID NO: 122356 - DNA, 33 bp, Artificial Sequence
  Description of Artificial Sequence: Synthetic oligonucleotide
cactgcagcgggagttaaacaaactgagtcaac

SEQ ID NO: 122357 - DNA, 33 bp, Artificial Sequence
  Description of Artificial Sequence: Synthetic oligonucleotide
actgcagcgggagttaaacaaactgagtcaacc

SEQ ID NO: 122358 - DNA, 32 bp, Artificial Sequence
  Description of Artificial Sequence: Synthetic oligonucleotide
ctgcagcgggagttaaacaaactgagtcaacc

SEQ ID NO: 122359 - DNA, 33 bp, Artificial Sequence
  Description of Artificial Sequence: Synthetic oligonucleotide
tgcagcgggagttaaacaaactgagtcaaccag

SEQ ID NO: 122360 - DNA, 32 bp, Artificial Sequence
  Description of Artificial Sequence: Synthetic oligonucleotide
gcagcgggagttaaacaaactgagtcaaccag

SEQ ID NO: 122361 - DNA, 32 bp, Artificial Sequence
  Description of Artificial Sequence: Synthetic oligonucleotide
cagcgggagttaaacaaactgagtcaaccagc

SEQ ID NO: 122362 - DNA, 34 bp, Artificial Sequence
  Description of Artificial Sequence: Synthetic oligonucleotide
agcgggagttaaacaaactgagtcaaccagcttc

SEQ ID NO: 122363 - DNA, 33 bp, Artificial Sequence
  Description of Artificial Sequence: Synthetic oligonucleotide
gcgggagttaaacaaactgagtcaaccagcttc

SEQ ID NO: 122364 - DNA, 33 bp, Artificial Sequence
  Description of Artificial Sequence: Synthetic oligonucleotide
cgggagttaaacaaactgagtcaaccagcttcc

SEQ ID NO: 122365 - DNA, 35 bp, Artificial Sequence
  Description of Artificial Sequence: Synthetic oligonucleotide
gggagttaaacaaactgagtcaaccagcttccttg

SEQ ID NO: 122366 - DNA, 43 bp, Artificial Sequence
  Description of Artificial Sequence: Synthetic oligonucleotide
ggagttaaacaaactgagtcaaccagcttccttgaaaaaaaag

SEQ ID NO: 122367 - DNA, 44 bp, Artificial Sequence
  Description of Artificial Sequence: Synthetic oligonucleotide
gagttaaacaaactgagtcaaccagcttccttgaaaaaaaagtg

SEQ ID NO: 122368 - DNA, 46 bp, Artificial Sequence
  Description of Artificial Sequence: Synthetic oligonucleotide
agttaaacaaactgagtcaaccagcttccttgaaaaaaaagtgaag

SEQ ID NO: 122369 - DNA, 45 bp, Artificial Sequence
  Description of Artificial Sequence: Synthetic oligonucleotide
gttaaacaaactgagtcaaccagcttccttgaaaaaaaagtgaag

SEQ ID NO: 122370 - DNA, 47 bp, Artificial Sequence
  Description of Artificial Sequence: Synthetic oligonucleotide
ttaaacaaactgagtcaaccagcttccttgaaaaaaaagtgaagaag

SEQ ID NO: 122371 - DNA, 46 bp, Artificial Sequence
  Description of Artificial Sequence: Synthetic oligonucleotide
taaacaaactgagtcaaccagcttccttgaaaaaaaagtgaagaag

SEQ ID NO: 122372 - DNA, 45 bp, Artificial Sequence
  Description of Artificial Sequence: Synthetic oligonucleotide
aaacaaactgagtcaaccagcttccttgaaaaaaaagtgaagaag

SEQ ID NO: 122373 - DNA, 44 bp, Artificial Sequence
  Description of Artificial Sequence: Synthetic oligonucleotide
aacaaactgagtcaaccagcttccttgaaaaaaaagtgaagaag

SEQ ID NO: 122374 - DNA, 43 bp, Artificial Sequence
  Description of Artificial Sequence: Synthetic oligonucleotide
acaaactgagtcaaccagcttccttgaaaaaaaagtgaagaag

SEQ ID NO: 122375 - DNA, 42 bp, Artificial Sequence
  Description of Artificial Sequence: Synthetic oligonucleotide
caaactgagtcaaccagcttccttgaaaaaaaagtgaagaag

SEQ ID NO: 122376 - DNA, 48 bp, Artificial Sequence
  Description of Artificial Sequence: Synthetic oligonucleotide
aaactgagtcaaccagcttccttgaaaaaaaagtgaagaagaaatttg

SEQ ID NO: 122377 - DNA, 47 bp, Artificial Sequence
  Description of Artificial Sequence: Synthetic oligonucleotide
aactgagtcaaccagcttccttgaaaaaaaagtgaagaagaaatttg

SEQ ID NO: 122378 - DNA, 46 bp, Artificial Sequence
  Description of Artificial Sequence: Synthetic oligonucleotide
actgagtcaaccagcttccttgaaaaaaaagtgaagaagaaatttg

SEQ ID NO: 122379 - DNA, 45 bp, Artificial Sequence
  Description of Artificial Sequence: Synthetic oligonucleotide
ctgagtcaaccagcttccttgaaaaaaaagtgaagaagaaatttg

SEQ ID NO: 122380 - DNA, 48 bp, Artificial Sequence
  Description of Artificial Sequence: Synthetic oligonucleotide
tgagtcaaccagcttccttgaaaaaaaagtgaagaagaaatttgattg

SEQ ID NO: 122381 - DNA, 47 bp, Artificial Sequence
  Description of Artificial Sequence: Synthetic oligonucleotide
gagtcaaccagcttccttgaaaaaaaagtgaagaagaaatttgattg

SEQ ID NO: 122382 - DNA, 47 bp, Artificial Sequence
  Description of Artificial Sequence: Synthetic oligonucleotide
agtcaaccagcttccttgaaaaaaaagtgaagaagaaatttgattgg

SEQ ID NO: 122383 - DNA, 46 bp, Artificial Sequence
  Description of Artificial Sequence: Synthetic oligonucleotide
gtcaaccagcttccttgaaaaaaaagtgaagaagaaatttgattgg

SEQ ID NO: 122384 - DNA, 47 bp, Artificial Sequence
  Description of Artificial Sequence: Synthetic oligonucleotide
tcaaccagcttccttgaaaaaaaagtgaagaagaaatttgattggac

SEQ ID NO: 122385 - DNA, 46 bp, Artificial Sequence
  Description of Artificial Sequence: Synthetic oligonucleotide
caaccagcttccttgaaaaaaaagtgaagaagaaatttgattggac

SEQ ID NO: 122386 - DNA, 50 bp, Artificial Sequence
  Description of Artificial Sequence: Synthetic oligonucleotide
aaccagcttccttgaaaaaaaagtgaagaagaaatttgattggacatttg

SEQ ID NO: 122387 - DNA, 49 bp, Artificial Sequence
  Description of Artificial Sequence: Synthetic oligonucleotide
accagcttccttgaaaaaaaagtgaagaagaaatttgattggacatttg

SEQ ID NO: 122388 - DNA, 48 bp, Artificial Sequence
  Description of Artificial Sequence: Synthetic oligonucleotide
ccagcttccttgaaaaaaaagtgaagaagaaatttgattggacatttg

SEQ ID NO: 122389 - DNA, 50 bp, Artificial Sequence
  Description of Artificial Sequence: Synthetic oligonucleotide
cagcttccttgaaaaaaaagtgaagaagaaatttgattggacatttgaac

SEQ ID NO: 122390 - DNA, 51 bp, Artificial Sequence
  Description of Artificial Sequence: Synthetic oligonucleotide
agcttccttgaaaaaaaagtgaagaagaaatttgattggacatttgaacag

SEQ ID NO: 122391 - DNA, 50 bp, Artificial Sequence
  Description of Artificial Sequence: Synthetic oligonucleotide
gcttccttgaaaaaaaagtgaagaagaaatttgattggacatttgaacag

SEQ ID NO: 122392 - DNA, 51 bp, Artificial Sequence
  Description of Artificial Sequence: Synthetic oligonucleotide
cttccttgaaaaaaaagtgaagaagaaatttgattggacatttgaacagac

SEQ ID NO: 122393 - DNA, 52 bp, Artificial Sequence
  Description of Artificial Sequence: Synthetic oligonucleotide
ttccttgaaaaaaaagtgaagaagaaatttgattggacatttgaacagacag

SEQ ID NO: 122394 - DNA, 51 bp, Artificial Sequence
  Description of Artificial Sequence: Synthetic oligonucleotide
tccttgaaaaaaaagtgaagaagaaatttgattggacatttgaacagacag

SEQ ID NO: 122395 - DNA, 50 bp, Artificial Sequence
  Description of Artificial Sequence: Synthetic oligonucleotide
ccttgaaaaaaaagtgaagaagaaatttgattggacatttgaacagacag

SEQ ID NO: 122396 - DNA, 51 bp, Artificial Sequence
  Description of Artificial Sequence: Synthetic oligonucleotide
cttgaaaaaaaagtgaagaagaaatttgattggacatttgaacagacagtg

SEQ ID NO: 122397 - DNA, 51 bp, Artificial Sequence
  Description of Artificial Sequence: Synthetic oligonucleotide
ttgaaaaaaaagtgaagaagaaatttgattggacatttgaacagacagtgg

SEQ ID NO: 122398 - DNA, 50 bp, Artificial Sequence
  Description of Artificial Sequence: Synthetic oligonucleotide
tgaaaaaaaagtgaagaagaaatttgattggacatttgaacagacagtgg

SEQ ID NO: 122399 - DNA, 49 bp, Artificial Sequence
  Description of Artificial Sequence: Synthetic oligonucleotide
gaaaaaaaagtgaagaagaaatttgattggacatttgaacagacagtgg

SEQ ID NO: 122400 - DNA, 52 bp, Artificial Sequence
  Description of Artificial Sequence: Synthetic oligonucleotide
aaaaaaaagtgaagaagaaatttgattggacatttgaacagacagtggaaac

SEQ ID NO: 122401 - DNA, 51 bp, Artificial Sequence
  Description of Artificial Sequence: Synthetic oligonucleotide
aaaaaaagtgaagaagaaatttgattggacatttgaacagacagtggaaac

SEQ ID NO: 122402 - DNA, 50 bp, Artificial Sequence
  Description of Artificial Sequence: Synthetic oligonucleotide
aaaaaagtgaagaagaaatttgattggacatttgaacagacagtggaaac

SEQ ID NO: 122403 - DNA, 49 bp, Artificial Sequence
  Description of Artificial Sequence: Synthetic oligonucleotide
aaaaagtgaagaagaaatttgattggacatttgaacagacagtggaaac

SEQ ID NO: 122404 - DNA, 48 bp, Artificial Sequence
  Description of Artificial Sequence: Synthetic oligonucleotide
aaaagtgaagaagaaatttgattggacatttgaacagacagtggaaac

SEQ ID NO: 122405 - DNA, 47 bp, Artificial Sequence
  Description of Artificial Sequence: Synthetic oligonucleotide
aaagtgaagaagaaatttgattggacatttgaacagacagtggaaac

SEQ ID NO: 122406 - DNA, 46 bp, Artificial Sequence
  Description of Artificial Sequence: Synthetic oligonucleotide
aagtgaagaagaaatttgattggacatttgaacagacagtggaaac

SEQ ID NO: 122407 - DNA, 45 bp, Artificial Sequence
  Description of Artificial Sequence: Synthetic oligonucleotide
agtgaagaagaaatttgattggacatttgaacagacagtggaaac

SEQ ID NO: 122408 - DNA, 44 bp, Artificial Sequence
  Description of Artificial Sequence: Synthetic oligonucleotide
gtgaagaagaaatttgattggacatttgaacagacagtggaaac

SEQ ID NO: 122409 - DNA, 45 bp, Artificial Sequence
  Description of Artificial Sequence: Synthetic oligonucleotide
tgaagaagaaatttgattggacatttgaacagacagtggaaactg

SEQ ID NO: 122410 - DNA, 44 bp, Artificial Sequence
  Description of Artificial Sequence: Synthetic oligonucleotide
gaagaagaaatttgattggacatttgaacagacagtggaaactg

SEQ ID NO: 122411 - DNA, 44 bp, Artificial Sequence
  Description of Artificial Sequence: Synthetic oligonucleotide
aagaagaaatttgattggacatttgaacagacagtggaaactgc

SEQ ID NO: 122412 - DNA, 43 bp, Artificial Sequence
  Description of Artificial Sequence: Synthetic oligonucleotide
agaagaaatttgattggacatttgaacagacagtggaaactgc

SEQ ID NO: 122413 - DNA, 42 bp, Artificial Sequence
  Description of Artificial Sequence: Synthetic oligonucleotide
gaagaaatttgattggacatttgaacagacagtggaaactgc

SEQ ID NO: 122414 - DNA, 47 bp, Artificial Sequence
  Description of Artificial Sequence: Synthetic oligonucleotide
aagaaatttgattggacatttgaacagacagtggaaactgcaattac

SEQ ID NO: 122415 - DNA, 46 bp, Artificial Sequence
  Description of Artificial Sequence: Synthetic oligonucleotide
agaaatttgattggacatttgaacagacagtggaaactgcaattac

SEQ ID NO: 122416 - DNA, 45 bp, Artificial Sequence
  Description of Artificial Sequence: Synthetic oligonucleotide
gaaatttgattggacatttgaacagacagtggaaactgcaattac

SEQ ID NO: 122417 - DNA, 47 bp, Artificial Sequence
  Description of Artificial Sequence: Synthetic oligonucleotide
aaatttgattggacatttgaacagacagtggaaactgcaattacatg

SEQ ID NO: 122418 - DNA, 46 bp, Artificial Sequence
  Description of Artificial Sequence: Synthetic oligonucleotide
aatttgattggacatttgaacagacagtggaaactgcaattacatg

SEQ ID NO: 122419 - DNA, 45 bp, Artificial Sequence
  Description of Artificial Sequence: Synthetic oligonucleotide
atttgattggacatttgaacagacagtggaaactgcaattacatg

SEQ ID NO: 122420 - DNA, 44 bp, Artificial Sequence
  Description of Artificial Sequence: Synthetic oligonucleotide
tttgattggacatttgaacagacagtggaaactgcaattacatg

SEQ ID NO: 122421 - DNA, 43 bp, Artificial Sequence
  Description of Artificial Sequence: Synthetic oligonucleotide
ttgattggacatttgaacagacagtggaaactgcaattacatg

SEQ ID NO: 122422 - DNA, 42 bp, Artificial Sequence
  Description of Artificial Sequence: Synthetic oligonucleotide
tgattggacatttgaacagacagtggaaactgcaattacatg

SEQ ID NO: 122423 - DNA, 41 bp, Artificial Sequence
  Description of Artificial Sequence: Synthetic oligonucleotide
gattggacatttgaacagacagtggaaactgcaattacatg

SEQ ID NO: 122424 - DNA, 41 bp, Artificial Sequence
  Description of Artificial Sequence: Synthetic oligonucleotide
attggacatttgaacagacagtggaaactgcaattacatgc

SEQ ID NO: 122425 - DNA, 40 bp, Artificial Sequence
  Description of Artificial Sequence: Synthetic oligonucleotide
ttggacatttgaacagacagtggaaactgcaattacatgc

SEQ ID NO: 122426 - DNA, 39 bp, Artificial Sequence
  Description of Artificial Sequence: Synthetic oligonucleotide
tggacatttgaacagacagtggaaactgcaattacatgc

SEQ ID NO: 122427 - DNA, 38 bp, Artificial Sequence
  Description of Artificial Sequence: Synthetic oligonucleotide
ggacatttgaacagacagtggaaactgcaattacatgc

SEQ ID NO: 122428 - DNA, 38 bp, Artificial Sequence
  Description of Artificial Sequence: Synthetic oligonucleotide
gacatttgaacagacagtggaaactgcaattacatgcc

SEQ ID NO: 122429 - DNA, 39 bp, Artificial Sequence
  Description of Artificial Sequence: Synthetic oligonucleotide
acatttgaacagacagtggaaactgcaattacatgcctg

SEQ ID NO: 122430 - DNA, 38 bp, Artificial Sequence
  Description of Artificial Sequence: Synthetic oligonucleotide
catttgaacagacagtggaaactgcaattacatgcctg

SEQ ID NO: 122431 - DNA, 39 bp, Artificial Sequence
  Description of Artificial Sequence: Synthetic oligonucleotide
atttgaacagacagtggaaactgcaattacatgcctgtc

SEQ ID NO: 122432 - DNA, 38 bp, Artificial Sequence
  Description of Artificial Sequence: Synthetic oligonucleotide
tttgaacagacagtggaaactgcaattacatgcctgtc

SEQ ID NO: 122433 - DNA, 37 bp, Artificial Sequence
  Description of Artificial Sequence: Synthetic oligonucleotide
ttgaacagacagtggaaactgcaattacatgcctgtc

SEQ ID NO: 122434 - DNA, 36 bp, Artificial Sequence
  Description of Artificial Sequence: Synthetic oligonucleotide
tgaacagacagtggaaactgcaattacatgcctgtc

SEQ ID NO: 122435 - DNA, 35 bp, Artificial Sequence
  Description of Artificial Sequence: Synthetic oligonucleotide
gaacagacagtggaaactgcaattacatgcctgtc

SEQ ID NO: 122436 - DNA, 37 bp, Artificial Sequence
  Description of Artificial Sequence: Synthetic oligonucleotide
aacagacagtggaaactgcaattacatgcctgtctac

SEQ ID NO: 122437 - DNA, 36 bp, Artificial Sequence
  Description of Artificial Sequence: Synthetic oligonucleotide
acagacagtggaaactgcaattacatgcctgtctac

SEQ ID NO: 122438 - DNA, 35 bp, Artificial Sequence
  Description of Artificial Sequence: Synthetic oligonucleotide
cagacagtggaaactgcaattacatgcctgtctac

SEQ ID NO: 122439 - DNA, 36 bp, Artificial Sequence
  Description of Artificial Sequence: Synthetic oligonucleotide
agacagtggaaactgcaattacatgcctgtctactg

SEQ ID NO: 122440 - DNA, 35 bp, Artificial Sequence
  Description of Artificial Sequence: Synthetic oligonucleotide
gacagtggaaactgcaattacatgcctgtctactg

SEQ ID NO: 122441 - DNA, 37 bp, Artificial Sequence
  Description of Artificial Sequence: Synthetic oligonucleotide
acagtggaaactgcaattacatgcctgtctactgttc

SEQ ID NO: 122442 - DNA, 36 bp, Artificial Sequence
  Description of Artificial Sequence: Synthetic oligonucleotide
cagtggaaactgcaattacatgcctgtctactgttc

SEQ ID NO: 122443 - DNA, 39 bp, Artificial Sequence
  Description of Artificial Sequence: Synthetic oligonucleotide
agtggaaactgcaattacatgcctgtctactgttctatc

SEQ ID NO: 122444 - DNA, 38 bp, Artificial Sequence
  Description of Artificial Sequence: Synthetic oligonucleotide
gtggaaactgcaattacatgcctgtctactgttctatc

SEQ ID NO: 122445 - DNA, 42 bp, Artificial Sequence
  Description of Artificial Sequence: Synthetic oligonucleotide
tggaaactgcaattacatgcctgtctactgttctatcaattg

SEQ ID NO: 122446 - DNA, 41 bp, Artificial Sequence
  Description of Artificial Sequence: Synthetic oligonucleotide
ggaaactgcaattacatgcctgtctactgttctatcaattg

SEQ ID NO: 122447 - DNA, 45 bp, Artificial Sequence
  Description of Artificial Sequence: Synthetic oligonucleotide
gaaactgcaattacatgcctgtctactgttctatcaattgatttc

SEQ ID NO: 122448 - DNA, 48 bp, Artificial Sequence
  Description of Artificial Sequence: Synthetic oligonucleotide
aaactgcaattacatgcctgtctactgttctatcaattgatttcaaac

SEQ ID NO: 122449 - DNA, 47 bp, Artificial Sequence
  Description of Artificial Sequence: Synthetic oligonucleotide
aactgcaattacatgcctgtctactgttctatcaattgatttcaaac

SEQ ID NO: 122450 - DNA, 46 bp, Artificial Sequence
  Description of Artificial Sequence: Synthetic oligonucleotide
actgcaattacatgcctgtctactgttctatcaattgatttcaaac

SEQ ID NO: 122451 - DNA, 45 bp, Artificial Sequence
  Description of Artificial Sequence: Synthetic oligonucleotide
ctgcaattacatgcctgtctactgttctatcaattgatttcaaac

SEQ ID NO: 122452 - DNA, 45 bp, Artificial Sequence
  Description of Artificial Sequence: Synthetic oligonucleotide
tgcaattacatgcctgtctactgttctatcaattgatttcaaacc

SEQ ID NO: 122453 - DNA, 44 bp, Artificial Sequence
  Description of Artificial Sequence: Synthetic oligonucleotide
gcaattacatgcctgtctactgttctatcaattgatttcaaacc

SEQ ID NO: 122454 - DNA, 46 bp, Artificial Sequence
  Description of Artificial Sequence: Synthetic oligonucleotide
caattacatgcctgtctactgttctatcaattgatttcaaaccttc

SEQ ID NO: 122455 - DNA, 47 bp, Artificial Sequence
  Description of Artificial Sequence: Synthetic oligonucleotide
aattacatgcctgtctactgttctatcaattgatttcaaaccttcag

SEQ ID NO: 122456 - DNA, 46 bp, Artificial Sequence
  Description of Artificial Sequence: Synthetic oligonucleotide
attacatgcctgtctactgttctatcaattgatttcaaaccttcag

SEQ ID NO: 122457 - DNA, 45 bp, Artificial Sequence
  Description of Artificial Sequence: Synthetic oligonucleotide
ttacatgcctgtctactgttctatcaattgatttcaaaccttcag

SEQ ID NO: 122458 - DNA, 44 bp, Artificial Sequence
  Description of Artificial Sequence: Synthetic oligonucleotide
tacatgcctgtctactgttctatcaattgatttcaaaccttcag

SEQ ID NO: 122459 - DNA, 43 bp, Artificial Sequence
  Description of Artificial Sequence: Synthetic oligonucleotide
acatgcctgtctactgttctatcaattgatttcaaaccttcag

SEQ ID NO: 122460 - DNA, 42 bp, Artificial Sequence
  Description of Artificial Sequence: Synthetic oligonucleotide
catgcctgtctactgttctatcaattgatttcaaaccttcag

SEQ ID NO: 122461 - DNA, 47 bp, Artificial Sequence
  Description of Artificial Sequence: Synthetic oligonucleotide
atgcctgtctactgttctatcaattgatttcaaaccttcagaaatag

SEQ ID NO: 122462 - DNA, 46 bp, Artificial Sequence
  Description of Artificial Sequence: Synthetic oligonucleotide
tgcctgtctactgttctatcaattgatttcaaaccttcagaaatag

SEQ ID NO: 122463 - DNA, 45 bp, Artificial Sequence
  Description of Artificial Sequence: Synthetic oligonucleotide
gcctgtctactgttctatcaattgatttcaaaccttcagaaatag

SEQ ID NO: 122464 - DNA, 47 bp, Artificial Sequence
  Description of Artificial Sequence: Synthetic oligonucleotide
cctgtctactgttctatcaattgatttcaaaccttcagaaatagaag

SEQ ID NO: 122465 - DNA, 49 bp, Artificial Sequence
  Description of Artificial Sequence: Synthetic oligonucleotide
ctgtctactgttctatcaattgatttcaaaccttcagaaatagaagttg

SEQ ID NO: 122466 - DNA, 49 bp, Artificial Sequence
  Description of Artificial Sequence: Synthetic oligonucleotide
tgtctactgttctatcaattgatttcaaaccttcagaaatagaagttgg

SEQ ID NO: 122467 - DNA, 48 bp, Artificial Sequence
  Description of Artificial Sequence: Synthetic oligonucleotide
gtctactgttctatcaattgatttcaaaccttcagaaatagaagttgg

SEQ ID NO: 122468 - DNA, 49 bp, Artificial Sequence
  Description of Artificial Sequence: Synthetic oligonucleotide
tctactgttctatcaattgatttcaaaccttcagaaatagaagttggag

SEQ ID NO: 122469 - DNA, 48 bp, Artificial Sequence
  Description of Artificial Sequence: Synthetic oligonucleotide
ctactgttctatcaattgatttcaaaccttcagaaatagaagttggag

SEQ ID NO: 122470 - DNA, 50 bp, Artificial Sequence
  Description of Artificial Sequence: Synthetic oligonucleotide
tactgttctatcaattgatttcaaaccttcagaaatagaagttggagtag

SEQ ID NO: 122471 - DNA, 49 bp, Artificial Sequence
  Description of Artificial Sequence: Synthetic oligonucleotide
actgttctatcaattgatttcaaaccttcagaaatagaagttggagtag

SEQ ID NO: 122472 - DNA, 48 bp, Artificial Sequence
  Description of Artificial Sequence: Synthetic oligonucleotide
ctgttctatcaattgatttcaaaccttcagaaatagaagttggagtag

SEQ ID NO: 122473 - DNA, 49 bp, Artificial Sequence
  Description of Artificial Sequence: Synthetic oligonucleotide
tgttctatcaattgatttcaaaccttcagaaatagaagttggagtagtg

SEQ ID NO: 122474 - DNA, 48 bp, Artificial Sequence
  Description of Artificial Sequence: Synthetic oligonucleotide
gttctatcaattgatttcaaaccttcagaaatagaagttggagtagtg

SEQ ID NO: 122475 - DNA, 49 bp, Artificial Sequence
  Description of Artificial Sequence: Synthetic oligonucleotide
ttctatcaattgatttcaaaccttcagaaatagaagttggagtagtgac

SEQ ID NO: 122476 - DNA, 48 bp, Artificial Sequence
  Description of Artificial Sequence: Synthetic oligonucleotide
tctatcaattgatttcaaaccttcagaaatagaagttggagtagtgac

SEQ ID NO: 122477 - DNA, 47 bp, Artificial Sequence
  Description of Artificial Sequence: Synthetic oligonucleotide
ctatcaattgatttcaaaccttcagaaatagaagttggagtagtgac

SEQ ID NO: 122478 - DNA, 48 bp, Artificial Sequence
  Description of Artificial Sequence: Synthetic oligonucleotide
tatcaattgatttcaaaccttcagaaatagaagttggagtagtgacag

SEQ ID NO: 122479 - DNA, 47 bp, Artificial Sequence
  Description of Artificial Sequence: Synthetic oligonucleotide
atcaattgatttcaaaccttcagaaatagaagttggagtagtgacag

SEQ ID NO: 122480 - DNA, 46 bp, Artificial Sequence
  Description of Artificial Sequence: Synthetic oligonucleotide
tcaattgatttcaaaccttcagaaatagaagttggagtagtgacag

SEQ ID NO: 122481 - DNA, 45 bp, Artificial Sequence
  Description of Artificial Sequence: Synthetic oligonucleotide
caattgatttcaaaccttcagaaatagaagttggagtagtgacag

SEQ ID NO: 122482 - DNA, 47 bp, Artificial Sequence
  Description of Artificial Sequence: Synthetic oligonucleotide
aattgatttcaaaccttcagaaatagaagttggagtagtgacagttg

SEQ ID NO: 122483 - DNA, 46 bp, Artificial Sequence
  Description of Artificial Sequence: Synthetic oligonucleotide
attgatttcaaaccttcagaaatagaagttggagtagtgacagttg

SEQ ID NO: 122484 - DNA, 45 bp, Artificial Sequence
  Description of Artificial Sequence: Synthetic oligonucleotide
ttgatttcaaaccttcagaaatagaagttggagtagtgacagttg

SEQ ID NO: 122485 - DNA, 44 bp, Artificial Sequence
  Description of Artificial Sequence: Synthetic oligonucleotide
tgatttcaaaccttcagaaatagaagttggagtagtgacagttg

SEQ ID NO: 122486 - DNA, 43 bp, Artificial Sequence
  Description of Artificial Sequence: Synthetic oligonucleotide
gatttcaaaccttcagaaatagaagttggagtagtgacagttg

SEQ ID NO: 122487 - DNA, 48 bp, Artificial Sequence
  Description of Artificial Sequence: Synthetic oligonucleotide
atttcaaaccttcagaaatagaagttggagtagtgacagttgaaaatc

SEQ ID NO: 122488 - DNA, 47 bp, Artificial Sequence
  Description of Artificial Sequence: Synthetic oligonucleotide
tttcaaaccttcagaaatagaagttggagtagtgacagttgaaaatc

SEQ ID NO: 122489 - DNA, 46 bp, Artificial Sequence
  Description of Artificial Sequence: Synthetic oligonucleotide
ttcaaaccttcagaaatagaagttggagtagtgacagttgaaaatc

SEQ ID NO: 122490 - DNA, 45 bp, Artificial Sequence
  Description of Artificial Sequence: Synthetic oligonucleotide
tcaaaccttcagaaatagaagttggagtagtgacagttgaaaatc

SEQ ID NO: 122491 - DNA, 44 bp, Artificial Sequence
  Description of Artificial Sequence: Synthetic oligonucleotide
caaaccttcagaaatagaagttggagtagtgacagttgaaaatc

SEQ ID NO: 122492 - DNA, 44 bp, Artificial Sequence
  Description of Artificial Sequence: Synthetic oligonucleotide
aaaccttcagaaatagaagttggagtagtgacagttgaaaatcc

SEQ ID NO: 122493 - DNA, 43 bp, Artificial Sequence
  Description of Artificial Sequence: Synthetic oligonucleotide
aaccttcagaaatagaagttggagtagtgacagttgaaaatcc

SEQ ID NO: 122494 - DNA, 42 bp, Artificial Sequence
  Description of Artificial Sequence: Synthetic oligonucleotide
accttcagaaatagaagttggagtagtgacagttgaaaatcc

SEQ ID NO: 122495 - DNA, 41 bp, Artificial Sequence
  Description of Artificial Sequence: Synthetic oligonucleotide
ccttcagaaatagaagttggagtagtgacagttgaaaatcc

SEQ ID NO: 122496 - DNA, 47 bp, Artificial Sequence
  Description of Artificial Sequence: Synthetic oligonucleotide
cttcagaaatagaagttggagtagtgacagttgaaaatcctaaattc

SEQ ID NO: 122497 - DNA, 48 bp, Artificial Sequence
  Description of Artificial Sequence: Synthetic oligonucleotide
ttcagaaatagaagttggagtagtgacagttgaaaatcctaaattcag

SEQ ID NO: 122498 - DNA, 47 bp, Artificial Sequence
  Description of Artificial Sequence: Synthetic oligonucleotide
tcagaaatagaagttggagtagtgacagttgaaaatcctaaattcag

SEQ ID NO: 122499 - DNA, 46 bp, Artificial Sequence
  Description of Artificial Sequence: Synthetic oligonucleotide
cagaaatagaagttggagtagtgacagttgaaaatcctaaattcag

SEQ ID NO: 122500 - DNA, 46 bp, Artificial Sequence
  Description of Artificial Sequence: Synthetic oligonucleotide
agaaatagaagttggagtagtgacagttgaaaatcctaaattcagg

SEQ ID NO: 122501 - DNA, 45 bp, Artificial Sequence
  Description of Artificial Sequence: Synthetic oligonucleotide
gaaatagaagttggagtagtgacagttgaaaatcctaaattcagg

SEQ ID NO: 122502 - DNA, 48 bp, Artificial Sequence
  Description of Artificial Sequence: Synthetic oligonucleotide
aaatagaagttggagtagtgacagttgaaaatcctaaattcaggattc

SEQ ID NO: 122503 - DNA, 47 bp, Artificial Sequence
  Description of Artificial Sequence: Synthetic oligonucleotide
aatagaagttggagtagtgacagttgaaaatcctaaattcaggattc

SEQ ID NO: 122504 - DNA, 46 bp, Artificial Sequence
  Description of Artificial Sequence: Synthetic oligonucleotide
atagaagttggagtagtgacagttgaaaatcctaaattcaggattc

SEQ ID NO: 122505 - DNA, 45 bp, Artificial Sequence
  Description of Artificial Sequence: Synthetic oligonucleotide
tagaagttggagtagtgacagttgaaaatcctaaattcaggattc

SEQ ID NO: 122506 - DNA, 44 bp, Artificial Sequence
  Description of Artificial Sequence: Synthetic oligonucleotide
agaagttggagtagtgacagttgaaaatcctaaattcaggattc

SEQ ID NO: 122507 - DNA, 43 bp, Artificial Sequence
  Description of Artificial Sequence: Synthetic oligonucleotide
gaagttggagtagtgacagttgaaaatcctaaattcaggattc

SEQ ID NO: 122508 - DNA, 46 bp, Artificial Sequence
  Description of Artificial Sequence: Synthetic oligonucleotide
aagttggagtagtgacagttgaaaatcctaaattcaggattcttac

SEQ ID NO: 122509 - DNA, 45 bp, Artificial Sequence
  Description of Artificial Sequence: Synthetic oligonucleotide
agttggagtagtgacagttgaaaatcctaaattcaggattcttac

SEQ ID NO: 122510 - DNA, 44 bp, Artificial Sequence
  Description of Artificial Sequence: Synthetic oligonucleotide
gttggagtagtgacagttgaaaatcctaaattcaggattcttac

SEQ ID NO: 122511 - DNA, 45 bp, Artificial Sequence
  Description of Artificial Sequence: Synthetic oligonucleotide
ttggagtagtgacagttgaaaatcctaaattcaggattcttacag

SEQ ID NO: 122512 - DNA, 44 bp, Artificial Sequence
  Description of Artificial Sequence: Synthetic oligonucleotide
tggagtagtgacagttgaaaatcctaaattcaggattcttacag

SEQ ID NO: 122513 - DNA, 43 bp, Artificial Sequence
  Description of Artificial Sequence: Synthetic oligonucleotide
ggagtagtgacagttgaaaatcctaaattcaggattcttacag

SEQ ID NO: 122514 - DNA, 45 bp, Artificial Sequence
  Description of Artificial Sequence: Synthetic oligonucleotide
gagtagtgacagttgaaaatcctaaattcaggattcttacagaag

SEQ ID NO: 122515 - DNA, 45 bp, Artificial Sequence
  Description of Artificial Sequence: Synthetic oligonucleotide
agtagtgacagttgaaaatcctaaattcaggattcttacagaagc

SEQ ID NO: 122516 - DNA, 44 bp, Artificial Sequence
  Description of Artificial Sequence: Synthetic oligonucleotide
gtagtgacagttgaaaatcctaaattcaggattcttacagaagc

SEQ ID NO: 122517 - DNA, 45 bp, Artificial Sequence
  Description of Artificial Sequence: Synthetic oligonucleotide
tagtgacagttgaaaatcctaaattcaggattcttacagaagcag

SEQ ID NO: 122518 - DNA, 44 bp, Artificial Sequence
  Description of Artificial Sequence: Synthetic oligonucleotide
agtgacagttgaaaatcctaaattcaggattcttacagaagcag

SEQ ID NO: 122519 - DNA, 43 bp, Artificial Sequence
  Description of Artificial Sequence: Synthetic oligonucleotide
gtgacagttgaaaatcctaaattcaggattcttacagaagcag

SEQ ID NO: 122520 - DNA, 44 bp, Artificial Sequence
  Description of Artificial Sequence: Synthetic oligonucleotide
tgacagttgaaaatcctaaattcaggattcttacagaagcagag

SEQ ID NO: 122521 - DNA, 43 bp, Artificial Sequence
  Description of Artificial Sequence: Synthetic oligonucleotide
gacagttgaaaatcctaaattcaggattcttacagaagcagag

SEQ ID NO: 122522 - DNA, 46 bp, Artificial Sequence
  Description of Artificial Sequence: Synthetic oligonucleotide
acagttgaaaatcctaaattcaggattcttacagaagcagagattg

SEQ ID NO: 122523 - DNA, 45 bp, Artificial Sequence
  Description of Artificial Sequence: Synthetic oligonucleotide
cagttgaaaatcctaaattcaggattcttacagaagcagagattg

SEQ ID NO: 122524 - DNA, 47 bp, Artificial Sequence
  Description of Artificial Sequence: Synthetic oligonucleotide
agttgaaaatcctaaattcaggattcttacagaagcagagattgatg

SEQ ID NO: 122525 - DNA, 46 bp, Artificial Sequence
  Description of Artificial Sequence: Synthetic oligonucleotide
gttgaaaatcctaaattcaggattcttacagaagcagagattgatg

SEQ ID NO: 122526 - DNA, 46 bp, Artificial Sequence
  Description of Artificial Sequence: Synthetic oligonucleotide
ttgaaaatcctaaattcaggattcttacagaagcagagattgatgc

SEQ ID NO: 122527 - DNA, 45 bp, Artificial Sequence
  Description of Artificial Sequence: Synthetic oligonucleotide
tgaaaatcctaaattcaggattcttacagaagcagagattgatgc

SEQ ID NO: 122528 - DNA, 44 bp, Artificial Sequence
  Description of Artificial Sequence: Synthetic oligonucleotide
gaaaatcctaaattcaggattcttacagaagcagagattgatgc

SEQ ID NO: 122529 - DNA, 45 bp, Artificial Sequence
  Description of Artificial Sequence: Synthetic oligonucleotide
aaaatcctaaattcaggattcttacagaagcagagattgatgctc

SEQ ID NO: 122530 - DNA, 44 bp, Artificial Sequence
  Description of Artificial Sequence: Synthetic oligonucleotide
aaatcctaaattcaggattcttacagaagcagagattgatgctc

SEQ ID NO: 122531 - DNA, 43 bp, Artificial Sequence
  Description of Artificial Sequence: Synthetic oligonucleotide
aatcctaaattcaggattcttacagaagcagagattgatgctc

SEQ ID NO: 122532 - DNA, 42 bp, Artificial Sequence
  Description of Artificial Sequence: Synthetic oligonucleotide
atcctaaattcaggattcttacagaagcagagattgatgctc

SEQ ID NO: 122533 - DNA, 41 bp, Artificial Sequence
  Description of Artificial Sequence: Synthetic oligonucleotide
tcctaaattcaggattcttacagaagcagagattgatgctc

SEQ ID NO: 122534 - DNA, 40 bp, Artificial Sequence
  Description of Artificial Sequence: Synthetic oligonucleotide
cctaaattcaggattcttacagaagcagagattgatgctc

SEQ ID NO: 122535 - DNA, 41 bp, Artificial Sequence
  Description of Artificial Sequence: Synthetic oligonucleotide
ctaaattcaggattcttacagaagcagagattgatgctcac

SEQ ID NO: 122536 - DNA, 41 bp, Artificial Sequence
  Description of Artificial Sequence: Synthetic oligonucleotide
taaattcaggattcttacagaagcagagattgatgctcacc

SEQ ID NO: 122537 - DNA, 40 bp, Artificial Sequence
  Description of Artificial Sequence: Synthetic oligonucleotide
aaattcaggattcttacagaagcagagattgatgctcacc

SEQ ID NO: 122538 - DNA, 39 bp, Artificial Sequence
  Description of Artificial Sequence: Synthetic oligonucleotide
aattcaggattcttacagaagcagagattgatgctcacc

SEQ ID NO: 122539 - DNA, 38 bp, Artificial Sequence
  Description of Artificial Sequence: Synthetic oligonucleotide
attcaggattcttacagaagcagagattgatgctcacc

SEQ ID NO: 122540 - DNA, 37 bp, Artificial Sequence
  Description of Artificial Sequence: Synthetic oligonucleotide
ttcaggattcttacagaagcagagattgatgctcacc

SEQ ID NO: 122541 - DNA, 36 bp, Artificial Sequence
  Description of Artificial Sequence: Synthetic oligonucleotide
tcaggattcttacagaagcagagattgatgctcacc

SEQ ID NO: 122542 - DNA, 35 bp, Artificial Sequence
  Description of Artificial Sequence: Synthetic oligonucleotide
caggattcttacagaagcagagattgatgctcacc

SEQ ID NO: 122543 - DNA, 37 bp, Artificial Sequence
  Description of Artificial Sequence: Synthetic oligonucleotide
aggattcttacagaagcagagattgatgctcaccttg

SEQ ID NO: 122544 - DNA, 36 bp, Artificial Sequence
  Description of Artificial Sequence: Synthetic oligonucleotide
ggattcttacagaagcagagattgatgctcaccttg

SEQ ID NO: 122545 - DNA, 38 bp, Artificial Sequence
  Description of Artificial Sequence: Synthetic oligonucleotide
gattcttacagaagcagagattgatgctcaccttgttg

SEQ ID NO: 122546 - DNA, 38 bp, Artificial Sequence
  Description of Artificial Sequence: Synthetic oligonucleotide
attcttacagaagcagagattgatgctcaccttgttgc

SEQ ID NO: 122547 - DNA, 37 bp, Artificial Sequence
  Description of Artificial Sequence: Synthetic oligonucleotide
ttcttacagaagcagagattgatgctcaccttgttgc

SEQ ID NO: 122548 - DNA, 36 bp, Artificial Sequence
  Description of Artificial Sequence: Synthetic oligonucleotide
tcttacagaagcagagattgatgctcaccttgttgc

SEQ ID NO: 122549 - DNA, 35 bp, Artificial Sequence
  Description of Artificial Sequence: Synthetic oligonucleotide
cttacagaagcagagattgatgctcaccttgttgc

SEQ ID NO: 122550 - DNA, 36 bp, Artificial Sequence
  Description of Artificial Sequence: Synthetic oligonucleotide
ttacagaagcagagattgatgctcaccttgttgctc

SEQ ID NO: 122551 - DNA, 35 bp, Artificial Sequence
  Description of Artificial Sequence: Synthetic oligonucleotide
tacagaagcagagattgatgctcaccttgttgctc

SEQ ID NO: 122552 - DNA, 34 bp, Artificial Sequence
  Description of Artificial Sequence: Synthetic oligonucleotide
acagaagcagagattgatgctcaccttgttgctc

SEQ ID NO: 122553 - DNA, 33 bp, Artificial Sequence
  Description of Artificial Sequence: Synthetic oligonucleotide
cagaagcagagattgatgctcaccttgttgctc

SEQ ID NO: 122554 - DNA, 35 bp, Artificial Sequence
  Description of Artificial Sequence: Synthetic oligonucleotide
agaagcagagattgatgctcaccttgttgctctag

SEQ ID NO: 122555 - DNA, 34 bp, Artificial Sequence
  Description of Artificial Sequence: Synthetic oligonucleotide
gaagcagagattgatgctcaccttgttgctctag

SEQ ID NO: 122556 - DNA, 34 bp, Artificial Sequence
  Description of Artificial Sequence: Synthetic oligonucleotide
aagcagagattgatgctcaccttgttgctctagc

SEQ ID NO: 122557 - DNA, 33 bp, Artificial Sequence
  Description of Artificial Sequence: Synthetic oligonucleotide
agcagagattgatgctcaccttgttgctctagc

SEQ ID NO: 122558 - DNA, 32 bp, Artificial Sequence
  Description of Artificial Sequence: Synthetic oligonucleotide
gcagagattgatgctcaccttgttgctctagc

SEQ ID NO: 122559 - DNA, 33 bp, Artificial Sequence
  Description of Artificial Sequence: Synthetic oligonucleotide
cagagattgatgctcaccttgttgctctagcag

SEQ ID NO: 122560 - DNA, 34 bp, Artificial Sequence
  Description of Artificial Sequence: Synthetic oligonucleotide
agagattgatgctcaccttgttgctctagcagag

SEQ ID NO: 122561 - DNA, 33 bp, Artificial Sequence
  Description of Artificial Sequence: Synthetic oligonucleotide
gagattgatgctcaccttgttgctctagcagag

SEQ ID NO: 122562 - DNA, 34 bp, Artificial Sequence
  Description of Artificial Sequence: Synthetic oligonucleotide
agattgatgctcaccttgttgctctagcagagag

SEQ ID NO: 122563 - DNA, 33 bp, Artificial Sequence
  Description of Artificial Sequence: Synthetic oligonucleotide
gattgatgctcaccttgttgctctagcagagag

SEQ ID NO: 122564 - DNA, 34 bp, Artificial Sequence
  Description of Artificial Sequence: Synthetic oligonucleotide
attgatgctcaccttgttgctctagcagagagag

SEQ ID NO: 122565 - DNA, 33 bp, Artificial Sequence
  Description of Artificial Sequence: Synthetic oligonucleotide
ttgatgctcaccttgttgctctagcagagagag

SEQ ID NO: 122566 - DNA, 32 bp, Artificial Sequence
  Description of Artificial Sequence: Synthetic oligonucleotide
tgatgctcaccttgttgctctagcagagagag

SEQ ID NO: 122567 - DNA, 31 bp, Artificial Sequence
  Description of Artificial Sequence: Synthetic oligonucleotide
gatgctcaccttgttgctctagcagagagag

SEQ ID NO: 122568 - DNA, 32 bp, Artificial Sequence
  Description of Artificial Sequence: Synthetic oligonucleotide
atgctcaccttgttgctctagcagagagagac

SEQ ID NO: 122569 - DNA, 31 bp, Artificial Sequence
  Description of Artificial Sequence: Synthetic oligonucleotide
tgctcaccttgttgctctagcagagagagac

SEQ ID NO: 122570 - DNA, 30 bp, Artificial Sequence
  Description of Artificial Sequence: Synthetic oligonucleotide
gctcaccttgttgctctagcagagagagac

SEQ ID NO: 122571 - DNA, 26 bp, Artificial Sequence
  Description of Artificial Sequence: Synthetic oligonucleotide
atgagctacgaccgcgccatcaccgt

SEQ ID NO: 122572 - DNA, 25 bp, Artificial Sequence
  Description of Artificial Sequence: Synthetic oligonucleotide
tgagctacgaccgcgccatcaccgt

SEQ ID NO: 122573 - DNA, 24 bp, Artificial Sequence
  Description of Artificial Sequence: Synthetic oligonucleotide
gagctacgaccgcgccatcaccgt

SEQ ID NO: 122574 - DNA, 26 bp, Artificial Sequence
  Description of Artificial Sequence: Synthetic oligonucleotide
agctacgaccgcgccatcaccgtctt

SEQ ID NO: 122575 - DNA, 25 bp, Artificial Sequence
  Description of Artificial Sequence: Synthetic oligonucleotide
gctacgaccgcgccatcaccgtctt

SEQ ID NO: 122576 - DNA, 26 bp, Artificial Sequence
  Description of Artificial Sequence: Synthetic oligonucleotide
ctacgaccgcgccatcaccgtcttct

SEQ ID NO: 122577 - DNA, 26 bp, Artificial Sequence
  Description of Artificial Sequence: Synthetic oligonucleotide
tacgaccgcgccatcaccgtcttctc

SEQ ID NO: 122578 - DNA, 25 bp, Artificial Sequence
  Description of Artificial Sequence: Synthetic oligonucleotide
acgaccgcgccatcaccgtcttctc

SEQ ID NO: 122579 - DNA, 24 bp, Artificial Sequence
  Description of Artificial Sequence: Synthetic oligonucleotide
cgaccgcgccatcaccgtcttctc

SEQ ID NO: 122580 - DNA, 24 bp, Artificial Sequence
  Description of Artificial Sequence: Synthetic oligonucleotide
gaccgcgccatcaccgtcttctcg

SEQ ID NO: 122581 - DNA, 24 bp, Artificial Sequence
  Description of Artificial Sequence: Synthetic oligonucleotide
accgcgccatcaccgtcttctcgc

SEQ ID NO: 122582 - DNA, 23 bp, Artificial Sequence
  Description of Artificial Sequence: Synthetic oligonucleotide
ccgcgccatcaccgtcttctcgc

SEQ ID NO: 122583 - DNA, 23 bp, Artificial Sequence
  Description of Artificial Sequence: Synthetic oligonucleotide
cgcgccatcaccgtcttctcgcc

SEQ ID NO: 122584 - DNA, 23 bp, Artificial Sequence
  Description of Artificial Sequence: Synthetic oligonucleotide
gcgccatcaccgtcttctcgccc

SEQ ID NO: 122585 - DNA, 24 bp, Artificial Sequence
  Description of Artificial Sequence: Synthetic oligonucleotide
cgccatcaccgtcttctcgcccga

SEQ ID NO: 122586 - DNA, 24 bp, Artificial Sequence
  Description of Artificial Sequence: Synthetic oligonucleotide
gccatcaccgtcttctcgcccgac

SEQ ID NO: 122587 - DNA, 24 bp, Artificial Sequence
  Description of Artificial Sequence: Synthetic oligonucleotide
ccatcaccgtcttctcgcccgacg

SEQ ID NO: 122588 - DNA, 24 bp, Artificial Sequence
  Description of Artificial Sequence: Synthetic oligonucleotide
catcaccgtcttctcgcccgacgg

SEQ ID NO: 122589 - DNA, 24 bp, Artificial Sequence
  Description of Artificial Sequence: Synthetic oligonucleotide
atcaccgtcttctcgcccgacggc

SEQ ID NO: 122590 - DNA, 23 bp, Artificial Sequence
  Description of Artificial Sequence: Synthetic oligonucleotide
tcaccgtcttctcgcccgacggc

SEQ ID NO: 122591 - DNA, 22 bp, Artificial Sequence
  Description of Artificial Sequence: Synthetic oligonucleotide
caccgtcttctcgcccgacggc

SEQ ID NO: 122592 - DNA, 23 bp, Artificial Sequence
  Description of Artificial Sequence: Synthetic oligonucleotide
accgtcttctcgcccgacggcca

SEQ ID NO: 122593 - DNA, 22 bp, Artificial Sequence
  Description of Artificial Sequence: Synthetic oligonucleotide
ccgtcttctcgcccgacggcca

SEQ ID NO: 122594 - DNA, 22 bp, Artificial Sequence
  Description of Artificial Sequence: Synthetic oligonucleotide
cgtcttctcgcccgacggccac

SEQ ID NO: 122595 - DNA, 23 bp, Artificial Sequence
  Description of Artificial Sequence: Synthetic oligonucleotide
gtcttctcgcccgacggccacct

SEQ ID NO: 122596 - DNA, 25 bp, Artificial Sequence
  Description of Artificial Sequence: Synthetic oligonucleotide
tcttctcgcccgacggccacctctt

SEQ ID NO: 122597 - DNA, 24 bp, Artificial Sequence
  Description of Artificial Sequence: Synthetic oligonucleotide
cttctcgcccgacggccacctctt

SEQ ID NO: 122598 - DNA, 24 bp, Artificial Sequence
  Description of Artificial Sequence: Synthetic oligonucleotide
ttctcgcccgacggccacctcttc

SEQ ID NO: 122599 - DNA, 23 bp, Artificial Sequence
  Description of Artificial Sequence: Synthetic oligonucleotide
tctcgcccgacggccacctcttc

SEQ ID NO: 122600 - DNA, 22 bp, Artificial Sequence
  Description of Artificial Sequence: Synthetic oligonucleotide
ctcgcccgacggccacctcttc

SEQ ID NO: 122601 - DNA, 24 bp, Artificial Sequence
  Description of Artificial Sequence: Synthetic oligonucleotide
tcgcccgacggccacctcttccaa

SEQ ID NO: 122602 - DNA, 23 bp, Artificial Sequence
  Description of Artificial Sequence: Synthetic oligonucleotide
cgcccgacggccacctcttccaa

SEQ ID NO: 122603 - DNA, 24 bp, Artificial Sequence
  Description of Artificial Sequence: Synthetic oligonucleotide
gcccgacggccacctcttccaagt

SEQ ID NO: 122604 - DNA, 24 bp, Artificial Sequence
  Description of Artificial Sequence: Synthetic oligonucleotide
cccgacggccacctcttccaagtg

SEQ ID NO: 122605 - DNA, 25 bp, Artificial Sequence
  Description of Artificial Sequence: Synthetic oligonucleotide
ccgacggccacctcttccaagtgga

SEQ ID NO: 122606 - DNA, 27 bp, Artificial Sequence
  Description of Artificial Sequence: Synthetic oligonucleotide
cgacggccacctcttccaagtggagta

SEQ ID NO: 122607 - DNA, 27 bp, Artificial Sequence
  Description of Artificial Sequence: Synthetic oligonucleotide
gacggccacctcttccaagtggagtac

SEQ ID NO: 122608 - DNA, 27 bp, Artificial Sequence
  Description of Artificial Sequence: Synthetic oligonucleotide
acggccacctcttccaagtggagtacg

SEQ ID NO: 122609 - DNA, 26 bp, Artificial Sequence
  Description of Artificial Sequence: Synthetic oligonucleotide
cggccacctcttccaagtggagtacg

SEQ ID NO: 122610 - DNA, 26 bp, Artificial Sequence
  Description of Artificial Sequence: Synthetic oligonucleotide
ggccacctcttccaagtggagtacgc

SEQ ID NO: 122611 - DNA, 26 bp, Artificial Sequence
  Description of Artificial Sequence: Synthetic oligonucleotide
gccacctcttccaagtggagtacgcg

SEQ ID NO: 122612 - DNA, 27 bp, Artificial Sequence
  Description of Artificial Sequence: Synthetic oligonucleotide
ccacctcttccaagtggagtacgcgca

SEQ ID NO: 122613 - DNA, 27 bp, Artificial Sequence
  Description of Artificial Sequence: Synthetic oligonucleotide
cacctcttccaagtggagtacgcgcag

SEQ ID NO: 122614 - DNA, 27 bp, Artificial Sequence
  Description of Artificial Sequence: Synthetic oligonucleotide
acctcttccaagtggagtacgcgcagg

SEQ ID NO: 122615 - DNA, 27 bp, Artificial Sequence
  Description of Artificial Sequence: Synthetic oligonucleotide
cctcttccaagtggagtacgcgcagga

SEQ ID NO: 122616 - DNA, 27 bp, Artificial Sequence
  Description of Artificial Sequence: Synthetic oligonucleotide
ctcttccaagtggagtacgcgcaggag

SEQ ID NO: 122617 - DNA, 27 bp, Artificial Sequence
  Description of Artificial Sequence: Synthetic oligonucleotide
tcttccaagtggagtacgcgcaggagg

SEQ ID NO: 122618 - DNA, 26 bp, Artificial Sequence
  Description of Artificial Sequence: Synthetic oligonucleotide
cttccaagtggagtacgcgcaggagg

SEQ ID NO: 122619 - DNA, 26 bp, Artificial Sequence
  Description of Artificial Sequence: Synthetic oligonucleotide
ttccaagtggagtacgcgcaggaggc

SEQ ID NO: 122620 - DNA, 25 bp, Artificial Sequence
  Description of Artificial Sequence: Synthetic oligonucleotide
tccaagtggagtacgcgcaggaggc

SEQ ID NO: 122621 - DNA, 24 bp, Artificial Sequence
  Description of Artificial Sequence: Synthetic oligonucleotide
ccaagtggagtacgcgcaggaggc

SEQ ID NO: 122622 - DNA, 24 bp, Artificial Sequence
  Description of Artificial Sequence: Synthetic oligonucleotide
caagtggagtacgcgcaggaggcc

SEQ ID NO: 122623 - DNA, 25 bp, Artificial Sequence
  Description of Artificial Sequence: Synthetic oligonucleotide
aagtggagtacgcgcaggaggccgt

SEQ ID NO: 122624 - DNA, 24 bp, Artificial Sequence
  Description of Artificial Sequence: Synthetic oligonucleotide
agtggagtacgcgcaggaggccgt

SEQ ID NO: 122625 - DNA, 23 bp, Artificial Sequence
  Description of Artificial Sequence: Synthetic oligonucleotide
gtggagtacgcgcaggaggccgt

SEQ ID NO: 122626 - DNA, 25 bp, Artificial Sequence
  Description of Artificial Sequence: Synthetic oligonucleotide
tggagtacgcgcaggaggccgtcaa

SEQ ID NO: 122627 - DNA, 24 bp, Artificial Sequence
  Description of Artificial Sequence: Synthetic oligonucleotide
ggagtacgcgcaggaggccgtcaa

SEQ ID NO: 122628 - DNA, 26 bp, Artificial Sequence
  Description of Artificial Sequence: Synthetic oligonucleotide
gagtacgcgcaggaggccgtcaagaa

SEQ ID NO: 122629 - DNA, 26 bp, Artificial Sequence
  Description of Artificial Sequence: Synthetic oligonucleotide
agtacgcgcaggaggccgtcaagaag

SEQ ID NO: 122630 - DNA, 25 bp, Artificial Sequence
  Description of Artificial Sequence: Synthetic oligonucleotide
gtacgcgcaggaggccgtcaagaag

SEQ ID NO: 122631 - DNA, 25 bp, Artificial Sequence
  Description of Artificial Sequence: Synthetic oligonucleotide
tacgcgcaggaggccgtcaagaagg

SEQ ID NO: 122632 - DNA, 24 bp, Artificial Sequence
  Description of Artificial Sequence: Synthetic oligonucleotide
acgcgcaggaggccgtcaagaagg

SEQ ID NO: 122633 - DNA, 23 bp, Artificial Sequence
  Description of Artificial Sequence: Synthetic oligonucleotide
cgcgcaggaggccgtcaagaagg

SEQ ID NO: 122634 - DNA, 23 bp, Artificial Sequence
  Description of Artificial Sequence: Synthetic oligonucleotide
gcgcaggaggccgtcaagaaggg

SEQ ID NO: 122635 - DNA, 24 bp, Artificial Sequence
  Description of Artificial Sequence: Synthetic oligonucleotide
cgcaggaggccgtcaagaagggct

SEQ ID NO: 122636 - DNA, 24 bp, Artificial Sequence
  Description of Artificial Sequence: Synthetic oligonucleotide
gcaggaggccgtcaagaagggctc

SEQ ID NO: 122637 - DNA, 25 bp, Artificial Sequence
  Description of Artificial Sequence: Synthetic oligonucleotide
caggaggccgtcaagaagggctcga

SEQ ID NO: 122638 - DNA, 25 bp, Artificial Sequence
  Description of Artificial Sequence: Synthetic oligonucleotide
aggaggccgtcaagaagggctcgac

SEQ ID NO: 122639 - DNA, 24 bp, Artificial Sequence
  Description of Artificial Sequence: Synthetic oligonucleotide
ggaggccgtcaagaagggctcgac

SEQ ID NO: 122640 - DNA, 24 bp, Artificial Sequence
  Description of Artificial Sequence: Synthetic oligonucleotide
gaggccgtcaagaagggctcgacc

SEQ ID NO: 122641 - DNA, 24 bp, Artificial Sequence
  Description of Artificial Sequence: Synthetic oligonucleotide
aggccgtcaagaagggctcgaccg

SEQ ID NO: 122642 - DNA, 23 bp, Artificial Sequence
  Description of Artificial Sequence: Synthetic oligonucleotide
ggccgtcaagaagggctcgaccg

SEQ ID NO: 122643 - DNA, 23 bp, Artificial Sequence
  Description of Artificial Sequence: Synthetic oligonucleotide
gccgtcaagaagggctcgaccgc

SEQ ID NO: 122644 - DNA, 23 bp, Artificial Sequence
  Description of Artificial Sequence: Synthetic oligonucleotide
ccgtcaagaagggctcgaccgcg

SEQ ID NO: 122645 - DNA, 25 bp, Artificial Sequence
  Description of Artificial Sequence: Synthetic oligonucleotide
cgtcaagaagggctcgaccgcggtt

SEQ ID NO: 122646 - DNA, 25 bp, Artificial Sequence
  Description of Artificial Sequence: Synthetic oligonucleotide
gtcaagaagggctcgaccgcggttg

SEQ ID NO: 122647 - DNA, 26 bp, Artificial Sequence
  Description of Artificial Sequence: Synthetic oligonucleotide
tcaagaagggctcgaccgcggttggt

SEQ ID NO: 122648 - DNA, 25 bp, Artificial Sequence
  Description of Artificial Sequence: Synthetic oligonucleotide
caagaagggctcgaccgcggttggt

SEQ ID NO: 122649 - DNA, 27 bp, Artificial Sequence
  Description of Artificial Sequence: Synthetic oligonucleotide
aagaagggctcgaccgcggttggtgtt

SEQ ID NO: 122650 - DNA, 26 bp, Artificial Sequence
  Description of Artificial Sequence: Synthetic oligonucleotide
agaagggctcgaccgcggttggtgtt

SEQ ID NO: 122651 - DNA, 25 bp, Artificial Sequence
  Description of Artificial Sequence: Synthetic oligonucleotide
gaagggctcgaccgcggttggtgtt

SEQ ID NO: 122652 - DNA, 25 bp, Artificial Sequence
  Description of Artificial Sequence: Synthetic oligonucleotide
aagggctcgaccgcggttggtgttc

SEQ ID NO: 122653 - DNA, 24 bp, Artificial Sequence
  Description of Artificial Sequence: Synthetic oligonucleotide
agggctcgaccgcggttggtgttc

SEQ ID NO: 122654 - DNA, 23 bp, Artificial Sequence
  Description of Artificial Sequence: Synthetic oligonucleotide
gggctcgaccgcggttggtgttc

SEQ ID NO: 122655 - DNA, 24 bp, Artificial Sequence
  Description of Artificial Sequence: Synthetic oligonucleotide
ggctcgaccgcggttggtgttcga

SEQ ID NO: 122656 - DNA, 24 bp, Artificial Sequence
  Description of Artificial Sequence: Synthetic oligonucleotide
gctcgaccgcggttggtgttcgag

SEQ ID NO: 122657 - DNA, 26 bp, Artificial Sequence
  Description of Artificial Sequence: Synthetic oligonucleotide
ctcgaccgcggttggtgttcgaggaa

SEQ ID NO: 122658 - DNA, 27 bp, Artificial Sequence
  Description of Artificial Sequence: Synthetic oligonucleotide
tcgaccgcggttggtgttcgaggaaga

SEQ ID NO: 122659 - DNA, 26 bp, Artificial Sequence
  Description of Artificial Sequence: Synthetic oligonucleotide
cgaccgcggttggtgttcgaggaaga

SEQ ID NO: 122660 - DNA, 27 bp, Artificial Sequence
  Description of Artificial Sequence: Synthetic oligonucleotide
gaccgcggttggtgttcgaggaagaga

SEQ ID NO: 122661 - DNA, 27 bp, Artificial Sequence
  Description of Artificial Sequence: Synthetic oligonucleotide
accgcggttggtgttcgaggaagagac

SEQ ID NO: 122662 - DNA, 27 bp, Artificial Sequence
  Description of Artificial Sequence: Synthetic oligonucleotide
ccgcggttggtgttcgaggaagagaca

SEQ ID NO: 122663 - DNA, 29 bp, Artificial Sequence
  Description of Artificial Sequence: Synthetic oligonucleotide
cgcggttggtgttcgaggaagagacattg

SEQ ID NO: 122664 - DNA, 31 bp, Artificial Sequence
  Description of Artificial Sequence: Synthetic oligonucleotide
gcggttggtgttcgaggaagagacattgttg

SEQ ID NO: 122665 - DNA, 33 bp, Artificial Sequence
  Description of Artificial Sequence: Synthetic oligonucleotide
cggttggtgttcgaggaagagacattgttgttc

SEQ ID NO: 122666 - DNA, 35 bp, Artificial Sequence
  Description of Artificial Sequence: Synthetic oligonucleotide
ggttggtgttcgaggaagagacattgttgttcttg

SEQ ID NO: 122667 - DNA, 35 bp, Artificial Sequence
  Description of Artificial Sequence: Synthetic oligonucleotide
gttggtgttcgaggaagagacattgttgttcttgg

SEQ ID NO: 122668 - DNA, 36 bp, Artificial Sequence
  Description of Artificial Sequence: Synthetic oligonucleotide
ttggtgttcgaggaagagacattgttgttcttggtg

SEQ ID NO: 122669 - DNA, 35 bp, Artificial Sequence
  Description of Artificial Sequence: Synthetic oligonucleotide
tggtgttcgaggaagagacattgttgttcttggtg

SEQ ID NO: 122670 - DNA, 34 bp, Artificial Sequence
  Description of Artificial Sequence: Synthetic oligonucleotide
ggtgttcgaggaagagacattgttgttcttggtg

SEQ ID NO: 122671 - DNA, 35 bp, Artificial Sequence
  Description of Artificial Sequence: Synthetic oligonucleotide
gtgttcgaggaagagacattgttgttcttggtgtg

SEQ ID NO: 122672 - DNA, 35 bp, Artificial Sequence
  Description of Artificial Sequence: Synthetic oligonucleotide
tgttcgaggaagagacattgttgttcttggtgtgg

SEQ ID NO: 122673 - DNA, 34 bp, Artificial Sequence
  Description of Artificial Sequence: Synthetic oligonucleotide
gttcgaggaagagacattgttgttcttggtgtgg

SEQ ID NO: 122674 - DNA, 35 bp, Artificial Sequence
  Description of Artificial Sequence: Synthetic oligonucleotide
ttcgaggaagagacattgttgttcttggtgtggag

SEQ ID NO: 122675 - DNA, 34 bp, Artificial Sequence
  Description of Artificial Sequence: Synthetic oligonucleotide
tcgaggaagagacattgttgttcttggtgtggag

SEQ ID NO: 122676 - DNA, 33 bp, Artificial Sequence
  Description of Artificial Sequence: Synthetic oligonucleotide
cgaggaagagacattgttgttcttggtgtggag

SEQ ID NO: 122677 - DNA, 35 bp, Artificial Sequence
  Description of Artificial Sequence: Synthetic oligonucleotide
gaggaagagacattgttgttcttggtgtggagaag

SEQ ID NO: 122678 - DNA, 37 bp, Artificial Sequence
  Description of Artificial Sequence: Synthetic oligonucleotide
aggaagagacattgttgttcttggtgtggagaagaag

SEQ ID NO: 122679 - DNA, 36 bp, Artificial Sequence
  Description of Artificial Sequence: Synthetic oligonucleotide
ggaagagacattgttgttcttggtgtggagaagaag

SEQ ID NO: 122680 - DNA, 37 bp, Artificial Sequence
  Description of Artificial Sequence: Synthetic oligonucleotide
gaagagacattgttgttcttggtgtggagaagaagtc

SEQ ID NO: 122681 - DNA, 38 bp, Artificial Sequence
  Description of Artificial Sequence: Synthetic oligonucleotide
aagagacattgttgttcttggtgtggagaagaagtcag

SEQ ID NO: 122682 - DNA, 37 bp, Artificial Sequence
  Description of Artificial Sequence: Synthetic oligonucleotide
agagacattgttgttcttggtgtggagaagaagtcag

SEQ ID NO: 122683 - DNA, 36 bp, Artificial Sequence
  Description of Artificial Sequence: Synthetic oligonucleotide
gagacattgttgttcttggtgtggagaagaagtcag

SEQ ID NO: 122684 - DNA, 37 bp, Artificial Sequence
  Description of Artificial Sequence: Synthetic oligonucleotide
agacattgttgttcttggtgtggagaagaagtcagtg

SEQ ID NO: 122685 - DNA, 36 bp, Artificial Sequence
  Description of Artificial Sequence: Synthetic oligonucleotide
gacattgttgttcttggtgtggagaagaagtcagtg

SEQ ID NO: 122686 - DNA, 36 bp, Artificial Sequence
  Description of Artificial Sequence: Synthetic oligonucleotide
acattgttgttcttggtgtggagaagaagtcagtgg

SEQ ID NO: 122687 - DNA, 35 bp, Artificial Sequence
  Description of Artificial Sequence: Synthetic oligonucleotide
cattgttgttcttggtgtggagaagaagtcagtgg

SEQ ID NO: 122688 - DNA, 35 bp, Artificial Sequence
  Description of Artificial Sequence: Synthetic oligonucleotide
attgttgttcttggtgtggagaagaagtcagtggc

SEQ ID NO: 122689 - DNA, 34 bp, Artificial Sequence
  Description of Artificial Sequence: Synthetic oligonucleotide
ttgttgttcttggtgtggagaagaagtcagtggc

SEQ ID NO: 122690 - DNA, 33 bp, Artificial Sequence
  Description of Artificial Sequence: Synthetic oligonucleotide
tgttgttcttggtgtggagaagaagtcagtggc

SEQ ID NO: 122691 - DNA, 32 bp, Artificial Sequence
  Description of Artificial Sequence: Synthetic oligonucleotide
gttgttcttggtgtggagaagaagtcagtggc

SEQ ID NO: 122692 - DNA, 32 bp, Artificial Sequence
  Description of Artificial Sequence: Synthetic oligonucleotide
ttgttcttggtgtggagaagaagtcagtggcc

SEQ ID NO: 122693 - DNA, 31 bp, Artificial Sequence
  Description of Artificial Sequence: Synthetic oligonucleotide
tgttcttggtgtggagaagaagtcagtggcc

SEQ ID NO: 122694 - DNA, 30 bp, Artificial Sequence
  Description of Artificial Sequence: Synthetic oligonucleotide
gttcttggtgtggagaagaagtcagtggcc

SEQ ID NO: 122695 - DNA, 33 bp, Artificial Sequence
  Description of Artificial Sequence: Synthetic oligonucleotide
ttcttggtgtggagaagaagtcagtggccaaac

SEQ ID NO: 122696 - DNA, 32 bp, Artificial Sequence
  Description of Artificial Sequence: Synthetic oligonucleotide
tcttggtgtggagaagaagtcagtggccaaac

SEQ ID NO: 122697 - DNA, 31 bp, Artificial Sequence
  Description of Artificial Sequence: Synthetic oligonucleotide
cttggtgtggagaagaagtcagtggccaaac

SEQ ID NO: 122698 - DNA, 32 bp, Artificial Sequence
  Description of Artificial Sequence: Synthetic oligonucleotide
ttggtgtggagaagaagtcagtggccaaactg

SEQ ID NO: 122699 - DNA, 31 bp, Artificial Sequence
  Description of Artificial Sequence: Synthetic oligonucleotide
tggtgtggagaagaagtcagtggccaaactg

SEQ ID NO: 122700 - DNA, 30 bp, Artificial Sequence
  Description of Artificial Sequence: Synthetic oligonucleotide
ggtgtggagaagaagtcagtggccaaactg

SEQ ID NO: 122701 - DNA, 30 bp, Artificial Sequence
  Description of Artificial Sequence: Synthetic oligonucleotide
gtgtggagaagaagtcagtggccaaactgc

SEQ ID NO: 122702 - DNA, 31 bp, Artificial Sequence
  Description of Artificial Sequence: Synthetic oligonucleotide
tgtggagaagaagtcagtggccaaactgcag

SEQ ID NO: 122703 - DNA, 30 bp, Artificial Sequence
  Description of Artificial Sequence: Synthetic oligonucleotide
gtggagaagaagtcagtggccaaactgcag

SEQ ID NO: 122704 - DNA, 30 bp, Artificial Sequence
  Description of Artificial Sequence: Synthetic oligonucleotide
tggagaagaagtcagtggccaaactgcagg

SEQ ID NO: 122705 - DNA, 29 bp, Artificial Sequence
  Description of Artificial Sequence: Synthetic oligonucleotide
ggagaagaagtcagtggccaaactgcagg

SEQ ID NO: 122706 - DNA, 31 bp, Artificial Sequence
  Description of Artificial Sequence: Synthetic oligonucleotide
gagaagaagtcagtggccaaactgcaggatg

SEQ ID NO: 122707 - DNA, 34 bp, Artificial Sequence
  Description of Artificial Sequence: Synthetic oligonucleotide
agaagaagtcagtggccaaactgcaggatgaaag

SEQ ID NO: 122708 - DNA, 33 bp, Artificial Sequence
  Description of Artificial Sequence: Synthetic oligonucleotide
gaagaagtcagtggccaaactgcaggatgaaag

SEQ ID NO: 122709 - DNA, 35 bp, Artificial Sequence
  Description of Artificial Sequence: Synthetic oligonucleotide
aagaagtcagtggccaaactgcaggatgaaagaac

SEQ ID NO: 122710 - DNA, 34 bp, Artificial Sequence
  Description of Artificial Sequence: Synthetic oligonucleotide
agaagtcagtggccaaactgcaggatgaaagaac

SEQ ID NO: 122711 - DNA, 33 bp, Artificial Sequence
  Description of Artificial Sequence: Synthetic oligonucleotide
gaagtcagtggccaaactgcaggatgaaagaac

SEQ ID NO: 122712 - DNA, 34 bp, Artificial Sequence
  Description of Artificial Sequence: Synthetic oligonucleotide
aagtcagtggccaaactgcaggatgaaagaacag

SEQ ID NO: 122713 - DNA, 33 bp, Artificial Sequence
  Description of Artificial Sequence: Synthetic oligonucleotide
agtcagtggccaaactgcaggatgaaagaacag

SEQ ID NO: 122714 - DNA, 32 bp, Artificial Sequence
  Description of Artificial Sequence: Synthetic oligonucleotide
gtcagtggccaaactgcaggatgaaagaacag

SEQ ID NO: 122715 - DNA, 33 bp, Artificial Sequence
  Description of Artificial Sequence: Synthetic oligonucleotide
tcagtggccaaactgcaggatgaaagaacagtg

SEQ ID NO: 122716 - DNA, 32 bp, Artificial Sequence
  Description of Artificial Sequence: Synthetic oligonucleotide
cagtggccaaactgcaggatgaaagaacagtg

SEQ ID NO: 122717 - DNA, 32 bp, Artificial Sequence
  Description of Artificial Sequence: Synthetic oligonucleotide
agtggccaaactgcaggatgaaagaacagtgc

SEQ ID NO: 122718 - DNA, 31 bp, Artificial Sequence
  Description of Artificial Sequence: Synthetic oligonucleotide
gtggccaaactgcaggatgaaagaacagtgc

SEQ ID NO: 122719 - DNA, 31 bp, Artificial Sequence
  Description of Artificial Sequence: Synthetic oligonucleotide
tggccaaactgcaggatgaaagaacagtgcg

SEQ ID NO: 122720 - DNA, 30 bp, Artificial Sequence
  Description of Artificial Sequence: Synthetic oligonucleotide
ggccaaactgcaggatgaaagaacagtgcg

SEQ ID NO: 122721 - DNA, 30 bp, Artificial Sequence
  Description of Artificial Sequence: Synthetic oligonucleotide
gccaaactgcaggatgaaagaacagtgcgg

SEQ ID NO: 122722 - DNA, 32 bp, Artificial Sequence
  Description of Artificial Sequence: Synthetic oligonucleotide
ccaaactgcaggatgaaagaacagtgcggaag

SEQ ID NO: 122723 - DNA, 34 bp, Artificial Sequence
  Description of Artificial Sequence: Synthetic oligonucleotide
caaactgcaggatgaaagaacagtgcggaagatc

SEQ ID NO: 122724 - DNA, 35 bp, Artificial Sequence
  Description of Artificial Sequence: Synthetic oligonucleotide
aaactgcaggatgaaagaacagtgcggaagatctg

SEQ ID NO: 122725 - DNA, 34 bp, Artificial Sequence
  Description of Artificial Sequence: Synthetic oligonucleotide
aactgcaggatgaaagaacagtgcggaagatctg

SEQ ID NO: 122726 - DNA, 33 bp, Artificial Sequence
  Description of Artificial Sequence: Synthetic oligonucleotide
actgcaggatgaaagaacagtgcggaagatctg

SEQ ID NO: 122727 - DNA, 32 bp, Artificial Sequence
  Description of Artificial Sequence: Synthetic oligonucleotide
ctgcaggatgaaagaacagtgcggaagatctg

SEQ ID NO: 122728 - DNA, 33 bp, Artificial Sequence
  Description of Artificial Sequence: Synthetic oligonucleotide
tgcaggatgaaagaacagtgcggaagatctgtg

SEQ ID NO: 122729 - DNA, 32 bp, Artificial Sequence
  Description of Artificial Sequence: Synthetic oligonucleotide
gcaggatgaaagaacagtgcggaagatctgtg

SEQ ID NO: 122730 - DNA, 32 bp, Artificial Sequence
  Description of Artificial Sequence: Synthetic oligonucleotide
caggatgaaagaacagtgcggaagatctgtgc

SEQ ID NO: 122731 - DNA, 35 bp, Artificial Sequence
  Description of Artificial Sequence: Synthetic oligonucleotide
aggatgaaagaacagtgcggaagatctgtgctttg

SEQ ID NO: 122732 - DNA, 34 bp, Artificial Sequence
  Description of Artificial Sequence: Synthetic oligonucleotide
ggatgaaagaacagtgcggaagatctgtgctttg

SEQ ID NO: 122733 - DNA, 34 bp, Artificial Sequence
  Description of Artificial Sequence: Synthetic oligonucleotide
gatgaaagaacagtgcggaagatctgtgctttgg

SEQ ID NO: 122734 - DNA, 36 bp, Artificial Sequence
  Description of Artificial Sequence: Synthetic oligonucleotide
atgaaagaacagtgcggaagatctgtgctttggatg

SEQ ID NO: 122735 - DNA, 35 bp, Artificial Sequence
  Description of Artificial Sequence: Synthetic oligonucleotide
tgaaagaacagtgcggaagatctgtgctttggatg

SEQ ID NO: 122736 - DNA, 34 bp, Artificial Sequence
  Description of Artificial Sequence: Synthetic oligonucleotide
gaaagaacagtgcggaagatctgtgctttggatg

SEQ ID NO: 122737 - DNA, 35 bp, Artificial Sequence
  Description of Artificial Sequence: Synthetic oligonucleotide
aaagaacagtgcggaagatctgtgctttggatgac

SEQ ID NO: 122738 - DNA, 34 bp, Artificial Sequence
  Description of Artificial Sequence: Synthetic oligonucleotide
aagaacagtgcggaagatctgtgctttggatgac

SEQ ID NO: 122739 - DNA, 33 bp, Artificial Sequence
  Description of Artificial Sequence: Synthetic oligonucleotide
agaacagtgcggaagatctgtgctttggatgac

SEQ ID NO: 122740 - DNA, 32 bp, Artificial Sequence
  Description of Artificial Sequence: Synthetic oligonucleotide
gaacagtgcggaagatctgtgctttggatgac

SEQ ID NO: 122741 - DNA, 34 bp, Artificial Sequence
  Description of Artificial Sequence: Synthetic oligonucleotide
aacagtgcggaagatctgtgctttggatgacaac

SEQ ID NO: 122742 - DNA, 33 bp, Artificial Sequence
  Description of Artificial Sequence: Synthetic oligonucleotide
acagtgcggaagatctgtgctttggatgacaac

SEQ ID NO: 122743 - DNA, 32 bp, Artificial Sequence
  Description of Artificial Sequence: Synthetic oligonucleotide
cagtgcggaagatctgtgctttggatgacaac

SEQ ID NO: 122744 - DNA, 32 bp, Artificial Sequence
  Description of Artificial Sequence: Synthetic oligonucleotide
agtgcggaagatctgtgctttggatgacaacg

SEQ ID NO: 122745 - DNA, 31 bp, Artificial Sequence
  Description of Artificial Sequence: Synthetic oligonucleotide
gtgcggaagatctgtgctttggatgacaacg

SEQ ID NO: 122746 - DNA, 32 bp, Artificial Sequence
  Description of Artificial Sequence: Synthetic oligonucleotide
tgcggaagatctgtgctttggatgacaacgtc

SEQ ID NO: 122747 - DNA, 31 bp, Artificial Sequence
  Description of Artificial Sequence: Synthetic oligonucleotide
gcggaagatctgtgctttggatgacaacgtc

SEQ ID NO: 122748 - DNA, 32 bp, Artificial Sequence
  Description of Artificial Sequence: Synthetic oligonucleotide
cggaagatctgtgctttggatgacaacgtctg

SEQ ID NO: 122749 - DNA, 32 bp, Artificial Sequence
  Description of Artificial Sequence: Synthetic oligonucleotide
ggaagatctgtgctttggatgacaacgtctgc

SEQ ID NO: 122750 - DNA, 34 bp, Artificial Sequence
  Description of Artificial Sequence: Synthetic oligonucleotide
gaagatctgtgctttggatgacaacgtctgcatg

SEQ ID NO: 122751 - DNA, 34 bp, Artificial Sequence
  Description of Artificial Sequence: Synthetic oligonucleotide
aagatctgtgctttggatgacaacgtctgcatgg

SEQ ID NO: 122752 - DNA, 33 bp, Artificial Sequence
  Description of Artificial Sequence: Synthetic oligonucleotide
agatctgtgctttggatgacaacgtctgcatgg

SEQ ID NO: 122753 - DNA, 32 bp, Artificial Sequence
  Description of Artificial Sequence: Synthetic oligonucleotide
gatctgtgctttggatgacaacgtctgcatgg

SEQ ID NO: 122754 - DNA, 32 bp, Artificial Sequence
  Description of Artificial Sequence: Synthetic oligonucleotide
atctgtgctttggatgacaacgtctgcatggc

SEQ ID NO: 122755 - DNA, 31 bp, Artificial Sequence
  Description of Artificial Sequence: Synthetic oligonucleotide
tctgtgctttggatgacaacgtctgcatggc

SEQ ID NO: 122756 - DNA, 30 bp, Artificial Sequence
  Description of Artificial Sequence: Synthetic oligonucleotide
ctgtgctttggatgacaacgtctgcatggc

SEQ ID NO: 122757 - DNA, 30 bp, Artificial Sequence
  Description of Artificial Sequence: Synthetic oligonucleotide
tgtgctttggatgacaacgtctgcatggcc

SEQ ID NO: 122758 - DNA, 29 bp, Artificial Sequence
  Description of Artificial Sequence: Synthetic oligonucleotide
gtgctttggatgacaacgtctgcatggcc

SEQ ID NO: 122759 - DNA, 32 bp, Artificial Sequence
  Description of Artificial Sequence: Synthetic oligonucleotide
tgctttggatgacaacgtctgcatggcctttg

SEQ ID NO: 122760 - DNA, 31 bp, Artificial Sequence
  Description of Artificial Sequence: Synthetic oligonucleotide
gctttggatgacaacgtctgcatggcctttg

SEQ ID NO: 122761 - DNA, 31 bp, Artificial Sequence
  Description of Artificial Sequence: Synthetic oligonucleotide
ctttggatgacaacgtctgcatggcctttgc

SEQ ID NO: 122762 - DNA, 32 bp, Artificial Sequence
  Description of Artificial Sequence: Synthetic oligonucleotide
tttggatgacaacgtctgcatggcctttgcag

SEQ ID NO: 122763 - DNA, 31 bp, Artificial Sequence
  Description of Artificial Sequence: Synthetic oligonucleotide
ttggatgacaacgtctgcatggcctttgcag

SEQ ID NO: 122764 - DNA, 30 bp, Artificial Sequence
  Description of Artificial Sequence: Synthetic oligonucleotide
tggatgacaacgtctgcatggcctttgcag

SEQ ID NO: 122765 - DNA, 29 bp, Artificial Sequence
  Description of Artificial Sequence: Synthetic oligonucleotide
ggatgacaacgtctgcatggcctttgcag

SEQ ID NO: 122766 - DNA, 29 bp, Artificial Sequence
  Description of Artificial Sequence: Synthetic oligonucleotide
gatgacaacgtctgcatggcctttgcagg

SEQ ID NO: 122767 - DNA, 29 bp, Artificial Sequence
  Description of Artificial Sequence: Synthetic oligonucleotide
atgacaacgtctgcatggcctttgcaggc

SEQ ID NO: 122768 - DNA, 28 bp, Artificial Sequence
  Description of Artificial Sequence: Synthetic oligonucleotide
tgacaacgtctgcatggcctttgcaggc

SEQ ID NO: 122769 - DNA, 27 bp, Artificial Sequence
  Description of Artificial Sequence: Synthetic oligonucleotide
gacaacgtctgcatggcctttgcaggc

SEQ ID NO: 122770 - DNA, 27 bp, Artificial Sequence
  Description of Artificial Sequence: Synthetic oligonucleotide
acaacgtctgcatggcctttgcaggcc

SEQ ID NO: 122771 - DNA, 27 bp, Artificial Sequence
  Description of Artificial Sequence: Synthetic oligonucleotide
caacgtctgcatggcctttgcaggcct

SEQ ID NO: 122772 - DNA, 27 bp, Artificial Sequence
  Description of Artificial Sequence: Synthetic oligonucleotide
aacgtctgcatggcctttgcaggcctc

SEQ ID NO: 122773 - DNA, 27 bp, Artificial Sequence
  Description of Artificial Sequence: Synthetic oligonucleotide
acgtctgcatggcctttgcaggcctca

SEQ ID NO: 122774 - DNA, 26 bp, Artificial Sequence
  Description of Artificial Sequence: Synthetic oligonucleotide
cgtctgcatggcctttgcaggcctca

SEQ ID NO: 122775 - DNA, 26 bp, Artificial Sequence
  Description of Artificial Sequence: Synthetic oligonucleotide
gtctgcatggcctttgcaggcctcac

SEQ ID NO: 122776 - DNA, 26 bp, Artificial Sequence
  Description of Artificial Sequence: Synthetic oligonucleotide
tctgcatggcctttgcaggcctcacc

SEQ ID NO: 122777 - DNA, 25 bp, Artificial Sequence
  Description of Artificial Sequence: Synthetic oligonucleotide
ctgcatggcctttgcaggcctcacc

SEQ ID NO: 122778 - DNA, 25 bp, Artificial Sequence
  Description of Artificial Sequence: Synthetic oligonucleotide
tgcatggcctttgcaggcctcaccg

SEQ ID NO: 122779 - DNA, 24 bp, Artificial Sequence
  Description of Artificial Sequence: Synthetic oligonucleotide
gcatggcctttgcaggcctcaccg

SEQ ID NO: 122780 - DNA, 24 bp, Artificial Sequence
  Description of Artificial Sequence: Synthetic oligonucleotide
catggcctttgcaggcctcaccgc

SEQ ID NO: 122781 - DNA, 24 bp, Artificial Sequence
  Description of Artificial Sequence: Synthetic oligonucleotide
atggcctttgcaggcctcaccgcc

SEQ ID NO: 122782 - DNA, 23 bp, Artificial Sequence
  Description of Artificial Sequence: Synthetic oligonucleotide
tggcctttgcaggcctcaccgcc

SEQ ID NO: 122783 - DNA, 22 bp, Artificial Sequence
  Description of Artificial Sequence: Synthetic oligonucleotide
ggcctttgcaggcctcaccgcc

SEQ ID NO: 122784 - DNA, 24 bp, Artificial Sequence
  Description of Artificial Sequence: Synthetic oligonucleotide
gcctttgcaggcctcaccgccgat

SEQ ID NO: 122785 - DNA, 24 bp, Artificial Sequence
  Description of Artificial Sequence: Synthetic oligonucleotide
cctttgcaggcctcaccgccgatg

SEQ ID NO: 122786 - DNA, 26 bp, Artificial Sequence
  Description of Artificial Sequence: Synthetic oligonucleotide
ctttgcaggcctcaccgccgatgcaa

SEQ ID NO: 122787 - DNA, 26 bp, Artificial Sequence
  Description of Artificial Sequence: Synthetic oligonucleotide
tttgcaggcctcaccgccgatgcaag

SEQ ID NO: 122788 - DNA, 25 bp, Artificial Sequence
  Description of Artificial Sequence: Synthetic oligonucleotide
ttgcaggcctcaccgccgatgcaag

SEQ ID NO: 122789 - DNA, 24 bp, Artificial Sequence
  Description of Artificial Sequence: Synthetic oligonucleotide
tgcaggcctcaccgccgatgcaag

SEQ ID NO: 122790 - DNA, 23 bp, Artificial Sequence
  Description of Artificial Sequence: Synthetic oligonucleotide
gcaggcctcaccgccgatgcaag

SEQ ID NO: 122791 - DNA, 26 bp, Artificial Sequence
  Description of Artificial Sequence: Synthetic oligonucleotide
caggcctcaccgccgatgcaaggata

SEQ ID NO: 122792 - DNA, 27 bp, Artificial Sequence
  Description of Artificial Sequence: Synthetic oligonucleotide
aggcctcaccgccgatgcaaggatagt

SEQ ID NO: 122793 - DNA, 26 bp, Artificial Sequence
  Description of Artificial Sequence: Synthetic oligonucleotide
ggcctcaccgccgatgcaaggatagt

SEQ ID NO: 122794 - DNA, 27 bp, Artificial Sequence
  Description of Artificial Sequence: Synthetic oligonucleotide
gcctcaccgccgatgcaaggatagtca

SEQ ID NO: 122795 - DNA, 28 bp, Artificial Sequence
  Description of Artificial Sequence: Synthetic oligonucleotide
cctcaccgccgatgcaaggatagtcatc

SEQ ID NO: 122796 - DNA, 30 bp, Artificial Sequence
  Description of Artificial Sequence: Synthetic oligonucleotide
ctcaccgccgatgcaaggatagtcatcaac

SEQ ID NO: 122797 - DNA, 31 bp, Artificial Sequence
  Description of Artificial Sequence: Synthetic oligonucleotide
tcaccgccgatgcaaggatagtcatcaacag

SEQ ID NO: 122798 - DNA, 30 bp, Artificial Sequence
  Description of Artificial Sequence: Synthetic oligonucleotide
caccgccgatgcaaggatagtcatcaacag

SEQ ID NO: 122799 - DNA, 30 bp, Artificial Sequence
  Description of Artificial Sequence: Synthetic oligonucleotide
accgccgatgcaaggatagtcatcaacagg

SEQ ID NO: 122800 - DNA, 29 bp, Artificial Sequence
  Description of Artificial Sequence: Synthetic oligonucleotide
ccgccgatgcaaggatagtcatcaacagg

SEQ ID NO: 122801 - DNA, 29 bp, Artificial Sequence
  Description of Artificial Sequence: Synthetic oligonucleotide
cgccgatgcaaggatagtcatcaacaggg

SEQ ID NO: 122802 - DNA, 29 bp, Artificial Sequence
  Description of Artificial Sequence: Synthetic oligonucleotide
gccgatgcaaggatagtcatcaacagggc

SEQ ID NO: 122803 - DNA, 29 bp, Artificial Sequence
  Description of Artificial Sequence: Synthetic oligonucleotide
ccgatgcaaggatagtcatcaacagggcc

SEQ ID NO: 122804 - DNA, 29 bp, Artificial Sequence
  Description of Artificial Sequence: Synthetic oligonucleotide
cgatgcaaggatagtcatcaacagggccc

SEQ ID NO: 122805 - DNA, 29 bp, Artificial Sequence
  Description of Artificial Sequence: Synthetic oligonucleotide
gatgcaaggatagtcatcaacagggcccg

SEQ ID NO: 122806 - DNA, 29 bp, Artificial Sequence
  Description of Artificial Sequence: Synthetic oligonucleotide
atgcaaggatagtcatcaacagggcccgg

SEQ ID NO: 122807 - DNA, 28 bp, Artificial Sequence
  Description of Artificial Sequence: Synthetic oligonucleotide
tgcaaggatagtcatcaacagggcccgg

SEQ ID NO: 122808 - DNA, 27 bp, Artificial Sequence
  Description of Artificial Sequence: Synthetic oligonucleotide
gcaaggatagtcatcaacagggcccgg

SEQ ID NO: 122809 - DNA, 27 bp, Artificial Sequence
  Description of Artificial Sequence: Synthetic oligonucleotide
caaggatagtcatcaacagggcccggg

SEQ ID NO: 122810 - DNA, 28 bp, Artificial Sequence
  Description of Artificial Sequence: Synthetic oligonucleotide
aaggatagtcatcaacagggcccgggtg

SEQ ID NO: 122811 - DNA, 27 bp, Artificial Sequence
  Description of Artificial Sequence: Synthetic oligonucleotide
aggatagtcatcaacagggcccgggtg

SEQ ID NO: 122812 - DNA, 26 bp, Artificial Sequence
  Description of Artificial Sequence: Synthetic oligonucleotide
ggatagtcatcaacagggcccgggtg

SEQ ID NO: 122813 - DNA, 27 bp, Artificial Sequence
  Description of Artificial Sequence: Synthetic oligonucleotide
gatagtcatcaacagggcccgggtgga

SEQ ID NO: 122814 - DNA, 27 bp, Artificial Sequence
  Description of Artificial Sequence: Synthetic oligonucleotide
atagtcatcaacagggcccgggtggag

SEQ ID NO: 122815 - DNA, 27 bp, Artificial Sequence
  Description of Artificial Sequence: Synthetic oligonucleotide
tagtcatcaacagggcccgggtggagt

SEQ ID NO: 122816 - DNA, 26 bp, Artificial Sequence
  Description of Artificial Sequence: Synthetic oligonucleotide
agtcatcaacagggcccgggtggagt

SEQ ID NO: 122817 - DNA, 25 bp, Artificial Sequence
  Description of Artificial Sequence: Synthetic oligonucleotide
gtcatcaacagggcccgggtggagt

SEQ ID NO: 122818 - DNA, 25 bp, Artificial Sequence
  Description of Artificial Sequence: Synthetic oligonucleotide
tcatcaacagggcccgggtggagtg

SEQ ID NO: 122819 - DNA, 24 bp, Artificial Sequence
  Description of Artificial Sequence: Synthetic oligonucleotide
catcaacagggcccgggtggagtg

SEQ ID NO: 122820 - DNA, 24 bp, Artificial Sequence
  Description of Artificial Sequence: Synthetic oligonucleotide
atcaacagggcccgggtggagtgc

SEQ ID NO: 122821 - DNA, 23 bp, Artificial Sequence
  Description of Artificial Sequence: Synthetic oligonucleotide
tcaacagggcccgggtggagtgc

SEQ ID NO: 122822 - DNA, 22 bp, Artificial Sequence
  Description of Artificial Sequence: Synthetic oligonucleotide
caacagggcccgggtggagtgc

SEQ ID NO: 122823 - DNA, 23 bp, Artificial Sequence
  Description of Artificial Sequence: Synthetic oligonucleotide
aacagggcccgggtggagtgcca

SEQ ID NO: 122824 - DNA, 22 bp, Artificial Sequence
  Description of Artificial Sequence: Synthetic oligonucleotide
acagggcccgggtggagtgcca

SEQ ID NO: 122825 - DNA, 21 bp, Artificial Sequence
  Description of Artificial Sequence: Synthetic oligonucleotide
cagggcccgggtggagtgcca

SEQ ID NO: 122826 - DNA, 22 bp, Artificial Sequence
  Description of Artificial Sequence: Synthetic oligonucleotide
agggcccgggtggagtgccaga

SEQ ID NO: 122827 - DNA, 21 bp, Artificial Sequence
  Description of Artificial Sequence: Synthetic oligonucleotide
gggcccgggtggagtgccaga

SEQ ID NO: 122828 - DNA, 21 bp, Artificial Sequence
  Description of Artificial Sequence: Synthetic oligonucleotide
ggcccgggtggagtgccagag

SEQ ID NO: 122829 - DNA, 21 bp, Artificial Sequence
  Description of Artificial Sequence: Synthetic oligonucleotide
gcccgggtggagtgccagagc

SEQ ID NO: 122830 - DNA, 22 bp, Artificial Sequence
  Description of Artificial Sequence: Synthetic oligonucleotide
cccgggtggagtgccagagcca

SEQ ID NO: 122831 - DNA, 22 bp, Artificial Sequence
  Description of Artificial Sequence: Synthetic oligonucleotide
ccgggtggagtgccagagccac

SEQ ID NO: 122832 - DNA, 22 bp, Artificial Sequence
  Description of Artificial Sequence: Synthetic oligonucleotide
cgggtggagtgccagagccacc

SEQ ID NO: 122833 - DNA, 22 bp, Artificial Sequence
  Description of Artificial Sequence: Synthetic oligonucleotide
gggtggagtgccagagccaccg

SEQ ID NO: 122834 - DNA, 22 bp, Artificial Sequence
  Description of Artificial Sequence: Synthetic oligonucleotide
ggtggagtgccagagccaccgg

SEQ ID NO: 122835 - DNA, 23 bp, Artificial Sequence
  Description of Artificial Sequence: Synthetic oligonucleotide
gtggagtgccagagccaccggct

SEQ ID NO: 122836 - DNA, 24 bp, Artificial Sequence
  Description of Artificial Sequence: Synthetic oligonucleotide
tggagtgccagagccaccggctga

SEQ ID NO: 122837 - DNA, 23 bp, Artificial Sequence
  Description of Artificial Sequence: Synthetic oligonucleotide
ggagtgccagagccaccggctga

SEQ ID NO: 122838 - DNA, 24 bp, Artificial Sequence
  Description of Artificial Sequence: Synthetic oligonucleotide
gagtgccagagccaccggctgact

SEQ ID NO: 122839 - DNA, 25 bp, Artificial Sequence
  Description of Artificial Sequence: Synthetic oligonucleotide
agtgccagagccaccggctgactgt

SEQ ID NO: 122840 - DNA, 24 bp, Artificial Sequence
  Description of Artificial Sequence: Synthetic oligonucleotide
gtgccagagccaccggctgactgt

SEQ ID NO: 122841 - DNA, 24 bp, Artificial Sequence
  Description of Artificial Sequence: Synthetic oligonucleotide
tgccagagccaccggctgactgtg

SEQ ID NO: 122842 - DNA, 23 bp, Artificial Sequence
  Description of Artificial Sequence: Synthetic oligonucleotide
gccagagccaccggctgactgtg

SEQ ID NO: 122843 - DNA, 24 bp, Artificial Sequence
  Description of Artificial Sequence: Synthetic oligonucleotide
ccagagccaccggctgactgtgga

SEQ ID NO: 122844 - DNA, 24 bp, Artificial Sequence
  Description of Artificial Sequence: Synthetic oligonucleotide
cagagccaccggctgactgtggag

SEQ ID NO: 122845 - DNA, 25 bp, Artificial Sequence
  Description of Artificial Sequence: Synthetic oligonucleotide
agagccaccggctgactgtggagga

SEQ ID NO: 122846 - DNA, 24 bp, Artificial Sequence
  Description of Artificial Sequence: Synthetic oligonucleotide
gagccaccggctgactgtggagga

SEQ ID NO: 122847 - DNA, 24 bp, Artificial Sequence
  Description of Artificial Sequence: Synthetic oligonucleotide
agccaccggctgactgtggaggac

SEQ ID NO: 122848 - DNA, 23 bp, Artificial Sequence
  Description of Artificial Sequence: Synthetic oligonucleotide
gccaccggctgactgtggaggac

SEQ ID NO: 122849 - DNA, 23 bp, Artificial Sequence
  Description of Artificial Sequence: Synthetic oligonucleotide
ccaccggctgactgtggaggacc

SEQ ID NO: 122850 - DNA, 23 bp, Artificial Sequence
  Description of Artificial Sequence: Synthetic oligonucleotide
caccggctgactgtggaggaccc

SEQ ID NO: 122851 - DNA, 23 bp, Artificial Sequence
  Description of Artificial Sequence: Synthetic oligonucleotide
accggctgactgtggaggacccg

SEQ ID NO: 122852 - DNA, 22 bp, Artificial Sequence
  Description of Artificial Sequence: Synthetic oligonucleotide
ccggctgactgtggaggacccg

SEQ ID NO: 122853 - DNA, 23 bp, Artificial Sequence
  Description of Artificial Sequence: Synthetic oligonucleotide
cggctgactgtggaggacccggt

SEQ ID NO: 122854 - DNA, 24 bp, Artificial Sequence
  Description of Artificial Sequence: Synthetic oligonucleotide
ggctgactgtggaggacccggtca

SEQ ID NO: 122855 - DNA, 25 bp, Artificial Sequence
  Description of Artificial Sequence: Synthetic oligonucleotide
gctgactgtggaggacccggtcact

SEQ ID NO: 122856 - DNA, 26 bp, Artificial Sequence
  Description of Artificial Sequence: Synthetic oligonucleotide
ctgactgtggaggacccggtcactgt

SEQ ID NO: 122857 - DNA, 26 bp, Artificial Sequence
  Description of Artificial Sequence: Synthetic oligonucleotide
tgactgtggaggacccggtcactgtg

SEQ ID NO: 122858 - DNA, 25 bp, Artificial Sequence
  Description of Artificial Sequence: Synthetic oligonucleotide
gactgtggaggacccggtcactgtg

SEQ ID NO: 122859 - DNA, 26 bp, Artificial Sequence
  Description of Artificial Sequence: Synthetic oligonucleotide
actgtggaggacccggtcactgtgga

SEQ ID NO: 122860 - DNA, 25 bp, Artificial Sequence
  Description of Artificial Sequence: Synthetic oligonucleotide
ctgtggaggacccggtcactgtgga

SEQ ID NO: 122861 - DNA, 27 bp, Artificial Sequence
  Description of Artificial Sequence: Synthetic oligonucleotide
tgtggaggacccggtcactgtggagta

SEQ ID NO: 122862 - DNA, 26 bp, Artificial Sequence
  Description of Artificial Sequence: Synthetic oligonucleotide
gtggaggacccggtcactgtggagta

SEQ ID NO: 122863 - DNA, 27 bp, Artificial Sequence
  Description of Artificial Sequence: Synthetic oligonucleotide
tggaggacccggtcactgtggagtaca

SEQ ID NO: 122864 - DNA, 27 bp, Artificial Sequence
  Description of Artificial Sequence: Synthetic oligonucleotide
ggaggacccggtcactgtggagtacat

SEQ ID NO: 122865 - DNA, 27 bp, Artificial Sequence
  Description of Artificial Sequence: Synthetic oligonucleotide
gaggacccggtcactgtggagtacatc

SEQ ID NO: 122866 - DNA, 28 bp, Artificial Sequence
  Description of Artificial Sequence: Synthetic oligonucleotide
aggacccggtcactgtggagtacatcac

SEQ ID NO: 122867 - DNA, 27 bp, Artificial Sequence
  Description of Artificial Sequence: Synthetic oligonucleotide
ggacccggtcactgtggagtacatcac

SEQ ID NO: 122868 - DNA, 27 bp, Artificial Sequence
  Description of Artificial Sequence: Synthetic oligonucleotide
gacccggtcactgtggagtacatcacc

SEQ ID NO: 122869 - DNA, 27 bp, Artificial Sequence
  Description of Artificial Sequence: Synthetic oligonucleotide
acccggtcactgtggagtacatcaccc

SEQ ID NO: 122870 - DNA, 26 bp, Artificial Sequence
  Description of Artificial Sequence: Synthetic oligonucleotide
cccggtcactgtggagtacatcaccc

SEQ ID NO: 122871 - DNA, 26 bp, Artificial Sequence
  Description of Artificial Sequence: Synthetic oligonucleotide
ccggtcactgtggagtacatcacccg

SEQ ID NO: 122872 - DNA, 27 bp, Artificial Sequence
  Description of Artificial Sequence: Synthetic oligonucleotide
cggtcactgtggagtacatcacccgct

SEQ ID NO: 122873 - DNA, 28 bp, Artificial Sequence
  Description of Artificial Sequence: Synthetic oligonucleotide
ggtcactgtggagtacatcacccgctac

SEQ ID NO: 122874 - DNA, 30 bp, Artificial Sequence
  Description of Artificial Sequence: Synthetic oligonucleotide
gtcactgtggagtacatcacccgctacatc

SEQ ID NO: 122875 - DNA, 30 bp, Artificial Sequence
  Description of Artificial Sequence: Synthetic oligonucleotide
tcactgtggagtacatcacccgctacatcg

SEQ ID NO: 122876 - DNA, 29 bp, Artificial Sequence
  Description of Artificial Sequence: Synthetic oligonucleotide
cactgtggagtacatcacccgctacatcg

SEQ ID NO: 122877 - DNA, 29 bp, Artificial Sequence
  Description of Artificial Sequence: Synthetic oligonucleotide
actgtggagtacatcacccgctacatcgc

SEQ ID NO: 122878 - DNA, 28 bp, Artificial Sequence
  Description of Artificial Sequence: Synthetic oligonucleotide
ctgtggagtacatcacccgctacatcgc

SEQ ID NO: 122879 - DNA, 28 bp, Artificial Sequence
  Description of Artificial Sequence: Synthetic oligonucleotide
tgtggagtacatcacccgctacatcgcc

SEQ ID NO: 122880 - DNA, 27 bp, Artificial Sequence
  Description of Artificial Sequence: Synthetic oligonucleotide
gtggagtacatcacccgctacatcgcc

SEQ ID NO: 122881 - DNA, 28 bp, Artificial Sequence
  Description of Artificial Sequence: Synthetic oligonucleotide
tggagtacatcacccgctacatcgccag

SEQ ID NO: 122882 - DNA, 27 bp, Artificial Sequence
  Description of Artificial Sequence: Synthetic oligonucleotide
ggagtacatcacccgctacatcgccag

SEQ ID NO: 122883 - DNA, 28 bp, Artificial Sequence
  Description of Artificial Sequence: Synthetic oligonucleotide
gagtacatcacccgctacatcgccagtc

SEQ ID NO: 122884 - DNA, 29 bp, Artificial Sequence
  Description of Artificial Sequence: Synthetic oligonucleotide
agtacatcacccgctacatcgccagtctg

SEQ ID NO: 122885 - DNA, 28 bp, Artificial Sequence
  Description of Artificial Sequence: Synthetic oligonucleotide
gtacatcacccgctacatcgccagtctg

SEQ ID NO: 122886 - DNA, 30 bp, Artificial Sequence
  Description of Artificial Sequence: Synthetic oligonucleotide
tacatcacccgctacatcgccagtctgaag

SEQ ID NO: 122887 - DNA, 29 bp, Artificial Sequence
  Description of Artificial Sequence: Synthetic oligonucleotide
acatcacccgctacatcgccagtctgaag

SEQ ID NO: 122888 - DNA, 28 bp, Artificial Sequence
  Description of Artificial Sequence: Synthetic oligonucleotide
catcacccgctacatcgccagtctgaag

SEQ ID NO: 122889 - DNA, 28 bp, Artificial Sequence
  Description of Artificial Sequence: Synthetic oligonucleotide
atcacccgctacatcgccagtctgaagc

SEQ ID NO: 122890 - DNA, 27 bp, Artificial Sequence
  Description of Artificial Sequence: Synthetic oligonucleotide
tcacccgctacatcgccagtctgaagc

SEQ ID NO: 122891 - DNA, 27 bp, Artificial Sequence
  Description of Artificial Sequence: Synthetic oligonucleotide
cacccgctacatcgccagtctgaagca

SEQ ID NO: 122892 - DNA, 27 bp, Artificial Sequence
  Description of Artificial Sequence: Synthetic oligonucleotide
acccgctacatcgccagtctgaagcag

SEQ ID NO: 122893 - DNA, 26 bp, Artificial Sequence
  Description of Artificial Sequence: Synthetic oligonucleotide
cccgctacatcgccagtctgaagcag

SEQ ID NO: 122894 - DNA, 26 bp, Artificial Sequence
  Description of Artificial Sequence: Synthetic oligonucleotide
ccgctacatcgccagtctgaagcagc

SEQ ID NO: 122895 - DNA, 27 bp, Artificial Sequence
  Description of Artificial Sequence: Synthetic oligonucleotide
cgctacatcgccagtctgaagcagcgt

SEQ ID NO: 122896 - DNA, 31 bp, Artificial Sequence
  Description of Artificial Sequence: Synthetic oligonucleotide
gctacatcgccagtctgaagcagcgttatac

SEQ ID NO: 122897 - DNA, 31 bp, Artificial Sequence
  Description of Artificial Sequence: Synthetic oligonucleotide
ctacatcgccagtctgaagcagcgttatacg

SEQ ID NO: 122898 - DNA, 31 bp, Artificial Sequence
  Description of Artificial Sequence: Synthetic oligonucleotide
tacatcgccagtctgaagcagcgttatacgc

SEQ ID NO: 122899 - DNA, 30 bp, Artificial Sequence
  Description of Artificial Sequence: Synthetic oligonucleotide
acatcgccagtctgaagcagcgttatacgc

SEQ ID NO: 122900 - DNA, 29 bp, Artificial Sequence
  Description of Artificial Sequence: Synthetic oligonucleotide
catcgccagtctgaagcagcgttatacgc

SEQ ID NO: 122901 - DNA, 30 bp, Artificial Sequence
  Description of Artificial Sequence: Synthetic oligonucleotide
atcgccagtctgaagcagcgttatacgcag

SEQ ID NO: 122902 - DNA, 29 bp, Artificial Sequence
  Description of Artificial Sequence: Synthetic oligonucleotide
tcgccagtctgaagcagcgttatacgcag

SEQ ID NO: 122903 - DNA, 28 bp, Artificial Sequence
  Description of Artificial Sequence: Synthetic oligonucleotide
cgccagtctgaagcagcgttatacgcag

SEQ ID NO: 122904 - DNA, 29 bp, Artificial Sequence
  Description of Artificial Sequence: Synthetic oligonucleotide
gccagtctgaagcagcgttatacgcagag

SEQ ID NO: 122905 - DNA, 29 bp, Artificial Sequence
  Description of Artificial Sequence: Synthetic oligonucleotide
ccagtctgaagcagcgttatacgcagagc

SEQ ID NO: 122906 - DNA, 32 bp, Artificial Sequence
  Description of Artificial Sequence: Synthetic oligonucleotide
cagtctgaagcagcgttatacgcagagcaatg

SEQ ID NO: 122907 - DNA, 32 bp, Artificial Sequence
  Description of Artificial Sequence: Synthetic oligonucleotide
agtctgaagcagcgttatacgcagagcaatgg

SEQ ID NO: 122908 - DNA, 31 bp, Artificial Sequence
  Description of Artificial Sequence: Synthetic oligonucleotide
gtctgaagcagcgttatacgcagagcaatgg

SEQ ID NO: 122909 - DNA, 31 bp, Artificial Sequence
  Description of Artificial Sequence: Synthetic oligonucleotide
tctgaagcagcgttatacgcagagcaatggg

SEQ ID NO: 122910 - DNA, 30 bp, Artificial Sequence
  Description of Artificial Sequence: Synthetic oligonucleotide
ctgaagcagcgttatacgcagagcaatggg

SEQ ID NO: 122911 - DNA, 30 bp, Artificial Sequence
  Description of Artificial Sequence: Synthetic oligonucleotide
tgaagcagcgttatacgcagagcaatgggc

SEQ ID NO: 122912 - DNA, 29 bp, Artificial Sequence
  Description of Artificial Sequence: Synthetic oligonucleotide
gaagcagcgttatacgcagagcaatgggc

SEQ ID NO: 122913 - DNA, 29 bp, Artificial Sequence
  Description of Artificial Sequence: Synthetic oligonucleotide
aagcagcgttatacgcagagcaatgggcg

SEQ ID NO: 122914 - DNA, 28 bp, Artificial Sequence
  Description of Artificial Sequence: Synthetic oligonucleotide
agcagcgttatacgcagagcaatgggcg

SEQ ID NO: 122915 - DNA, 27 bp, Artificial Sequence
  Description of Artificial Sequence: Synthetic oligonucleotide
gcagcgttatacgcagagcaatgggcg

SEQ ID NO: 122916 - DNA, 27 bp, Artificial Sequence
  Description of Artificial Sequence: Synthetic oligonucleotide
cagcgttatacgcagagcaatgggcgc

SEQ ID NO: 122917 - DNA, 28 bp, Artificial Sequence
  Description of Artificial Sequence: Synthetic oligonucleotide
agcgttatacgcagagcaatgggcgcag

SEQ ID NO: 122918 - DNA, 27 bp, Artificial Sequence
  Description of Artificial Sequence: Synthetic oligonucleotide
gcgttatacgcagagcaatgggcgcag

SEQ ID NO: 122919 - DNA, 27 bp, Artificial Sequence
  Description of Artificial Sequence: Synthetic oligonucleotide
cgttatacgcagagcaatgggcgcagg

SEQ ID NO: 122920 - DNA, 27 bp, Artificial Sequence
  Description of Artificial Sequence: Synthetic oligonucleotide
gttatacgcagagcaatgggcgcaggc

SEQ ID NO: 122921 - DNA, 27 bp, Artificial Sequence
  Description of Artificial Sequence: Synthetic oligonucleotide
ttatacgcagagcaatgggcgcaggcc

SEQ ID NO: 122922 - DNA, 26 bp, Artificial Sequence
  Description of Artificial Sequence: Synthetic oligonucleotide
tatacgcagagcaatgggcgcaggcc

SEQ ID NO: 122923 - DNA, 25 bp, Artificial Sequence
  Description of Artificial Sequence: Synthetic oligonucleotide
atacgcagagcaatgggcgcaggcc

SEQ ID NO: 122924 - DNA, 24 bp, Artificial Sequence
  Description of Artificial Sequence: Synthetic oligonucleotide
tacgcagagcaatgggcgcaggcc

SEQ ID NO: 122925 - DNA, 23 bp, Artificial Sequence
  Description of Artificial Sequence: Synthetic oligonucleotide
acgcagagcaatgggcgcaggcc

SEQ ID NO: 122926 - DNA, 22 bp, Artificial Sequence
  Description of Artificial Sequence: Synthetic oligonucleotide
cgcagagcaatgggcgcaggcc

SEQ ID NO: 122927 - DNA, 25 bp, Artificial Sequence
  Description of Artificial Sequence: Synthetic oligonucleotide
gcagagcaatgggcgcaggccgttt

SEQ ID NO: 122928 - DNA, 25 bp, Artificial Sequence
  Description of Artificial Sequence: Synthetic oligonucleotide
cagagcaatgggcgcaggccgtttg

SEQ ID NO: 122929 - DNA, 25 bp, Artificial Sequence
  Description of Artificial Sequence: Synthetic oligonucleotide
agagcaatgggcgcaggccgtttgg

SEQ ID NO: 122930 - DNA, 24 bp, Artificial Sequence
  Description of Artificial Sequence: Synthetic oligonucleotide
gagcaatgggcgcaggccgtttgg

SEQ ID NO: 122931 - DNA, 26 bp, Artificial Sequence
  Description of Artificial Sequence: Synthetic oligonucleotide
agcaatgggcgcaggccgtttggcat

SEQ ID NO: 122932 - DNA, 25 bp, Artificial Sequence
  Description of Artificial Sequence: Synthetic oligonucleotide
gcaatgggcgcaggccgtttggcat

SEQ ID NO: 122933 - DNA, 26 bp, Artificial Sequence
  Description of Artificial Sequence: Synthetic oligonucleotide
caatgggcgcaggccgtttggcatct

SEQ ID NO: 122934 - DNA, 27 bp, Artificial Sequence
  Description of Artificial Sequence: Synthetic oligonucleotide
aatgggcgcaggccgtttggcatctct

SEQ ID NO: 122935 - DNA, 26 bp, Artificial Sequence
  Description of Artificial Sequence: Synthetic oligonucleotide
atgggcgcaggccgtttggcatctct

SEQ ID NO: 122936 - DNA, 25 bp, Artificial Sequence
  Description of Artificial Sequence: Synthetic oligonucleotide
tgggcgcaggccgtttggcatctct

SEQ ID NO: 122937 - DNA, 24 bp, Artificial Sequence
  Description of Artificial Sequence: Synthetic oligonucleotide
gggcgcaggccgtttggcatctct

SEQ ID NO: 122938 - DNA, 24 bp, Artificial Sequence
  Description of Artificial Sequence: Synthetic oligonucleotide
ggcgcaggccgtttggcatctctg

SEQ ID NO: 122939 - DNA, 24 bp, Artificial Sequence
  Description of Artificial Sequence: Synthetic oligonucleotide
gcgcaggccgtttggcatctctgc

SEQ ID NO: 122940 - DNA, 24 bp, Artificial Sequence
  Description of Artificial Sequence: Synthetic oligonucleotide
cgcaggccgtttggcatctctgcc

SEQ ID NO: 122941 - DNA, 25 bp, Artificial Sequence
  Description of Artificial Sequence: Synthetic oligonucleotide
gcaggccgtttggcatctctgccct

SEQ ID NO: 122942 - DNA, 27 bp, Artificial Sequence
  Description of Artificial Sequence: Synthetic oligonucleotide
caggccgtttggcatctctgccctcat

SEQ ID NO: 122943 - DNA, 27 bp, Artificial Sequence
  Description of Artificial Sequence: Synthetic oligonucleotide
aggccgtttggcatctctgccctcatc

SEQ ID NO: 122944 - DNA, 26 bp, Artificial Sequence
  Description of Artificial Sequence: Synthetic oligonucleotide
ggccgtttggcatctctgccctcatc

SEQ ID NO: 122945 - DNA, 27 bp, Artificial Sequence
  Description of Artificial Sequence: Synthetic oligonucleotide
gccgtttggcatctctgccctcatcgt

SEQ ID NO: 122946 - DNA, 27 bp, Artificial Sequence
  Description of Artificial Sequence: Synthetic oligonucleotide
ccgtttggcatctctgccctcatcgtg

SEQ ID NO: 122947 - DNA, 27 bp, Artificial Sequence
  Description of Artificial Sequence: Synthetic oligonucleotide
cgtttggcatctctgccctcatcgtgg

SEQ ID NO: 122948 - DNA, 27 bp, Artificial Sequence
  Description of Artificial Sequence: Synthetic oligonucleotide
gtttggcatctctgccctcatcgtggg

SEQ ID NO: 122949 - DNA, 30 bp, Artificial Sequence
  Description of Artificial Sequence: Synthetic oligonucleotide
tttggcatctctgccctcatcgtgggtttc

SEQ ID NO: 122950 - DNA, 29 bp, Artificial Sequence
  Description of Artificial Sequence: Synthetic oligonucleotide
ttggcatctctgccctcatcgtgggtttc

SEQ ID NO: 122951 - DNA, 28 bp, Artificial Sequence
  Description of Artificial Sequence: Synthetic oligonucleotide
tggcatctctgccctcatcgtgggtttc

SEQ ID NO: 122952 - DNA, 27 bp, Artificial Sequence
  Description of Artificial Sequence: Synthetic oligonucleotide
ggcatctctgccctcatcgtgggtttc

SEQ ID NO: 122953 - DNA, 27 bp, Artificial Sequence
  Description of Artificial Sequence: Synthetic oligonucleotide
gcatctctgccctcatcgtgggtttcg

SEQ ID NO: 122954 - DNA, 28 bp, Artificial Sequence
  Description of Artificial Sequence: Synthetic oligonucleotide
catctctgccctcatcgtgggtttcgac

SEQ ID NO: 122955 - DNA, 31 bp, Artificial Sequence
  Description of Artificial Sequence: Synthetic oligonucleotide
atctctgccctcatcgtgggtttcgactttg

SEQ ID NO: 122956 - DNA, 30 bp, Artificial Sequence
  Description of Artificial Sequence: Synthetic oligonucleotide
tctctgccctcatcgtgggtttcgactttg

SEQ ID NO: 122957 - DNA, 29 bp, Artificial Sequence
  Description of Artificial Sequence: Synthetic oligonucleotide
ctctgccctcatcgtgggtttcgactttg

SEQ ID NO: 122958 - DNA, 31 bp, Artificial Sequence
  Description of Artificial Sequence: Synthetic oligonucleotide
tctgccctcatcgtgggtttcgactttgatg

SEQ ID NO: 122959 - DNA, 30 bp, Artificial Sequence
  Description of Artificial Sequence: Synthetic oligonucleotide
ctgccctcatcgtgggtttcgactttgatg

SEQ ID NO: 122960 - DNA, 30 bp, Artificial Sequence
  Description of Artificial Sequence: Synthetic oligonucleotide
tgccctcatcgtgggtttcgactttgatgg

SEQ ID NO: 122961 - DNA, 29 bp, Artificial Sequence
  Description of Artificial Sequence: Synthetic oligonucleotide
gccctcatcgtgggtttcgactttgatgg

SEQ ID NO: 122962 - DNA, 29 bp, Artificial Sequence
  Description of Artificial Sequence: Synthetic oligonucleotide
ccctcatcgtgggtttcgactttgatggc

SEQ ID NO: 122963 - DNA, 30 bp, Artificial Sequence
  Description of Artificial Sequence: Synthetic oligonucleotide
cctcatcgtgggtttcgactttgatggcac

SEQ ID NO: 122964 - DNA, 31 bp, Artificial Sequence
  Description of Artificial Sequence: Synthetic oligonucleotide
ctcatcgtgggtttcgactttgatggcactc

SEQ ID NO: 122965 - DNA, 31 bp, Artificial Sequence
  Description of Artificial Sequence: Synthetic oligonucleotide
tcatcgtgggtttcgactttgatggcactcc

SEQ ID NO: 122966 - DNA, 30 bp, Artificial Sequence
  Description of Artificial Sequence: Synthetic oligonucleotide
catcgtgggtttcgactttgatggcactcc

SEQ ID NO: 122967 - DNA, 32 bp, Artificial Sequence
  Description of Artificial Sequence: Synthetic oligonucleotide
atcgtgggtttcgactttgatggcactcctag

SEQ ID NO: 122968 - DNA, 31 bp, Artificial Sequence
  Description of Artificial Sequence: Synthetic oligonucleotide
tcgtgggtttcgactttgatggcactcctag

SEQ ID NO: 122969 - DNA, 30 bp, Artificial Sequence
  Description of Artificial Sequence: Synthetic oligonucleotide
cgtgggtttcgactttgatggcactcctag

SEQ ID NO: 122970 - DNA, 30 bp, Artificial Sequence
  Description of Artificial Sequence: Synthetic oligonucleotide
gtgggtttcgactttgatggcactcctagg

SEQ ID NO: 122971 - DNA, 30 bp, Artificial Sequence
  Description of Artificial Sequence: Synthetic oligonucleotide
tgggtttcgactttgatggcactcctaggc

SEQ ID NO: 122972 - DNA, 29 bp, Artificial Sequence
  Description of Artificial Sequence: Synthetic oligonucleotide
gggtttcgactttgatggcactcctaggc

SEQ ID NO: 122973 - DNA, 30 bp, Artificial Sequence
  Description of Artificial Sequence: Synthetic oligonucleotide
ggtttcgactttgatggcactcctaggctc

SEQ ID NO: 122974 - DNA, 33 bp, Artificial Sequence
  Description of Artificial Sequence: Synthetic oligonucleotide
gtttcgactttgatggcactcctaggctctatc

SEQ ID NO: 122975 - DNA, 34 bp, Artificial Sequence
  Description of Artificial Sequence: Synthetic oligonucleotide
tttcgactttgatggcactcctaggctctatcag

SEQ ID NO: 122976 - DNA, 33 bp, Artificial Sequence
  Description of Artificial Sequence: Synthetic oligonucleotide
ttcgactttgatggcactcctaggctctatcag

SEQ ID NO: 122977 - DNA, 32 bp, Artificial Sequence
  Description of Artificial Sequence: Synthetic oligonucleotide
tcgactttgatggcactcctaggctctatcag

SEQ ID NO: 122978 - DNA, 31 bp, Artificial Sequence
  Description of Artificial Sequence: Synthetic oligonucleotide
cgactttgatggcactcctaggctctatcag

SEQ ID NO: 122979 - DNA, 32 bp, Artificial Sequence
  Description of Artificial Sequence: Synthetic oligonucleotide
gactttgatggcactcctaggctctatcagac

SEQ ID NO: 122980 - DNA, 33 bp, Artificial Sequence
  Description of Artificial Sequence: Synthetic oligonucleotide
actttgatggcactcctaggctctatcagactg

SEQ ID NO: 122981 - DNA, 32 bp, Artificial Sequence
  Description of Artificial Sequence: Synthetic oligonucleotide
ctttgatggcactcctaggctctatcagactg

SEQ ID NO: 122982 - DNA, 33 bp, Artificial Sequence
  Description of Artificial Sequence: Synthetic oligonucleotide
tttgatggcactcctaggctctatcagactgac

SEQ ID NO: 122983 - DNA, 32 bp, Artificial Sequence
  Description of Artificial Sequence: Synthetic oligonucleotide
ttgatggcactcctaggctctatcagactgac

SEQ ID NO: 122984 - DNA, 31 bp, Artificial Sequence
  Description of Artificial Sequence: Synthetic oligonucleotide
tgatggcactcctaggctctatcagactgac

SEQ ID NO: 122985 - DNA, 30 bp, Artificial Sequence
  Description of Artificial Sequence: Synthetic oligonucleotide
gatggcactcctaggctctatcagactgac

SEQ ID NO: 122986 - DNA, 30 bp, Artificial Sequence
  Description of Artificial Sequence: Synthetic oligonucleotide
atggcactcctaggctctatcagactgacc

SEQ ID NO: 122987 - DNA, 29 bp, Artificial Sequence
  Description of Artificial Sequence: Synthetic oligonucleotide
tggcactcctaggctctatcagactgacc

SEQ ID NO: 122988 - DNA, 28 bp, Artificial Sequence
  Description of Artificial Sequence: Synthetic oligonucleotide
ggcactcctaggctctatcagactgacc

SEQ ID NO: 122989 - DNA, 28 bp, Artificial Sequence
  Description of Artificial Sequence: Synthetic oligonucleotide
gcactcctaggctctatcagactgaccc

SEQ ID NO: 122990 - DNA, 28 bp, Artificial Sequence
  Description of Artificial Sequence: Synthetic oligonucleotide
cactcctaggctctatcagactgacccc

SEQ ID NO: 122991 - DNA, 29 bp, Artificial Sequence
  Description of Artificial Sequence: Synthetic oligonucleotide
actcctaggctctatcagactgacccctc

SEQ ID NO: 122992 - DNA, 28 bp, Artificial Sequence
  Description of Artificial Sequence: Synthetic oligonucleotide
ctcctaggctctatcagactgacccctc

SEQ ID NO: 122993 - DNA, 28 bp, Artificial Sequence
  Description of Artificial Sequence: Synthetic oligonucleotide
tcctaggctctatcagactgacccctcg

SEQ ID NO: 122994 - DNA, 27 bp, Artificial Sequence
  Description of Artificial Sequence: Synthetic oligonucleotide
cctaggctctatcagactgacccctcg

SEQ ID NO: 122995 - DNA, 27 bp, Artificial Sequence
  Description of Artificial Sequence: Synthetic oligonucleotide
ctaggctctatcagactgacccctcgg

SEQ ID NO: 122996 - DNA, 27 bp, Artificial Sequence
  Description of Artificial Sequence: Synthetic oligonucleotide
taggctctatcagactgacccctcggg

SEQ ID NO: 122997 - DNA, 26 bp, Artificial Sequence
  Description of Artificial Sequence: Synthetic oligonucleotide
aggctctatcagactgacccctcggg

SEQ ID NO: 122998 - DNA, 25 bp, Artificial Sequence
  Description of Artificial Sequence: Synthetic oligonucleotide
ggctctatcagactgacccctcggg

SEQ ID NO: 122999 - DNA, 26 bp, Artificial Sequence
  Description of Artificial Sequence: Synthetic oligonucleotide
gctctatcagactgacccctcgggca

SEQ ID NO: 123000 - DNA, 27 bp, Artificial Sequence
  Description of Artificial Sequence: Synthetic oligonucleotide
ctctatcagactgacccctcgggcaca

SEQ ID NO: 123001 - DNA, 29 bp, Artificial Sequence
  Description of Artificial Sequence: Synthetic oligonucleotide
tctatcagactgacccctcgggcacatac

SEQ ID NO: 123002 - DNA, 28 bp, Artificial Sequence
  Description of Artificial Sequence: Synthetic oligonucleotide
ctatcagactgacccctcgggcacatac

SEQ ID NO: 123003 - DNA, 28 bp, Artificial Sequence
  Description of Artificial Sequence: Synthetic oligonucleotide
tatcagactgacccctcgggcacatacc

SEQ ID NO: 123004 - DNA, 27 bp, Artificial Sequence
  Description of Artificial Sequence: Synthetic oligonucleotide
atcagactgacccctcgggcacatacc

SEQ ID NO: 123005 - DNA, 27 bp, Artificial Sequence
  Description of Artificial Sequence: Synthetic oligonucleotide
tcagactgacccctcgggcacatacca

SEQ ID NO: 123006 - DNA, 27 bp, Artificial Sequence
  Description of Artificial Sequence: Synthetic oligonucleotide
cagactgacccctcgggcacataccat

SEQ ID NO: 123007 - DNA, 27 bp, Artificial Sequence
  Description of Artificial Sequence: Synthetic oligonucleotide
agactgacccctcgggcacataccatg

SEQ ID NO: 123008 - DNA, 26 bp, Artificial Sequence
  Description of Artificial Sequence: Synthetic oligonucleotide
gactgacccctcgggcacataccatg

SEQ ID NO: 123009 - DNA, 26 bp, Artificial Sequence
  Description of Artificial Sequence: Synthetic oligonucleotide
actgacccctcgggcacataccatgc

SEQ ID NO: 123010 - DNA, 25 bp, Artificial Sequence
  Description of Artificial Sequence: Synthetic oligonucleotide
ctgacccctcgggcacataccatgc

SEQ ID NO: 123011 - DNA, 26 bp, Artificial Sequence
  Description of Artificial Sequence: Synthetic oligonucleotide
tgacccctcgggcacataccatgcct

SEQ ID NO: 123012 - DNA, 25 bp, Artificial Sequence
  Description of Artificial Sequence: Synthetic oligonucleotide
gacccctcgggcacataccatgcct

SEQ ID NO: 123013 - DNA, 25 bp, Artificial Sequence
  Description of Artificial Sequence: Synthetic oligonucleotide
acccctcgggcacataccatgcctg

SEQ ID NO: 123014 - DNA, 24 bp, Artificial Sequence
  Description of Artificial Sequence: Synthetic oligonucleotide
cccctcgggcacataccatgcctg

SEQ ID NO: 123015 - DNA, 26 bp, Artificial Sequence
  Description of Artificial Sequence: Synthetic oligonucleotide
ccctcgggcacataccatgcctggaa

SEQ ID NO: 123016 - DNA, 26 bp, Artificial Sequence
  Description of Artificial Sequence: Synthetic oligonucleotide
cctcgggcacataccatgcctggaag

SEQ ID NO: 123017 - DNA, 26 bp, Artificial Sequence
  Description of Artificial Sequence: Synthetic oligonucleotide
ctcgggcacataccatgcctggaagg

SEQ ID NO: 123018 - DNA, 26 bp, Artificial Sequence
  Description of Artificial Sequence: Synthetic oligonucleotide
tcgggcacataccatgcctggaaggc

SEQ ID NO: 123019 - DNA, 25 bp, Artificial Sequence
  Description of Artificial Sequence: Synthetic oligonucleotide
cgggcacataccatgcctggaaggc

SEQ ID NO: 123020 - DNA, 27 bp, Artificial Sequence
  Description of Artificial Sequence: Synthetic oligonucleotide
gggcacataccatgcctggaaggccaa

SEQ ID NO: 123021 - DNA, 28 bp, Artificial Sequence
  Description of Artificial Sequence: Synthetic oligonucleotide
ggcacataccatgcctggaaggccaatg

SEQ ID NO: 123022 - DNA, 28 bp, Artificial Sequence
  Description of Artificial Sequence: Synthetic oligonucleotide
gcacataccatgcctggaaggccaatgc

SEQ ID NO: 123023 - DNA, 28 bp, Artificial Sequence
  Description of Artificial Sequence: Synthetic oligonucleotide
cacataccatgcctggaaggccaatgcc

SEQ ID NO: 123024 - DNA, 31 bp, Artificial Sequence
  Description of Artificial Sequence: Synthetic oligonucleotide
acataccatgcctggaaggccaatgccatag

SEQ ID NO: 123025 - DNA, 30 bp, Artificial Sequence
  Description of Artificial Sequence: Synthetic oligonucleotide
cataccatgcctggaaggccaatgccatag

SEQ ID NO: 123026 - DNA, 30 bp, Artificial Sequence
  Description of Artificial Sequence: Synthetic oligonucleotide
ataccatgcctggaaggccaatgccatagg

SEQ ID NO: 123027 - DNA, 29 bp, Artificial Sequence
  Description of Artificial Sequence: Synthetic oligonucleotide
taccatgcctggaaggccaatgccatagg

SEQ ID NO: 123028 - DNA, 28 bp, Artificial Sequence
  Description of Artificial Sequence: Synthetic oligonucleotide
accatgcctggaaggccaatgccatagg

SEQ ID NO: 123029 - DNA, 27 bp, Artificial Sequence
  Description of Artificial Sequence: Synthetic oligonucleotide
ccatgcctggaaggccaatgccatagg

SEQ ID NO: 123030 - DNA, 28 bp, Artificial Sequence
  Description of Artificial Sequence: Synthetic oligonucleotide
catgcctggaaggccaatgccataggtc

SEQ ID NO: 123031 - DNA, 28 bp, Artificial Sequence
  Description of Artificial Sequence: Synthetic oligonucleotide
atgcctggaaggccaatgccataggtcg

SEQ ID NO: 123032 - DNA, 27 bp, Artificial Sequence
  Description of Artificial Sequence: Synthetic oligonucleotide
tgcctggaaggccaatgccataggtcg

SEQ ID NO: 123033 - DNA, 26 bp, Artificial Sequence
  Description of Artificial Sequence: Synthetic oligonucleotide
gcctggaaggccaatgccataggtcg

SEQ ID NO: 123034 - DNA, 26 bp, Artificial Sequence
  Description of Artificial Sequence: Synthetic oligonucleotide
cctggaaggccaatgccataggtcgg

SEQ ID NO: 123035 - DNA, 26 bp, Artificial Sequence
  Description of Artificial Sequence: Synthetic oligonucleotide
ctggaaggccaatgccataggtcggg

SEQ ID NO: 123036 - DNA, 27 bp, Artificial Sequence
  Description of Artificial Sequence: Synthetic oligonucleotide
tggaaggccaatgccataggtcggggt

SEQ ID NO: 123037 - DNA, 26 bp, Artificial Sequence
  Description of Artificial Sequence: Synthetic oligonucleotide
ggaaggccaatgccataggtcggggt

SEQ ID NO: 123038 - DNA, 26 bp, Artificial Sequence
  Description of Artificial Sequence: Synthetic oligonucleotide
gaaggccaatgccataggtcggggtg

SEQ ID NO: 123039 - DNA, 26 bp, Artificial Sequence
  Description of Artificial Sequence: Synthetic oligonucleotide
aaggccaatgccataggtcggggtgc

SEQ ID NO: 123040 - DNA, 25 bp, Artificial Sequence
  Description of Artificial Sequence: Synthetic oligonucleotide
aggccaatgccataggtcggggtgc

SEQ ID NO: 123041 - DNA, 24 bp, Artificial Sequence
  Description of Artificial Sequence: Synthetic oligonucleotide
ggccaatgccataggtcggggtgc

SEQ ID NO: 123042 - DNA, 26 bp, Artificial Sequence
  Description of Artificial Sequence: Synthetic oligonucleotide
gccaatgccataggtcggggtgccaa

SEQ ID NO: 123043 - DNA, 27 bp, Artificial Sequence
  Description of Artificial Sequence: Synthetic oligonucleotide
ccaatgccataggtcggggtgccaagt

SEQ ID NO: 123044 - DNA, 27 bp, Artificial Sequence
  Description of Artificial Sequence: Synthetic oligonucleotide
caatgccataggtcggggtgccaagtc

SEQ ID NO: 123045 - DNA, 28 bp, Artificial Sequence
  Description of Artificial Sequence: Synthetic oligonucleotide
aatgccataggtcggggtgccaagtcag

SEQ ID NO: 123046 - DNA, 27 bp, Artificial Sequence
  Description of Artificial Sequence: Synthetic oligonucleotide
atgccataggtcggggtgccaagtcag

SEQ ID NO: 123047 - DNA, 27 bp, Artificial Sequence
  Description of Artificial Sequence: Synthetic oligonucleotide
tgccataggtcggggtgccaagtcagt

SEQ ID NO: 123048 - DNA, 26 bp, Artificial Sequence
  Description of Artificial Sequence: Synthetic oligonucleotide
gccataggtcggggtgccaagtcagt

SEQ ID NO: 123049 - DNA, 26 bp, Artificial Sequence
  Description of Artificial Sequence: Synthetic oligonucleotide
ccataggtcggggtgccaagtcagtg

SEQ ID NO: 123050 - DNA, 26 bp, Artificial Sequence
  Description of Artificial Sequence: Synthetic oligonucleotide
cataggtcggggtgccaagtcagtgc

SEQ ID NO: 123051 - DNA, 26 bp, Artificial Sequence
  Description of Artificial Sequence: Synthetic oligonucleotide
ataggtcggggtgccaagtcagtgcg

SEQ ID NO: 123052 - DNA, 25 bp, Artificial Sequence
  Description of Artificial Sequence: Synthetic oligonucleotide
taggtcggggtgccaagtcagtgcg

SEQ ID NO: 123053 - DNA, 24 bp, Artificial Sequence
  Description of Artificial Sequence: Synthetic oligonucleotide
aggtcggggtgccaagtcagtgcg

SEQ ID NO: 123054 - DNA, 23 bp, Artificial Sequence
  Description of Artificial Sequence: Synthetic oligonucleotide
ggtcggggtgccaagtcagtgcg

SEQ ID NO: 123055 - DNA, 23 bp, Artificial Sequence
  Description of Artificial Sequence: Synthetic oligonucleotide
gtcggggtgccaagtcagtgcgc

SEQ ID NO: 123056 - DNA, 24 bp, Artificial Sequence
  Description of Artificial Sequence: Synthetic oligonucleotide
tcggggtgccaagtcagtgcgcga

SEQ ID NO: 123057 - DNA, 23 bp, Artificial Sequence
  Description of Artificial Sequence: Synthetic oligonucleotide
cggggtgccaagtcagtgcgcga

SEQ ID NO: 123058 - DNA, 25 bp, Artificial Sequence
  Description of Artificial Sequence: Synthetic oligonucleotide
ggggtgccaagtcagtgcgcgagtt

SEQ ID NO: 123059 - DNA, 25 bp, Artificial Sequence
  Description of Artificial Sequence: Synthetic oligonucleotide
gggtgccaagtcagtgcgcgagttc

SEQ ID NO: 123060 - DNA, 26 bp, Artificial Sequence
  Description of Artificial Sequence: Synthetic oligonucleotide
ggtgccaagtcagtgcgcgagttcct

SEQ ID NO: 123061 - DNA, 26 bp, Artificial Sequence
  Description of Artificial Sequence: Synthetic oligonucleotide
gtgccaagtcagtgcgcgagttcctg

SEQ ID NO: 123062 - DNA, 27 bp, Artificial Sequence
  Description of Artificial Sequence: Synthetic oligonucleotide
tgccaagtcagtgcgcgagttcctgga

SEQ ID NO: 123063 - DNA, 26 bp, Artificial Sequence
  Description of Artificial Sequence: Synthetic oligonucleotide
gccaagtcagtgcgcgagttcctgga

SEQ ID NO: 123064 - DNA, 27 bp, Artificial Sequence
  Description of Artificial Sequence: Synthetic oligonucleotide
ccaagtcagtgcgcgagttcctggaga

SEQ ID NO: 123065 - DNA, 28 bp, Artificial Sequence
  Description of Artificial Sequence: Synthetic oligonucleotide
caagtcagtgcgcgagttcctggagaag

SEQ ID NO: 123066 - DNA, 30 bp, Artificial Sequence
  Description of Artificial Sequence: Synthetic oligonucleotide
aagtcagtgcgcgagttcctggagaagaac

SEQ ID NO: 123067 - DNA, 29 bp, Artificial Sequence
  Description of Artificial Sequence: Synthetic oligonucleotide
agtcagtgcgcgagttcctggagaagaac

SEQ ID NO: 123068 - DNA, 28 bp, Artificial Sequence
  Description of Artificial Sequence: Synthetic oligonucleotide
gtcagtgcgcgagttcctggagaagaac

SEQ ID NO: 123069 - DNA, 32 bp, Artificial Sequence
  Description of Artificial Sequence: Synthetic oligonucleotide
tcagtgcgcgagttcctggagaagaactatac

SEQ ID NO: 123070 - DNA, 31 bp, Artificial Sequence
  Description of Artificial Sequence: Synthetic oligonucleotide
cagtgcgcgagttcctggagaagaactatac

SEQ ID NO: 123071 - DNA, 32 bp, Artificial Sequence
  Description of Artificial Sequence: Synthetic oligonucleotide
agtgcgcgagttcctggagaagaactatactg

SEQ ID NO: 123072 - DNA, 31 bp, Artificial Sequence
  Description of Artificial Sequence: Synthetic oligonucleotide
gtgcgcgagttcctggagaagaactatactg

SEQ ID NO: 123073 - DNA, 32 bp, Artificial Sequence
  Description of Artificial Sequence: Synthetic oligonucleotide
tgcgcgagttcctggagaagaactatactgac

SEQ ID NO: 123074 - DNA, 31 bp, Artificial Sequence
  Description of Artificial Sequence: Synthetic oligonucleotide
gcgcgagttcctggagaagaactatactgac

SEQ ID NO: 123075 - DNA, 31 bp, Artificial Sequence
  Description of Artificial Sequence: Synthetic oligonucleotide
cgcgagttcctggagaagaactatactgacg

SEQ ID NO: 123076 - DNA, 33 bp, Artificial Sequence
  Description of Artificial Sequence: Synthetic oligonucleotide
gcgagttcctggagaagaactatactgacgaag

SEQ ID NO: 123077 - DNA, 33 bp, Artificial Sequence
  Description of Artificial Sequence: Synthetic oligonucleotide
cgagttcctggagaagaactatactgacgaagc

SEQ ID NO: 123078 - DNA, 33 bp, Artificial Sequence
  Description of Artificial Sequence: Synthetic oligonucleotide
gagttcctggagaagaactatactgacgaagcc

SEQ ID NO: 123079 - DNA, 36 bp, Artificial Sequence
  Description of Artificial Sequence: Synthetic oligonucleotide
agttcctggagaagaactatactgacgaagccattg

SEQ ID NO: 123080 - DNA, 35 bp, Artificial Sequence
  Description of Artificial Sequence: Synthetic oligonucleotide
gttcctggagaagaactatactgacgaagccattg

SEQ ID NO: 123081 - DNA, 38 bp, Artificial Sequence
  Description of Artificial Sequence: Synthetic oligonucleotide
ttcctggagaagaactatactgacgaagccattgaaac

SEQ ID NO: 123082 - DNA, 37 bp, Artificial Sequence
  Description of Artificial Sequence: Synthetic oligonucleotide
tcctggagaagaactatactgacgaagccattgaaac

SEQ ID NO: 123083 - DNA, 36 bp, Artificial Sequence
  Description of Artificial Sequence: Synthetic oligonucleotide
cctggagaagaactatactgacgaagccattgaaac

SEQ ID NO: 123084 - DNA, 37 bp, Artificial Sequence
  Description of Artificial Sequence: Synthetic oligonucleotide
ctggagaagaactatactgacgaagccattgaaacag

SEQ ID NO: 123085 - DNA, 39 bp, Artificial Sequence
  Description of Artificial Sequence: Synthetic oligonucleotide
tggagaagaactatactgacgaagccattgaaacagatg

SEQ ID NO: 123086 - DNA, 38 bp, Artificial Sequence
  Description of Artificial Sequence: Synthetic oligonucleotide
ggagaagaactatactgacgaagccattgaaacagatg

SEQ ID NO: 123087 - DNA, 40 bp, Artificial Sequence
  Description of Artificial Sequence: Synthetic oligonucleotide
gagaagaactatactgacgaagccattgaaacagatgatc

SEQ ID NO: 123088 - DNA, 41 bp, Artificial Sequence
  Description of Artificial Sequence: Synthetic oligonucleotide
agaagaactatactgacgaagccattgaaacagatgatctg

SEQ ID NO: 123089 - DNA, 40 bp, Artificial Sequence
  Description of Artificial Sequence: Synthetic oligonucleotide
gaagaactatactgacgaagccattgaaacagatgatctg

SEQ ID NO: 123090 - DNA, 41 bp, Artificial Sequence
  Description of Artificial Sequence: Synthetic oligonucleotide
aagaactatactgacgaagccattgaaacagatgatctgac

SEQ ID NO: 123091 - DNA, 40 bp, Artificial Sequence
  Description of Artificial Sequence: Synthetic oligonucleotide
agaactatactgacgaagccattgaaacagatgatctgac

SEQ ID NO: 123092 - DNA, 39 bp, Artificial Sequence
  Description of Artificial Sequence: Synthetic oligonucleotide
gaactatactgacgaagccattgaaacagatgatctgac

SEQ ID NO: 123093 - DNA, 39 bp, Artificial Sequence
  Description of Artificial Sequence: Synthetic oligonucleotide
aactatactgacgaagccattgaaacagatgatctgacc

SEQ ID NO: 123094 - DNA, 38 bp, Artificial Sequence
  Description of Artificial Sequence: Synthetic oligonucleotide
actatactgacgaagccattgaaacagatgatctgacc

SEQ ID NO: 123095 - DNA, 37 bp, Artificial Sequence
  Description of Artificial Sequence: Synthetic oligonucleotide
ctatactgacgaagccattgaaacagatgatctgacc

SEQ ID NO: 123096 - DNA, 42 bp, Artificial Sequence
  Description of Artificial Sequence: Synthetic oligonucleotide
tatactgacgaagccattgaaacagatgatctgaccattaag

SEQ ID NO: 123097 - DNA, 41 bp, Artificial Sequence
  Description of Artificial Sequence: Synthetic oligonucleotide
atactgacgaagccattgaaacagatgatctgaccattaag

SEQ ID NO: 123098 - DNA, 40 bp, Artificial Sequence
  Description of Artificial Sequence: Synthetic oligonucleotide
tactgacgaagccattgaaacagatgatctgaccattaag

SEQ ID NO: 123099 - DNA, 39 bp, Artificial Sequence
  Description of Artificial Sequence: Synthetic oligonucleotide
actgacgaagccattgaaacagatgatctgaccattaag

SEQ ID NO: 123100 - DNA, 38 bp, Artificial Sequence
  Description of Artificial Sequence: Synthetic oligonucleotide
ctgacgaagccattgaaacagatgatctgaccattaag

SEQ ID NO: 123101 - DNA, 38 bp, Artificial Sequence
  Description of Artificial Sequence: Synthetic oligonucleotide
tgacgaagccattgaaacagatgatctgaccattaagc

SEQ ID NO: 123102 - DNA, 37 bp, Artificial Sequence
  Description of Artificial Sequence: Synthetic oligonucleotide
gacgaagccattgaaacagatgatctgaccattaagc

SEQ ID NO: 123103 - DNA, 38 bp, Artificial Sequence
  Description of Artificial Sequence: Synthetic oligonucleotide
acgaagccattgaaacagatgatctgaccattaagctg

SEQ ID NO: 123104 - DNA, 37 bp, Artificial Sequence
  Description of Artificial Sequence: Synthetic oligonucleotide
cgaagccattgaaacagatgatctgaccattaagctg

SEQ ID NO: 123105 - DNA, 37 bp, Artificial Sequence
  Description of Artificial Sequence: Synthetic oligonucleotide
gaagccattgaaacagatgatctgaccattaagctgg

SEQ ID NO: 123106 - DNA, 38 bp, Artificial Sequence
  Description of Artificial Sequence: Synthetic oligonucleotide
aagccattgaaacagatgatctgaccattaagctggtg

SEQ ID NO: 123107 - DNA, 37 bp, Artificial Sequence
  Description of Artificial Sequence: Synthetic oligonucleotide
agccattgaaacagatgatctgaccattaagctggtg

SEQ ID NO: 123108 - DNA, 36 bp, Artificial Sequence
  Description of Artificial Sequence: Synthetic oligonucleotide
gccattgaaacagatgatctgaccattaagctggtg

SEQ ID NO: 123109 - DNA, 38 bp, Artificial Sequence
  Description of Artificial Sequence: Synthetic oligonucleotide
ccattgaaacagatgatctgaccattaagctggtgatc

SEQ ID NO: 123110 - DNA, 40 bp, Artificial Sequence
  Description of Artificial Sequence: Synthetic oligonucleotide
cattgaaacagatgatctgaccattaagctggtgatcaag

SEQ ID NO: 123111 - DNA, 40 bp, Artificial Sequence
  Description of Artificial Sequence: Synthetic oligonucleotide
attgaaacagatgatctgaccattaagctggtgatcaagg

SEQ ID NO: 123112 - DNA, 39 bp, Artificial Sequence
  Description of Artificial Sequence: Synthetic oligonucleotide
ttgaaacagatgatctgaccattaagctggtgatcaagg

SEQ ID NO: 123113 - DNA, 38 bp, Artificial Sequence
  Description of Artificial Sequence: Synthetic oligonucleotide
tgaaacagatgatctgaccattaagctggtgatcaagg

SEQ ID NO: 123114 - DNA, 37 bp, Artificial Sequence
  Description of Artificial Sequence: Synthetic oligonucleotide
gaaacagatgatctgaccattaagctggtgatcaagg

SEQ ID NO: 123115 - DNA, 37 bp, Artificial Sequence
  Description of Artificial Sequence: Synthetic oligonucleotide
aaacagatgatctgaccattaagctggtgatcaaggc

SEQ ID NO: 123116 - DNA, 36 bp, Artificial Sequence
  Description of Artificial Sequence: Synthetic oligonucleotide
aacagatgatctgaccattaagctggtgatcaaggc

SEQ ID NO: 123117 - DNA, 35 bp, Artificial Sequence
  Description of Artificial Sequence: Synthetic oligonucleotide
acagatgatctgaccattaagctggtgatcaaggc

SEQ ID NO: 123118 - DNA, 34 bp, Artificial Sequence
  Description of Artificial Sequence: Synthetic oligonucleotide
cagatgatctgaccattaagctggtgatcaaggc

SEQ ID NO: 123119 - DNA, 35 bp, Artificial Sequence
  Description of Artificial Sequence: Synthetic oligonucleotide
agatgatctgaccattaagctggtgatcaaggcac

SEQ ID NO: 123120 - DNA, 34 bp, Artificial Sequence
  Description of Artificial Sequence: Synthetic oligonucleotide
gatgatctgaccattaagctggtgatcaaggcac

SEQ ID NO: 123121 - DNA, 35 bp, Artificial Sequence
  Description of Artificial Sequence: Synthetic oligonucleotide
atgatctgaccattaagctggtgatcaaggcactc

SEQ ID NO: 123122 - DNA, 34 bp, Artificial Sequence
  Description of Artificial Sequence: Synthetic oligonucleotide
tgatctgaccattaagctggtgatcaaggcactc

SEQ ID NO: 123123 - DNA, 33 bp, Artificial Sequence
  Description of Artificial Sequence: Synthetic oligonucleotide
gatctgaccattaagctggtgatcaaggcactc

SEQ ID NO: 123124 - DNA, 33 bp, Artificial Sequence
  Description of Artificial Sequence: Synthetic oligonucleotide
atctgaccattaagctggtgatcaaggcactcc

SEQ ID NO: 123125 - DNA, 32 bp, Artificial Sequence
  Description of Artificial Sequence: Synthetic oligonucleotide
tctgaccattaagctggtgatcaaggcactcc

SEQ ID NO: 123126 - DNA, 31 bp, Artificial Sequence
  Description of Artificial Sequence: Synthetic oligonucleotide
ctgaccattaagctggtgatcaaggcactcc

SEQ ID NO: 123127 - DNA, 32 bp, Artificial Sequence
  Description of Artificial Sequence: Synthetic oligonucleotide
tgaccattaagctggtgatcaaggcactcctg

SEQ ID NO: 123128 - DNA, 31 bp, Artificial Sequence
  Description of Artificial Sequence: Synthetic oligonucleotide
gaccattaagctggtgatcaaggcactcctg

SEQ ID NO: 123129 - DNA, 31 bp, Artificial Sequence
  Description of Artificial Sequence: Synthetic oligonucleotide
accattaagctggtgatcaaggcactcctgg

SEQ ID NO: 123130 - DNA, 30 bp, Artificial Sequence
  Description of Artificial Sequence: Synthetic oligonucleotide
ccattaagctggtgatcaaggcactcctgg

SEQ ID NO: 123131 - DNA, 32 bp, Artificial Sequence
  Description of Artificial Sequence: Synthetic oligonucleotide
cattaagctggtgatcaaggcactcctggaag

SEQ ID NO: 123132 - DNA, 33 bp, Artificial Sequence
  Description of Artificial Sequence: Synthetic oligonucleotide
attaagctggtgatcaaggcactcctggaagtg

SEQ ID NO: 123133 - DNA, 32 bp, Artificial Sequence
  Description of Artificial Sequence: Synthetic oligonucleotide
ttaagctggtgatcaaggcactcctggaagtg

SEQ ID NO: 123134 - DNA, 31 bp, Artificial Sequence
  Description of Artificial Sequence: Synthetic oligonucleotide
taagctggtgatcaaggcactcctggaagtg

SEQ ID NO: 123135 - DNA, 30 bp, Artificial Sequence
  Description of Artificial Sequence: Synthetic oligonucleotide
aagctggtgatcaaggcactcctggaagtg

SEQ ID NO: 123136 - DNA, 29 bp, Artificial Sequence
  Description of Artificial Sequence: Synthetic oligonucleotide
agctggtgatcaaggcactcctggaagtg

SEQ ID NO: 123137 - DNA, 28 bp, Artificial Sequence
  Description of Artificial Sequence: Synthetic oligonucleotide
gctggtgatcaaggcactcctggaagtg

SEQ ID NO: 123138 - DNA, 28 bp, Artificial Sequence
  Description of Artificial Sequence: Synthetic oligonucleotide
ctggtgatcaaggcactcctggaagtgg

SEQ ID NO: 123139 - DNA, 30 bp, Artificial Sequence
  Description of Artificial Sequence: Synthetic oligonucleotide
tggtgatcaaggcactcctggaagtggttc

SEQ ID NO: 123140 - DNA, 29 bp, Artificial Sequence
  Description of Artificial Sequence: Synthetic oligonucleotide
ggtgatcaaggcactcctggaagtggttc

SEQ ID NO: 123141 - DNA, 30 bp, Artificial Sequence
  Description of Artificial Sequence: Synthetic oligonucleotide
gtgatcaaggcactcctggaagtggttcag

SEQ ID NO: 123142 - DNA, 31 bp, Artificial Sequence
  Description of Artificial Sequence: Synthetic oligonucleotide
tgatcaaggcactcctggaagtggttcagtc

SEQ ID NO: 123143 - DNA, 30 bp, Artificial Sequence
  Description of Artificial Sequence: Synthetic oligonucleotide
gatcaaggcactcctggaagtggttcagtc

SEQ ID NO: 123144 - DNA, 31 bp, Artificial Sequence
  Description of Artificial Sequence: Synthetic oligonucleotide
atcaaggcactcctggaagtggttcagtcag

SEQ ID NO: 123145 - DNA, 30 bp, Artificial Sequence
  Description of Artificial Sequence: Synthetic oligonucleotide
tcaaggcactcctggaagtggttcagtcag

SEQ ID NO: 123146 - DNA, 29 bp, Artificial Sequence
  Description of Artificial Sequence: Synthetic oligonucleotide
caaggcactcctggaagtggttcagtcag

SEQ ID NO: 123147 - DNA, 29 bp, Artificial Sequence
  Description of Artificial Sequence: Synthetic oligonucleotide
aaggcactcctggaagtggttcagtcagg

SEQ ID NO: 123148 - DNA, 28 bp, Artificial Sequence
  Description of Artificial Sequence: Synthetic oligonucleotide
aggcactcctggaagtggttcagtcagg

SEQ ID NO: 123149 - DNA, 27 bp, Artificial Sequence
  Description of Artificial Sequence: Synthetic oligonucleotide
ggcactcctggaagtggttcagtcagg

SEQ ID NO: 123150 - DNA, 28 bp, Artificial Sequence
  Description of Artificial Sequence: Synthetic oligonucleotide
gcactcctggaagtggttcagtcaggtg

SEQ ID NO: 123151 - DNA, 28 bp, Artificial Sequence
  Description of Artificial Sequence: Synthetic oligonucleotide
cactcctggaagtggttcagtcaggtgg

SEQ ID NO: 123152 - DNA, 28 bp, Artificial Sequence
  Description of Artificial Sequence: Synthetic oligonucleotide
actcctggaagtggttcagtcaggtggc

SEQ ID NO: 123153 - DNA, 27 bp, Artificial Sequence
  Description of Artificial Sequence: Synthetic oligonucleotide
ctcctggaagtggttcagtcaggtggc

SEQ ID NO: 123154 - DNA, 32 bp, Artificial Sequence
  Description of Artificial Sequence: Synthetic oligonucleotide
tcctggaagtggttcagtcaggtggcaaaaac

SEQ ID NO: 123155 - DNA, 31 bp, Artificial Sequence
  Description of Artificial Sequence: Synthetic oligonucleotide
cctggaagtggttcagtcaggtggcaaaaac

SEQ ID NO: 123156 - DNA, 34 bp, Artificial Sequence
  Description of Artificial Sequence: Synthetic oligonucleotide
ctggaagtggttcagtcaggtggcaaaaacattg

SEQ ID NO: 123157 - DNA, 36 bp, Artificial Sequence
  Description of Artificial Sequence: Synthetic oligonucleotide
tggaagtggttcagtcaggtggcaaaaacattgaac

SEQ ID NO: 123158 - DNA, 35 bp, Artificial Sequence
  Description of Artificial Sequence: Synthetic oligonucleotide
ggaagtggttcagtcaggtggcaaaaacattgaac

SEQ ID NO: 123159 - DNA, 37 bp, Artificial Sequence
  Description of Artificial Sequence: Synthetic oligonucleotide
gaagtggttcagtcaggtggcaaaaacattgaacttg

SEQ ID NO: 123160 - DNA, 37 bp, Artificial Sequence
  Description of Artificial Sequence: Synthetic oligonucleotide
aagtggttcagtcaggtggcaaaaacattgaacttgc

SEQ ID NO: 123161 - DNA, 36 bp, Artificial Sequence
  Description of Artificial Sequence: Synthetic oligonucleotide
agtggttcagtcaggtggcaaaaacattgaacttgc

SEQ ID NO: 123162 - DNA, 35 bp, Artificial Sequence
  Description of Artificial Sequence: Synthetic oligonucleotide
gtggttcagtcaggtggcaaaaacattgaacttgc

SEQ ID NO: 123163 - DNA, 36 bp, Artificial Sequence
  Description of Artificial Sequence: Synthetic oligonucleotide
tggttcagtcaggtggcaaaaacattgaacttgctg

SEQ ID NO: 123164 - DNA, 35 bp, Artificial Sequence
  Description of Artificial Sequence: Synthetic oligonucleotide
ggttcagtcaggtggcaaaaacattgaacttgctg

SEQ ID NO: 123165 - DNA, 36 bp, Artificial Sequence
  Description of Artificial Sequence: Synthetic oligonucleotide
gttcagtcaggtggcaaaaacattgaacttgctgtc

SEQ ID NO: 123166 - DNA, 38 bp, Artificial Sequence
  Description of Artificial Sequence: Synthetic oligonucleotide
ttcagtcaggtggcaaaaacattgaacttgctgtcatg

SEQ ID NO: 123167 - DNA, 37 bp, Artificial Sequence
  Description of Artificial Sequence: Synthetic oligonucleotide
tcagtcaggtggcaaaaacattgaacttgctgtcatg

SEQ ID NO: 123168 - DNA, 36 bp, Artificial Sequence
  Description of Artificial Sequence: Synthetic oligonucleotide
cagtcaggtggcaaaaacattgaacttgctgtcatg

SEQ ID NO: 123169 - DNA, 37 bp, Artificial Sequence
  Description of Artificial Sequence: Synthetic oligonucleotide
agtcaggtggcaaaaacattgaacttgctgtcatgag

SEQ ID NO: 123170 - DNA, 36 bp, Artificial Sequence
  Description of Artificial Sequence: Synthetic oligonucleotide
gtcaggtggcaaaaacattgaacttgctgtcatgag

SEQ ID NO: 123171 - DNA, 36 bp, Artificial Sequence
  Description of Artificial Sequence: Synthetic oligonucleotide
tcaggtggcaaaaacattgaacttgctgtcatgagg

SEQ ID NO: 123172 - DNA, 35 bp, Artificial Sequence
  Description of Artificial Sequence: Synthetic oligonucleotide
caggtggcaaaaacattgaacttgctgtcatgagg

SEQ ID NO: 123173 - DNA, 35 bp, Artificial Sequence
  Description of Artificial Sequence: Synthetic oligonucleotide
aggtggcaaaaacattgaacttgctgtcatgaggc

SEQ ID NO: 123174 - DNA, 34 bp, Artificial Sequence
  Description of Artificial Sequence: Synthetic oligonucleotide
ggtggcaaaaacattgaacttgctgtcatgaggc

SEQ ID NO: 123175 - DNA, 34 bp, Artificial Sequence
  Description of Artificial Sequence: Synthetic oligonucleotide
gtggcaaaaacattgaacttgctgtcatgaggcg

SEQ ID NO: 123176 - DNA, 35 bp, Artificial Sequence
  Description of Artificial Sequence: Synthetic oligonucleotide
tggcaaaaacattgaacttgctgtcatgaggcgag

SEQ ID NO: 123177 - DNA, 34 bp, Artificial Sequence
  Description of Artificial Sequence: Synthetic oligonucleotide
ggcaaaaacattgaacttgctgtcatgaggcgag

SEQ ID NO: 123178 - DNA, 36 bp, Artificial Sequence
  Description of Artificial Sequence: Synthetic oligonucleotide
gcaaaaacattgaacttgctgtcatgaggcgagatc

SEQ ID NO: 123179 - DNA, 39 bp, Artificial Sequence
  Description of Artificial Sequence: Synthetic oligonucleotide
caaaaacattgaacttgctgtcatgaggcgagatcaatc

SEQ ID NO: 123180 - DNA, 39 bp, Artificial Sequence
  Description of Artificial Sequence: Synthetic oligonucleotide
aaaaacattgaacttgctgtcatgaggcgagatcaatcc

SEQ ID NO: 123181 - DNA, 38 bp, Artificial Sequence
  Description of Artificial Sequence: Synthetic oligonucleotide
aaaacattgaacttgctgtcatgaggcgagatcaatcc

SEQ ID NO: 123182 - DNA, 37 bp, Artificial Sequence
  Description of Artificial Sequence: Synthetic oligonucleotide
aaacattgaacttgctgtcatgaggcgagatcaatcc

SEQ ID NO: 123183 - DNA, 36 bp, Artificial Sequence
  Description of Artificial Sequence: Synthetic oligonucleotide
aacattgaacttgctgtcatgaggcgagatcaatcc

SEQ ID NO: 123184 - DNA, 35 bp, Artificial Sequence
  Description of Artificial Sequence: Synthetic oligonucleotide
acattgaacttgctgtcatgaggcgagatcaatcc

SEQ ID NO: 123185 - DNA, 34 bp, Artificial Sequence
  Description of Artificial Sequence: Synthetic oligonucleotide
cattgaacttgctgtcatgaggcgagatcaatcc

SEQ ID NO: 123186 - DNA, 34 bp, Artificial Sequence
  Description of Artificial Sequence: Synthetic oligonucleotide
attgaacttgctgtcatgaggcgagatcaatccc

SEQ ID NO: 123187 - DNA, 33 bp, Artificial Sequence
  Description of Artificial Sequence: Synthetic oligonucleotide
ttgaacttgctgtcatgaggcgagatcaatccc

SEQ ID NO: 123188 - DNA, 32 bp, Artificial Sequence
  Description of Artificial Sequence: Synthetic oligonucleotide
tgaacttgctgtcatgaggcgagatcaatccc

SEQ ID NO: 123189 - DNA, 31 bp, Artificial Sequence
  Description of Artificial Sequence: Synthetic oligonucleotide
gaacttgctgtcatgaggcgagatcaatccc

SEQ ID NO: 123190 - DNA, 32 bp, Artificial Sequence
  Description of Artificial Sequence: Synthetic oligonucleotide
aacttgctgtcatgaggcgagatcaatccctc

SEQ ID NO: 123191 - DNA, 31 bp, Artificial Sequence
  Description of Artificial Sequence: Synthetic oligonucleotide
acttgctgtcatgaggcgagatcaatccctc

SEQ ID NO: 123192 - DNA, 30 bp, Artificial Sequence
  Description of Artificial Sequence: Synthetic oligonucleotide
cttgctgtcatgaggcgagatcaatccctc

SEQ ID NO: 123193 - DNA, 32 bp, Artificial Sequence
  Description of Artificial Sequence: Synthetic oligonucleotide
ttgctgtcatgaggcgagatcaatccctcaag

SEQ ID NO: 123194 - DNA, 31 bp, Artificial Sequence
  Description of Artificial Sequence: Synthetic oligonucleotide
tgctgtcatgaggcgagatcaatccctcaag

SEQ ID NO: 123195 - DNA, 30 bp, Artificial Sequence
  Description of Artificial Sequence: Synthetic oligonucleotide
gctgtcatgaggcgagatcaatccctcaag

SEQ ID NO: 123196 - DNA, 39 bp, Artificial Sequence
  Description of Artificial Sequence: Synthetic oligonucleotide
ctgtcatgaggcgagatcaatccctcaagattttaaatc

SEQ ID NO: 123197 - DNA, 39 bp, Artificial Sequence
  Description of Artificial Sequence: Synthetic oligonucleotide
tgtcatgaggcgagatcaatccctcaagattttaaatcc

SEQ ID NO: 123198 - DNA, 38 bp, Artificial Sequence
  Description of Artificial Sequence: Synthetic oligonucleotide
gtcatgaggcgagatcaatccctcaagattttaaatcc

SEQ ID NO: 123199 - DNA, 39 bp, Artificial Sequence
  Description of Artificial Sequence: Synthetic oligonucleotide
tcatgaggcgagatcaatccctcaagattttaaatcctg

SEQ ID NO: 123200 - DNA, 38 bp, Artificial Sequence
  Description of Artificial Sequence: Synthetic oligonucleotide
catgaggcgagatcaatccctcaagattttaaatcctg

SEQ ID NO: 123201 - DNA, 40 bp, Artificial Sequence
  Description of Artificial Sequence: Synthetic oligonucleotide
atgaggcgagatcaatccctcaagattttaaatcctgaag

SEQ ID NO: 123202 - DNA, 39 bp, Artificial Sequence
  Description of Artificial Sequence: Synthetic oligonucleotide
tgaggcgagatcaatccctcaagattttaaatcctgaag

SEQ ID NO: 123203 - DNA, 38 bp, Artificial Sequence
  Description of Artificial Sequence: Synthetic oligonucleotide
gaggcgagatcaatccctcaagattttaaatcctgaag

SEQ ID NO: 123204 - DNA, 43 bp, Artificial Sequence
  Description of Artificial Sequence: Synthetic oligonucleotide
aggcgagatcaatccctcaagattttaaatcctgaagaaattg

SEQ ID NO: 123205 - DNA, 42 bp, Artificial Sequence
  Description of Artificial Sequence: Synthetic oligonucleotide
ggcgagatcaatccctcaagattttaaatcctgaagaaattg

SEQ ID NO: 123206 - DNA, 43 bp, Artificial Sequence
  Description of Artificial Sequence: Synthetic oligonucleotide
gcgagatcaatccctcaagattttaaatcctgaagaaattgag

SEQ ID NO: 123207 - DNA, 45 bp, Artificial Sequence
  Description of Artificial Sequence: Synthetic oligonucleotide
cgagatcaatccctcaagattttaaatcctgaagaaattgagaag

SEQ ID NO: 123208 - DNA, 48 bp, Artificial Sequence
  Description of Artificial Sequence: Synthetic oligonucleotide
gagatcaatccctcaagattttaaatcctgaagaaattgagaagtatg

SEQ ID NO: 123209 - DNA, 50 bp, Artificial Sequence
  Description of Artificial Sequence: Synthetic oligonucleotide
agatcaatccctcaagattttaaatcctgaagaaattgagaagtatgttg

SEQ ID NO: 123210 - DNA, 49 bp, Artificial Sequence
  Description of Artificial Sequence: Synthetic oligonucleotide
gatcaatccctcaagattttaaatcctgaagaaattgagaagtatgttg

SEQ ID NO: 123211 - DNA, 49 bp, Artificial Sequence
  Description of Artificial Sequence: Synthetic oligonucleotide
atcaatccctcaagattttaaatcctgaagaaattgagaagtatgttgc

SEQ ID NO: 123212 - DNA, 48 bp, Artificial Sequence
  Description of Artificial Sequence: Synthetic oligonucleotide
tcaatccctcaagattttaaatcctgaagaaattgagaagtatgttgc

SEQ ID NO: 123213 - DNA, 47 bp, Artificial Sequence
  Description of Artificial Sequence: Synthetic oligonucleotide
caatccctcaagattttaaatcctgaagaaattgagaagtatgttgc

SEQ ID NO: 123214 - DNA, 48 bp, Artificial Sequence
  Description of Artificial Sequence: Synthetic oligonucleotide
aatccctcaagattttaaatcctgaagaaattgagaagtatgttgctg

SEQ ID NO: 123215 - DNA, 47 bp, Artificial Sequence
  Description of Artificial Sequence: Synthetic oligonucleotide
atccctcaagattttaaatcctgaagaaattgagaagtatgttgctg

SEQ ID NO: 123216 - DNA, 46 bp, Artificial Sequence
  Description of Artificial Sequence: Synthetic oligonucleotide
tccctcaagattttaaatcctgaagaaattgagaagtatgttgctg

SEQ ID NO: 123217 - DNA, 45 bp, Artificial Sequence
  Description of Artificial Sequence: Synthetic oligonucleotide
ccctcaagattttaaatcctgaagaaattgagaagtatgttgctg

SEQ ID NO: 123218 - DNA, 50 bp, Artificial Sequence
  Description of Artificial Sequence: Synthetic oligonucleotide
cctcaagattttaaatcctgaagaaattgagaagtatgttgctgaaattg

SEQ ID NO: 123219 - DNA, 55 bp, Artificial Sequence
  Description of Artificial Sequence: Synthetic oligonucleotide
ctcaagattttaaatcctgaagaaattgagaagtatgttgctgaaattgaaaaag

SEQ ID NO: 123220 - DNA, 60 bp, Artificial Sequence
  Description of Artificial Sequence: Synthetic oligonucleotide
tcaagattttaaatcctgaagaaattgagaagtatgttgctgaaattgaaaaagaaaaag

SEQ ID NO: 123221 - DNA, 59 bp, Artificial Sequence
  Description of Artificial Sequence: Synthetic oligonucleotide
caagattttaaatcctgaagaaattgagaagtatgttgctgaaattgaaaaagaaaaag

SEQ ID NO: 123222 - DNA, 60 bp, Artificial Sequence
  Description of Artificial Sequence: Synthetic oligonucleotide
aagattttaaatcctgaagaaattgagaagtatgttgctgaaattgaaaaagaaaaagaa

SEQ ID NO: 123223 - DNA, 60 bp, Artificial Sequence
  Description of Artificial Sequence: Synthetic oligonucleotide
agattttaaatcctgaagaaattgagaagtatgttgctgaaattgaaaaagaaaaagaag

SEQ ID NO: 123224 - DNA, 59 bp, Artificial Sequence
  Description of Artificial Sequence: Synthetic oligonucleotide
gattttaaatcctgaagaaattgagaagtatgttgctgaaattgaaaaagaaaaagaag

SEQ ID NO: 123225 - DNA, 60 bp, Artificial Sequence
  Description of Artificial Sequence: Synthetic oligonucleotide
attttaaatcctgaagaaattgagaagtatgttgctgaaattgaaaaagaaaaagaagaa

SEQ ID NO: 123226 - DNA, 60 bp, Artificial Sequence
  Description of Artificial Sequence: Synthetic oligonucleotide
ttttaaatcctgaagaaattgagaagtatgttgctgaaattgaaaaagaaaaagaagaaa

SEQ ID NO: 123227 - DNA, 60 bp, Artificial Sequence
  Description of Artificial Sequence: Synthetic oligonucleotide
tttaaatcctgaagaaattgagaagtatgttgctgaaattgaaaaagaaaaagaagaaaa

SEQ ID NO: 123228 - DNA, 60 bp, Artificial Sequence
  Description of Artificial Sequence: Synthetic oligonucleotide
ttaaatcctgaagaaattgagaagtatgttgctgaaattgaaaaagaaaaagaagaaaac

SEQ ID NO: 123229 - DNA, 59 bp, Artificial Sequence
  Description of Artificial Sequence: Synthetic oligonucleotide
taaatcctgaagaaattgagaagtatgttgctgaaattgaaaaagaaaaagaagaaaac

SEQ ID NO: 123230 - DNA, 58 bp, Artificial Sequence
  Description of Artificial Sequence: Synthetic oligonucleotide
aaatcctgaagaaattgagaagtatgttgctgaaattgaaaaagaaaaagaagaaaac

SEQ ID NO: 123231 - DNA, 57 bp, Artificial Sequence
  Description of Artificial Sequence: Synthetic oligonucleotide
aatcctgaagaaattgagaagtatgttgctgaaattgaaaaagaaaaagaagaaaac

SEQ ID NO: 123232 - DNA, 56 bp, Artificial Sequence
  Description of Artificial Sequence: Synthetic oligonucleotide
atcctgaagaaattgagaagtatgttgctgaaattgaaaaagaaaaagaagaaaac

SEQ ID NO: 123233 - DNA, 55 bp, Artificial Sequence
  Description of Artificial Sequence: Synthetic oligonucleotide
tcctgaagaaattgagaagtatgttgctgaaattgaaaaagaaaaagaagaaaac

SEQ ID NO: 123234 - DNA, 54 bp, Artificial Sequence
  Description of Artificial Sequence: Synthetic oligonucleotide
cctgaagaaattgagaagtatgttgctgaaattgaaaaagaaaaagaagaaaac

SEQ ID NO: 123235 - DNA, 54 bp, Artificial Sequence
  Description of Artificial Sequence: Synthetic oligonucleotide
ctgaagaaattgagaagtatgttgctgaaattgaaaaagaaaaagaagaaaacg

SEQ ID NO: 123236 - DNA, 58 bp, Artificial Sequence
  Description of Artificial Sequence: Synthetic oligonucleotide
tgaagaaattgagaagtatgttgctgaaattgaaaaagaaaaagaagaaaacgaaaag

SEQ ID NO: 123237 - DNA, 57 bp, Artificial Sequence
  Description of Artificial Sequence: Synthetic oligonucleotide
gaagaaattgagaagtatgttgctgaaattgaaaaagaaaaagaagaaaacgaaaag

SEQ ID NO: 123238 - DNA, 59 bp, Artificial Sequence
  Description of Artificial Sequence: Synthetic oligonucleotide
aagaaattgagaagtatgttgctgaaattgaaaaagaaaaagaagaaaacgaaaagaag

SEQ ID NO: 123239 - DNA, 58 bp, Artificial Sequence
  Description of Artificial Sequence: Synthetic oligonucleotide
agaaattgagaagtatgttgctgaaattgaaaaagaaaaagaagaaaacgaaaagaag

SEQ ID NO: 123240 - DNA, 57 bp, Artificial Sequence
  Description of Artificial Sequence: Synthetic oligonucleotide
gaaattgagaagtatgttgctgaaattgaaaaagaaaaagaagaaaacgaaaagaag

SEQ ID NO: 123241 - DNA, 60 bp, Artificial Sequence
  Description of Artificial Sequence: Synthetic oligonucleotide
aaattgagaagtatgttgctgaaattgaaaaagaaaaagaagaaaacgaaaagaagaaac

SEQ ID NO: 123242 - DNA, 59 bp, Artificial Sequence
  Description of Artificial Sequence: Synthetic oligonucleotide
aattgagaagtatgttgctgaaattgaaaaagaaaaagaagaaaacgaaaagaagaaac

SEQ ID NO: 123243 - DNA, 58 bp, Artificial Sequence
  Description of Artificial Sequence: Synthetic oligonucleotide
attgagaagtatgttgctgaaattgaaaaagaaaaagaagaaaacgaaaagaagaaac

SEQ ID NO: 123244 - DNA, 57 bp, Artificial Sequence
  Description of Artificial Sequence: Synthetic oligonucleotide
ttgagaagtatgttgctgaaattgaaaaagaaaaagaagaaaacgaaaagaagaaac

SEQ ID NO: 123245 - DNA, 56 bp, Artificial Sequence
  Description of Artificial Sequence: Synthetic oligonucleotide
tgagaagtatgttgctgaaattgaaaaagaaaaagaagaaaacgaaaagaagaaac

SEQ ID NO: 123246 - DNA, 55 bp, Artificial Sequence
  Description of Artificial Sequence: Synthetic oligonucleotide
gagaagtatgttgctgaaattgaaaaagaaaaagaagaaaacgaaaagaagaaac

SEQ ID NO: 123247 - DNA, 59 bp, Artificial Sequence
  Description of Artificial Sequence: Synthetic oligonucleotide
agaagtatgttgctgaaattgaaaaagaaaaagaagaaaacgaaaagaagaaacaaaag

SEQ ID NO: 123248 - DNA, 58 bp, Artificial Sequence
  Description of Artificial Sequence: Synthetic oligonucleotide
gaagtatgttgctgaaattgaaaaagaaaaagaagaaaacgaaaagaagaaacaaaag

SEQ ID NO: 123249 - DNA, 60 bp, Artificial Sequence
  Description of Artificial Sequence: Synthetic oligonucleotide
aagtatgttgctgaaattgaaaaagaaaaagaagaaaacgaaaagaagaaacaaaagaaa

SEQ ID NO: 123250 - DNA, 60 bp, Artificial Sequence
  Description of Artificial Sequence: Synthetic oligonucleotide
agtatgttgctgaaattgaaaaagaaaaagaagaaaacgaaaagaagaaacaaaagaaag

SEQ ID NO: 123251 - DNA, 59 bp, Artificial Sequence
  Description of Artificial Sequence: Synthetic oligonucleotide
gtatgttgctgaaattgaaaaagaaaaagaagaaaacgaaaagaagaaacaaaagaaag

SEQ ID NO: 123252 - DNA, 59 bp, Artificial Sequence
  Description of Artificial Sequence: Synthetic oligonucleotide
tatgttgctgaaattgaaaaagaaaaagaagaaaacgaaaagaagaaacaaaagaaagc

SEQ ID NO: 123253 - DNA, 58 bp, Artificial Sequence
  Description of Artificial Sequence: Synthetic oligonucleotide
atgttgctgaaattgaaaaagaaaaagaagaaaacgaaaagaagaaacaaaagaaagc

SEQ ID NO: 123254 - DNA, 57 bp, Artificial Sequence
  Description of Artificial Sequence: Synthetic oligonucleotide
tgttgctgaaattgaaaaagaaaaagaagaaaacgaaaagaagaaacaaaagaaagc

SEQ ID NO: 123255 - DNA, 56 bp, Artificial Sequence
  Description of Artificial Sequence: Synthetic oligonucleotide
gttgctgaaattgaaaaagaaaaagaagaaaacgaaaagaagaaacaaaagaaagc

SEQ ID NO: 123256 - DNA, 58 bp, Artificial Sequence
  Description of Artificial Sequence: Synthetic oligonucleotide
ttgctgaaattgaaaaagaaaaagaagaaaacgaaaagaagaaacaaaagaaagcatc

SEQ ID NO: 123257 - DNA, 57 bp, Artificial Sequence
  Description of Artificial Sequence: Synthetic oligonucleotide
tgctgaaattgaaaaagaaaaagaagaaaacgaaaagaagaaacaaaagaaagcatc

SEQ ID NO: 123258 - DNA, 56 bp, Artificial Sequence
  Description of Artificial Sequence: Synthetic oligonucleotide
gctgaaattgaaaaagaaaaagaagaaaacgaaaagaagaaacaaaagaaagcatc

SEQ ID NO: 123259 - DNA, 58 bp, Artificial Sequence
  Description of Artificial Sequence: Synthetic oligonucleotide
ctgaaattgaaaaagaaaaagaagaaaacgaaaagaagaaacaaaagaaagcatcatg

SEQ ID NO: 123260 - DNA, 58 bp, Artificial Sequence
  Description of Artificial Sequence: Synthetic oligonucleotide
tgaaattgaaaaagaaaaagaagaaaacgaaaagaagaaacaaaagaaagcatcatga

SEQ ID NO: 123261 - DNA, 32 bp, Artificial Sequence
  Description of Artificial Sequence: Synthetic oligonucleotide
atgttgtcctctacagccatgtattcggctcc

SEQ ID NO: 123262 - DNA, 31 bp, Artificial Sequence
  Description of Artificial Sequence: Synthetic oligonucleotide
tgttgtcctctacagccatgtattcggctcc

SEQ ID NO: 123263 - DNA, 30 bp, Artificial Sequence
  Description of Artificial Sequence: Synthetic oligonucleotide
gttgtcctctacagccatgtattcggctcc

SEQ ID NO: 123264 - DNA, 31 bp, Artificial Sequence
  Description of Artificial Sequence: Synthetic oligonucleotide
ttgtcctctacagccatgtattcggctcctg

SEQ ID NO: 123265 - DNA, 30 bp, Artificial Sequence
  Description of Artificial Sequence: Synthetic oligonucleotide
tgtcctctacagccatgtattcggctcctg

SEQ ID NO: 123266 - DNA, 29 bp, Artificial Sequence
  Description of Artificial Sequence: Synthetic oligonucleotide
gtcctctacagccatgtattcggctcctg

SEQ ID NO: 123267 - DNA, 29 bp, Artificial Sequence
  Description of Artificial Sequence: Synthetic oligonucleotide
tcctctacagccatgtattcggctcctgg

SEQ ID NO: 123268 - DNA, 28 bp, Artificial Sequence
  Description of Artificial Sequence: Synthetic oligonucleotide
cctctacagccatgtattcggctcctgg

SEQ ID NO: 123269 - DNA, 28 bp, Artificial Sequence
  Description of Artificial Sequence: Synthetic oligonucleotide
ctctacagccatgtattcggctcctggc

SEQ ID NO: 123270 - DNA, 29 bp, Artificial Sequence
  Description of Artificial Sequence: Synthetic oligonucleotide
tctacagccatgtattcggctcctggcag

SEQ ID NO: 123271 - DNA, 28 bp, Artificial Sequence
  Description of Artificial Sequence: Synthetic oligonucleotide
ctacagccatgtattcggctcctggcag

SEQ ID NO: 123272 - DNA, 29 bp, Artificial Sequence
  Description of Artificial Sequence: Synthetic oligonucleotide
tacagccatgtattcggctcctggcagag

SEQ ID NO: 123273 - DNA, 28 bp, Artificial Sequence
  Description of Artificial Sequence: Synthetic oligonucleotide
acagccatgtattcggctcctggcagag

SEQ ID NO: 123274 - DNA, 27 bp, Artificial Sequence
  Description of Artificial Sequence: Synthetic oligonucleotide
cagccatgtattcggctcctggcagag

SEQ ID NO: 123275 - DNA, 28 bp, Artificial Sequence
  Description of Artificial Sequence: Synthetic oligonucleotide
agccatgtattcggctcctggcagagac

SEQ ID NO: 123276 - DNA, 27 bp, Artificial Sequence
  Description of Artificial Sequence: Synthetic oligonucleotide
gccatgtattcggctcctggcagagac

SEQ ID NO: 123277 - DNA, 29 bp, Artificial Sequence
  Description of Artificial Sequence: Synthetic oligonucleotide
ccatgtattcggctcctggcagagacttg

SEQ ID NO: 123278 - DNA, 29 bp, Artificial Sequence
  Description of Artificial Sequence: Synthetic oligonucleotide
catgtattcggctcctggcagagacttgg

SEQ ID NO: 123279 - DNA, 29 bp, Artificial Sequence
  Description of Artificial Sequence: Synthetic oligonucleotide
atgtattcggctcctggcagagacttggg

SEQ ID NO: 123280 - DNA, 28 bp, Artificial Sequence
  Description of Artificial Sequence: Synthetic oligonucleotide
tgtattcggctcctggcagagacttggg

SEQ ID NO: 123281 - DNA, 27 bp, Artificial Sequence
  Description of Artificial Sequence: Synthetic oligonucleotide
gtattcggctcctggcagagacttggg

SEQ ID NO: 123282 - DNA, 27 bp, Artificial Sequence
  Description of Artificial Sequence: Synthetic oligonucleotide
tattcggctcctggcagagacttgggg

SEQ ID NO: 123283 - DNA, 27 bp, Artificial Sequence
  Description of Artificial Sequence: Synthetic oligonucleotide
attcggctcctggcagagacttgggga

SEQ ID NO: 123284 - DNA, 27 bp, Artificial Sequence
  Description of Artificial Sequence: Synthetic oligonucleotide
ttcggctcctggcagagacttggggat

SEQ ID NO: 123285 - DNA, 26 bp, Artificial Sequence
  Description of Artificial Sequence: Synthetic oligonucleotide
tcggctcctggcagagacttggggat

SEQ ID NO: 123286 - DNA, 25 bp, Artificial Sequence
  Description of Artificial Sequence: Synthetic oligonucleotide
cggctcctggcagagacttggggat

SEQ ID NO: 123287 - DNA, 25 bp, Artificial Sequence
  Description of Artificial Sequence: Synthetic oligonucleotide
ggctcctggcagagacttggggatg

SEQ ID NO: 123288 - DNA, 27 bp, Artificial Sequence
  Description of Artificial Sequence: Synthetic oligonucleotide
gctcctggcagagacttggggatggaa

SEQ ID NO: 123289 - DNA, 27 bp, Artificial Sequence
  Description of Artificial Sequence: Synthetic oligonucleotide
ctcctggcagagacttggggatggaac

SEQ ID NO: 123290 - DNA, 27 bp, Artificial Sequence
  Description of Artificial Sequence: Synthetic oligonucleotide
tcctggcagagacttggggatggaacc

SEQ ID NO: 123291 - DNA, 26 bp, Artificial Sequence
  Description of Artificial Sequence: Synthetic oligonucleotide
cctggcagagacttggggatggaacc

SEQ ID NO: 123292 - DNA, 26 bp, Artificial Sequence
  Description of Artificial Sequence: Synthetic oligonucleotide
ctggcagagacttggggatggaaccg

SEQ ID NO: 123293 - DNA, 27 bp, Artificial Sequence
  Description of Artificial Sequence: Synthetic oligonucleotide
tggcagagacttggggatggaaccgca

SEQ ID NO: 123294 - DNA, 26 bp, Artificial Sequence
  Description of Artificial Sequence: Synthetic oligonucleotide
ggcagagacttggggatggaaccgca

SEQ ID NO: 123295 - DNA, 27 bp, Artificial Sequence
  Description of Artificial Sequence: Synthetic oligonucleotide
gcagagacttggggatggaaccgcaca

SEQ ID NO: 123296 - DNA, 27 bp, Artificial Sequence
  Description of Artificial Sequence: Synthetic oligonucleotide
cagagacttggggatggaaccgcacag

SEQ ID NO: 123297 - DNA, 28 bp, Artificial Sequence
  Description of Artificial Sequence: Synthetic oligonucleotide
agagacttggggatggaaccgcacagag

SEQ ID NO: 123298 - DNA, 27 bp, Artificial Sequence
  Description of Artificial Sequence: Synthetic oligonucleotide
gagacttggggatggaaccgcacagag

SEQ ID NO: 123299 - DNA, 27 bp, Artificial Sequence
  Description of Artificial Sequence: Synthetic oligonucleotide
agacttggggatggaaccgcacagagc

SEQ ID NO: 123300 - DNA, 26 bp, Artificial Sequence
  Description of Artificial Sequence: Synthetic oligonucleotide
gacttggggatggaaccgcacagagc

SEQ ID NO: 123301 - DNA, 26 bp, Artificial Sequence
  Description of Artificial Sequence: Synthetic oligonucleotide
acttggggatggaaccgcacagagcc

SEQ ID NO: 123302 - DNA, 25 bp, Artificial Sequence
  Description of Artificial Sequence: Synthetic oligonucleotide
cttggggatggaaccgcacagagcc

SEQ ID NO: 123303 - DNA, 25 bp, Artificial Sequence
  Description of Artificial Sequence: Synthetic oligonucleotide
ttggggatggaaccgcacagagccg

SEQ ID NO: 123304 - DNA, 24 bp, Artificial Sequence
  Description of Artificial Sequence: Synthetic oligonucleotide
tggggatggaaccgcacagagccg

SEQ ID NO: 123305 - DNA, 23 bp, Artificial Sequence
  Description of Artificial Sequence: Synthetic oligonucleotide
ggggatggaaccgcacagagccg

SEQ ID NO: 123306 - DNA, 23 bp, Artificial Sequence
  Description of Artificial Sequence: Synthetic oligonucleotide
gggatggaaccgcacagagccgc

SEQ ID NO: 123307 - DNA, 23 bp, Artificial Sequence
  Description of Artificial Sequence: Synthetic oligonucleotide
ggatggaaccgcacagagccgcg

SEQ ID NO: 123308 - DNA, 23 bp, Artificial Sequence
  Description of Artificial Sequence: Synthetic oligonucleotide
gatggaaccgcacagagccgcgg

SEQ ID NO: 123309 - DNA, 23 bp, Artificial Sequence
  Description of Artificial Sequence: Synthetic oligonucleotide
atggaaccgcacagagccgcggg

SEQ ID NO: 123310 - DNA, 22 bp, Artificial Sequence
  Description of Artificial Sequence: Synthetic oligonucleotide
tggaaccgcacagagccgcggg

SEQ ID NO: 123311 - DNA, 21 bp, Artificial Sequence
  Description of Artificial Sequence: Synthetic oligonucleotide
ggaaccgcacagagccgcggg

SEQ ID NO: 123312 - DNA, 21 bp, Artificial Sequence
  Description of Artificial Sequence: Synthetic oligonucleotide
gaaccgcacagagccgcgggc

SEQ ID NO: 123313 - DNA, 21 bp, Artificial Sequence
  Description of Artificial Sequence: Synthetic oligonucleotide
aaccgcacagagccgcgggcc

SEQ ID NO: 123314 - DNA, 20 bp, Artificial Sequence
  Description of Artificial Sequence: Synthetic oligonucleotide
accgcacagagccgcgggcc

SEQ ID NO: 123315 - DNA, 20 bp, Artificial Sequence
  Description of Artificial Sequence: Synthetic oligonucleotide
ccgcacagagccgcgggcct

SEQ ID NO: 123316 - DNA, 22 bp, Artificial Sequence
  Description of Artificial Sequence: Synthetic oligonucleotide
cgcacagagccgcgggcccttt

SEQ ID NO: 123317 - DNA, 22 bp, Artificial Sequence
  Description of Artificial Sequence: Synthetic oligonucleotide
gcacagagccgcgggccctttg

SEQ ID NO: 123318 - DNA, 23 bp, Artificial Sequence
  Description of Artificial Sequence: Synthetic oligonucleotide
cacagagccgcgggccctttgca

SEQ ID NO: 123319 - DNA, 23 bp, Artificial Sequence
  Description of Artificial Sequence: Synthetic oligonucleotide
acagagccgcgggccctttgcag

SEQ ID NO: 123320 - DNA, 22 bp, Artificial Sequence
  Description of Artificial Sequence: Synthetic oligonucleotide
cagagccgcgggccctttgcag

SEQ ID NO: 123321 - DNA, 23 bp, Artificial Sequence
  Description of Artificial Sequence: Synthetic oligonucleotide
agagccgcgggccctttgcagct

SEQ ID NO: 123322 - DNA, 22 bp, Artificial Sequence
  Description of Artificial Sequence: Synthetic oligonucleotide
gagccgcgggccctttgcagct

SEQ ID NO: 123323 - DNA, 22 bp, Artificial Sequence
  Description of Artificial Sequence: Synthetic oligonucleotide
agccgcgggccctttgcagctg

SEQ ID NO: 123324 - DNA, 21 bp, Artificial Sequence
  Description of Artificial Sequence: Synthetic oligonucleotide
gccgcgggccctttgcagctg

SEQ ID NO: 123325 - DNA, 21 bp, Artificial Sequence
  Description of Artificial Sequence: Synthetic oligonucleotide
ccgcgggccctttgcagctgc

SEQ ID NO: 123326 - DNA, 26 bp, Artificial Sequence
  Description of Artificial Sequence: Synthetic oligonucleotide
cgcgggccctttgcagctgcgatttt

SEQ ID NO: 123327 - DNA, 26 bp, Artificial Sequence
  Description of Artificial Sequence: Synthetic oligonucleotide
gcgggccctttgcagctgcgattttc

SEQ ID NO: 123328 - DNA, 26 bp, Artificial Sequence
  Description of Artificial Sequence: Synthetic oligonucleotide
cgggccctttgcagctgcgattttcg

SEQ ID NO: 123329 - DNA, 26 bp, Artificial Sequence
  Description of Artificial Sequence: Synthetic oligonucleotide
gggccctttgcagctgcgattttcgc

SEQ ID NO: 123330 - DNA, 26 bp, Artificial Sequence
  Description of Artificial Sequence: Synthetic oligonucleotide
ggccctttgcagctgcgattttcgcc

SEQ ID NO: 123331 - DNA, 27 bp, Artificial Sequence
  Description of Artificial Sequence: Synthetic oligonucleotide
gccctttgcagctgcgattttcgccct

SEQ ID NO: 123332 - DNA, 28 bp, Artificial Sequence
  Description of Artificial Sequence: Synthetic oligonucleotide
ccctttgcagctgcgattttcgccctac

SEQ ID NO: 123333 - DNA, 28 bp, Artificial Sequence
  Description of Artificial Sequence: Synthetic oligonucleotide
cctttgcagctgcgattttcgccctacg

SEQ ID NO: 123334 - DNA, 32 bp, Artificial Sequence
  Description of Artificial Sequence: Synthetic oligonucleotide
ctttgcagctgcgattttcgccctacgttttc

SEQ ID NO: 123335 - DNA, 34 bp, Artificial Sequence
  Description of Artificial Sequence: Synthetic oligonucleotide
tttgcagctgcgattttcgccctacgttttcaac

SEQ ID NO: 123336 - DNA, 33 bp, Artificial Sequence
  Description of Artificial Sequence: Synthetic oligonucleotide
ttgcagctgcgattttcgccctacgttttcaac

SEQ ID NO: 123337 - DNA, 32 bp, Artificial Sequence
  Description of Artificial Sequence: Synthetic oligonucleotide
tgcagctgcgattttcgccctacgttttcaac

SEQ ID NO: 123338 - DNA, 31 bp, Artificial Sequence
  Description of Artificial Sequence: Synthetic oligonucleotide
gcagctgcgattttcgccctacgttttcaac

SEQ ID NO: 123339 - DNA, 31 bp, Artificial Sequence
  Description of Artificial Sequence: Synthetic oligonucleotide
cagctgcgattttcgccctacgttttcaacg

SEQ ID NO: 123340 - DNA, 31 bp, Artificial Sequence
  Description of Artificial Sequence: Synthetic oligonucleotide
agctgcgattttcgccctacgttttcaacgg

SEQ ID NO: 123341 - DNA, 30 bp, Artificial Sequence
  Description of Artificial Sequence: Synthetic oligonucleotide
gctgcgattttcgccctacgttttcaacgg

SEQ ID NO: 123342 - DNA, 31 bp, Artificial Sequence
  Description of Artificial Sequence: Synthetic oligonucleotide
ctgcgattttcgccctacgttttcaacggag

SEQ ID NO: 123343 - DNA, 31 bp, Artificial Sequence
  Description of Artificial Sequence: Synthetic oligonucleotide
tgcgattttcgccctacgttttcaacggagg

SEQ ID NO: 123344 - DNA, 30 bp, Artificial Sequence
  Description of Artificial Sequence: Synthetic oligonucleotide
gcgattttcgccctacgttttcaacggagg

SEQ ID NO: 123345 - DNA, 32 bp, Artificial Sequence
  Description of Artificial Sequence: Synthetic oligonucleotide
cgattttcgccctacgttttcaacggaggtac

SEQ ID NO: 123346 - DNA, 36 bp, Artificial Sequence
  Description of Artificial Sequence: Synthetic oligonucleotide
gattttcgccctacgttttcaacggaggtactatac

SEQ ID NO: 123347 - DNA, 37 bp, Artificial Sequence
  Description of Artificial Sequence: Synthetic oligonucleotide
attttcgccctacgttttcaacggaggtactatactg

SEQ ID NO: 123348 - DNA, 36 bp, Artificial Sequence
  Description of Artificial Sequence: Synthetic oligonucleotide
ttttcgccctacgttttcaacggaggtactatactg

SEQ ID NO: 123349 - DNA, 35 bp, Artificial Sequence
  Description of Artificial Sequence: Synthetic oligonucleotide
tttcgccctacgttttcaacggaggtactatactg

SEQ ID NO: 123350 - DNA, 34 bp, Artificial Sequence
  Description of Artificial Sequence: Synthetic oligonucleotide
ttcgccctacgttttcaacggaggtactatactg

SEQ ID NO: 123351 - DNA, 33 bp, Artificial Sequence
  Description of Artificial Sequence: Synthetic oligonucleotide
tcgccctacgttttcaacggaggtactatactg

SEQ ID NO: 123352 - DNA, 32 bp, Artificial Sequence
  Description of Artificial Sequence: Synthetic oligonucleotide
cgccctacgttttcaacggaggtactatactg

SEQ ID NO: 123353 - DNA, 32 bp, Artificial Sequence
  Description of Artificial Sequence: Synthetic oligonucleotide
gccctacgttttcaacggaggtactatactgg

SEQ ID NO: 123354 - DNA, 32 bp, Artificial Sequence
  Description of Artificial Sequence: Synthetic oligonucleotide
ccctacgttttcaacggaggtactatactggc

SEQ ID NO: 123355 - DNA, 36 bp, Artificial Sequence
  Description of Artificial Sequence: Synthetic oligonucleotide
cctacgttttcaacggaggtactatactggcaattg

SEQ ID NO: 123356 - DNA, 36 bp, Artificial Sequence
  Description of Artificial Sequence: Synthetic oligonucleotide
ctacgttttcaacggaggtactatactggcaattgc

SEQ ID NO: 123357 - DNA, 37 bp, Artificial Sequence
  Description of Artificial Sequence: Synthetic oligonucleotide
tacgttttcaacggaggtactatactggcaattgctg

SEQ ID NO: 123358 - DNA, 36 bp, Artificial Sequence
  Description of Artificial Sequence: Synthetic oligonucleotide
acgttttcaacggaggtactatactggcaattgctg

SEQ ID NO: 123359 - DNA, 35 bp, Artificial Sequence
  Description of Artificial Sequence: Synthetic oligonucleotide
cgttttcaacggaggtactatactggcaattgctg

SEQ ID NO: 123360 - DNA, 35 bp, Artificial Sequence
  Description of Artificial Sequence: Synthetic oligonucleotide
gttttcaacggaggtactatactggcaattgctgg

SEQ ID NO: 123361 - DNA, 36 bp, Artificial Sequence
  Description of Artificial Sequence: Synthetic oligonucleotide
ttttcaacggaggtactatactggcaattgctggag

SEQ ID NO: 123362 - DNA, 35 bp, Artificial Sequence
  Description of Artificial Sequence: Synthetic oligonucleotide
tttcaacggaggtactatactggcaattgctggag

SEQ ID NO: 123363 - DNA, 34 bp, Artificial Sequence
  Description of Artificial Sequence: Synthetic oligonucleotide
ttcaacggaggtactatactggcaattgctggag

SEQ ID NO: 123364 - DNA, 33 bp, Artificial Sequence
  Description of Artificial Sequence: Synthetic oligonucleotide
tcaacggaggtactatactggcaattgctggag

SEQ ID NO: 123365 - DNA, 32 bp, Artificial Sequence
  Description of Artificial Sequence: Synthetic oligonucleotide
caacggaggtactatactggcaattgctggag

SEQ ID NO: 123366 - DNA, 34 bp, Artificial Sequence
  Description of Artificial Sequence: Synthetic oligonucleotide
aacggaggtactatactggcaattgctggagaag

SEQ ID NO: 123367 - DNA, 33 bp, Artificial Sequence
  Description of Artificial Sequence: Synthetic oligonucleotide
acggaggtactatactggcaattgctggagaag

SEQ ID NO: 123368 - DNA, 32 bp, Artificial Sequence
  Description of Artificial Sequence: Synthetic oligonucleotide
cggaggtactatactggcaattgctggagaag

SEQ ID NO: 123369 - DNA, 37 bp, Artificial Sequence
  Description of Artificial Sequence: Synthetic oligonucleotide
ggaggtactatactggcaattgctggagaagattttg

SEQ ID NO: 123370 - DNA, 37 bp, Artificial Sequence
  Description of Artificial Sequence: Synthetic oligonucleotide
gaggtactatactggcaattgctggagaagattttgc

SEQ ID NO: 123371 - DNA, 41 bp, Artificial Sequence
  Description of Artificial Sequence: Synthetic oligonucleotide
aggtactatactggcaattgctggagaagattttgcaattg

SEQ ID NO: 123372 - DNA, 40 bp, Artificial Sequence
  Description of Artificial Sequence: Synthetic oligonucleotide
ggtactatactggcaattgctggagaagattttgcaattg

SEQ ID NO: 123373 - DNA, 42 bp, Artificial Sequence
  Description of Artificial Sequence: Synthetic oligonucleotide
gtactatactggcaattgctggagaagattttgcaattgttg

SEQ ID NO: 123374 - DNA, 42 bp, Artificial Sequence
  Description of Artificial Sequence: Synthetic oligonucleotide
tactatactggcaattgctggagaagattttgcaattgttgc

SEQ ID NO: 123375 - DNA, 41 bp, Artificial Sequence
  Description of Artificial Sequence: Synthetic oligonucleotide
actatactggcaattgctggagaagattttgcaattgttgc

SEQ ID NO: 123376 - DNA, 40 bp, Artificial Sequence
  Description of Artificial Sequence: Synthetic oligonucleotide
ctatactggcaattgctggagaagattttgcaattgttgc

SEQ ID NO: 123377 - DNA, 42 bp, Artificial Sequence
  Description of Artificial Sequence: Synthetic oligonucleotide
tatactggcaattgctggagaagattttgcaattgttgcttc

SEQ ID NO: 123378 - DNA, 41 bp, Artificial Sequence
  Description of Artificial Sequence: Synthetic oligonucleotide
atactggcaattgctggagaagattttgcaattgttgcttc

SEQ ID NO: 123379 - DNA, 40 bp, Artificial Sequence
  Description of Artificial Sequence: Synthetic oligonucleotide
tactggcaattgctggagaagattttgcaattgttgcttc

SEQ ID NO: 123380 - DNA, 39 bp, Artificial Sequence
  Description of Artificial Sequence: Synthetic oligonucleotide
actggcaattgctggagaagattttgcaattgttgcttc

SEQ ID NO: 123381 - DNA, 38 bp, Artificial Sequence
  Description of Artificial Sequence: Synthetic oligonucleotide
ctggcaattgctggagaagattttgcaattgttgcttc

SEQ ID NO: 123382 - DNA, 39 bp, Artificial Sequence
  Description of Artificial Sequence: Synthetic oligonucleotide
tggcaattgctggagaagattttgcaattgttgcttctg

SEQ ID NO: 123383 - DNA, 38 bp, Artificial Sequence
  Description of Artificial Sequence: Synthetic oligonucleotide
ggcaattgctggagaagattttgcaattgttgcttctg

SEQ ID NO: 123384 - DNA, 41 bp, Artificial Sequence
  Description of Artificial Sequence: Synthetic oligonucleotide
gcaattgctggagaagattttgcaattgttgcttctgatac

SEQ ID NO: 123385 - DNA, 42 bp, Artificial Sequence
  Description of Artificial Sequence: Synthetic oligonucleotide
caattgctggagaagattttgcaattgttgcttctgatactc

SEQ ID NO: 123386 - DNA, 42 bp, Artificial Sequence
  Description of Artificial Sequence: Synthetic oligonucleotide
aattgctggagaagattttgcaattgttgcttctgatactcg

SEQ ID NO: 123387 - DNA, 41 bp, Artificial Sequence
  Description of Artificial Sequence: Synthetic oligonucleotide
attgctggagaagattttgcaattgttgcttctgatactcg

SEQ ID NO: 123388 - DNA, 40 bp, Artificial Sequence
  Description of Artificial Sequence: Synthetic oligonucleotide
ttgctggagaagattttgcaattgttgcttctgatactcg

SEQ ID NO: 123389 - DNA, 39 bp, Artificial Sequence
  Description of Artificial Sequence: Synthetic oligonucleotide
tgctggagaagattttgcaattgttgcttctgatactcg

SEQ ID NO: 123390 - DNA, 38 bp, Artificial Sequence
  Description of Artificial Sequence: Synthetic oligonucleotide
gctggagaagattttgcaattgttgcttctgatactcg

SEQ ID NO: 123391 - DNA, 41 bp, Artificial Sequence
  Description of Artificial Sequence: Synthetic oligonucleotide
ctggagaagattttgcaattgttgcttctgatactcgattg

SEQ ID NO: 123392 - DNA, 42 bp, Artificial Sequence
  Description of Artificial Sequence: Synthetic oligonucleotide
tggagaagattttgcaattgttgcttctgatactcgattgag

SEQ ID NO: 123393 - DNA, 41 bp, Artificial Sequence
  Description of Artificial Sequence: Synthetic oligonucleotide
ggagaagattttgcaattgttgcttctgatactcgattgag

SEQ ID NO: 123394 - DNA, 42 bp, Artificial Sequence
  Description of Artificial Sequence: Synthetic oligonucleotide
gagaagattttgcaattgttgcttctgatactcgattgagtg

SEQ ID NO: 123395 - DNA, 44 bp, Artificial Sequence
  Description of Artificial Sequence: Synthetic oligonucleotide
agaagattttgcaattgttgcttctgatactcgattgagtgaag

SEQ ID NO: 123396 - DNA, 43 bp, Artificial Sequence
  Description of Artificial Sequence: Synthetic oligonucleotide
gaagattttgcaattgttgcttctgatactcgattgagtgaag

SEQ ID NO: 123397 - DNA, 43 bp, Artificial Sequence
  Description of Artificial Sequence: Synthetic oligonucleotide
aagattttgcaattgttgcttctgatactcgattgagtgaagg

SEQ ID NO: 123398 - DNA, 42 bp, Artificial Sequence
  Description of Artificial Sequence: Synthetic oligonucleotide
agattttgcaattgttgcttctgatactcgattgagtgaagg

SEQ ID NO: 123399 - DNA, 41 bp, Artificial Sequence
  Description of Artificial Sequence: Synthetic oligonucleotide
gattttgcaattgttgcttctgatactcgattgagtgaagg

SEQ ID NO: 123400 - DNA, 41 bp, Artificial Sequence
  Description of Artificial Sequence: Synthetic oligonucleotide
attttgcaattgttgcttctgatactcgattgagtgaaggg

SEQ ID NO: 123401 - DNA, 40 bp, Artificial Sequence
  Description of Artificial Sequence: Synthetic oligonucleotide
ttttgcaattgttgcttctgatactcgattgagtgaaggg

SEQ ID NO: 123402 - DNA, 39 bp, Artificial Sequence
  Description of Artificial Sequence: Synthetic oligonucleotide
tttgcaattgttgcttctgatactcgattgagtgaaggg

SEQ ID NO: 123403 - DNA, 38 bp, Artificial Sequence
  Description of Artificial Sequence: Synthetic oligonucleotide
ttgcaattgttgcttctgatactcgattgagtgaaggg

SEQ ID NO: 123404 - DNA, 37 bp, Artificial Sequence
  Description of Artificial Sequence: Synthetic oligonucleotide
tgcaattgttgcttctgatactcgattgagtgaaggg

SEQ ID NO: 123405 - DNA, 36 bp, Artificial Sequence
  Description of Artificial Sequence: Synthetic oligonucleotide
gcaattgttgcttctgatactcgattgagtgaaggg

SEQ ID NO: 123406 - DNA, 40 bp, Artificial Sequence
  Description of Artificial Sequence: Synthetic oligonucleotide
caattgttgcttctgatactcgattgagtgaagggttttc

SEQ ID NO: 123407 - DNA, 44 bp, Artificial Sequence
  Description of Artificial Sequence: Synthetic oligonucleotide
aattgttgcttctgatactcgattgagtgaagggttttcaattc

SEQ ID NO: 123408 - DNA, 43 bp, Artificial Sequence
  Description of Artificial Sequence: Synthetic oligonucleotide
attgttgcttctgatactcgattgagtgaagggttttcaattc

SEQ ID NO: 123409 - DNA, 42 bp, Artificial Sequence
  Description of Artificial Sequence: Synthetic oligonucleotide
ttgttgcttctgatactcgattgagtgaagggttttcaattc

SEQ ID NO: 123410 - DNA, 41 bp, Artificial Sequence
  Description of Artificial Sequence: Synthetic oligonucleotide
tgttgcttctgatactcgattgagtgaagggttttcaattc

SEQ ID NO: 123411 - DNA, 40 bp, Artificial Sequence
  Description of Artificial Sequence: Synthetic oligonucleotide
gttgcttctgatactcgattgagtgaagggttttcaattc

SEQ ID NO: 123412 - DNA, 43 bp, Artificial Sequence
  Description of Artificial Sequence: Synthetic oligonucleotide
ttgcttctgatactcgattgagtgaagggttttcaattcatac

SEQ ID NO: 123413 - DNA, 42 bp, Artificial Sequence
  Description of Artificial Sequence: Synthetic oligonucleotide
tgcttctgatactcgattgagtgaagggttttcaattcatac

SEQ ID NO: 123414 - DNA, 41 bp, Artificial Sequence
  Description of Artificial Sequence: Synthetic oligonucleotide
gcttctgatactcgattgagtgaagggttttcaattcatac

SEQ ID NO: 123415 - DNA, 41 bp, Artificial Sequence
  Description of Artificial Sequence: Synthetic oligonucleotide
cttctgatactcgattgagtgaagggttttcaattcatacg

SEQ ID NO: 123416 - DNA, 41 bp, Artificial Sequence
  Description of Artificial Sequence: Synthetic oligonucleotide
ttctgatactcgattgagtgaagggttttcaattcatacgc

SEQ ID NO: 123417 - DNA, 40 bp, Artificial Sequence
  Description of Artificial Sequence: Synthetic oligonucleotide
tctgatactcgattgagtgaagggttttcaattcatacgc

SEQ ID NO: 123418 - DNA, 39 bp, Artificial Sequence
  Description of Artificial Sequence: Synthetic oligonucleotide
ctgatactcgattgagtgaagggttttcaattcatacgc

SEQ ID NO: 123419 - DNA, 39 bp, Artificial Sequence
  Description of Artificial Sequence: Synthetic oligonucleotide
tgatactcgattgagtgaagggttttcaattcatacgcg

SEQ ID NO: 123420 - DNA, 38 bp, Artificial Sequence
  Description of Artificial Sequence: Synthetic oligonucleotide
gatactcgattgagtgaagggttttcaattcatacgcg

SEQ ID NO: 123421 - DNA, 38 bp, Artificial Sequence
  Description of Artificial Sequence: Synthetic oligonucleotide
atactcgattgagtgaagggttttcaattcatacgcgg

SEQ ID NO: 123422 - DNA, 37 bp, Artificial Sequence
  Description of Artificial Sequence: Synthetic oligonucleotide
tactcgattgagtgaagggttttcaattcatacgcgg

SEQ ID NO: 123423 - DNA, 36 bp, Artificial Sequence
  Description of Artificial Sequence: Synthetic oligonucleotide
actcgattgagtgaagggttttcaattcatacgcgg

SEQ ID NO: 123424 - DNA, 35 bp, Artificial Sequence
  Description of Artificial Sequence: Synthetic oligonucleotide
ctcgattgagtgaagggttttcaattcatacgcgg

SEQ ID NO: 123425 - DNA, 35 bp, Artificial Sequence
  Description of Artificial Sequence: Synthetic oligonucleotide
tcgattgagtgaagggttttcaattcatacgcggg

SEQ ID NO: 123426 - DNA, 34 bp, Artificial Sequence
  Description of Artificial Sequence: Synthetic oligonucleotide
cgattgagtgaagggttttcaattcatacgcggg

SEQ ID NO: 123427 - DNA, 37 bp, Artificial Sequence
  Description of Artificial Sequence: Synthetic oligonucleotide
gattgagtgaagggttttcaattcatacgcgggatag

SEQ ID NO: 123428 - DNA, 37 bp, Artificial Sequence
  Description of Artificial Sequence: Synthetic oligonucleotide
attgagtgaagggttttcaattcatacgcgggatagc

SEQ ID NO: 123429 - DNA, 36 bp, Artificial Sequence
  Description of Artificial Sequence: Synthetic oligonucleotide
ttgagtgaagggttttcaattcatacgcgggatagc

SEQ ID NO: 123430 - DNA, 35 bp, Artificial Sequence
  Description of Artificial Sequence: Synthetic oligonucleotide
tgagtgaagggttttcaattcatacgcgggatagc

SEQ ID NO: 123431 - DNA, 34 bp, Artificial Sequence
  Description of Artificial Sequence: Synthetic oligonucleotide
gagtgaagggttttcaattcatacgcgggatagc

SEQ ID NO: 123432 - DNA, 34 bp, Artificial Sequence
  Description of Artificial Sequence: Synthetic oligonucleotide
agtgaagggttttcaattcatacgcgggatagcc

SEQ ID NO: 123433 - DNA, 33 bp, Artificial Sequence
  Description of Artificial Sequence: Synthetic oligonucleotide
gtgaagggttttcaattcatacgcgggatagcc

SEQ ID NO: 123434 - DNA, 33 bp, Artificial Sequence
  Description of Artificial Sequence: Synthetic oligonucleotide
tgaagggttttcaattcatacgcgggatagccc

SEQ ID NO: 123435 - DNA, 32 bp, Artificial Sequence
  Description of Artificial Sequence: Synthetic oligonucleotide
gaagggttttcaattcatacgcgggatagccc

SEQ ID NO: 123436 - DNA, 32 bp, Artificial Sequence
  Description of Artificial Sequence: Synthetic oligonucleotide
aagggttttcaattcatacgcgggatagcccc

SEQ ID NO: 123437 - DNA, 31 bp, Artificial Sequence
  Description of Artificial Sequence: Synthetic oligonucleotide
agggttttcaattcatacgcgggatagcccc

SEQ ID NO: 123438 - DNA, 30 bp, Artificial Sequence
  Description of Artificial Sequence: Synthetic oligonucleotide
gggttttcaattcatacgcgggatagcccc

SEQ ID NO: 123439 - DNA, 34 bp, Artificial Sequence
  Description of Artificial Sequence: Synthetic oligonucleotide
ggttttcaattcatacgcgggatagccccaaatg

SEQ ID NO: 123440 - DNA, 37 bp, Artificial Sequence
  Description of Artificial Sequence: Synthetic oligonucleotide
gttttcaattcatacgcgggatagccccaaatgttac

SEQ ID NO: 123441 - DNA, 44 bp, Artificial Sequence
  Description of Artificial Sequence: Synthetic oligonucleotide
ttttcaattcatacgcgggatagccccaaatgttacaaattaac

SEQ ID NO: 123442 - DNA, 43 bp, Artificial Sequence
  Description of Artificial Sequence: Synthetic oligonucleotide
tttcaattcatacgcgggatagccccaaatgttacaaattaac

SEQ ID NO: 123443 - DNA, 42 bp, Artificial Sequence
  Description of Artificial Sequence: Synthetic oligonucleotide
ttcaattcatacgcgggatagccccaaatgttacaaattaac

SEQ ID NO: 123444 - DNA, 41 bp, Artificial Sequence
  Description of Artificial Sequence: Synthetic oligonucleotide
tcaattcatacgcgggatagccccaaatgttacaaattaac

SEQ ID NO: 123445 - DNA, 40 bp, Artificial Sequence
  Description of Artificial Sequence: Synthetic oligonucleotide
caattcatacgcgggatagccccaaatgttacaaattaac

SEQ ID NO: 123446 - DNA, 41 bp, Artificial Sequence
  Description of Artificial Sequence: Synthetic oligonucleotide
aattcatacgcgggatagccccaaatgttacaaattaacag

SEQ ID NO: 123447 - DNA, 40 bp, Artificial Sequence
  Description of Artificial Sequence: Synthetic oligonucleotide
attcatacgcgggatagccccaaatgttacaaattaacag

SEQ ID NO: 123448 - DNA, 39 bp, Artificial Sequence
  Description of Artificial Sequence: Synthetic oligonucleotide
ttcatacgcgggatagccccaaatgttacaaattaacag

SEQ ID NO: 123449 - DNA, 38 bp, Artificial Sequence
  Description of Artificial Sequence: Synthetic oligonucleotide
tcatacgcgggatagccccaaatgttacaaattaacag

SEQ ID NO: 123450 - DNA, 37 bp, Artificial Sequence
  Description of Artificial Sequence: Synthetic oligonucleotide
catacgcgggatagccccaaatgttacaaattaacag

SEQ ID NO: 123451 - DNA, 38 bp, Artificial Sequence
  Description of Artificial Sequence: Synthetic oligonucleotide
atacgcgggatagccccaaatgttacaaattaacagac

SEQ ID NO: 123452 - DNA, 37 bp, Artificial Sequence
  Description of Artificial Sequence: Synthetic oligonucleotide
tacgcgggatagccccaaatgttacaaattaacagac

SEQ ID NO: 123453 - DNA, 36 bp, Artificial Sequence
  Description of Artificial Sequence: Synthetic oligonucleotide
acgcgggatagccccaaatgttacaaattaacagac

SEQ ID NO: 123454 - DNA, 35 bp, Artificial Sequence
  Description of Artificial Sequence: Synthetic oligonucleotide
cgcgggatagccccaaatgttacaaattaacagac

SEQ ID NO: 123455 - DNA, 39 bp, Artificial Sequence
  Description of Artificial Sequence: Synthetic oligonucleotide
gcgggatagccccaaatgttacaaattaacagacaaaac

SEQ ID NO: 123456 - DNA, 40 bp, Artificial Sequence
  Description of Artificial Sequence: Synthetic oligonucleotide
cgggatagccccaaatgttacaaattaacagacaaaacag

SEQ ID NO: 123457 - DNA, 41 bp, Artificial Sequence
  Description of Artificial Sequence: Synthetic oligonucleotide
gggatagccccaaatgttacaaattaacagacaaaacagtc

SEQ ID NO: 123458 - DNA, 44 bp, Artificial Sequence
  Description of Artificial Sequence: Synthetic oligonucleotide
ggatagccccaaatgttacaaattaacagacaaaacagtcattg

SEQ ID NO: 123459 - DNA, 44 bp, Artificial Sequence
  Description of Artificial Sequence: Synthetic oligonucleotide
gatagccccaaatgttacaaattaacagacaaaacagtcattgg

SEQ ID NO: 123460 - DNA, 46 bp, Artificial Sequence
  Description of Artificial Sequence: Synthetic oligonucleotide
atagccccaaatgttacaaattaacagacaaaacagtcattggatg

SEQ ID NO: 123461 - DNA, 45 bp, Artificial Sequence
  Description of Artificial Sequence: Synthetic oligonucleotide
tagccccaaatgttacaaattaacagacaaaacagtcattggatg

SEQ ID NO: 123462 - DNA, 44 bp, Artificial Sequence
  Description of Artificial Sequence: Synthetic oligonucleotide
agccccaaatgttacaaattaacagacaaaacagtcattggatg

SEQ ID NO: 123463 - DNA, 43 bp, Artificial Sequence
  Description of Artificial Sequence: Synthetic oligonucleotide
gccccaaatgttacaaattaacagacaaaacagtcattggatg

SEQ ID NO: 123464 - DNA, 43 bp, Artificial Sequence
  Description of Artificial Sequence: Synthetic oligonucleotide
ccccaaatgttacaaattaacagacaaaacagtcattggatgc

SEQ ID NO: 123465 - DNA, 44 bp, Artificial Sequence
  Description of Artificial Sequence: Synthetic oligonucleotide
cccaaatgttacaaattaacagacaaaacagtcattggatgcag

SEQ ID NO: 123466 - DNA, 44 bp, Artificial Sequence
  Description of Artificial Sequence: Synthetic oligonucleotide
ccaaatgttacaaattaacagacaaaacagtcattggatgcagc

SEQ ID NO: 123467 - DNA, 44 bp, Artificial Sequence
  Description of Artificial Sequence: Synthetic oligonucleotide
caaatgttacaaattaacagacaaaacagtcattggatgcagcg

SEQ ID NO: 123468 - DNA, 44 bp, Artificial Sequence
  Description of Artificial Sequence: Synthetic oligonucleotide
aaatgttacaaattaacagacaaaacagtcattggatgcagcgg

SEQ ID NO: 123469 - DNA, 43 bp, Artificial Sequence
  Description of Artificial Sequence: Synthetic oligonucleotide
aatgttacaaattaacagacaaaacagtcattggatgcagcgg

SEQ ID NO: 123470 - DNA, 42 bp, Artificial Sequence
  Description of Artificial Sequence: Synthetic oligonucleotide
atgttacaaattaacagacaaaacagtcattggatgcagcgg

SEQ ID NO: 123471 - DNA, 41 bp, Artificial Sequence
  Description of Artificial Sequence: Synthetic oligonucleotide
tgttacaaattaacagacaaaacagtcattggatgcagcgg

SEQ ID NO: 123472 - DNA, 40 bp, Artificial Sequence
  Description of Artificial Sequence: Synthetic oligonucleotide
gttacaaattaacagacaaaacagtcattggatgcagcgg

SEQ ID NO: 123473 - DNA, 44 bp, Artificial Sequence
  Description of Artificial Sequence: Synthetic oligonucleotide
ttacaaattaacagacaaaacagtcattggatgcagcggttttc

SEQ ID NO: 123474 - DNA, 43 bp, Artificial Sequence
  Description of Artificial Sequence: Synthetic oligonucleotide
tacaaattaacagacaaaacagtcattggatgcagcggttttc

SEQ ID NO: 123475 - DNA, 42 bp, Artificial Sequence
  Description of Artificial Sequence: Synthetic oligonucleotide
acaaattaacagacaaaacagtcattggatgcagcggttttc

SEQ ID NO: 123476 - DNA, 41 bp, Artificial Sequence
  Description of Artificial Sequence: Synthetic oligonucleotide
caaattaacagacaaaacagtcattggatgcagcggttttc

SEQ ID NO: 123477 - DNA, 43 bp, Artificial Sequence
  Description of Artificial Sequence: Synthetic oligonucleotide
aaattaacagacaaaacagtcattggatgcagcggttttcatg

SEQ ID NO: 123478 - DNA, 42 bp, Artificial Sequence
  Description of Artificial Sequence: Synthetic oligonucleotide
aattaacagacaaaacagtcattggatgcagcggttttcatg

SEQ ID NO: 123479 - DNA, 41 bp, Artificial Sequence
  Description of Artificial Sequence: Synthetic oligonucleotide
attaacagacaaaacagtcattggatgcagcggttttcatg

SEQ ID NO: 123480 - DNA, 40 bp, Artificial Sequence
  Description of Artificial Sequence: Synthetic oligonucleotide
ttaacagacaaaacagtcattggatgcagcggttttcatg

SEQ ID NO: 123481 - DNA, 39 bp, Artificial Sequence
  Description of Artificial Sequence: Synthetic oligonucleotide
taacagacaaaacagtcattggatgcagcggttttcatg

SEQ ID NO: 123482 - DNA, 38 bp, Artificial Sequence
  Description of Artificial Sequence: Synthetic oligonucleotide
aacagacaaaacagtcattggatgcagcggttttcatg

SEQ ID NO: 123483 - DNA, 37 bp, Artificial Sequence
  Description of Artificial Sequence: Synthetic oligonucleotide
acagacaaaacagtcattggatgcagcggttttcatg

SEQ ID NO: 123484 - DNA, 36 bp, Artificial Sequence
  Description of Artificial Sequence: Synthetic oligonucleotide
cagacaaaacagtcattggatgcagcggttttcatg

SEQ ID NO: 123485 - DNA, 36 bp, Artificial Sequence
  Description of Artificial Sequence: Synthetic oligonucleotide
agacaaaacagtcattggatgcagcggttttcatgg

SEQ ID NO: 123486 - DNA, 35 bp, Artificial Sequence
  Description of Artificial Sequence: Synthetic oligonucleotide
gacaaaacagtcattggatgcagcggttttcatgg

SEQ ID NO: 123487 - DNA, 36 bp, Artificial Sequence
  Description of Artificial Sequence: Synthetic oligonucleotide
acaaaacagtcattggatgcagcggttttcatggag

SEQ ID NO: 123488 - DNA, 35 bp, Artificial Sequence
  Description of Artificial Sequence: Synthetic oligonucleotide
caaaacagtcattggatgcagcggttttcatggag

SEQ ID NO: 123489 - DNA, 36 bp, Artificial Sequence
  Description of Artificial Sequence: Synthetic oligonucleotide
aaaacagtcattggatgcagcggttttcatggagac

SEQ ID NO: 123490 - DNA, 35 bp, Artificial Sequence
  Description of Artificial Sequence: Synthetic oligonucleotide
aaacagtcattggatgcagcggttttcatggagac

SEQ ID NO: 123491 - DNA, 34 bp, Artificial Sequence
  Description of Artificial Sequence: Synthetic oligonucleotide
aacagtcattggatgcagcggttttcatggagac

SEQ ID NO: 123492 - DNA, 33 bp, Artificial Sequence
  Description of Artificial Sequence: Synthetic oligonucleotide
acagtcattggatgcagcggttttcatggagac

SEQ ID NO: 123493 - DNA, 32 bp, Artificial Sequence
  Description of Artificial Sequence: Synthetic oligonucleotide
cagtcattggatgcagcggttttcatggagac

SEQ ID NO: 123494 - DNA, 33 bp, Artificial Sequence
  Description of Artificial Sequence: Synthetic oligonucleotide
agtcattggatgcagcggttttcatggagactg

SEQ ID NO: 123495 - DNA, 32 bp, Artificial Sequence
  Description of Artificial Sequence: Synthetic oligonucleotide
gtcattggatgcagcggttttcatggagactg

SEQ ID NO: 123496 - DNA, 33 bp, Artificial Sequence
  Description of Artificial Sequence: Synthetic oligonucleotide
tcattggatgcagcggttttcatggagactgtc

SEQ ID NO: 123497 - DNA, 32 bp, Artificial Sequence
  Description of Artificial Sequence: Synthetic oligonucleotide
cattggatgcagcggttttcatggagactgtc

SEQ ID NO: 123498 - DNA, 35 bp, Artificial Sequence
  Description of Artificial Sequence: Synthetic oligonucleotide
attggatgcagcggttttcatggagactgtcttac

SEQ ID NO: 123499 - DNA, 34 bp, Artificial Sequence
  Description of Artificial Sequence: Synthetic oligonucleotide
ttggatgcagcggttttcatggagactgtcttac

SEQ ID NO: 123500 - DNA, 33 bp, Artificial Sequence
  Description of Artificial Sequence: Synthetic oligonucleotide
tggatgcagcggttttcatggagactgtcttac

SEQ ID NO: 123501 - DNA, 32 bp, Artificial Sequence
  Description of Artificial Sequence: Synthetic oligonucleotide
ggatgcagcggttttcatggagactgtcttac

SEQ ID NO: 123502 - DNA, 32 bp, Artificial Sequence
  Description of Artificial Sequence: Synthetic oligonucleotide
gatgcagcggttttcatggagactgtcttacg

SEQ ID NO: 123503 - DNA, 32 bp, Artificial Sequence
  Description of Artificial Sequence: Synthetic oligonucleotide
atgcagcggttttcatggagactgtcttacgc

SEQ ID NO: 123504 - DNA, 31 bp, Artificial Sequence
  Description of Artificial Sequence: Synthetic oligonucleotide
tgcagcggttttcatggagactgtcttacgc

SEQ ID NO: 123505 - DNA, 30 bp, Artificial Sequence
  Description of Artificial Sequence: Synthetic oligonucleotide
gcagcggttttcatggagactgtcttacgc

SEQ ID NO: 123506 - DNA, 31 bp, Artificial Sequence
  Description of Artificial Sequence: Synthetic oligonucleotide
cagcggttttcatggagactgtcttacgctg

SEQ ID NO: 123507 - DNA, 32 bp, Artificial Sequence
  Description of Artificial Sequence: Synthetic oligonucleotide
agcggttttcatggagactgtcttacgctgac

SEQ ID NO: 123508 - DNA, 31 bp, Artificial Sequence
  Description of Artificial Sequence: Synthetic oligonucleotide
gcggttttcatggagactgtcttacgctgac

SEQ ID NO: 123509 - DNA, 34 bp, Artificial Sequence
  Description of Artificial Sequence: Synthetic oligonucleotide
cggttttcatggagactgtcttacgctgacaaag

SEQ ID NO: 123510 - DNA, 40 bp, Artificial Sequence
  Description of Artificial Sequence: Synthetic oligonucleotide
ggttttcatggagactgtcttacgctgacaaagattattg

SEQ ID NO: 123511 - DNA, 42 bp, Artificial Sequence
  Description of Artificial Sequence: Synthetic oligonucleotide
gttttcatggagactgtcttacgctgacaaagattattgaag

SEQ ID NO: 123512 - DNA, 42 bp, Artificial Sequence
  Description of Artificial Sequence: Synthetic oligonucleotide
ttttcatggagactgtcttacgctgacaaagattattgaagc

SEQ ID NO: 123513 - DNA, 41 bp, Artificial Sequence
  Description of Artificial Sequence: Synthetic oligonucleotide
tttcatggagactgtcttacgctgacaaagattattgaagc

SEQ ID NO: 123514 - DNA, 40 bp, Artificial Sequence
  Description of Artificial Sequence: Synthetic oligonucleotide
ttcatggagactgtcttacgctgacaaagattattgaagc

SEQ ID NO: 123515 - DNA, 39 bp, Artificial Sequence
  Description of Artificial Sequence: Synthetic oligonucleotide
tcatggagactgtcttacgctgacaaagattattgaagc

SEQ ID NO: 123516 - DNA, 38 bp, Artificial Sequence
  Description of Artificial Sequence: Synthetic oligonucleotide
catggagactgtcttacgctgacaaagattattgaagc

SEQ ID NO: 123517 - DNA, 40 bp, Artificial Sequence
  Description of Artificial Sequence: Synthetic oligonucleotide
atggagactgtcttacgctgacaaagattattgaagcaag

SEQ ID NO: 123518 - DNA, 39 bp, Artificial Sequence
  Description of Artificial Sequence: Synthetic oligonucleotide
tggagactgtcttacgctgacaaagattattgaagcaag

SEQ ID NO: 123519 - DNA, 38 bp, Artificial Sequence
  Description of Artificial Sequence: Synthetic oligonucleotide
ggagactgtcttacgctgacaaagattattgaagcaag

SEQ ID NO: 123520 - DNA, 39 bp, Artificial Sequence
  Description of Artificial Sequence: Synthetic oligonucleotide
gagactgtcttacgctgacaaagattattgaagcaagac

SEQ ID NO: 123521 - DNA, 43 bp, Artificial Sequence
  Description of Artificial Sequence: Synthetic oligonucleotide
agactgtcttacgctgacaaagattattgaagcaagactaaag

SEQ ID NO: 123522 - DNA, 42 bp, Artificial Sequence
  Description of Artificial Sequence: Synthetic oligonucleotide
gactgtcttacgctgacaaagattattgaagcaagactaaag

SEQ ID NO: 123523 - DNA, 44 bp, Artificial Sequence
  Description of Artificial Sequence: Synthetic oligonucleotide
actgtcttacgctgacaaagattattgaagcaagactaaagatg

SEQ ID NO: 123524 - DNA, 43 bp, Artificial Sequence
  Description of Artificial Sequence: Synthetic oligonucleotide
ctgtcttacgctgacaaagattattgaagcaagactaaagatg

SEQ ID NO: 123525 - DNA, 48 bp, Artificial Sequence
  Description of Artificial Sequence: Synthetic oligonucleotide
tgtcttacgctgacaaagattattgaagcaagactaaagatgtataag

SEQ ID NO: 123526 - DNA, 47 bp, Artificial Sequence
  Description of Artificial Sequence: Synthetic oligonucleotide
gtcttacgctgacaaagattattgaagcaagactaaagatgtataag

SEQ ID NO: 123527 - DNA, 47 bp, Artificial Sequence
  Description of Artificial Sequence: Synthetic oligonucleotide
tcttacgctgacaaagattattgaagcaagactaaagatgtataagc

SEQ ID NO: 123528 - DNA, 46 bp, Artificial Sequence
  Description of Artificial Sequence: Synthetic oligonucleotide
cttacgctgacaaagattattgaagcaagactaaagatgtataagc

SEQ ID NO: 123529 - DNA, 49 bp, Artificial Sequence
  Description of Artificial Sequence: Synthetic oligonucleotide
ttacgctgacaaagattattgaagcaagactaaagatgtataagcattc

SEQ ID NO: 123530 - DNA, 48 bp, Artificial Sequence
  Description of Artificial Sequence: Synthetic oligonucleotide
tacgctgacaaagattattgaagcaagactaaagatgtataagcattc

SEQ ID NO: 123531 - DNA, 47 bp, Artificial Sequence
  Description of Artificial Sequence: Synthetic oligonucleotide
acgctgacaaagattattgaagcaagactaaagatgtataagcattc

SEQ ID NO: 123532 - DNA, 46 bp, Artificial Sequence
  Description of Artificial Sequence: Synthetic oligonucleotide
cgctgacaaagattattgaagcaagactaaagatgtataagcattc

SEQ ID NO: 123533 - DNA, 46 bp, Artificial Sequence
  Description of Artificial Sequence: Synthetic oligonucleotide
gctgacaaagattattgaagcaagactaaagatgtataagcattcc

SEQ ID NO: 123534 - DNA, 54 bp, Artificial Sequence
  Description of Artificial Sequence: Synthetic oligonucleotide
ctgacaaagattattgaagcaagactaaagatgtataagcattccaataataag

SEQ ID NO: 123535 - DNA, 54 bp, Artificial Sequence
  Description of Artificial Sequence: Synthetic oligonucleotide
tgacaaagattattgaagcaagactaaagatgtataagcattccaataataagg

SEQ ID NO: 123536 - DNA, 53 bp, Artificial Sequence
  Description of Artificial Sequence: Synthetic oligonucleotide
gacaaagattattgaagcaagactaaagatgtataagcattccaataataagg

SEQ ID NO: 123537 - DNA, 53 bp, Artificial Sequence
  Description of Artificial Sequence: Synthetic oligonucleotide
acaaagattattgaagcaagactaaagatgtataagcattccaataataaggc

SEQ ID NO: 123538 - DNA, 52 bp, Artificial Sequence
  Description of Artificial Sequence: Synthetic oligonucleotide
caaagattattgaagcaagactaaagatgtataagcattccaataataaggc

SEQ ID NO: 123539 - DNA, 52 bp, Artificial Sequence
  Description of Artificial Sequence: Synthetic oligonucleotide
aaagattattgaagcaagactaaagatgtataagcattccaataataaggcc

SEQ ID NO: 123540 - DNA, 51 bp, Artificial Sequence
  Description of Artificial Sequence: Synthetic oligonucleotide
aagattattgaagcaagactaaagatgtataagcattccaataataaggcc

SEQ ID NO: 123541 - DNA, 50 bp, Artificial Sequence
  Description of Artificial Sequence: Synthetic oligonucleotide
agattattgaagcaagactaaagatgtataagcattccaataataaggcc

SEQ ID NO: 123542 - DNA, 49 bp, Artificial Sequence
  Description of Artificial Sequence: Synthetic oligonucleotide
gattattgaagcaagactaaagatgtataagcattccaataataaggcc

SEQ ID NO: 123543 - DNA, 51 bp, Artificial Sequence
  Description of Artificial Sequence: Synthetic oligonucleotide
attattgaagcaagactaaagatgtataagcattccaataataaggccatg

SEQ ID NO: 123544 - DNA, 50 bp, Artificial Sequence
  Description of Artificial Sequence: Synthetic oligonucleotide
ttattgaagcaagactaaagatgtataagcattccaataataaggccatg

SEQ ID NO: 123545 - DNA, 49 bp, Artificial Sequence
  Description of Artificial Sequence: Synthetic oligonucleotide
tattgaagcaagactaaagatgtataagcattccaataataaggccatg

SEQ ID NO: 123546 - DNA, 48 bp, Artificial Sequence
  Description of Artificial Sequence: Synthetic oligonucleotide
attgaagcaagactaaagatgtataagcattccaataataaggccatg

SEQ ID NO: 123547 - DNA, 47 bp, Artificial Sequence
  Description of Artificial Sequence: Synthetic oligonucleotide
ttgaagcaagactaaagatgtataagcattccaataataaggccatg

SEQ ID NO: 123548 - DNA, 46 bp, Artificial Sequence
  Description of Artificial Sequence: Synthetic oligonucleotide
tgaagcaagactaaagatgtataagcattccaataataaggccatg

SEQ ID NO: 123549 - DNA, 45 bp, Artificial Sequence
  Description of Artificial Sequence: Synthetic oligonucleotide
gaagcaagactaaagatgtataagcattccaataataaggccatg

SEQ ID NO: 123550 - DNA, 46 bp, Artificial Sequence
  Description of Artificial Sequence: Synthetic oligonucleotide
aagcaagactaaagatgtataagcattccaataataaggccatgac

SEQ ID NO: 123551 - DNA, 45 bp, Artificial Sequence
  Description of Artificial Sequence: Synthetic oligonucleotide
agcaagactaaagatgtataagcattccaataataaggccatgac

SEQ ID NO: 123552 - DNA, 44 bp, Artificial Sequence
  Description of Artificial Sequence: Synthetic oligonucleotide
gcaagactaaagatgtataagcattccaataataaggccatgac

SEQ ID NO: 123553 - DNA, 46 bp, Artificial Sequence
  Description of Artificial Sequence: Synthetic oligonucleotide
caagactaaagatgtataagcattccaataataaggccatgactac

SEQ ID NO: 123554 - DNA, 46 bp, Artificial Sequence
  Description of Artificial Sequence: Synthetic oligonucleotide
aagactaaagatgtataagcattccaataataaggccatgactacg

SEQ ID NO: 123555 - DNA, 45 bp, Artificial Sequence
  Description of Artificial Sequence: Synthetic oligonucleotide
agactaaagatgtataagcattccaataataaggccatgactacg

SEQ ID NO: 123556 - DNA, 44 bp, Artificial Sequence
  Description of Artificial Sequence: Synthetic oligonucleotide
gactaaagatgtataagcattccaataataaggccatgactacg

SEQ ID NO: 123557 - DNA, 44 bp, Artificial Sequence
  Description of Artificial Sequence: Synthetic oligonucleotide
actaaagatgtataagcattccaataataaggccatgactacgg

SEQ ID NO: 123558 - DNA, 43 bp, Artificial Sequence
  Description of Artificial Sequence: Synthetic oligonucleotide
ctaaagatgtataagcattccaataataaggccatgactacgg

SEQ ID NO: 123559 - DNA, 43 bp, Artificial Sequence
  Description of Artificial Sequence: Synthetic oligonucleotide
taaagatgtataagcattccaataataaggccatgactacggg

SEQ ID NO: 123560 - DNA, 42 bp, Artificial Sequence
  Description of Artificial Sequence: Synthetic oligonucleotide
aaagatgtataagcattccaataataaggccatgactacggg

SEQ ID NO: 123561 - DNA, 41 bp, Artificial Sequence
  Description of Artificial Sequence: Synthetic oligonucleotide
aagatgtataagcattccaataataaggccatgactacggg

SEQ ID NO: 123562 - DNA, 40 bp, Artificial Sequence
  Description of Artificial Sequence: Synthetic oligonucleotide
agatgtataagcattccaataataaggccatgactacggg

SEQ ID NO: 123563 - DNA, 39 bp, Artificial Sequence
  Description of Artificial Sequence: Synthetic oligonucleotide
gatgtataagcattccaataataaggccatgactacggg

SEQ ID NO: 123564 - DNA, 39 bp, Artificial Sequence
  Description of Artificial Sequence: Synthetic oligonucleotide
atgtataagcattccaataataaggccatgactacgggg

SEQ ID NO: 123565 - DNA, 38 bp, Artificial Sequence
  Description of Artificial Sequence: Synthetic oligonucleotide
tgtataagcattccaataataaggccatgactacgggg

SEQ ID NO: 123566 - DNA, 37 bp, Artificial Sequence
  Description of Artificial Sequence: Synthetic oligonucleotide
gtataagcattccaataataaggccatgactacgggg

SEQ ID NO: 123567 - DNA, 37 bp, Artificial Sequence
  Description of Artificial Sequence: Synthetic oligonucleotide
tataagcattccaataataaggccatgactacggggg

SEQ ID NO: 123568 - DNA, 36 bp, Artificial Sequence
  Description of Artificial Sequence: Synthetic oligonucleotide
ataagcattccaataataaggccatgactacggggg

SEQ ID NO: 123569 - DNA, 35 bp, Artificial Sequence
  Description of Artificial Sequence: Synthetic oligonucleotide
taagcattccaataataaggccatgactacggggg

SEQ ID NO: 123570 - DNA, 34 bp, Artificial Sequence
  Description of Artificial Sequence: Synthetic oligonucleotide
aagcattccaataataaggccatgactacggggg

SEQ ID NO: 123571 - DNA, 33 bp, Artificial Sequence
  Description of Artificial Sequence: Synthetic oligonucleotide
agcattccaataataaggccatgactacggggg

SEQ ID NO: 123572 - DNA, 32 bp, Artificial Sequence
  Description of Artificial Sequence: Synthetic oligonucleotide
gcattccaataataaggccatgactacggggg

SEQ ID NO: 123573 - DNA, 32 bp, Artificial Sequence
  Description of Artificial Sequence: Synthetic oligonucleotide
cattccaataataaggccatgactacgggggc

SEQ ID NO: 123574 - DNA, 36 bp, Artificial Sequence
  Description of Artificial Sequence: Synthetic oligonucleotide
attccaataataaggccatgactacgggggcaattg

SEQ ID NO: 123575 - DNA, 35 bp, Artificial Sequence
  Description of Artificial Sequence: Synthetic oligonucleotide
ttccaataataaggccatgactacgggggcaattg

SEQ ID NO: 123576 - DNA, 34 bp, Artificial Sequence
  Description of Artificial Sequence: Synthetic oligonucleotide
tccaataataaggccatgactacgggggcaattg

SEQ ID NO: 123577 - DNA, 33 bp, Artificial Sequence
  Description of Artificial Sequence: Synthetic oligonucleotide
ccaataataaggccatgactacgggggcaattg

SEQ ID NO: 123578 - DNA, 33 bp, Artificial Sequence
  Description of Artificial Sequence: Synthetic oligonucleotide
caataataaggccatgactacgggggcaattgc

SEQ ID NO: 123579 - DNA, 34 bp, Artificial Sequence
  Description of Artificial Sequence: Synthetic oligonucleotide
aataataaggccatgactacgggggcaattgctg

SEQ ID NO: 123580 - DNA, 33 bp, Artificial Sequence
  Description of Artificial Sequence: Synthetic oligonucleotide
ataataaggccatgactacgggggcaattgctg

SEQ ID NO: 123581 - DNA, 32 bp, Artificial Sequence
  Description of Artificial Sequence: Synthetic oligonucleotide
taataaggccatgactacgggggcaattgctg

SEQ ID NO: 123582 - DNA, 31 bp, Artificial Sequence
  Description of Artificial Sequence: Synthetic oligonucleotide
aataaggccatgactacgggggcaattgctg

SEQ ID NO: 123583 - DNA, 30 bp, Artificial Sequence
  Description of Artificial Sequence: Synthetic oligonucleotide
ataaggccatgactacgggggcaattgctg

SEQ ID NO: 123584 - DNA, 29 bp, Artificial Sequence
  Description of Artificial Sequence: Synthetic oligonucleotide
taaggccatgactacgggggcaattgctg

SEQ ID NO: 123585 - DNA, 28 bp, Artificial Sequence
  Description of Artificial Sequence: Synthetic oligonucleotide
aaggccatgactacgggggcaattgctg

SEQ ID NO: 123586 - DNA, 27 bp, Artificial Sequence
  Description of Artificial Sequence: Synthetic oligonucleotide
aggccatgactacgggggcaattgctg

SEQ ID NO: 123587 - DNA, 26 bp, Artificial Sequence
  Description of Artificial Sequence: Synthetic oligonucleotide
ggccatgactacgggggcaattgctg

SEQ ID NO: 123588 - DNA, 27 bp, Artificial Sequence
  Description of Artificial Sequence: Synthetic oligonucleotide
gccatgactacgggggcaattgctgca

SEQ ID NO: 123589 - DNA, 29 bp, Artificial Sequence
  Description of Artificial Sequence: Synthetic oligonucleotide
ccatgactacgggggcaattgctgcaatg

SEQ ID NO: 123590 - DNA, 29 bp, Artificial Sequence
  Description of Artificial Sequence: Synthetic oligonucleotide
catgactacgggggcaattgctgcaatgc

SEQ ID NO: 123591 - DNA, 30 bp, Artificial Sequence
  Description of Artificial Sequence: Synthetic oligonucleotide
atgactacgggggcaattgctgcaatgctg

SEQ ID NO: 123592 - DNA, 29 bp, Artificial Sequence
  Description of Artificial Sequence: Synthetic oligonucleotide
tgactacgggggcaattgctgcaatgctg

SEQ ID NO: 123593 - DNA, 28 bp, Artificial Sequence
  Description of Artificial Sequence: Synthetic oligonucleotide
gactacgggggcaattgctgcaatgctg

SEQ ID NO: 123594 - DNA, 29 bp, Artificial Sequence
  Description of Artificial Sequence: Synthetic oligonucleotide
actacgggggcaattgctgcaatgctgtc

SEQ ID NO: 123595 - DNA, 28 bp, Artificial Sequence
  Description of Artificial Sequence: Synthetic oligonucleotide
ctacgggggcaattgctgcaatgctgtc

SEQ ID NO: 123596 - DNA, 30 bp, Artificial Sequence
  Description of Artificial Sequence: Synthetic oligonucleotide
tacgggggcaattgctgcaatgctgtctac

SEQ ID NO: 123597 - DNA, 29 bp, Artificial Sequence
  Description of Artificial Sequence: Synthetic oligonucleotide
acgggggcaattgctgcaatgctgtctac

SEQ ID NO: 123598 - DNA, 28 bp, Artificial Sequence
  Description of Artificial Sequence: Synthetic oligonucleotide
cgggggcaattgctgcaatgctgtctac

SEQ ID NO: 123599 - DNA, 31 bp, Artificial Sequence
  Description of Artificial Sequence: Synthetic oligonucleotide
gggggcaattgctgcaatgctgtctacaatc

SEQ ID NO: 123600 - DNA, 31 bp, Artificial Sequence
  Description of Artificial Sequence: Synthetic oligonucleotide
ggggcaattgctgcaatgctgtctacaatcc

SEQ ID NO: 123601 - DNA, 32 bp, Artificial Sequence
  Description of Artificial Sequence: Synthetic oligonucleotide
gggcaattgctgcaatgctgtctacaatcctg

SEQ ID NO: 123602 - DNA, 36 bp, Artificial Sequence
  Description of Artificial Sequence: Synthetic oligonucleotide
ggcaattgctgcaatgctgtctacaatcctgtattc

SEQ ID NO: 123603 - DNA, 38 bp, Artificial Sequence
  Description of Artificial Sequence: Synthetic oligonucleotide
gcaattgctgcaatgctgtctacaatcctgtattcaag

SEQ ID NO: 123604 - DNA, 38 bp, Artificial Sequence
  Description of Artificial Sequence: Synthetic oligonucleotide
caattgctgcaatgctgtctacaatcctgtattcaagg

SEQ ID NO: 123605 - DNA, 38 bp, Artificial Sequence
  Description of Artificial Sequence: Synthetic oligonucleotide
aattgctgcaatgctgtctacaatcctgtattcaaggc

SEQ ID NO: 123606 - DNA, 37 bp, Artificial Sequence
  Description of Artificial Sequence: Synthetic oligonucleotide
attgctgcaatgctgtctacaatcctgtattcaaggc

SEQ ID NO: 123607 - DNA, 36 bp, Artificial Sequence
  Description of Artificial Sequence: Synthetic oligonucleotide
ttgctgcaatgctgtctacaatcctgtattcaaggc

SEQ ID NO: 123608 - DNA, 35 bp, Artificial Sequence
  Description of Artificial Sequence: Synthetic oligonucleotide
tgctgcaatgctgtctacaatcctgtattcaaggc

SEQ ID NO: 123609 - DNA, 34 bp, Artificial Sequence
  Description of Artificial Sequence: Synthetic oligonucleotide
gctgcaatgctgtctacaatcctgtattcaaggc

SEQ ID NO: 123610 - DNA, 34 bp, Artificial Sequence
  Description of Artificial Sequence: Synthetic oligonucleotide
ctgcaatgctgtctacaatcctgtattcaaggcg

SEQ ID NO: 123611 - DNA, 34 bp, Artificial Sequence
  Description of Artificial Sequence: Synthetic oligonucleotide
tgcaatgctgtctacaatcctgtattcaaggcgc

SEQ ID NO: 123612 - DNA, 33 bp, Artificial Sequence
  Description of Artificial Sequence: Synthetic oligonucleotide
gcaatgctgtctacaatcctgtattcaaggcgc

SEQ ID NO: 123613 - DNA, 35 bp, Artificial Sequence
  Description of Artificial Sequence: Synthetic oligonucleotide
caatgctgtctacaatcctgtattcaaggcgcttc

SEQ ID NO: 123614 - DNA, 38 bp, Artificial Sequence
  Description of Artificial Sequence: Synthetic oligonucleotide
aatgctgtctacaatcctgtattcaaggcgcttctttc

SEQ ID NO: 123615 - DNA, 37 bp, Artificial Sequence
  Description of Artificial Sequence: Synthetic oligonucleotide
atgctgtctacaatcctgtattcaaggcgcttctttc

SEQ ID NO: 123616 - DNA, 36 bp, Artificial Sequence
  Description of Artificial Sequence: Synthetic oligonucleotide
tgctgtctacaatcctgtattcaaggcgcttctttc

SEQ ID NO: 123617 - DNA, 35 bp, Artificial Sequence
  Description of Artificial Sequence: Synthetic oligonucleotide
gctgtctacaatcctgtattcaaggcgcttctttc

SEQ ID NO: 123618 - DNA, 35 bp, Artificial Sequence
  Description of Artificial Sequence: Synthetic oligonucleotide
ctgtctacaatcctgtattcaaggcgcttctttcc

SEQ ID NO: 123619 - DNA, 38 bp, Artificial Sequence
  Description of Artificial Sequence: Synthetic oligonucleotide
tgtctacaatcctgtattcaaggcgcttctttccatac

SEQ ID NO: 123620 - DNA, 37 bp, Artificial Sequence
  Description of Artificial Sequence: Synthetic oligonucleotide
gtctacaatcctgtattcaaggcgcttctttccatac

SEQ ID NO: 123621 - DNA, 40 bp, Artificial Sequence
  Description of Artificial Sequence: Synthetic oligonucleotide
tctacaatcctgtattcaaggcgcttctttccatactatg

SEQ ID NO: 123622 - DNA, 39 bp, Artificial Sequence
  Description of Artificial Sequence: Synthetic oligonucleotide
ctacaatcctgtattcaaggcgcttctttccatactatg

SEQ ID NO: 123623 - DNA, 43 bp, Artificial Sequence
  Description of Artificial Sequence: Synthetic oligonucleotide
tacaatcctgtattcaaggcgcttctttccatactatgtttac

SEQ ID NO: 123624 - DNA, 42 bp, Artificial Sequence
  Description of Artificial Sequence: Synthetic oligonucleotide
acaatcctgtattcaaggcgcttctttccatactatgtttac

SEQ ID NO: 123625 - DNA, 41 bp, Artificial Sequence
  Description of Artificial Sequence: Synthetic oligonucleotide
caatcctgtattcaaggcgcttctttccatactatgtttac

SEQ ID NO: 123626 - DNA, 43 bp, Artificial Sequence
  Description of Artificial Sequence: Synthetic oligonucleotide
aatcctgtattcaaggcgcttctttccatactatgtttacaac

SEQ ID NO: 123627 - DNA, 42 bp, Artificial Sequence
  Description of Artificial Sequence: Synthetic oligonucleotide
atcctgtattcaaggcgcttctttccatactatgtttacaac

SEQ ID NO: 123628 - DNA, 41 bp, Artificial Sequence
  Description of Artificial Sequence: Synthetic oligonucleotide
tcctgtattcaaggcgcttctttccatactatgtttacaac

SEQ ID NO: 123629 - DNA, 40 bp, Artificial Sequence
  Description of Artificial Sequence: Synthetic oligonucleotide
cctgtattcaaggcgcttctttccatactatgtttacaac

SEQ ID NO: 123630 - DNA, 42 bp, Artificial Sequence
  Description of Artificial Sequence: Synthetic oligonucleotide
ctgtattcaaggcgcttctttccatactatgtttacaacatc

SEQ ID NO: 123631 - DNA, 44 bp, Artificial Sequence
  Description of Artificial Sequence: Synthetic oligonucleotide
tgtattcaaggcgcttctttccatactatgtttacaacatcatc

SEQ ID NO: 123632 - DNA, 43 bp, Artificial Sequence
  Description of Artificial Sequence: Synthetic oligonucleotide
gtattcaaggcgcttctttccatactatgtttacaacatcatc

SEQ ID NO: 123633 - DNA, 43 bp, Artificial Sequence
  Description of Artificial Sequence: Synthetic oligonucleotide
tattcaaggcgcttctttccatactatgtttacaacatcatcg

SEQ ID NO: 123634 - DNA, 42 bp, Artificial Sequence
  Description of Artificial Sequence: Synthetic oligonucleotide
attcaaggcgcttctttccatactatgtttacaacatcatcg

SEQ ID NO: 123635 - DNA, 41 bp, Artificial Sequence
  Description of Artificial Sequence: Synthetic oligonucleotide
ttcaaggcgcttctttccatactatgtttacaacatcatcg

SEQ ID NO: 123636 - DNA, 40 bp, Artificial Sequence
  Description of Artificial Sequence: Synthetic oligonucleotide
tcaaggcgcttctttccatactatgtttacaacatcatcg

SEQ ID NO: 123637 - DNA, 39 bp, Artificial Sequence
  Description of Artificial Sequence: Synthetic oligonucleotide
caaggcgcttctttccatactatgtttacaacatcatcg

SEQ ID NO: 123638 - DNA, 39 bp, Artificial Sequence
  Description of Artificial Sequence: Synthetic oligonucleotide
aaggcgcttctttccatactatgtttacaacatcatcgg

SEQ ID NO: 123639 - DNA, 38 bp, Artificial Sequence
  Description of Artificial Sequence: Synthetic oligonucleotide
aggcgcttctttccatactatgtttacaacatcatcgg

SEQ ID NO: 123640 - DNA, 37 bp, Artificial Sequence
  Description of Artificial Sequence: Synthetic oligonucleotide
ggcgcttctttccatactatgtttacaacatcatcgg

SEQ ID NO: 123641 - DNA, 38 bp, Artificial Sequence
  Description of Artificial Sequence: Synthetic oligonucleotide
gcgcttctttccatactatgtttacaacatcatcggtg

SEQ ID NO: 123642 - DNA, 38 bp, Artificial Sequence
  Description of Artificial Sequence: Synthetic oligonucleotide
cgcttctttccatactatgtttacaacatcatcggtgg

SEQ ID NO: 123643 - DNA, 39 bp, Artificial Sequence
  Description of Artificial Sequence: Synthetic oligonucleotide
gcttctttccatactatgtttacaacatcatcggtggac

SEQ ID NO: 123644 - DNA, 41 bp, Artificial Sequence
  Description of Artificial Sequence: Synthetic oligonucleotide
cttctttccatactatgtttacaacatcatcggtggacttg

SEQ ID NO: 123645 - DNA, 43 bp, Artificial Sequence
  Description of Artificial Sequence: Synthetic oligonucleotide
ttctttccatactatgtttacaacatcatcggtggacttgatg

SEQ ID NO: 123646 - DNA, 42 bp, Artificial Sequence
  Description of Artificial Sequence: Synthetic oligonucleotide
tctttccatactatgtttacaacatcatcggtggacttgatg

SEQ ID NO: 123647 - DNA, 41 bp, Artificial Sequence
  Description of Artificial Sequence: Synthetic oligonucleotide
ctttccatactatgtttacaacatcatcggtggacttgatg

SEQ ID NO: 123648 - DNA, 43 bp, Artificial Sequence
  Description of Artificial Sequence: Synthetic oligonucleotide
tttccatactatgtttacaacatcatcggtggacttgatgaag

SEQ ID NO: 123649 - DNA, 42 bp, Artificial Sequence
  Description of Artificial Sequence: Synthetic oligonucleotide
ttccatactatgtttacaacatcatcggtggacttgatgaag

SEQ ID NO: 123650 - DNA, 41 bp, Artificial Sequence
  Description of Artificial Sequence: Synthetic oligonucleotide
tccatactatgtttacaacatcatcggtggacttgatgaag

SEQ ID NO: 123651 - DNA, 40 bp, Artificial Sequence
  Description of Artificial Sequence: Synthetic oligonucleotide
ccatactatgtttacaacatcatcggtggacttgatgaag

SEQ ID NO: 123652 - DNA, 42 bp, Artificial Sequence
  Description of Artificial Sequence: Synthetic oligonucleotide
catactatgtttacaacatcatcggtggacttgatgaagaag

SEQ ID NO: 123653 - DNA, 42 bp, Artificial Sequence
  Description of Artificial Sequence: Synthetic oligonucleotide
atactatgtttacaacatcatcggtggacttgatgaagaagg

SEQ ID NO: 123654 - DNA, 41 bp, Artificial Sequence
  Description of Artificial Sequence: Synthetic oligonucleotide
tactatgtttacaacatcatcggtggacttgatgaagaagg

SEQ ID NO: 123655 - DNA, 40 bp, Artificial Sequence
  Description of Artificial Sequence: Synthetic oligonucleotide
actatgtttacaacatcatcggtggacttgatgaagaagg

SEQ ID NO: 123656 - DNA, 39 bp, Artificial Sequence
  Description of Artificial Sequence: Synthetic oligonucleotide
ctatgtttacaacatcatcggtggacttgatgaagaagg

SEQ ID NO: 123657 - DNA, 42 bp, Artificial Sequence
  Description of Artificial Sequence: Synthetic oligonucleotide
tatgtttacaacatcatcggtggacttgatgaagaaggaaag

SEQ ID NO: 123658 - DNA, 41 bp, Artificial Sequence
  Description of Artificial Sequence: Synthetic oligonucleotide
atgtttacaacatcatcggtggacttgatgaagaaggaaag

SEQ ID NO: 123659 - DNA, 40 bp, Artificial Sequence
  Description of Artificial Sequence: Synthetic oligonucleotide
tgtttacaacatcatcggtggacttgatgaagaaggaaag

SEQ ID NO: 123660 - DNA, 39 bp, Artificial Sequence
  Description of Artificial Sequence: Synthetic oligonucleotide
gtttacaacatcatcggtggacttgatgaagaaggaaag

SEQ ID NO: 123661 - DNA, 39 bp, Artificial Sequence
  Description of Artificial Sequence: Synthetic oligonucleotide
tttacaacatcatcggtggacttgatgaagaaggaaagg

SEQ ID NO: 123662 - DNA, 38 bp, Artificial Sequence
  Description of Artificial Sequence: Synthetic oligonucleotide
ttacaacatcatcggtggacttgatgaagaaggaaagg

SEQ ID NO: 123663 - DNA, 37 bp, Artificial Sequence
  Description of Artificial Sequence: Synthetic oligonucleotide
tacaacatcatcggtggacttgatgaagaaggaaagg

SEQ ID NO: 123664 - DNA, 36 bp, Artificial Sequence
  Description of Artificial Sequence: Synthetic oligonucleotide
acaacatcatcggtggacttgatgaagaaggaaagg

SEQ ID NO: 123665 - DNA, 35 bp, Artificial Sequence
  Description of Artificial Sequence: Synthetic oligonucleotide
caacatcatcggtggacttgatgaagaaggaaagg

SEQ ID NO: 123666 - DNA, 35 bp, Artificial Sequence
  Description of Artificial Sequence: Synthetic oligonucleotide
aacatcatcggtggacttgatgaagaaggaaaggg

SEQ ID NO: 123667 - DNA, 34 bp, Artificial Sequence
  Description of Artificial Sequence: Synthetic oligonucleotide
acatcatcggtggacttgatgaagaaggaaaggg

SEQ ID NO: 123668 - DNA, 33 bp, Artificial Sequence
  Description of Artificial Sequence: Synthetic oligonucleotide
catcatcggtggacttgatgaagaaggaaaggg

SEQ ID NO: 123669 - DNA, 33 bp, Artificial Sequence
  Description of Artificial Sequence: Synthetic oligonucleotide
atcatcggtggacttgatgaagaaggaaagggg

SEQ ID NO: 123670 - DNA, 32 bp, Artificial Sequence
  Description of Artificial Sequence: Synthetic oligonucleotide
tcatcggtggacttgatgaagaaggaaagggg

SEQ ID NO: 123671 - DNA, 31 bp, Artificial Sequence
  Description of Artificial Sequence: Synthetic oligonucleotide
catcggtggacttgatgaagaaggaaagggg

SEQ ID NO: 123672 - DNA, 31 bp, Artificial Sequence
  Description of Artificial Sequence: Synthetic oligonucleotide
atcggtggacttgatgaagaaggaaaggggg

SEQ ID NO: 123673 - DNA, 30 bp, Artificial Sequence
  Description of Artificial Sequence: Synthetic oligonucleotide
tcggtggacttgatgaagaaggaaaggggg

SEQ ID NO: 123674 - DNA, 29 bp, Artificial Sequence
  Description of Artificial Sequence: Synthetic oligonucleotide
cggtggacttgatgaagaaggaaaggggg

SEQ ID NO: 123675 - DNA, 29 bp, Artificial Sequence
  Description of Artificial Sequence: Synthetic oligonucleotide
ggtggacttgatgaagaaggaaagggggc

SEQ ID NO: 123676 - DNA, 30 bp, Artificial Sequence
  Description of Artificial Sequence: Synthetic oligonucleotide
gtggacttgatgaagaaggaaagggggctg

SEQ ID NO: 123677 - DNA, 34 bp, Artificial Sequence
  Description of Artificial Sequence: Synthetic oligonucleotide
tggacttgatgaagaaggaaagggggctgtatac

SEQ ID NO: 123678 - DNA, 33 bp, Artificial Sequence
  Description of Artificial Sequence: Synthetic oligonucleotide
ggacttgatgaagaaggaaagggggctgtatac

SEQ ID NO: 123679 - DNA, 34 bp, Artificial Sequence
  Description of Artificial Sequence: Synthetic oligonucleotide
gacttgatgaagaaggaaagggggctgtatacag

SEQ ID NO: 123680 - DNA, 34 bp, Artificial Sequence
  Description of Artificial Sequence: Synthetic oligonucleotide
acttgatgaagaaggaaagggggctgtatacagc

SEQ ID NO: 123681 - DNA, 33 bp, Artificial Sequence
  Description of Artificial Sequence: Synthetic oligonucleotide
cttgatgaagaaggaaagggggctgtatacagc

SEQ ID NO: 123682 - DNA, 36 bp, Artificial Sequence
  Description of Artificial Sequence: Synthetic oligonucleotide
ttgatgaagaaggaaagggggctgtatacagctttg

SEQ ID NO: 123683 - DNA, 35 bp, Artificial Sequence
  Description of Artificial Sequence: Synthetic oligonucleotide
tgatgaagaaggaaagggggctgtatacagctttg

SEQ ID NO: 123684 - DNA, 34 bp, Artificial Sequence
  Description of Artificial Sequence: Synthetic oligonucleotide
gatgaagaaggaaagggggctgtatacagctttg

SEQ ID NO: 123685 - DNA, 36 bp, Artificial Sequence
  Description of Artificial Sequence: Synthetic oligonucleotide
atgaagaaggaaagggggctgtatacagctttgatc

SEQ ID NO: 123686 - DNA, 35 bp, Artificial Sequence
  Description of Artificial Sequence: Synthetic oligonucleotide
tgaagaaggaaagggggctgtatacagctttgatc

SEQ ID NO: 123687 - DNA, 34 bp, Artificial Sequence
  Description of Artificial Sequence: Synthetic oligonucleotide
gaagaaggaaagggggctgtatacagctttgatc

SEQ ID NO: 123688 - DNA, 34 bp, Artificial Sequence
  Description of Artificial Sequence: Synthetic oligonucleotide
aagaaggaaagggggctgtatacagctttgatcc

SEQ ID NO: 123689 - DNA, 33 bp, Artificial Sequence
  Description of Artificial Sequence: Synthetic oligonucleotide
agaaggaaagggggctgtatacagctttgatcc

SEQ ID NO: 123690 - DNA, 32 bp, Artificial Sequence
  Description of Artificial Sequence: Synthetic oligonucleotide
gaaggaaagggggctgtatacagctttgatcc

SEQ ID NO: 123691 - DNA, 33 bp, Artificial Sequence
  Description of Artificial Sequence: Synthetic oligonucleotide
aaggaaagggggctgtatacagctttgatccag

SEQ ID NO: 123692 - DNA, 32 bp, Artificial Sequence
  Description of Artificial Sequence: Synthetic oligonucleotide
aggaaagggggctgtatacagctttgatccag

SEQ ID NO: 123693 - DNA, 31 bp, Artificial Sequence
  Description of Artificial Sequence: Synthetic oligonucleotide
ggaaagggggctgtatacagctttgatccag

SEQ ID NO: 123694 - DNA, 33 bp, Artificial Sequence
  Description of Artificial Sequence: Synthetic oligonucleotide
gaaagggggctgtatacagctttgatccagtag

SEQ ID NO: 123695 - DNA, 33 bp, Artificial Sequence
  Description of Artificial Sequence: Synthetic oligonucleotide
aaagggggctgtatacagctttgatccagtagg

SEQ ID NO: 123696 - DNA, 32 bp, Artificial Sequence
  Description of Artificial Sequence: Synthetic oligonucleotide
aagggggctgtatacagctttgatccagtagg

SEQ ID NO: 123697 - DNA, 31 bp, Artificial Sequence
  Description of Artificial Sequence: Synthetic oligonucleotide
agggggctgtatacagctttgatccagtagg

SEQ ID NO: 123698 - DNA, 30 bp, Artificial Sequence
  Description of Artificial Sequence: Synthetic oligonucleotide
gggggctgtatacagctttgatccagtagg

SEQ ID NO: 123699 - DNA, 30 bp, Artificial Sequence
  Description of Artificial Sequence: Synthetic oligonucleotide
ggggctgtatacagctttgatccagtaggg

SEQ ID NO: 123700 - DNA, 31 bp, Artificial Sequence
  Description of Artificial Sequence: Synthetic oligonucleotide
gggctgtatacagctttgatccagtagggtc

SEQ ID NO: 123701 - DNA, 34 bp, Artificial Sequence
  Description of Artificial Sequence: Synthetic oligonucleotide
ggctgtatacagctttgatccagtagggtcttac

SEQ ID NO: 123702 - DNA, 34 bp, Artificial Sequence
  Description of Artificial Sequence: Synthetic oligonucleotide
gctgtatacagctttgatccagtagggtcttacc

SEQ ID NO: 123703 - DNA, 35 bp, Artificial Sequence
  Description of Artificial Sequence: Synthetic oligonucleotide
ctgtatacagctttgatccagtagggtcttaccag

SEQ ID NO: 123704 - DNA, 36 bp, Artificial Sequence
  Description of Artificial Sequence: Synthetic oligonucleotide
tgtatacagctttgatccagtagggtcttaccagag

SEQ ID NO: 123705 - DNA, 35 bp, Artificial Sequence
  Description of Artificial Sequence: Synthetic oligonucleotide
gtatacagctttgatccagtagggtcttaccagag

SEQ ID NO: 123706 - DNA, 36 bp, Artificial Sequence
  Description of Artificial Sequence: Synthetic oligonucleotide
tatacagctttgatccagtagggtcttaccagagag

SEQ ID NO: 123707 - DNA, 35 bp, Artificial Sequence
  Description of Artificial Sequence: Synthetic oligonucleotide
atacagctttgatccagtagggtcttaccagagag

SEQ ID NO: 123708 - DNA, 34 bp, Artificial Sequence
  Description of Artificial Sequence: Synthetic oligonucleotide
tacagctttgatccagtagggtcttaccagagag

SEQ ID NO: 123709 - DNA, 33 bp, Artificial Sequence
  Description of Artificial Sequence: Synthetic oligonucleotide
acagctttgatccagtagggtcttaccagagag

SEQ ID NO: 123710 - DNA, 32 bp, Artificial Sequence
  Description of Artificial Sequence: Synthetic oligonucleotide
cagctttgatccagtagggtcttaccagagag

SEQ ID NO: 123711 - DNA, 33 bp, Artificial Sequence
  Description of Artificial Sequence: Synthetic oligonucleotide
agctttgatccagtagggtcttaccagagagac

SEQ ID NO: 123712 - DNA, 32 bp, Artificial Sequence
  Description of Artificial Sequence: Synthetic oligonucleotide
gctttgatccagtagggtcttaccagagagac

SEQ ID NO: 123713 - DNA, 33 bp, Artificial Sequence
  Description of Artificial Sequence: Synthetic oligonucleotide
ctttgatccagtagggtcttaccagagagactc

SEQ ID NO: 123714 - DNA, 33 bp, Artificial Sequence
  Description of Artificial Sequence: Synthetic oligonucleotide
tttgatccagtagggtcttaccagagagactcc

SEQ ID NO: 123715 - DNA, 32 bp, Artificial Sequence
  Description of Artificial Sequence: Synthetic oligonucleotide
ttgatccagtagggtcttaccagagagactcc

SEQ ID NO: 123716 - DNA, 31 bp, Artificial Sequence
  Description of Artificial Sequence: Synthetic oligonucleotide
tgatccagtagggtcttaccagagagactcc

SEQ ID NO: 123717 - DNA, 30 bp, Artificial Sequence
  Description of Artificial Sequence: Synthetic oligonucleotide
gatccagtagggtcttaccagagagactcc

SEQ ID NO: 123718 - DNA, 32 bp, Artificial Sequence
  Description of Artificial Sequence: Synthetic oligonucleotide
atccagtagggtcttaccagagagactccttc

SEQ ID NO: 123719 - DNA, 31 bp, Artificial Sequence
  Description of Artificial Sequence: Synthetic oligonucleotide
tccagtagggtcttaccagagagactccttc

SEQ ID NO: 123720 - DNA, 30 bp, Artificial Sequence
  Description of Artificial Sequence: Synthetic oligonucleotide
ccagtagggtcttaccagagagactccttc

SEQ ID NO: 123721 - DNA, 32 bp, Artificial Sequence
  Description of Artificial Sequence: Synthetic oligonucleotide
cagtagggtcttaccagagagactccttcaag

SEQ ID NO: 123722 - DNA, 32 bp, Artificial Sequence
  Description of Artificial Sequence: Synthetic oligonucleotide
agtagggtcttaccagagagactccttcaagg

SEQ ID NO: 123723 - DNA, 31 bp, Artificial Sequence
  Description of Artificial Sequence: Synthetic oligonucleotide
gtagggtcttaccagagagactccttcaagg

SEQ ID NO: 123724 - DNA, 31 bp, Artificial Sequence
  Description of Artificial Sequence: Synthetic oligonucleotide
tagggtcttaccagagagactccttcaaggc

SEQ ID NO: 123725 - DNA, 30 bp, Artificial Sequence
  Description of Artificial Sequence: Synthetic oligonucleotide
agggtcttaccagagagactccttcaaggc

SEQ ID NO: 123726 - DNA, 29 bp, Artificial Sequence
  Description of Artificial Sequence: Synthetic oligonucleotide
gggtcttaccagagagactccttcaaggc

SEQ ID NO: 123727 - DNA, 30 bp, Artificial Sequence
  Description of Artificial Sequence: Synthetic oligonucleotide
ggtcttaccagagagactccttcaaggctg

SEQ ID NO: 123728 - DNA, 30 bp, Artificial Sequence
  Description of Artificial Sequence: Synthetic oligonucleotide
gtcttaccagagagactccttcaaggctgg

SEQ ID NO: 123729 - DNA, 31 bp, Artificial Sequence
  Description of Artificial Sequence: Synthetic oligonucleotide
tcttaccagagagactccttcaaggctggag

SEQ ID NO: 123730 - DNA, 30 bp, Artificial Sequence
  Description of Artificial Sequence: Synthetic oligonucleotide
cttaccagagagactccttcaaggctggag

SEQ ID NO: 123731 - DNA, 30 bp, Artificial Sequence
  Description of Artificial Sequence: Synthetic oligonucleotide
ttaccagagagactccttcaaggctggagg

SEQ ID NO: 123732 - DNA, 29 bp, Artificial Sequence
  Description of Artificial Sequence: Synthetic oligonucleotide
taccagagagactccttcaaggctggagg

SEQ ID NO: 123733 - DNA, 28 bp, Artificial Sequence
  Description of Artificial Sequence: Synthetic oligonucleotide
accagagagactccttcaaggctggagg

SEQ ID NO: 123734 - DNA, 27 bp, Artificial Sequence
  Description of Artificial Sequence: Synthetic oligonucleotide
ccagagagactccttcaaggctggagg

SEQ ID NO: 123735 - DNA, 27 bp, Artificial Sequence
  Description of Artificial Sequence: Synthetic oligonucleotide
cagagagactccttcaaggctggaggc

SEQ ID NO: 123736 - DNA, 28 bp, Artificial Sequence
  Description of Artificial Sequence: Synthetic oligonucleotide
agagagactccttcaaggctggaggctc

SEQ ID NO: 123737 - DNA, 27 bp, Artificial Sequence
  Description of Artificial Sequence: Synthetic oligonucleotide
gagagactccttcaaggctggaggctc

SEQ ID NO: 123738 - DNA, 28 bp, Artificial Sequence
  Description of Artificial Sequence: Synthetic oligonucleotide
agagactccttcaaggctggaggctcag

SEQ ID NO: 123739 - DNA, 27 bp, Artificial Sequence
  Description of Artificial Sequence: Synthetic oligonucleotide
gagactccttcaaggctggaggctcag

SEQ ID NO: 123740 - DNA, 27 bp, Artificial Sequence
  Description of Artificial Sequence: Synthetic oligonucleotide
agactccttcaaggctggaggctcagc

SEQ ID NO: 123741 - DNA, 27 bp, Artificial Sequence
  Description of Artificial Sequence: Synthetic oligonucleotide
gactccttcaaggctggaggctcagca

SEQ ID NO: 123742 - DNA, 28 bp, Artificial Sequence
  Description of Artificial Sequence: Synthetic oligonucleotide
actccttcaaggctggaggctcagcaag

SEQ ID NO: 123743 - DNA, 27 bp, Artificial Sequence
  Description of Artificial Sequence: Synthetic oligonucleotide
ctccttcaaggctggaggctcagcaag

SEQ ID NO: 123744 - DNA, 28 bp, Artificial Sequence
  Description of Artificial Sequence: Synthetic oligonucleotide
tccttcaaggctggaggctcagcaagtg

SEQ ID NO: 123745 - DNA, 27 bp, Artificial Sequence
  Description of Artificial Sequence: Synthetic oligonucleotide
ccttcaaggctggaggctcagcaagtg

SEQ ID NO: 123746 - DNA, 27 bp, Artificial Sequence
  Description of Artificial Sequence: Synthetic oligonucleotide
cttcaaggctggaggctcagcaagtgc

SEQ ID NO: 123747 - DNA, 27 bp, Artificial Sequence
  Description of Artificial Sequence: Synthetic oligonucleotide
ttcaaggctggaggctcagcaagtgcc

SEQ ID NO: 123748 - DNA, 27 bp, Artificial Sequence
  Description of Artificial Sequence: Synthetic oligonucleotide
tcaaggctggaggctcagcaagtgcca

SEQ ID NO: 123749 - DNA, 27 bp, Artificial Sequence
  Description of Artificial Sequence: Synthetic oligonucleotide
caaggctggaggctcagcaagtgccat

SEQ ID NO: 123750 - DNA, 27 bp, Artificial Sequence
  Description of Artificial Sequence: Synthetic oligonucleotide
aaggctggaggctcagcaagtgccatg

SEQ ID NO: 123751 - DNA, 26 bp, Artificial Sequence
  Description of Artificial Sequence: Synthetic oligonucleotide
aggctggaggctcagcaagtgccatg

SEQ ID NO: 123752 - DNA, 25 bp, Artificial Sequence
  Description of Artificial Sequence: Synthetic oligonucleotide
ggctggaggctcagcaagtgccatg

SEQ ID NO: 123753 - DNA, 27 bp, Artificial Sequence
  Description of Artificial Sequence: Synthetic oligonucleotide
gctggaggctcagcaagtgccatgcta

SEQ ID NO: 123754 - DNA, 27 bp, Artificial Sequence
  Description of Artificial Sequence: Synthetic oligonucleotide
ctggaggctcagcaagtgccatgctac

SEQ ID NO: 123755 - DNA, 28 bp, Artificial Sequence
  Description of Artificial Sequence: Synthetic oligonucleotide
tggaggctcagcaagtgccatgctacag

SEQ ID NO: 123756 - DNA, 27 bp, Artificial Sequence
  Description of Artificial Sequence: Synthetic oligonucleotide
ggaggctcagcaagtgccatgctacag

SEQ ID NO: 123757 - DNA, 27 bp, Artificial Sequence
  Description of Artificial Sequence: Synthetic oligonucleotide
gaggctcagcaagtgccatgctacagc

SEQ ID NO: 123758 - DNA, 27 bp, Artificial Sequence
  Description of Artificial Sequence: Synthetic oligonucleotide
aggctcagcaagtgccatgctacagcc

SEQ ID NO: 123759 - DNA, 26 bp, Artificial Sequence
  Description of Artificial Sequence: Synthetic oligonucleotide
ggctcagcaagtgccatgctacagcc

SEQ ID NO: 123760 - DNA, 26 bp, Artificial Sequence
  Description of Artificial Sequence: Synthetic oligonucleotide
gctcagcaagtgccatgctacagccc

SEQ ID NO: 123761 - DNA, 27 bp, Artificial Sequence
  Description of Artificial Sequence: Synthetic oligonucleotide
ctcagcaagtgccatgctacagcccct

SEQ ID NO: 123762 - DNA, 27 bp, Artificial Sequence
  Description of Artificial Sequence: Synthetic oligonucleotide
tcagcaagtgccatgctacagcccctg

SEQ ID NO: 123763 - DNA, 26 bp, Artificial Sequence
  Description of Artificial Sequence: Synthetic oligonucleotide
cagcaagtgccatgctacagcccctg

SEQ ID NO: 123764 - DNA, 27 bp, Artificial Sequence
  Description of Artificial Sequence: Synthetic oligonucleotide
agcaagtgccatgctacagcccctgct

SEQ ID NO: 123765 - DNA, 27 bp, Artificial Sequence
  Description of Artificial Sequence: Synthetic oligonucleotide
gcaagtgccatgctacagcccctgctt

SEQ ID NO: 123766 - DNA, 27 bp, Artificial Sequence
  Description of Artificial Sequence: Synthetic oligonucleotide
caagtgccatgctacagcccctgcttg

SEQ ID NO: 123767 - DNA, 28 bp, Artificial Sequence
  Description of Artificial Sequence: Synthetic oligonucleotide
aagtgccatgctacagcccctgcttgac

SEQ ID NO: 123768 - DNA, 27 bp, Artificial Sequence
  Description of Artificial Sequence: Synthetic oligonucleotide
agtgccatgctacagcccctgcttgac

SEQ ID NO: 123769 - DNA, 27 bp, Artificial Sequence
  Description of Artificial Sequence: Synthetic oligonucleotide
gtgccatgctacagcccctgcttgaca

SEQ ID NO: 123770 - DNA, 28 bp, Artificial Sequence
  Description of Artificial Sequence: Synthetic oligonucleotide
tgccatgctacagcccctgcttgacaac

SEQ ID NO: 123771 - DNA, 27 bp, Artificial Sequence
  Description of Artificial Sequence: Synthetic oligonucleotide
gccatgctacagcccctgcttgacaac

SEQ ID NO: 123772 - DNA, 27 bp, Artificial Sequence
  Description of Artificial Sequence: Synthetic oligonucleotide
ccatgctacagcccctgcttgacaacc

SEQ ID NO: 123773 - DNA, 28 bp, Artificial Sequence
  Description of Artificial Sequence: Synthetic oligonucleotide
catgctacagcccctgcttgacaaccag

SEQ ID NO: 123774 - DNA, 28 bp, Artificial Sequence
  Description of Artificial Sequence: Synthetic oligonucleotide
atgctacagcccctgcttgacaaccagg

SEQ ID NO: 123775 - DNA, 27 bp, Artificial Sequence
  Description of Artificial Sequence: Synthetic oligonucleotide
tgctacagcccctgcttgacaaccagg

SEQ ID NO: 123776 - DNA, 27 bp, Artificial Sequence
  Description of Artificial Sequence: Synthetic oligonucleotide
gctacagcccctgcttgacaaccaggt

SEQ ID NO: 123777 - DNA, 28 bp, Artificial Sequence
  Description of Artificial Sequence: Synthetic oligonucleotide
ctacagcccctgcttgacaaccaggttg

SEQ ID NO: 123778 - DNA, 28 bp, Artificial Sequence
  Description of Artificial Sequence: Synthetic oligonucleotide
tacagcccctgcttgacaaccaggttgg

SEQ ID NO: 123779 - DNA, 27 bp, Artificial Sequence
  Description of Artificial Sequence: Synthetic oligonucleotide
acagcccctgcttgacaaccaggttgg

SEQ ID NO: 123780 - DNA, 27 bp, Artificial Sequence
  Description of Artificial Sequence: Synthetic oligonucleotide
cagcccctgcttgacaaccaggttggt

SEQ ID NO: 123781 - DNA, 32 bp, Artificial Sequence
  Description of Artificial Sequence: Synthetic oligonucleotide
agcccctgcttgacaaccaggttggttttaag

SEQ ID NO: 123782 - DNA, 31 bp, Artificial Sequence
  Description of Artificial Sequence: Synthetic oligonucleotide
gcccctgcttgacaaccaggttggttttaag

SEQ ID NO: 123783 - DNA, 33 bp, Artificial Sequence
  Description of Artificial Sequence: Synthetic oligonucleotide
cccctgcttgacaaccaggttggttttaagaac

SEQ ID NO: 123784 - DNA, 35 bp, Artificial Sequence
  Description of Artificial Sequence: Synthetic oligonucleotide
ccctgcttgacaaccaggttggttttaagaacatg

SEQ ID NO: 123785 - DNA, 35 bp, Artificial Sequence
  Description of Artificial Sequence: Synthetic oligonucleotide
cctgcttgacaaccaggttggttttaagaacatgc

SEQ ID NO: 123786 - DNA, 36 bp, Artificial Sequence
  Description of Artificial Sequence: Synthetic oligonucleotide
ctgcttgacaaccaggttggttttaagaacatgcag

SEQ ID NO: 123787 - DNA, 39 bp, Artificial Sequence
  Description of Artificial Sequence: Synthetic oligonucleotide
tgcttgacaaccaggttggttttaagaacatgcagaatg

SEQ ID NO: 123788 - DNA, 38 bp, Artificial Sequence
  Description of Artificial Sequence: Synthetic oligonucleotide
gcttgacaaccaggttggttttaagaacatgcagaatg

SEQ ID NO: 123789 - DNA, 39 bp, Artificial Sequence
  Description of Artificial Sequence: Synthetic oligonucleotide
cttgacaaccaggttggttttaagaacatgcagaatgtg

SEQ ID NO: 123790 - DNA, 39 bp, Artificial Sequence
  Description of Artificial Sequence: Synthetic oligonucleotide
ttgacaaccaggttggttttaagaacatgcagaatgtgg

SEQ ID NO: 123791 - DNA, 38 bp, Artificial Sequence
  Description of Artificial Sequence: Synthetic oligonucleotide
tgacaaccaggttggttttaagaacatgcagaatgtgg

SEQ ID NO: 123792 - DNA, 37 bp, Artificial Sequence
  Description of Artificial Sequence: Synthetic oligonucleotide
gacaaccaggttggttttaagaacatgcagaatgtgg

SEQ ID NO: 123793 - DNA, 38 bp, Artificial Sequence
  Description of Artificial Sequence: Synthetic oligonucleotide
acaaccaggttggttttaagaacatgcagaatgtggag

SEQ ID NO: 123794 - DNA, 37 bp, Artificial Sequence
  Description of Artificial Sequence: Synthetic oligonucleotide
caaccaggttggttttaagaacatgcagaatgtggag

SEQ ID NO: 123795 - DNA, 37 bp, Artificial Sequence
  Description of Artificial Sequence: Synthetic oligonucleotide
aaccaggttggttttaagaacatgcagaatgtggagc

SEQ ID NO: 123796 - DNA, 36 bp, Artificial Sequence
  Description of Artificial Sequence: Synthetic oligonucleotide
accaggttggttttaagaacatgcagaatgtggagc

SEQ ID NO: 123797 - DNA, 35 bp, Artificial Sequence
  Description of Artificial Sequence: Synthetic oligonucleotide
ccaggttggttttaagaacatgcagaatgtggagc

SEQ ID NO: 123798 - DNA, 37 bp, Artificial Sequence
  Description of Artificial Sequence: Synthetic oligonucleotide
caggttggttttaagaacatgcagaatgtggagcatg

SEQ ID NO: 123799 - DNA, 39 bp, Artificial Sequence
  Description of Artificial Sequence: Synthetic oligonucleotide
aggttggttttaagaacatgcagaatgtggagcatgttc

SEQ ID NO: 123800 - DNA, 38 bp, Artificial Sequence
  Description of Artificial Sequence: Synthetic oligonucleotide
ggttggttttaagaacatgcagaatgtggagcatgttc

SEQ ID NO: 123801 - DNA, 38 bp, Artificial Sequence
  Description of Artificial Sequence: Synthetic oligonucleotide
gttggttttaagaacatgcagaatgtggagcatgttcc

SEQ ID NO: 123802 - DNA, 38 bp, Artificial Sequence
  Description of Artificial Sequence: Synthetic oligonucleotide
ttggttttaagaacatgcagaatgtggagcatgttccg

SEQ ID NO: 123803 - DNA, 37 bp, Artificial Sequence
  Description of Artificial Sequence: Synthetic oligonucleotide
tggttttaagaacatgcagaatgtggagcatgttccg

SEQ ID NO: 123804 - DNA, 36 bp, Artificial Sequence
  Description of Artificial Sequence: Synthetic oligonucleotide
ggttttaagaacatgcagaatgtggagcatgttccg

SEQ ID NO: 123805 - DNA, 36 bp, Artificial Sequence
  Description of Artificial Sequence: Synthetic oligonucleotide
gttttaagaacatgcagaatgtggagcatgttccgc

SEQ ID NO: 123806 - DNA, 37 bp, Artificial Sequence
  Description of Artificial Sequence: Synthetic oligonucleotide
ttttaagaacatgcagaatgtggagcatgttccgctg

SEQ ID NO: 123807 - DNA, 36 bp, Artificial Sequence
  Description of Artificial Sequence: Synthetic oligonucleotide
tttaagaacatgcagaatgtggagcatgttccgctg

SEQ ID NO: 123808 - DNA, 35 bp, Artificial Sequence
  Description of Artificial Sequence: Synthetic oligonucleotide
ttaagaacatgcagaatgtggagcatgttccgctg

SEQ ID NO: 123809 - DNA, 34 bp, Artificial Sequence
  Description of Artificial Sequence: Synthetic oligonucleotide
taagaacatgcagaatgtggagcatgttccgctg

SEQ ID NO: 123810 - DNA, 33 bp, Artificial Sequence
  Description of Artificial Sequence: Synthetic oligonucleotide
aagaacatgcagaatgtggagcatgttccgctg

SEQ ID NO: 123811 - DNA, 32 bp, Artificial Sequence
  Description of Artificial Sequence: Synthetic oligonucleotide
agaacatgcagaatgtggagcatgttccgctg

SEQ ID NO: 123812 - DNA, 31 bp, Artificial Sequence
  Description of Artificial Sequence: Synthetic oligonucleotide
gaacatgcagaatgtggagcatgttccgctg

SEQ ID NO: 123813 - DNA, 32 bp, Artificial Sequence
  Description of Artificial Sequence: Synthetic oligonucleotide
aacatgcagaatgtggagcatgttccgctgtc

SEQ ID NO: 123814 - DNA, 31 bp, Artificial Sequence
  Description of Artificial Sequence: Synthetic oligonucleotide
acatgcagaatgtggagcatgttccgctgtc

SEQ ID NO: 123815 - DNA, 30 bp, Artificial Sequence
  Description of Artificial Sequence: Synthetic oligonucleotide
catgcagaatgtggagcatgttccgctgtc

SEQ ID NO: 123816 - DNA, 30 bp, Artificial Sequence
  Description of Artificial Sequence: Synthetic oligonucleotide
atgcagaatgtggagcatgttccgctgtcc

SEQ ID NO: 123817 - DNA, 29 bp, Artificial Sequence
  Description of Artificial Sequence: Synthetic oligonucleotide
tgcagaatgtggagcatgttccgctgtcc

SEQ ID NO: 123818 - DNA, 28 bp, Artificial Sequence
  Description of Artificial Sequence: Synthetic oligonucleotide
gcagaatgtggagcatgttccgctgtcc

SEQ ID NO: 123819 - DNA, 30 bp, Artificial Sequence
  Description of Artificial Sequence: Synthetic oligonucleotide
cagaatgtggagcatgttccgctgtccttg

SEQ ID NO: 123820 - DNA, 30 bp, Artificial Sequence
  Description of Artificial Sequence: Synthetic oligonucleotide
agaatgtggagcatgttccgctgtccttgg

SEQ ID NO: 123821 - DNA, 29 bp, Artificial Sequence
  Description of Artificial Sequence: Synthetic oligonucleotide
gaatgtggagcatgttccgctgtccttgg

SEQ ID NO: 123822 - DNA, 30 bp, Artificial Sequence
  Description of Artificial Sequence: Synthetic oligonucleotide
aatgtggagcatgttccgctgtccttggac

SEQ ID NO: 123823 - DNA, 29 bp, Artificial Sequence
  Description of Artificial Sequence: Synthetic oligonucleotide
atgtggagcatgttccgctgtccttggac

SEQ ID NO: 123824 - DNA, 28 bp, Artificial Sequence
  Description of Artificial Sequence: Synthetic oligonucleotide
tgtggagcatgttccgctgtccttggac

SEQ ID NO: 123825 - DNA, 27 bp, Artificial Sequence
  Description of Artificial Sequence: Synthetic oligonucleotide
gtggagcatgttccgctgtccttggac

SEQ ID NO: 123826 - DNA, 28 bp, Artificial Sequence
  Description of Artificial Sequence: Synthetic oligonucleotide
tggagcatgttccgctgtccttggacag

SEQ ID NO: 123827 - DNA, 27 bp, Artificial Sequence
  Description of Artificial Sequence: Synthetic oligonucleotide
ggagcatgttccgctgtccttggacag

SEQ ID NO: 123828 - DNA, 28 bp, Artificial Sequence
  Description of Artificial Sequence: Synthetic oligonucleotide
gagcatgttccgctgtccttggacagag

SEQ ID NO: 123829 - DNA, 28 bp, Artificial Sequence
  Description of Artificial Sequence: Synthetic oligonucleotide
agcatgttccgctgtccttggacagagc

SEQ ID NO: 123830 - DNA, 27 bp, Artificial Sequence
  Description of Artificial Sequence: Synthetic oligonucleotide
gcatgttccgctgtccttggacagagc

SEQ ID NO: 123831 - DNA, 27 bp, Artificial Sequence
  Description of Artificial Sequence: Synthetic oligonucleotide
catgttccgctgtccttggacagagcc

SEQ ID NO: 123832 - DNA, 29 bp, Artificial Sequence
  Description of Artificial Sequence: Synthetic oligonucleotide
atgttccgctgtccttggacagagccatg

SEQ ID NO: 123833 - DNA, 28 bp, Artificial Sequence
  Description of Artificial Sequence: Synthetic oligonucleotide
tgttccgctgtccttggacagagccatg

SEQ ID NO: 123834 - DNA, 27 bp, Artificial Sequence
  Description of Artificial Sequence: Synthetic oligonucleotide
gttccgctgtccttggacagagccatg

SEQ ID NO: 123835 - DNA, 27 bp, Artificial Sequence
  Description of Artificial Sequence: Synthetic oligonucleotide
ttccgctgtccttggacagagccatgc

SEQ ID NO: 123836 - DNA, 26 bp, Artificial Sequence
  Description of Artificial Sequence: Synthetic oligonucleotide
tccgctgtccttggacagagccatgc

SEQ ID NO: 123837 - DNA, 25 bp, Artificial Sequence
  Description of Artificial Sequence: Synthetic oligonucleotide
ccgctgtccttggacagagccatgc

SEQ ID NO: 123838 - DNA, 25 bp, Artificial Sequence
  Description of Artificial Sequence: Synthetic oligonucleotide
cgctgtccttggacagagccatgcg

SEQ ID NO: 123839 - DNA, 25 bp, Artificial Sequence
  Description of Artificial Sequence: Synthetic oligonucleotide
gctgtccttggacagagccatgcgg

SEQ ID NO: 123840 - DNA, 26 bp, Artificial Sequence
  Description of Artificial Sequence: Synthetic oligonucleotide
ctgtccttggacagagccatgcggct

SEQ ID NO: 123841 - DNA, 26 bp, Artificial Sequence
  Description of Artificial Sequence: Synthetic oligonucleotide
tgtccttggacagagccatgcggctg

SEQ ID NO: 123842 - DNA, 25 bp, Artificial Sequence
  Description of Artificial Sequence: Synthetic oligonucleotide
gtccttggacagagccatgcggctg

SEQ ID NO: 123843 - DNA, 26 bp, Artificial Sequence
  Description of Artificial Sequence: Synthetic oligonucleotide
tccttggacagagccatgcggctggt

SEQ ID NO: 123844 - DNA, 25 bp, Artificial Sequence
  Description of Artificial Sequence: Synthetic oligonucleotide
ccttggacagagccatgcggctggt

SEQ ID NO: 123845 - DNA, 27 bp, Artificial Sequence
  Description of Artificial Sequence: Synthetic oligonucleotide
cttggacagagccatgcggctggtgaa

SEQ ID NO: 123846 - DNA, 28 bp, Artificial Sequence
  Description of Artificial Sequence: Synthetic oligonucleotide
ttggacagagccatgcggctggtgaaag

SEQ ID NO: 123847 - DNA, 27 bp, Artificial Sequence
  Description of Artificial Sequence: Synthetic oligonucleotide
tggacagagccatgcggctggtgaaag

SEQ ID NO: 123848 - DNA, 27 bp, Artificial Sequence
  Description of Artificial Sequence: Synthetic oligonucleotide
ggacagagccatgcggctggtgaaaga

SEQ ID NO: 123849 - DNA, 28 bp, Artificial Sequence
  Description of Artificial Sequence: Synthetic oligonucleotide
gacagagccatgcggctggtgaaagatg

SEQ ID NO: 123850 - DNA, 29 bp, Artificial Sequence
  Description of Artificial Sequence: Synthetic oligonucleotide
acagagccatgcggctggtgaaagatgtc

SEQ ID NO: 123851 - DNA, 28 bp, Artificial Sequence
  Description of Artificial Sequence: Synthetic oligonucleotide
cagagccatgcggctggtgaaagatgtc

SEQ ID NO: 123852 - DNA, 30 bp, Artificial Sequence
  Description of Artificial Sequence: Synthetic oligonucleotide
agagccatgcggctggtgaaagatgtcttc

SEQ ID NO: 123853 - DNA, 29 bp, Artificial Sequence
  Description of Artificial Sequence: Synthetic oligonucleotide
gagccatgcggctggtgaaagatgtcttc

SEQ ID NO: 123854 - DNA, 33 bp, Artificial Sequence
  Description of Artificial Sequence: Synthetic oligonucleotide
agccatgcggctggtgaaagatgtcttcatttc

SEQ ID NO: 123855 - DNA, 32 bp, Artificial Sequence
  Description of Artificial Sequence: Synthetic oligonucleotide
gccatgcggctggtgaaagatgtcttcatttc

SEQ ID NO: 123856 - DNA, 33 bp, Artificial Sequence
  Description of Artificial Sequence: Synthetic oligonucleotide
ccatgcggctggtgaaagatgtcttcatttctg

SEQ ID NO: 123857 - DNA, 33 bp, Artificial Sequence
  Description of Artificial Sequence: Synthetic oligonucleotide
catgcggctggtgaaagatgtcttcatttctgc

SEQ ID NO: 123858 - DNA, 33 bp, Artificial Sequence
  Description of Artificial Sequence: Synthetic oligonucleotide
atgcggctggtgaaagatgtcttcatttctgcg

SEQ ID NO: 123859 - DNA, 32 bp, Artificial Sequence
  Description of Artificial Sequence: Synthetic oligonucleotide
tgcggctggtgaaagatgtcttcatttctgcg

SEQ ID NO: 123860 - DNA, 31 bp, Artificial Sequence
  Description of Artificial Sequence: Synthetic oligonucleotide
gcggctggtgaaagatgtcttcatttctgcg

SEQ ID NO: 123861 - DNA, 31 bp, Artificial Sequence
  Description of Artificial Sequence: Synthetic oligonucleotide
cggctggtgaaagatgtcttcatttctgcgg

SEQ ID NO: 123862 - DNA, 31 bp, Artificial Sequence
  Description of Artificial Sequence: Synthetic oligonucleotide
ggctggtgaaagatgtcttcatttctgcggc

SEQ ID NO: 123863 - DNA, 32 bp, Artificial Sequence
  Description of Artificial Sequence: Synthetic oligonucleotide
gctggtgaaagatgtcttcatttctgcggctg

SEQ ID NO: 123864 - DNA, 33 bp, Artificial Sequence
  Description of Artificial Sequence: Synthetic oligonucleotide
ctggtgaaagatgtcttcatttctgcggctgag

SEQ ID NO: 123865 - DNA, 34 bp, Artificial Sequence
  Description of Artificial Sequence: Synthetic oligonucleotide
tggtgaaagatgtcttcatttctgcggctgagag

SEQ ID NO: 123866 - DNA, 33 bp, Artificial Sequence
  Description of Artificial Sequence: Synthetic oligonucleotide
ggtgaaagatgtcttcatttctgcggctgagag

SEQ ID NO: 123867 - DNA, 34 bp, Artificial Sequence
  Description of Artificial Sequence: Synthetic oligonucleotide
gtgaaagatgtcttcatttctgcggctgagagag

SEQ ID NO: 123868 - DNA, 36 bp, Artificial Sequence
  Description of Artificial Sequence: Synthetic oligonucleotide
tgaaagatgtcttcatttctgcggctgagagagatg

SEQ ID NO: 123869 - DNA, 35 bp, Artificial Sequence
  Description of Artificial Sequence: Synthetic oligonucleotide
gaaagatgtcttcatttctgcggctgagagagatg

SEQ ID NO: 123870 - DNA, 36 bp, Artificial Sequence
  Description of Artificial Sequence: Synthetic oligonucleotide
aaagatgtcttcatttctgcggctgagagagatgtg

SEQ ID NO: 123871 - DNA, 35 bp, Artificial Sequence
  Description of Artificial Sequence: Synthetic oligonucleotide
aagatgtcttcatttctgcggctgagagagatgtg

SEQ ID NO: 123872 - DNA, 34 bp, Artificial Sequence
  Description of Artificial Sequence: Synthetic oligonucleotide
agatgtcttcatttctgcggctgagagagatgtg

SEQ ID NO: 123873 - DNA, 33 bp, Artificial Sequence
  Description of Artificial Sequence: Synthetic oligonucleotide
gatgtcttcatttctgcggctgagagagatgtg

SEQ ID NO: 123874 - DNA, 35 bp, Artificial Sequence
  Description of Artificial Sequence: Synthetic oligonucleotide
atgtcttcatttctgcggctgagagagatgtgtac

SEQ ID NO: 123875 - DNA, 34 bp, Artificial Sequence
  Description of Artificial Sequence: Synthetic oligonucleotide
tgtcttcatttctgcggctgagagagatgtgtac

SEQ ID NO: 123876 - DNA, 33 bp, Artificial Sequence
  Description of Artificial Sequence: Synthetic oligonucleotide
gtcttcatttctgcggctgagagagatgtgtac

SEQ ID NO: 123877 - DNA, 34 bp, Artificial Sequence
  Description of Artificial Sequence: Synthetic oligonucleotide
tcttcatttctgcggctgagagagatgtgtacac

SEQ ID NO: 123878 - DNA, 33 bp, Artificial Sequence
  Description of Artificial Sequence: Synthetic oligonucleotide
cttcatttctgcggctgagagagatgtgtacac

SEQ ID NO: 123879 - DNA, 34 bp, Artificial Sequence
  Description of Artificial Sequence: Synthetic oligonucleotide
ttcatttctgcggctgagagagatgtgtacactg

SEQ ID NO: 123880 - DNA, 33 bp, Artificial Sequence
  Description of Artificial Sequence: Synthetic oligonucleotide
tcatttctgcggctgagagagatgtgtacactg

SEQ ID NO: 123881 - DNA, 32 bp, Artificial Sequence
  Description of Artificial Sequence: Synthetic oligonucleotide
catttctgcggctgagagagatgtgtacactg

SEQ ID NO: 123882 - DNA, 32 bp, Artificial Sequence
  Description of Artificial Sequence: Synthetic oligonucleotide
atttctgcggctgagagagatgtgtacactgg

SEQ ID NO: 123883 - DNA, 31 bp, Artificial Sequence
  Description of Artificial Sequence: Synthetic oligonucleotide
tttctgcggctgagagagatgtgtacactgg

SEQ ID NO: 123884 - DNA, 30 bp, Artificial Sequence
  Description of Artificial Sequence: Synthetic oligonucleotide
ttctgcggctgagagagatgtgtacactgg

SEQ ID NO: 123885 - DNA, 29 bp, Artificial Sequence
  Description of Artificial Sequence: Synthetic oligonucleotide
tctgcggctgagagagatgtgtacactgg

SEQ ID NO: 123886 - DNA, 28 bp, Artificial Sequence
  Description of Artificial Sequence: Synthetic oligonucleotide
ctgcggctgagagagatgtgtacactgg

SEQ ID NO: 123887 - DNA, 28 bp, Artificial Sequence
  Description of Artificial Sequence: Synthetic oligonucleotide
tgcggctgagagagatgtgtacactggg

SEQ ID NO: 123888 - DNA, 27 bp, Artificial Sequence
  Description of Artificial Sequence: Synthetic oligonucleotide
gcggctgagagagatgtgtacactggg

SEQ ID NO: 123889 - DNA, 27 bp, Artificial Sequence
  Description of Artificial Sequence: Synthetic oligonucleotide
cggctgagagagatgtgtacactgggg

SEQ ID NO: 123890 - DNA, 28 bp, Artificial Sequence
  Description of Artificial Sequence: Synthetic oligonucleotide
ggctgagagagatgtgtacactggggac

SEQ ID NO: 123891 - DNA, 28 bp, Artificial Sequence
  Description of Artificial Sequence: Synthetic oligonucleotide
gctgagagagatgtgtacactggggacg

SEQ ID NO: 123892 - DNA, 28 bp, Artificial Sequence
  Description of Artificial Sequence: Synthetic oligonucleotide
ctgagagagatgtgtacactggggacgc

SEQ ID NO: 123893 - DNA, 29 bp, Artificial Sequence
  Description of Artificial Sequence: Synthetic oligonucleotide
tgagagagatgtgtacactggggacgcac

SEQ ID NO: 123894 - DNA, 28 bp, Artificial Sequence
  Description of Artificial Sequence: Synthetic oligonucleotide
gagagagatgtgtacactggggacgcac

SEQ ID NO: 123895 - DNA, 29 bp, Artificial Sequence
  Description of Artificial Sequence: Synthetic oligonucleotide
agagagatgtgtacactggggacgcactc

SEQ ID NO: 123896 - DNA, 28 bp, Artificial Sequence
  Description of Artificial Sequence: Synthetic oligonucleotide
gagagatgtgtacactggggacgcactc

SEQ ID NO: 123897 - DNA, 28 bp, Artificial Sequence
  Description of Artificial Sequence: Synthetic oligonucleotide
agagatgtgtacactggggacgcactcc

SEQ ID NO: 123898 - DNA, 27 bp, Artificial Sequence
  Description of Artificial Sequence: Synthetic oligonucleotide
gagatgtgtacactggggacgcactcc

SEQ ID NO: 123899 - DNA, 27 bp, Artificial Sequence
  Description of Artificial Sequence: Synthetic oligonucleotide
agatgtgtacactggggacgcactccg

SEQ ID NO: 123900 - DNA, 26 bp, Artificial Sequence
  Description of Artificial Sequence: Synthetic oligonucleotide
gatgtgtacactggggacgcactccg

SEQ ID NO: 123901 - DNA, 27 bp, Artificial Sequence
  Description of Artificial Sequence: Synthetic oligonucleotide
atgtgtacactggggacgcactccgga

SEQ ID NO: 123902 - DNA, 27 bp, Artificial Sequence
  Description of Artificial Sequence: Synthetic oligonucleotide
tgtgtacactggggacgcactccggat

SEQ ID NO: 123903 - DNA, 26 bp, Artificial Sequence
  Description of Artificial Sequence: Synthetic oligonucleotide
gtgtacactggggacgcactccggat

SEQ ID NO: 123904 - DNA, 27 bp, Artificial Sequence
  Description of Artificial Sequence: Synthetic oligonucleotide
tgtacactggggacgcactccggatct

SEQ ID NO: 123905 - DNA, 26 bp, Artificial Sequence
  Description of Artificial Sequence: Synthetic oligonucleotide
gtacactggggacgcactccggatct

SEQ ID NO: 123906 - DNA, 26 bp, Artificial Sequence
  Description of Artificial Sequence: Synthetic oligonucleotide
tacactggggacgcactccggatctg

SEQ ID NO: 123907 - DNA, 25 bp, Artificial Sequence
  Description of Artificial Sequence: Synthetic oligonucleotide
acactggggacgcactccggatctg

SEQ ID NO: 123908 - DNA, 24 bp, Artificial Sequence
  Description of Artificial Sequence: Synthetic oligonucleotide
cactggggacgcactccggatctg

SEQ ID NO: 123909 - DNA, 27 bp, Artificial Sequence
  Description of Artificial Sequence: Synthetic oligonucleotide
actggggacgcactccggatctgcata

SEQ ID NO: 123910 - DNA, 26 bp, Artificial Sequence
  Description of Artificial Sequence: Synthetic oligonucleotide
ctggggacgcactccggatctgcata

SEQ ID NO: 123911 - DNA, 27 bp, Artificial Sequence
  Description of Artificial Sequence: Synthetic oligonucleotide
tggggacgcactccggatctgcatagt

SEQ ID NO: 123912 - DNA, 26 bp, Artificial Sequence
  Description of Artificial Sequence: Synthetic oligonucleotide
ggggacgcactccggatctgcatagt

SEQ ID NO: 123913 - DNA, 27 bp, Artificial Sequence
  Description of Artificial Sequence: Synthetic oligonucleotide
gggacgcactccggatctgcatagtga

SEQ ID NO: 123914 - DNA, 27 bp, Artificial Sequence
  Description of Artificial Sequence: Synthetic oligonucleotide
ggacgcactccggatctgcatagtgac

SEQ ID NO: 123915 - DNA, 27 bp, Artificial Sequence
  Description of Artificial Sequence: Synthetic oligonucleotide
gacgcactccggatctgcatagtgacc

SEQ ID NO: 123916 - DNA, 30 bp, Artificial Sequence
  Description of Artificial Sequence: Synthetic oligonucleotide
acgcactccggatctgcatagtgaccaaag

SEQ ID NO: 123917 - DNA, 29 bp, Artificial Sequence
  Description of Artificial Sequence: Synthetic oligonucleotide
cgcactccggatctgcatagtgaccaaag

SEQ ID NO: 123918 - DNA, 30 bp, Artificial Sequence
  Description of Artificial Sequence: Synthetic oligonucleotide
gcactccggatctgcatagtgaccaaagag

SEQ ID NO: 123919 - DNA, 30 bp, Artificial Sequence
  Description of Artificial Sequence: Synthetic oligonucleotide
cactccggatctgcatagtgaccaaagagg

SEQ ID NO: 123920 - DNA, 30 bp, Artificial Sequence
  Description of Artificial Sequence: Synthetic oligonucleotide
actccggatctgcatagtgaccaaagaggg

SEQ ID NO: 123921 - DNA, 29 bp, Artificial Sequence
  Description of Artificial Sequence: Synthetic oligonucleotide
ctccggatctgcatagtgaccaaagaggg

SEQ ID NO: 123922 - DNA, 29 bp, Artificial Sequence
  Description of Artificial Sequence: Synthetic oligonucleotide
tccggatctgcatagtgaccaaagagggc

SEQ ID NO: 123923 - DNA, 28 bp, Artificial Sequence
  Description of Artificial Sequence: Synthetic oligonucleotide
ccggatctgcatagtgaccaaagagggc

SEQ ID NO: 123924 - DNA, 30 bp, Artificial Sequence
  Description of Artificial Sequence: Synthetic oligonucleotide
cggatctgcatagtgaccaaagagggcatc

SEQ ID NO: 123925 - DNA, 31 bp, Artificial Sequence
  Description of Artificial Sequence: Synthetic oligonucleotide
ggatctgcatagtgaccaaagagggcatcag

SEQ ID NO: 123926 - DNA, 31 bp, Artificial Sequence
  Description of Artificial Sequence: Synthetic oligonucleotide
gatctgcatagtgaccaaagagggcatcagg

SEQ ID NO: 123927 - DNA, 31 bp, Artificial Sequence
  Description of Artificial Sequence: Synthetic oligonucleotide
atctgcatagtgaccaaagagggcatcaggg

SEQ ID NO: 123928 - DNA, 30 bp, Artificial Sequence
  Description of Artificial Sequence: Synthetic oligonucleotide
tctgcatagtgaccaaagagggcatcaggg

SEQ ID NO: 123929 - DNA, 29 bp, Artificial Sequence
  Description of Artificial Sequence: Synthetic oligonucleotide
ctgcatagtgaccaaagagggcatcaggg

SEQ ID NO: 123930 - DNA, 30 bp, Artificial Sequence
  Description of Artificial Sequence: Synthetic oligonucleotide
tgcatagtgaccaaagagggcatcagggag

SEQ ID NO: 123931 - DNA, 29 bp, Artificial Sequence
  Description of Artificial Sequence: Synthetic oligonucleotide
gcatagtgaccaaagagggcatcagggag

SEQ ID NO: 123932 - DNA, 29 bp, Artificial Sequence
  Description of Artificial Sequence: Synthetic oligonucleotide
catagtgaccaaagagggcatcagggagg

SEQ ID NO: 123933 - DNA, 32 bp, Artificial Sequence
  Description of Artificial Sequence: Synthetic oligonucleotide
atagtgaccaaagagggcatcagggaggaaac

SEQ ID NO: 123934 - DNA, 31 bp, Artificial Sequence
  Description of Artificial Sequence: Synthetic oligonucleotide
tagtgaccaaagagggcatcagggaggaaac

SEQ ID NO: 123935 - DNA, 30 bp, Artificial Sequence
  Description of Artificial Sequence: Synthetic oligonucleotide
agtgaccaaagagggcatcagggaggaaac

SEQ ID NO: 123936 - DNA, 29 bp, Artificial Sequence
  Description of Artificial Sequence: Synthetic oligonucleotide
gtgaccaaagagggcatcagggaggaaac

SEQ ID NO: 123937 - DNA, 30 bp, Artificial Sequence
  Description of Artificial Sequence: Synthetic oligonucleotide
tgaccaaagagggcatcagggaggaaactg

SEQ ID NO: 123938 - DNA, 29 bp, Artificial Sequence
  Description of Artificial Sequence: Synthetic oligonucleotide
gaccaaagagggcatcagggaggaaactg

SEQ ID NO: 123939 - DNA, 32 bp, Artificial Sequence
  Description of Artificial Sequence: Synthetic oligonucleotide
accaaagagggcatcagggaggaaactgtttc

SEQ ID NO: 123940 - DNA, 31 bp, Artificial Sequence
  Description of Artificial Sequence: Synthetic oligonucleotide
ccaaagagggcatcagggaggaaactgtttc

SEQ ID NO: 123941 - DNA, 31 bp, Artificial Sequence
  Description of Artificial Sequence: Synthetic oligonucleotide
caaagagggcatcagggaggaaactgtttcc

SEQ ID NO: 123942 - DNA, 35 bp, Artificial Sequence
  Description of Artificial Sequence: Synthetic oligonucleotide
aaagagggcatcagggaggaaactgtttccttaag

SEQ ID NO: 123943 - DNA, 34 bp, Artificial Sequence
  Description of Artificial Sequence: Synthetic oligonucleotide
aagagggcatcagggaggaaactgtttccttaag

SEQ ID NO: 123944 - DNA, 33 bp, Artificial Sequence
  Description of Artificial Sequence: Synthetic oligonucleotide
agagggcatcagggaggaaactgtttccttaag

SEQ ID NO: 123945 - DNA, 32 bp, Artificial Sequence
  Description of Artificial Sequence: Synthetic oligonucleotide
gagggcatcagggaggaaactgtttccttaag

SEQ ID NO: 123946 - DNA, 32 bp, Artificial Sequence
  Description of Artificial Sequence: Synthetic oligonucleotide
agggcatcagggaggaaactgtttccttaagg

SEQ ID NO: 123947 - DNA, 31 bp, Artificial Sequence
  Description of Artificial Sequence: Synthetic oligonucleotide
gggcatcagggaggaaactgtttccttaagg

SEQ ID NO: 123948 - DNA, 33 bp, Artificial Sequence
  Description of Artificial Sequence: Synthetic oligonucleotide
ggcatcagggaggaaactgtttccttaaggaag

SEQ ID NO: 123949 - DNA, 33 bp, Artificial Sequence
  Description of Artificial Sequence: Synthetic oligonucleotide
gcatcagggaggaaactgtttccttaaggaagg

SEQ ID NO: 123950 - DNA, 34 bp, Artificial Sequence
  Description of Artificial Sequence: Synthetic oligonucleotide
catcagggaggaaactgtttccttaaggaaggac

SEQ ID NO: 123951 - DNA, 35 bp, Artificial Sequence
  Description of Artificial Sequence: Synthetic oligonucleotide
atcagggaggaaactgtttccttaaggaaggactg

SEQ ID NO: 123952 - DNA, 34 bp, Artificial Sequence
  Description of Artificial Sequence: Synthetic oligonucleotide
tcagggaggaaactgtttccttaaggaaggactg

SEQ ID NO: 123953 - DNA, 33 bp, Artificial Sequence
  Description of Artificial Sequence: Synthetic oligonucleotide
cagggaggaaactgtttccttaaggaaggactg

SEQ ID NO: 123954 - DNA, 29 bp, Artificial Sequence
  Description of Artificial Sequence: Synthetic oligonucleotide
atggagtacctcatcggtatccaaggccc

SEQ ID NO: 123955 - DNA, 28 bp, Artificial Sequence
  Description of Artificial Sequence: Synthetic oligonucleotide
tggagtacctcatcggtatccaaggccc

SEQ ID NO: 123956 - DNA, 27 bp, Artificial Sequence
  Description of Artificial Sequence: Synthetic oligonucleotide
ggagtacctcatcggtatccaaggccc

SEQ ID NO: 123957 - DNA, 27 bp, Artificial Sequence
  Description of Artificial Sequence: Synthetic oligonucleotide
gagtacctcatcggtatccaaggcccc

SEQ ID NO: 123958 - DNA, 27 bp, Artificial Sequence
  Description of Artificial Sequence: Synthetic oligonucleotide
agtacctcatcggtatccaaggccccg

SEQ ID NO: 123959 - DNA, 27 bp, Artificial Sequence
  Description of Artificial Sequence: Synthetic oligonucleotide
gtacctcatcggtatccaaggccccga

SEQ ID NO: 123960 - DNA, 27 bp, Artificial Sequence
  Description of Artificial Sequence: Synthetic oligonucleotide
tacctcatcggtatccaaggccccgac

SEQ ID NO: 123961 - DNA, 27 bp, Artificial Sequence
  Description of Artificial Sequence: Synthetic oligonucleotide
acctcatcggtatccaaggccccgact

SEQ ID NO: 123962 - DNA, 27 bp, Artificial Sequence
  Description of Artificial Sequence: Synthetic oligonucleotide
cctcatcggtatccaaggccccgacta

SEQ ID NO: 123963 - DNA, 28 bp, Artificial Sequence
  Description of Artificial Sequence: Synthetic oligonucleotide
ctcatcggtatccaaggccccgactatg

SEQ ID NO: 123964 - DNA, 30 bp, Artificial Sequence
  Description of Artificial Sequence: Synthetic oligonucleotide
tcatcggtatccaaggccccgactatgttc

SEQ ID NO: 123965 - DNA, 29 bp, Artificial Sequence
  Description of Artificial Sequence: Synthetic oligonucleotide
catcggtatccaaggccccgactatgttc

SEQ ID NO: 123966 - DNA, 31 bp, Artificial Sequence
  Description of Artificial Sequence: Synthetic oligonucleotide
atcggtatccaaggccccgactatgttcttg

SEQ ID NO: 123967 - DNA, 30 bp, Artificial Sequence
  Description of Artificial Sequence: Synthetic oligonucleotide
tcggtatccaaggccccgactatgttcttg

SEQ ID NO: 123968 - DNA, 29 bp, Artificial Sequence
  Description of Artificial Sequence: Synthetic oligonucleotide
cggtatccaaggccccgactatgttcttg

SEQ ID NO: 123969 - DNA, 30 bp, Artificial Sequence
  Description of Artificial Sequence: Synthetic oligonucleotide
ggtatccaaggccccgactatgttcttgtc

SEQ ID NO: 123970 - DNA, 30 bp, Artificial Sequence
  Description of Artificial Sequence: Synthetic oligonucleotide
gtatccaaggccccgactatgttcttgtcg

SEQ ID NO: 123971 - DNA, 30 bp, Artificial Sequence
  Description of Artificial Sequence: Synthetic oligonucleotide
tatccaaggccccgactatgttcttgtcgc

SEQ ID NO: 123972 - DNA, 29 bp, Artificial Sequence
  Description of Artificial Sequence: Synthetic oligonucleotide
atccaaggccccgactatgttcttgtcgc

SEQ ID NO: 123973 - DNA, 28 bp, Artificial Sequence
  Description of Artificial Sequence: Synthetic oligonucleotide
tccaaggccccgactatgttcttgtcgc

SEQ ID NO: 123974 - DNA, 27 bp, Artificial Sequence
  Description of Artificial Sequence: Synthetic oligonucleotide
ccaaggccccgactatgttcttgtcgc

SEQ ID NO: 123975 - DNA, 27 bp, Artificial Sequence
  Description of Artificial Sequence: Synthetic oligonucleotide
caaggccccgactatgttcttgtcgcc

SEQ ID NO: 123976 - DNA, 28 bp, Artificial Sequence
  Description of Artificial Sequence: Synthetic oligonucleotide
aaggccccgactatgttcttgtcgcctc

SEQ ID NO: 123977 - DNA, 27 bp, Artificial Sequence
  Description of Artificial Sequence: Synthetic oligonucleotide
aggccccgactatgttcttgtcgcctc

SEQ ID NO: 123978 - DNA, 26 bp, Artificial Sequence
  Description of Artificial Sequence: Synthetic oligonucleotide
ggccccgactatgttcttgtcgcctc

SEQ ID NO: 123979 - DNA, 26 bp, Artificial Sequence
  Description of Artificial Sequence: Synthetic oligonucleotide
gccccgactatgttcttgtcgcctcc

SEQ ID NO: 123980 - DNA, 27 bp, Artificial Sequence
  Description of Artificial Sequence: Synthetic oligonucleotide
ccccgactatgttcttgtcgcctccga

SEQ ID NO: 123981 - DNA, 27 bp, Artificial Sequence
  Description of Artificial Sequence: Synthetic oligonucleotide
cccgactatgttcttgtcgcctccgac

SEQ ID NO: 123982 - DNA, 27 bp, Artificial Sequence
  Description of Artificial Sequence: Synthetic oligonucleotide
ccgactatgttcttgtcgcctccgacc

SEQ ID NO: 123983 - DNA, 27 bp, Artificial Sequence
  Description of Artificial Sequence: Synthetic oligonucleotide
cgactatgttcttgtcgcctccgaccg

SEQ ID NO: 123984 - DNA, 27 bp, Artificial Sequence
  Description of Artificial Sequence: Synthetic oligonucleotide
gactatgttcttgtcgcctccgaccgg

SEQ ID NO: 123985 - DNA, 27 bp, Artificial Sequence
  Description of Artificial Sequence: Synthetic oligonucleotide
actatgttcttgtcgcctccgaccggg

SEQ ID NO: 123986 - DNA, 27 bp, Artificial Sequence
  Description of Artificial Sequence: Synthetic oligonucleotide
ctatgttcttgtcgcctccgaccgggt

SEQ ID NO: 123987 - DNA, 27 bp, Artificial Sequence
  Description of Artificial Sequence: Synthetic oligonucleotide
tatgttcttgtcgcctccgaccgggtg

SEQ ID NO: 123988 - DNA, 26 bp, Artificial Sequence
  Description of Artificial Sequence: Synthetic oligonucleotide
atgttcttgtcgcctccgaccgggtg

SEQ ID NO: 123989 - DNA, 25 bp, Artificial Sequence
  Description of Artificial Sequence: Synthetic oligonucleotide
tgttcttgtcgcctccgaccgggtg

SEQ ID NO: 123990 - DNA, 24 bp, Artificial Sequence
  Description of Artificial Sequence: Synthetic oligonucleotide
gttcttgtcgcctccgaccgggtg

SEQ ID NO: 123991 - DNA, 24 bp, Artificial Sequence
  Description of Artificial Sequence: Synthetic oligonucleotide
ttcttgtcgcctccgaccgggtgg

SEQ ID NO: 123992 - DNA, 23 bp, Artificial Sequence
  Description of Artificial Sequence: Synthetic oligonucleotide
tcttgtcgcctccgaccgggtgg

SEQ ID NO: 123993 - DNA, 22 bp, Artificial Sequence
  Description of Artificial Sequence: Synthetic oligonucleotide
cttgtcgcctccgaccgggtgg

SEQ ID NO: 123994 - DNA, 22 bp, Artificial Sequence
  Description of Artificial Sequence: Synthetic oligonucleotide
ttgtcgcctccgaccgggtggc

SEQ ID NO: 123995 - DNA, 21 bp, Artificial Sequence
  Description of Artificial Sequence: Synthetic oligonucleotide
tgtcgcctccgaccgggtggc

SEQ ID NO: 123996 - DNA, 20 bp, Artificial Sequence
  Description of Artificial Sequence: Synthetic oligonucleotide
gtcgcctccgaccgggtggc

SEQ ID NO: 123997 - DNA, 20 bp, Artificial Sequence
  Description of Artificial Sequence: Synthetic oligonucleotide
tcgcctccgaccgggtggcc

SEQ ID NO: 123998 - DNA, 20 bp, Artificial Sequence
  Description of Artificial Sequence: Synthetic oligonucleotide
cgcctccgaccgggtggcct

SEQ ID NO: 123999 - DNA, 20 bp, Artificial Sequence
  Description of Artificial Sequence: Synthetic oligonucleotide
gcctccgaccgggtggccgt

SEQ ID NO: 124000 - DNA, 20 bp, Artificial Sequence
  Description of Artificial Sequence: Synthetic oligonucleotide
cctccgaccgggtggccgct

SEQ ID NO: 124001 - DNA, 20 bp, Artificial Sequence
  Description of Artificial Sequence: Synthetic oligonucleotide
ctccgaccgggtggccgcca

SEQ ID NO: 124002 - DNA, 20 bp, Artificial Sequence
  Description of Artificial Sequence: Synthetic oligonucleotide
tccgaccgggtggccgccag

SEQ ID NO: 124003 - DNA, 20 bp, Artificial Sequence
  Description of Artificial Sequence: Synthetic oligonucleotide
ccgaccgggtggccgccagt

SEQ ID NO: 124004 - DNA, 25 bp, Artificial Sequence
  Description of Artificial Sequence: Synthetic oligonucleotide
cgaccgggtggccgccagcaatatt

SEQ ID NO: 124005 - DNA, 26 bp, Artificial Sequence
  Description of Artificial Sequence: Synthetic oligonucleotide
gaccgggtggccgccagcaatattgt

SEQ ID NO: 124006 - DNA, 26 bp, Artificial Sequence
  Description of Artificial Sequence: Synthetic oligonucleotide
accgggtggccgccagcaatattgtc

SEQ ID NO: 124007 - DNA, 25 bp, Artificial Sequence
  Description of Artificial Sequence: Synthetic oligonucleotide
ccgggtggccgccagcaatattgtc

SEQ ID NO: 124008 - DNA, 26 bp, Artificial Sequence
  Description of Artificial Sequence: Synthetic oligonucleotide
cgggtggccgccagcaatattgtcca

SEQ ID NO: 124009 - DNA, 27 bp, Artificial Sequence
  Description of Artificial Sequence: Synthetic oligonucleotide
gggtggccgccagcaatattgtccaga

SEQ ID NO: 124010 - DNA, 28 bp, Artificial Sequence
  Description of Artificial Sequence: Synthetic oligonucleotide
ggtggccgccagcaatattgtccagatg

SEQ ID NO: 124011 - DNA, 30 bp, Artificial Sequence
  Description of Artificial Sequence: Synthetic oligonucleotide
gtggccgccagcaatattgtccagatgaag

SEQ ID NO: 124012 - DNA, 30 bp, Artificial Sequence
  Description of Artificial Sequence: Synthetic oligonucleotide
tggccgccagcaatattgtccagatgaagg

SEQ ID NO: 124013 - DNA, 29 bp, Artificial Sequence
  Description of Artificial Sequence: Synthetic oligonucleotide
ggccgccagcaatattgtccagatgaagg

SEQ ID NO: 124014 - DNA, 30 bp, Artificial Sequence
  Description of Artificial Sequence: Synthetic oligonucleotide
gccgccagcaatattgtccagatgaaggac

SEQ ID NO: 124015 - DNA, 30 bp, Artificial Sequence
  Description of Artificial Sequence: Synthetic oligonucleotide
ccgccagcaatattgtccagatgaaggacg

SEQ ID NO: 124016 - DNA, 32 bp, Artificial Sequence
  Description of Artificial Sequence: Synthetic oligonucleotide
cgccagcaatattgtccagatgaaggacgatc

SEQ ID NO: 124017 - DNA, 34 bp, Artificial Sequence
  Description of Artificial Sequence: Synthetic oligonucleotide
gccagcaatattgtccagatgaaggacgatcatg

SEQ ID NO: 124018 - DNA, 35 bp, Artificial Sequence
  Description of Artificial Sequence: Synthetic oligonucleotide
ccagcaatattgtccagatgaaggacgatcatgac

SEQ ID NO: 124019 - DNA, 37 bp, Artificial Sequence
  Description of Artificial Sequence: Synthetic oligonucleotide
cagcaatattgtccagatgaaggacgatcatgacaag

SEQ ID NO: 124020 - DNA, 39 bp, Artificial Sequence
  Description of Artificial Sequence: Synthetic oligonucleotide
agcaatattgtccagatgaaggacgatcatgacaagatg

SEQ ID NO: 124021 - DNA, 38 bp, Artificial Sequence
  Description of Artificial Sequence: Synthetic oligonucleotide
gcaatattgtccagatgaaggacgatcatgacaagatg

SEQ ID NO: 124022 - DNA, 43 bp, Artificial Sequence
  Description of Artificial Sequence: Synthetic oligonucleotide
caatattgtccagatgaaggacgatcatgacaagatgtttaag

SEQ ID NO: 124023 - DNA, 45 bp, Artificial Sequence
  Description of Artificial Sequence: Synthetic oligonucleotide
aatattgtccagatgaaggacgatcatgacaagatgtttaagatg

SEQ ID NO: 124024 - DNA, 44 bp, Artificial Sequence
  Description of Artificial Sequence: Synthetic oligonucleotide
atattgtccagatgaaggacgatcatgacaagatgtttaagatg

SEQ ID NO: 124025 - DNA, 43 bp, Artificial Sequence
  Description of Artificial Sequence: Synthetic oligonucleotide
tattgtccagatgaaggacgatcatgacaagatgtttaagatg

SEQ ID NO: 124026 - DNA, 42 bp, Artificial Sequence
  Description of Artificial Sequence: Synthetic oligonucleotide
attgtccagatgaaggacgatcatgacaagatgtttaagatg

SEQ ID NO: 124027 - DNA, 41 bp, Artificial Sequence
  Description of Artificial Sequence: Synthetic oligonucleotide
ttgtccagatgaaggacgatcatgacaagatgtttaagatg

SEQ ID NO: 124028 - DNA, 40 bp, Artificial Sequence
  Description of Artificial Sequence: Synthetic oligonucleotide
tgtccagatgaaggacgatcatgacaagatgtttaagatg

SEQ ID NO: 124029 - DNA, 39 bp, Artificial Sequence
  Description of Artificial Sequence: Synthetic oligonucleotide
gtccagatgaaggacgatcatgacaagatgtttaagatg

SEQ ID NO: 124030 - DNA, 40 bp, Artificial Sequence
  Description of Artificial Sequence: Synthetic oligonucleotide
tccagatgaaggacgatcatgacaagatgtttaagatgag

SEQ ID NO: 124031 - DNA, 39 bp, Artificial Sequence
  Description of Artificial Sequence: Synthetic oligonucleotide
ccagatgaaggacgatcatgacaagatgtttaagatgag

SEQ ID NO: 124032 - DNA, 40 bp, Artificial Sequence
  Description of Artificial Sequence: Synthetic oligonucleotide
cagatgaaggacgatcatgacaagatgtttaagatgagtg

SEQ ID NO: 124033 - DNA, 44 bp, Artificial Sequence
  Description of Artificial Sequence: Synthetic oligonucleotide
agatgaaggacgatcatgacaagatgtttaagatgagtgaaaag

SEQ ID NO: 124034 - DNA, 43 bp, Artificial Sequence
  Description of Artificial Sequence: Synthetic oligonucleotide
gatgaaggacgatcatgacaagatgtttaagatgagtgaaaag

SEQ ID NO: 124035 - DNA, 49 bp, Artificial Sequence
  Description of Artificial Sequence: Synthetic oligonucleotide
atgaaggacgatcatgacaagatgtttaagatgagtgaaaagatattac

SEQ ID NO: 124036 - DNA, 48 bp, Artificial Sequence
  Description of Artificial Sequence: Synthetic oligonucleotide
tgaaggacgatcatgacaagatgtttaagatgagtgaaaagatattac

SEQ ID NO: 124037 - DNA, 47 bp, Artificial Sequence
  Description of Artificial Sequence: Synthetic oligonucleotide
gaaggacgatcatgacaagatgtttaagatgagtgaaaagatattac

SEQ ID NO: 124038 - DNA, 48 bp, Artificial Sequence
  Description of Artificial Sequence: Synthetic oligonucleotide
aaggacgatcatgacaagatgtttaagatgagtgaaaagatattactc

SEQ ID NO: 124039 - DNA, 47 bp, Artificial Sequence
  Description of Artificial Sequence: Synthetic oligonucleotide
aggacgatcatgacaagatgtttaagatgagtgaaaagatattactc

SEQ ID NO: 124040 - DNA, 46 bp, Artificial Sequence
  Description of Artificial Sequence: Synthetic oligonucleotide
ggacgatcatgacaagatgtttaagatgagtgaaaagatattactc

SEQ ID NO: 124041 - DNA, 46 bp, Artificial Sequence
  Description of Artificial Sequence: Synthetic oligonucleotide
gacgatcatgacaagatgtttaagatgagtgaaaagatattactcc

SEQ ID NO: 124042 - DNA, 47 bp, Artificial Sequence
  Description of Artificial Sequence: Synthetic oligonucleotide
acgatcatgacaagatgtttaagatgagtgaaaagatattactcctg

SEQ ID NO: 124043 - DNA, 46 bp, Artificial Sequence
  Description of Artificial Sequence: Synthetic oligonucleotide
cgatcatgacaagatgtttaagatgagtgaaaagatattactcctg

SEQ ID NO: 124044 - DNA, 47 bp, Artificial Sequence
  Description of Artificial Sequence: Synthetic oligonucleotide
gatcatgacaagatgtttaagatgagtgaaaagatattactcctgtg

SEQ ID NO: 124045 - DNA, 48 bp, Artificial Sequence
  Description of Artificial Sequence: Synthetic oligonucleotide
atcatgacaagatgtttaagatgagtgaaaagatattactcctgtgtg

SEQ ID NO: 124046 - DNA, 47 bp, Artificial Sequence
  Description of Artificial Sequence: Synthetic oligonucleotide
tcatgacaagatgtttaagatgagtgaaaagatattactcctgtgtg

SEQ ID NO: 124047 - DNA, 46 bp, Artificial Sequence
  Description of Artificial Sequence: Synthetic oligonucleotide
catgacaagatgtttaagatgagtgaaaagatattactcctgtgtg

SEQ ID NO: 124048 - DNA, 48 bp, Artificial Sequence
  Description of Artificial Sequence: Synthetic oligonucleotide
atgacaagatgtttaagatgagtgaaaagatattactcctgtgtgttg

SEQ ID NO: 124049 - DNA, 47 bp, Artificial Sequence
  Description of Artificial Sequence: Synthetic oligonucleotide
tgacaagatgtttaagatgagtgaaaagatattactcctgtgtgttg

SEQ ID NO: 124050 - DNA, 46 bp, Artificial Sequence
  Description of Artificial Sequence: Synthetic oligonucleotide
gacaagatgtttaagatgagtgaaaagatattactcctgtgtgttg

SEQ ID NO: 124051 - DNA, 46 bp, Artificial Sequence
  Description of Artificial Sequence: Synthetic oligonucleotide
acaagatgtttaagatgagtgaaaagatattactcctgtgtgttgg

SEQ ID NO: 124052 - DNA, 45 bp, Artificial Sequence
  Description of Artificial Sequence: Synthetic oligonucleotide
caagatgtttaagatgagtgaaaagatattactcctgtgtgttgg

SEQ ID NO: 124053 - DNA, 46 bp, Artificial Sequence
  Description of Artificial Sequence: Synthetic oligonucleotide
aagatgtttaagatgagtgaaaagatattactcctgtgtgttggag

SEQ ID NO: 124054 - DNA, 45 bp, Artificial Sequence
  Description of Artificial Sequence: Synthetic oligonucleotide
agatgtttaagatgagtgaaaagatattactcctgtgtgttggag

SEQ ID NO: 124055 - DNA, 44 bp, Artificial Sequence
  Description of Artificial Sequence: Synthetic oligonucleotide
gatgtttaagatgagtgaaaagatattactcctgtgtgttggag

SEQ ID NO: 124056 - DNA, 45 bp, Artificial Sequence
  Description of Artificial Sequence: Synthetic oligonucleotide
atgtttaagatgagtgaaaagatattactcctgtgtgttggagag

SEQ ID NO: 124057 - DNA, 44 bp, Artificial Sequence
  Description of Artificial Sequence: Synthetic oligonucleotide
tgtttaagatgagtgaaaagatattactcctgtgtgttggagag

SEQ ID NO: 124058 - DNA, 43 bp, Artificial Sequence
  Description of Artificial Sequence: Synthetic oligonucleotide
gtttaagatgagtgaaaagatattactcctgtgtgttggagag

SEQ ID NO: 124059 - DNA, 43 bp, Artificial Sequence
  Description of Artificial Sequence: Synthetic oligonucleotide
tttaagatgagtgaaaagatattactcctgtgtgttggagagg

SEQ ID NO: 124060 - DNA, 42 bp, Artificial Sequence
  Description of Artificial Sequence: Synthetic oligonucleotide
ttaagatgagtgaaaagatattactcctgtgtgttggagagg

SEQ ID NO: 124061 - DNA, 41 bp, Artificial Sequence
  Description of Artificial Sequence: Synthetic oligonucleotide
taagatgagtgaaaagatattactcctgtgtgttggagagg

SEQ ID NO: 124062 - DNA, 40 bp, Artificial Sequence
  Description of Artificial Sequence: Synthetic oligonucleotide
aagatgagtgaaaagatattactcctgtgtgttggagagg

SEQ ID NO: 124063 - DNA, 39 bp, Artificial Sequence
  Description of Artificial Sequence: Synthetic oligonucleotide
agatgagtgaaaagatattactcctgtgtgttggagagg

SEQ ID NO: 124064 - DNA, 38 bp, Artificial Sequence
  Description of Artificial Sequence: Synthetic oligonucleotide
gatgagtgaaaagatattactcctgtgtgttggagagg

SEQ ID NO: 124065 - DNA, 38 bp, Artificial Sequence
  Description of Artificial Sequence: Synthetic oligonucleotide
atgagtgaaaagatattactcctgtgtgttggagaggc

SEQ ID NO: 124066 - DNA, 37 bp, Artificial Sequence
  Description of Artificial Sequence: Synthetic oligonucleotide
tgagtgaaaagatattactcctgtgtgttggagaggc

SEQ ID NO: 124067 - DNA, 36 bp, Artificial Sequence
  Description of Artificial Sequence: Synthetic oligonucleotide
gagtgaaaagatattactcctgtgtgttggagaggc

SEQ ID NO: 124068 - DNA, 37 bp, Artificial Sequence
  Description of Artificial Sequence: Synthetic oligonucleotide
agtgaaaagatattactcctgtgtgttggagaggctg

SEQ ID NO: 124069 - DNA, 36 bp, Artificial Sequence
  Description of Artificial Sequence: Synthetic oligonucleotide
gtgaaaagatattactcctgtgtgttggagaggctg

SEQ ID NO: 124070 - DNA, 36 bp, Artificial Sequence
  Description of Artificial Sequence: Synthetic oligonucleotide
tgaaaagatattactcctgtgtgttggagaggctgg

SEQ ID NO: 124071 - DNA, 35 bp, Artificial Sequence
  Description of Artificial Sequence: Synthetic oligonucleotide
gaaaagatattactcctgtgtgttggagaggctgg

SEQ ID NO: 124072 - DNA, 36 bp, Artificial Sequence
  Description of Artificial Sequence: Synthetic oligonucleotide
aaaagatattactcctgtgtgttggagaggctggag

SEQ ID NO: 124073 - DNA, 35 bp, Artificial Sequence
  Description of Artificial Sequence: Synthetic oligonucleotide
aaagatattactcctgtgtgttggagaggctggag

SEQ ID NO: 124074 - DNA, 34 bp, Artificial Sequence
  Description of Artificial Sequence: Synthetic oligonucleotide
aagatattactcctgtgtgttggagaggctggag

SEQ ID NO: 124075 - DNA, 33 bp, Artificial Sequence
  Description of Artificial Sequence: Synthetic oligonucleotide
agatattactcctgtgtgttggagaggctggag

SEQ ID NO: 124076 - DNA, 32 bp, Artificial Sequence
  Description of Artificial Sequence: Synthetic oligonucleotide
gatattactcctgtgtgttggagaggctggag

SEQ ID NO: 124077 - DNA, 33 bp, Artificial Sequence
  Description of Artificial Sequence: Synthetic oligonucleotide
atattactcctgtgtgttggagaggctggagac

SEQ ID NO: 124078 - DNA, 32 bp, Artificial Sequence
  Description of Artificial Sequence: Synthetic oligonucleotide
tattactcctgtgtgttggagaggctggagac

SEQ ID NO: 124079 - DNA, 31 bp, Artificial Sequence
  Description of Artificial Sequence: Synthetic oligonucleotide
attactcctgtgtgttggagaggctggagac

SEQ ID NO: 124080 - DNA, 30 bp, Artificial Sequence
  Description of Artificial Sequence: Synthetic oligonucleotide
ttactcctgtgtgttggagaggctggagac

SEQ ID NO: 124081 - DNA, 29 bp, Artificial Sequence
  Description of Artificial Sequence: Synthetic oligonucleotide
tactcctgtgtgttggagaggctggagac

SEQ ID NO: 124082 - DNA, 28 bp, Artificial Sequence
  Description of Artificial Sequence: Synthetic oligonucleotide
actcctgtgtgttggagaggctggagac

SEQ ID NO: 124083 - DNA, 27 bp, Artificial Sequence
  Description of Artificial Sequence: Synthetic oligonucleotide
ctcctgtgtgttggagaggctggagac

SEQ ID NO: 124084 - DNA, 28 bp, Artificial Sequence
  Description of Artificial Sequence: Synthetic oligonucleotide
tcctgtgtgttggagaggctggagacac

SEQ ID NO: 124085 - DNA, 27 bp, Artificial Sequence
  Description of Artificial Sequence: Synthetic oligonucleotide
cctgtgtgttggagaggctggagacac

SEQ ID NO: 124086 - DNA, 28 bp, Artificial Sequence
  Description of Artificial Sequence: Synthetic oligonucleotide
ctgtgtgttggagaggctggagacactg

SEQ ID NO: 124087 - DNA, 30 bp, Artificial Sequence
  Description of Artificial Sequence: Synthetic oligonucleotide
tgtgtgttggagaggctggagacactgtac

SEQ ID NO: 124088 - DNA, 29 bp, Artificial Sequence
  Description of Artificial Sequence: Synthetic oligonucleotide
gtgtgttggagaggctggagacactgtac

SEQ ID NO: 124089 - DNA, 30 bp, Artificial Sequence
  Description of Artificial Sequence: Synthetic oligonucleotide
tgtgttggagaggctggagacactgtacag

SEQ ID NO: 124090 - DNA, 29 bp, Artificial Sequence
  Description of Artificial Sequence: Synthetic oligonucleotide
gtgttggagaggctggagacactgtacag

SEQ ID NO: 124091 - DNA, 32 bp, Artificial Sequence
  Description of Artificial Sequence: Synthetic oligonucleotide
tgttggagaggctggagacactgtacagtttg

SEQ ID NO: 124092 - DNA, 31 bp, Artificial Sequence
  Description of Artificial Sequence: Synthetic oligonucleotide
gttggagaggctggagacactgtacagtttg

SEQ ID NO: 124093 - DNA, 31 bp, Artificial Sequence
  Description of Artificial Sequence: Synthetic oligonucleotide
ttggagaggctggagacactgtacagtttgc

SEQ ID NO: 124094 - DNA, 30 bp, Artificial Sequence
  Description of Artificial Sequence: Synthetic oligonucleotide
tggagaggctggagacactgtacagtttgc

SEQ ID NO: 124095 - DNA, 29 bp, Artificial Sequence
  Description of Artificial Sequence: Synthetic oligonucleotide
ggagaggctggagacactgtacagtttgc

SEQ ID NO: 124096 - DNA, 30 bp, Artificial Sequence
  Description of Artificial Sequence: Synthetic oligonucleotide
gagaggctggagacactgtacagtttgcag

SEQ ID NO: 124097 - DNA, 38 bp, Artificial Sequence
  Description of Artificial Sequence: Synthetic oligonucleotide
agaggctggagacactgtacagtttgcagaatatattc

SEQ ID NO: 124098 - DNA, 37 bp, Artificial Sequence
  Description of Artificial Sequence: Synthetic oligonucleotide
gaggctggagacactgtacagtttgcagaatatattc

SEQ ID NO: 124099 - DNA, 38 bp, Artificial Sequence
  Description of Artificial Sequence: Synthetic oligonucleotide
aggctggagacactgtacagtttgcagaatatattcag

SEQ ID NO: 124100 - DNA, 37 bp, Artificial Sequence
  Description of Artificial Sequence: Synthetic oligonucleotide
ggctggagacactgtacagtttgcagaatatattcag

SEQ ID NO: 124101 - DNA, 42 bp, Artificial Sequence
  Description of Artificial Sequence: Synthetic oligonucleotide
gctggagacactgtacagtttgcagaatatattcagaaaaac

SEQ ID NO: 124102 - DNA, 42 bp, Artificial Sequence
  Description of Artificial Sequence: Synthetic oligonucleotide
ctggagacactgtacagtttgcagaatatattcagaaaaacg

SEQ ID NO: 124103 - DNA, 43 bp, Artificial Sequence
  Description of Artificial Sequence: Synthetic oligonucleotide
tggagacactgtacagtttgcagaatatattcagaaaaacgtg

SEQ ID NO: 124104 - DNA, 42 bp, Artificial Sequence
  Description of Artificial Sequence: Synthetic oligonucleotide
ggagacactgtacagtttgcagaatatattcagaaaaacgtg

SEQ ID NO: 124105 - DNA, 42 bp, Artificial Sequence
  Description of Artificial Sequence: Synthetic oligonucleotide
gagacactgtacagtttgcagaatatattcagaaaaacgtgc

SEQ ID NO: 124106 - DNA, 44 bp, Artificial Sequence
  Description of Artificial Sequence: Synthetic oligonucleotide
agacactgtacagtttgcagaatatattcagaaaaacgtgcaac

SEQ ID NO: 124107 - DNA, 43 bp, Artificial Sequence
  Description of Artificial Sequence: Synthetic oligonucleotide
gacactgtacagtttgcagaatatattcagaaaaacgtgcaac

SEQ ID NO: 124108 - DNA, 50 bp, Artificial Sequence
  Description of Artificial Sequence: Synthetic oligonucleotide
acactgtacagtttgcagaatatattcagaaaaacgtgcaactttataag

SEQ ID NO: 124109 - DNA, 49 bp, Artificial Sequence
  Description of Artificial Sequence: Synthetic oligonucleotide
cactgtacagtttgcagaatatattcagaaaaacgtgcaactttataag

SEQ ID NO: 124110 - DNA, 51 bp, Artificial Sequence
  Description of Artificial Sequence: Synthetic oligonucleotide
actgtacagtttgcagaatatattcagaaaaacgtgcaactttataagatg

SEQ ID NO: 124111 - DNA, 50 bp, Artificial Sequence
  Description of Artificial Sequence: Synthetic oligonucleotide
ctgtacagtttgcagaatatattcagaaaaacgtgcaactttataagatg

SEQ ID NO: 124112 - DNA, 50 bp, Artificial Sequence
  Description of Artificial Sequence: Synthetic oligonucleotide
tgtacagtttgcagaatatattcagaaaaacgtgcaactttataagatgc

SEQ ID NO: 124113 - DNA, 49 bp, Artificial Sequence
  Description of Artificial Sequence: Synthetic oligonucleotide
gtacagtttgcagaatatattcagaaaaacgtgcaactttataagatgc

SEQ ID NO: 124114 - DNA, 49 bp, Artificial Sequence
  Description of Artificial Sequence: Synthetic oligonucleotide
tacagtttgcagaatatattcagaaaaacgtgcaactttataagatgcg

SEQ ID NO: 124115 - DNA, 48 bp, Artificial Sequence
  Description of Artificial Sequence: Synthetic oligonucleotide
acagtttgcagaatatattcagaaaaacgtgcaactttataagatgcg

SEQ ID NO: 124116 - DNA, 47 bp, Artificial Sequence
  Description of Artificial Sequence: Synthetic oligonucleotide
cagtttgcagaatatattcagaaaaacgtgcaactttataagatgcg

SEQ ID NO: 124117 - DNA, 51 bp, Artificial Sequence
  Description of Artificial Sequence: Synthetic oligonucleotide
agtttgcagaatatattcagaaaaacgtgcaactttataagatgcgaaatg

SEQ ID NO: 124118 - DNA, 50 bp, Artificial Sequence
  Description of Artificial Sequence: Synthetic oligonucleotide
gtttgcagaatatattcagaaaaacgtgcaactttataagatgcgaaatg

SEQ ID NO: 124119 - DNA, 50 bp, Artificial Sequence
  Description of Artificial Sequence: Synthetic oligonucleotide
tttgcagaatatattcagaaaaacgtgcaactttataagatgcgaaatgg

SEQ ID NO: 124120 - DNA, 49 bp, Artificial Sequence
  Description of Artificial Sequence: Synthetic oligonucleotide
ttgcagaatatattcagaaaaacgtgcaactttataagatgcgaaatgg

SEQ ID NO: 124121 - DNA, 48 bp, Artificial Sequence
  Description of Artificial Sequence: Synthetic oligonucleotide
tgcagaatatattcagaaaaacgtgcaactttataagatgcgaaatgg

SEQ ID NO: 124122 - DNA, 47 bp, Artificial Sequence
  Description of Artificial Sequence: Synthetic oligonucleotide
gcagaatatattcagaaaaacgtgcaactttataagatgcgaaatgg

SEQ ID NO: 124123 - DNA, 51 bp, Artificial Sequence
  Description of Artificial Sequence: Synthetic oligonucleotide
cagaatatattcagaaaaacgtgcaactttataagatgcgaaatggatatg

SEQ ID NO: 124124 - DNA, 55 bp, Artificial Sequence
  Description of Artificial Sequence: Synthetic oligonucleotide
agaatatattcagaaaaacgtgcaactttataagatgcgaaatggatatgaattg

SEQ ID NO: 124125 - DNA, 54 bp, Artificial Sequence
  Description of Artificial Sequence: Synthetic oligonucleotide
gaatatattcagaaaaacgtgcaactttataagatgcgaaatggatatgaattg

SEQ ID NO: 124126 - DNA, 55 bp, Artificial Sequence
  Description of Artificial Sequence: Synthetic oligonucleotide
aatatattcagaaaaacgtgcaactttataagatgcgaaatggatatgaattgtc

SEQ ID NO: 124127 - DNA, 54 bp, Artificial Sequence
  Description of Artificial Sequence: Synthetic oligonucleotide
atatattcagaaaaacgtgcaactttataagatgcgaaatggatatgaattgtc

SEQ ID NO: 124128 - DNA, 53 bp, Artificial Sequence
  Description of Artificial Sequence: Synthetic oligonucleotide
tatattcagaaaaacgtgcaactttataagatgcgaaatggatatgaattgtc

SEQ ID NO: 124129 - DNA, 52 bp, Artificial Sequence
  Description of Artificial Sequence: Synthetic oligonucleotide
atattcagaaaaacgtgcaactttataagatgcgaaatggatatgaattgtc

SEQ ID NO: 124130 - DNA, 51 bp, Artificial Sequence
  Description of Artificial Sequence: Synthetic oligonucleotide
tattcagaaaaacgtgcaactttataagatgcgaaatggatatgaattgtc

SEQ ID NO: 124131 - DNA, 50 bp, Artificial Sequence
  Description of Artificial Sequence: Synthetic oligonucleotide
attcagaaaaacgtgcaactttataagatgcgaaatggatatgaattgtc

SEQ ID NO: 124132 - DNA, 49 bp, Artificial Sequence
  Description of Artificial Sequence: Synthetic oligonucleotide
ttcagaaaaacgtgcaactttataagatgcgaaatggatatgaattgtc

SEQ ID NO: 124133 - DNA, 48 bp, Artificial Sequence
  Description of Artificial Sequence: Synthetic oligonucleotide
tcagaaaaacgtgcaactttataagatgcgaaatggatatgaattgtc

SEQ ID NO: 124134 - DNA, 47 bp, Artificial Sequence
  Description of Artificial Sequence: Synthetic oligonucleotide
cagaaaaacgtgcaactttataagatgcgaaatggatatgaattgtc

SEQ ID NO: 124135 - DNA, 48 bp, Artificial Sequence
  Description of Artificial Sequence: Synthetic oligonucleotide
agaaaaacgtgcaactttataagatgcgaaatggatatgaattgtctc

SEQ ID NO: 124136 - DNA, 47 bp, Artificial Sequence
  Description of Artificial Sequence: Synthetic oligonucleotide
gaaaaacgtgcaactttataagatgcgaaatggatatgaattgtctc

SEQ ID NO: 124137 - DNA, 47 bp, Artificial Sequence
  Description of Artificial Sequence: Synthetic oligonucleotide
aaaaacgtgcaactttataagatgcgaaatggatatgaattgtctcc

SEQ ID NO: 124138 - DNA, 46 bp, Artificial Sequence
  Description of Artificial Sequence: Synthetic oligonucleotide
aaaacgtgcaactttataagatgcgaaatggatatgaattgtctcc

SEQ ID NO: 124139 - DNA, 45 bp, Artificial Sequence
  Description of Artificial Sequence: Synthetic oligonucleotide
aaacgtgcaactttataagatgcgaaatggatatgaattgtctcc

SEQ ID NO: 124140 - DNA, 44 bp, Artificial Sequence
  Description of Artificial Sequence: Synthetic oligonucleotide
aacgtgcaactttataagatgcgaaatggatatgaattgtctcc

SEQ ID NO: 124141 - DNA, 43 bp, Artificial Sequence
  Description of Artificial Sequence: Synthetic oligonucleotide
acgtgcaactttataagatgcgaaatggatatgaattgtctcc

SEQ ID NO: 124142 - DNA, 42 bp, Artificial Sequence
  Description of Artificial Sequence: Synthetic oligonucleotide
cgtgcaactttataagatgcgaaatggatatgaattgtctcc

SEQ ID NO: 124143 - DNA, 42 bp, Artificial Sequence
  Description of Artificial Sequence: Synthetic oligonucleotide
gtgcaactttataagatgcgaaatggatatgaattgtctccc

SEQ ID NO: 124144 - DNA, 43 bp, Artificial Sequence
  Description of Artificial Sequence: Synthetic oligonucleotide
tgcaactttataagatgcgaaatggatatgaattgtctcccac

SEQ ID NO: 124145 - DNA, 42 bp, Artificial Sequence
  Description of Artificial Sequence: Synthetic oligonucleotide
gcaactttataagatgcgaaatggatatgaattgtctcccac

SEQ ID NO: 124146 - DNA, 42 bp, Artificial Sequence
  Description of Artificial Sequence: Synthetic oligonucleotide
caactttataagatgcgaaatggatatgaattgtctcccacg

SEQ ID NO: 124147 - DNA, 42 bp, Artificial Sequence
  Description of Artificial Sequence: Synthetic oligonucleotide
aactttataagatgcgaaatggatatgaattgtctcccacgg

SEQ ID NO: 124148 - DNA, 41 bp, Artificial Sequence
  Description of Artificial Sequence: Synthetic oligonucleotide
actttataagatgcgaaatggatatgaattgtctcccacgg

SEQ ID NO: 124149 - DNA, 40 bp, Artificial Sequence
  Description of Artificial Sequence: Synthetic oligonucleotide
ctttataagatgcgaaatggatatgaattgtctcccacgg

SEQ ID NO: 124150 - DNA, 40 bp, Artificial Sequence
  Description of Artificial Sequence: Synthetic oligonucleotide
tttataagatgcgaaatggatatgaattgtctcccacggc

SEQ ID NO: 124151 - DNA, 39 bp, Artificial Sequence
  Description of Artificial Sequence: Synthetic oligonucleotide
ttataagatgcgaaatggatatgaattgtctcccacggc

SEQ ID NO: 124152 - DNA, 38 bp, Artificial Sequence
  Description of Artificial Sequence: Synthetic oligonucleotide
tataagatgcgaaatggatatgaattgtctcccacggc

SEQ ID NO: 124153 - DNA, 37 bp, Artificial Sequence
  Description of Artificial Sequence: Synthetic oligonucleotide
ataagatgcgaaatggatatgaattgtctcccacggc

SEQ ID NO: 124154 - DNA, 36 bp, Artificial Sequence
  Description of Artificial Sequence: Synthetic oligonucleotide
taagatgcgaaatggatatgaattgtctcccacggc

SEQ ID NO: 124155 - DNA, 35 bp, Artificial Sequence
  Description of Artificial Sequence: Synthetic oligonucleotide
aagatgcgaaatggatatgaattgtctcccacggc

SEQ ID NO: 124156 - DNA, 34 bp, Artificial Sequence
  Description of Artificial Sequence: Synthetic oligonucleotide
agatgcgaaatggatatgaattgtctcccacggc

SEQ ID NO: 124157 - DNA, 33 bp, Artificial Sequence
  Description of Artificial Sequence: Synthetic oligonucleotide
gatgcgaaatggatatgaattgtctcccacggc

SEQ ID NO: 124158 - DNA, 34 bp, Artificial Sequence
  Description of Artificial Sequence: Synthetic oligonucleotide
atgcgaaatggatatgaattgtctcccacggcag

SEQ ID NO: 124159 - DNA, 33 bp, Artificial Sequence
  Description of Artificial Sequence: Synthetic oligonucleotide
tgcgaaatggatatgaattgtctcccacggcag

SEQ ID NO: 124160 - DNA, 32 bp, Artificial Sequence
  Description of Artificial Sequence: Synthetic oligonucleotide
gcgaaatggatatgaattgtctcccacggcag

SEQ ID NO: 124161 - DNA, 32 bp, Artificial Sequence
  Description of Artificial Sequence: Synthetic oligonucleotide
cgaaatggatatgaattgtctcccacggcagc

SEQ ID NO: 124162 - DNA, 33 bp, Artificial Sequence
  Description of Artificial Sequence: Synthetic oligonucleotide
gaaatggatatgaattgtctcccacggcagcag

SEQ ID NO: 124163 - DNA, 33 bp, Artificial Sequence
  Description of Artificial Sequence: Synthetic oligonucleotide
aaatggatatgaattgtctcccacggcagcagc

SEQ ID NO: 124164 - DNA, 32 bp, Artificial Sequence
  Description of Artificial Sequence: Synthetic oligonucleotide
aatggatatgaattgtctcccacggcagcagc

SEQ ID NO: 124165 - DNA, 31 bp, Artificial Sequence
  Description of Artificial Sequence: Synthetic oligonucleotide
atggatatgaattgtctcccacggcagcagc

SEQ ID NO: 124166 - DNA, 30 bp, Artificial Sequence
  Description of Artificial Sequence: Synthetic oligonucleotide
tggatatgaattgtctcccacggcagcagc

SEQ ID NO: 124167 - DNA, 29 bp, Artificial Sequence
  Description of Artificial Sequence: Synthetic oligonucleotide
ggatatgaattgtctcccacggcagcagc

SEQ ID NO: 124168 - DNA, 32 bp, Artificial Sequence
  Description of Artificial Sequence: Synthetic oligonucleotide
gatatgaattgtctcccacggcagcagctaac

SEQ ID NO: 124169 - DNA, 34 bp, Artificial Sequence
  Description of Artificial Sequence: Synthetic oligonucleotide
atatgaattgtctcccacggcagcagctaacttc

SEQ ID NO: 124170 - DNA, 33 bp, Artificial Sequence
  Description of Artificial Sequence: Synthetic oligonucleotide
tatgaattgtctcccacggcagcagctaacttc

SEQ ID NO: 124171 - DNA, 32 bp, Artificial Sequence
  Description of Artificial Sequence: Synthetic oligonucleotide
atgaattgtctcccacggcagcagctaacttc

SEQ ID NO: 124172 - DNA, 31 bp, Artificial Sequence
  Description of Artificial Sequence: Synthetic oligonucleotide
tgaattgtctcccacggcagcagctaacttc

SEQ ID NO: 124173 - DNA, 30 bp, Artificial Sequence
  Description of Artificial Sequence: Synthetic oligonucleotide
gaattgtctcccacggcagcagctaacttc

SEQ ID NO: 124174 - DNA, 31 bp, Artificial Sequence
  Description of Artificial Sequence: Synthetic oligonucleotide
aattgtctcccacggcagcagctaacttcac

SEQ ID NO: 124175 - DNA, 30 bp, Artificial Sequence
  Description of Artificial Sequence: Synthetic oligonucleotide
attgtctcccacggcagcagctaacttcac

SEQ ID NO: 124176 - DNA, 29 bp, Artificial Sequence
  Description of Artificial Sequence: Synthetic oligonucleotide
ttgtctcccacggcagcagctaacttcac

SEQ ID NO: 124177 - DNA, 28 bp, Artificial Sequence
  Description of Artificial Sequence: Synthetic oligonucleotide
tgtctcccacggcagcagctaacttcac

SEQ ID NO: 124178 - DNA, 27 bp, Artificial Sequence
  Description of Artificial Sequence: Synthetic oligonucleotide
gtctcccacggcagcagctaacttcac

SEQ ID NO: 124179 - DNA, 28 bp, Artificial Sequence
  Description of Artificial Sequence: Synthetic oligonucleotide
tctcccacggcagcagctaacttcacac

SEQ ID NO: 124180 - DNA, 27 bp, Artificial Sequence
  Description of Artificial Sequence: Synthetic oligonucleotide
ctcccacggcagcagctaacttcacac

SEQ ID NO: 124181 - DNA, 27 bp, Artificial Sequence
  Description of Artificial Sequence: Synthetic oligonucleotide
tcccacggcagcagctaacttcacacg

SEQ ID NO: 124182 - DNA, 26 bp, Artificial Sequence
  Description of Artificial Sequence: Synthetic oligonucleotide
cccacggcagcagctaacttcacacg

SEQ ID NO: 124183 - DNA, 26 bp, Artificial Sequence
  Description of Artificial Sequence: Synthetic oligonucleotide
ccacggcagcagctaacttcacacgc

SEQ ID NO: 124184 - DNA, 26 bp, Artificial Sequence
  Description of Artificial Sequence: Synthetic oligonucleotide
cacggcagcagctaacttcacacgcc

SEQ ID NO: 124185 - DNA, 27 bp, Artificial Sequence
  Description of Artificial Sequence: Synthetic oligonucleotide
acggcagcagctaacttcacacgccga

SEQ ID NO: 124186 - DNA, 27 bp, Artificial Sequence
  Description of Artificial Sequence: Synthetic oligonucleotide
cggcagcagctaacttcacacgccgaa

SEQ ID NO: 124187 - DNA, 28 bp, Artificial Sequence
  Description of Artificial Sequence: Synthetic oligonucleotide
ggcagcagctaacttcacacgccgaaac

SEQ ID NO: 124188 - DNA, 28 bp, Artificial Sequence
  Description of Artificial Sequence: Synthetic oligonucleotide
gcagcagctaacttcacacgccgaaacc

SEQ ID NO: 124189 - DNA, 29 bp, Artificial Sequence
  Description of Artificial Sequence: Synthetic oligonucleotide
cagcagctaacttcacacgccgaaacctg

SEQ ID NO: 124190 - DNA, 29 bp, Artificial Sequence
  Description of Artificial Sequence: Synthetic oligonucleotide
agcagctaacttcacacgccgaaacctgg

SEQ ID NO: 124191 - DNA, 28 bp, Artificial Sequence
  Description of Artificial Sequence: Synthetic oligonucleotide
gcagctaacttcacacgccgaaacctgg

SEQ ID NO: 124192 - DNA, 28 bp, Artificial Sequence
  Description of Artificial Sequence: Synthetic oligonucleotide
cagctaacttcacacgccgaaacctggc

SEQ ID NO: 124193 - DNA, 29 bp, Artificial Sequence
  Description of Artificial Sequence: Synthetic oligonucleotide
agctaacttcacacgccgaaacctggctg

SEQ ID NO: 124194 - DNA, 28 bp, Artificial Sequence
  Description of Artificial Sequence: Synthetic oligonucleotide
gctaacttcacacgccgaaacctggctg

SEQ ID NO: 124195 - DNA, 29 bp, Artificial Sequence
  Description of Artificial Sequence: Synthetic oligonucleotide
ctaacttcacacgccgaaacctggctgac

SEQ ID NO: 124196 - DNA, 30 bp, Artificial Sequence
  Description of Artificial Sequence: Synthetic oligonucleotide
taacttcacacgccgaaacctggctgactg

SEQ ID NO: 124197 - DNA, 29 bp, Artificial Sequence
  Description of Artificial Sequence: Synthetic oligonucleotide
aacttcacacgccgaaacctggctgactg

SEQ ID NO: 124198 - DNA, 28 bp, Artificial Sequence
  Description of Artificial Sequence: Synthetic oligonucleotide
acttcacacgccgaaacctggctgactg

SEQ ID NO: 124199 - DNA, 27 bp, Artificial Sequence
  Description of Artificial Sequence: Synthetic oligonucleotide
cttcacacgccgaaacctggctgactg

SEQ ID NO: 124200 - DNA, 28 bp, Artificial Sequence
  Description of Artificial Sequence: Synthetic oligonucleotide
ttcacacgccgaaacctggctgactgtc

SEQ ID NO: 124201 - DNA, 27 bp, Artificial Sequence
  Description of Artificial Sequence: Synthetic oligonucleotide
tcacacgccgaaacctggctgactgtc

SEQ ID NO: 124202 - DNA, 27 bp, Artificial Sequence
  Description of Artificial Sequence: Synthetic oligonucleotide
cacacgccgaaacctggctgactgtct

SEQ ID NO: 124203 - DNA, 28 bp, Artificial Sequence
  Description of Artificial Sequence: Synthetic oligonucleotide
acacgccgaaacctggctgactgtcttc

SEQ ID NO: 124204 - DNA, 27 bp, Artificial Sequence
  Description of Artificial Sequence: Synthetic oligonucleotide
cacgccgaaacctggctgactgtcttc

SEQ ID NO: 124205 - DNA, 27 bp, Artificial Sequence
  Description of Artificial Sequence: Synthetic oligonucleotide
acgccgaaacctggctgactgtcttcg

SEQ ID NO: 124206 - DNA, 26 bp, Artificial Sequence
  Description of Artificial Sequence: Synthetic oligonucleotide
cgccgaaacctggctgactgtcttcg

SEQ ID NO: 124207 - DNA, 27 bp, Artificial Sequence
  Description of Artificial Sequence: Synthetic oligonucleotide
gccgaaacctggctgactgtcttcgga

SEQ ID NO: 124208 - DNA, 27 bp, Artificial Sequence
  Description of Artificial Sequence: Synthetic oligonucleotide
ccgaaacctggctgactgtcttcggag

SEQ ID NO: 124209 - DNA, 28 bp, Artificial Sequence
  Description of Artificial Sequence: Synthetic oligonucleotide
cgaaacctggctgactgtcttcggagtc

SEQ ID NO: 124210 - DNA, 28 bp, Artificial Sequence
  Description of Artificial Sequence: Synthetic oligonucleotide
gaaacctggctgactgtcttcggagtcg

SEQ ID NO: 124211 - DNA, 28 bp, Artificial Sequence
  Description of Artificial Sequence: Synthetic oligonucleotide
aaacctggctgactgtcttcggagtcgg

SEQ ID NO: 124212 - DNA, 27 bp, Artificial Sequence
  Description of Artificial Sequence: Synthetic oligonucleotide
aacctggctgactgtcttcggagtcgg

SEQ ID NO: 124213 - DNA, 27 bp, Artificial Sequence
  Description of Artificial Sequence: Synthetic oligonucleotide
acctggctgactgtcttcggagtcgga

SEQ ID NO: 124214 - DNA, 26 bp, Artificial Sequence
  Description of Artificial Sequence: Synthetic oligonucleotide
cctggctgactgtcttcggagtcgga

SEQ ID NO: 124215 - DNA, 26 bp, Artificial Sequence
  Description of Artificial Sequence: Synthetic oligonucleotide
ctggctgactgtcttcggagtcggac

SEQ ID NO: 124216 - DNA, 26 bp, Artificial Sequence
  Description of Artificial Sequence: Synthetic oligonucleotide
tggctgactgtcttcggagtcggacc

SEQ ID NO: 124217 - DNA, 25 bp, Artificial Sequence
  Description of Artificial Sequence: Synthetic oligonucleotide
ggctgactgtcttcggagtcggacc

SEQ ID NO: 124218 - DNA, 25 bp, Artificial Sequence
  Description of Artificial Sequence: Synthetic oligonucleotide
gctgactgtcttcggagtcggaccc

SEQ ID NO: 124219 - DNA, 27 bp, Artificial Sequence
  Description of Artificial Sequence: Synthetic oligonucleotide
ctgactgtcttcggagtcggaccccat

SEQ ID NO: 124220 - DNA, 29 bp, Artificial Sequence
  Description of Artificial Sequence: Synthetic oligonucleotide
tgactgtcttcggagtcggaccccatatc

SEQ ID NO: 124221 - DNA, 28 bp, Artificial Sequence
  Description of Artificial Sequence: Synthetic oligonucleotide
gactgtcttcggagtcggaccccatatc

SEQ ID NO: 124222 - DNA, 30 bp, Artificial Sequence
  Description of Artificial Sequence: Synthetic oligonucleotide
actgtcttcggagtcggaccccatatcatg

SEQ ID NO: 124223 - DNA, 29 bp, Artificial Sequence
  Description of Artificial Sequence: Synthetic oligonucleotide
ctgtcttcggagtcggaccccatatcatg

SEQ ID NO: 124224 - DNA, 30 bp, Artificial Sequence
  Description of Artificial Sequence: Synthetic oligonucleotide
tgtcttcggagtcggaccccatatcatgtg

SEQ ID NO: 124225 - DNA, 29 bp, Artificial Sequence
  Description of Artificial Sequence: Synthetic oligonucleotide
gtcttcggagtcggaccccatatcatgtg

SEQ ID NO: 124226 - DNA, 31 bp, Artificial Sequence
  Description of Artificial Sequence: Synthetic oligonucleotide
tcttcggagtcggaccccatatcatgtgaac

SEQ ID NO: 124227 - DNA, 30 bp, Artificial Sequence
  Description of Artificial Sequence: Synthetic oligonucleotide
cttcggagtcggaccccatatcatgtgaac

SEQ ID NO: 124228 - DNA, 30 bp, Artificial Sequence
  Description of Artificial Sequence: Synthetic oligonucleotide
ttcggagtcggaccccatatcatgtgaacc

SEQ ID NO: 124229 - DNA, 29 bp, Artificial Sequence
  Description of Artificial Sequence: Synthetic oligonucleotide
tcggagtcggaccccatatcatgtgaacc

SEQ ID NO: 124230 - DNA, 28 bp, Artificial Sequence
  Description of Artificial Sequence: Synthetic oligonucleotide
cggagtcggaccccatatcatgtgaacc

SEQ ID NO: 124231 - DNA, 29 bp, Artificial Sequence
  Description of Artificial Sequence: Synthetic oligonucleotide
ggagtcggaccccatatcatgtgaacctc

SEQ ID NO: 124232 - DNA, 29 bp, Artificial Sequence
  Description of Artificial Sequence: Synthetic oligonucleotide
gagtcggaccccatatcatgtgaacctcc

SEQ ID NO: 124233 - DNA, 30 bp, Artificial Sequence
  Description of Artificial Sequence: Synthetic oligonucleotide
agtcggaccccatatcatgtgaacctcctc

SEQ ID NO: 124234 - DNA, 29 bp, Artificial Sequence
  Description of Artificial Sequence: Synthetic oligonucleotide
gtcggaccccatatcatgtgaacctcctc

SEQ ID NO: 124235 - DNA, 29 bp, Artificial Sequence
  Description of Artificial Sequence: Synthetic oligonucleotide
tcggaccccatatcatgtgaacctcctcc

SEQ ID NO: 124236 - DNA, 28 bp, Artificial Sequence
  Description of Artificial Sequence: Synthetic oligonucleotide
cggaccccatatcatgtgaacctcctcc

SEQ ID NO: 124237 - DNA, 29 bp, Artificial Sequence
  Description of Artificial Sequence: Synthetic oligonucleotide
ggaccccatatcatgtgaacctcctcctg

SEQ ID NO: 124238 - DNA, 29 bp, Artificial Sequence
  Description of Artificial Sequence: Synthetic oligonucleotide
gaccccatatcatgtgaacctcctcctgg

SEQ ID NO: 124239 - DNA, 29 bp, Artificial Sequence
  Description of Artificial Sequence: Synthetic oligonucleotide
accccatatcatgtgaacctcctcctggc

SEQ ID NO: 124240 - DNA, 28 bp, Artificial Sequence
  Description of Artificial Sequence: Synthetic oligonucleotide
ccccatatcatgtgaacctcctcctggc

SEQ ID NO: 124241 - DNA, 29 bp, Artificial Sequence
  Description of Artificial Sequence: Synthetic oligonucleotide
cccatatcatgtgaacctcctcctggctg

SEQ ID NO: 124242 - DNA, 29 bp, Artificial Sequence
  Description of Artificial Sequence: Synthetic oligonucleotide
ccatatcatgtgaacctcctcctggctgg

SEQ ID NO: 124243 - DNA, 29 bp, Artificial Sequence
  Description of Artificial Sequence: Synthetic oligonucleotide
catatcatgtgaacctcctcctggctggc

SEQ ID NO: 124244 - DNA, 32 bp, Artificial Sequence
  Description of Artificial Sequence: Synthetic oligonucleotide
atatcatgtgaacctcctcctggctggctatg

SEQ ID NO: 124245 - DNA, 31 bp, Artificial Sequence
  Description of Artificial Sequence: Synthetic oligonucleotide
tatcatgtgaacctcctcctggctggctatg

SEQ ID NO: 124246 - DNA, 30 bp, Artificial Sequence
  Description of Artificial Sequence: Synthetic oligonucleotide
atcatgtgaacctcctcctggctggctatg

SEQ ID NO: 124247 - DNA, 29 bp, Artificial Sequence
  Description of Artificial Sequence: Synthetic oligonucleotide
tcatgtgaacctcctcctggctggctatg

SEQ ID NO: 124248 - DNA, 28 bp, Artificial Sequence
  Description of Artificial Sequence: Synthetic oligonucleotide
catgtgaacctcctcctggctggctatg

SEQ ID NO: 124249 - DNA, 30 bp, Artificial Sequence
  Description of Artificial Sequence: Synthetic oligonucleotide
atgtgaacctcctcctggctggctatgatg

SEQ ID NO: 124250 - DNA, 29 bp, Artificial Sequence
  Description of Artificial Sequence: Synthetic oligonucleotide
tgtgaacctcctcctggctggctatgatg

SEQ ID NO: 124251 - DNA, 28 bp, Artificial Sequence
  Description of Artificial Sequence: Synthetic oligonucleotide
gtgaacctcctcctggctggctatgatg

SEQ ID NO: 124252 - DNA, 29 bp, Artificial Sequence
  Description of Artificial Sequence: Synthetic oligonucleotide
tgaacctcctcctggctggctatgatgag

SEQ ID NO: 124253 - DNA, 28 bp, Artificial Sequence
  Description of Artificial Sequence: Synthetic oligonucleotide
gaacctcctcctggctggctatgatgag

SEQ ID NO: 124254 - DNA, 28 bp, Artificial Sequence
  Description of Artificial Sequence: Synthetic oligonucleotide
aacctcctcctggctggctatgatgagc

SEQ ID NO: 124255 - DNA, 27 bp, Artificial Sequence
  Description of Artificial Sequence: Synthetic oligonucleotide
acctcctcctggctggctatgatgagc

SEQ ID NO: 124256 - DNA, 27 bp, Artificial Sequence
  Description of Artificial Sequence: Synthetic oligonucleotide
cctcctcctggctggctatgatgagca

SEQ ID NO: 124257 - DNA, 28 bp, Artificial Sequence
  Description of Artificial Sequence: Synthetic oligonucleotide
ctcctcctggctggctatgatgagcatg

SEQ ID NO: 124258 - DNA, 30 bp, Artificial Sequence
  Description of Artificial Sequence: Synthetic oligonucleotide
tcctcctggctggctatgatgagcatgaag

SEQ ID NO: 124259 - DNA, 29 bp, Artificial Sequence
  Description of Artificial Sequence: Synthetic oligonucleotide
cctcctggctggctatgatgagcatgaag

SEQ ID NO: 124260 - DNA, 29 bp, Artificial Sequence
  Description of Artificial Sequence: Synthetic oligonucleotide
ctcctggctggctatgatgagcatgaagg

SEQ ID NO: 124261 - DNA, 29 bp, Artificial Sequence
  Description of Artificial Sequence: Synthetic oligonucleotide
tcctggctggctatgatgagcatgaaggg

SEQ ID NO: 124262 - DNA, 28 bp, Artificial Sequence
  Description of Artificial Sequence: Synthetic oligonucleotide
cctggctggctatgatgagcatgaaggg

SEQ ID NO: 124263 - DNA, 28 bp, Artificial Sequence
  Description of Artificial Sequence: Synthetic oligonucleotide
ctggctggctatgatgagcatgaagggc

SEQ ID NO: 124264 - DNA, 28 bp, Artificial Sequence
  Description of Artificial Sequence: Synthetic oligonucleotide
tggctggctatgatgagcatgaagggcc

SEQ ID NO: 124265 - DNA, 27 bp, Artificial Sequence
  Description of Artificial Sequence: Synthetic oligonucleotide
ggctggctatgatgagcatgaagggcc

SEQ ID NO: 124266 - DNA, 28 bp, Artificial Sequence
  Description of Artificial Sequence: Synthetic oligonucleotide
gctggctatgatgagcatgaagggccag

SEQ ID NO: 124267 - DNA, 28 bp, Artificial Sequence
  Description of Artificial Sequence: Synthetic oligonucleotide
ctggctatgatgagcatgaagggccagc

SEQ ID NO: 124268 - DNA, 28 bp, Artificial Sequence
  Description of Artificial Sequence: Synthetic oligonucleotide
tggctatgatgagcatgaagggccagcg

SEQ ID NO: 124269 - DNA, 27 bp, Artificial Sequence
  Description of Artificial Sequence: Synthetic oligonucleotide
ggctatgatgagcatgaagggccagcg

SEQ ID NO: 124270 - DNA, 27 bp, Artificial Sequence
  Description of Artificial Sequence: Synthetic oligonucleotide
gctatgatgagcatgaagggccagcgc

SEQ ID NO: 124271 - DNA, 28 bp, Artificial Sequence
  Description of Artificial Sequence: Synthetic oligonucleotide
ctatgatgagcatgaagggccagcgctg

SEQ ID NO: 124272 - DNA, 33 bp, Artificial Sequence
  Description of Artificial Sequence: Synthetic oligonucleotide
tatgatgagcatgaagggccagcgctgtattac

SEQ ID NO: 124273 - DNA, 32 bp, Artificial Sequence
  Description of Artificial Sequence: Synthetic oligonucleotide
atgatgagcatgaagggccagcgctgtattac

SEQ ID NO: 124274 - DNA, 31 bp, Artificial Sequence
  Description of Artificial Sequence: Synthetic oligonucleotide
tgatgagcatgaagggccagcgctgtattac

SEQ ID NO: 124275 - DNA, 30 bp, Artificial Sequence
  Description of Artificial Sequence: Synthetic oligonucleotide
gatgagcatgaagggccagcgctgtattac

SEQ ID NO: 124276 - DNA, 32 bp, Artificial Sequence
  Description of Artificial Sequence: Synthetic oligonucleotide
atgagcatgaagggccagcgctgtattacatg

SEQ ID NO: 124277 - DNA, 31 bp, Artificial Sequence
  Description of Artificial Sequence: Synthetic oligonucleotide
tgagcatgaagggccagcgctgtattacatg

SEQ ID NO: 124278 - DNA, 30 bp, Artificial Sequence
  Description of Artificial Sequence: Synthetic oligonucleotide
gagcatgaagggccagcgctgtattacatg

SEQ ID NO: 124279 - DNA, 30 bp, Artificial Sequence
  Description of Artificial Sequence: Synthetic oligonucleotide
agcatgaagggccagcgctgtattacatgg

SEQ ID NO: 124280 - DNA, 29 bp, Artificial Sequence
  Description of Artificial Sequence: Synthetic oligonucleotide
gcatgaagggccagcgctgtattacatgg

SEQ ID NO: 124281 - DNA, 30 bp, Artificial Sequence
  Description of Artificial Sequence: Synthetic oligonucleotide
catgaagggccagcgctgtattacatggac

SEQ ID NO: 124282 - DNA, 32 bp, Artificial Sequence
  Description of Artificial Sequence: Synthetic oligonucleotide
atgaagggccagcgctgtattacatggactac

SEQ ID NO: 124283 - DNA, 31 bp, Artificial Sequence
  Description of Artificial Sequence: Synthetic oligonucleotide
tgaagggccagcgctgtattacatggactac

SEQ ID NO: 124284 - DNA, 30 bp, Artificial Sequence
  Description of Artificial Sequence: Synthetic oligonucleotide
gaagggccagcgctgtattacatggactac

SEQ ID NO: 124285 - DNA, 30 bp, Artificial Sequence
  Description of Artificial Sequence: Synthetic oligonucleotide
aagggccagcgctgtattacatggactacc

SEQ ID NO: 124286 - DNA, 29 bp, Artificial Sequence
  Description of Artificial Sequence: Synthetic oligonucleotide
agggccagcgctgtattacatggactacc

SEQ ID NO: 124287 - DNA, 28 bp, Artificial Sequence
  Description of Artificial Sequence: Synthetic oligonucleotide
gggccagcgctgtattacatggactacc

SEQ ID NO: 124288 - DNA, 29 bp, Artificial Sequence
  Description of Artificial Sequence: Synthetic oligonucleotide
ggccagcgctgtattacatggactacctg

SEQ ID NO: 124289 - DNA, 29 bp, Artificial Sequence
  Description of Artificial Sequence: Synthetic oligonucleotide
gccagcgctgtattacatggactacctgg

SEQ ID NO: 124290 - DNA, 29 bp, Artificial Sequence
  Description of Artificial Sequence: Synthetic oligonucleotide
ccagcgctgtattacatggactacctggc

SEQ ID NO: 124291 - DNA, 30 bp, Artificial Sequence
  Description of Artificial Sequence: Synthetic oligonucleotide
cagcgctgtattacatggactacctggcag

SEQ ID NO: 124292 - DNA, 30 bp, Artificial Sequence
  Description of Artificial Sequence: Synthetic oligonucleotide
agcgctgtattacatggactacctggcagc

SEQ ID NO: 124293 - DNA, 29 bp, Artificial Sequence
  Description of Artificial Sequence: Synthetic oligonucleotide
gcgctgtattacatggactacctggcagc

SEQ ID NO: 124294 - DNA, 29 bp, Artificial Sequence
  Description of Artificial Sequence: Synthetic oligonucleotide
cgctgtattacatggactacctggcagcc

SEQ ID NO: 124295 - DNA, 31 bp, Artificial Sequence
  Description of Artificial Sequence: Synthetic oligonucleotide
gctgtattacatggactacctggcagccttg

SEQ ID NO: 124296 - DNA, 31 bp, Artificial Sequence
  Description of Artificial Sequence: Synthetic oligonucleotide
ctgtattacatggactacctggcagccttgg

SEQ ID NO: 124297 - DNA, 31 bp, Artificial Sequence
  Description of Artificial Sequence: Synthetic oligonucleotide
tgtattacatggactacctggcagccttggc

SEQ ID NO: 124298 - DNA, 30 bp, Artificial Sequence
  Description of Artificial Sequence: Synthetic oligonucleotide
gtattacatggactacctggcagccttggc

SEQ ID NO: 124299 - DNA, 30 bp, Artificial Sequence
  Description of Artificial Sequence: Synthetic oligonucleotide
tattacatggactacctggcagccttggcc

SEQ ID NO: 124300 - DNA, 29 bp, Artificial Sequence
  Description of Artificial Sequence: Synthetic oligonucleotide
attacatggactacctggcagccttggcc

SEQ ID NO: 124301 - DNA, 28 bp, Artificial Sequence
  Description of Artificial Sequence: Synthetic oligonucleotide
ttacatggactacctggcagccttggcc

SEQ ID NO: 124302 - DNA, 27 bp, Artificial Sequence
  Description of Artificial Sequence: Synthetic oligonucleotide
tacatggactacctggcagccttggcc

SEQ ID NO: 124303 - DNA, 27 bp, Artificial Sequence
  Description of Artificial Sequence: Synthetic oligonucleotide
acatggactacctggcagccttggcca

SEQ ID NO: 124304 - DNA, 27 bp, Artificial Sequence
  Description of Artificial Sequence: Synthetic oligonucleotide
catggactacctggcagccttggccaa

SEQ ID NO: 124305 - DNA, 27 bp, Artificial Sequence
  Description of Artificial Sequence: Synthetic oligonucleotide
atggactacctggcagccttggccaag

SEQ ID NO: 124306 - DNA, 26 bp, Artificial Sequence
  Description of Artificial Sequence: Synthetic oligonucleotide
tggactacctggcagccttggccaag

SEQ ID NO: 124307 - DNA, 25 bp, Artificial Sequence
  Description of Artificial Sequence: Synthetic oligonucleotide
ggactacctggcagccttggccaag

SEQ ID NO: 124308 - DNA, 25 bp, Artificial Sequence
  Description of Artificial Sequence: Synthetic oligonucleotide
gactacctggcagccttggccaagg

SEQ ID NO: 124309 - DNA, 25 bp, Artificial Sequence
  Description of Artificial Sequence: Synthetic oligonucleotide
actacctggcagccttggccaaggc

SEQ ID NO: 124310 - DNA, 24 bp, Artificial Sequence
  Description of Artificial Sequence: Synthetic oligonucleotide
ctacctggcagccttggccaaggc

SEQ ID NO: 124311 - DNA, 24 bp, Artificial Sequence
  Description of Artificial Sequence: Synthetic oligonucleotide
tacctggcagccttggccaaggcc

SEQ ID NO: 124312 - DNA, 23 bp, Artificial Sequence
  Description of Artificial Sequence: Synthetic oligonucleotide
acctggcagccttggccaaggcc

SEQ ID NO: 124313 - DNA, 22 bp, Artificial Sequence
  Description of Artificial Sequence: Synthetic oligonucleotide
cctggcagccttggccaaggcc

SEQ ID NO: 124314 - DNA, 22 bp, Artificial Sequence
  Description of Artificial Sequence: Synthetic oligonucleotide
ctggcagccttggccaaggccc

SEQ ID NO: 124315 - DNA, 26 bp, Artificial Sequence
  Description of Artificial Sequence: Synthetic oligonucleotide
tggcagccttggccaaggcccctttt

SEQ ID NO: 124316 - DNA, 25 bp, Artificial Sequence
  Description of Artificial Sequence: Synthetic oligonucleotide
ggcagccttggccaaggcccctttt

SEQ ID NO: 124317 - DNA, 25 bp, Artificial Sequence
  Description of Artificial Sequence: Synthetic oligonucleotide
gcagccttggccaaggccccttttg

SEQ ID NO: 124318 - DNA, 26 bp, Artificial Sequence
  Description of Artificial Sequence: Synthetic oligonucleotide
cagccttggccaaggccccttttgca

SEQ ID NO: 124319 - DNA, 26 bp, Artificial Sequence
  Description of Artificial Sequence: Synthetic oligonucleotide
agccttggccaaggccccttttgcag

SEQ ID NO: 124320 - DNA, 25 bp, Artificial Sequence
  Description of Artificial Sequence: Synthetic oligonucleotide
gccttggccaaggccccttttgcag

SEQ ID NO: 124321 - DNA, 25 bp, Artificial Sequence
  Description of Artificial Sequence: Synthetic oligonucleotide
ccttggccaaggccccttttgcagc

SEQ ID NO: 124322 - DNA, 25 bp, Artificial Sequence
  Description of Artificial Sequence: Synthetic oligonucleotide
cttggccaaggccccttttgcagcc

SEQ ID NO: 124323 - DNA, 26 bp, Artificial Sequence
  Description of Artificial Sequence: Synthetic oligonucleotide
ttggccaaggccccttttgcagccca

SEQ ID NO: 124324 - DNA, 25 bp, Artificial Sequence
  Description of Artificial Sequence: Synthetic oligonucleotide
tggccaaggccccttttgcagccca

SEQ ID NO: 124325 - DNA, 24 bp, Artificial Sequence
  Description of Artificial Sequence: Synthetic oligonucleotide
ggccaaggccccttttgcagccca

SEQ ID NO: 124326 - DNA, 24 bp, Artificial Sequence
  Description of Artificial Sequence: Synthetic oligonucleotide
gccaaggccccttttgcagcccac

SEQ ID NO: 124327 - DNA, 24 bp, Artificial Sequence
  Description of Artificial Sequence: Synthetic oligonucleotide
ccaaggccccttttgcagcccacg

SEQ ID NO: 124328 - DNA, 24 bp, Artificial Sequence
  Description of Artificial Sequence: Synthetic oligonucleotide
caaggccccttttgcagcccacgg

SEQ ID NO: 124329 - DNA, 27 bp, Artificial Sequence
  Description of Artificial Sequence: Synthetic oligonucleotide
aaggccccttttgcagcccacggctat

SEQ ID NO: 124330 - DNA, 26 bp, Artificial Sequence
  Description of Artificial Sequence: Synthetic oligonucleotide
aggccccttttgcagcccacggctat

SEQ ID NO: 124331 - DNA, 25 bp, Artificial Sequence
  Description of Artificial Sequence: Synthetic oligonucleotide
ggccccttttgcagcccacggctat

SEQ ID NO: 124332 - DNA, 25 bp, Artificial Sequence
  Description of Artificial Sequence: Synthetic oligonucleotide
gccccttttgcagcccacggctatg

SEQ ID NO: 124333 - DNA, 26 bp, Artificial Sequence
  Description of Artificial Sequence: Synthetic oligonucleotide
ccccttttgcagcccacggctatggt

SEQ ID NO: 124334 - DNA, 26 bp, Artificial Sequence
  Description of Artificial Sequence: Synthetic oligonucleotide
cccttttgcagcccacggctatggtg

SEQ ID NO: 124335 - DNA, 26 bp, Artificial Sequence
  Description of Artificial Sequence: Synthetic oligonucleotide
ccttttgcagcccacggctatggtgc

SEQ ID NO: 124336 - DNA, 27 bp, Artificial Sequence
  Description of Artificial Sequence: Synthetic oligonucleotide
cttttgcagcccacggctatggtgcct

SEQ ID NO: 124337 - DNA, 28 bp, Artificial Sequence
  Description of Artificial Sequence: Synthetic oligonucleotide
ttttgcagcccacggctatggtgccttc

SEQ ID NO: 124338 - DNA, 27 bp, Artificial Sequence
  Description of Artificial Sequence: Synthetic oligonucleotide
tttgcagcccacggctatggtgccttc

SEQ ID NO: 124339 - DNA, 26 bp, Artificial Sequence
  Description of Artificial Sequence: Synthetic oligonucleotide
ttgcagcccacggctatggtgccttc

SEQ ID NO: 124340 - DNA, 25 bp, Artificial Sequence
  Description of Artificial Sequence: Synthetic oligonucleotide
tgcagcccacggctatggtgccttc

SEQ ID NO: 124341 - DNA, 24 bp, Artificial Sequence
  Description of Artificial Sequence: Synthetic oligonucleotide
gcagcccacggctatggtgccttc

SEQ ID NO: 124342 - DNA, 25 bp, Artificial Sequence
  Description of Artificial Sequence: Synthetic oligonucleotide
cagcccacggctatggtgccttcct

SEQ ID NO: 124343 - DNA, 26 bp, Artificial Sequence
  Description of Artificial Sequence: Synthetic oligonucleotide
agcccacggctatggtgccttcctga

SEQ ID NO: 124344 - DNA, 25 bp, Artificial Sequence
  Description of Artificial Sequence: Synthetic oligonucleotide
gcccacggctatggtgccttcctga

SEQ ID NO: 124345 - DNA, 26 bp, Artificial Sequence
  Description of Artificial Sequence: Synthetic oligonucleotide
cccacggctatggtgccttcctgact

SEQ ID NO: 124346 - DNA, 27 bp, Artificial Sequence
  Description of Artificial Sequence: Synthetic oligonucleotide
ccacggctatggtgccttcctgactct

SEQ ID NO: 124347 - DNA, 27 bp, Artificial Sequence
  Description of Artificial Sequence: Synthetic oligonucleotide
cacggctatggtgccttcctgactctc

SEQ ID NO: 124348 - DNA, 28 bp, Artificial Sequence
  Description of Artificial Sequence: Synthetic oligonucleotide
acggctatggtgccttcctgactctcag

SEQ ID NO: 124349 - DNA, 27 bp, Artificial Sequence
  Description of Artificial Sequence: Synthetic oligonucleotide
cggctatggtgccttcctgactctcag

SEQ ID NO: 124350 - DNA, 30 bp, Artificial Sequence
  Description of Artificial Sequence: Synthetic oligonucleotide
ggctatggtgccttcctgactctcagtatc

SEQ ID NO: 124351 - DNA, 30 bp, Artificial Sequence
  Description of Artificial Sequence: Synthetic oligonucleotide
gctatggtgccttcctgactctcagtatcc

SEQ ID NO: 124352 - DNA, 31 bp, Artificial Sequence
  Description of Artificial Sequence: Synthetic oligonucleotide
ctatggtgccttcctgactctcagtatcctc

SEQ ID NO: 124353 - DNA, 31 bp, Artificial Sequence
  Description of Artificial Sequence: Synthetic oligonucleotide
tatggtgccttcctgactctcagtatcctcg

SEQ ID NO: 124354 - DNA, 30 bp, Artificial Sequence
  Description of Artificial Sequence: Synthetic oligonucleotide
atggtgccttcctgactctcagtatcctcg

SEQ ID NO: 124355 - DNA, 29 bp, Artificial Sequence
  Description of Artificial Sequence: Synthetic oligonucleotide
tggtgccttcctgactctcagtatcctcg

SEQ ID NO: 124356 - DNA, 28 bp, Artificial Sequence
  Description of Artificial Sequence: Synthetic oligonucleotide
ggtgccttcctgactctcagtatcctcg

SEQ ID NO: 124357 - DNA, 29 bp, Artificial Sequence
  Description of Artificial Sequence: Synthetic oligonucleotide
gtgccttcctgactctcagtatcctcgac

SEQ ID NO: 124358 - DNA, 29 bp, Artificial Sequence
  Description of Artificial Sequence: Synthetic oligonucleotide
tgccttcctgactctcagtatcctcgacc

SEQ ID NO: 124359 - DNA, 28 bp, Artificial Sequence
  Description of Artificial Sequence: Synthetic oligonucleotide
gccttcctgactctcagtatcctcgacc

SEQ ID NO: 124360 - DNA, 28 bp, Artificial Sequence
  Description of Artificial Sequence: Synthetic oligonucleotide
ccttcctgactctcagtatcctcgaccg

SEQ ID NO: 124361 - DNA, 31 bp, Artificial Sequence
  Description of Artificial Sequence: Synthetic oligonucleotide
cttcctgactctcagtatcctcgaccgatac

SEQ ID NO: 124362 - DNA, 33 bp, Artificial Sequence
  Description of Artificial Sequence: Synthetic oligonucleotide
ttcctgactctcagtatcctcgaccgatactac

SEQ ID NO: 124363 - DNA, 32 bp, Artificial Sequence
  Description of Artificial Sequence: Synthetic oligonucleotide
tcctgactctcagtatcctcgaccgatactac

SEQ ID NO: 124364 - DNA, 31 bp, Artificial Sequence
  Description of Artificial Sequence: Synthetic oligonucleotide
cctgactctcagtatcctcgaccgatactac

SEQ ID NO: 124365 - DNA, 32 bp, Artificial Sequence
  Description of Artificial Sequence: Synthetic oligonucleotide
ctgactctcagtatcctcgaccgatactacac

SEQ ID NO: 124366 - DNA, 33 bp, Artificial Sequence
  Description of Artificial Sequence: Synthetic oligonucleotide
tgactctcagtatcctcgaccgatactacacac

SEQ ID NO: 124367 - DNA, 32 bp, Artificial Sequence
  Description of Artificial Sequence: Synthetic oligonucleotide
gactctcagtatcctcgaccgatactacacac

SEQ ID NO: 124368 - DNA, 32 bp, Artificial Sequence
  Description of Artificial Sequence: Synthetic oligonucleotide
actctcagtatcctcgaccgatactacacacc

SEQ ID NO: 124369 - DNA, 31 bp, Artificial Sequence
  Description of Artificial Sequence: Synthetic oligonucleotide
ctctcagtatcctcgaccgatactacacacc

SEQ ID NO: 124370 - DNA, 31 bp, Artificial Sequence
  Description of Artificial Sequence: Synthetic oligonucleotide
tctcagtatcctcgaccgatactacacaccg

SEQ ID NO: 124371 - DNA, 30 bp, Artificial Sequence
  Description of Artificial Sequence: Synthetic oligonucleotide
ctcagtatcctcgaccgatactacacaccg

SEQ ID NO: 124372 - DNA, 31 bp, Artificial Sequence
  Description of Artificial Sequence: Synthetic oligonucleotide
tcagtatcctcgaccgatactacacaccgac

SEQ ID NO: 124373 - DNA, 30 bp, Artificial Sequence
  Description of Artificial Sequence: Synthetic oligonucleotide
cagtatcctcgaccgatactacacaccgac

SEQ ID NO: 124374 - DNA, 33 bp, Artificial Sequence
  Description of Artificial Sequence: Synthetic oligonucleotide
agtatcctcgaccgatactacacaccgactatc

SEQ ID NO: 124375 - DNA, 32 bp, Artificial Sequence
  Description of Artificial Sequence: Synthetic oligonucleotide
gtatcctcgaccgatactacacaccgactatc

SEQ ID NO: 124376 - DNA, 33 bp, Artificial Sequence
  Description of Artificial Sequence: Synthetic oligonucleotide
tatcctcgaccgatactacacaccgactatctc

SEQ ID NO: 124377 - DNA, 32 bp, Artificial Sequence
  Description of Artificial Sequence: Synthetic oligonucleotide
atcctcgaccgatactacacaccgactatctc

SEQ ID NO: 124378 - DNA, 31 bp, Artificial Sequence
  Description of Artificial Sequence: Synthetic oligonucleotide
tcctcgaccgatactacacaccgactatctc

SEQ ID NO: 124379 - DNA, 30 bp, Artificial Sequence
  Description of Artificial Sequence: Synthetic oligonucleotide
cctcgaccgatactacacaccgactatctc

SEQ ID NO: 124380 - DNA, 31 bp, Artificial Sequence
  Description of Artificial Sequence: Synthetic oligonucleotide
ctcgaccgatactacacaccgactatctcac

SEQ ID NO: 124381 - DNA, 31 bp, Artificial Sequence
  Description of Artificial Sequence: Synthetic oligonucleotide
tcgaccgatactacacaccgactatctcacg

SEQ ID NO: 124382 - DNA, 30 bp, Artificial Sequence
  Description of Artificial Sequence: Synthetic oligonucleotide
cgaccgatactacacaccgactatctcacg

SEQ ID NO: 124383 - DNA, 31 bp, Artificial Sequence
  Description of Artificial Sequence: Synthetic oligonucleotide
gaccgatactacacaccgactatctcacgtg

SEQ ID NO: 124384 - DNA, 32 bp, Artificial Sequence
  Description of Artificial Sequence: Synthetic oligonucleotide
accgatactacacaccgactatctcacgtgag

SEQ ID NO: 124385 - DNA, 31 bp, Artificial Sequence
  Description of Artificial Sequence: Synthetic oligonucleotide
ccgatactacacaccgactatctcacgtgag

SEQ ID NO: 124386 - DNA, 32 bp, Artificial Sequence
  Description of Artificial Sequence: Synthetic oligonucleotide
cgatactacacaccgactatctcacgtgagag

SEQ ID NO: 124387 - DNA, 32 bp, Artificial Sequence
  Description of Artificial Sequence: Synthetic oligonucleotide
gatactacacaccgactatctcacgtgagagg

SEQ ID NO: 124388 - DNA, 32 bp, Artificial Sequence
  Description of Artificial Sequence: Synthetic oligonucleotide
atactacacaccgactatctcacgtgagaggg

SEQ ID NO: 124389 - DNA, 31 bp, Artificial Sequence
  Description of Artificial Sequence: Synthetic oligonucleotide
tactacacaccgactatctcacgtgagaggg

SEQ ID NO: 124390 - DNA, 30 bp, Artificial Sequence
  Description of Artificial Sequence: Synthetic oligonucleotide
actacacaccgactatctcacgtgagaggg

SEQ ID NO: 124391 - DNA, 29 bp, Artificial Sequence
  Description of Artificial Sequence: Synthetic oligonucleotide
ctacacaccgactatctcacgtgagaggg

SEQ ID NO: 124392 - DNA, 29 bp, Artificial Sequence
  Description of Artificial Sequence: Synthetic oligonucleotide
tacacaccgactatctcacgtgagagggc

SEQ ID NO: 124393 - DNA, 28 bp, Artificial Sequence
  Description of Artificial Sequence: Synthetic oligonucleotide
acacaccgactatctcacgtgagagggc

SEQ ID NO: 124394 - DNA, 27 bp, Artificial Sequence
  Description of Artificial Sequence: Synthetic oligonucleotide
cacaccgactatctcacgtgagagggc

SEQ ID NO: 124395 - DNA, 28 bp, Artificial Sequence
  Description of Artificial Sequence: Synthetic oligonucleotide
acaccgactatctcacgtgagagggcag

SEQ ID NO: 124396 - DNA, 27 bp, Artificial Sequence
  Description of Artificial Sequence: Synthetic oligonucleotide
caccgactatctcacgtgagagggcag

SEQ ID NO: 124397 - DNA, 28 bp, Artificial Sequence
  Description of Artificial Sequence: Synthetic oligonucleotide
accgactatctcacgtgagagggcagtg

SEQ ID NO: 124398 - DNA, 27 bp, Artificial Sequence
  Description of Artificial Sequence: Synthetic oligonucleotide
ccgactatctcacgtgagagggcagtg

SEQ ID NO: 124399 - DNA, 27 bp, Artificial Sequence
  Description of Artificial Sequence: Synthetic oligonucleotide
cgactatctcacgtgagagggcagtgg

SEQ ID NO: 124400 - DNA, 29 bp, Artificial Sequence
  Description of Artificial Sequence: Synthetic oligonucleotide
gactatctcacgtgagagggcagtggaac

SEQ ID NO: 124401 - DNA, 30 bp, Artificial Sequence
  Description of Artificial Sequence: Synthetic oligonucleotide
actatctcacgtgagagggcagtggaactc

SEQ ID NO: 124402 - DNA, 29 bp, Artificial Sequence
  Description of Artificial Sequence: Synthetic oligonucleotide
ctatctcacgtgagagggcagtggaactc

SEQ ID NO: 124403 - DNA, 29 bp, Artificial Sequence
  Description of Artificial Sequence: Synthetic oligonucleotide
tatctcacgtgagagggcagtggaactcc

SEQ ID NO: 124404 - DNA, 28 bp, Artificial Sequence
  Description of Artificial Sequence: Synthetic oligonucleotide
atctcacgtgagagggcagtggaactcc

SEQ ID NO: 124405 - DNA, 27 bp, Artificial Sequence
  Description of Artificial Sequence: Synthetic oligonucleotide
tctcacgtgagagggcagtggaactcc

SEQ ID NO: 124406 - DNA, 27 bp, Artificial Sequence
  Description of Artificial Sequence: Synthetic oligonucleotide
ctcacgtgagagggcagtggaactcct

SEQ ID NO: 124407 - DNA, 29 bp, Artificial Sequence
  Description of Artificial Sequence: Synthetic oligonucleotide
tcacgtgagagggcagtggaactccttag

SEQ ID NO: 124408 - DNA, 28 bp, Artificial Sequence
  Description of Artificial Sequence: Synthetic oligonucleotide
cacgtgagagggcagtggaactccttag

SEQ ID NO: 124409 - DNA, 28 bp, Artificial Sequence
  Description of Artificial Sequence: Synthetic oligonucleotide
acgtgagagggcagtggaactccttagg

SEQ ID NO: 124410 - DNA, 27 bp, Artificial Sequence
  Description of Artificial Sequence: Synthetic oligonucleotide
cgtgagagggcagtggaactccttagg

SEQ ID NO: 124411 - DNA, 31 bp, Artificial Sequence
  Description of Artificial Sequence: Synthetic oligonucleotide
gtgagagggcagtggaactccttaggaaatg

SEQ ID NO: 124412 - DNA, 32 bp, Artificial Sequence
  Description of Artificial Sequence: Synthetic oligonucleotide
tgagagggcagtggaactccttaggaaatgtc

SEQ ID NO: 124413 - DNA, 31 bp, Artificial Sequence
  Description of Artificial Sequence: Synthetic oligonucleotide
gagagggcagtggaactccttaggaaatgtc

SEQ ID NO: 124414 - DNA, 32 bp, Artificial Sequence
  Description of Artificial Sequence: Synthetic oligonucleotide
agagggcagtggaactccttaggaaatgtctg

SEQ ID NO: 124415 - DNA, 31 bp, Artificial Sequence
  Description of Artificial Sequence: Synthetic oligonucleotide
gagggcagtggaactccttaggaaatgtctg

SEQ ID NO: 124416 - DNA, 31 bp, Artificial Sequence
  Description of Artificial Sequence: Synthetic oligonucleotide
agggcagtggaactccttaggaaatgtctgg

SEQ ID NO: 124417 - DNA, 30 bp, Artificial Sequence
  Description of Artificial Sequence: Synthetic oligonucleotide
gggcagtggaactccttaggaaatgtctgg

SEQ ID NO: 124418 - DNA, 31 bp, Artificial Sequence
  Description of Artificial Sequence: Synthetic oligonucleotide
ggcagtggaactccttaggaaatgtctggag

SEQ ID NO: 124419 - DNA, 31 bp, Artificial Sequence
  Description of Artificial Sequence: Synthetic oligonucleotide
gcagtggaactccttaggaaatgtctggagg

SEQ ID NO: 124420 - DNA, 32 bp, Artificial Sequence
  Description of Artificial Sequence: Synthetic oligonucleotide
cagtggaactccttaggaaatgtctggaggag

SEQ ID NO: 124421 - DNA, 32 bp, Artificial Sequence
  Description of Artificial Sequence: Synthetic oligonucleotide
agtggaactccttaggaaatgtctggaggagc

SEQ ID NO: 124422 - DNA, 31 bp, Artificial Sequence
  Description of Artificial Sequence: Synthetic oligonucleotide
gtggaactccttaggaaatgtctggaggagc

SEQ ID NO: 124423 - DNA, 32 bp, Artificial Sequence
  Description of Artificial Sequence: Synthetic oligonucleotide
tggaactccttaggaaatgtctggaggagctc

SEQ ID NO: 124424 - DNA, 31 bp, Artificial Sequence
  Description of Artificial Sequence: Synthetic oligonucleotide
ggaactccttaggaaatgtctggaggagctc

SEQ ID NO: 124425 - DNA, 31 bp, Artificial Sequence
  Description of Artificial Sequence: Synthetic oligonucleotide
gaactccttaggaaatgtctggaggagctcc

SEQ ID NO: 124426 - DNA, 32 bp, Artificial Sequence
  Description of Artificial Sequence: Synthetic oligonucleotide
aactccttaggaaatgtctggaggagctccag

SEQ ID NO: 124427 - DNA, 31 bp, Artificial Sequence
  Description of Artificial Sequence: Synthetic oligonucleotide
actccttaggaaatgtctggaggagctccag

SEQ ID NO: 124428 - DNA, 30 bp, Artificial Sequence
  Description of Artificial Sequence: Synthetic oligonucleotide
ctccttaggaaatgtctggaggagctccag

SEQ ID NO: 124429 - DNA, 33 bp, Artificial Sequence
  Description of Artificial Sequence: Synthetic oligonucleotide
tccttaggaaatgtctggaggagctccagaaac

SEQ ID NO: 124430 - DNA, 32 bp, Artificial Sequence
  Description of Artificial Sequence: Synthetic oligonucleotide
ccttaggaaatgtctggaggagctccagaaac

SEQ ID NO: 124431 - DNA, 32 bp, Artificial Sequence
  Description of Artificial Sequence: Synthetic oligonucleotide
cttaggaaatgtctggaggagctccagaaacg

SEQ ID NO: 124432 - DNA, 32 bp, Artificial Sequence
  Description of Artificial Sequence: Synthetic oligonucleotide
ttaggaaatgtctggaggagctccagaaacgc

SEQ ID NO: 124433 - DNA, 31 bp, Artificial Sequence
  Description of Artificial Sequence: Synthetic oligonucleotide
taggaaatgtctggaggagctccagaaacgc

SEQ ID NO: 124434 - DNA, 30 bp, Artificial Sequence
  Description of Artificial Sequence: Synthetic oligonucleotide
aggaaatgtctggaggagctccagaaacgc

SEQ ID NO: 124435 - DNA, 29 bp, Artificial Sequence
  Description of Artificial Sequence: Synthetic oligonucleotide
ggaaatgtctggaggagctccagaaacgc

SEQ ID NO: 124436 - DNA, 31 bp, Artificial Sequence
  Description of Artificial Sequence: Synthetic oligonucleotide
gaaatgtctggaggagctccagaaacgcttc

SEQ ID NO: 124437 - DNA, 33 bp, Artificial Sequence
  Description of Artificial Sequence: Synthetic oligonucleotide
aaatgtctggaggagctccagaaacgcttcatc

SEQ ID NO: 124438 - DNA, 32 bp, Artificial Sequence
  Description of Artificial Sequence: Synthetic oligonucleotide
aatgtctggaggagctccagaaacgcttcatc

SEQ ID NO: 124439 - DNA, 31 bp, Artificial Sequence
  Description of Artificial Sequence: Synthetic oligonucleotide
atgtctggaggagctccagaaacgcttcatc

SEQ ID NO: 124440 - DNA, 30 bp, Artificial Sequence
  Description of Artificial Sequence: Synthetic oligonucleotide
tgtctggaggagctccagaaacgcttcatc

SEQ ID NO: 124441 - DNA, 29 bp, Artificial Sequence
  Description of Artificial Sequence: Synthetic oligonucleotide
gtctggaggagctccagaaacgcttcatc

SEQ ID NO: 124442 - DNA, 29 bp, Artificial Sequence
  Description of Artificial Sequence: Synthetic oligonucleotide
tctggaggagctccagaaacgcttcatcc

SEQ ID NO: 124443 - DNA, 28 bp, Artificial Sequence
  Description of Artificial Sequence: Synthetic oligonucleotide
ctggaggagctccagaaacgcttcatcc

SEQ ID NO: 124444 - DNA, 29 bp, Artificial Sequence
  Description of Artificial Sequence: Synthetic oligonucleotide
tggaggagctccagaaacgcttcatcctg

SEQ ID NO: 124445 - DNA, 28 bp, Artificial Sequence
  Description of Artificial Sequence: Synthetic oligonucleotide
ggaggagctccagaaacgcttcatcctg

SEQ ID NO: 124446 - DNA, 31 bp, Artificial Sequence
  Description of Artificial Sequence: Synthetic oligonucleotide
gaggagctccagaaacgcttcatcctgaatc

SEQ ID NO: 124447 - DNA, 32 bp, Artificial Sequence
  Description of Artificial Sequence: Synthetic oligonucleotide
aggagctccagaaacgcttcatcctgaatctg

SEQ ID NO: 124448 - DNA, 31 bp, Artificial Sequence
  Description of Artificial Sequence: Synthetic oligonucleotide
ggagctccagaaacgcttcatcctgaatctg

SEQ ID NO: 124449 - DNA, 31 bp, Artificial Sequence
  Description of Artificial Sequence: Synthetic oligonucleotide
gagctccagaaacgcttcatcctgaatctgc

SEQ ID NO: 124450 - DNA, 31 bp, Artificial Sequence
  Description of Artificial Sequence: Synthetic oligonucleotide
agctccagaaacgcttcatcctgaatctgcc

SEQ ID NO: 124451 - DNA, 30 bp, Artificial Sequence
  Description of Artificial Sequence: Synthetic oligonucleotide
gctccagaaacgcttcatcctgaatctgcc

SEQ ID NO: 124452 - DNA, 32 bp, Artificial Sequence
  Description of Artificial Sequence: Synthetic oligonucleotide
ctccagaaacgcttcatcctgaatctgccaac

SEQ ID NO: 124453 - DNA, 32 bp, Artificial Sequence
  Description of Artificial Sequence: Synthetic oligonucleotide
tccagaaacgcttcatcctgaatctgccaacc

SEQ ID NO: 124454 - DNA, 31 bp, Artificial Sequence
  Description of Artificial Sequence: Synthetic oligonucleotide
ccagaaacgcttcatcctgaatctgccaacc

SEQ ID NO: 124455 - DNA, 33 bp, Artificial Sequence
  Description of Artificial Sequence: Synthetic oligonucleotide
cagaaacgcttcatcctgaatctgccaaccttc

SEQ ID NO: 124456 - DNA, 34 bp, Artificial Sequence
  Description of Artificial Sequence: Synthetic oligonucleotide
agaaacgcttcatcctgaatctgccaaccttcag

SEQ ID NO: 124457 - DNA, 33 bp, Artificial Sequence
  Description of Artificial Sequence: Synthetic oligonucleotide
gaaacgcttcatcctgaatctgccaaccttcag

SEQ ID NO: 124458 - DNA, 34 bp, Artificial Sequence
  Description of Artificial Sequence: Synthetic oligonucleotide
aaacgcttcatcctgaatctgccaaccttcagtg

SEQ ID NO: 124459 - DNA, 33 bp, Artificial Sequence
  Description of Artificial Sequence: Synthetic oligonucleotide
aacgcttcatcctgaatctgccaaccttcagtg

SEQ ID NO: 124460 - DNA, 32 bp, Artificial Sequence
  Description of Artificial Sequence: Synthetic oligonucleotide
acgcttcatcctgaatctgccaaccttcagtg

SEQ ID NO: 124461 - DNA, 31 bp, Artificial Sequence
  Description of Artificial Sequence: Synthetic oligonucleotide
cgcttcatcctgaatctgccaaccttcagtg

SEQ ID NO: 124462 - DNA, 33 bp, Artificial Sequence
  Description of Artificial Sequence: Synthetic oligonucleotide
gcttcatcctgaatctgccaaccttcagtgttc

SEQ ID NO: 124463 - DNA, 33 bp, Artificial Sequence
  Description of Artificial Sequence: Synthetic oligonucleotide
cttcatcctgaatctgccaaccttcagtgttcg

SEQ ID NO: 124464 - DNA, 36 bp, Artificial Sequence
  Description of Artificial Sequence: Synthetic oligonucleotide
ttcatcctgaatctgccaaccttcagtgttcgaatc

SEQ ID NO: 124465 - DNA, 35 bp, Artificial Sequence
  Description of Artificial Sequence: Synthetic oligonucleotide
tcatcctgaatctgccaaccttcagtgttcgaatc

SEQ ID NO: 124466 - DNA, 34 bp, Artificial Sequence
  Description of Artificial Sequence: Synthetic oligonucleotide
catcctgaatctgccaaccttcagtgttcgaatc

SEQ ID NO: 124467 - DNA, 37 bp, Artificial Sequence
  Description of Artificial Sequence: Synthetic oligonucleotide
atcctgaatctgccaaccttcagtgttcgaatcattg

SEQ ID NO: 124468 - DNA, 36 bp, Artificial Sequence
  Description of Artificial Sequence: Synthetic oligonucleotide
tcctgaatctgccaaccttcagtgttcgaatcattg

SEQ ID NO: 124469 - DNA, 35 bp, Artificial Sequence
  Description of Artificial Sequence: Synthetic oligonucleotide
cctgaatctgccaaccttcagtgttcgaatcattg

SEQ ID NO: 124470 - DNA, 36 bp, Artificial Sequence
  Description of Artificial Sequence: Synthetic oligonucleotide
ctgaatctgccaaccttcagtgttcgaatcattgac

SEQ ID NO: 124471 - DNA, 42 bp, Artificial Sequence
  Description of Artificial Sequence: Synthetic oligonucleotide
tgaatctgccaaccttcagtgttcgaatcattgacaaaaatg

SEQ ID NO: 124472 - DNA, 41 bp, Artificial Sequence
  Description of Artificial Sequence: Synthetic oligonucleotide
gaatctgccaaccttcagtgttcgaatcattgacaaaaatg

SEQ ID NO: 124473 - DNA, 41 bp, Artificial Sequence
  Description of Artificial Sequence: Synthetic oligonucleotide
aatctgccaaccttcagtgttcgaatcattgacaaaaatgg

SEQ ID NO: 124474 - DNA, 40 bp, Artificial Sequence
  Description of Artificial Sequence: Synthetic oligonucleotide
atctgccaaccttcagtgttcgaatcattgacaaaaatgg

SEQ ID NO: 124475 - DNA, 39 bp, Artificial Sequence
  Description of Artificial Sequence: Synthetic oligonucleotide
tctgccaaccttcagtgttcgaatcattgacaaaaatgg

SEQ ID NO: 124476 - DNA, 38 bp, Artificial Sequence
  Description of Artificial Sequence: Synthetic oligonucleotide
ctgccaaccttcagtgttcgaatcattgacaaaaatgg

SEQ ID NO: 124477 - DNA, 38 bp, Artificial Sequence
  Description of Artificial Sequence: Synthetic oligonucleotide
tgccaaccttcagtgttcgaatcattgacaaaaatggc

SEQ ID NO: 124478 - DNA, 37 bp, Artificial Sequence
  Description of Artificial Sequence: Synthetic oligonucleotide
gccaaccttcagtgttcgaatcattgacaaaaatggc

SEQ ID NO: 124479 - DNA, 39 bp, Artificial Sequence
  Description of Artificial Sequence: Synthetic oligonucleotide
ccaaccttcagtgttcgaatcattgacaaaaatggcatc

SEQ ID NO: 124480 - DNA, 39 bp, Artificial Sequence
  Description of Artificial Sequence: Synthetic oligonucleotide
caaccttcagtgttcgaatcattgacaaaaatggcatcc

SEQ ID NO: 124481 - DNA, 41 bp, Artificial Sequence
  Description of Artificial Sequence: Synthetic oligonucleotide
aaccttcagtgttcgaatcattgacaaaaatggcatccatg

SEQ ID NO: 124482 - DNA, 40 bp, Artificial Sequence
  Description of Artificial Sequence: Synthetic oligonucleotide
accttcagtgttcgaatcattgacaaaaatggcatccatg

SEQ ID NO: 124483 - DNA, 39 bp, Artificial Sequence
  Description of Artificial Sequence: Synthetic oligonucleotide
ccttcagtgttcgaatcattgacaaaaatggcatccatg

SEQ ID NO: 124484 - DNA, 40 bp, Artificial Sequence
  Description of Artificial Sequence: Synthetic oligonucleotide
cttcagtgttcgaatcattgacaaaaatggcatccatgac

SEQ ID NO: 124485 - DNA, 40 bp, Artificial Sequence
  Description of Artificial Sequence: Synthetic oligonucleotide
ttcagtgttcgaatcattgacaaaaatggcatccatgacc

SEQ ID NO: 124486 - DNA, 39 bp, Artificial Sequence
  Description of Artificial Sequence: Synthetic oligonucleotide
tcagtgttcgaatcattgacaaaaatggcatccatgacc

SEQ ID NO: 124487 - DNA, 38 bp, Artificial Sequence
  Description of Artificial Sequence: Synthetic oligonucleotide
cagtgttcgaatcattgacaaaaatggcatccatgacc

SEQ ID NO: 124488 - DNA, 39 bp, Artificial Sequence
  Description of Artificial Sequence: Synthetic oligonucleotide
agtgttcgaatcattgacaaaaatggcatccatgacctg

SEQ ID NO: 124489 - DNA, 38 bp, Artificial Sequence
  Description of Artificial Sequence: Synthetic oligonucleotide
gtgttcgaatcattgacaaaaatggcatccatgacctg

SEQ ID NO: 124490 - DNA, 38 bp, Artificial Sequence
  Description of Artificial Sequence: Synthetic oligonucleotide
tgttcgaatcattgacaaaaatggcatccatgacctgg

SEQ ID NO: 124491 - DNA, 37 bp, Artificial Sequence
  Description of Artificial Sequence: Synthetic oligonucleotide
gttcgaatcattgacaaaaatggcatccatgacctgg

SEQ ID NO: 124492 - DNA, 41 bp, Artificial Sequence
  Description of Artificial Sequence: Synthetic oligonucleotide
ttcgaatcattgacaaaaatggcatccatgacctggataac

SEQ ID NO: 124493 - DNA, 40 bp, Artificial Sequence
  Description of Artificial Sequence: Synthetic oligonucleotide
tcgaatcattgacaaaaatggcatccatgacctggataac

SEQ ID NO: 124494 - DNA, 39 bp, Artificial Sequence
  Description of Artificial Sequence: Synthetic oligonucleotide
cgaatcattgacaaaaatggcatccatgacctggataac

SEQ ID NO: 124495 - DNA, 43 bp, Artificial Sequence
  Description of Artificial Sequence: Synthetic oligonucleotide
gaatcattgacaaaaatggcatccatgacctggataacatttc

SEQ ID NO: 124496 - DNA, 43 bp, Artificial Sequence
  Description of Artificial Sequence: Synthetic oligonucleotide
aatcattgacaaaaatggcatccatgacctggataacatttcc

SEQ ID NO: 124497 - DNA, 42 bp, Artificial Sequence
  Description of Artificial Sequence: Synthetic oligonucleotide
atcattgacaaaaatggcatccatgacctggataacatttcc

SEQ ID NO: 124498 - DNA, 41 bp, Artificial Sequence
  Description of Artificial Sequence: Synthetic oligonucleotide
tcattgacaaaaatggcatccatgacctggataacatttcc

SEQ ID NO: 124499 - DNA, 40 bp, Artificial Sequence
  Description of Artificial Sequence: Synthetic oligonucleotide
cattgacaaaaatggcatccatgacctggataacatttcc

SEQ ID NO: 124500 - DNA, 42 bp, Artificial Sequence
  Description of Artificial Sequence: Synthetic oligonucleotide
attgacaaaaatggcatccatgacctggataacatttccttc

SEQ ID NO: 124501 - DNA, 41 bp, Artificial Sequence
  Description of Artificial Sequence: Synthetic oligonucleotide
ttgacaaaaatggcatccatgacctggataacatttccttc

SEQ ID NO: 124502 - DNA, 40 bp, Artificial Sequence
  Description of Artificial Sequence: Synthetic oligonucleotide
tgacaaaaatggcatccatgacctggataacatttccttc

SEQ ID NO: 124503 - DNA, 39 bp, Artificial Sequence
  Description of Artificial Sequence: Synthetic oligonucleotide
gacaaaaatggcatccatgacctggataacatttccttc

SEQ ID NO: 124504 - DNA, 39 bp, Artificial Sequence
  Description of Artificial Sequence: Synthetic oligonucleotide
acaaaaatggcatccatgacctggataacatttccttcc

SEQ ID NO: 124505 - DNA, 38 bp, Artificial Sequence
  Description of Artificial Sequence: Synthetic oligonucleotide
caaaaatggcatccatgacctggataacatttccttcc

SEQ ID NO: 124506 - DNA, 38 bp, Artificial Sequence
  Description of Artificial Sequence: Synthetic oligonucleotide
aaaaatggcatccatgacctggataacatttccttccc

SEQ ID NO: 124507 - DNA, 37 bp, Artificial Sequence
  Description of Artificial Sequence: Synthetic oligonucleotide
aaaatggcatccatgacctggataacatttccttccc

SEQ ID NO: 124508 - DNA, 36 bp, Artificial Sequence
  Description of Artificial Sequence: Synthetic oligonucleotide
aaatggcatccatgacctggataacatttccttccc

SEQ ID NO: 124509 - DNA, 35 bp, Artificial Sequence
  Description of Artificial Sequence: Synthetic oligonucleotide
aatggcatccatgacctggataacatttccttccc

SEQ ID NO: 124510 - DNA, 34 bp, Artificial Sequence
  Description of Artificial Sequence: Synthetic oligonucleotide
atggcatccatgacctggataacatttccttccc

SEQ ID NO: 124511 - DNA, 33 bp, Artificial Sequence
  Description of Artificial Sequence: Synthetic oligonucleotide
tggcatccatgacctggataacatttccttccc

SEQ ID NO: 124512 - DNA, 32 bp, Artificial Sequence
  Description of Artificial Sequence: Synthetic oligonucleotide
ggcatccatgacctggataacatttccttccc

SEQ ID NO: 124513 - DNA, 32 bp, Artificial Sequence
  Description of Artificial Sequence: Synthetic oligonucleotide
gcatccatgacctggataacatttccttcccc

SEQ ID NO: 124514 - DNA, 35 bp, Artificial Sequence
  Description of Artificial Sequence: Synthetic oligonucleotide
catccatgacctggataacatttccttccccaaac

SEQ ID NO: 124515 - DNA, 36 bp, Artificial Sequence
  Description of Artificial Sequence: Synthetic oligonucleotide
atccatgacctggataacatttccttccccaaacag

SEQ ID NO: 124516 - DNA, 35 bp, Artificial Sequence
  Description of Artificial Sequence: Synthetic oligonucleotide
tccatgacctggataacatttccttccccaaacag

SEQ ID NO: 124517 - DNA, 34 bp, Artificial Sequence
  Description of Artificial Sequence: Synthetic oligonucleotide
ccatgacctggataacatttccttccccaaacag

SEQ ID NO: 124518 - DNA, 34 bp, Artificial Sequence
  Description of Artificial Sequence: Synthetic oligonucleotide
catgacctggataacatttccttccccaaacagg

SEQ ID NO: 124519 - DNA, 34 bp, Artificial Sequence
  Description of Artificial Sequence: Synthetic oligonucleotide
atgacctggataacatttccttccccaaacaggg

SEQ ID NO: 124520 - DNA, 33 bp, Artificial Sequence
  Description of Artificial Sequence: Synthetic oligonucleotide
tgacctggataacatttccttccccaaacaggg

SEQ ID NO: 124521 - DNA, 32 bp, Artificial Sequence
  Description of Artificial Sequence: Synthetic oligonucleotide
gacctggataacatttccttccccaaacaggg

SEQ ID NO: 124522 - DNA, 32 bp, Artificial Sequence
  Description of Artificial Sequence: Synthetic oligonucleotide
acctggataacatttccttccccaaacagggc

SEQ ID NO: 124523 - DNA, 31 bp, Artificial Sequence
  Description of Artificial Sequence: Synthetic oligonucleotide
cctggataacatttccttccccaaacagggc

SEQ ID NO: 124524 - DNA, 32 bp, Artificial Sequence
  Description of Artificial Sequence: Synthetic oligonucleotide
ctggataacatttccttccccaaacagggctc

SEQ ID NO: 124525 - DNA, 32 bp, Artificial Sequence
  Description of Artificial Sequence: Synthetic oligonucleotide
tggataacatttccttccccaaacagggctcc

SEQ ID NO: 124526 - DNA, 31 bp, Artificial Sequence
  Description of Artificial Sequence: Synthetic oligonucleotide
ggataacatttccttccccaaacagggctcc

SEQ ID NO: 124527 - DNA, 33 bp, Artificial Sequence
  Description of Artificial Sequence: Synthetic oligonucleotide
atgtctattatgtcctataacggaggggccgtc

SEQ ID NO: 124528 - DNA, 32 bp, Artificial Sequence
  Description of Artificial Sequence: Synthetic oligonucleotide
tgtctattatgtcctataacggaggggccgtc

SEQ ID NO: 124529 - DNA, 31 bp, Artificial Sequence
  Description of Artificial Sequence: Synthetic oligonucleotide
gtctattatgtcctataacggaggggccgtc

SEQ ID NO: 124530 - DNA, 33 bp, Artificial Sequence
  Description of Artificial Sequence: Synthetic oligonucleotide
tctattatgtcctataacggaggggccgtcatg

SEQ ID NO: 124531 - DNA, 32 bp, Artificial Sequence
  Description of Artificial Sequence: Synthetic oligonucleotide
ctattatgtcctataacggaggggccgtcatg

SEQ ID NO: 124532 - DNA, 32 bp, Artificial Sequence
  Description of Artificial Sequence: Synthetic oligonucleotide
tattatgtcctataacggaggggccgtcatgg

SEQ ID NO: 124533 - DNA, 31 bp, Artificial Sequence
  Description of Artificial Sequence: Synthetic oligonucleotide
attatgtcctataacggaggggccgtcatgg

SEQ ID NO: 124534 - DNA, 30 bp, Artificial Sequence
  Description of Artificial Sequence: Synthetic oligonucleotide
ttatgtcctataacggaggggccgtcatgg

SEQ ID NO: 124535 - DNA, 29 bp, Artificial Sequence
  Description of Artificial Sequence: Synthetic oligonucleotide
tatgtcctataacggaggggccgtcatgg

SEQ ID NO: 124536 - DNA, 28 bp, Artificial Sequence
  Description of Artificial Sequence: Synthetic oligonucleotide
atgtcctataacggaggggccgtcatgg

SEQ ID NO: 124537 - DNA, 27 bp, Artificial Sequence
  Description of Artificial Sequence: Synthetic oligonucleotide
tgtcctataacggaggggccgtcatgg

SEQ ID NO: 124538 - DNA, 26 bp, Artificial Sequence
  Description of Artificial Sequence: Synthetic oligonucleotide
gtcctataacggaggggccgtcatgg

SEQ ID NO: 124539 - DNA, 26 bp, Artificial Sequence
  Description of Artificial Sequence: Synthetic oligonucleotide
tcctataacggaggggccgtcatggc

SEQ ID NO: 124540 - DNA, 25 bp, Artificial Sequence
  Description of Artificial Sequence: Synthetic oligonucleotide
cctataacggaggggccgtcatggc

SEQ ID NO: 124541 - DNA, 27 bp, Artificial Sequence
  Description of Artificial Sequence: Synthetic oligonucleotide
ctataacggaggggccgtcatggccat

SEQ ID NO: 124542 - DNA, 27 bp, Artificial Sequence
  Description of Artificial Sequence: Synthetic oligonucleotide
tataacggaggggccgtcatggccatg

SEQ ID NO: 124543 - DNA, 27 bp, Artificial Sequence
  Description of Artificial Sequence: Synthetic oligonucleotide
ataacggaggggccgtcatggccatga

SEQ ID NO: 124544 - DNA, 27 bp, Artificial Sequence
  Description of Artificial Sequence: Synthetic oligonucleotide
taacggaggggccgtcatggccatgaa

SEQ ID NO: 124545 - DNA, 26 bp, Artificial Sequence
  Description of Artificial Sequence: Synthetic oligonucleotide
aacggaggggccgtcatggccatgaa

SEQ ID NO: 124546 - DNA, 25 bp, Artificial Sequence
  Description of Artificial Sequence: Synthetic oligonucleotide
acggaggggccgtcatggccatgaa

SEQ ID NO: 124547 - DNA, 24 bp, Artificial Sequence
  Description of Artificial Sequence: Synthetic oligonucleotide
cggaggggccgtcatggccatgaa

SEQ ID NO: 124548 - DNA, 24 bp, Artificial Sequence
  Description of Artificial Sequence: Synthetic oligonucleotide
ggaggggccgtcatggccatgaag

SEQ ID NO: 124549 - DNA, 24 bp, Artificial Sequence
  Description of Artificial Sequence: Synthetic oligonucleotide
gaggggccgtcatggccatgaagg

SEQ ID NO: 124550 - DNA, 24 bp, Artificial Sequence
  Description of Artificial Sequence: Synthetic oligonucleotide
aggggccgtcatggccatgaaggg

SEQ ID NO: 124551 - DNA, 23 bp, Artificial Sequence
  Description of Artificial Sequence: Synthetic oligonucleotide
ggggccgtcatggccatgaaggg

SEQ ID NO: 124552 - DNA, 25 bp, Artificial Sequence
  Description of Artificial Sequence: Synthetic oligonucleotide
gggccgtcatggccatgaaggggaa

SEQ ID NO: 124553 - DNA, 27 bp, Artificial Sequence
  Description of Artificial Sequence: Synthetic oligonucleotide
ggccgtcatggccatgaaggggaagaa

SEQ ID NO: 124554 - DNA, 27 bp, Artificial Sequence
  Description of Artificial Sequence: Synthetic oligonucleotide
gccgtcatggccatgaaggggaagaac

SEQ ID NO: 124555 - DNA, 28 bp, Artificial Sequence
  Description of Artificial Sequence: Synthetic oligonucleotide
ccgtcatggccatgaaggggaagaactg

SEQ ID NO: 124556 - DNA, 29 bp, Artificial Sequence
  Description of Artificial Sequence: Synthetic oligonucleotide
cgtcatggccatgaaggggaagaactgtg

SEQ ID NO: 124557 - DNA, 30 bp, Artificial Sequence
  Description of Artificial Sequence: Synthetic oligonucleotide
gtcatggccatgaaggggaagaactgtgtg

SEQ ID NO: 124558 - DNA, 30 bp, Artificial Sequence
  Description of Artificial Sequence: Synthetic oligonucleotide
tcatggccatgaaggggaagaactgtgtgg

SEQ ID NO: 124559 - DNA, 29 bp, Artificial Sequence
  Description of Artificial Sequence: Synthetic oligonucleotide
catggccatgaaggggaagaactgtgtgg

SEQ ID NO: 124560 - DNA, 29 bp, Artificial Sequence
  Description of Artificial Sequence: Synthetic oligonucleotide
atggccatgaaggggaagaactgtgtggc

SEQ ID NO: 124561 - DNA, 28 bp, Artificial Sequence
  Description of Artificial Sequence: Synthetic oligonucleotide
tggccatgaaggggaagaactgtgtggc

SEQ ID NO: 124562 - DNA, 27 bp, Artificial Sequence
  Description of Artificial Sequence: Synthetic oligonucleotide
ggccatgaaggggaagaactgtgtggc

SEQ ID NO: 124563 - DNA, 27 bp, Artificial Sequence
  Description of Artificial Sequence: Synthetic oligonucleotide
gccatgaaggggaagaactgtgtggcc

SEQ ID NO: 124564 - DNA, 29 bp, Artificial Sequence
  Description of Artificial Sequence: Synthetic oligonucleotide
ccatgaaggggaagaactgtgtggccatc

SEQ ID NO: 124565 - DNA, 29 bp, Artificial Sequence
  Description of Artificial Sequence: Synthetic oligonucleotide
catgaaggggaagaactgtgtggccatcg

SEQ ID NO: 124566 - DNA, 29 bp, Artificial Sequence
  Description of Artificial Sequence: Synthetic oligonucleotide
atgaaggggaagaactgtgtggccatcgc

SEQ ID NO: 124567 - DNA, 28 bp, Artificial Sequence
  Description of Artificial Sequence: Synthetic oligonucleotide
tgaaggggaagaactgtgtggccatcgc

SEQ ID NO: 124568 - DNA, 27 bp, Artificial Sequence
  Description of Artificial Sequence: Synthetic oligonucleotide
gaaggggaagaactgtgtggccatcgc

SEQ ID NO: 124569 - DNA, 28 bp, Artificial Sequence
  Description of Artificial Sequence: Synthetic oligonucleotide
aaggggaagaactgtgtggccatcgctg

SEQ ID NO: 124570 - DNA, 27 bp, Artificial Sequence
  Description of Artificial Sequence: Synthetic oligonucleotide
aggggaagaactgtgtggccatcgctg

SEQ ID NO: 124571 - DNA, 26 bp, Artificial Sequence
  Description of Artificial Sequence: Synthetic oligonucleotide
ggggaagaactgtgtggccatcgctg

SEQ ID NO: 124572 - DNA, 27 bp, Artificial Sequence
  Description of Artificial Sequence: Synthetic oligonucleotide
gggaagaactgtgtggccatcgctgca

SEQ ID NO: 124573 - DNA, 27 bp, Artificial Sequence
  Description of Artificial Sequence: Synthetic oligonucleotide
ggaagaactgtgtggccatcgctgcag

SEQ ID NO: 124574 - DNA, 28 bp, Artificial Sequence
  Description of Artificial Sequence: Synthetic oligonucleotide
gaagaactgtgtggccatcgctgcagac

SEQ ID NO: 124575 - DNA, 29 bp, Artificial Sequence
  Description of Artificial Sequence: Synthetic oligonucleotide
aagaactgtgtggccatcgctgcagacag

SEQ ID NO: 124576 - DNA, 28 bp, Artificial Sequence
  Description of Artificial Sequence: Synthetic oligonucleotide
agaactgtgtggccatcgctgcagacag

SEQ ID NO: 124577 - DNA, 27 bp, Artificial Sequence
  Description of Artificial Sequence: Synthetic oligonucleotide
gaactgtgtggccatcgctgcagacag

SEQ ID NO: 124578 - DNA, 27 bp, Artificial Sequence
  Description of Artificial Sequence: Synthetic oligonucleotide
aactgtgtggccatcgctgcagacagg

SEQ ID NO: 124579 - DNA, 26 bp, Artificial Sequence
  Description of Artificial Sequence: Synthetic oligonucleotide
actgtgtggccatcgctgcagacagg

SEQ ID NO: 124580 - DNA, 25 bp, Artificial Sequence
  Description of Artificial Sequence: Synthetic oligonucleotide
ctgtgtggccatcgctgcagacagg

SEQ ID NO: 124581 - DNA, 25 bp, Artificial Sequence
  Description of Artificial Sequence: Synthetic oligonucleotide
tgtgtggccatcgctgcagacaggc

SEQ ID NO: 124582 - DNA, 24 bp, Artificial Sequence
  Description of Artificial Sequence: Synthetic oligonucleotide
gtgtggccatcgctgcagacaggc

SEQ ID NO: 124583 - DNA, 24 bp, Artificial Sequence
  Description of Artificial Sequence: Synthetic oligonucleotide
tgtggccatcgctgcagacaggcg

SEQ ID NO: 124584 - DNA, 23 bp, Artificial Sequence
  Description of Artificial Sequence: Synthetic oligonucleotide
gtggccatcgctgcagacaggcg

SEQ ID NO: 124585 - DNA, 25 bp, Artificial Sequence
  Description of Artificial Sequence: Synthetic oligonucleotide
tggccatcgctgcagacaggcgctt

SEQ ID NO: 124586 - DNA, 24 bp, Artificial Sequence
  Description of Artificial Sequence: Synthetic oligonucleotide
ggccatcgctgcagacaggcgctt

SEQ ID NO: 124587 - DNA, 24 bp, Artificial Sequence
  Description of Artificial Sequence: Synthetic oligonucleotide
gccatcgctgcagacaggcgcttc

SEQ ID NO: 124588 - DNA, 24 bp, Artificial Sequence
  Description of Artificial Sequence: Synthetic oligonucleotide
ccatcgctgcagacaggcgcttcg

SEQ ID NO: 124589 - DNA, 24 bp, Artificial Sequence
  Description of Artificial Sequence: Synthetic oligonucleotide
catcgctgcagacaggcgcttcgg

SEQ ID NO: 124590 - DNA, 26 bp, Artificial Sequence
  Description of Artificial Sequence: Synthetic oligonucleotide
atcgctgcagacaggcgcttcgggat

SEQ ID NO: 124591 - DNA, 25 bp, Artificial Sequence
  Description of Artificial Sequence: Synthetic oligonucleotide
tcgctgcagacaggcgcttcgggat

SEQ ID NO: 124592 - DNA, 24 bp, Artificial Sequence
  Description of Artificial Sequence: Synthetic oligonucleotide
cgctgcagacaggcgcttcgggat

SEQ ID NO: 124593 - DNA, 24 bp, Artificial Sequence
  Description of Artificial Sequence: Synthetic oligonucleotide
gctgcagacaggcgcttcgggatc

SEQ ID NO: 124594 - DNA, 25 bp, Artificial Sequence
  Description of Artificial Sequence: Synthetic oligonucleotide
ctgcagacaggcgcttcgggatcca

SEQ ID NO: 124595 - DNA, 25 bp, Artificial Sequence
  Description of Artificial Sequence: Synthetic oligonucleotide
tgcagacaggcgcttcgggatccag

SEQ ID NO: 124596 - DNA, 24 bp, Artificial Sequence
  Description of Artificial Sequence: Synthetic oligonucleotide
gcagacaggcgcttcgggatccag

SEQ ID NO: 124597 - DNA, 24 bp, Artificial Sequence
  Description of Artificial Sequence: Synthetic oligonucleotide
cagacaggcgcttcgggatccagg

SEQ ID NO: 124598 - DNA, 24 bp, Artificial Sequence
  Description of Artificial Sequence: Synthetic oligonucleotide
agacaggcgcttcgggatccaggc

SEQ ID NO: 124599 - DNA, 23 bp, Artificial Sequence
  Description of Artificial Sequence: Synthetic oligonucleotide
gacaggcgcttcgggatccaggc

SEQ ID NO: 124600 - DNA, 23 bp, Artificial Sequence
  Description of Artificial Sequence: Synthetic oligonucleotide
acaggcgcttcgggatccaggcc

SEQ ID NO: 124601 - DNA, 22 bp, Artificial Sequence
  Description of Artificial Sequence: Synthetic oligonucleotide
caggcgcttcgggatccaggcc

SEQ ID NO: 124602 - DNA, 23 bp, Artificial Sequence
  Description of Artificial Sequence: Synthetic oligonucleotide
aggcgcttcgggatccaggccca

SEQ ID NO: 124603 - DNA, 22 bp, Artificial Sequence
  Description of Artificial Sequence: Synthetic oligonucleotide
ggcgcttcgggatccaggccca

SEQ ID NO: 124604 - DNA, 24 bp, Artificial Sequence
  Description of Artificial Sequence: Synthetic oligonucleotide
gcgcttcgggatccaggcccagat

SEQ ID NO: 124605 - DNA, 24 bp, Artificial Sequence
  Description of Artificial Sequence: Synthetic oligonucleotide
cgcttcgggatccaggcccagatg

SEQ ID NO: 124606 - DNA, 25 bp, Artificial Sequence
  Description of Artificial Sequence: Synthetic oligonucleotide
gcttcgggatccaggcccagatggt

SEQ ID NO: 124607 - DNA, 26 bp, Artificial Sequence
  Description of Artificial Sequence: Synthetic oligonucleotide
cttcgggatccaggcccagatggtga

SEQ ID NO: 124608 - DNA, 26 bp, Artificial Sequence
  Description of Artificial Sequence: Synthetic oligonucleotide
ttcgggatccaggcccagatggtgac

SEQ ID NO: 124609 - DNA, 25 bp, Artificial Sequence
  Description of Artificial Sequence: Synthetic oligonucleotide
tcgggatccaggcccagatggtgac

SEQ ID NO: 124610 - DNA, 24 bp, Artificial Sequence
  Description of Artificial Sequence: Synthetic oligonucleotide
cgggatccaggcccagatggtgac

SEQ ID NO: 124611 - DNA, 25 bp, Artificial Sequence
  Description of Artificial Sequence: Synthetic oligonucleotide
gggatccaggcccagatggtgacca

SEQ ID NO: 124612 - DNA, 25 bp, Artificial Sequence
  Description of Artificial Sequence: Synthetic oligonucleotide
ggatccaggcccagatggtgaccac

SEQ ID NO: 124613 - DNA, 25 bp, Artificial Sequence
  Description of Artificial Sequence: Synthetic oligonucleotide
gatccaggcccagatggtgaccacg

SEQ ID NO: 124614 - DNA, 26 bp, Artificial Sequence
  Description of Artificial Sequence: Synthetic oligonucleotide
atccaggcccagatggtgaccacgga

SEQ ID NO: 124615 - DNA, 25 bp, Artificial Sequence
  Description of Artificial Sequence: Synthetic oligonucleotide
tccaggcccagatggtgaccacgga

SEQ ID NO: 124616 - DNA, 24 bp, Artificial Sequence
  Description of Artificial Sequence: Synthetic oligonucleotide
ccaggcccagatggtgaccacgga

SEQ ID NO: 124617 - DNA, 26 bp, Artificial Sequence
  Description of Artificial Sequence: Synthetic oligonucleotide
caggcccagatggtgaccacggactt

SEQ ID NO: 124618 - DNA, 26 bp, Artificial Sequence
  Description of Artificial Sequence: Synthetic oligonucleotide
aggcccagatggtgaccacggacttc

SEQ ID NO: 124619 - DNA, 25 bp, Artificial Sequence
  Description of Artificial Sequence: Synthetic oligonucleotide
ggcccagatggtgaccacggacttc

SEQ ID NO: 124620 - DNA, 26 bp, Artificial Sequence
  Description of Artificial Sequence: Synthetic oligonucleotide
gcccagatggtgaccacggacttcca

SEQ ID NO: 124621 - DNA, 27 bp, Artificial Sequence
  Description of Artificial Sequence: Synthetic oligonucleotide
cccagatggtgaccacggacttccaga

SEQ ID NO: 124622 - DNA, 28 bp, Artificial Sequence
  Description of Artificial Sequence: Synthetic oligonucleotide
ccagatggtgaccacggacttccagaag

SEQ ID NO: 124623 - DNA, 30 bp, Artificial Sequence
  Description of Artificial Sequence: Synthetic oligonucleotide
cagatggtgaccacggacttccagaagatc

SEQ ID NO: 124624 - DNA, 33 bp, Artificial Sequence
  Description of Artificial Sequence: Synthetic oligonucleotide
agatggtgaccacggacttccagaagatctttc

SEQ ID NO: 124625 - DNA, 32 bp, Artificial Sequence
  Description of Artificial Sequence: Synthetic oligonucleotide
gatggtgaccacggacttccagaagatctttc

SEQ ID NO: 124626 - DNA, 32 bp, Artificial Sequence
  Description of Artificial Sequence: Synthetic oligonucleotide
atggtgaccacggacttccagaagatctttcc

SEQ ID NO: 124627 - DNA, 31 bp, Artificial Sequence
  Description of Artificial Sequence: Synthetic oligonucleotide
tggtgaccacggacttccagaagatctttcc

SEQ ID NO: 124628 - DNA, 30 bp, Artificial Sequence
  Description of Artificial Sequence: Synthetic oligonucleotide
ggtgaccacggacttccagaagatctttcc

SEQ ID NO: 124629 - DNA, 30 bp, Artificial Sequence
  Description of Artificial Sequence: Synthetic oligonucleotide
gtgaccacggacttccagaagatctttccc

SEQ ID NO: 124630 - DNA, 32 bp, Artificial Sequence
  Description of Artificial Sequence: Synthetic oligonucleotide
tgaccacggacttccagaagatctttcccatg

SEQ ID NO: 124631 - DNA, 31 bp, Artificial Sequence
  Description of Artificial Sequence: Synthetic oligonucleotide
gaccacggacttccagaagatctttcccatg

SEQ ID NO: 124632 - DNA, 31 bp, Artificial Sequence
  Description of Artificial Sequence: Synthetic oligonucleotide
accacggacttccagaagatctttcccatgg

SEQ ID NO: 124633 - DNA, 30 bp, Artificial Sequence
  Description of Artificial Sequence: Synthetic oligonucleotide
ccacggacttccagaagatctttcccatgg

SEQ ID NO: 124634 - DNA, 30 bp, Artificial Sequence
  Description of Artificial Sequence: Synthetic oligonucleotide
cacggacttccagaagatctttcccatggg

SEQ ID NO: 124635 - DNA, 31 bp, Artificial Sequence
  Description of Artificial Sequence: Synthetic oligonucleotide
acggacttccagaagatctttcccatgggtg

SEQ ID NO: 124636 - DNA, 30 bp, Artificial Sequence
  Description of Artificial Sequence: Synthetic oligonucleotide
cggacttccagaagatctttcccatgggtg

SEQ ID NO: 124637 - DNA, 31 bp, Artificial Sequence
  Description of Artificial Sequence: Synthetic oligonucleotide
ggacttccagaagatctttcccatgggtgac

SEQ ID NO: 124638 - DNA, 31 bp, Artificial Sequence
  Description of Artificial Sequence: Synthetic oligonucleotide
gacttccagaagatctttcccatgggtgacc

SEQ ID NO: 124639 - DNA, 31 bp, Artificial Sequence
  Description of Artificial Sequence: Synthetic oligonucleotide
acttccagaagatctttcccatgggtgaccg

SEQ ID NO: 124640 - DNA, 30 bp, Artificial Sequence
  Description of Artificial Sequence: Synthetic oligonucleotide
cttccagaagatctttcccatgggtgaccg

SEQ ID NO: 124641 - DNA, 30 bp, Artificial Sequence
  Description of Artificial Sequence: Synthetic oligonucleotide
ttccagaagatctttcccatgggtgaccgg

SEQ ID NO: 124642 - DNA, 29 bp, Artificial Sequence
  Description of Artificial Sequence: Synthetic oligonucleotide
tccagaagatctttcccatgggtgaccgg

SEQ ID NO: 124643 - DNA, 28 bp, Artificial Sequence
  Description of Artificial Sequence: Synthetic oligonucleotide
ccagaagatctttcccatgggtgaccgg

SEQ ID NO: 124644 - DNA, 28 bp, Artificial Sequence
  Description of Artificial Sequence: Synthetic oligonucleotide
cagaagatctttcccatgggtgaccggc

SEQ ID NO: 124645 - DNA, 29 bp, Artificial Sequence
  Description of Artificial Sequence: Synthetic oligonucleotide
agaagatctttcccatgggtgaccggctg

SEQ ID NO: 124646 - DNA, 28 bp, Artificial Sequence
  Description of Artificial Sequence: Synthetic oligonucleotide
gaagatctttcccatgggtgaccggctg

SEQ ID NO: 124647 - DNA, 30 bp, Artificial Sequence
  Description of Artificial Sequence: Synthetic oligonucleotide
aagatctttcccatgggtgaccggctgtac

SEQ ID NO: 124648 - DNA, 29 bp, Artificial Sequence
  Description of Artificial Sequence: Synthetic oligonucleotide
agatctttcccatgggtgaccggctgtac

SEQ ID NO: 124649 - DNA, 28 bp, Artificial Sequence
  Description of Artificial Sequence: Synthetic oligonucleotide
gatctttcccatgggtgaccggctgtac

SEQ ID NO: 124650 - DNA, 30 bp, Artificial Sequence
  Description of Artificial Sequence: Synthetic oligonucleotide
atctttcccatgggtgaccggctgtacatc

SEQ ID NO: 124651 - DNA, 29 bp, Artificial Sequence
  Description of Artificial Sequence: Synthetic oligonucleotide
tctttcccatgggtgaccggctgtacatc

SEQ ID NO: 124652 - DNA, 28 bp, Artificial Sequence
  Description of Artificial Sequence: Synthetic oligonucleotide
ctttcccatgggtgaccggctgtacatc

SEQ ID NO: 124653 - DNA, 28 bp, Artificial Sequence
  Description of Artificial Sequence: Synthetic oligonucleotide
tttcccatgggtgaccggctgtacatcg

SEQ ID NO: 124654 - DNA, 27 bp, Artificial Sequence
  Description of Artificial Sequence: Synthetic oligonucleotide
ttcccatgggtgaccggctgtacatcg

SEQ ID NO: 124655 - DNA, 26 bp, Artificial Sequence
  Description of Artificial Sequence: Synthetic oligonucleotide
tcccatgggtgaccggctgtacatcg

SEQ ID NO: 124656 - DNA, 25 bp, Artificial Sequence
  Description of Artificial Sequence: Synthetic oligonucleotide
cccatgggtgaccggctgtacatcg

SEQ ID NO: 124657 - DNA, 26 bp, Artificial Sequence
  Description of Artificial Sequence: Synthetic oligonucleotide
ccatgggtgaccggctgtacatcggt

SEQ ID NO: 124658 - DNA, 27 bp, Artificial Sequence
  Description of Artificial Sequence: Synthetic oligonucleotide
catgggtgaccggctgtacatcggtct

SEQ ID NO: 124659 - DNA, 27 bp, Artificial Sequence
  Description of Artificial Sequence: Synthetic oligonucleotide
atgggtgaccggctgtacatcggtctg

SEQ ID NO: 124660 - DNA, 26 bp, Artificial Sequence
  Description of Artificial Sequence: Synthetic oligonucleotide
tgggtgaccggctgtacatcggtctg

SEQ ID NO: 124661 - DNA, 25 bp, Artificial Sequence
  Description of Artificial Sequence: Synthetic oligonucleotide
gggtgaccggctgtacatcggtctg

SEQ ID NO: 124662 - DNA, 25 bp, Artificial Sequence
  Description of Artificial Sequence: Synthetic oligonucleotide
ggtgaccggctgtacatcggtctgg

SEQ ID NO: 124663 - DNA, 25 bp, Artificial Sequence
  Description of Artificial Sequence: Synthetic oligonucleotide
gtgaccggctgtacatcggtctggc

SEQ ID NO: 124664 - DNA, 25 bp, Artificial Sequence
  Description of Artificial Sequence: Synthetic oligonucleotide
tgaccggctgtacatcggtctggcc

SEQ ID NO: 124665 - DNA, 24 bp, Artificial Sequence
  Description of Artificial Sequence: Synthetic oligonucleotide
gaccggctgtacatcggtctggcc

SEQ ID NO: 124666 - DNA, 24 bp, Artificial Sequence
  Description of Artificial Sequence: Synthetic oligonucleotide
accggctgtacatcggtctggccg

SEQ ID NO: 124667 - DNA, 23 bp, Artificial Sequence
  Description of Artificial Sequence: Synthetic oligonucleotide
ccggctgtacatcggtctggccg

SEQ ID NO: 124668 - DNA, 23 bp, Artificial Sequence
  Description of Artificial Sequence: Synthetic oligonucleotide
cggctgtacatcggtctggccgg

SEQ ID NO: 124669 - DNA, 23 bp, Artificial Sequence
  Description of Artificial Sequence: Synthetic oligonucleotide
ggctgtacatcggtctggccggg

SEQ ID NO: 124670 - DNA, 24 bp, Artificial Sequence
  Description of Artificial Sequence: Synthetic oligonucleotide
gctgtacatcggtctggccgggct

SEQ ID NO: 124671 - DNA, 24 bp, Artificial Sequence
  Description of Artificial Sequence: Synthetic oligonucleotide
ctgtacatcggtctggccgggctc

SEQ ID NO: 124672 - DNA, 24 bp, Artificial Sequence
  Description of Artificial Sequence: Synthetic oligonucleotide
tgtacatcggtctggccgggctcg

SEQ ID NO: 124673 - DNA, 23 bp, Artificial Sequence
  Description of Artificial Sequence: Synthetic oligonucleotide
gtacatcggtctggccgggctcg

SEQ ID NO: 124674 - DNA, 23 bp, Artificial Sequence
  Description of Artificial Sequence: Synthetic oligonucleotide
tacatcggtctggccgggctcgc

SEQ ID NO: 124675 - DNA, 22 bp, Artificial Sequence
  Description of Artificial Sequence: Synthetic oligonucleotide
acatcggtctggccgggctcgc

SEQ ID NO: 124676 - DNA, 21 bp, Artificial Sequence
  Description of Artificial Sequence: Synthetic oligonucleotide
catcggtctggccgggctcgc

SEQ ID NO: 124677 - DNA, 22 bp, Artificial Sequence
  Description of Artificial Sequence: Synthetic oligonucleotide
atcggtctggccgggctcgcca

SEQ ID NO: 124678 - DNA, 21 bp, Artificial Sequence
  Description of Artificial Sequence: Synthetic oligonucleotide
tcggtctggccgggctcgcca

SEQ ID NO: 124679 - DNA, 20 bp, Artificial Sequence
  Description of Artificial Sequence: Synthetic oligonucleotide
cggtctggccgggctcgcca

SEQ ID NO: 124680 - DNA, 21 bp, Artificial Sequence
  Description of Artificial Sequence: Synthetic oligonucleotide
ggtctggccgggctcgccact

SEQ ID NO: 124681 - DNA, 22 bp, Artificial Sequence
  Description of Artificial Sequence: Synthetic oligonucleotide
gtctggccgggctcgccactga

SEQ ID NO: 124682 - DNA, 22 bp, Artificial Sequence
  Description of Artificial Sequence: Synthetic oligonucleotide
tctggccgggctcgccactgac

SEQ ID NO: 124683 - DNA, 21 bp, Artificial Sequence
  Description of Artificial Sequence: Synthetic oligonucleotide
ctggccgggctcgccactgac

SEQ ID NO: 124684 - DNA, 22 bp, Artificial Sequence
  Description of Artificial Sequence: Synthetic oligonucleotide
tggccgggctcgccactgacgt

SEQ ID NO: 124685 - DNA, 21 bp, Artificial Sequence
  Description of Artificial Sequence: Synthetic oligonucleotide
ggccgggctcgccactgacgt

SEQ ID NO: 124686 - DNA, 21 bp, Artificial Sequence
  Description of Artificial Sequence: Synthetic oligonucleotide
gccgggctcgccactgacgtc

SEQ ID NO: 124687 - DNA, 22 bp, Artificial Sequence
  Description of Artificial Sequence: Synthetic oligonucleotide
ccgggctcgccactgacgtcca

SEQ ID NO: 124688 - DNA, 23 bp, Artificial Sequence
  Description of Artificial Sequence: Synthetic oligonucleotide
cgggctcgccactgacgtccaga

SEQ ID NO: 124689 - DNA, 24 bp, Artificial Sequence
  Description of Artificial Sequence: Synthetic oligonucleotide
gggctcgccactgacgtccagaca

SEQ ID NO: 124690 - DNA, 26 bp, Artificial Sequence
  Description of Artificial Sequence: Synthetic oligonucleotide
ggctcgccactgacgtccagacagtt

SEQ ID NO: 124691 - DNA, 26 bp, Artificial Sequence
  Description of Artificial Sequence: Synthetic oligonucleotide
gctcgccactgacgtccagacagttg

SEQ ID NO: 124692 - DNA, 26 bp, Artificial Sequence
  Description of Artificial Sequence: Synthetic oligonucleotide
ctcgccactgacgtccagacagttgc

SEQ ID NO: 124693 - DNA, 26 bp, Artificial Sequence
  Description of Artificial Sequence: Synthetic oligonucleotide
tcgccactgacgtccagacagttgcc

SEQ ID NO: 124694 - DNA, 25 bp, Artificial Sequence
  Description of Artificial Sequence: Synthetic oligonucleotide
cgccactgacgtccagacagttgcc

SEQ ID NO: 124695 - DNA, 26 bp, Artificial Sequence
  Description of Artificial Sequence: Synthetic oligonucleotide
gccactgacgtccagacagttgccca

SEQ ID NO: 124696 - DNA, 26 bp, Artificial Sequence
  Description of Artificial Sequence: Synthetic oligonucleotide
ccactgacgtccagacagttgcccag

SEQ ID NO: 124697 - DNA, 26 bp, Artificial Sequence
  Description of Artificial Sequence: Synthetic oligonucleotide
cactgacgtccagacagttgcccagc

SEQ ID NO: 124698 - DNA, 26 bp, Artificial Sequence
  Description of Artificial Sequence: Synthetic oligonucleotide
actgacgtccagacagttgcccagcg

SEQ ID NO: 124699 - DNA, 25 bp, Artificial Sequence
  Description of Artificial Sequence: Synthetic oligonucleotide
ctgacgtccagacagttgcccagcg

SEQ ID NO: 124700 - DNA, 25 bp, Artificial Sequence
  Description of Artificial Sequence: Synthetic oligonucleotide
tgacgtccagacagttgcccagcgc

SEQ ID NO: 124701 - DNA, 24 bp, Artificial Sequence
  Description of Artificial Sequence: Synthetic oligonucleotide
gacgtccagacagttgcccagcgc

SEQ ID NO: 124702 - DNA, 25 bp, Artificial Sequence
  Description of Artificial Sequence: Synthetic oligonucleotide
acgtccagacagttgcccagcgcct

SEQ ID NO: 124703 - DNA, 24 bp, Artificial Sequence
  Description of Artificial Sequence: Synthetic oligonucleotide
cgtccagacagttgcccagcgcct

SEQ ID NO: 124704 - DNA, 26 bp, Artificial Sequence
  Description of Artificial Sequence: Synthetic oligonucleotide
gtccagacagttgcccagcgcctcaa

SEQ ID NO: 124705 - DNA, 27 bp, Artificial Sequence
  Description of Artificial Sequence: Synthetic oligonucleotide
tccagacagttgcccagcgcctcaagt

SEQ ID NO: 124706 - DNA, 27 bp, Artificial Sequence
  Description of Artificial Sequence: Synthetic oligonucleotide
ccagacagttgcccagcgcctcaagtt

SEQ ID NO: 124707 - DNA, 27 bp, Artificial Sequence
  Description of Artificial Sequence: Synthetic oligonucleotide
cagacagttgcccagcgcctcaagttc

SEQ ID NO: 124708 - DNA, 27 bp, Artificial Sequence
  Description of Artificial Sequence: Synthetic oligonucleotide
agacagttgcccagcgcctcaagttcc

SEQ ID NO: 124709 - DNA, 26 bp, Artificial Sequence
  Description of Artificial Sequence: Synthetic oligonucleotide
gacagttgcccagcgcctcaagttcc

SEQ ID NO: 124710 - DNA, 26 bp, Artificial Sequence
  Description of Artificial Sequence: Synthetic oligonucleotide
acagttgcccagcgcctcaagttccg

SEQ ID NO: 124711 - DNA, 25 bp, Artificial Sequence
  Description of Artificial Sequence: Synthetic oligonucleotide
cagttgcccagcgcctcaagttccg

SEQ ID NO: 124712 - DNA, 25 bp, Artificial Sequence
  Description of Artificial Sequence: Synthetic oligonucleotide
agttgcccagcgcctcaagttccgg

SEQ ID NO: 124713 - DNA, 24 bp, Artificial Sequence
  Description of Artificial Sequence: Synthetic oligonucleotide
gttgcccagcgcctcaagttccgg

SEQ ID NO: 124714 - DNA, 25 bp, Artificial Sequence
  Description of Artificial Sequence: Synthetic oligonucleotide
ttgcccagcgcctcaagttccggct

SEQ ID NO: 124715 - DNA, 24 bp, Artificial Sequence
  Description of Artificial Sequence: Synthetic oligonucleotide
tgcccagcgcctcaagttccggct

SEQ ID NO: 124716 - DNA, 23 bp, Artificial Sequence
  Description of Artificial Sequence: Synthetic oligonucleotide
gcccagcgcctcaagttccggct

SEQ ID NO: 124717 - DNA, 25 bp, Artificial Sequence
  Description of Artificial Sequence: Synthetic oligonucleotide
cccagcgcctcaagttccggctgaa

SEQ ID NO: 124718 - DNA, 25 bp, Artificial Sequence
  Description of Artificial Sequence: Synthetic oligonucleotide
ccagcgcctcaagttccggctgaac

SEQ ID NO: 124719 - DNA, 26 bp, Artificial Sequence
  Description of Artificial Sequence: Synthetic oligonucleotide
cagcgcctcaagttccggctgaacct

SEQ ID NO: 124720 - DNA, 27 bp, Artificial Sequence
  Description of Artificial Sequence: Synthetic oligonucleotide
agcgcctcaagttccggctgaacctgt

SEQ ID NO: 124721 - DNA, 27 bp, Artificial Sequence
  Description of Artificial Sequence: Synthetic oligonucleotide
gcgcctcaagttccggctgaacctgta

SEQ ID NO: 124722 - DNA, 28 bp, Artificial Sequence
  Description of Artificial Sequence: Synthetic oligonucleotide
cgcctcaagttccggctgaacctgtatg

SEQ ID NO: 124723 - DNA, 29 bp, Artificial Sequence
  Description of Artificial Sequence: Synthetic oligonucleotide
gcctcaagttccggctgaacctgtatgag

SEQ ID NO: 124724 - DNA, 31 bp, Artificial Sequence
  Description of Artificial Sequence: Synthetic oligonucleotide
cctcaagttccggctgaacctgtatgagttg

SEQ ID NO: 124725 - DNA, 33 bp, Artificial Sequence
  Description of Artificial Sequence: Synthetic oligonucleotide
ctcaagttccggctgaacctgtatgagttgaag

SEQ ID NO: 124726 - DNA, 33 bp, Artificial Sequence
  Description of Artificial Sequence: Synthetic oligonucleotide
tcaagttccggctgaacctgtatgagttgaagg

SEQ ID NO: 124727 - DNA, 32 bp, Artificial Sequence
  Description of Artificial Sequence: Synthetic oligonucleotide
caagttccggctgaacctgtatgagttgaagg

SEQ ID NO: 124728 - DNA, 34 bp, Artificial Sequence
  Description of Artificial Sequence: Synthetic oligonucleotide
aagttccggctgaacctgtatgagttgaaggaag

SEQ ID NO: 124729 - DNA, 33 bp, Artificial Sequence
  Description of Artificial Sequence: Synthetic oligonucleotide
agttccggctgaacctgtatgagttgaaggaag

SEQ ID NO: 124730 - DNA, 32 bp, Artificial Sequence
  Description of Artificial Sequence: Synthetic oligonucleotide
gttccggctgaacctgtatgagttgaaggaag

SEQ ID NO: 124731 - DNA, 32 bp, Artificial Sequence
  Description of Artificial Sequence: Synthetic oligonucleotide
ttccggctgaacctgtatgagttgaaggaagg

SEQ ID NO: 124732 - DNA, 31 bp, Artificial Sequence
  Description of Artificial Sequence: Synthetic oligonucleotide
tccggctgaacctgtatgagttgaaggaagg

SEQ ID NO: 124733 - DNA, 30 bp, Artificial Sequence
  Description of Artificial Sequence: Synthetic oligonucleotide
ccggctgaacctgtatgagttgaaggaagg

SEQ ID NO: 124734 - DNA, 31 bp, Artificial Sequence
  Description of Artificial Sequence: Synthetic oligonucleotide
cggctgaacctgtatgagttgaaggaaggtc

SEQ ID NO: 124735 - DNA, 31 bp, Artificial Sequence
  Description of Artificial Sequence: Synthetic oligonucleotide
ggctgaacctgtatgagttgaaggaaggtcg

SEQ ID NO: 124736 - DNA, 31 bp, Artificial Sequence
  Description of Artificial Sequence: Synthetic oligonucleotide
gctgaacctgtatgagttgaaggaaggtcgg

SEQ ID NO: 124737 - DNA, 31 bp, Artificial Sequence
  Description of Artificial Sequence: Synthetic oligonucleotide
ctgaacctgtatgagttgaaggaaggtcggc

SEQ ID NO: 124738 - DNA, 32 bp, Artificial Sequence
  Description of Artificial Sequence: Synthetic oligonucleotide
tgaacctgtatgagttgaaggaaggtcggcag

SEQ ID NO: 124739 - DNA, 31 bp, Artificial Sequence
  Description of Artificial Sequence: Synthetic oligonucleotide
gaacctgtatgagttgaaggaaggtcggcag

SEQ ID NO: 124740 - DNA, 33 bp, Artificial Sequence
  Description of Artificial Sequence: Synthetic oligonucleotide
aacctgtatgagttgaaggaaggtcggcagatc

SEQ ID NO: 124741 - DNA, 32 bp, Artificial Sequence
  Description of Artificial Sequence: Synthetic oligonucleotide
acctgtatgagttgaaggaaggtcggcagatc

SEQ ID NO: 124742 - DNA, 31 bp, Artificial Sequence
  Description of Artificial Sequence: Synthetic oligonucleotide
cctgtatgagttgaaggaaggtcggcagatc

SEQ ID NO: 124743 - DNA, 34 bp, Artificial Sequence
  Description of Artificial Sequence: Synthetic oligonucleotide
ctgtatgagttgaaggaaggtcggcagatcaaac

SEQ ID NO: 124744 - DNA, 34 bp, Artificial Sequence
  Description of Artificial Sequence: Synthetic oligonucleotide
tgtatgagttgaaggaaggtcggcagatcaaacc

SEQ ID NO: 124745 - DNA, 33 bp, Artificial Sequence
  Description of Artificial Sequence: Synthetic oligonucleotide
gtatgagttgaaggaaggtcggcagatcaaacc

SEQ ID NO: 124746 - DNA, 38 bp, Artificial Sequence
  Description of Artificial Sequence: Synthetic oligonucleotide
tatgagttgaaggaaggtcggcagatcaaaccttatac

SEQ ID NO: 124747 - DNA, 37 bp, Artificial Sequence
  Description of Artificial Sequence: Synthetic oligonucleotide
atgagttgaaggaaggtcggcagatcaaaccttatac

SEQ ID NO: 124748 - DNA, 36 bp, Artificial Sequence
  Description of Artificial Sequence: Synthetic oligonucleotide
tgagttgaaggaaggtcggcagatcaaaccttatac

SEQ ID NO: 124749 - DNA, 35 bp, Artificial Sequence
  Description of Artificial Sequence: Synthetic oligonucleotide
gagttgaaggaaggtcggcagatcaaaccttatac

SEQ ID NO: 124750 - DNA, 35 bp, Artificial Sequence
  Description of Artificial Sequence: Synthetic oligonucleotide
agttgaaggaaggtcggcagatcaaaccttatacc

SEQ ID NO: 124751 - DNA, 34 bp, Artificial Sequence
  Description of Artificial Sequence: Synthetic oligonucleotide
gttgaaggaaggtcggcagatcaaaccttatacc

SEQ ID NO: 124752 - DNA, 34 bp, Artificial Sequence
  Description of Artificial Sequence: Synthetic oligonucleotide
ttgaaggaaggtcggcagatcaaaccttataccc

SEQ ID NO: 124753 - DNA, 33 bp, Artificial Sequence
  Description of Artificial Sequence: Synthetic oligonucleotide
tgaaggaaggtcggcagatcaaaccttataccc

SEQ ID NO: 124754 - DNA, 32 bp, Artificial Sequence
  Description of Artificial Sequence: Synthetic oligonucleotide
gaaggaaggtcggcagatcaaaccttataccc

SEQ ID NO: 124755 - DNA, 33 bp, Artificial Sequence
  Description of Artificial Sequence: Synthetic oligonucleotide
aaggaaggtcggcagatcaaaccttataccctc

SEQ ID NO: 124756 - DNA, 32 bp, Artificial Sequence
  Description of Artificial Sequence: Synthetic oligonucleotide
aggaaggtcggcagatcaaaccttataccctc

SEQ ID NO: 124757 - DNA, 31 bp, Artificial Sequence
  Description of Artificial Sequence: Synthetic oligonucleotide
ggaaggtcggcagatcaaaccttataccctc

SEQ ID NO: 124758 - DNA, 33 bp, Artificial Sequence
  Description of Artificial Sequence: Synthetic oligonucleotide
gaaggtcggcagatcaaaccttataccctcatg

SEQ ID NO: 124759 - DNA, 34 bp, Artificial Sequence
  Description of Artificial Sequence: Synthetic oligonucleotide
aaggtcggcagatcaaaccttataccctcatgag

SEQ ID NO: 124760 - DNA, 33 bp, Artificial Sequence
  Description of Artificial Sequence: Synthetic oligonucleotide
aggtcggcagatcaaaccttataccctcatgag

SEQ ID NO: 124761 - DNA, 32 bp, Artificial Sequence
  Description of Artificial Sequence: Synthetic oligonucleotide
ggtcggcagatcaaaccttataccctcatgag

SEQ ID NO: 124762 - DNA, 32 bp, Artificial Sequence
  Description of Artificial Sequence: Synthetic oligonucleotide
gtcggcagatcaaaccttataccctcatgagc

SEQ ID NO: 124763 - DNA, 34 bp, Artificial Sequence
  Description of Artificial Sequence: Synthetic oligonucleotide
tcggcagatcaaaccttataccctcatgagcatg

SEQ ID NO: 124764 - DNA, 33 bp, Artificial Sequence
  Description of Artificial Sequence: Synthetic oligonucleotide
cggcagatcaaaccttataccctcatgagcatg

SEQ ID NO: 124765 - DNA, 33 bp, Artificial Sequence
  Description of Artificial Sequence: Synthetic oligonucleotide
ggcagatcaaaccttataccctcatgagcatgg

SEQ ID NO: 124766 - DNA, 34 bp, Artificial Sequence
  Description of Artificial Sequence: Synthetic oligonucleotide
gcagatcaaaccttataccctcatgagcatggtg

SEQ ID NO: 124767 - DNA, 34 bp, Artificial Sequence
  Description of Artificial Sequence: Synthetic oligonucleotide
cagatcaaaccttataccctcatgagcatggtgg

SEQ ID NO: 124768 - DNA, 34 bp, Artificial Sequence
  Description of Artificial Sequence: Synthetic oligonucleotide
agatcaaaccttataccctcatgagcatggtggc

SEQ ID NO: 124769 - DNA, 33 bp, Artificial Sequence
  Description of Artificial Sequence: Synthetic oligonucleotide
gatcaaaccttataccctcatgagcatggtggc

SEQ ID NO: 124770 - DNA, 33 bp, Artificial Sequence
  Description of Artificial Sequence: Synthetic oligonucleotide
atcaaaccttataccctcatgagcatggtggcc

SEQ ID NO: 124771 - DNA, 32 bp, Artificial Sequence
  Description of Artificial Sequence: Synthetic oligonucleotide
tcaaaccttataccctcatgagcatggtggcc

SEQ ID NO: 124772 - DNA, 31 bp, Artificial Sequence
  Description of Artificial Sequence: Synthetic oligonucleotide
caaaccttataccctcatgagcatggtggcc

SEQ ID NO: 124773 - DNA, 33 bp, Artificial Sequence
  Description of Artificial Sequence: Synthetic oligonucleotide
aaaccttataccctcatgagcatggtggccaac

SEQ ID NO: 124774 - DNA, 32 bp, Artificial Sequence
  Description of Artificial Sequence: Synthetic oligonucleotide
aaccttataccctcatgagcatggtggccaac

SEQ ID NO: 124775 - DNA, 31 bp, Artificial Sequence
  Description of Artificial Sequence: Synthetic oligonucleotide
accttataccctcatgagcatggtggccaac

SEQ ID NO: 124776 - DNA, 30 bp, Artificial Sequence
  Description of Artificial Sequence: Synthetic oligonucleotide
ccttataccctcatgagcatggtggccaac

SEQ ID NO: 124777 - DNA, 30 bp, Artificial Sequence
  Description of Artificial Sequence: Synthetic oligonucleotide
cttataccctcatgagcatggtggccaacc

SEQ ID NO: 124778 - DNA, 31 bp, Artificial Sequence
  Description of Artificial Sequence: Synthetic oligonucleotide
ttataccctcatgagcatggtggccaacctc

SEQ ID NO: 124779 - DNA, 30 bp, Artificial Sequence
  Description of Artificial Sequence: Synthetic oligonucleotide
tataccctcatgagcatggtggccaacctc

SEQ ID NO: 124780 - DNA, 29 bp, Artificial Sequence
  Description of Artificial Sequence: Synthetic oligonucleotide
ataccctcatgagcatggtggccaacctc

SEQ ID NO: 124781 - DNA, 28 bp, Artificial Sequence
  Description of Artificial Sequence: Synthetic oligonucleotide
taccctcatgagcatggtggccaacctc

SEQ ID NO: 124782 - DNA, 27 bp, Artificial Sequence
  Description of Artificial Sequence: Synthetic oligonucleotide
accctcatgagcatggtggccaacctc

SEQ ID NO: 124783 - DNA, 27 bp, Artificial Sequence
  Description of Artificial Sequence: Synthetic oligonucleotide
ccctcatgagcatggtggccaacctct

SEQ ID NO: 124784 - DNA, 28 bp, Artificial Sequence
  Description of Artificial Sequence: Synthetic oligonucleotide
cctcatgagcatggtggccaacctcttg

SEQ ID NO: 124785 - DNA, 31 bp, Artificial Sequence
  Description of Artificial Sequence: Synthetic oligonucleotide
ctcatgagcatggtggccaacctcttgtatg

SEQ ID NO: 124786 - DNA, 32 bp, Artificial Sequence
  Description of Artificial Sequence: Synthetic oligonucleotide
tcatgagcatggtggccaacctcttgtatgag

SEQ ID NO: 124787 - DNA, 31 bp, Artificial Sequence
  Description of Artificial Sequence: Synthetic oligonucleotide
catgagcatggtggccaacctcttgtatgag

SEQ ID NO: 124788 - DNA, 34 bp, Artificial Sequence
  Description of Artificial Sequence: Synthetic oligonucleotide
atgagcatggtggccaacctcttgtatgagaaac

SEQ ID NO: 124789 - DNA, 33 bp, Artificial Sequence
  Description of Artificial Sequence: Synthetic oligonucleotide
tgagcatggtggccaacctcttgtatgagaaac

SEQ ID NO: 124790 - DNA, 32 bp, Artificial Sequence
  Description of Artificial Sequence: Synthetic oligonucleotide
gagcatggtggccaacctcttgtatgagaaac

SEQ ID NO: 124791 - DNA, 32 bp, Artificial Sequence
  Description of Artificial Sequence: Synthetic oligonucleotide
agcatggtggccaacctcttgtatgagaaacg

SEQ ID NO: 124792 - DNA, 31 bp, Artificial Sequence
  Description of Artificial Sequence: Synthetic oligonucleotide
gcatggtggccaacctcttgtatgagaaacg

SEQ ID NO: 124793 - DNA, 31 bp, Artificial Sequence
  Description of Artificial Sequence: Synthetic oligonucleotide
catggtggccaacctcttgtatgagaaacgg

SEQ ID NO: 124794 - DNA, 34 bp, Artificial Sequence
  Description of Artificial Sequence: Synthetic oligonucleotide
atggtggccaacctcttgtatgagaaacggtttg

SEQ ID NO: 124795 - DNA, 33 bp, Artificial Sequence
  Description of Artificial Sequence: Synthetic oligonucleotide
tggtggccaacctcttgtatgagaaacggtttg

SEQ ID NO: 124796 - DNA, 32 bp, Artificial Sequence
  Description of Artificial Sequence: Synthetic oligonucleotide
ggtggccaacctcttgtatgagaaacggtttg

SEQ ID NO: 124797 - DNA, 32 bp, Artificial Sequence
  Description of Artificial Sequence: Synthetic oligonucleotide
gtggccaacctcttgtatgagaaacggtttgg

SEQ ID NO: 124798 - DNA, 32 bp, Artificial Sequence
  Description of Artificial Sequence: Synthetic oligonucleotide
tggccaacctcttgtatgagaaacggtttggc

SEQ ID NO: 124799 - DNA, 31 bp, Artificial Sequence
  Description of Artificial Sequence: Synthetic oligonucleotide
ggccaacctcttgtatgagaaacggtttggc

SEQ ID NO: 124800 - DNA, 31 bp, Artificial Sequence
  Description of Artificial Sequence: Synthetic oligonucleotide
gccaacctcttgtatgagaaacggtttggcc

SEQ ID NO: 124801 - DNA, 31 bp, Artificial Sequence
  Description of Artificial Sequence: Synthetic oligonucleotide
ccaacctcttgtatgagaaacggtttggccc

SEQ ID NO: 124802 - DNA, 34 bp, Artificial Sequence
  Description of Artificial Sequence: Synthetic oligonucleotide
caacctcttgtatgagaaacggtttggcccttac

SEQ ID NO: 124803 - DNA, 36 bp, Artificial Sequence
  Description of Artificial Sequence: Synthetic oligonucleotide
aacctcttgtatgagaaacggtttggcccttactac

SEQ ID NO: 124804 - DNA, 35 bp, Artificial Sequence
  Description of Artificial Sequence: Synthetic oligonucleotide
acctcttgtatgagaaacggtttggcccttactac

SEQ ID NO: 124805 - DNA, 34 bp, Artificial Sequence
  Description of Artificial Sequence: Synthetic oligonucleotide
cctcttgtatgagaaacggtttggcccttactac

SEQ ID NO: 124806 - DNA, 35 bp, Artificial Sequence
  Description of Artificial Sequence: Synthetic oligonucleotide
ctcttgtatgagaaacggtttggcccttactacac

SEQ ID NO: 124807 - DNA, 36 bp, Artificial Sequence
  Description of Artificial Sequence: Synthetic oligonucleotide
tcttgtatgagaaacggtttggcccttactacactg

SEQ ID NO: 124808 - DNA, 35 bp, Artificial Sequence
  Description of Artificial Sequence: Synthetic oligonucleotide
cttgtatgagaaacggtttggcccttactacactg

SEQ ID NO: 124809 - DNA, 36 bp, Artificial Sequence
  Description of Artificial Sequence: Synthetic oligonucleotide
ttgtatgagaaacggtttggcccttactacactgag

SEQ ID NO: 124810 - DNA, 35 bp, Artificial Sequence
  Description of Artificial Sequence: Synthetic oligonucleotide
tgtatgagaaacggtttggcccttactacactgag

SEQ ID NO: 124811 - DNA, 34 bp, Artificial Sequence
  Description of Artificial Sequence: Synthetic oligonucleotide
gtatgagaaacggtttggcccttactacactgag

SEQ ID NO: 124812 - DNA, 34 bp, Artificial Sequence
  Description of Artificial Sequence: Synthetic oligonucleotide
tatgagaaacggtttggcccttactacactgagc

SEQ ID NO: 124813 - DNA, 33 bp, Artificial Sequence
  Description of Artificial Sequence: Synthetic oligonucleotide
atgagaaacggtttggcccttactacactgagc

SEQ ID NO: 124814 - DNA, 32 bp, Artificial Sequence
  Description of Artificial Sequence: Synthetic oligonucleotide
tgagaaacggtttggcccttactacactgagc

SEQ ID NO: 124815 - DNA, 31 bp, Artificial Sequence
  Description of Artificial Sequence: Synthetic oligonucleotide
gagaaacggtttggcccttactacactgagc

SEQ ID NO: 124816 - DNA, 31 bp, Artificial Sequence
  Description of Artificial Sequence: Synthetic oligonucleotide
agaaacggtttggcccttactacactgagcc

SEQ ID NO: 124817 - DNA, 30 bp, Artificial Sequence
  Description of Artificial Sequence: Synthetic oligonucleotide
gaaacggtttggcccttactacactgagcc

SEQ ID NO: 124818 - DNA, 31 bp, Artificial Sequence
  Description of Artificial Sequence: Synthetic oligonucleotide
aaacggtttggcccttactacactgagccag

SEQ ID NO: 124819 - DNA, 30 bp, Artificial Sequence
  Description of Artificial Sequence: Synthetic oligonucleotide
aacggtttggcccttactacactgagccag

SEQ ID NO: 124820 - DNA, 29 bp, Artificial Sequence
  Description of Artificial Sequence: Synthetic oligonucleotide
acggtttggcccttactacactgagccag

SEQ ID NO: 124821 - DNA, 28 bp, Artificial Sequence
  Description of Artificial Sequence: Synthetic oligonucleotide
cggtttggcccttactacactgagccag

SEQ ID NO: 124822 - DNA, 29 bp, Artificial Sequence
  Description of Artificial Sequence: Synthetic oligonucleotide
ggtttggcccttactacactgagccagtc

SEQ ID NO: 124823 - DNA, 32 bp, Artificial Sequence
  Description of Artificial Sequence: Synthetic oligonucleotide
gtttggcccttactacactgagccagtcattg

SEQ ID NO: 124824 - DNA, 32 bp, Artificial Sequence
  Description of Artificial Sequence: Synthetic oligonucleotide
tttggcccttactacactgagccagtcattgc

SEQ ID NO: 124825 - DNA, 31 bp, Artificial Sequence
  Description of Artificial Sequence: Synthetic oligonucleotide
ttggcccttactacactgagccagtcattgc

SEQ ID NO: 124826 - DNA, 30 bp, Artificial Sequence
  Description of Artificial Sequence: Synthetic oligonucleotide
tggcccttactacactgagccagtcattgc

SEQ ID NO: 124827 - DNA, 29 bp, Artificial Sequence
  Description of Artificial Sequence: Synthetic oligonucleotide
ggcccttactacactgagccagtcattgc

SEQ ID NO: 124828 - DNA, 29 bp, Artificial Sequence
  Description of Artificial Sequence: Synthetic oligonucleotide
gcccttactacactgagccagtcattgcc

SEQ ID NO: 124829 - DNA, 29 bp, Artificial Sequence
  Description of Artificial Sequence: Synthetic oligonucleotide
cccttactacactgagccagtcattgccg

SEQ ID NO: 124830 - DNA, 29 bp, Artificial Sequence
  Description of Artificial Sequence: Synthetic oligonucleotide
ccttactacactgagccagtcattgccgg

SEQ ID NO: 124831 - DNA, 29 bp, Artificial Sequence
  Description of Artificial Sequence: Synthetic oligonucleotide
cttactacactgagccagtcattgccggg

SEQ ID NO: 124832 - DNA, 31 bp, Artificial Sequence
  Description of Artificial Sequence: Synthetic oligonucleotide
ttactacactgagccagtcattgccgggttg

SEQ ID NO: 124833 - DNA, 30 bp, Artificial Sequence
  Description of Artificial Sequence: Synthetic oligonucleotide
tactacactgagccagtcattgccgggttg

SEQ ID NO: 124834 - DNA, 29 bp, Artificial Sequence
  Description of Artificial Sequence: Synthetic oligonucleotide
actacactgagccagtcattgccgggttg

SEQ ID NO: 124835 - DNA, 28 bp, Artificial Sequence
  Description of Artificial Sequence: Synthetic oligonucleotide
ctacactgagccagtcattgccgggttg

SEQ ID NO: 124836 - DNA, 28 bp, Artificial Sequence
  Description of Artificial Sequence: Synthetic oligonucleotide
tacactgagccagtcattgccgggttgg

SEQ ID NO: 124837 - DNA, 27 bp, Artificial Sequence
  Description of Artificial Sequence: Synthetic oligonucleotide
acactgagccagtcattgccgggttgg

SEQ ID NO: 124838 - DNA, 27 bp, Artificial Sequence
  Description of Artificial Sequence: Synthetic oligonucleotide
cactgagccagtcattgccgggttgga

SEQ ID NO: 124839 - DNA, 27 bp, Artificial Sequence
  Description of Artificial Sequence: Synthetic oligonucleotide
actgagccagtcattgccgggttggac

SEQ ID NO: 124840 - DNA, 26 bp, Artificial Sequence
  Description of Artificial Sequence: Synthetic oligonucleotide
ctgagccagtcattgccgggttggac

SEQ ID NO: 124841 - DNA, 26 bp, Artificial Sequence
  Description of Artificial Sequence: Synthetic oligonucleotide
tgagccagtcattgccgggttggacc

SEQ ID NO: 124842 - DNA, 25 bp, Artificial Sequence
  Description of Artificial Sequence: Synthetic oligonucleotide
gagccagtcattgccgggttggacc

SEQ ID NO: 124843 - DNA, 25 bp, Artificial Sequence
  Description of Artificial Sequence: Synthetic oligonucleotide
agccagtcattgccgggttggaccc

SEQ ID NO: 124844 - DNA, 24 bp, Artificial Sequence
  Description of Artificial Sequence: Synthetic oligonucleotide
gccagtcattgccgggttggaccc

SEQ ID NO: 124845 - DNA, 26 bp, Artificial Sequence
  Description of Artificial Sequence: Synthetic oligonucleotide
ccagtcattgccgggttggacccgaa

SEQ ID NO: 124846 - DNA, 27 bp, Artificial Sequence
  Description of Artificial Sequence: Synthetic oligonucleotide
cagtcattgccgggttggacccgaaga

SEQ ID NO: 124847 - DNA, 27 bp, Artificial Sequence
  Description of Artificial Sequence: Synthetic oligonucleotide
agtcattgccgggttggacccgaagac

SEQ ID NO: 124848 - DNA, 26 bp, Artificial Sequence
  Description of Artificial Sequence: Synthetic oligonucleotide
gtcattgccgggttggacccgaagac

SEQ ID NO: 124849 - DNA, 27 bp, Artificial Sequence
  Description of Artificial Sequence: Synthetic oligonucleotide
tcattgccgggttggacccgaagacct

SEQ ID NO: 124850 - DNA, 27 bp, Artificial Sequence
  Description of Artificial Sequence: Synthetic oligonucleotide
cattgccgggttggacccgaagacctt

SEQ ID NO: 124851 - DNA, 30 bp, Artificial Sequence
  Description of Artificial Sequence: Synthetic oligonucleotide
attgccgggttggacccgaagacctttaag

SEQ ID NO: 124852 - DNA, 29 bp, Artificial Sequence
  Description of Artificial Sequence: Synthetic oligonucleotide
ttgccgggttggacccgaagacctttaag

SEQ ID NO: 124853 - DNA, 28 bp, Artificial Sequence
  Description of Artificial Sequence: Synthetic oligonucleotide
tgccgggttggacccgaagacctttaag

SEQ ID NO: 124854 - DNA, 27 bp, Artificial Sequence
  Description of Artificial Sequence: Synthetic oligonucleotide
gccgggttggacccgaagacctttaag

SEQ ID NO: 124855 - DNA, 27 bp, Artificial Sequence
  Description of Artificial Sequence: Synthetic oligonucleotide
ccgggttggacccgaagacctttaagc

SEQ ID NO: 124856 - DNA, 27 bp, Artificial Sequence
  Description of Artificial Sequence: Synthetic oligonucleotide
cgggttggacccgaagacctttaagcc

SEQ ID NO: 124857 - DNA, 27 bp, Artificial Sequence
  Description of Artificial Sequence: Synthetic oligonucleotide
gggttggacccgaagacctttaagccc

SEQ ID NO: 124858 - DNA, 29 bp, Artificial Sequence
  Description of Artificial Sequence: Synthetic oligonucleotide
ggttggacccgaagacctttaagcccttc

SEQ ID NO: 124859 - DNA, 33 bp, Artificial Sequence
  Description of Artificial Sequence: Synthetic oligonucleotide
gttggacccgaagacctttaagcccttcatttg

SEQ ID NO: 124860 - DNA, 33 bp, Artificial Sequence
  Description of Artificial Sequence: Synthetic oligonucleotide
ttggacccgaagacctttaagcccttcatttgc

SEQ ID NO: 124861 - DNA, 32 bp, Artificial Sequence
  Description of Artificial Sequence: Synthetic oligonucleotide
tggacccgaagacctttaagcccttcatttgc

SEQ ID NO: 124862 - DNA, 31 bp, Artificial Sequence
  Description of Artificial Sequence: Synthetic oligonucleotide
ggacccgaagacctttaagcccttcatttgc

SEQ ID NO: 124863 - DNA, 32 bp, Artificial Sequence
  Description of Artificial Sequence: Synthetic oligonucleotide
gacccgaagacctttaagcccttcatttgctc

SEQ ID NO: 124864 - DNA, 33 bp, Artificial Sequence
  Description of Artificial Sequence: Synthetic oligonucleotide
acccgaagacctttaagcccttcatttgctctc

SEQ ID NO: 124865 - DNA, 32 bp, Artificial Sequence
  Description of Artificial Sequence: Synthetic oligonucleotide
cccgaagacctttaagcccttcatttgctctc

SEQ ID NO: 124866 - DNA, 34 bp, Artificial Sequence
  Description of Artificial Sequence: Synthetic oligonucleotide
ccgaagacctttaagcccttcatttgctctctag

SEQ ID NO: 124867 - DNA, 35 bp, Artificial Sequence
  Description of Artificial Sequence: Synthetic oligonucleotide
cgaagacctttaagcccttcatttgctctctagac

SEQ ID NO: 124868 - DNA, 35 bp, Artificial Sequence
  Description of Artificial Sequence: Synthetic oligonucleotide
gaagacctttaagcccttcatttgctctctagacc

SEQ ID NO: 124869 - DNA, 36 bp, Artificial Sequence
  Description of Artificial Sequence: Synthetic oligonucleotide
aagacctttaagcccttcatttgctctctagacctc

SEQ ID NO: 124870 - DNA, 35 bp, Artificial Sequence
  Description of Artificial Sequence: Synthetic oligonucleotide
agacctttaagcccttcatttgctctctagacctc

SEQ ID NO: 124871 - DNA, 34 bp, Artificial Sequence
  Description of Artificial Sequence: Synthetic oligonucleotide
gacctttaagcccttcatttgctctctagacctc

SEQ ID NO: 124872 - DNA, 36 bp, Artificial Sequence
  Description of Artificial Sequence: Synthetic oligonucleotide
acctttaagcccttcatttgctctctagacctcatc

SEQ ID NO: 124873 - DNA, 35 bp, Artificial Sequence
  Description of Artificial Sequence: Synthetic oligonucleotide
cctttaagcccttcatttgctctctagacctcatc

SEQ ID NO: 124874 - DNA, 35 bp, Artificial Sequence
  Description of Artificial Sequence: Synthetic oligonucleotide
ctttaagcccttcatttgctctctagacctcatcg

SEQ ID NO: 124875 - DNA, 35 bp, Artificial Sequence
  Description of Artificial Sequence: Synthetic oligonucleotide
tttaagcccttcatttgctctctagacctcatcgg

SEQ ID NO: 124876 - DNA, 34 bp, Artificial Sequence
  Description of Artificial Sequence: Synthetic oligonucleotide
ttaagcccttcatttgctctctagacctcatcgg

SEQ ID NO: 124877 - DNA, 33 bp, Artificial Sequence
  Description of Artificial Sequence: Synthetic oligonucleotide
taagcccttcatttgctctctagacctcatcgg

SEQ ID NO: 124878 - DNA, 32 bp, Artificial Sequence
  Description of Artificial Sequence: Synthetic oligonucleotide
aagcccttcatttgctctctagacctcatcgg

SEQ ID NO: 124879 - DNA, 31 bp, Artificial Sequence
  Description of Artificial Sequence: Synthetic oligonucleotide
agcccttcatttgctctctagacctcatcgg

SEQ ID NO: 124880 - DNA, 30 bp, Artificial Sequence
  Description of Artificial Sequence: Synthetic oligonucleotide
gcccttcatttgctctctagacctcatcgg

SEQ ID NO: 124881 - DNA, 30 bp, Artificial Sequence
  Description of Artificial Sequence: Synthetic oligonucleotide
cccttcatttgctctctagacctcatcggc

SEQ ID NO: 124882 - DNA, 31 bp, Artificial Sequence
  Description of Artificial Sequence: Synthetic oligonucleotide
ccttcatttgctctctagacctcatcggctg

SEQ ID NO: 124883 - DNA, 31 bp, Artificial Sequence
  Description of Artificial Sequence: Synthetic oligonucleotide
cttcatttgctctctagacctcatcggctgc

SEQ ID NO: 124884 - DNA, 31 bp, Artificial Sequence
  Description of Artificial Sequence: Synthetic oligonucleotide
ttcatttgctctctagacctcatcggctgcc

SEQ ID NO: 124885 - DNA, 30 bp, Artificial Sequence
  Description of Artificial Sequence: Synthetic oligonucleotide
tcatttgctctctagacctcatcggctgcc

SEQ ID NO: 124886 - DNA, 29 bp, Artificial Sequence
  Description of Artificial Sequence: Synthetic oligonucleotide
catttgctctctagacctcatcggctgcc

SEQ ID NO: 124887 - DNA, 29 bp, Artificial Sequence
  Description of Artificial Sequence: Synthetic oligonucleotide
atttgctctctagacctcatcggctgccc

SEQ ID NO: 124888 - DNA, 28 bp, Artificial Sequence
  Description of Artificial Sequence: Synthetic oligonucleotide
tttgctctctagacctcatcggctgccc

SEQ ID NO: 124889 - DNA, 27 bp, Artificial Sequence
  Description of Artificial Sequence: Synthetic oligonucleotide
ttgctctctagacctcatcggctgccc

SEQ ID NO: 124890 - DNA, 26 bp, Artificial Sequence
  Description of Artificial Sequence: Synthetic oligonucleotide
tgctctctagacctcatcggctgccc

SEQ ID NO: 124891 - DNA, 25 bp, Artificial Sequence
  Description of Artificial Sequence: Synthetic oligonucleotide
gctctctagacctcatcggctgccc

SEQ ID NO: 124892 - DNA, 27 bp, Artificial Sequence
  Description of Artificial Sequence: Synthetic oligonucleotide
ctctctagacctcatcggctgccccat

SEQ ID NO: 124893 - DNA, 27 bp, Artificial Sequence
  Description of Artificial Sequence: Synthetic oligonucleotide
tctctagacctcatcggctgccccatg

SEQ ID NO: 124894 - DNA, 26 bp, Artificial Sequence
  Description of Artificial Sequence: Synthetic oligonucleotide
ctctagacctcatcggctgccccatg

SEQ ID NO: 124895 - DNA, 27 bp, Artificial Sequence
  Description of Artificial Sequence: Synthetic oligonucleotide
tctagacctcatcggctgccccatggt

SEQ ID NO: 124896 - DNA, 26 bp, Artificial Sequence
  Description of Artificial Sequence: Synthetic oligonucleotide
ctagacctcatcggctgccccatggt

SEQ ID NO: 124897 - DNA, 27 bp, Artificial Sequence
  Description of Artificial Sequence: Synthetic oligonucleotide
tagacctcatcggctgccccatggtga

SEQ ID NO: 124898 - DNA, 26 bp, Artificial Sequence
  Description of Artificial Sequence: Synthetic oligonucleotide
agacctcatcggctgccccatggtga

SEQ ID NO: 124899 - DNA, 25 bp, Artificial Sequence
  Description of Artificial Sequence: Synthetic oligonucleotide
gacctcatcggctgccccatggtga

SEQ ID NO: 124900 - DNA, 26 bp, Artificial Sequence
  Description of Artificial Sequence: Synthetic oligonucleotide
acctcatcggctgccccatggtgact

SEQ ID NO: 124901 - DNA, 25 bp, Artificial Sequence
  Description of Artificial Sequence: Synthetic oligonucleotide
cctcatcggctgccccatggtgact

SEQ ID NO: 124902 - DNA, 27 bp, Artificial Sequence
  Description of Artificial Sequence: Synthetic oligonucleotide
ctcatcggctgccccatggtgactgat

SEQ ID NO: 124903 - DNA, 27 bp, Artificial Sequence
  Description of Artificial Sequence: Synthetic oligonucleotide
tcatcggctgccccatggtgactgatg

SEQ ID NO: 124904 - DNA, 27 bp, Artificial Sequence
  Description of Artificial Sequence: Synthetic oligonucleotide
catcggctgccccatggtgactgatga

SEQ ID NO: 124905 - DNA, 27 bp, Artificial Sequence
  Description of Artificial Sequence: Synthetic oligonucleotide
atcggctgccccatggtgactgatgac

SEQ ID NO: 124906 - DNA, 27 bp, Artificial Sequence
  Description of Artificial Sequence: Synthetic oligonucleotide
tcggctgccccatggtgactgatgact

SEQ ID NO: 124907 - DNA, 27 bp, Artificial Sequence
  Description of Artificial Sequence: Synthetic oligonucleotide
cggctgccccatggtgactgatgactt

SEQ ID NO: 124908 - DNA, 28 bp, Artificial Sequence
  Description of Artificial Sequence: Synthetic oligonucleotide
ggctgccccatggtgactgatgactttg

SEQ ID NO: 124909 - DNA, 29 bp, Artificial Sequence
  Description of Artificial Sequence: Synthetic oligonucleotide
gctgccccatggtgactgatgactttgtg

SEQ ID NO: 124910 - DNA, 29 bp, Artificial Sequence
  Description of Artificial Sequence: Synthetic oligonucleotide
ctgccccatggtgactgatgactttgtgg

SEQ ID NO: 124911 - DNA, 30 bp, Artificial Sequence
  Description of Artificial Sequence: Synthetic oligonucleotide
tgccccatggtgactgatgactttgtggtc

SEQ ID NO: 124912 - DNA, 29 bp, Artificial Sequence
  Description of Artificial Sequence: Synthetic oligonucleotide
gccccatggtgactgatgactttgtggtc

SEQ ID NO: 124913 - DNA, 30 bp, Artificial Sequence
  Description of Artificial Sequence: Synthetic oligonucleotide
ccccatggtgactgatgactttgtggtcag

SEQ ID NO: 124914 - DNA, 31 bp, Artificial Sequence
  Description of Artificial Sequence: Synthetic oligonucleotide
cccatggtgactgatgactttgtggtcagtg

SEQ ID NO: 124915 - DNA, 31 bp, Artificial Sequence
  Description of Artificial Sequence: Synthetic oligonucleotide
ccatggtgactgatgactttgtggtcagtgg

SEQ ID NO: 124916 - DNA, 31 bp, Artificial Sequence
  Description of Artificial Sequence: Synthetic oligonucleotide
catggtgactgatgactttgtggtcagtggc

SEQ ID NO: 124917 - DNA, 32 bp, Artificial Sequence
  Description of Artificial Sequence: Synthetic oligonucleotide
atggtgactgatgactttgtggtcagtggcac

SEQ ID NO: 124918 - DNA, 31 bp, Artificial Sequence
  Description of Artificial Sequence: Synthetic oligonucleotide
tggtgactgatgactttgtggtcagtggcac

SEQ ID NO: 124919 - DNA, 30 bp, Artificial Sequence
  Description of Artificial Sequence: Synthetic oligonucleotide
ggtgactgatgactttgtggtcagtggcac

SEQ ID NO: 124920 - DNA, 30 bp, Artificial Sequence
  Description of Artificial Sequence: Synthetic oligonucleotide
gtgactgatgactttgtggtcagtggcacc

SEQ ID NO: 124921 - DNA, 31 bp, Artificial Sequence
  Description of Artificial Sequence: Synthetic oligonucleotide
tgactgatgactttgtggtcagtggcacctg

SEQ ID NO: 124922 - DNA, 30 bp, Artificial Sequence
  Description of Artificial Sequence: Synthetic oligonucleotide
gactgatgactttgtggtcagtggcacctg

SEQ ID NO: 124923 - DNA, 30 bp, Artificial Sequence
  Description of Artificial Sequence: Synthetic oligonucleotide
actgatgactttgtggtcagtggcacctgc

SEQ ID NO: 124924 - DNA, 29 bp, Artificial Sequence
  Description of Artificial Sequence: Synthetic oligonucleotide
ctgatgactttgtggtcagtggcacctgc

SEQ ID NO: 124925 - DNA, 29 bp, Artificial Sequence
  Description of Artificial Sequence: Synthetic oligonucleotide
tgatgactttgtggtcagtggcacctgcg

SEQ ID NO: 124926 - DNA, 28 bp, Artificial Sequence
  Description of Artificial Sequence: Synthetic oligonucleotide
gatgactttgtggtcagtggcacctgcg

SEQ ID NO: 124927 - DNA, 28 bp, Artificial Sequence
  Description of Artificial Sequence: Synthetic oligonucleotide
atgactttgtggtcagtggcacctgcgc

SEQ ID NO: 124928 - DNA, 27 bp, Artificial Sequence
  Description of Artificial Sequence: Synthetic oligonucleotide
tgactttgtggtcagtggcacctgcgc

SEQ ID NO: 124929 - DNA, 26 bp, Artificial Sequence
  Description of Artificial Sequence: Synthetic oligonucleotide
gactttgtggtcagtggcacctgcgc

SEQ ID NO: 124930 - DNA, 26 bp, Artificial Sequence
  Description of Artificial Sequence: Synthetic oligonucleotide
actttgtggtcagtggcacctgcgcc

SEQ ID NO: 124931 - DNA, 25 bp, Artificial Sequence
  Description of Artificial Sequence: Synthetic oligonucleotide
ctttgtggtcagtggcacctgcgcc

SEQ ID NO: 124932 - DNA, 27 bp, Artificial Sequence
  Description of Artificial Sequence: Synthetic oligonucleotide
tttgtggtcagtggcacctgcgccgaa

SEQ ID NO: 124933 - DNA, 26 bp, Artificial Sequence
  Description of Artificial Sequence: Synthetic oligonucleotide
ttgtggtcagtggcacctgcgccgaa

SEQ ID NO: 124934 - DNA, 25 bp, Artificial Sequence
  Description of Artificial Sequence: Synthetic oligonucleotide
tgtggtcagtggcacctgcgccgaa

SEQ ID NO: 124935 - DNA, 24 bp, Artificial Sequence
  Description of Artificial Sequence: Synthetic oligonucleotide
gtggtcagtggcacctgcgccgaa

SEQ ID NO: 124936 - DNA, 27 bp, Artificial Sequence
  Description of Artificial Sequence: Synthetic oligonucleotide
tggtcagtggcacctgcgccgaacaaa

SEQ ID NO: 124937 - DNA, 27 bp, Artificial Sequence
  Description of Artificial Sequence: Synthetic oligonucleotide
ggtcagtggcacctgcgccgaacaaat

SEQ ID NO: 124938 - DNA, 27 bp, Artificial Sequence
  Description of Artificial Sequence: Synthetic oligonucleotide
gtcagtggcacctgcgccgaacaaatg

SEQ ID NO: 124939 - DNA, 29 bp, Artificial Sequence
  Description of Artificial Sequence: Synthetic oligonucleotide
tcagtggcacctgcgccgaacaaatgtac

SEQ ID NO: 124940 - DNA, 28 bp, Artificial Sequence
  Description of Artificial Sequence: Synthetic oligonucleotide
cagtggcacctgcgccgaacaaatgtac

SEQ ID NO: 124941 - DNA, 28 bp, Artificial Sequence
  Description of Artificial Sequence: Synthetic oligonucleotide
agtggcacctgcgccgaacaaatgtacg

SEQ ID NO: 124942 - DNA, 27 bp, Artificial Sequence
  Description of Artificial Sequence: Synthetic oligonucleotide
gtggcacctgcgccgaacaaatgtacg

SEQ ID NO: 124943 - DNA, 27 bp, Artificial Sequence
  Description of Artificial Sequence: Synthetic oligonucleotide
tggcacctgcgccgaacaaatgtacgg

SEQ ID NO: 124944 - DNA, 27 bp, Artificial Sequence
  Description of Artificial Sequence: Synthetic oligonucleotide
ggcacctgcgccgaacaaatgtacgga

SEQ ID NO: 124945 - DNA, 29 bp, Artificial Sequence
  Description of Artificial Sequence: Synthetic oligonucleotide
gcacctgcgccgaacaaatgtacggaatg

SEQ ID NO: 124946 - DNA, 30 bp, Artificial Sequence
  Description of Artificial Sequence: Synthetic oligonucleotide
cacctgcgccgaacaaatgtacggaatgtg

SEQ ID NO: 124947 - DNA, 31 bp, Artificial Sequence
  Description of Artificial Sequence: Synthetic oligonucleotide
acctgcgccgaacaaatgtacggaatgtgtg

SEQ ID NO: 124948 - DNA, 30 bp, Artificial Sequence
  Description of Artificial Sequence: Synthetic oligonucleotide
cctgcgccgaacaaatgtacggaatgtgtg

SEQ ID NO: 124949 - DNA, 31 bp, Artificial Sequence
  Description of Artificial Sequence: Synthetic oligonucleotide
ctgcgccgaacaaatgtacggaatgtgtgag

SEQ ID NO: 124950 - DNA, 32 bp, Artificial Sequence
  Description of Artificial Sequence: Synthetic oligonucleotide
tgcgccgaacaaatgtacggaatgtgtgagtc

SEQ ID NO: 124951 - DNA, 31 bp, Artificial Sequence
  Description of Artificial Sequence: Synthetic oligonucleotide
gcgccgaacaaatgtacggaatgtgtgagtc

SEQ ID NO: 124952 - DNA, 31 bp, Artificial Sequence
  Description of Artificial Sequence: Synthetic oligonucleotide
cgccgaacaaatgtacggaatgtgtgagtcc

SEQ ID NO: 124953 - DNA, 31 bp, Artificial Sequence
  Description of Artificial Sequence: Synthetic oligonucleotide
gccgaacaaatgtacggaatgtgtgagtccc

SEQ ID NO: 124954 - DNA, 32 bp, Artificial Sequence
  Description of Artificial Sequence: Synthetic oligonucleotide
ccgaacaaatgtacggaatgtgtgagtccctc

SEQ ID NO: 124955 - DNA, 33 bp, Artificial Sequence
  Description of Artificial Sequence: Synthetic oligonucleotide
cgaacaaatgtacggaatgtgtgagtccctctg

SEQ ID NO: 124956 - DNA, 33 bp, Artificial Sequence
  Description of Artificial Sequence: Synthetic oligonucleotide
gaacaaatgtacggaatgtgtgagtccctctgg

SEQ ID NO: 124957 - DNA, 33 bp, Artificial Sequence
  Description of Artificial Sequence: Synthetic oligonucleotide
aacaaatgtacggaatgtgtgagtccctctggg

SEQ ID NO: 124958 - DNA, 32 bp, Artificial Sequence
  Description of Artificial Sequence: Synthetic oligonucleotide
acaaatgtacggaatgtgtgagtccctctggg

SEQ ID NO: 124959 - DNA, 31 bp, Artificial Sequence
  Description of Artificial Sequence: Synthetic oligonucleotide
caaatgtacggaatgtgtgagtccctctggg

SEQ ID NO: 124960 - DNA, 32 bp, Artificial Sequence
  Description of Artificial Sequence: Synthetic oligonucleotide
aaatgtacggaatgtgtgagtccctctgggag

SEQ ID NO: 124961 - DNA, 31 bp, Artificial Sequence
  Description of Artificial Sequence: Synthetic oligonucleotide
aatgtacggaatgtgtgagtccctctgggag

SEQ ID NO: 124962 - DNA, 30 bp, Artificial Sequence
  Description of Artificial Sequence: Synthetic oligonucleotide
atgtacggaatgtgtgagtccctctgggag

SEQ ID NO: 124963 - DNA, 29 bp, Artificial Sequence
  Description of Artificial Sequence: Synthetic oligonucleotide
tgtacggaatgtgtgagtccctctgggag

SEQ ID NO: 124964 - DNA, 28 bp, Artificial Sequence
  Description of Artificial Sequence: Synthetic oligonucleotide
gtacggaatgtgtgagtccctctgggag

SEQ ID NO: 124965 - DNA, 28 bp, Artificial Sequence
  Description of Artificial Sequence: Synthetic oligonucleotide
tacggaatgtgtgagtccctctgggagc

SEQ ID NO: 124966 - DNA, 27 bp, Artificial Sequence
  Description of Artificial Sequence: Synthetic oligonucleotide
acggaatgtgtgagtccctctgggagc

SEQ ID NO: 124967 - DNA, 26 bp, Artificial Sequence
  Description of Artificial Sequence: Synthetic oligonucleotide
cggaatgtgtgagtccctctgggagc

SEQ ID NO: 124968 - DNA, 26 bp, Artificial Sequence
  Description of Artificial Sequence: Synthetic oligonucleotide
ggaatgtgtgagtccctctgggagcc

SEQ ID NO: 124969 - DNA, 27 bp, Artificial Sequence
  Description of Artificial Sequence: Synthetic oligonucleotide
gaatgtgtgagtccctctgggagccca

SEQ ID NO: 124970 - DNA, 28 bp, Artificial Sequence
  Description of Artificial Sequence: Synthetic oligonucleotide
aatgtgtgagtccctctgggagcccaac

SEQ ID NO: 124971 - DNA, 27 bp, Artificial Sequence
  Description of Artificial Sequence: Synthetic oligonucleotide
atgtgtgagtccctctgggagcccaac

SEQ ID NO: 124972 - DNA, 27 bp, Artificial Sequence
  Description of Artificial Sequence: Synthetic oligonucleotide
tgtgtgagtccctctgggagcccaaca

SEQ ID NO: 124973 - DNA, 27 bp, Artificial Sequence
  Description of Artificial Sequence: Synthetic oligonucleotide
gtgtgagtccctctgggagcccaacat

SEQ ID NO: 124974 - DNA, 27 bp, Artificial Sequence
  Description of Artificial Sequence: Synthetic oligonucleotide
tgtgagtccctctgggagcccaacatg

SEQ ID NO: 124975 - DNA, 26 bp, Artificial Sequence
  Description of Artificial Sequence: Synthetic oligonucleotide
gtgagtccctctgggagcccaacatg

SEQ ID NO: 124976 - DNA, 27 bp, Artificial Sequence
  Description of Artificial Sequence: Synthetic oligonucleotide
tgagtccctctgggagcccaacatgga

SEQ ID NO: 124977 - DNA, 27 bp, Artificial Sequence
  Description of Artificial Sequence: Synthetic oligonucleotide
gagtccctctgggagcccaacatggat

SEQ ID NO: 124978 - DNA, 27 bp, Artificial Sequence
  Description of Artificial Sequence: Synthetic oligonucleotide
agtccctctgggagcccaacatggatc

SEQ ID NO: 124979 - DNA, 26 bp, Artificial Sequence
  Description of Artificial Sequence: Synthetic oligonucleotide
gtccctctgggagcccaacatggatc

SEQ ID NO: 124980 - DNA, 26 bp, Artificial Sequence
  Description of Artificial Sequence: Synthetic oligonucleotide
tccctctgggagcccaacatggatcc

SEQ ID NO: 124981 - DNA, 25 bp, Artificial Sequence
  Description of Artificial Sequence: Synthetic oligonucleotide
ccctctgggagcccaacatggatcc

SEQ ID NO: 124982 - DNA, 25 bp, Artificial Sequence
  Description of Artificial Sequence: Synthetic oligonucleotide
cctctgggagcccaacatggatccg

SEQ ID NO: 124983 - DNA, 27 bp, Artificial Sequence
  Description of Artificial Sequence: Synthetic oligonucleotide
ctctgggagcccaacatggatccggat

SEQ ID NO: 124984 - DNA, 27 bp, Artificial Sequence
  Description of Artificial Sequence: Synthetic oligonucleotide
tctgggagcccaacatggatccggatc

SEQ ID NO: 124985 - DNA, 27 bp, Artificial Sequence
  Description of Artificial Sequence: Synthetic oligonucleotide
ctgggagcccaacatggatccggatca

SEQ ID NO: 124986 - DNA, 27 bp, Artificial Sequence
  Description of Artificial Sequence: Synthetic oligonucleotide
tgggagcccaacatggatccggatcac

SEQ ID NO: 124987 - DNA, 26 bp, Artificial Sequence
  Description of Artificial Sequence: Synthetic oligonucleotide
gggagcccaacatggatccggatcac

SEQ ID NO: 124988 - DNA, 27 bp, Artificial Sequence
  Description of Artificial Sequence: Synthetic oligonucleotide
ggagcccaacatggatccggatcacct

SEQ ID NO: 124989 - DNA, 27 bp, Artificial Sequence
  Description of Artificial Sequence: Synthetic oligonucleotide
gagcccaacatggatccggatcacctg

SEQ ID NO: 124990 - DNA, 30 bp, Artificial Sequence
  Description of Artificial Sequence: Synthetic oligonucleotide
agcccaacatggatccggatcacctgtttg

SEQ ID NO: 124991 - DNA, 29 bp, Artificial Sequence
  Description of Artificial Sequence: Synthetic oligonucleotide
gcccaacatggatccggatcacctgtttg

SEQ ID NO: 124992 - DNA, 32 bp, Artificial Sequence
  Description of Artificial Sequence: Synthetic oligonucleotide
cccaacatggatccggatcacctgtttgaaac

SEQ ID NO: 124993 - DNA, 32 bp, Artificial Sequence
  Description of Artificial Sequence: Synthetic oligonucleotide
ccaacatggatccggatcacctgtttgaaacc

SEQ ID NO: 124994 - DNA, 34 bp, Artificial Sequence
  Description of Artificial Sequence: Synthetic oligonucleotide
caacatggatccggatcacctgtttgaaaccatc

SEQ ID NO: 124995 - DNA, 35 bp, Artificial Sequence
  Description of Artificial Sequence: Synthetic oligonucleotide
aacatggatccggatcacctgtttgaaaccatctc

SEQ ID NO: 124996 - DNA, 34 bp, Artificial Sequence
  Description of Artificial Sequence: Synthetic oligonucleotide
acatggatccggatcacctgtttgaaaccatctc

SEQ ID NO: 124997 - DNA, 33 bp, Artificial Sequence
  Description of Artificial Sequence: Synthetic oligonucleotide
catggatccggatcacctgtttgaaaccatctc

SEQ ID NO: 124998 - DNA, 33 bp, Artificial Sequence
  Description of Artificial Sequence: Synthetic oligonucleotide
atggatccggatcacctgtttgaaaccatctcc

SEQ ID NO: 124999 - DNA, 32 bp, Artificial Sequence
  Description of Artificial Sequence: Synthetic oligonucleotide
tggatccggatcacctgtttgaaaccatctcc

SEQ ID NO: 125000 - DNA, 31 bp, Artificial Sequence
  Description of Artificial Sequence: Synthetic oligonucleotide
ggatccggatcacctgtttgaaaccatctcc

SEQ ID NO: 125001 - DNA, 31 bp, Artificial Sequence
  Description of Artificial Sequence: Synthetic oligonucleotide
gatccggatcacctgtttgaaaccatctccc

SEQ ID NO: 125002 - DNA, 33 bp, Artificial Sequence
  Description of Artificial Sequence: Synthetic oligonucleotide
atccggatcacctgtttgaaaccatctcccaag

SEQ ID NO: 125003 - DNA, 32 bp, Artificial Sequence
  Description of Artificial Sequence: Synthetic oligonucleotide
tccggatcacctgtttgaaaccatctcccaag

SEQ ID NO: 125004 - DNA, 31 bp, Artificial Sequence
  Description of Artificial Sequence: Synthetic oligonucleotide
ccggatcacctgtttgaaaccatctcccaag

SEQ ID NO: 125005 - DNA, 31 bp, Artificial Sequence
  Description of Artificial Sequence: Synthetic oligonucleotide
cggatcacctgtttgaaaccatctcccaagc

SEQ ID NO: 125006 - DNA, 31 bp, Artificial Sequence
  Description of Artificial Sequence: Synthetic oligonucleotide
ggatcacctgtttgaaaccatctcccaagcc

SEQ ID NO: 125007 - DNA, 33 bp, Artificial Sequence
  Description of Artificial Sequence: Synthetic oligonucleotide
gatcacctgtttgaaaccatctcccaagccatg

SEQ ID NO: 125008 - DNA, 33 bp, Artificial Sequence
  Description of Artificial Sequence: Synthetic oligonucleotide
atcacctgtttgaaaccatctcccaagccatgc

SEQ ID NO: 125009 - DNA, 32 bp, Artificial Sequence
  Description of Artificial Sequence: Synthetic oligonucleotide
tcacctgtttgaaaccatctcccaagccatgc

SEQ ID NO: 125010 - DNA, 31 bp, Artificial Sequence
  Description of Artificial Sequence: Synthetic oligonucleotide
cacctgtttgaaaccatctcccaagccatgc

SEQ ID NO: 125011 - DNA, 32 bp, Artificial Sequence
  Description of Artificial Sequence: Synthetic oligonucleotide
acctgtttgaaaccatctcccaagccatgctg

SEQ ID NO: 125012 - DNA, 31 bp, Artificial Sequence
  Description of Artificial Sequence: Synthetic oligonucleotide
cctgtttgaaaccatctcccaagccatgctg

SEQ ID NO: 125013 - DNA, 34 bp, Artificial Sequence
  Description of Artificial Sequence: Synthetic oligonucleotide
ctgtttgaaaccatctcccaagccatgctgaatg

SEQ ID NO: 125014 - DNA, 34 bp, Artificial Sequence
  Description of Artificial Sequence: Synthetic oligonucleotide
tgtttgaaaccatctcccaagccatgctgaatgc

SEQ ID NO: 125015 - DNA, 33 bp, Artificial Sequence
  Description of Artificial Sequence: Synthetic oligonucleotide
gtttgaaaccatctcccaagccatgctgaatgc

SEQ ID NO: 125016 - DNA, 34 bp, Artificial Sequence
  Description of Artificial Sequence: Synthetic oligonucleotide
tttgaaaccatctcccaagccatgctgaatgctg

SEQ ID NO: 125017 - DNA, 33 bp, Artificial Sequence
  Description of Artificial Sequence: Synthetic oligonucleotide
ttgaaaccatctcccaagccatgctgaatgctg

SEQ ID NO: 125018 - DNA, 32 bp, Artificial Sequence
  Description of Artificial Sequence: Synthetic oligonucleotide
tgaaaccatctcccaagccatgctgaatgctg

SEQ ID NO: 125019 - DNA, 31 bp, Artificial Sequence
  Description of Artificial Sequence: Synthetic oligonucleotide
gaaaccatctcccaagccatgctgaatgctg

SEQ ID NO: 125020 - DNA, 32 bp, Artificial Sequence
  Description of Artificial Sequence: Synthetic oligonucleotide
aaaccatctcccaagccatgctgaatgctgtg

SEQ ID NO: 125021 - DNA, 31 bp, Artificial Sequence
  Description of Artificial Sequence: Synthetic oligonucleotide
aaccatctcccaagccatgctgaatgctgtg

SEQ ID NO: 125022 - DNA, 30 bp, Artificial Sequence
  Description of Artificial Sequence: Synthetic oligonucleotide
accatctcccaagccatgctgaatgctgtg

SEQ ID NO: 125023 - DNA, 29 bp, Artificial Sequence
  Description of Artificial Sequence: Synthetic oligonucleotide
ccatctcccaagccatgctgaatgctgtg

SEQ ID NO: 125024 - DNA, 29 bp, Artificial Sequence
  Description of Artificial Sequence: Synthetic oligonucleotide
catctcccaagccatgctgaatgctgtgg

SEQ ID NO: 125025 - DNA, 30 bp, Artificial Sequence
  Description of Artificial Sequence: Synthetic oligonucleotide
atctcccaagccatgctgaatgctgtggac

SEQ ID NO: 125026 - DNA, 29 bp, Artificial Sequence
  Description of Artificial Sequence: Synthetic oligonucleotide
tctcccaagccatgctgaatgctgtggac

SEQ ID NO: 125027 - DNA, 28 bp, Artificial Sequence
  Description of Artificial Sequence: Synthetic oligonucleotide
ctcccaagccatgctgaatgctgtggac

SEQ ID NO: 125028 - DNA, 28 bp, Artificial Sequence
  Description of Artificial Sequence: Synthetic oligonucleotide
tcccaagccatgctgaatgctgtggacc

SEQ ID NO: 125029 - DNA, 27 bp, Artificial Sequence
  Description of Artificial Sequence: Synthetic oligonucleotide
cccaagccatgctgaatgctgtggacc

SEQ ID NO: 125030 - DNA, 27 bp, Artificial Sequence
  Description of Artificial Sequence: Synthetic oligonucleotide
ccaagccatgctgaatgctgtggaccg

SEQ ID NO: 125031 - DNA, 27 bp, Artificial Sequence
  Description of Artificial Sequence: Synthetic oligonucleotide
caagccatgctgaatgctgtggaccgg

SEQ ID NO: 125032 - DNA, 27 bp, Artificial Sequence
  Description of Artificial Sequence: Synthetic oligonucleotide
aagccatgctgaatgctgtggaccggg

SEQ ID NO: 125033 - DNA, 27 bp, Artificial Sequence
  Description of Artificial Sequence: Synthetic oligonucleotide
agccatgctgaatgctgtggaccggga

SEQ ID NO: 125034 - DNA, 27 bp, Artificial Sequence
  Description of Artificial Sequence: Synthetic oligonucleotide
gccatgctgaatgctgtggaccgggat

SEQ ID NO: 125035 - DNA, 27 bp, Artificial Sequence
  Description of Artificial Sequence: Synthetic oligonucleotide
ccatgctgaatgctgtggaccgggatg

SEQ ID NO: 125036 - DNA, 27 bp, Artificial Sequence
  Description of Artificial Sequence: Synthetic oligonucleotide
catgctgaatgctgtggaccgggatgc

SEQ ID NO: 125037 - DNA, 28 bp, Artificial Sequence
  Description of Artificial Sequence: Synthetic oligonucleotide
atgctgaatgctgtggaccgggatgcag

SEQ ID NO: 125038 - DNA, 27 bp, Artificial Sequence
  Description of Artificial Sequence: Synthetic oligonucleotide
tgctgaatgctgtggaccgggatgcag

SEQ ID NO: 125039 - DNA, 27 bp, Artificial Sequence
  Description of Artificial Sequence: Synthetic oligonucleotide
gctgaatgctgtggaccgggatgcagt

SEQ ID NO: 125040 - DNA, 27 bp, Artificial Sequence
  Description of Artificial Sequence: Synthetic oligonucleotide
ctgaatgctgtggaccgggatgcagtg

SEQ ID NO: 125041 - DNA, 28 bp, Artificial Sequence
  Description of Artificial Sequence: Synthetic oligonucleotide
tgaatgctgtggaccgggatgcagtgtc

SEQ ID NO: 125042 - DNA, 27 bp, Artificial Sequence
  Description of Artificial Sequence: Synthetic oligonucleotide
gaatgctgtggaccgggatgcagtgtc

SEQ ID NO: 125043 - DNA, 28 bp, Artificial Sequence
  Description of Artificial Sequence: Synthetic oligonucleotide
aatgctgtggaccgggatgcagtgtcag

SEQ ID NO: 125044 - DNA, 27 bp, Artificial Sequence
  Description of Artificial Sequence: Synthetic oligonucleotide
atgctgtggaccgggatgcagtgtcag

SEQ ID NO: 125045 - DNA, 26 bp, Artificial Sequence
  Description of Artificial Sequence: Synthetic oligonucleotide
tgctgtggaccgggatgcagtgtcag

SEQ ID NO: 125046 - DNA, 25 bp, Artificial Sequence
  Description of Artificial Sequence: Synthetic oligonucleotide
gctgtggaccgggatgcagtgtcag

SEQ ID NO: 125047 - DNA, 25 bp, Artificial Sequence
  Description of Artificial Sequence: Synthetic oligonucleotide
ctgtggaccgggatgcagtgtcagg

SEQ ID NO: 125048 - DNA, 27 bp, Artificial Sequence
  Description of Artificial Sequence: Synthetic oligonucleotide
tgtggaccgggatgcagtgtcaggcat

SEQ ID NO: 125049 - DNA, 26 bp, Artificial Sequence
  Description of Artificial Sequence: Synthetic oligonucleotide
gtggaccgggatgcagtgtcaggcat

SEQ ID NO: 125050 - DNA, 26 bp, Artificial Sequence
  Description of Artificial Sequence: Synthetic oligonucleotide
tggaccgggatgcagtgtcaggcatg

SEQ ID NO: 125051 - DNA, 25 bp, Artificial Sequence
  Description of Artificial Sequence: Synthetic oligonucleotide
ggaccgggatgcagtgtcaggcatg

SEQ ID NO: 125052 - DNA, 25 bp, Artificial Sequence
  Description of Artificial Sequence: Synthetic oligonucleotide
gaccgggatgcagtgtcaggcatgg

SEQ ID NO: 125053 - DNA, 26 bp, Artificial Sequence
  Description of Artificial Sequence: Synthetic oligonucleotide
accgggatgcagtgtcaggcatggga

SEQ ID NO: 125054 - DNA, 25 bp, Artificial Sequence
  Description of Artificial Sequence: Synthetic oligonucleotide
ccgggatgcagtgtcaggcatggga

SEQ ID NO: 125055 - DNA, 26 bp, Artificial Sequence
  Description of Artificial Sequence: Synthetic oligonucleotide
cgggatgcagtgtcaggcatgggagt

SEQ ID NO: 125056 - DNA, 27 bp, Artificial Sequence
  Description of Artificial Sequence: Synthetic oligonucleotide
gggatgcagtgtcaggcatgggagtca

SEQ ID NO: 125057 - DNA, 29 bp, Artificial Sequence
  Description of Artificial Sequence: Synthetic oligonucleotide
ggatgcagtgtcaggcatgggagtcattg

SEQ ID NO: 125058 - DNA, 30 bp, Artificial Sequence
  Description of Artificial Sequence: Synthetic oligonucleotide
gatgcagtgtcaggcatgggagtcattgtc

SEQ ID NO: 125059 - DNA, 30 bp, Artificial Sequence
  Description of Artificial Sequence: Synthetic oligonucleotide
atgcagtgtcaggcatgggagtcattgtcc

SEQ ID NO: 125060 - DNA, 29 bp, Artificial Sequence
  Description of Artificial Sequence: Synthetic oligonucleotide
tgcagtgtcaggcatgggagtcattgtcc

SEQ ID NO: 125061 - DNA, 28 bp, Artificial Sequence
  Description of Artificial Sequence: Synthetic oligonucleotide
gcagtgtcaggcatgggagtcattgtcc

SEQ ID NO: 125062 - DNA, 29 bp, Artificial Sequence
  Description of Artificial Sequence: Synthetic oligonucleotide
cagtgtcaggcatgggagtcattgtccac

SEQ ID NO: 125063 - DNA, 31 bp, Artificial Sequence
  Description of Artificial Sequence: Synthetic oligonucleotide
agtgtcaggcatgggagtcattgtccacatc

SEQ ID NO: 125064 - DNA, 30 bp, Artificial Sequence
  Description of Artificial Sequence: Synthetic oligonucleotide
gtgtcaggcatgggagtcattgtccacatc

SEQ ID NO: 125065 - DNA, 32 bp, Artificial Sequence
  Description of Artificial Sequence: Synthetic oligonucleotide
tgtcaggcatgggagtcattgtccacatcatc

SEQ ID NO: 125066 - DNA, 31 bp, Artificial Sequence
  Description of Artificial Sequence: Synthetic oligonucleotide
gtcaggcatgggagtcattgtccacatcatc

SEQ ID NO: 125067 - DNA, 31 bp, Artificial Sequence
  Description of Artificial Sequence: Synthetic oligonucleotide
tcaggcatgggagtcattgtccacatcatcg

SEQ ID NO: 125068 - DNA, 30 bp, Artificial Sequence
  Description of Artificial Sequence: Synthetic oligonucleotide
caggcatgggagtcattgtccacatcatcg

SEQ ID NO: 125069 - DNA, 31 bp, Artificial Sequence
  Description of Artificial Sequence: Synthetic oligonucleotide
aggcatgggagtcattgtccacatcatcgag

SEQ ID NO: 125070 - DNA, 30 bp, Artificial Sequence
  Description of Artificial Sequence: Synthetic oligonucleotide
ggcatgggagtcattgtccacatcatcgag

SEQ ID NO: 125071 - DNA, 32 bp, Artificial Sequence
  Description of Artificial Sequence: Synthetic oligonucleotide
gcatgggagtcattgtccacatcatcgagaag

SEQ ID NO: 125072 - DNA, 32 bp, Artificial Sequence
  Description of Artificial Sequence: Synthetic oligonucleotide
catgggagtcattgtccacatcatcgagaagg

SEQ ID NO: 125073 - DNA, 33 bp, Artificial Sequence
  Description of Artificial Sequence: Synthetic oligonucleotide
atgggagtcattgtccacatcatcgagaaggac

SEQ ID NO: 125074 - DNA, 32 bp, Artificial Sequence
  Description of Artificial Sequence: Synthetic oligonucleotide
tgggagtcattgtccacatcatcgagaaggac

SEQ ID NO: 125075 - DNA, 31 bp, Artificial Sequence
  Description of Artificial Sequence: Synthetic oligonucleotide
gggagtcattgtccacatcatcgagaaggac

SEQ ID NO: 125076 - DNA, 36 bp, Artificial Sequence
  Description of Artificial Sequence: Synthetic oligonucleotide
ggagtcattgtccacatcatcgagaaggacaaaatc

SEQ ID NO: 125077 - DNA, 37 bp, Artificial Sequence
  Description of Artificial Sequence: Synthetic oligonucleotide
gagtcattgtccacatcatcgagaaggacaaaatcac

SEQ ID NO: 125078 - DNA, 37 bp, Artificial Sequence
  Description of Artificial Sequence: Synthetic oligonucleotide
agtcattgtccacatcatcgagaaggacaaaatcacc

SEQ ID NO: 125079 - DNA, 36 bp, Artificial Sequence
  Description of Artificial Sequence: Synthetic oligonucleotide
gtcattgtccacatcatcgagaaggacaaaatcacc

SEQ ID NO: 125080 - DNA, 37 bp, Artificial Sequence
  Description of Artificial Sequence: Synthetic oligonucleotide
tcattgtccacatcatcgagaaggacaaaatcaccac

SEQ ID NO: 125081 - DNA, 36 bp, Artificial Sequence
  Description of Artificial Sequence: Synthetic oligonucleotide
cattgtccacatcatcgagaaggacaaaatcaccac

SEQ ID NO: 125082 - DNA, 36 bp, Artificial Sequence
  Description of Artificial Sequence: Synthetic oligonucleotide
attgtccacatcatcgagaaggacaaaatcaccacc

SEQ ID NO: 125083 - DNA, 35 bp, Artificial Sequence
  Description of Artificial Sequence: Synthetic oligonucleotide
ttgtccacatcatcgagaaggacaaaatcaccacc

SEQ ID NO: 125084 - DNA, 34 bp, Artificial Sequence
  Description of Artificial Sequence: Synthetic oligonucleotide
tgtccacatcatcgagaaggacaaaatcaccacc

SEQ ID NO: 125085 - DNA, 33 bp, Artificial Sequence
  Description of Artificial Sequence: Synthetic oligonucleotide
gtccacatcatcgagaaggacaaaatcaccacc

SEQ ID NO: 125086 - DNA, 34 bp, Artificial Sequence
  Description of Artificial Sequence: Synthetic oligonucleotide
tccacatcatcgagaaggacaaaatcaccaccag

SEQ ID NO: 125087 - DNA, 33 bp, Artificial Sequence
  Description of Artificial Sequence: Synthetic oligonucleotide
ccacatcatcgagaaggacaaaatcaccaccag

SEQ ID NO: 125088 - DNA, 33 bp, Artificial Sequence
  Description of Artificial Sequence: Synthetic oligonucleotide
cacatcatcgagaaggacaaaatcaccaccagg

SEQ ID NO: 125089 - DNA, 34 bp, Artificial Sequence
  Description of Artificial Sequence: Synthetic oligonucleotide
acatcatcgagaaggacaaaatcaccaccaggac

SEQ ID NO: 125090 - DNA, 33 bp, Artificial Sequence
  Description of Artificial Sequence: Synthetic oligonucleotide
catcatcgagaaggacaaaatcaccaccaggac

SEQ ID NO: 125091 - DNA, 34 bp, Artificial Sequence
  Description of Artificial Sequence: Synthetic oligonucleotide
atcatcgagaaggacaaaatcaccaccaggacac

SEQ ID NO: 125092 - DNA, 33 bp, Artificial Sequence
  Description of Artificial Sequence: Synthetic oligonucleotide
tcatcgagaaggacaaaatcaccaccaggacac

SEQ ID NO: 125093 - DNA, 32 bp, Artificial Sequence
  Description of Artificial Sequence: Synthetic oligonucleotide
catcgagaaggacaaaatcaccaccaggacac

SEQ ID NO: 125094 - DNA, 33 bp, Artificial Sequence
  Description of Artificial Sequence: Synthetic oligonucleotide
atcgagaaggacaaaatcaccaccaggacactg

SEQ ID NO: 125095 - DNA, 32 bp, Artificial Sequence
  Description of Artificial Sequence: Synthetic oligonucleotide
tcgagaaggacaaaatcaccaccaggacactg

SEQ ID NO: 125096 - DNA, 31 bp, Artificial Sequence
  Description of Artificial Sequence: Synthetic oligonucleotide
cgagaaggacaaaatcaccaccaggacactg

SEQ ID NO: 125097 - DNA, 33 bp, Artificial Sequence
  Description of Artificial Sequence: Synthetic oligonucleotide
gagaaggacaaaatcaccaccaggacactgaag

SEQ ID NO: 125098 - DNA, 33 bp, Artificial Sequence
  Description of Artificial Sequence: Synthetic oligonucleotide
agaaggacaaaatcaccaccaggacactgaagg

SEQ ID NO: 125099 - DNA, 32 bp, Artificial Sequence
  Description of Artificial Sequence: Synthetic oligonucleotide
gaaggacaaaatcaccaccaggacactgaagg

SEQ ID NO: 125100 - DNA, 32 bp, Artificial Sequence
  Description of Artificial Sequence: Synthetic oligonucleotide
aaggacaaaatcaccaccaggacactgaaggc

SEQ ID NO: 125101 - DNA, 31 bp, Artificial Sequence
  Description of Artificial Sequence: Synthetic oligonucleotide
aggacaaaatcaccaccaggacactgaaggc

SEQ ID NO: 125102 - DNA, 30 bp, Artificial Sequence
  Description of Artificial Sequence: Synthetic oligonucleotide
ggacaaaatcaccaccaggacactgaaggc

SEQ ID NO: 125103 - DNA, 30 bp, Artificial Sequence
  Description of Artificial Sequence: Synthetic oligonucleotide
gacaaaatcaccaccaggacactgaaggcc

SEQ ID NO: 125104 - DNA, 30 bp, Artificial Sequence
  Description of Artificial Sequence: Synthetic oligonucleotide
acaaaatcaccaccaggacactgaaggccc

SEQ ID NO: 125105 - DNA, 29 bp, Artificial Sequence
  Description of Artificial Sequence: Synthetic oligonucleotide
caaaatcaccaccaggacactgaaggccc

SEQ ID NO: 125106 - DNA, 29 bp, Artificial Sequence
  Description of Artificial Sequence: Synthetic oligonucleotide
aaaatcaccaccaggacactgaaggcccg

SEQ ID NO: 125107 - DNA, 28 bp, Artificial Sequence
  Description of Artificial Sequence: Synthetic oligonucleotide
aaatcaccaccaggacactgaaggcccg

SEQ ID NO: 125108 - DNA, 27 bp, Artificial Sequence
  Description of Artificial Sequence: Synthetic oligonucleotide
aatcaccaccaggacactgaaggcccg

SEQ ID NO: 125109 - DNA, 27 bp, Artificial Sequence
  Description of Artificial Sequence: Synthetic oligonucleotide
atcaccaccaggacactgaaggcccga

SEQ ID NO: 125110 - DNA, 27 bp, Artificial Sequence
  Description of Artificial Sequence: Synthetic oligonucleotide
tcaccaccaggacactgaaggcccgaa

SEQ ID NO: 125111 - DNA, 27 bp, Artificial Sequence
  Description of Artificial Sequence: Synthetic oligonucleotide
caccaccaggacactgaaggcccgaat

SEQ ID NO: 125112 - DNA, 27 bp, Artificial Sequence
  Description of Artificial Sequence: Synthetic oligonucleotide
accaccaggacactgaaggcccgaatg

SEQ ID NO: 125113 - DNA, 26 bp, Artificial Sequence
  Description of Artificial Sequence: Synthetic oligonucleotide
ccaccaggacactgaaggcccgaatg

SEQ ID NO: 125114 - DNA, 27 bp, Artificial Sequence
  Description of Artificial Sequence: Synthetic oligonucleotide
caccaggacactgaaggcccgaatgga

SEQ ID NO: 125115 - DNA, 27 bp, Artificial Sequence
  Description of Artificial Sequence: Synthetic oligonucleotide
accaggacactgaaggcccgaatggac

SEQ ID NO: 125116 - DNA, 27 bp, Artificial Sequence
  Description of Artificial Sequence: Synthetic oligonucleotide
ccaggacactgaaggcccgaatggact

SEQ ID NO: 125117 - DNA, 27 bp, Artificial Sequence
  Description of Artificial Sequence: Synthetic oligonucleotide
atggaagcgtttttggggtcgcggtcc

SEQ ID NO: 125118 - DNA, 26 bp, Artificial Sequence
  Description of Artificial Sequence: Synthetic oligonucleotide
tggaagcgtttttggggtcgcggtcc

SEQ ID NO: 125119 - DNA, 25 bp, Artificial Sequence
  Description of Artificial Sequence: Synthetic oligonucleotide
ggaagcgtttttggggtcgcggtcc

SEQ ID NO: 125120 - DNA, 25 bp, Artificial Sequence
  Description of Artificial Sequence: Synthetic oligonucleotide
gaagcgtttttggggtcgcggtccg

SEQ ID NO: 125121 - DNA, 26 bp, Artificial Sequence
  Description of Artificial Sequence: Synthetic oligonucleotide
aagcgtttttggggtcgcggtccgga

SEQ ID NO: 125122 - DNA, 25 bp, Artificial Sequence
  Description of Artificial Sequence: Synthetic oligonucleotide
agcgtttttggggtcgcggtccgga

SEQ ID NO: 125123 - DNA, 24 bp, Artificial Sequence
  Description of Artificial Sequence: Synthetic oligonucleotide
gcgtttttggggtcgcggtccgga

SEQ ID NO: 125124 - DNA, 27 bp, Artificial Sequence
  Description of Artificial Sequence: Synthetic oligonucleotide
cgtttttggggtcgcggtccggacttt

SEQ ID NO: 125125 - DNA, 27 bp, Artificial Sequence
  Description of Artificial Sequence: Synthetic oligonucleotide
gtttttggggtcgcggtccggactttg

SEQ ID NO: 125126 - DNA, 27 bp, Artificial Sequence
  Description of Artificial Sequence: Synthetic oligonucleotide
tttttggggtcgcggtccggactttgg

SEQ ID NO: 125127 - DNA, 26 bp, Artificial Sequence
  Description of Artificial Sequence: Synthetic oligonucleotide
ttttggggtcgcggtccggactttgg

SEQ ID NO: 125128 - DNA, 25 bp, Artificial Sequence
  Description of Artificial Sequence: Synthetic oligonucleotide
tttggggtcgcggtccggactttgg

SEQ ID NO: 125129 - DNA, 24 bp, Artificial Sequence
  Description of Artificial Sequence: Synthetic oligonucleotide
ttggggtcgcggtccggactttgg

SEQ ID NO: 125130 - DNA, 23 bp, Artificial Sequence
  Description of Artificial Sequence: Synthetic oligonucleotide
tggggtcgcggtccggactttgg

SEQ ID NO: 125131 - DNA, 22 bp, Artificial Sequence
  Description of Artificial Sequence: Synthetic oligonucleotide
ggggtcgcggtccggactttgg

SEQ ID NO: 125132 - DNA, 22 bp, Artificial Sequence
  Description of Artificial Sequence: Synthetic oligonucleotide
gggtcgcggtccggactttggg

SEQ ID NO: 125133 - DNA, 22 bp, Artificial Sequence
  Description of Artificial Sequence: Synthetic oligonucleotide
ggtcgcggtccggactttgggc

SEQ ID NO: 125134 - DNA, 22 bp, Artificial Sequence
  Description of Artificial Sequence: Synthetic oligonucleotide
gtcgcggtccggactttgggcg

SEQ ID NO: 125135 - DNA, 22 bp, Artificial Sequence
  Description of Artificial Sequence: Synthetic oligonucleotide
tcgcggtccggactttgggcgg

SEQ ID NO: 125136 - DNA, 21 bp, Artificial Sequence
  Description of Artificial Sequence: Synthetic oligonucleotide
cgcggtccggactttgggcgg

SEQ ID NO: 125137 - DNA, 21 bp, Artificial Sequence
  Description of Artificial Sequence: Synthetic oligonucleotide
gcggtccggactttgggcggg

SEQ ID NO: 125138 - DNA, 21 bp, Artificial Sequence
  Description of Artificial Sequence: Synthetic oligonucleotide
cggtccggactttgggcgggg

SEQ ID NO: 125139 - DNA, 21 bp, Artificial Sequence
  Description of Artificial Sequence: Synthetic oligonucleotide
ggtccggactttgggcggggg

SEQ ID NO: 125140 - DNA, 22 bp, Artificial Sequence
  Description of Artificial Sequence: Synthetic oligonucleotide
gtccggactttgggcggggggt

SEQ ID NO: 125141 - DNA, 22 bp, Artificial Sequence
  Description of Artificial Sequence: Synthetic oligonucleotide
tccggactttgggcggggggtc

SEQ ID NO: 125142 - DNA, 21 bp, Artificial Sequence
  Description of Artificial Sequence: Synthetic oligonucleotide
ccggactttgggcggggggtc

SEQ ID NO: 125143 - DNA, 21 bp, Artificial Sequence
  Description of Artificial Sequence: Synthetic oligonucleotide
cggactttgggcggggggtcc

SEQ ID NO: 125144 - DNA, 21 bp, Artificial Sequence
  Description of Artificial Sequence: Synthetic oligonucleotide
ggactttgggcggggggtccg

SEQ ID NO: 125145 - DNA, 21 bp, Artificial Sequence
  Description of Artificial Sequence: Synthetic oligonucleotide
gactttgggcggggggtccgg

SEQ ID NO: 125146 - DNA, 21 bp, Artificial Sequence
  Description of Artificial Sequence: Synthetic oligonucleotide
actttgggcggggggtccggc

SEQ ID NO: 125147 - DNA, 20 bp, Artificial Sequence
  Description of Artificial Sequence: Synthetic oligonucleotide
ctttgggcggggggtccggc

SEQ ID NO: 125148 - DNA, 20 bp, Artificial Sequence
  Description of Artificial Sequence: Synthetic oligonucleotide
tttgggcggggggtccggcc

SEQ ID NO: 125149 - DNA, 20 bp, Artificial Sequence
  Description of Artificial Sequence: Synthetic oligonucleotide
ttgggcggggggtccggcct

SEQ ID NO: 125150 - DNA, 20 bp, Artificial Sequence
  Description of Artificial Sequence: Synthetic oligonucleotide
tgggcggggggtccggcctt

SEQ ID NO: 125151 - DNA, 20 bp, Artificial Sequence
  Description of Artificial Sequence: Synthetic oligonucleotide
gggcggggggtccggccttt

SEQ ID NO: 125152 - DNA, 20 bp, Artificial Sequence
  Description of Artificial Sequence: Synthetic oligonucleotide
ggcggggggtccggcccttt

SEQ ID NO: 125153 - DNA, 20 bp, Artificial Sequence
  Description of Artificial Sequence: Synthetic oligonucleotide
gcggggggtccggccccatt

SEQ ID NO: 125154 - DNA, 20 bp, Artificial Sequence
  Description of Artificial Sequence: Synthetic oligonucleotide
cggggggtccggccccagtt

SEQ ID NO: 125155 - DNA, 20 bp, Artificial Sequence
  Description of Artificial Sequence: Synthetic oligonucleotide
ggggggtccggccccaggat

SEQ ID NO: 125156 - DNA, 20 bp, Artificial Sequence
  Description of Artificial Sequence: Synthetic oligonucleotide
gggggtccggccccaggaca

SEQ ID NO: 125157 - DNA, 25 bp, Artificial Sequence
  Description of Artificial Sequence: Synthetic oligonucleotide
ggggtccggccccaggacagtttta

SEQ ID NO: 125158 - DNA, 25 bp, Artificial Sequence
  Description of Artificial Sequence: Synthetic oligonucleotide
gggtccggccccaggacagttttac

SEQ ID NO: 125159 - DNA, 25 bp, Artificial Sequence
  Description of Artificial Sequence: Synthetic oligonucleotide
ggtccggccccaggacagttttacc

SEQ ID NO: 125160 - DNA, 25 bp, Artificial Sequence
  Description of Artificial Sequence: Synthetic oligonucleotide
gtccggccccaggacagttttaccg

SEQ ID NO: 125161 - DNA, 27 bp, Artificial Sequence
  Description of Artificial Sequence: Synthetic oligonucleotide
tccggccccaggacagttttaccgcat

SEQ ID NO: 125162 - DNA, 27 bp, Artificial Sequence
  Description of Artificial Sequence: Synthetic oligonucleotide
ccggccccaggacagttttaccgcatt

SEQ ID NO: 125163 - DNA, 27 bp, Artificial Sequence
  Description of Artificial Sequence: Synthetic oligonucleotide
cggccccaggacagttttaccgcattc

SEQ ID NO: 125164 - DNA, 27 bp, Artificial Sequence
  Description of Artificial Sequence: Synthetic oligonucleotide
ggccccaggacagttttaccgcattcc

SEQ ID NO: 125165 - DNA, 27 bp, Artificial Sequence
  Description of Artificial Sequence: Synthetic oligonucleotide
gccccaggacagttttaccgcattccg

SEQ ID NO: 125166 - DNA, 28 bp, Artificial Sequence
  Description of Artificial Sequence: Synthetic oligonucleotide
ccccaggacagttttaccgcattccgtc

SEQ ID NO: 125167 - DNA, 28 bp, Artificial Sequence
  Description of Artificial Sequence: Synthetic oligonucleotide
cccaggacagttttaccgcattccgtcc

SEQ ID NO: 125168 - DNA, 29 bp, Artificial Sequence
  Description of Artificial Sequence: Synthetic oligonucleotide
ccaggacagttttaccgcattccgtccac

SEQ ID NO: 125169 - DNA, 30 bp, Artificial Sequence
  Description of Artificial Sequence: Synthetic oligonucleotide
caggacagttttaccgcattccgtccactc

SEQ ID NO: 125170 - DNA, 30 bp, Artificial Sequence
  Description of Artificial Sequence: Synthetic oligonucleotide
aggacagttttaccgcattccgtccactcc

SEQ ID NO: 125171 - DNA, 29 bp, Artificial Sequence
  Description of Artificial Sequence: Synthetic oligonucleotide
ggacagttttaccgcattccgtccactcc

SEQ ID NO: 125172 - DNA, 29 bp, Artificial Sequence
  Description of Artificial Sequence: Synthetic oligonucleotide
gacagttttaccgcattccgtccactccc

SEQ ID NO: 125173 - DNA, 29 bp, Artificial Sequence
  Description of Artificial Sequence: Synthetic oligonucleotide
acagttttaccgcattccgtccactcccg

SEQ ID NO: 125174 - DNA, 28 bp, Artificial Sequence
  Description of Artificial Sequence: Synthetic oligonucleotide
cagttttaccgcattccgtccactcccg

SEQ ID NO: 125175 - DNA, 31 bp, Artificial Sequence
  Description of Artificial Sequence: Synthetic oligonucleotide
agttttaccgcattccgtccactcccgattc

SEQ ID NO: 125176 - DNA, 30 bp, Artificial Sequence
  Description of Artificial Sequence: Synthetic oligonucleotide
gttttaccgcattccgtccactcccgattc

SEQ ID NO: 125177 - DNA, 30 bp, Artificial Sequence
  Description of Artificial Sequence: Synthetic oligonucleotide
ttttaccgcattccgtccactcccgattcc

SEQ ID NO: 125178 - DNA, 29 bp, Artificial Sequence
  Description of Artificial Sequence: Synthetic oligonucleotide
tttaccgcattccgtccactcccgattcc

SEQ ID NO: 125179 - DNA, 28 bp, Artificial Sequence
  Description of Artificial Sequence: Synthetic oligonucleotide
ttaccgcattccgtccactcccgattcc

SEQ ID NO: 125180 - DNA, 27 bp, Artificial Sequence
  Description of Artificial Sequence: Synthetic oligonucleotide
taccgcattccgtccactcccgattcc

SEQ ID NO: 125181 - DNA, 27 bp, Artificial Sequence
  Description of Artificial Sequence: Synthetic oligonucleotide
accgcattccgtccactcccgattcct

SEQ ID NO: 125182 - DNA, 27 bp, Artificial Sequence
  Description of Artificial Sequence: Synthetic oligonucleotide
ccgcattccgtccactcccgattcctt

SEQ ID NO: 125183 - DNA, 27 bp, Artificial Sequence
  Description of Artificial Sequence: Synthetic oligonucleotide
cgcattccgtccactcccgattccttc

SEQ ID NO: 125184 - DNA, 29 bp, Artificial Sequence
  Description of Artificial Sequence: Synthetic oligonucleotide
gcattccgtccactcccgattccttcatg

SEQ ID NO: 125185 - DNA, 29 bp, Artificial Sequence
  Description of Artificial Sequence: Synthetic oligonucleotide
cattccgtccactcccgattccttcatgg

SEQ ID NO: 125186 - DNA, 31 bp, Artificial Sequence
  Description of Artificial Sequence: Synthetic oligonucleotide
attccgtccactcccgattccttcatggatc

SEQ ID NO: 125187 - DNA, 30 bp, Artificial Sequence
  Description of Artificial Sequence: Synthetic oligonucleotide
ttccgtccactcccgattccttcatggatc

SEQ ID NO: 125188 - DNA, 29 bp, Artificial Sequence
  Description of Artificial Sequence: Synthetic oligonucleotide
tccgtccactcccgattccttcatggatc

SEQ ID NO: 125189 - DNA, 28 bp, Artificial Sequence
  Description of Artificial Sequence: Synthetic oligonucleotide
ccgtccactcccgattccttcatggatc

SEQ ID NO: 125190 - DNA, 28 bp, Artificial Sequence
  Description of Artificial Sequence: Synthetic oligonucleotide
cgtccactcccgattccttcatggatcc

SEQ ID NO: 125191 - DNA, 28 bp, Artificial Sequence
  Description of Artificial Sequence: Synthetic oligonucleotide
gtccactcccgattccttcatggatccg

SEQ ID NO: 125192 - DNA, 28 bp, Artificial Sequence
  Description of Artificial Sequence: Synthetic oligonucleotide
tccactcccgattccttcatggatccgg

SEQ ID NO: 125193 - DNA, 27 bp, Artificial Sequence
  Description of Artificial Sequence: Synthetic oligonucleotide
ccactcccgattccttcatggatccgg

SEQ ID NO: 125194 - DNA, 27 bp, Artificial Sequence
  Description of Artificial Sequence: Synthetic oligonucleotide
cactcccgattccttcatggatccggc

SEQ ID NO: 125195 - DNA, 27 bp, Artificial Sequence
  Description of Artificial Sequence: Synthetic oligonucleotide
actcccgattccttcatggatccggcg

SEQ ID NO: 125196 - DNA, 27 bp, Artificial Sequence
  Description of Artificial Sequence: Synthetic oligonucleotide
ctcccgattccttcatggatccggcgt

SEQ ID NO: 125197 - DNA, 27 bp, Artificial Sequence
  Description of Artificial Sequence: Synthetic oligonucleotide
tcccgattccttcatggatccggcgtc

SEQ ID NO: 125198 - DNA, 27 bp, Artificial Sequence
  Description of Artificial Sequence: Synthetic oligonucleotide
cccgattccttcatggatccggcgtct

SEQ ID NO: 125199 - DNA, 27 bp, Artificial Sequence
  Description of Artificial Sequence: Synthetic oligonucleotide
ccgattccttcatggatccggcgtctg

SEQ ID NO: 125200 - DNA, 27 bp, Artificial Sequence
  Description of Artificial Sequence: Synthetic oligonucleotide
cgattccttcatggatccggcgtctgc

SEQ ID NO: 125201 - DNA, 28 bp, Artificial Sequence
  Description of Artificial Sequence: Synthetic oligonucleotide
gattccttcatggatccggcgtctgcac

SEQ ID NO: 125202 - DNA, 32 bp, Artificial Sequence
  Description of Artificial Sequence: Synthetic oligonucleotide
attccttcatggatccggcgtctgcactttac

SEQ ID NO: 125203 - DNA, 31 bp, Artificial Sequence
  Description of Artificial Sequence: Synthetic oligonucleotide
ttccttcatggatccggcgtctgcactttac

SEQ ID NO: 125204 - DNA, 30 bp, Artificial Sequence
  Description of Artificial Sequence: Synthetic oligonucleotide
tccttcatggatccggcgtctgcactttac

SEQ ID NO: 125205 - DNA, 29 bp, Artificial Sequence
  Description of Artificial Sequence: Synthetic oligonucleotide
ccttcatggatccggcgtctgcactttac

SEQ ID NO: 125206 - DNA, 30 bp, Artificial Sequence
  Description of Artificial Sequence: Synthetic oligonucleotide
cttcatggatccggcgtctgcactttacag

SEQ ID NO: 125207 - DNA, 31 bp, Artificial Sequence
  Description of Artificial Sequence: Synthetic oligonucleotide
ttcatggatccggcgtctgcactttacagag

SEQ ID NO: 125208 - DNA, 30 bp, Artificial Sequence
  Description of Artificial Sequence: Synthetic oligonucleotide
tcatggatccggcgtctgcactttacagag

SEQ ID NO: 125209 - DNA, 29 bp, Artificial Sequence
  Description of Artificial Sequence: Synthetic oligonucleotide
catggatccggcgtctgcactttacagag

SEQ ID NO: 125210 - DNA, 29 bp, Artificial Sequence
  Description of Artificial Sequence: Synthetic oligonucleotide
atggatccggcgtctgcactttacagagg

SEQ ID NO: 125211 - DNA, 28 bp, Artificial Sequence
  Description of Artificial Sequence: Synthetic oligonucleotide
tggatccggcgtctgcactttacagagg

SEQ ID NO: 125212 - DNA, 27 bp, Artificial Sequence
  Description of Artificial Sequence: Synthetic oligonucleotide
ggatccggcgtctgcactttacagagg

SEQ ID NO: 125213 - DNA, 28 bp, Artificial Sequence
  Description of Artificial Sequence: Synthetic oligonucleotide
gatccggcgtctgcactttacagaggtc

SEQ ID NO: 125214 - DNA, 28 bp, Artificial Sequence
  Description of Artificial Sequence: Synthetic oligonucleotide
atccggcgtctgcactttacagaggtcc

SEQ ID NO: 125215 - DNA, 27 bp, Artificial Sequence
  Description of Artificial Sequence: Synthetic oligonucleotide
tccggcgtctgcactttacagaggtcc

SEQ ID NO: 125216 - DNA, 27 bp, Artificial Sequence
  Description of Artificial Sequence: Synthetic oligonucleotide
ccggcgtctgcactttacagaggtcca

SEQ ID NO: 125217 - DNA, 29 bp, Artificial Sequence
  Description of Artificial Sequence: Synthetic oligonucleotide
cggcgtctgcactttacagaggtccaatc

SEQ ID NO: 125218 - DNA, 30 bp, Artificial Sequence
  Description of Artificial Sequence: Synthetic oligonucleotide
ggcgtctgcactttacagaggtccaatcac

SEQ ID NO: 125219 - DNA, 30 bp, Artificial Sequence
  Description of Artificial Sequence: Synthetic oligonucleotide
gcgtctgcactttacagaggtccaatcacg

SEQ ID NO: 125220 - DNA, 30 bp, Artificial Sequence
  Description of Artificial Sequence: Synthetic oligonucleotide
cgtctgcactttacagaggtccaatcacgc

SEQ ID NO: 125221 - DNA, 30 bp, Artificial Sequence
  Description of Artificial Sequence: Synthetic oligonucleotide
gtctgcactttacagaggtccaatcacgcg

SEQ ID NO: 125222 - DNA, 30 bp, Artificial Sequence
  Description of Artificial Sequence: Synthetic oligonucleotide
tctgcactttacagaggtccaatcacgcgg

SEQ ID NO: 125223 - DNA, 29 bp, Artificial Sequence
  Description of Artificial Sequence: Synthetic oligonucleotide
ctgcactttacagaggtccaatcacgcgg

SEQ ID NO: 125224 - DNA, 30 bp, Artificial Sequence
  Description of Artificial Sequence: Synthetic oligonucleotide
tgcactttacagaggtccaatcacgcggac

SEQ ID NO: 125225 - DNA, 29 bp, Artificial Sequence
  Description of Artificial Sequence: Synthetic oligonucleotide
gcactttacagaggtccaatcacgcggac

SEQ ID NO: 125226 - DNA, 29 bp, Artificial Sequence
  Description of Artificial Sequence: Synthetic oligonucleotide
cactttacagaggtccaatcacgcggacc

SEQ ID NO: 125227 - DNA, 29 bp, Artificial Sequence
  Description of Artificial Sequence: Synthetic oligonucleotide
actttacagaggtccaatcacgcggaccc

SEQ ID NO: 125228 - DNA, 28 bp, Artificial Sequence
  Description of Artificial Sequence: Synthetic oligonucleotide
ctttacagaggtccaatcacgcggaccc

SEQ ID NO: 125229 - DNA, 29 bp, Artificial Sequence
  Description of Artificial Sequence: Synthetic oligonucleotide
tttacagaggtccaatcacgcggacccag

SEQ ID NO: 125230 - DNA, 28 bp, Artificial Sequence
  Description of Artificial Sequence: Synthetic oligonucleotide
ttacagaggtccaatcacgcggacccag

SEQ ID NO: 125231 - DNA, 27 bp, Artificial Sequence
  Description of Artificial Sequence: Synthetic oligonucleotide
tacagaggtccaatcacgcggacccag

SEQ ID NO: 125232 - DNA, 27 bp, Artificial Sequence
  Description of Artificial Sequence: Synthetic oligonucleotide
acagaggtccaatcacgcggacccaga

SEQ ID NO: 125233 - DNA, 27 bp, Artificial Sequence
  Description of Artificial Sequence: Synthetic oligonucleotide
cagaggtccaatcacgcggacccagaa

SEQ ID NO: 125234 - DNA, 27 bp, Artificial Sequence
  Description of Artificial Sequence: Synthetic oligonucleotide
agaggtccaatcacgcggacccagaac

SEQ ID NO: 125235 - DNA, 26 bp, Artificial Sequence
  Description of Artificial Sequence: Synthetic oligonucleotide
gaggtccaatcacgcggacccagaac

SEQ ID NO: 125236 - DNA, 26 bp, Artificial Sequence
  Description of Artificial Sequence: Synthetic oligonucleotide
aggtccaatcacgcggacccagaacc

SEQ ID NO: 125237 - DNA, 25 bp, Artificial Sequence
  Description of Artificial Sequence: Synthetic oligonucleotide
ggtccaatcacgcggacccagaacc

SEQ ID NO: 125238 - DNA, 25 bp, Artificial Sequence
  Description of Artificial Sequence: Synthetic oligonucleotide
gtccaatcacgcggacccagaaccc

SEQ ID NO: 125239 - DNA, 27 bp, Artificial Sequence
  Description of Artificial Sequence: Synthetic oligonucleotide
tccaatcacgcggacccagaaccccat

SEQ ID NO: 125240 - DNA, 26 bp, Artificial Sequence
  Description of Artificial Sequence: Synthetic oligonucleotide
ccaatcacgcggacccagaaccccat

SEQ ID NO: 125241 - DNA, 26 bp, Artificial Sequence
  Description of Artificial Sequence: Synthetic oligonucleotide
caatcacgcggacccagaaccccatg

SEQ ID NO: 125242 - DNA, 27 bp, Artificial Sequence
  Description of Artificial Sequence: Synthetic oligonucleotide
aatcacgcggacccagaaccccatggt

SEQ ID NO: 125243 - DNA, 26 bp, Artificial Sequence
  Description of Artificial Sequence: Synthetic oligonucleotide
atcacgcggacccagaaccccatggt

SEQ ID NO: 125244 - DNA, 25 bp, Artificial Sequence
  Description of Artificial Sequence: Synthetic oligonucleotide
tcacgcggacccagaaccccatggt

SEQ ID NO: 125245 - DNA, 24 bp, Artificial Sequence
  Description of Artificial Sequence: Synthetic oligonucleotide
cacgcggacccagaaccccatggt

SEQ ID NO: 125246 - DNA, 25 bp, Artificial Sequence
  Description of Artificial Sequence: Synthetic oligonucleotide
acgcggacccagaaccccatggtga

SEQ ID NO: 125247 - DNA, 24 bp, Artificial Sequence
  Description of Artificial Sequence: Synthetic oligonucleotide
cgcggacccagaaccccatggtga

SEQ ID NO: 125248 - DNA, 24 bp, Artificial Sequence
  Description of Artificial Sequence: Synthetic oligonucleotide
gcggacccagaaccccatggtgac

SEQ ID NO: 125249 - DNA, 24 bp, Artificial Sequence
  Description of Artificial Sequence: Synthetic oligonucleotide
cggacccagaaccccatggtgacc

SEQ ID NO: 125250 - DNA, 24 bp, Artificial Sequence
  Description of Artificial Sequence: Synthetic oligonucleotide
ggacccagaaccccatggtgaccg

SEQ ID NO: 125251 - DNA, 24 bp, Artificial Sequence
  Description of Artificial Sequence: Synthetic oligonucleotide
gacccagaaccccatggtgaccgg

SEQ ID NO: 125252 - DNA, 25 bp, Artificial Sequence
  Description of Artificial Sequence: Synthetic oligonucleotide
acccagaaccccatggtgaccggga

SEQ ID NO: 125253 - DNA, 24 bp, Artificial Sequence
  Description of Artificial Sequence: Synthetic oligonucleotide
cccagaaccccatggtgaccggga

SEQ ID NO: 125254 - DNA, 24 bp, Artificial Sequence
  Description of Artificial Sequence: Synthetic oligonucleotide
ccagaaccccatggtgaccgggac

SEQ ID NO: 125255 - DNA, 25 bp, Artificial Sequence
  Description of Artificial Sequence: Synthetic oligonucleotide
cagaaccccatggtgaccgggacct

SEQ ID NO: 125256 - DNA, 26 bp, Artificial Sequence
  Description of Artificial Sequence: Synthetic oligonucleotide
agaaccccatggtgaccgggacctca

SEQ ID NO: 125257 - DNA, 25 bp, Artificial Sequence
  Description of Artificial Sequence: Synthetic oligonucleotide
gaaccccatggtgaccgggacctca

SEQ ID NO: 125258 - DNA, 26 bp, Artificial Sequence
  Description of Artificial Sequence: Synthetic oligonucleotide
aaccccatggtgaccgggacctcagt

SEQ ID NO: 125259 - DNA, 25 bp, Artificial Sequence
  Description of Artificial Sequence: Synthetic oligonucleotide
accccatggtgaccgggacctcagt

SEQ ID NO: 125260 - DNA, 24 bp, Artificial Sequence
  Description of Artificial Sequence: Synthetic oligonucleotide
ccccatggtgaccgggacctcagt

SEQ ID NO: 125261 - DNA, 24 bp, Artificial Sequence
  Description of Artificial Sequence: Synthetic oligonucleotide
cccatggtgaccgggacctcagtc

SEQ ID NO: 125262 - DNA, 25 bp, Artificial Sequence
  Description of Artificial Sequence: Synthetic oligonucleotide
ccatggtgaccgggacctcagtcct

SEQ ID NO: 125263 - DNA, 25 bp, Artificial Sequence
  Description of Artificial Sequence: Synthetic oligonucleotide
catggtgaccgggacctcagtcctc

SEQ ID NO: 125264 - DNA, 25 bp, Artificial Sequence
  Description of Artificial Sequence: Synthetic oligonucleotide
atggtgaccgggacctcagtcctcg

SEQ ID NO: 125265 - DNA, 24 bp, Artificial Sequence
  Description of Artificial Sequence: Synthetic oligonucleotide
tggtgaccgggacctcagtcctcg

SEQ ID NO: 125266 - DNA, 23 bp, Artificial Sequence
  Description of Artificial Sequence: Synthetic oligonucleotide
ggtgaccgggacctcagtcctcg

SEQ ID NO: 125267 - DNA, 23 bp, Artificial Sequence
  Description of Artificial Sequence: Synthetic oligonucleotide
gtgaccgggacctcagtcctcgg

SEQ ID NO: 125268 - DNA, 23 bp, Artificial Sequence
  Description of Artificial Sequence: Synthetic oligonucleotide
tgaccgggacctcagtcctcggc

SEQ ID NO: 125269 - DNA, 22 bp, Artificial Sequence
  Description of Artificial Sequence: Synthetic oligonucleotide
gaccgggacctcagtcctcggc

SEQ ID NO: 125270 - DNA, 26 bp, Artificial Sequence
  Description of Artificial Sequence: Synthetic oligonucleotide
accgggacctcagtcctcggcgttaa

SEQ ID NO: 125271 - DNA, 25 bp, Artificial Sequence
  Description of Artificial Sequence: Synthetic oligonucleotide
ccgggacctcagtcctcggcgttaa

SEQ ID NO: 125272 - DNA, 27 bp, Artificial Sequence
  Description of Artificial Sequence: Synthetic oligonucleotide
cgggacctcagtcctcggcgttaagtt

SEQ ID NO: 125273 - DNA, 27 bp, Artificial Sequence
  Description of Artificial Sequence: Synthetic oligonucleotide
gggacctcagtcctcggcgttaagttc

SEQ ID NO: 125274 - DNA, 27 bp, Artificial Sequence
  Description of Artificial Sequence: Synthetic oligonucleotide
ggacctcagtcctcggcgttaagttcg

SEQ ID NO: 125275 - DNA, 28 bp, Artificial Sequence
  Description of Artificial Sequence: Synthetic oligonucleotide
gacctcagtcctcggcgttaagttcgag

SEQ ID NO: 125276 - DNA, 28 bp, Artificial Sequence
  Description of Artificial Sequence: Synthetic oligonucleotide
acctcagtcctcggcgttaagttcgagg

SEQ ID NO: 125277 - DNA, 27 bp, Artificial Sequence
  Description of Artificial Sequence: Synthetic oligonucleotide
cctcagtcctcggcgttaagttcgagg

SEQ ID NO: 125278 - DNA, 27 bp, Artificial Sequence
  Description of Artificial Sequence: Synthetic oligonucleotide
ctcagtcctcggcgttaagttcgaggg

SEQ ID NO: 125279 - DNA, 27 bp, Artificial Sequence
  Description of Artificial Sequence: Synthetic oligonucleotide
tcagtcctcggcgttaagttcgagggc

SEQ ID NO: 125280 - DNA, 26 bp, Artificial Sequence
  Description of Artificial Sequence: Synthetic oligonucleotide
cagtcctcggcgttaagttcgagggc

SEQ ID NO: 125281 - DNA, 26 bp, Artificial Sequence
  Description of Artificial Sequence: Synthetic oligonucleotide
agtcctcggcgttaagttcgagggcg

SEQ ID NO: 125282 - DNA, 25 bp, Artificial Sequence
  Description of Artificial Sequence: Synthetic oligonucleotide
gtcctcggcgttaagttcgagggcg

SEQ ID NO: 125283 - DNA, 26 bp, Artificial Sequence
  Description of Artificial Sequence: Synthetic oligonucleotide
tcctcggcgttaagttcgagggcgga

SEQ ID NO: 125284 - DNA, 25 bp, Artificial Sequence
  Description of Artificial Sequence: Synthetic oligonucleotide
cctcggcgttaagttcgagggcgga

SEQ ID NO: 125285 - DNA, 26 bp, Artificial Sequence
  Description of Artificial Sequence: Synthetic oligonucleotide
ctcggcgttaagttcgagggcggagt

SEQ ID NO: 125286 - DNA, 26 bp, Artificial Sequence
  Description of Artificial Sequence: Synthetic oligonucleotide
tcggcgttaagttcgagggcggagtg

SEQ ID NO: 125287 - DNA, 25 bp, Artificial Sequence
  Description of Artificial Sequence: Synthetic oligonucleotide
cggcgttaagttcgagggcggagtg

SEQ ID NO: 125288 - DNA, 26 bp, Artificial Sequence
  Description of Artificial Sequence: Synthetic oligonucleotide
ggcgttaagttcgagggcggagtggt

SEQ ID NO: 125289 - DNA, 27 bp, Artificial Sequence
  Description of Artificial Sequence: Synthetic oligonucleotide
gcgttaagttcgagggcggagtggtga

SEQ ID NO: 125290 - DNA, 29 bp, Artificial Sequence
  Description of Artificial Sequence: Synthetic oligonucleotide
cgttaagttcgagggcggagtggtgattg

SEQ ID NO: 125291 - DNA, 29 bp, Artificial Sequence
  Description of Artificial Sequence: Synthetic oligonucleotide
gttaagttcgagggcggagtggtgattgc

SEQ ID NO: 125292 - DNA, 29 bp, Artificial Sequence
  Description of Artificial Sequence: Synthetic oligonucleotide
ttaagttcgagggcggagtggtgattgcc

SEQ ID NO: 125293 - DNA, 28 bp, Artificial Sequence
  Description of Artificial Sequence: Synthetic oligonucleotide
taagttcgagggcggagtggtgattgcc

SEQ ID NO: 125294 - DNA, 27 bp, Artificial Sequence
  Description of Artificial Sequence: Synthetic oligonucleotide
aagttcgagggcggagtggtgattgcc

SEQ ID NO: 125295 - DNA, 26 bp, Artificial Sequence
  Description of Artificial Sequence: Synthetic oligonucleotide
agttcgagggcggagtggtgattgcc

SEQ ID NO: 125296 - DNA, 25 bp, Artificial Sequence
  Description of Artificial Sequence: Synthetic oligonucleotide
gttcgagggcggagtggtgattgcc

SEQ ID NO: 125297 - DNA, 25 bp, Artificial Sequence
  Description of Artificial Sequence: Synthetic oligonucleotide
ttcgagggcggagtggtgattgccg

SEQ ID NO: 125298 - DNA, 24 bp, Artificial Sequence
  Description of Artificial Sequence: Synthetic oligonucleotide
tcgagggcggagtggtgattgccg

SEQ ID NO: 125299 - DNA, 23 bp, Artificial Sequence
  Description of Artificial Sequence: Synthetic oligonucleotide
cgagggcggagtggtgattgccg

SEQ ID NO: 125300 - DNA, 24 bp, Artificial Sequence
  Description of Artificial Sequence: Synthetic oligonucleotide
gagggcggagtggtgattgccgca

SEQ ID NO: 125301 - DNA, 25 bp, Artificial Sequence
  Description of Artificial Sequence: Synthetic oligonucleotide
agggcggagtggtgattgccgcaga

SEQ ID NO: 125302 - DNA, 24 bp, Artificial Sequence
  Description of Artificial Sequence: Synthetic oligonucleotide
gggcggagtggtgattgccgcaga

SEQ ID NO: 125303 - DNA, 26 bp, Artificial Sequence
  Description of Artificial Sequence: Synthetic oligonucleotide
ggcggagtggtgattgccgcagacat

SEQ ID NO: 125304 - DNA, 26 bp, Artificial Sequence
  Description of Artificial Sequence: Synthetic oligonucleotide
gcggagtggtgattgccgcagacatg

SEQ ID NO: 125305 - DNA, 27 bp, Artificial Sequence
  Description of Artificial Sequence: Synthetic oligonucleotide
cggagtggtgattgccgcagacatgct

SEQ ID NO: 125306 - DNA, 27 bp, Artificial Sequence
  Description of Artificial Sequence: Synthetic oligonucleotide
ggagtggtgattgccgcagacatgctg

SEQ ID NO: 125307 - DNA, 27 bp, Artificial Sequence
  Description of Artificial Sequence: Synthetic oligonucleotide
gagtggtgattgccgcagacatgctgg

SEQ ID NO: 125308 - DNA, 27 bp, Artificial Sequence
  Description of Artificial Sequence: Synthetic oligonucleotide
agtggtgattgccgcagacatgctggg

SEQ ID NO: 125309 - DNA, 27 bp, Artificial Sequence
  Description of Artificial Sequence: Synthetic oligonucleotide
gtggtgattgccgcagacatgctggga

SEQ ID NO: 125310 - DNA, 28 bp, Artificial Sequence
  Description of Artificial Sequence: Synthetic oligonucleotide
tggtgattgccgcagacatgctgggatc

SEQ ID NO: 125311 - DNA, 27 bp, Artificial Sequence
  Description of Artificial Sequence: Synthetic oligonucleotide
ggtgattgccgcagacatgctgggatc

SEQ ID NO: 125312 - DNA, 27 bp, Artificial Sequence
  Description of Artificial Sequence: Synthetic oligonucleotide
gtgattgccgcagacatgctgggatcc

SEQ ID NO: 125313 - DNA, 29 bp, Artificial Sequence
  Description of Artificial Sequence: Synthetic oligonucleotide
tgattgccgcagacatgctgggatcctac

SEQ ID NO: 125314 - DNA, 28 bp, Artificial Sequence
  Description of Artificial Sequence: Synthetic oligonucleotide
gattgccgcagacatgctgggatcctac

SEQ ID NO: 125315 - DNA, 28 bp, Artificial Sequence
  Description of Artificial Sequence: Synthetic oligonucleotide
attgccgcagacatgctgggatcctacg

SEQ ID NO: 125316 - DNA, 27 bp, Artificial Sequence
  Description of Artificial Sequence: Synthetic oligonucleotide
ttgccgcagacatgctgggatcctacg

SEQ ID NO: 125317 - DNA, 26 bp, Artificial Sequence
  Description of Artificial Sequence: Synthetic oligonucleotide
tgccgcagacatgctgggatcctacg

SEQ ID NO: 125318 - DNA, 25 bp, Artificial Sequence
  Description of Artificial Sequence: Synthetic oligonucleotide
gccgcagacatgctgggatcctacg

SEQ ID NO: 125319 - DNA, 25 bp, Artificial Sequence
  Description of Artificial Sequence: Synthetic oligonucleotide
ccgcagacatgctgggatcctacgg

SEQ ID NO: 125320 - DNA, 26 bp, Artificial Sequence
  Description of Artificial Sequence: Synthetic oligonucleotide
cgcagacatgctgggatcctacggct

SEQ ID NO: 125321 - DNA, 26 bp, Artificial Sequence
  Description of Artificial Sequence: Synthetic oligonucleotide
gcagacatgctgggatcctacggctc

SEQ ID NO: 125322 - DNA, 27 bp, Artificial Sequence
  Description of Artificial Sequence: Synthetic oligonucleotide
cagacatgctgggatcctacggctcct

SEQ ID NO: 125323 - DNA, 28 bp, Artificial Sequence
  Description of Artificial Sequence: Synthetic oligonucleotide
agacatgctgggatcctacggctccttg

SEQ ID NO: 125324 - DNA, 27 bp, Artificial Sequence
  Description of Artificial Sequence: Synthetic oligonucleotide
gacatgctgggatcctacggctccttg

SEQ ID NO: 125325 - DNA, 27 bp, Artificial Sequence
  Description of Artificial Sequence: Synthetic oligonucleotide
acatgctgggatcctacggctccttgg

SEQ ID NO: 125326 - DNA, 26 bp, Artificial Sequence
  Description of Artificial Sequence: Synthetic oligonucleotide
catgctgggatcctacggctccttgg

SEQ ID NO: 125327 - DNA, 27 bp, Artificial Sequence
  Description of Artificial Sequence: Synthetic oligonucleotide
atgctgggatcctacggctccttggct

SEQ ID NO: 125328 - DNA, 26 bp, Artificial Sequence
  Description of Artificial Sequence: Synthetic oligonucleotide
tgctgggatcctacggctccttggct

SEQ ID NO: 125329 - DNA, 25 bp, Artificial Sequence
  Description of Artificial Sequence: Synthetic oligonucleotide
gctgggatcctacggctccttggct

SEQ ID NO: 125330 - DNA, 25 bp, Artificial Sequence
  Description of Artificial Sequence: Synthetic oligonucleotide
ctgggatcctacggctccttggctc

SEQ ID NO: 125331 - DNA, 27 bp, Artificial Sequence
  Description of Artificial Sequence: Synthetic oligonucleotide
tgggatcctacggctccttggctcgtt

SEQ ID NO: 125332 - DNA, 27 bp, Artificial Sequence
  Description of Artificial Sequence: Synthetic oligonucleotide
gggatcctacggctccttggctcgttt

SEQ ID NO: 125333 - DNA, 27 bp, Artificial Sequence
  Description of Artificial Sequence: Synthetic oligonucleotide
ggatcctacggctccttggctcgtttc

SEQ ID NO: 125334 - DNA, 27 bp, Artificial Sequence
  Description of Artificial Sequence: Synthetic oligonucleotide
gatcctacggctccttggctcgtttcc

SEQ ID NO: 125335 - DNA, 27 bp, Artificial Sequence
  Description of Artificial Sequence: Synthetic oligonucleotide
atcctacggctccttggctcgtttccg

SEQ ID NO: 125336 - DNA, 26 bp, Artificial Sequence
  Description of Artificial Sequence: Synthetic oligonucleotide
tcctacggctccttggctcgtttccg

SEQ ID NO: 125337 - DNA, 25 bp, Artificial Sequence
  Description of Artificial Sequence: Synthetic oligonucleotide
cctacggctccttggctcgtttccg

SEQ ID NO: 125338 - DNA, 27 bp, Artificial Sequence
  Description of Artificial Sequence: Synthetic oligonucleotide
ctacggctccttggctcgtttccgcaa

SEQ ID NO: 125339 - DNA, 27 bp, Artificial Sequence
  Description of Artificial Sequence: Synthetic oligonucleotide
tacggctccttggctcgtttccgcaac

SEQ ID NO: 125340 - DNA, 27 bp, Artificial Sequence
  Description of Artificial Sequence: Synthetic oligonucleotide
acggctccttggctcgtttccgcaaca

SEQ ID NO: 125341 - DNA, 27 bp, Artificial Sequence
  Description of Artificial Sequence: Synthetic oligonucleotide
cggctccttggctcgtttccgcaacat

SEQ ID NO: 125342 - DNA, 27 bp, Artificial Sequence
  Description of Artificial Sequence: Synthetic oligonucleotide
ggctccttggctcgtttccgcaacatc

SEQ ID NO: 125343 - DNA, 28 bp, Artificial Sequence
  Description of Artificial Sequence: Synthetic oligonucleotide
gctccttggctcgtttccgcaacatctc

SEQ ID NO: 125344 - DNA, 29 bp, Artificial Sequence
  Description of Artificial Sequence: Synthetic oligonucleotide
ctccttggctcgtttccgcaacatctctc

SEQ ID NO: 125345 - DNA, 29 bp, Artificial Sequence
  Description of Artificial Sequence: Synthetic oligonucleotide
tccttggctcgtttccgcaacatctctcg

SEQ ID NO: 125346 - DNA, 28 bp, Artificial Sequence
  Description of Artificial Sequence: Synthetic oligonucleotide
ccttggctcgtttccgcaacatctctcg

SEQ ID NO: 125347 - DNA, 28 bp, Artificial Sequence
  Description of Artificial Sequence: Synthetic oligonucleotide
cttggctcgtttccgcaacatctctcgc

SEQ ID NO: 125348 - DNA, 33 bp, Artificial Sequence
  Description of Artificial Sequence: Synthetic oligonucleotide
ttggctcgtttccgcaacatctctcgcattatg

SEQ ID NO: 125349 - DNA, 32 bp, Artificial Sequence
  Description of Artificial Sequence: Synthetic oligonucleotide
tggctcgtttccgcaacatctctcgcattatg

SEQ ID NO: 125350 - DNA, 31 bp, Artificial Sequence
  Description of Artificial Sequence: Synthetic oligonucleotide
ggctcgtttccgcaacatctctcgcattatg

SEQ ID NO: 125351 - DNA, 31 bp, Artificial Sequence
  Description of Artificial Sequence: Synthetic oligonucleotide
gctcgtttccgcaacatctctcgcattatgc

SEQ ID NO: 125352 - DNA, 31 bp, Artificial Sequence
  Description of Artificial Sequence: Synthetic oligonucleotide
ctcgtttccgcaacatctctcgcattatgcg

SEQ ID NO: 125353 - DNA, 32 bp, Artificial Sequence
  Description of Artificial Sequence: Synthetic oligonucleotide
tcgtttccgcaacatctctcgcattatgcgag

SEQ ID NO: 125354 - DNA, 31 bp, Artificial Sequence
  Description of Artificial Sequence: Synthetic oligonucleotide
cgtttccgcaacatctctcgcattatgcgag

SEQ ID NO: 125355 - DNA, 32 bp, Artificial Sequence
  Description of Artificial Sequence: Synthetic oligonucleotide
gtttccgcaacatctctcgcattatgcgagtc

SEQ ID NO: 125356 - DNA, 34 bp, Artificial Sequence
  Description of Artificial Sequence: Synthetic oligonucleotide
tttccgcaacatctctcgcattatgcgagtcaac

SEQ ID NO: 125357 - DNA, 33 bp, Artificial Sequence
  Description of Artificial Sequence: Synthetic oligonucleotide
ttccgcaacatctctcgcattatgcgagtcaac

SEQ ID NO: 125358 - DNA, 32 bp, Artificial Sequence
  Description of Artificial Sequence: Synthetic oligonucleotide
tccgcaacatctctcgcattatgcgagtcaac

SEQ ID NO: 125359 - DNA, 31 bp, Artificial Sequence
  Description of Artificial Sequence: Synthetic oligonucleotide
ccgcaacatctctcgcattatgcgagtcaac

SEQ ID NO: 125360 - DNA, 33 bp, Artificial Sequence
  Description of Artificial Sequence: Synthetic oligonucleotide
cgcaacatctctcgcattatgcgagtcaacaac

SEQ ID NO: 125361 - DNA, 34 bp, Artificial Sequence
  Description of Artificial Sequence: Synthetic oligonucleotide
gcaacatctctcgcattatgcgagtcaacaacag

SEQ ID NO: 125362 - DNA, 36 bp, Artificial Sequence
  Description of Artificial Sequence: Synthetic oligonucleotide
caacatctctcgcattatgcgagtcaacaacagtac

SEQ ID NO: 125363 - DNA, 36 bp, Artificial Sequence
  Description of Artificial Sequence: Synthetic oligonucleotide
aacatctctcgcattatgcgagtcaacaacagtacc

SEQ ID NO: 125364 - DNA, 35 bp, Artificial Sequence
  Description of Artificial Sequence: Synthetic oligonucleotide
acatctctcgcattatgcgagtcaacaacagtacc

SEQ ID NO: 125365 - DNA, 34 bp, Artificial Sequence
  Description of Artificial Sequence: Synthetic oligonucleotide
catctctcgcattatgcgagtcaacaacagtacc

SEQ ID NO: 125366 - DNA, 36 bp, Artificial Sequence
  Description of Artificial Sequence: Synthetic oligonucleotide
atctctcgcattatgcgagtcaacaacagtaccatg

SEQ ID NO: 125367 - DNA, 35 bp, Artificial Sequence
  Description of Artificial Sequence: Synthetic oligonucleotide
tctctcgcattatgcgagtcaacaacagtaccatg

SEQ ID NO: 125368 - DNA, 34 bp, Artificial Sequence
  Description of Artificial Sequence: Synthetic oligonucleotide
ctctcgcattatgcgagtcaacaacagtaccatg

SEQ ID NO: 125369 - DNA, 34 bp, Artificial Sequence
  Description of Artificial Sequence: Synthetic oligonucleotide
tctcgcattatgcgagtcaacaacagtaccatgc

SEQ ID NO: 125370 - DNA, 33 bp, Artificial Sequence
  Description of Artificial Sequence: Synthetic oligonucleotide
ctcgcattatgcgagtcaacaacagtaccatgc

SEQ ID NO: 125371 - DNA, 34 bp, Artificial Sequence
  Description of Artificial Sequence: Synthetic oligonucleotide
tcgcattatgcgagtcaacaacagtaccatgctg

SEQ ID NO: 125372 - DNA, 33 bp, Artificial Sequence
  Description of Artificial Sequence: Synthetic oligonucleotide
cgcattatgcgagtcaacaacagtaccatgctg

SEQ ID NO: 125373 - DNA, 33 bp, Artificial Sequence
  Description of Artificial Sequence: Synthetic oligonucleotide
gcattatgcgagtcaacaacagtaccatgctgg

SEQ ID NO: 125374 - DNA, 33 bp, Artificial Sequence
  Description of Artificial Sequence: Synthetic oligonucleotide
cattatgcgagtcaacaacagtaccatgctggg

SEQ ID NO: 125375 - DNA, 34 bp, Artificial Sequence
  Description of Artificial Sequence: Synthetic oligonucleotide
attatgcgagtcaacaacagtaccatgctgggtg

SEQ ID NO: 125376 - DNA, 33 bp, Artificial Sequence
  Description of Artificial Sequence: Synthetic oligonucleotide
ttatgcgagtcaacaacagtaccatgctgggtg

SEQ ID NO: 125377 - DNA, 32 bp, Artificial Sequence
  Description of Artificial Sequence: Synthetic oligonucleotide
tatgcgagtcaacaacagtaccatgctgggtg

SEQ ID NO: 125378 - DNA, 31 bp, Artificial Sequence
  Description of Artificial Sequence: Synthetic oligonucleotide
atgcgagtcaacaacagtaccatgctgggtg

SEQ ID NO: 125379 - DNA, 30 bp, Artificial Sequence
  Description of Artificial Sequence: Synthetic oligonucleotide
tgcgagtcaacaacagtaccatgctgggtg

SEQ ID NO: 125380 - DNA, 29 bp, Artificial Sequence
  Description of Artificial Sequence: Synthetic oligonucleotide
gcgagtcaacaacagtaccatgctgggtg

SEQ ID NO: 125381 - DNA, 29 bp, Artificial Sequence
  Description of Artificial Sequence: Synthetic oligonucleotide
cgagtcaacaacagtaccatgctgggtgc

SEQ ID NO: 125382 - DNA, 29 bp, Artificial Sequence
  Description of Artificial Sequence: Synthetic oligonucleotide
gagtcaacaacagtaccatgctgggtgcc

SEQ ID NO: 125383 - DNA, 30 bp, Artificial Sequence
  Description of Artificial Sequence: Synthetic oligonucleotide
agtcaacaacagtaccatgctgggtgcctc

SEQ ID NO: 125384 - DNA, 29 bp, Artificial Sequence
  Description of Artificial Sequence: Synthetic oligonucleotide
gtcaacaacagtaccatgctgggtgcctc

SEQ ID NO: 125385 - DNA, 30 bp, Artificial Sequence
  Description of Artificial Sequence: Synthetic oligonucleotide
tcaacaacagtaccatgctgggtgcctctg

SEQ ID NO: 125386 - DNA, 29 bp, Artificial Sequence
  Description of Artificial Sequence: Synthetic oligonucleotide
caacaacagtaccatgctgggtgcctctg

SEQ ID NO: 125387 - DNA, 29 bp, Artificial Sequence
  Description of Artificial Sequence: Synthetic oligonucleotide
aacaacagtaccatgctgggtgcctctgg

SEQ ID NO: 125388 - DNA, 28 bp, Artificial Sequence
  Description of Artificial Sequence: Synthetic oligonucleotide
acaacagtaccatgctgggtgcctctgg

SEQ ID NO: 125389 - DNA, 27 bp, Artificial Sequence
  Description of Artificial Sequence: Synthetic oligonucleotide
caacagtaccatgctgggtgcctctgg

SEQ ID NO: 125390 - DNA, 27 bp, Artificial Sequence
  Description of Artificial Sequence: Synthetic oligonucleotide
aacagtaccatgctgggtgcctctggc

SEQ ID NO: 125391 - DNA, 26 bp, Artificial Sequence
  Description of Artificial Sequence: Synthetic oligonucleotide
acagtaccatgctgggtgcctctggc

SEQ ID NO: 125392 - DNA, 25 bp, Artificial Sequence
  Description of Artificial Sequence: Synthetic oligonucleotide
cagtaccatgctgggtgcctctggc

SEQ ID NO: 125393 - DNA, 26 bp, Artificial Sequence
  Description of Artificial Sequence: Synthetic oligonucleotide
agtaccatgctgggtgcctctggcga

SEQ ID NO: 125394 - DNA, 25 bp, Artificial Sequence
  Description of Artificial Sequence: Synthetic oligonucleotide
gtaccatgctgggtgcctctggcga

SEQ ID NO: 125395 - DNA, 27 bp, Artificial Sequence
  Description of Artificial Sequence: Synthetic oligonucleotide
taccatgctgggtgcctctggcgacta

SEQ ID NO: 125396 - DNA, 26 bp, Artificial Sequence
  Description of Artificial Sequence: Synthetic oligonucleotide
accatgctgggtgcctctggcgacta

SEQ ID NO: 125397 - DNA, 25 bp, Artificial Sequence
  Description of Artificial Sequence: Synthetic oligonucleotide
ccatgctgggtgcctctggcgacta

SEQ ID NO: 125398 - DNA, 25 bp, Artificial Sequence
  Description of Artificial Sequence: Synthetic oligonucleotide
catgctgggtgcctctggcgactac

SEQ ID NO: 125399 - DNA, 25 bp, Artificial Sequence
  Description of Artificial Sequence: Synthetic oligonucleotide
atgctgggtgcctctggcgactacg

SEQ ID NO: 125400 - DNA, 24 bp, Artificial Sequence
  Description of Artificial Sequence: Synthetic oligonucleotide
tgctgggtgcctctggcgactacg

SEQ ID NO: 125401 - DNA, 23 bp, Artificial Sequence
  Description of Artificial Sequence: Synthetic oligonucleotide
gctgggtgcctctggcgactacg

SEQ ID NO: 125402 - DNA, 24 bp, Artificial Sequence
  Description of Artificial Sequence: Synthetic oligonucleotide
ctgggtgcctctggcgactacgct

SEQ ID NO: 125403 - DNA, 27 bp, Artificial Sequence
  Description of Artificial Sequence: Synthetic oligonucleotide
tgggtgcctctggcgactacgctgatt

SEQ ID NO: 125404 - DNA, 27 bp, Artificial Sequence
  Description of Artificial Sequence: Synthetic oligonucleotide
gggtgcctctggcgactacgctgattt

SEQ ID NO: 125405 - DNA, 27 bp, Artificial Sequence
  Description of Artificial Sequence: Synthetic oligonucleotide
ggtgcctctggcgactacgctgatttc

SEQ ID NO: 125406 - DNA, 27 bp, Artificial Sequence
  Description of Artificial Sequence: Synthetic oligonucleotide
gtgcctctggcgactacgctgatttcc

SEQ ID NO: 125407 - DNA, 28 bp, Artificial Sequence
  Description of Artificial Sequence: Synthetic oligonucleotide
tgcctctggcgactacgctgatttccag

SEQ ID NO: 125408 - DNA, 27 bp, Artificial Sequence
  Description of Artificial Sequence: Synthetic oligonucleotide
gcctctggcgactacgctgatttccag

SEQ ID NO: 125409 - DNA, 32 bp, Artificial Sequence
  Description of Artificial Sequence: Synthetic oligonucleotide
cctctggcgactacgctgatttccagtatttg

SEQ ID NO: 125410 - DNA, 34 bp, Artificial Sequence
  Description of Artificial Sequence: Synthetic oligonucleotide
ctctggcgactacgctgatttccagtatttgaag

SEQ ID NO: 125411 - DNA, 34 bp, Artificial Sequence
  Description of Artificial Sequence: Synthetic oligonucleotide
tctggcgactacgctgatttccagtatttgaagc

SEQ ID NO: 125412 - DNA, 33 bp, Artificial Sequence
  Description of Artificial Sequence: Synthetic oligonucleotide
ctggcgactacgctgatttccagtatttgaagc

SEQ ID NO: 125413 - DNA, 35 bp, Artificial Sequence
  Description of Artificial Sequence: Synthetic oligonucleotide
tggcgactacgctgatttccagtatttgaagcaag

SEQ ID NO: 125414 - DNA, 34 bp, Artificial Sequence
  Description of Artificial Sequence: Synthetic oligonucleotide
ggcgactacgctgatttccagtatttgaagcaag

SEQ ID NO: 125415 - DNA, 36 bp, Artificial Sequence
  Description of Artificial Sequence: Synthetic oligonucleotide
gcgactacgctgatttccagtatttgaagcaagttc

SEQ ID NO: 125416 - DNA, 37 bp, Artificial Sequence
  Description of Artificial Sequence: Synthetic oligonucleotide
cgactacgctgatttccagtatttgaagcaagttctc

SEQ ID NO: 125417 - DNA, 37 bp, Artificial Sequence
  Description of Artificial Sequence: Synthetic oligonucleotide
gactacgctgatttccagtatttgaagcaagttctcg

SEQ ID NO: 125418 - DNA, 37 bp, Artificial Sequence
  Description of Artificial Sequence: Synthetic oligonucleotide
actacgctgatttccagtatttgaagcaagttctcgg

SEQ ID NO: 125419 - DNA, 36 bp, Artificial Sequence
  Description of Artificial Sequence: Synthetic oligonucleotide
ctacgctgatttccagtatttgaagcaagttctcgg

SEQ ID NO: 125420 - DNA, 36 bp, Artificial Sequence
  Description of Artificial Sequence: Synthetic oligonucleotide
tacgctgatttccagtatttgaagcaagttctcggc

SEQ ID NO: 125421 - DNA, 35 bp, Artificial Sequence
  Description of Artificial Sequence: Synthetic oligonucleotide
acgctgatttccagtatttgaagcaagttctcggc

SEQ ID NO: 125422 - DNA, 34 bp, Artificial Sequence
  Description of Artificial Sequence: Synthetic oligonucleotide
cgctgatttccagtatttgaagcaagttctcggc

SEQ ID NO: 125423 - DNA, 34 bp, Artificial Sequence
  Description of Artificial Sequence: Synthetic oligonucleotide
gctgatttccagtatttgaagcaagttctcggcc

SEQ ID NO: 125424 - DNA, 35 bp, Artificial Sequence
  Description of Artificial Sequence: Synthetic oligonucleotide
ctgatttccagtatttgaagcaagttctcggccag

SEQ ID NO: 125425 - DNA, 37 bp, Artificial Sequence
  Description of Artificial Sequence: Synthetic oligonucleotide
tgatttccagtatttgaagcaagttctcggccagatg

SEQ ID NO: 125426 - DNA, 36 bp, Artificial Sequence
  Description of Artificial Sequence: Synthetic oligonucleotide
gatttccagtatttgaagcaagttctcggccagatg

SEQ ID NO: 125427 - DNA, 36 bp, Artificial Sequence
  Description of Artificial Sequence: Synthetic oligonucleotide
atttccagtatttgaagcaagttctcggccagatgg

SEQ ID NO: 125428 - DNA, 35 bp, Artificial Sequence
  Description of Artificial Sequence: Synthetic oligonucleotide
tttccagtatttgaagcaagttctcggccagatgg

SEQ ID NO: 125429 - DNA, 34 bp, Artificial Sequence
  Description of Artificial Sequence: Synthetic oligonucleotide
ttccagtatttgaagcaagttctcggccagatgg

SEQ ID NO: 125430 - DNA, 33 bp, Artificial Sequence
  Description of Artificial Sequence: Synthetic oligonucleotide
tccagtatttgaagcaagttctcggccagatgg

SEQ ID NO: 125431 - DNA, 32 bp, Artificial Sequence
  Description of Artificial Sequence: Synthetic oligonucleotide
ccagtatttgaagcaagttctcggccagatgg

SEQ ID NO: 125432 - DNA, 33 bp, Artificial Sequence
  Description of Artificial Sequence: Synthetic oligonucleotide
cagtatttgaagcaagttctcggccagatggtg

SEQ ID NO: 125433 - DNA, 36 bp, Artificial Sequence
  Description of Artificial Sequence: Synthetic oligonucleotide
agtatttgaagcaagttctcggccagatggtgattg

SEQ ID NO: 125434 - DNA, 35 bp, Artificial Sequence
  Description of Artificial Sequence: Synthetic oligonucleotide
gtatttgaagcaagttctcggccagatggtgattg

SEQ ID NO: 125435 - DNA, 37 bp, Artificial Sequence
  Description of Artificial Sequence: Synthetic oligonucleotide
tatttgaagcaagttctcggccagatggtgattgatg

SEQ ID NO: 125436 - DNA, 36 bp, Artificial Sequence
  Description of Artificial Sequence: Synthetic oligonucleotide
atttgaagcaagttctcggccagatggtgattgatg

SEQ ID NO: 125437 - DNA, 35 bp, Artificial Sequence
  Description of Artificial Sequence: Synthetic oligonucleotide
tttgaagcaagttctcggccagatggtgattgatg

SEQ ID NO: 125438 - DNA, 34 bp, Artificial Sequence
  Description of Artificial Sequence: Synthetic oligonucleotide
ttgaagcaagttctcggccagatggtgattgatg

SEQ ID NO: 125439 - DNA, 33 bp, Artificial Sequence
  Description of Artificial Sequence: Synthetic oligonucleotide
tgaagcaagttctcggccagatggtgattgatg

SEQ ID NO: 125440 - DNA, 32 bp, Artificial Sequence
  Description of Artificial Sequence: Synthetic oligonucleotide
gaagcaagttctcggccagatggtgattgatg

SEQ ID NO: 125441 - DNA, 33 bp, Artificial Sequence
  Description of Artificial Sequence: Synthetic oligonucleotide
aagcaagttctcggccagatggtgattgatgag

SEQ ID NO: 125442 - DNA, 32 bp, Artificial Sequence
  Description of Artificial Sequence: Synthetic oligonucleotide
agcaagttctcggccagatggtgattgatgag

SEQ ID NO: 125443 - DNA, 31 bp, Artificial Sequence
  Description of Artificial Sequence: Synthetic oligonucleotide
gcaagttctcggccagatggtgattgatgag

SEQ ID NO: 125444 - DNA, 31 bp, Artificial Sequence
  Description of Artificial Sequence: Synthetic oligonucleotide
caagttctcggccagatggtgattgatgagg

SEQ ID NO: 125445 - DNA, 32 bp, Artificial Sequence
  Description of Artificial Sequence: Synthetic oligonucleotide
aagttctcggccagatggtgattgatgaggag

SEQ ID NO: 125446 - DNA, 31 bp, Artificial Sequence
  Description of Artificial Sequence: Synthetic oligonucleotide
agttctcggccagatggtgattgatgaggag

SEQ ID NO: 125447 - DNA, 30 bp, Artificial Sequence
  Description of Artificial Sequence: Synthetic oligonucleotide
gttctcggccagatggtgattgatgaggag

SEQ ID NO: 125448 - DNA, 30 bp, Artificial Sequence
  Description of Artificial Sequence: Synthetic oligonucleotide
ttctcggccagatggtgattgatgaggagc

SEQ ID NO: 125449 - DNA, 29 bp, Artificial Sequence
  Description of Artificial Sequence: Synthetic oligonucleotide
tctcggccagatggtgattgatgaggagc

SEQ ID NO: 125450 - DNA, 28 bp, Artificial Sequence
  Description of Artificial Sequence: Synthetic oligonucleotide
ctcggccagatggtgattgatgaggagc

SEQ ID NO: 125451 - DNA, 30 bp, Artificial Sequence
  Description of Artificial Sequence: Synthetic oligonucleotide
tcggccagatggtgattgatgaggagcttc

SEQ ID NO: 125452 - DNA, 29 bp, Artificial Sequence
  Description of Artificial Sequence: Synthetic oligonucleotide
cggccagatggtgattgatgaggagcttc

SEQ ID NO: 125453 - DNA, 30 bp, Artificial Sequence
  Description of Artificial Sequence: Synthetic oligonucleotide
ggccagatggtgattgatgaggagcttctg

SEQ ID NO: 125454 - DNA, 30 bp, Artificial Sequence
  Description of Artificial Sequence: Synthetic oligonucleotide
gccagatggtgattgatgaggagcttctgg

SEQ ID NO: 125455 - DNA, 30 bp, Artificial Sequence
  Description of Artificial Sequence: Synthetic oligonucleotide
ccagatggtgattgatgaggagcttctggg

SEQ ID NO: 125456 - DNA, 31 bp, Artificial Sequence
  Description of Artificial Sequence: Synthetic oligonucleotide
cagatggtgattgatgaggagcttctgggag

SEQ ID NO: 125457 - DNA, 33 bp, Artificial Sequence
  Description of Artificial Sequence: Synthetic oligonucleotide
agatggtgattgatgaggagcttctgggagatg

SEQ ID NO: 125458 - DNA, 32 bp, Artificial Sequence
  Description of Artificial Sequence: Synthetic oligonucleotide
gatggtgattgatgaggagcttctgggagatg

SEQ ID NO: 125459 - DNA, 32 bp, Artificial Sequence
  Description of Artificial Sequence: Synthetic oligonucleotide
atggtgattgatgaggagcttctgggagatgg

SEQ ID NO: 125460 - DNA, 31 bp, Artificial Sequence
  Description of Artificial Sequence: Synthetic oligonucleotide
tggtgattgatgaggagcttctgggagatgg

SEQ ID NO: 125461 - DNA, 30 bp, Artificial Sequence
  Description of Artificial Sequence: Synthetic oligonucleotide
ggtgattgatgaggagcttctgggagatgg

SEQ ID NO: 125462 - DNA, 31 bp, Artificial Sequence
  Description of Artificial Sequence: Synthetic oligonucleotide
gtgattgatgaggagcttctgggagatggac

SEQ ID NO: 125463 - DNA, 32 bp, Artificial Sequence
  Description of Artificial Sequence: Synthetic oligonucleotide
tgattgatgaggagcttctgggagatggacac

SEQ ID NO: 125464 - DNA, 31 bp, Artificial Sequence
  Description of Artificial Sequence: Synthetic oligonucleotide
gattgatgaggagcttctgggagatggacac

SEQ ID NO: 125465 - DNA, 32 bp, Artificial Sequence
  Description of Artificial Sequence: Synthetic oligonucleotide
attgatgaggagcttctgggagatggacacag

SEQ ID NO: 125466 - DNA, 31 bp, Artificial Sequence
  Description of Artificial Sequence: Synthetic oligonucleotide
ttgatgaggagcttctgggagatggacacag

SEQ ID NO: 125467 - DNA, 30 bp, Artificial Sequence
  Description of Artificial Sequence: Synthetic oligonucleotide
tgatgaggagcttctgggagatggacacag

SEQ ID NO: 125468 - DNA, 29 bp, Artificial Sequence
  Description of Artificial Sequence: Synthetic oligonucleotide
gatgaggagcttctgggagatggacacag

SEQ ID NO: 125469 - DNA, 29 bp, Artificial Sequence
  Description of Artificial Sequence: Synthetic oligonucleotide
atgaggagcttctgggagatggacacagc

SEQ ID NO: 125470 - DNA, 28 bp, Artificial Sequence
  Description of Artificial Sequence: Synthetic oligonucleotide
tgaggagcttctgggagatggacacagc

SEQ ID NO: 125471 - DNA, 27 bp, Artificial Sequence
  Description of Artificial Sequence: Synthetic oligonucleotide
gaggagcttctgggagatggacacagc

SEQ ID NO: 125472 - DNA, 31 bp, Artificial Sequence
  Description of Artificial Sequence: Synthetic oligonucleotide
aggagcttctgggagatggacacagctatag

SEQ ID NO: 125473 - DNA, 30 bp, Artificial Sequence
  Description of Artificial Sequence: Synthetic oligonucleotide
ggagcttctgggagatggacacagctatag

SEQ ID NO: 125474 - DNA, 31 bp, Artificial Sequence
  Description of Artificial Sequence: Synthetic oligonucleotide
gagcttctgggagatggacacagctatagtc

SEQ ID NO: 125475 - DNA, 31 bp, Artificial Sequence
  Description of Artificial Sequence: Synthetic oligonucleotide
agcttctgggagatggacacagctatagtcc

SEQ ID NO: 125476 - DNA, 30 bp, Artificial Sequence
  Description of Artificial Sequence: Synthetic oligonucleotide
gcttctgggagatggacacagctatagtcc

SEQ ID NO: 125477 - DNA, 32 bp, Artificial Sequence
  Description of Artificial Sequence: Synthetic oligonucleotide
cttctgggagatggacacagctatagtcctag

SEQ ID NO: 125478 - DNA, 33 bp, Artificial Sequence
  Description of Artificial Sequence: Synthetic oligonucleotide
ttctgggagatggacacagctatagtcctagag

SEQ ID NO: 125479 - DNA, 32 bp, Artificial Sequence
  Description of Artificial Sequence: Synthetic oligonucleotide
tctgggagatggacacagctatagtcctagag

SEQ ID NO: 125480 - DNA, 31 bp, Artificial Sequence
  Description of Artificial Sequence: Synthetic oligonucleotide
ctgggagatggacacagctatagtcctagag

SEQ ID NO: 125481 - DNA, 31 bp, Artificial Sequence
  Description of Artificial Sequence: Synthetic oligonucleotide
tgggagatggacacagctatagtcctagagc

SEQ ID NO: 125482 - DNA, 30 bp, Artificial Sequence
  Description of Artificial Sequence: Synthetic oligonucleotide
gggagatggacacagctatagtcctagagc

SEQ ID NO: 125483 - DNA, 34 bp, Artificial Sequence
  Description of Artificial Sequence: Synthetic oligonucleotide
ggagatggacacagctatagtcctagagctattc

SEQ ID NO: 125484 - DNA, 37 bp, Artificial Sequence
  Description of Artificial Sequence: Synthetic oligonucleotide
gagatggacacagctatagtcctagagctattcattc

SEQ ID NO: 125485 - DNA, 39 bp, Artificial Sequence
  Description of Artificial Sequence: Synthetic oligonucleotide
agatggacacagctatagtcctagagctattcattcatg

SEQ ID NO: 125486 - DNA, 38 bp, Artificial Sequence
  Description of Artificial Sequence: Synthetic oligonucleotide
gatggacacagctatagtcctagagctattcattcatg

SEQ ID NO: 125487 - DNA, 38 bp, Artificial Sequence
  Description of Artificial Sequence: Synthetic oligonucleotide
atggacacagctatagtcctagagctattcattcatgg

SEQ ID NO: 125488 - DNA, 37 bp, Artificial Sequence
  Description of Artificial Sequence: Synthetic oligonucleotide
tggacacagctatagtcctagagctattcattcatgg

SEQ ID NO: 125489 - DNA, 36 bp, Artificial Sequence
  Description of Artificial Sequence: Synthetic oligonucleotide
ggacacagctatagtcctagagctattcattcatgg

SEQ ID NO: 125490 - DNA, 36 bp, Artificial Sequence
  Description of Artificial Sequence: Synthetic oligonucleotide
gacacagctatagtcctagagctattcattcatggc

SEQ ID NO: 125491 - DNA, 37 bp, Artificial Sequence
  Description of Artificial Sequence: Synthetic oligonucleotide
acacagctatagtcctagagctattcattcatggctg

SEQ ID NO: 125492 - DNA, 36 bp, Artificial Sequence
  Description of Artificial Sequence: Synthetic oligonucleotide
cacagctatagtcctagagctattcattcatggctg

SEQ ID NO: 125493 - DNA, 37 bp, Artificial Sequence
  Description of Artificial Sequence: Synthetic oligonucleotide
acagctatagtcctagagctattcattcatggctgac

SEQ ID NO: 125494 - DNA, 36 bp, Artificial Sequence
  Description of Artificial Sequence: Synthetic oligonucleotide
cagctatagtcctagagctattcattcatggctgac

SEQ ID NO: 125495 - DNA, 36 bp, Artificial Sequence
  Description of Artificial Sequence: Synthetic oligonucleotide
agctatagtcctagagctattcattcatggctgacc

SEQ ID NO: 125496 - DNA, 35 bp, Artificial Sequence
  Description of Artificial Sequence: Synthetic oligonucleotide
gctatagtcctagagctattcattcatggctgacc

SEQ ID NO: 125497 - DNA, 36 bp, Artificial Sequence
  Description of Artificial Sequence: Synthetic oligonucleotide
ctatagtcctagagctattcattcatggctgaccag

SEQ ID NO: 125498 - DNA, 36 bp, Artificial Sequence
  Description of Artificial Sequence: Synthetic oligonucleotide
tatagtcctagagctattcattcatggctgaccagg

SEQ ID NO: 125499 - DNA, 35 bp, Artificial Sequence
  Description of Artificial Sequence: Synthetic oligonucleotide
atagtcctagagctattcattcatggctgaccagg

SEQ ID NO: 125500 - DNA, 34 bp, Artificial Sequence
  Description of Artificial Sequence: Synthetic oligonucleotide
tagtcctagagctattcattcatggctgaccagg

SEQ ID NO: 125501 - DNA, 33 bp, Artificial Sequence
  Description of Artificial Sequence: Synthetic oligonucleotide
agtcctagagctattcattcatggctgaccagg

SEQ ID NO: 125502 - DNA, 32 bp, Artificial Sequence
  Description of Artificial Sequence: Synthetic oligonucleotide
gtcctagagctattcattcatggctgaccagg

SEQ ID NO: 125503 - DNA, 32 bp, Artificial Sequence
  Description of Artificial Sequence: Synthetic oligonucleotide
tcctagagctattcattcatggctgaccaggg

SEQ ID NO: 125504 - DNA, 31 bp, Artificial Sequence
  Description of Artificial Sequence: Synthetic oligonucleotide
cctagagctattcattcatggctgaccaggg

SEQ ID NO: 125505 - DNA, 31 bp, Artificial Sequence
  Description of Artificial Sequence: Synthetic oligonucleotide
ctagagctattcattcatggctgaccagggc

SEQ ID NO: 125506 - DNA, 31 bp, Artificial Sequence
  Description of Artificial Sequence: Synthetic oligonucleotide
tagagctattcattcatggctgaccagggcc

SEQ ID NO: 125507 - DNA, 30 bp, Artificial Sequence
  Description of Artificial Sequence: Synthetic oligonucleotide
agagctattcattcatggctgaccagggcc

SEQ ID NO: 125508 - DNA, 29 bp, Artificial Sequence
  Description of Artificial Sequence: Synthetic oligonucleotide
gagctattcattcatggctgaccagggcc

SEQ ID NO: 125509 - DNA, 31 bp, Artificial Sequence
  Description of Artificial Sequence: Synthetic oligonucleotide
agctattcattcatggctgaccagggccatg

SEQ ID NO: 125510 - DNA, 30 bp, Artificial Sequence
  Description of Artificial Sequence: Synthetic oligonucleotide
gctattcattcatggctgaccagggccatg

SEQ ID NO: 125511 - DNA, 32 bp, Artificial Sequence
  Description of Artificial Sequence: Synthetic oligonucleotide
ctattcattcatggctgaccagggccatgtac

SEQ ID NO: 125512 - DNA, 33 bp, Artificial Sequence
  Description of Artificial Sequence: Synthetic oligonucleotide
tattcattcatggctgaccagggccatgtacag

SEQ ID NO: 125513 - DNA, 32 bp, Artificial Sequence
  Description of Artificial Sequence: Synthetic oligonucleotide
attcattcatggctgaccagggccatgtacag

SEQ ID NO: 125514 - DNA, 31 bp, Artificial Sequence
  Description of Artificial Sequence: Synthetic oligonucleotide
ttcattcatggctgaccagggccatgtacag

SEQ ID NO: 125515 - DNA, 30 bp, Artificial Sequence
  Description of Artificial Sequence: Synthetic oligonucleotide
tcattcatggctgaccagggccatgtacag

SEQ ID NO: 125516 - DNA, 29 bp, Artificial Sequence
  Description of Artificial Sequence: Synthetic oligonucleotide
cattcatggctgaccagggccatgtacag

SEQ ID NO: 125517 - DNA, 29 bp, Artificial Sequence
  Description of Artificial Sequence: Synthetic oligonucleotide
attcatggctgaccagggccatgtacagc

SEQ ID NO: 125518 - DNA, 28 bp, Artificial Sequence
  Description of Artificial Sequence: Synthetic oligonucleotide
ttcatggctgaccagggccatgtacagc

SEQ ID NO: 125519 - DNA, 27 bp, Artificial Sequence
  Description of Artificial Sequence: Synthetic oligonucleotide
tcatggctgaccagggccatgtacagc

SEQ ID NO: 125520 - DNA, 26 bp, Artificial Sequence
  Description of Artificial Sequence: Synthetic oligonucleotide
catggctgaccagggccatgtacagc

SEQ ID NO: 125521 - DNA, 26 bp, Artificial Sequence
  Description of Artificial Sequence: Synthetic oligonucleotide
atggctgaccagggccatgtacagcc

SEQ ID NO: 125522 - DNA, 25 bp, Artificial Sequence
  Description of Artificial Sequence: Synthetic oligonucleotide
tggctgaccagggccatgtacagcc

SEQ ID NO: 125523 - DNA, 24 bp, Artificial Sequence
  Description of Artificial Sequence: Synthetic oligonucleotide
ggctgaccagggccatgtacagcc

SEQ ID NO: 125524 - DNA, 24 bp, Artificial Sequence
  Description of Artificial Sequence: Synthetic oligonucleotide
gctgaccagggccatgtacagccg

SEQ ID NO: 125525 - DNA, 24 bp, Artificial Sequence
  Description of Artificial Sequence: Synthetic oligonucleotide
ctgaccagggccatgtacagccgg

SEQ ID NO: 125526 - DNA, 24 bp, Artificial Sequence
  Description of Artificial Sequence: Synthetic oligonucleotide
tgaccagggccatgtacagccggc

SEQ ID NO: 125527 - DNA, 23 bp, Artificial Sequence
  Description of Artificial Sequence: Synthetic oligonucleotide
gaccagggccatgtacagccggc

SEQ ID NO: 125528 - DNA, 23 bp, Artificial Sequence
  Description of Artificial Sequence: Synthetic oligonucleotide
accagggccatgtacagccggcg

SEQ ID NO: 125529 - DNA, 22 bp, Artificial Sequence
  Description of Artificial Sequence: Synthetic oligonucleotide
ccagggccatgtacagccggcg

SEQ ID NO: 125530 - DNA, 23 bp, Artificial Sequence
  Description of Artificial Sequence: Synthetic oligonucleotide
cagggccatgtacagccggcgct

SEQ ID NO: 125531 - DNA, 23 bp, Artificial Sequence
  Description of Artificial Sequence: Synthetic oligonucleotide
agggccatgtacagccggcgctc

SEQ ID NO: 125532 - DNA, 22 bp, Artificial Sequence
  Description of Artificial Sequence: Synthetic oligonucleotide
gggccatgtacagccggcgctc

SEQ ID NO: 125533 - DNA, 24 bp, Artificial Sequence
  Description of Artificial Sequence: Synthetic oligonucleotide
ggccatgtacagccggcgctcgaa

SEQ ID NO: 125534 - DNA, 26 bp, Artificial Sequence
  Description of Artificial Sequence: Synthetic oligonucleotide
gccatgtacagccggcgctcgaagat

SEQ ID NO: 125535 - DNA, 27 bp, Artificial Sequence
  Description of Artificial Sequence: Synthetic oligonucleotide
ccatgtacagccggcgctcgaagatga

SEQ ID NO: 125536 - DNA, 28 bp, Artificial Sequence
  Description of Artificial Sequence: Synthetic oligonucleotide
catgtacagccggcgctcgaagatgaac

SEQ ID NO: 125537 - DNA, 28 bp, Artificial Sequence
  Description of Artificial Sequence: Synthetic oligonucleotide
atgtacagccggcgctcgaagatgaacc

SEQ ID NO: 125538 - DNA, 27 bp, Artificial Sequence
  Description of Artificial Sequence: Synthetic oligonucleotide
tgtacagccggcgctcgaagatgaacc

SEQ ID NO: 125539 - DNA, 26 bp, Artificial Sequence
  Description of Artificial Sequence: Synthetic oligonucleotide
gtacagccggcgctcgaagatgaacc

SEQ ID NO: 125540 - DNA, 27 bp, Artificial Sequence
  Description of Artificial Sequence: Synthetic oligonucleotide
tacagccggcgctcgaagatgaaccct

SEQ ID NO: 125541 - DNA, 27 bp, Artificial Sequence
  Description of Artificial Sequence: Synthetic oligonucleotide
acagccggcgctcgaagatgaaccctt

SEQ ID NO: 125542 - DNA, 27 bp, Artificial Sequence
  Description of Artificial Sequence: Synthetic oligonucleotide
cagccggcgctcgaagatgaacccttt

SEQ ID NO: 125543 - DNA, 27 bp, Artificial Sequence
  Description of Artificial Sequence: Synthetic oligonucleotide
agccggcgctcgaagatgaaccctttg

SEQ ID NO: 125544 - DNA, 27 bp, Artificial Sequence
  Description of Artificial Sequence: Synthetic oligonucleotide
gccggcgctcgaagatgaaccctttgt

SEQ ID NO: 125545 - DNA, 27 bp, Artificial Sequence
  Description of Artificial Sequence: Synthetic oligonucleotide
ccggcgctcgaagatgaaccctttgtg

SEQ ID NO: 125546 - DNA, 27 bp, Artificial Sequence
  Description of Artificial Sequence: Synthetic oligonucleotide
cggcgctcgaagatgaaccctttgtgg

SEQ ID NO: 125547 - DNA, 29 bp, Artificial Sequence
  Description of Artificial Sequence: Synthetic oligonucleotide
ggcgctcgaagatgaaccctttgtggaac

SEQ ID NO: 125548 - DNA, 30 bp, Artificial Sequence
  Description of Artificial Sequence: Synthetic oligonucleotide
gcgctcgaagatgaaccctttgtggaacac

SEQ ID NO: 125549 - DNA, 30 bp, Artificial Sequence
  Description of Artificial Sequence: Synthetic oligonucleotide
cgctcgaagatgaaccctttgtggaacacc

SEQ ID NO: 125550 - DNA, 32 bp, Artificial Sequence
  Description of Artificial Sequence: Synthetic oligonucleotide
gctcgaagatgaaccctttgtggaacaccatg

SEQ ID NO: 125551 - DNA, 32 bp, Artificial Sequence
  Description of Artificial Sequence: Synthetic oligonucleotide
ctcgaagatgaaccctttgtggaacaccatgg

SEQ ID NO: 125552 - DNA, 33 bp, Artificial Sequence
  Description of Artificial Sequence: Synthetic oligonucleotide
tcgaagatgaaccctttgtggaacaccatggtc

SEQ ID NO: 125553 - DNA, 32 bp, Artificial Sequence
  Description of Artificial Sequence: Synthetic oligonucleotide
cgaagatgaaccctttgtggaacaccatggtc

SEQ ID NO: 125554 - DNA, 34 bp, Artificial Sequence
  Description of Artificial Sequence: Synthetic oligonucleotide
gaagatgaaccctttgtggaacaccatggtcatc

SEQ ID NO: 125555 - DNA, 34 bp, Artificial Sequence
  Description of Artificial Sequence: Synthetic oligonucleotide
aagatgaaccctttgtggaacaccatggtcatcg

SEQ ID NO: 125556 - DNA, 33 bp, Artificial Sequence
  Description of Artificial Sequence: Synthetic oligonucleotide
agatgaaccctttgtggaacaccatggtcatcg

SEQ ID NO: 125557 - DNA, 32 bp, Artificial Sequence
  Description of Artificial Sequence: Synthetic oligonucleotide
gatgaaccctttgtggaacaccatggtcatcg

SEQ ID NO: 125558 - DNA, 32 bp, Artificial Sequence
  Description of Artificial Sequence: Synthetic oligonucleotide
atgaaccctttgtggaacaccatggtcatcgg

SEQ ID NO: 125559 - DNA, 31 bp, Artificial Sequence
  Description of Artificial Sequence: Synthetic oligonucleotide
tgaaccctttgtggaacaccatggtcatcgg

SEQ ID NO: 125560 - DNA, 30 bp, Artificial Sequence
  Description of Artificial Sequence: Synthetic oligonucleotide
gaaccctttgtggaacaccatggtcatcgg

SEQ ID NO: 125561 - DNA, 31 bp, Artificial Sequence
  Description of Artificial Sequence: Synthetic oligonucleotide
aaccctttgtggaacaccatggtcatcggag

SEQ ID NO: 125562 - DNA, 30 bp, Artificial Sequence
  Description of Artificial Sequence: Synthetic oligonucleotide
accctttgtggaacaccatggtcatcggag

SEQ ID NO: 125563 - DNA, 29 bp, Artificial Sequence
  Description of Artificial Sequence: Synthetic oligonucleotide
ccctttgtggaacaccatggtcatcggag

SEQ ID NO: 125564 - DNA, 29 bp, Artificial Sequence
  Description of Artificial Sequence: Synthetic oligonucleotide
cctttgtggaacaccatggtcatcggagg

SEQ ID NO: 125565 - DNA, 29 bp, Artificial Sequence
  Description of Artificial Sequence: Synthetic oligonucleotide
ctttgtggaacaccatggtcatcggaggc

SEQ ID NO: 125566 - DNA, 32 bp, Artificial Sequence
  Description of Artificial Sequence: Synthetic oligonucleotide
tttgtggaacaccatggtcatcggaggctatg

SEQ ID NO: 125567 - DNA, 31 bp, Artificial Sequence
  Description of Artificial Sequence: Synthetic oligonucleotide
ttgtggaacaccatggtcatcggaggctatg

SEQ ID NO: 125568 - DNA, 30 bp, Artificial Sequence
  Description of Artificial Sequence: Synthetic oligonucleotide
tgtggaacaccatggtcatcggaggctatg

SEQ ID NO: 125569 - DNA, 29 bp, Artificial Sequence
  Description of Artificial Sequence: Synthetic oligonucleotide
gtggaacaccatggtcatcggaggctatg

SEQ ID NO: 125570 - DNA, 29 bp, Artificial Sequence
  Description of Artificial Sequence: Synthetic oligonucleotide
tggaacaccatggtcatcggaggctatgc

SEQ ID NO: 125571 - DNA, 28 bp, Artificial Sequence
  Description of Artificial Sequence: Synthetic oligonucleotide
ggaacaccatggtcatcggaggctatgc

SEQ ID NO: 125572 - DNA, 29 bp, Artificial Sequence
  Description of Artificial Sequence: Synthetic oligonucleotide
gaacaccatggtcatcggaggctatgctg

SEQ ID NO: 125573 - DNA, 31 bp, Artificial Sequence
  Description of Artificial Sequence: Synthetic oligonucleotide
aacaccatggtcatcggaggctatgctgatg

SEQ ID NO: 125574 - DNA, 30 bp, Artificial Sequence
  Description of Artificial Sequence: Synthetic oligonucleotide
acaccatggtcatcggaggctatgctgatg

SEQ ID NO: 125575 - DNA, 29 bp, Artificial Sequence
  Description of Artificial Sequence: Synthetic oligonucleotide
caccatggtcatcggaggctatgctgatg

SEQ ID NO: 125576 - DNA, 29 bp, Artificial Sequence
  Description of Artificial Sequence: Synthetic oligonucleotide
accatggtcatcggaggctatgctgatgg

SEQ ID NO: 125577 - DNA, 28 bp, Artificial Sequence
  Description of Artificial Sequence: Synthetic oligonucleotide
ccatggtcatcggaggctatgctgatgg

SEQ ID NO: 125578 - DNA, 29 bp, Artificial Sequence
  Description of Artificial Sequence: Synthetic oligonucleotide
catggtcatcggaggctatgctgatggag

SEQ ID NO: 125579 - DNA, 30 bp, Artificial Sequence
  Description of Artificial Sequence: Synthetic oligonucleotide
atggtcatcggaggctatgctgatggagag

SEQ ID NO: 125580 - DNA, 29 bp, Artificial Sequence
  Description of Artificial Sequence: Synthetic oligonucleotide
tggtcatcggaggctatgctgatggagag

SEQ ID NO: 125581 - DNA, 28 bp, Artificial Sequence
  Description of Artificial Sequence: Synthetic oligonucleotide
ggtcatcggaggctatgctgatggagag

SEQ ID NO: 125582 - DNA, 29 bp, Artificial Sequence
  Description of Artificial Sequence: Synthetic oligonucleotide
gtcatcggaggctatgctgatggagagag

SEQ ID NO: 125583 - DNA, 29 bp, Artificial Sequence
  Description of Artificial Sequence: Synthetic oligonucleotide
tcatcggaggctatgctgatggagagagc

SEQ ID NO: 125584 - DNA, 28 bp, Artificial Sequence
  Description of Artificial Sequence: Synthetic oligonucleotide
catcggaggctatgctgatggagagagc

SEQ ID NO: 125585 - DNA, 30 bp, Artificial Sequence
  Description of Artificial Sequence: Synthetic oligonucleotide
atcggaggctatgctgatggagagagcttc

SEQ ID NO: 125586 - DNA, 29 bp, Artificial Sequence
  Description of Artificial Sequence: Synthetic oligonucleotide
tcggaggctatgctgatggagagagcttc

SEQ ID NO: 125587 - DNA, 28 bp, Artificial Sequence
  Description of Artificial Sequence: Synthetic oligonucleotide
cggaggctatgctgatggagagagcttc

SEQ ID NO: 125588 - DNA, 28 bp, Artificial Sequence
  Description of Artificial Sequence: Synthetic oligonucleotide
ggaggctatgctgatggagagagcttcc

SEQ ID NO: 125589 - DNA, 29 bp, Artificial Sequence
  Description of Artificial Sequence: Synthetic oligonucleotide
gaggctatgctgatggagagagcttcctc

SEQ ID NO: 125590 - DNA, 29 bp, Artificial Sequence
  Description of Artificial Sequence: Synthetic oligonucleotide
aggctatgctgatggagagagcttcctcg

SEQ ID NO: 125591 - DNA, 28 bp, Artificial Sequence
  Description of Artificial Sequence: Synthetic oligonucleotide
ggctatgctgatggagagagcttcctcg

SEQ ID NO: 125592 - DNA, 28 bp, Artificial Sequence
  Description of Artificial Sequence: Synthetic oligonucleotide
gctatgctgatggagagagcttcctcgg

SEQ ID NO: 125593 - DNA, 32 bp, Artificial Sequence
  Description of Artificial Sequence: Synthetic oligonucleotide
ctatgctgatggagagagcttcctcggttatg

SEQ ID NO: 125594 - DNA, 33 bp, Artificial Sequence
  Description of Artificial Sequence: Synthetic oligonucleotide
tatgctgatggagagagcttcctcggttatgtg

SEQ ID NO: 125595 - DNA, 32 bp, Artificial Sequence
  Description of Artificial Sequence: Synthetic oligonucleotide
atgctgatggagagagcttcctcggttatgtg

SEQ ID NO: 125596 - DNA, 31 bp, Artificial Sequence
  Description of Artificial Sequence: Synthetic oligonucleotide
tgctgatggagagagcttcctcggttatgtg

SEQ ID NO: 125597 - DNA, 30 bp, Artificial Sequence
  Description of Artificial Sequence: Synthetic oligonucleotide
gctgatggagagagcttcctcggttatgtg

SEQ ID NO: 125598 - DNA, 30 bp, Artificial Sequence
  Description of Artificial Sequence: Synthetic oligonucleotide
ctgatggagagagcttcctcggttatgtgg

SEQ ID NO: 125599 - DNA, 31 bp, Artificial Sequence
  Description of Artificial Sequence: Synthetic oligonucleotide
tgatggagagagcttcctcggttatgtggac

SEQ ID NO: 125600 - DNA, 30 bp, Artificial Sequence
  Description of Artificial Sequence: Synthetic oligonucleotide
gatggagagagcttcctcggttatgtggac

SEQ ID NO: 125601 - DNA, 32 bp, Artificial Sequence
  Description of Artificial Sequence: Synthetic oligonucleotide
atggagagagcttcctcggttatgtggacatg

SEQ ID NO: 125602 - DNA, 31 bp, Artificial Sequence
  Description of Artificial Sequence: Synthetic oligonucleotide
tggagagagcttcctcggttatgtggacatg

SEQ ID NO: 125603 - DNA, 30 bp, Artificial Sequence
  Description of Artificial Sequence: Synthetic oligonucleotide
ggagagagcttcctcggttatgtggacatg

SEQ ID NO: 125604 - DNA, 30 bp, Artificial Sequence
  Description of Artificial Sequence: Synthetic oligonucleotide
gagagagcttcctcggttatgtggacatgc

SEQ ID NO: 125605 - DNA, 32 bp, Artificial Sequence
  Description of Artificial Sequence: Synthetic oligonucleotide
agagagcttcctcggttatgtggacatgcttg

SEQ ID NO: 125606 - DNA, 31 bp, Artificial Sequence
  Description of Artificial Sequence: Synthetic oligonucleotide
gagagcttcctcggttatgtggacatgcttg

SEQ ID NO: 125607 - DNA, 31 bp, Artificial Sequence
  Description of Artificial Sequence: Synthetic oligonucleotide
agagcttcctcggttatgtggacatgcttgg

SEQ ID NO: 125608 - DNA, 30 bp, Artificial Sequence
  Description of Artificial Sequence: Synthetic oligonucleotide
gagcttcctcggttatgtggacatgcttgg

SEQ ID NO: 125609 - DNA, 31 bp, Artificial Sequence
  Description of Artificial Sequence: Synthetic oligonucleotide
agcttcctcggttatgtggacatgcttggtg

SEQ ID NO: 125610 - DNA, 30 bp, Artificial Sequence
  Description of Artificial Sequence: Synthetic oligonucleotide
gcttcctcggttatgtggacatgcttggtg

SEQ ID NO: 125611 - DNA, 32 bp, Artificial Sequence
  Description of Artificial Sequence: Synthetic oligonucleotide
cttcctcggttatgtggacatgcttggtgtag

SEQ ID NO: 125612 - DNA, 32 bp, Artificial Sequence
  Description of Artificial Sequence: Synthetic oligonucleotide
ttcctcggttatgtggacatgcttggtgtagc

SEQ ID NO: 125613 - DNA, 31 bp, Artificial Sequence
  Description of Artificial Sequence: Synthetic oligonucleotide
tcctcggttatgtggacatgcttggtgtagc

SEQ ID NO: 125614 - DNA, 30 bp, Artificial Sequence
  Description of Artificial Sequence: Synthetic oligonucleotide
cctcggttatgtggacatgcttggtgtagc

SEQ ID NO: 125615 - DNA, 30 bp, Artificial Sequence
  Description of Artificial Sequence: Synthetic oligonucleotide
ctcggttatgtggacatgcttggtgtagcc

SEQ ID NO: 125616 - DNA, 33 bp, Artificial Sequence
  Description of Artificial Sequence: Synthetic oligonucleotide
tcggttatgtggacatgcttggtgtagcctatg

SEQ ID NO: 125617 - DNA, 32 bp, Artificial Sequence
  Description of Artificial Sequence: Synthetic oligonucleotide
cggttatgtggacatgcttggtgtagcctatg

SEQ ID NO: 125618 - DNA, 34 bp, Artificial Sequence
  Description of Artificial Sequence: Synthetic oligonucleotide
ggttatgtggacatgcttggtgtagcctatgaag

SEQ ID NO: 125619 - DNA, 34 bp, Artificial Sequence
  Description of Artificial Sequence: Synthetic oligonucleotide
gttatgtggacatgcttggtgtagcctatgaagc

SEQ ID NO: 125620 - DNA, 34 bp, Artificial Sequence
  Description of Artificial Sequence: Synthetic oligonucleotide
ttatgtggacatgcttggtgtagcctatgaagcc

SEQ ID NO: 125621 - DNA, 33 bp, Artificial Sequence
  Description of Artificial Sequence: Synthetic oligonucleotide
tatgtggacatgcttggtgtagcctatgaagcc

SEQ ID NO: 125622 - DNA, 32 bp, Artificial Sequence
  Description of Artificial Sequence: Synthetic oligonucleotide
atgtggacatgcttggtgtagcctatgaagcc

SEQ ID NO: 125623 - DNA, 31 bp, Artificial Sequence
  Description of Artificial Sequence: Synthetic oligonucleotide
tgtggacatgcttggtgtagcctatgaagcc

SEQ ID NO: 125624 - DNA, 30 bp, Artificial Sequence
  Description of Artificial Sequence: Synthetic oligonucleotide
gtggacatgcttggtgtagcctatgaagcc

SEQ ID NO: 125625 - DNA, 30 bp, Artificial Sequence
  Description of Artificial Sequence: Synthetic oligonucleotide
tggacatgcttggtgtagcctatgaagccc

SEQ ID NO: 125626 - DNA, 29 bp, Artificial Sequence
  Description of Artificial Sequence: Synthetic oligonucleotide
ggacatgcttggtgtagcctatgaagccc

SEQ ID NO: 125627 - DNA, 29 bp, Artificial Sequence
  Description of Artificial Sequence: Synthetic oligonucleotide
gacatgcttggtgtagcctatgaagcccc

SEQ ID NO: 125628 - DNA, 31 bp, Artificial Sequence
  Description of Artificial Sequence: Synthetic oligonucleotide
acatgcttggtgtagcctatgaagccccttc

SEQ ID NO: 125629 - DNA, 30 bp, Artificial Sequence
  Description of Artificial Sequence: Synthetic oligonucleotide
catgcttggtgtagcctatgaagccccttc

SEQ ID NO: 125630 - DNA, 30 bp, Artificial Sequence
  Description of Artificial Sequence: Synthetic oligonucleotide
atgcttggtgtagcctatgaagccccttcg

SEQ ID NO: 125631 - DNA, 29 bp, Artificial Sequence
  Description of Artificial Sequence: Synthetic oligonucleotide
tgcttggtgtagcctatgaagccccttcg

SEQ ID NO: 125632 - DNA, 28 bp, Artificial Sequence
  Description of Artificial Sequence: Synthetic oligonucleotide
gcttggtgtagcctatgaagccccttcg

SEQ ID NO: 125633 - DNA, 28 bp, Artificial Sequence
  Description of Artificial Sequence: Synthetic oligonucleotide
cttggtgtagcctatgaagccccttcgc

SEQ ID NO: 125634 - DNA, 29 bp, Artificial Sequence
  Description of Artificial Sequence: Synthetic oligonucleotide
ttggtgtagcctatgaagccccttcgctg

SEQ ID NO: 125635 - DNA, 28 bp, Artificial Sequence
  Description of Artificial Sequence: Synthetic oligonucleotide
tggtgtagcctatgaagccccttcgctg

SEQ ID NO: 125636 - DNA, 27 bp, Artificial Sequence
  Description of Artificial Sequence: Synthetic oligonucleotide
ggtgtagcctatgaagccccttcgctg

SEQ ID NO: 125637 - DNA, 27 bp, Artificial Sequence
  Description of Artificial Sequence: Synthetic oligonucleotide
gtgtagcctatgaagccccttcgctgg

SEQ ID NO: 125638 - DNA, 27 bp, Artificial Sequence
  Description of Artificial Sequence: Synthetic oligonucleotide
tgtagcctatgaagccccttcgctggc

SEQ ID NO: 125639 - DNA, 26 bp, Artificial Sequence
  Description of Artificial Sequence: Synthetic oligonucleotide
gtagcctatgaagccccttcgctggc

SEQ ID NO: 125640 - DNA, 27 bp, Artificial Sequence
  Description of Artificial Sequence: Synthetic oligonucleotide
tagcctatgaagccccttcgctggcca

SEQ ID NO: 125641 - DNA, 26 bp, Artificial Sequence
  Description of Artificial Sequence: Synthetic oligonucleotide
agcctatgaagccccttcgctggcca

SEQ ID NO: 125642 - DNA, 25 bp, Artificial Sequence
  Description of Artificial Sequence: Synthetic oligonucleotide
gcctatgaagccccttcgctggcca

SEQ ID NO: 125643 - DNA, 26 bp, Artificial Sequence
  Description of Artificial Sequence: Synthetic oligonucleotide
cctatgaagccccttcgctggccact

SEQ ID NO: 125644 - DNA, 26 bp, Artificial Sequence
  Description of Artificial Sequence: Synthetic oligonucleotide
ctatgaagccccttcgctggccactg

SEQ ID NO: 125645 - DNA, 27 bp, Artificial Sequence
  Description of Artificial Sequence: Synthetic oligonucleotide
tatgaagccccttcgctggccactggt

SEQ ID NO: 125646 - DNA, 27 bp, Artificial Sequence
  Description of Artificial Sequence: Synthetic oligonucleotide
atgaagccccttcgctggccactggtt

SEQ ID NO: 125647 - DNA, 27 bp, Artificial Sequence
  Description of Artificial Sequence: Synthetic oligonucleotide
tgaagccccttcgctggccactggtta

SEQ ID NO: 125648 - DNA, 27 bp, Artificial Sequence
  Description of Artificial Sequence: Synthetic oligonucleotide
gaagccccttcgctggccactggttat

SEQ ID NO: 125649 - DNA, 27 bp, Artificial Sequence
  Description of Artificial Sequence: Synthetic oligonucleotide
aagccccttcgctggccactggttatg

SEQ ID NO: 125650 - DNA, 26 bp, Artificial Sequence
  Description of Artificial Sequence: Synthetic oligonucleotide
agccccttcgctggccactggttatg

SEQ ID NO: 125651 - DNA, 25 bp, Artificial Sequence
  Description of Artificial Sequence: Synthetic oligonucleotide
gccccttcgctggccactggttatg

SEQ ID NO: 125652 - DNA, 26 bp, Artificial Sequence
  Description of Artificial Sequence: Synthetic oligonucleotide
ccccttcgctggccactggttatggt

SEQ ID NO: 125653 - DNA, 26 bp, Artificial Sequence
  Description of Artificial Sequence: Synthetic oligonucleotide
cccttcgctggccactggttatggtg

SEQ ID NO: 125654 - DNA, 27 bp, Artificial Sequence
  Description of Artificial Sequence: Synthetic oligonucleotide
ccttcgctggccactggttatggtgca

SEQ ID NO: 125655 - DNA, 29 bp, Artificial Sequence
  Description of Artificial Sequence: Synthetic oligonucleotide
cttcgctggccactggttatggtgcatac

SEQ ID NO: 125656 - DNA, 31 bp, Artificial Sequence
  Description of Artificial Sequence: Synthetic oligonucleotide
ttcgctggccactggttatggtgcatacttg

SEQ ID NO: 125657 - DNA, 30 bp, Artificial Sequence
  Description of Artificial Sequence: Synthetic oligonucleotide
tcgctggccactggttatggtgcatacttg

SEQ ID NO: 125658 - DNA, 29 bp, Artificial Sequence
  Description of Artificial Sequence: Synthetic oligonucleotide
cgctggccactggttatggtgcatacttg

SEQ ID NO: 125659 - DNA, 29 bp, Artificial Sequence
  Description of Artificial Sequence: Synthetic oligonucleotide
gctggccactggttatggtgcatacttgg

SEQ ID NO: 125660 - DNA, 29 bp, Artificial Sequence
  Description of Artificial Sequence: Synthetic oligonucleotide
ctggccactggttatggtgcatacttggc

SEQ ID NO: 125661 - DNA, 30 bp, Artificial Sequence
  Description of Artificial Sequence: Synthetic oligonucleotide
tggccactggttatggtgcatacttggctc

SEQ ID NO: 125662 - DNA, 29 bp, Artificial Sequence
  Description of Artificial Sequence: Synthetic oligonucleotide
ggccactggttatggtgcatacttggctc

SEQ ID NO: 125663 - DNA, 30 bp, Artificial Sequence
  Description of Artificial Sequence: Synthetic oligonucleotide
gccactggttatggtgcatacttggctcag

SEQ ID NO: 125664 - DNA, 30 bp, Artificial Sequence
  Description of Artificial Sequence: Synthetic oligonucleotide
ccactggttatggtgcatacttggctcagc

SEQ ID NO: 125665 - DNA, 30 bp, Artificial Sequence
  Description of Artificial Sequence: Synthetic oligonucleotide
cactggttatggtgcatacttggctcagcc

SEQ ID NO: 125666 - DNA, 31 bp, Artificial Sequence
  Description of Artificial Sequence: Synthetic oligonucleotide
actggttatggtgcatacttggctcagcctc

SEQ ID NO: 125667 - DNA, 30 bp, Artificial Sequence
  Description of Artificial Sequence: Synthetic oligonucleotide
ctggttatggtgcatacttggctcagcctc

SEQ ID NO: 125668 - DNA, 31 bp, Artificial Sequence
  Description of Artificial Sequence: Synthetic oligonucleotide
tggttatggtgcatacttggctcagcctctg

SEQ ID NO: 125669 - DNA, 30 bp, Artificial Sequence
  Description of Artificial Sequence: Synthetic oligonucleotide
ggttatggtgcatacttggctcagcctctg

SEQ ID NO: 125670 - DNA, 30 bp, Artificial Sequence
  Description of Artificial Sequence: Synthetic oligonucleotide
gttatggtgcatacttggctcagcctctgc

SEQ ID NO: 125671 - DNA, 31 bp, Artificial Sequence
  Description of Artificial Sequence: Synthetic oligonucleotide
ttatggtgcatacttggctcagcctctgctg

SEQ ID NO: 125672 - DNA, 30 bp, Artificial Sequence
  Description of Artificial Sequence: Synthetic oligonucleotide
tatggtgcatacttggctcagcctctgctg

SEQ ID NO: 125673 - DNA, 29 bp, Artificial Sequence
  Description of Artificial Sequence: Synthetic oligonucleotide
atggtgcatacttggctcagcctctgctg

SEQ ID NO: 125674 - DNA, 28 bp, Artificial Sequence
  Description of Artificial Sequence: Synthetic oligonucleotide
tggtgcatacttggctcagcctctgctg

SEQ ID NO: 125675 - DNA, 27 bp, Artificial Sequence
  Description of Artificial Sequence: Synthetic oligonucleotide
ggtgcatacttggctcagcctctgctg

SEQ ID NO: 125676 - DNA, 27 bp, Artificial Sequence
  Description of Artificial Sequence: Synthetic oligonucleotide
gtgcatacttggctcagcctctgctgc

SEQ ID NO: 125677 - DNA, 27 bp, Artificial Sequence
  Description of Artificial Sequence: Synthetic oligonucleotide
tgcatacttggctcagcctctgctgcg

SEQ ID NO: 125678 - DNA, 27 bp, Artificial Sequence
  Description of Artificial Sequence: Synthetic oligonucleotide
gcatacttggctcagcctctgctgcga

SEQ ID NO: 125679 - DNA, 27 bp, Artificial Sequence
  Description of Artificial Sequence: Synthetic oligonucleotide
catacttggctcagcctctgctgcgag

SEQ ID NO: 125680 - DNA, 29 bp, Artificial Sequence
  Description of Artificial Sequence: Synthetic oligonucleotide
atacttggctcagcctctgctgcgagaag

SEQ ID NO: 125681 - DNA, 28 bp, Artificial Sequence
  Description of Artificial Sequence: Synthetic oligonucleotide
tacttggctcagcctctgctgcgagaag

SEQ ID NO: 125682 - DNA, 27 bp, Artificial Sequence
  Description of Artificial Sequence: Synthetic oligonucleotide
acttggctcagcctctgctgcgagaag

SEQ ID NO: 125683 - DNA, 27 bp, Artificial Sequence
  Description of Artificial Sequence: Synthetic oligonucleotide
cttggctcagcctctgctgcgagaagt

SEQ ID NO: 125684 - DNA, 28 bp, Artificial Sequence
  Description of Artificial Sequence: Synthetic oligonucleotide
ttggctcagcctctgctgcgagaagttc

SEQ ID NO: 125685 - DNA, 27 bp, Artificial Sequence
  Description of Artificial Sequence: Synthetic oligonucleotide
tggctcagcctctgctgcgagaagttc

SEQ ID NO: 125686 - DNA, 27 bp, Artificial Sequence
  Description of Artificial Sequence: Synthetic oligonucleotide
ggctcagcctctgctgcgagaagttct

SEQ ID NO: 125687 - DNA, 27 bp, Artificial Sequence
  Description of Artificial Sequence: Synthetic oligonucleotide
gctcagcctctgctgcgagaagttctg

SEQ ID NO: 125688 - DNA, 27 bp, Artificial Sequence
  Description of Artificial Sequence: Synthetic oligonucleotide
ctcagcctctgctgcgagaagttctgg

SEQ ID NO: 125689 - DNA, 28 bp, Artificial Sequence
  Description of Artificial Sequence: Synthetic oligonucleotide
tcagcctctgctgcgagaagttctggag

SEQ ID NO: 125690 - DNA, 27 bp, Artificial Sequence
  Description of Artificial Sequence: Synthetic oligonucleotide
cagcctctgctgcgagaagttctggag

SEQ ID NO: 125691 - DNA, 29 bp, Artificial Sequence
  Description of Artificial Sequence: Synthetic oligonucleotide
agcctctgctgcgagaagttctggagaag

SEQ ID NO: 125692 - DNA, 28 bp, Artificial Sequence
  Description of Artificial Sequence: Synthetic oligonucleotide
gcctctgctgcgagaagttctggagaag

SEQ ID NO: 125693 - DNA, 28 bp, Artificial Sequence
  Description of Artificial Sequence: Synthetic oligonucleotide
cctctgctgcgagaagttctggagaagc

SEQ ID NO: 125694 - DNA, 29 bp, Artificial Sequence
  Description of Artificial Sequence: Synthetic oligonucleotide
ctctgctgcgagaagttctggagaagcag

SEQ ID NO: 125695 - DNA, 29 bp, Artificial Sequence
  Description of Artificial Sequence: Synthetic oligonucleotide
tctgctgcgagaagttctggagaagcagc

SEQ ID NO: 125696 - DNA, 28 bp, Artificial Sequence
  Description of Artificial Sequence: Synthetic oligonucleotide
ctgctgcgagaagttctggagaagcagc

SEQ ID NO: 125697 - DNA, 28 bp, Artificial Sequence
  Description of Artificial Sequence: Synthetic oligonucleotide
tgctgcgagaagttctggagaagcagcc

SEQ ID NO: 125698 - DNA, 27 bp, Artificial Sequence
  Description of Artificial Sequence: Synthetic oligonucleotide
gctgcgagaagttctggagaagcagcc

SEQ ID NO: 125699 - DNA, 28 bp, Artificial Sequence
  Description of Artificial Sequence: Synthetic oligonucleotide
ctgcgagaagttctggagaagcagccag

SEQ ID NO: 125700 - DNA, 29 bp, Artificial Sequence
  Description of Artificial Sequence: Synthetic oligonucleotide
tgcgagaagttctggagaagcagccagtg

SEQ ID NO: 125701 - DNA, 28 bp, Artificial Sequence
  Description of Artificial Sequence: Synthetic oligonucleotide
gcgagaagttctggagaagcagccagtg

SEQ ID NO: 125702 - DNA, 28 bp, Artificial Sequence
  Description of Artificial Sequence: Synthetic oligonucleotide
cgagaagttctggagaagcagccagtgc

SEQ ID NO: 125703 - DNA, 31 bp, Artificial Sequence
  Description of Artificial Sequence: Synthetic oligonucleotide
gagaagttctggagaagcagccagtgctaag

SEQ ID NO: 125704 - DNA, 31 bp, Artificial Sequence
  Description of Artificial Sequence: Synthetic oligonucleotide
agaagttctggagaagcagccagtgctaagc

SEQ ID NO: 125705 - DNA, 30 bp, Artificial Sequence
  Description of Artificial Sequence: Synthetic oligonucleotide
gaagttctggagaagcagccagtgctaagc

SEQ ID NO: 125706 - DNA, 30 bp, Artificial Sequence
  Description of Artificial Sequence: Synthetic oligonucleotide
aagttctggagaagcagccagtgctaagcc

SEQ ID NO: 125707 - DNA, 29 bp, Artificial Sequence
  Description of Artificial Sequence: Synthetic oligonucleotide
agttctggagaagcagccagtgctaagcc

SEQ ID NO: 125708 - DNA, 28 bp, Artificial Sequence
  Description of Artificial Sequence: Synthetic oligonucleotide
gttctggagaagcagccagtgctaagcc

SEQ ID NO: 125709 - DNA, 29 bp, Artificial Sequence
  Description of Artificial Sequence: Synthetic oligonucleotide
ttctggagaagcagccagtgctaagccag

SEQ ID NO: 125710 - DNA, 28 bp, Artificial Sequence
  Description of Artificial Sequence: Synthetic oligonucleotide
tctggagaagcagccagtgctaagccag

SEQ ID NO: 125711 - DNA, 27 bp, Artificial Sequence
  Description of Artificial Sequence: Synthetic oligonucleotide
ctggagaagcagccagtgctaagccag

SEQ ID NO: 125712 - DNA, 28 bp, Artificial Sequence
  Description of Artificial Sequence: Synthetic oligonucleotide
tggagaagcagccagtgctaagccagac

SEQ ID NO: 125713 - DNA, 27 bp, Artificial Sequence
  Description of Artificial Sequence: Synthetic oligonucleotide
ggagaagcagccagtgctaagccagac

SEQ ID NO: 125714 - DNA, 27 bp, Artificial Sequence
  Description of Artificial Sequence: Synthetic oligonucleotide
gagaagcagccagtgctaagccagacc

SEQ ID NO: 125715 - DNA, 27 bp, Artificial Sequence
  Description of Artificial Sequence: Synthetic oligonucleotide
agaagcagccagtgctaagccagaccg

SEQ ID NO: 125716 - DNA, 27 bp, Artificial Sequence
  Description of Artificial Sequence: Synthetic oligonucleotide
gaagcagccagtgctaagccagaccga

SEQ ID NO: 125717 - DNA, 27 bp, Artificial Sequence
  Description of Artificial Sequence: Synthetic oligonucleotide
aagcagccagtgctaagccagaccgag

SEQ ID NO: 125718 - DNA, 26 bp, Artificial Sequence
  Description of Artificial Sequence: Synthetic oligonucleotide
agcagccagtgctaagccagaccgag

SEQ ID NO: 125719 - DNA, 25 bp, Artificial Sequence
  Description of Artificial Sequence: Synthetic oligonucleotide
gcagccagtgctaagccagaccgag

SEQ ID NO: 125720 - DNA, 25 bp, Artificial Sequence
  Description of Artificial Sequence: Synthetic oligonucleotide
cagccagtgctaagccagaccgagg

SEQ ID NO: 125721 - DNA, 25 bp, Artificial Sequence
  Description of Artificial Sequence: Synthetic oligonucleotide
agccagtgctaagccagaccgaggc

SEQ ID NO: 125722 - DNA, 24 bp, Artificial Sequence
  Description of Artificial Sequence: Synthetic oligonucleotide
gccagtgctaagccagaccgaggc

SEQ ID NO: 125723 - DNA, 24 bp, Artificial Sequence
  Description of Artificial Sequence: Synthetic oligonucleotide
ccagtgctaagccagaccgaggcc

SEQ ID NO: 125724 - DNA, 24 bp, Artificial Sequence
  Description of Artificial Sequence: Synthetic oligonucleotide
cagtgctaagccagaccgaggccc

SEQ ID NO: 125725 - DNA, 24 bp, Artificial Sequence
  Description of Artificial Sequence: Synthetic oligonucleotide
agtgctaagccagaccgaggcccg

SEQ ID NO: 125726 - DNA, 23 bp, Artificial Sequence
  Description of Artificial Sequence: Synthetic oligonucleotide
gtgctaagccagaccgaggcccg

SEQ ID NO: 125727 - DNA, 23 bp, Artificial Sequence
  Description of Artificial Sequence: Synthetic oligonucleotide
tgctaagccagaccgaggcccgc

SEQ ID NO: 125728 - DNA, 22 bp, Artificial Sequence
  Description of Artificial Sequence: Synthetic oligonucleotide
gctaagccagaccgaggcccgc

SEQ ID NO: 125729 - DNA, 23 bp, Artificial Sequence
  Description of Artificial Sequence: Synthetic oligonucleotide
ctaagccagaccgaggcccgcga

SEQ ID NO: 125730 - DNA, 26 bp, Artificial Sequence
  Description of Artificial Sequence: Synthetic oligonucleotide
taagccagaccgaggcccgcgactta

SEQ ID NO: 125731 - DNA, 25 bp, Artificial Sequence
  Description of Artificial Sequence: Synthetic oligonucleotide
aagccagaccgaggcccgcgactta

SEQ ID NO: 125732 - DNA, 24 bp, Artificial Sequence
  Description of Artificial Sequence: Synthetic oligonucleotide
agccagaccgaggcccgcgactta

SEQ ID NO: 125733 - DNA, 23 bp, Artificial Sequence
  Description of Artificial Sequence: Synthetic oligonucleotide
gccagaccgaggcccgcgactta

SEQ ID NO: 125734 - DNA, 25 bp, Artificial Sequence
  Description of Artificial Sequence: Synthetic oligonucleotide
ccagaccgaggcccgcgacttagta

SEQ ID NO: 125735 - DNA, 27 bp, Artificial Sequence
  Description of Artificial Sequence: Synthetic oligonucleotide
cagaccgaggcccgcgacttagtagaa

SEQ ID NO: 125736 - DNA, 27 bp, Artificial Sequence
  Description of Artificial Sequence: Synthetic oligonucleotide
agaccgaggcccgcgacttagtagaac

SEQ ID NO: 125737 - DNA, 26 bp, Artificial Sequence
  Description of Artificial Sequence: Synthetic oligonucleotide
gaccgaggcccgcgacttagtagaac

SEQ ID NO: 125738 - DNA, 26 bp, Artificial Sequence
  Description of Artificial Sequence: Synthetic oligonucleotide
accgaggcccgcgacttagtagaacg

SEQ ID NO: 125739 - DNA, 25 bp, Artificial Sequence
  Description of Artificial Sequence: Synthetic oligonucleotide
ccgaggcccgcgacttagtagaacg

SEQ ID NO: 125740 - DNA, 26 bp, Artificial Sequence
  Description of Artificial Sequence: Synthetic oligonucleotide
cgaggcccgcgacttagtagaacgct

SEQ ID NO: 125741 - DNA, 26 bp, Artificial Sequence
  Description of Artificial Sequence: Synthetic oligonucleotide
gaggcccgcgacttagtagaacgctg

SEQ ID NO: 125742 - DNA, 27 bp, Artificial Sequence
  Description of Artificial Sequence: Synthetic oligonucleotide
aggcccgcgacttagtagaacgctgca

SEQ ID NO: 125743 - DNA, 27 bp, Artificial Sequence
  Description of Artificial Sequence: Synthetic oligonucleotide
ggcccgcgacttagtagaacgctgcat

SEQ ID NO: 125744 - DNA, 27 bp, Artificial Sequence
  Description of Artificial Sequence: Synthetic oligonucleotide
gcccgcgacttagtagaacgctgcatg

SEQ ID NO: 125745 - DNA, 27 bp, Artificial Sequence
  Description of Artificial Sequence: Synthetic oligonucleotide
cccgcgacttagtagaacgctgcatgc

SEQ ID NO: 125746 - DNA, 27 bp, Artificial Sequence
  Description of Artificial Sequence: Synthetic oligonucleotide
ccgcgacttagtagaacgctgcatgcg

SEQ ID NO: 125747 - DNA, 28 bp, Artificial Sequence
  Description of Artificial Sequence: Synthetic oligonucleotide
cgcgacttagtagaacgctgcatgcgag

SEQ ID NO: 125748 - DNA, 29 bp, Artificial Sequence
  Description of Artificial Sequence: Synthetic oligonucleotide
gcgacttagtagaacgctgcatgcgagtg

SEQ ID NO: 125749 - DNA, 29 bp, Artificial Sequence
  Description of Artificial Sequence: Synthetic oligonucleotide
cgacttagtagaacgctgcatgcgagtgc

SEQ ID NO: 125750 - DNA, 30 bp, Artificial Sequence
  Description of Artificial Sequence: Synthetic oligonucleotide
gacttagtagaacgctgcatgcgagtgctg

SEQ ID NO: 125751 - DNA, 32 bp, Artificial Sequence
  Description of Artificial Sequence: Synthetic oligonucleotide
acttagtagaacgctgcatgcgagtgctgtac

SEQ ID NO: 125752 - DNA, 31 bp, Artificial Sequence
  Description of Artificial Sequence: Synthetic oligonucleotide
cttagtagaacgctgcatgcgagtgctgtac

SEQ ID NO: 125753 - DNA, 33 bp, Artificial Sequence
  Description of Artificial Sequence: Synthetic oligonucleotide
ttagtagaacgctgcatgcgagtgctgtactac

SEQ ID NO: 125754 - DNA, 32 bp, Artificial Sequence
  Description of Artificial Sequence: Synthetic oligonucleotide
tagtagaacgctgcatgcgagtgctgtactac

SEQ ID NO: 125755 - DNA, 31 bp, Artificial Sequence
  Description of Artificial Sequence: Synthetic oligonucleotide
agtagaacgctgcatgcgagtgctgtactac

SEQ ID NO: 125756 - DNA, 30 bp, Artificial Sequence
  Description of Artificial Sequence: Synthetic oligonucleotide
gtagaacgctgcatgcgagtgctgtactac

SEQ ID NO: 125757 - DNA, 30 bp, Artificial Sequence
  Description of Artificial Sequence: Synthetic oligonucleotide
tagaacgctgcatgcgagtgctgtactacc

SEQ ID NO: 125758 - DNA, 29 bp, Artificial Sequence
  Description of Artificial Sequence: Synthetic oligonucleotide
agaacgctgcatgcgagtgctgtactacc

SEQ ID NO: 125759 - DNA, 28 bp, Artificial Sequence
  Description of Artificial Sequence: Synthetic oligonucleotide
gaacgctgcatgcgagtgctgtactacc

SEQ ID NO: 125760 - DNA, 28 bp, Artificial Sequence
  Description of Artificial Sequence: Synthetic oligonucleotide
aacgctgcatgcgagtgctgtactaccg

SEQ ID NO: 125761 - DNA, 27 bp, Artificial Sequence
  Description of Artificial Sequence: Synthetic oligonucleotide
acgctgcatgcgagtgctgtactaccg

SEQ ID NO: 125762 - DNA, 27 bp, Artificial Sequence
  Description of Artificial Sequence: Synthetic oligonucleotide
cgctgcatgcgagtgctgtactaccga

SEQ ID NO: 125763 - DNA, 27 bp, Artificial Sequence
  Description of Artificial Sequence: Synthetic oligonucleotide
gctgcatgcgagtgctgtactaccgag

SEQ ID NO: 125764 - DNA, 29 bp, Artificial Sequence
  Description of Artificial Sequence: Synthetic oligonucleotide
ctgcatgcgagtgctgtactaccgagatg

SEQ ID NO: 125765 - DNA, 29 bp, Artificial Sequence
  Description of Artificial Sequence: Synthetic oligonucleotide
tgcatgcgagtgctgtactaccgagatgc

SEQ ID NO: 125766 - DNA, 28 bp, Artificial Sequence
  Description of Artificial Sequence: Synthetic oligonucleotide
gcatgcgagtgctgtactaccgagatgc

SEQ ID NO: 125767 - DNA, 28 bp, Artificial Sequence
  Description of Artificial Sequence: Synthetic oligonucleotide
catgcgagtgctgtactaccgagatgcc

SEQ ID NO: 125768 - DNA, 28 bp, Artificial Sequence
  Description of Artificial Sequence: Synthetic oligonucleotide
atgcgagtgctgtactaccgagatgccc

SEQ ID NO: 125769 - DNA, 27 bp, Artificial Sequence
  Description of Artificial Sequence: Synthetic oligonucleotide
tgcgagtgctgtactaccgagatgccc

SEQ ID NO: 125770 - DNA, 26 bp, Artificial Sequence
  Description of Artificial Sequence: Synthetic oligonucleotide
gcgagtgctgtactaccgagatgccc

SEQ ID NO: 125771 - DNA, 27 bp, Artificial Sequence
  Description of Artificial Sequence: Synthetic oligonucleotide
cgagtgctgtactaccgagatgcccgt

SEQ ID NO: 125772 - DNA, 28 bp, Artificial Sequence
  Description of Artificial Sequence: Synthetic oligonucleotide
gagtgctgtactaccgagatgcccgttc

SEQ ID NO: 125773 - DNA, 31 bp, Artificial Sequence
  Description of Artificial Sequence: Synthetic oligonucleotide
agtgctgtactaccgagatgcccgttcttac

SEQ ID NO: 125774 - DNA, 30 bp, Artificial Sequence
  Description of Artificial Sequence: Synthetic oligonucleotide
gtgctgtactaccgagatgcccgttcttac

SEQ ID NO: 125775 - DNA, 32 bp, Artificial Sequence
  Description of Artificial Sequence: Synthetic oligonucleotide
tgctgtactaccgagatgcccgttcttacaac

SEQ ID NO: 125776 - DNA, 31 bp, Artificial Sequence
  Description of Artificial Sequence: Synthetic oligonucleotide
gctgtactaccgagatgcccgttcttacaac

SEQ ID NO: 125777 - DNA, 31 bp, Artificial Sequence
  Description of Artificial Sequence: Synthetic oligonucleotide
ctgtactaccgagatgcccgttcttacaacc

SEQ ID NO: 125778 - DNA, 31 bp, Artificial Sequence
  Description of Artificial Sequence: Synthetic oligonucleotide
tgtactaccgagatgcccgttcttacaaccg

SEQ ID NO: 125779 - DNA, 30 bp, Artificial Sequence
  Description of Artificial Sequence: Synthetic oligonucleotide
gtactaccgagatgcccgttcttacaaccg

SEQ ID NO: 125780 - DNA, 30 bp, Artificial Sequence
  Description of Artificial Sequence: Synthetic oligonucleotide
tactaccgagatgcccgttcttacaaccgg

SEQ ID NO: 125781 - DNA, 29 bp, Artificial Sequence
  Description of Artificial Sequence: Synthetic oligonucleotide
actaccgagatgcccgttcttacaaccgg

SEQ ID NO: 125782 - DNA, 28 bp, Artificial Sequence
  Description of Artificial Sequence: Synthetic oligonucleotide
ctaccgagatgcccgttcttacaaccgg

SEQ ID NO: 125783 - DNA, 31 bp, Artificial Sequence
  Description of Artificial Sequence: Synthetic oligonucleotide
taccgagatgcccgttcttacaaccggtttc

SEQ ID NO: 125784 - DNA, 30 bp, Artificial Sequence
  Description of Artificial Sequence: Synthetic oligonucleotide
accgagatgcccgttcttacaaccggtttc

SEQ ID NO: 125785 - DNA, 29 bp, Artificial Sequence
  Description of Artificial Sequence: Synthetic oligonucleotide
ccgagatgcccgttcttacaaccggtttc

SEQ ID NO: 125786 - DNA, 33 bp, Artificial Sequence
  Description of Artificial Sequence: Synthetic oligonucleotide
cgagatgcccgttcttacaaccggtttcaaatc

SEQ ID NO: 125787 - DNA, 33 bp, Artificial Sequence
  Description of Artificial Sequence: Synthetic oligonucleotide
gagatgcccgttcttacaaccggtttcaaatcg

SEQ ID NO: 125788 - DNA, 33 bp, Artificial Sequence
  Description of Artificial Sequence: Synthetic oligonucleotide
agatgcccgttcttacaaccggtttcaaatcgc

SEQ ID NO: 125789 - DNA, 32 bp, Artificial Sequence
  Description of Artificial Sequence: Synthetic oligonucleotide
gatgcccgttcttacaaccggtttcaaatcgc

SEQ ID NO: 125790 - DNA, 32 bp, Artificial Sequence
  Description of Artificial Sequence: Synthetic oligonucleotide
atgcccgttcttacaaccggtttcaaatcgcc

SEQ ID NO: 125791 - DNA, 31 bp, Artificial Sequence
  Description of Artificial Sequence: Synthetic oligonucleotide
tgcccgttcttacaaccggtttcaaatcgcc

SEQ ID NO: 125792 - DNA, 30 bp, Artificial Sequence
  Description of Artificial Sequence: Synthetic oligonucleotide
gcccgttcttacaaccggtttcaaatcgcc

SEQ ID NO: 125793 - DNA, 31 bp, Artificial Sequence
  Description of Artificial Sequence: Synthetic oligonucleotide
cccgttcttacaaccggtttcaaatcgccac

SEQ ID NO: 125794 - DNA, 32 bp, Artificial Sequence
  Description of Artificial Sequence: Synthetic oligonucleotide
ccgttcttacaaccggtttcaaatcgccactg

SEQ ID NO: 125795 - DNA, 33 bp, Artificial Sequence
  Description of Artificial Sequence: Synthetic oligonucleotide
cgttcttacaaccggtttcaaatcgccactgtc

SEQ ID NO: 125796 - DNA, 34 bp, Artificial Sequence
  Description of Artificial Sequence: Synthetic oligonucleotide
gttcttacaaccggtttcaaatcgccactgtcac

SEQ ID NO: 125797 - DNA, 34 bp, Artificial Sequence
  Description of Artificial Sequence: Synthetic oligonucleotide
ttcttacaaccggtttcaaatcgccactgtcacc

SEQ ID NO: 125798 - DNA, 33 bp, Artificial Sequence
  Description of Artificial Sequence: Synthetic oligonucleotide
tcttacaaccggtttcaaatcgccactgtcacc

SEQ ID NO: 125799 - DNA, 32 bp, Artificial Sequence
  Description of Artificial Sequence: Synthetic oligonucleotide
cttacaaccggtttcaaatcgccactgtcacc

SEQ ID NO: 125800 - DNA, 32 bp, Artificial Sequence
  Description of Artificial Sequence: Synthetic oligonucleotide
ttacaaccggtttcaaatcgccactgtcaccg

SEQ ID NO: 125801 - DNA, 31 bp, Artificial Sequence
  Description of Artificial Sequence: Synthetic oligonucleotide
tacaaccggtttcaaatcgccactgtcaccg

SEQ ID NO: 125802 - DNA, 30 bp, Artificial Sequence
  Description of Artificial Sequence: Synthetic oligonucleotide
acaaccggtttcaaatcgccactgtcaccg

SEQ ID NO: 125803 - DNA, 29 bp, Artificial Sequence
  Description of Artificial Sequence: Synthetic oligonucleotide
caaccggtttcaaatcgccactgtcaccg

SEQ ID NO: 125804 - DNA, 34 bp, Artificial Sequence
  Description of Artificial Sequence: Synthetic oligonucleotide
aaccggtttcaaatcgccactgtcaccgaaaaag

SEQ ID NO: 125805 - DNA, 33 bp, Artificial Sequence
  Description of Artificial Sequence: Synthetic oligonucleotide
accggtttcaaatcgccactgtcaccgaaaaag

SEQ ID NO: 125806 - DNA, 32 bp, Artificial Sequence
  Description of Artificial Sequence: Synthetic oligonucleotide
ccggtttcaaatcgccactgtcaccgaaaaag

SEQ ID NO: 125807 - DNA, 32 bp, Artificial Sequence
  Description of Artificial Sequence: Synthetic oligonucleotide
cggtttcaaatcgccactgtcaccgaaaaagg

SEQ ID NO: 125808 - DNA, 33 bp, Artificial Sequence
  Description of Artificial Sequence: Synthetic oligonucleotide
ggtttcaaatcgccactgtcaccgaaaaaggtg

SEQ ID NO: 125809 - DNA, 35 bp, Artificial Sequence
  Description of Artificial Sequence: Synthetic oligonucleotide
gtttcaaatcgccactgtcaccgaaaaaggtgttg

SEQ ID NO: 125810 - DNA, 40 bp, Artificial Sequence
  Description of Artificial Sequence: Synthetic oligonucleotide
tttcaaatcgccactgtcaccgaaaaaggtgttgaaatag

SEQ ID NO: 125811 - DNA, 39 bp, Artificial Sequence
  Description of Artificial Sequence: Synthetic oligonucleotide
ttcaaatcgccactgtcaccgaaaaaggtgttgaaatag

SEQ ID NO: 125812 - DNA, 38 bp, Artificial Sequence
  Description of Artificial Sequence: Synthetic oligonucleotide
tcaaatcgccactgtcaccgaaaaaggtgttgaaatag

SEQ ID NO: 125813 - DNA, 37 bp, Artificial Sequence
  Description of Artificial Sequence: Synthetic oligonucleotide
caaatcgccactgtcaccgaaaaaggtgttgaaatag

SEQ ID NO: 125814 - DNA, 38 bp, Artificial Sequence
  Description of Artificial Sequence: Synthetic oligonucleotide
aaatcgccactgtcaccgaaaaaggtgttgaaatagag

SEQ ID NO: 125815 - DNA, 37 bp, Artificial Sequence
  Description of Artificial Sequence: Synthetic oligonucleotide
aatcgccactgtcaccgaaaaaggtgttgaaatagag

SEQ ID NO: 125816 - DNA, 36 bp, Artificial Sequence
  Description of Artificial Sequence: Synthetic oligonucleotide
atcgccactgtcaccgaaaaaggtgttgaaatagag

SEQ ID NO: 125817 - DNA, 35 bp, Artificial Sequence
  Description of Artificial Sequence: Synthetic oligonucleotide
tcgccactgtcaccgaaaaaggtgttgaaatagag

SEQ ID NO: 125818 - DNA, 34 bp, Artificial Sequence
  Description of Artificial Sequence: Synthetic oligonucleotide
cgccactgtcaccgaaaaaggtgttgaaatagag

SEQ ID NO: 125819 - DNA, 34 bp, Artificial Sequence
  Description of Artificial Sequence: Synthetic oligonucleotide
gccactgtcaccgaaaaaggtgttgaaatagagg

SEQ ID NO: 125820 - DNA, 34 bp, Artificial Sequence
  Description of Artificial Sequence: Synthetic oligonucleotide
ccactgtcaccgaaaaaggtgttgaaatagaggg

SEQ ID NO: 125821 - DNA, 35 bp, Artificial Sequence
  Description of Artificial Sequence: Synthetic oligonucleotide
cactgtcaccgaaaaaggtgttgaaatagagggac

SEQ ID NO: 125822 - DNA, 35 bp, Artificial Sequence
  Description of Artificial Sequence: Synthetic oligonucleotide
actgtcaccgaaaaaggtgttgaaatagagggacc

SEQ ID NO: 125823 - DNA, 34 bp, Artificial Sequence
  Description of Artificial Sequence: Synthetic oligonucleotide
ctgtcaccgaaaaaggtgttgaaatagagggacc

SEQ ID NO: 125824 - DNA, 37 bp, Artificial Sequence
  Description of Artificial Sequence: Synthetic oligonucleotide
tgtcaccgaaaaaggtgttgaaatagagggaccattg

SEQ ID NO: 125825 - DNA, 36 bp, Artificial Sequence
  Description of Artificial Sequence: Synthetic oligonucleotide
gtcaccgaaaaaggtgttgaaatagagggaccattg

SEQ ID NO: 125826 - DNA, 37 bp, Artificial Sequence
  Description of Artificial Sequence: Synthetic oligonucleotide
tcaccgaaaaaggtgttgaaatagagggaccattgtc

SEQ ID NO: 125827 - DNA, 36 bp, Artificial Sequence
  Description of Artificial Sequence: Synthetic oligonucleotide
caccgaaaaaggtgttgaaatagagggaccattgtc

SEQ ID NO: 125828 - DNA, 38 bp, Artificial Sequence
  Description of Artificial Sequence: Synthetic oligonucleotide
accgaaaaaggtgttgaaatagagggaccattgtctac

SEQ ID NO: 125829 - DNA, 37 bp, Artificial Sequence
  Description of Artificial Sequence: Synthetic oligonucleotide
ccgaaaaaggtgttgaaatagagggaccattgtctac

SEQ ID NO: 125830 - DNA, 38 bp, Artificial Sequence
  Description of Artificial Sequence: Synthetic oligonucleotide
cgaaaaaggtgttgaaatagagggaccattgtctacag

SEQ ID NO: 125831 - DNA, 39 bp, Artificial Sequence
  Description of Artificial Sequence: Synthetic oligonucleotide
gaaaaaggtgttgaaatagagggaccattgtctacagag

SEQ ID NO: 125832 - DNA, 40 bp, Artificial Sequence
  Description of Artificial Sequence: Synthetic oligonucleotide
aaaaaggtgttgaaatagagggaccattgtctacagagac

SEQ ID NO: 125833 - DNA, 39 bp, Artificial Sequence
  Description of Artificial Sequence: Synthetic oligonucleotide
aaaaggtgttgaaatagagggaccattgtctacagagac

SEQ ID NO: 125834 - DNA, 38 bp, Artificial Sequence
  Description of Artificial Sequence: Synthetic oligonucleotide
aaaggtgttgaaatagagggaccattgtctacagagac

SEQ ID NO: 125835 - DNA, 37 bp, Artificial Sequence
  Description of Artificial Sequence: Synthetic oligonucleotide
aaggtgttgaaatagagggaccattgtctacagagac

SEQ ID NO: 125836 - DNA, 36 bp, Artificial Sequence
  Description of Artificial Sequence: Synthetic oligonucleotide
aggtgttgaaatagagggaccattgtctacagagac

SEQ ID NO: 125837 - DNA, 35 bp, Artificial Sequence
  Description of Artificial Sequence: Synthetic oligonucleotide
ggtgttgaaatagagggaccattgtctacagagac

SEQ ID NO: 125838 - DNA, 35 bp, Artificial Sequence
  Description of Artificial Sequence: Synthetic oligonucleotide
gtgttgaaatagagggaccattgtctacagagacc

SEQ ID NO: 125839 - DNA, 37 bp, Artificial Sequence
  Description of Artificial Sequence: Synthetic oligonucleotide
tgttgaaatagagggaccattgtctacagagaccaac

SEQ ID NO: 125840 - DNA, 36 bp, Artificial Sequence
  Description of Artificial Sequence: Synthetic oligonucleotide
gttgaaatagagggaccattgtctacagagaccaac

SEQ ID NO: 125841 - DNA, 37 bp, Artificial Sequence
  Description of Artificial Sequence: Synthetic oligonucleotide
ttgaaatagagggaccattgtctacagagaccaactg

SEQ ID NO: 125842 - DNA, 36 bp, Artificial Sequence
  Description of Artificial Sequence: Synthetic oligonucleotide
tgaaatagagggaccattgtctacagagaccaactg

SEQ ID NO: 125843 - DNA, 35 bp, Artificial Sequence
  Description of Artificial Sequence: Synthetic oligonucleotide
gaaatagagggaccattgtctacagagaccaactg

SEQ ID NO: 125844 - DNA, 35 bp, Artificial Sequence
  Description of Artificial Sequence: Synthetic oligonucleotide
aaatagagggaccattgtctacagagaccaactgg

SEQ ID NO: 125845 - DNA, 34 bp, Artificial Sequence
  Description of Artificial Sequence: Synthetic oligonucleotide
aatagagggaccattgtctacagagaccaactgg

SEQ ID NO: 125846 - DNA, 33 bp, Artificial Sequence
  Description of Artificial Sequence: Synthetic oligonucleotide
atagagggaccattgtctacagagaccaactgg

SEQ ID NO: 125847 - DNA, 32 bp, Artificial Sequence
  Description of Artificial Sequence: Synthetic oligonucleotide
tagagggaccattgtctacagagaccaactgg

SEQ ID NO: 125848 - DNA, 31 bp, Artificial Sequence
  Description of Artificial Sequence: Synthetic oligonucleotide
agagggaccattgtctacagagaccaactgg

SEQ ID NO: 125849 - DNA, 30 bp, Artificial Sequence
  Description of Artificial Sequence: Synthetic oligonucleotide
gagggaccattgtctacagagaccaactgg

SEQ ID NO: 125850 - DNA, 30 bp, Artificial Sequence
  Description of Artificial Sequence: Synthetic oligonucleotide
agggaccattgtctacagagaccaactggg

SEQ ID NO: 125851 - DNA, 29 bp, Artificial Sequence
  Description of Artificial Sequence: Synthetic oligonucleotide
gggaccattgtctacagagaccaactggg

SEQ ID NO: 125852 - DNA, 34 bp, Artificial Sequence
  Description of Artificial Sequence: Synthetic oligonucleotide
ggaccattgtctacagagaccaactgggatattg

SEQ ID NO: 125853 - DNA, 34 bp, Artificial Sequence
  Description of Artificial Sequence: Synthetic oligonucleotide
gaccattgtctacagagaccaactgggatattgc

SEQ ID NO: 125854 - DNA, 34 bp, Artificial Sequence
  Description of Artificial Sequence: Synthetic oligonucleotide
accattgtctacagagaccaactgggatattgcc

SEQ ID NO: 125855 - DNA, 33 bp, Artificial Sequence
  Description of Artificial Sequence: Synthetic oligonucleotide
ccattgtctacagagaccaactgggatattgcc

SEQ ID NO: 125856 - DNA, 33 bp, Artificial Sequence
  Description of Artificial Sequence: Synthetic oligonucleotide
cattgtctacagagaccaactgggatattgccc

SEQ ID NO: 125857 - DNA, 34 bp, Artificial Sequence
  Description of Artificial Sequence: Synthetic oligonucleotide
attgtctacagagaccaactgggatattgcccac

SEQ ID NO: 125858 - DNA, 33 bp, Artificial Sequence
  Description of Artificial Sequence: Synthetic oligonucleotide
ttgtctacagagaccaactgggatattgcccac

SEQ ID NO: 125859 - DNA, 32 bp, Artificial Sequence
  Description of Artificial Sequence: Synthetic oligonucleotide
tgtctacagagaccaactgggatattgcccac

SEQ ID NO: 125860 - DNA, 31 bp, Artificial Sequence
  Description of Artificial Sequence: Synthetic oligonucleotide
gtctacagagaccaactgggatattgcccac

SEQ ID NO: 125861 - DNA, 33 bp, Artificial Sequence
  Description of Artificial Sequence: Synthetic oligonucleotide
tctacagagaccaactgggatattgcccacatg

SEQ ID NO: 125862 - DNA, 32 bp, Artificial Sequence
  Description of Artificial Sequence: Synthetic oligonucleotide
ctacagagaccaactgggatattgcccacatg

SEQ ID NO: 125863 - DNA, 34 bp, Artificial Sequence
  Description of Artificial Sequence: Synthetic oligonucleotide
tacagagaccaactgggatattgcccacatgatc

SEQ ID NO: 125864 - DNA, 33 bp, Artificial Sequence
  Description of Artificial Sequence: Synthetic oligonucleotide
acagagaccaactgggatattgcccacatgatc

SEQ ID NO: 125865 - DNA, 32 bp, Artificial Sequence
  Description of Artificial Sequence: Synthetic oligonucleotide
cagagaccaactgggatattgcccacatgatc

SEQ ID NO: 125866 - DNA, 33 bp, Artificial Sequence
  Description of Artificial Sequence: Synthetic oligonucleotide
agagaccaactgggatattgcccacatgatcag

SEQ ID NO: 125867 - DNA, 32 bp, Artificial Sequence
  Description of Artificial Sequence: Synthetic oligonucleotide
gagaccaactgggatattgcccacatgatcag

SEQ ID NO: 125868 - DNA, 33 bp, Artificial Sequence
  Description of Artificial Sequence: Synthetic oligonucleotide
agaccaactgggatattgcccacatgatcagtg

SEQ ID NO: 125869 - DNA, 32 bp, Artificial Sequence
  Description of Artificial Sequence: Synthetic oligonucleotide
gaccaactgggatattgcccacatgatcagtg

SEQ ID NO: 125870 - DNA, 32 bp, Artificial Sequence
  Description of Artificial Sequence: Synthetic oligonucleotide
accaactgggatattgcccacatgatcagtgg

SEQ ID NO: 125871 - DNA, 31 bp, Artificial Sequence
  Description of Artificial Sequence: Synthetic oligonucleotide
ccaactgggatattgcccacatgatcagtgg

SEQ ID NO: 125872 - DNA, 31 bp, Artificial Sequence
  Description of Artificial Sequence: Synthetic oligonucleotide
caactgggatattgcccacatgatcagtggc

SEQ ID NO: 125873 - DNA, 34 bp, Artificial Sequence
  Description of Artificial Sequence: Synthetic oligonucleotide
aactgggatattgcccacatgatcagtggctttg

SEQ ID NO: 125874 - DNA, 33 bp, Artificial Sequence
  Description of Artificial Sequence: Synthetic oligonucleotide
actgggatattgcccacatgatcagtggctttg

SEQ ID NO: 125875 - DNA, 32 bp, Artificial Sequence
  Description of Artificial Sequence: Synthetic oligonucleotide
ctgggatattgcccacatgatcagtggctttg

SEQ ID NO: 125876 - DNA, 35 bp, Artificial Sequence
  Description of Artificial Sequence: Synthetic oligonucleotide
tgggatattgcccacatgatcagtggctttgaatg

SEQ ID NO: 125877 - DNA, 34 bp, Artificial Sequence
  Description of Artificial Sequence: Synthetic oligonucleotide
gggatattgcccacatgatcagtggctttgaatg

SEQ ID NO: 125878 - DNA, 27 bp, Artificial Sequence
  Description of Artificial Sequence: Synthetic oligonucleotide
atggcggctaccttactagctgctcgg

SEQ ID NO: 125879 - DNA, 26 bp, Artificial Sequence
  Description of Artificial Sequence: Synthetic oligonucleotide
tggcggctaccttactagctgctcgg

SEQ ID NO: 125880 - DNA, 25 bp, Artificial Sequence
  Description of Artificial Sequence: Synthetic oligonucleotide
ggcggctaccttactagctgctcgg

SEQ ID NO: 125881 - DNA, 25 bp, Artificial Sequence
  Description of Artificial Sequence: Synthetic oligonucleotide
gcggctaccttactagctgctcggg

SEQ ID NO: 125882 - DNA, 26 bp, Artificial Sequence
  Description of Artificial Sequence: Synthetic oligonucleotide
cggctaccttactagctgctcgggga

SEQ ID NO: 125883 - DNA, 26 bp, Artificial Sequence
  Description of Artificial Sequence: Synthetic oligonucleotide
ggctaccttactagctgctcggggag

SEQ ID NO: 125884 - DNA, 26 bp, Artificial Sequence
  Description of Artificial Sequence: Synthetic oligonucleotide
gctaccttactagctgctcggggagc

SEQ ID NO: 125885 - DNA, 26 bp, Artificial Sequence
  Description of Artificial Sequence: Synthetic oligonucleotide
ctaccttactagctgctcggggagcc

SEQ ID NO: 125886 - DNA, 26 bp, Artificial Sequence
  Description of Artificial Sequence: Synthetic oligonucleotide
taccttactagctgctcggggagccg

SEQ ID NO: 125887 - DNA, 25 bp, Artificial Sequence
  Description of Artificial Sequence: Synthetic oligonucleotide
accttactagctgctcggggagccg

SEQ ID NO: 125888 - DNA, 24 bp, Artificial Sequence
  Description of Artificial Sequence: Synthetic oligonucleotide
ccttactagctgctcggggagccg

SEQ ID NO: 125889 - DNA, 24 bp, Artificial Sequence
  Description of Artificial Sequence: Synthetic oligonucleotide
cttactagctgctcggggagccgg

SEQ ID NO: 125890 - DNA, 24 bp, Artificial Sequence
  Description of Artificial Sequence: Synthetic oligonucleotide
ttactagctgctcggggagccggg

SEQ ID NO: 125891 - DNA, 23 bp, Artificial Sequence
  Description of Artificial Sequence: Synthetic oligonucleotide
tactagctgctcggggagccggg

SEQ ID NO: 125892 - DNA, 22 bp, Artificial Sequence
  Description of Artificial Sequence: Synthetic oligonucleotide
actagctgctcggggagccggg

SEQ ID NO: 125893 - DNA, 21 bp, Artificial Sequence
  Description of Artificial Sequence: Synthetic oligonucleotide
ctagctgctcggggagccggg

SEQ ID NO: 125894 - DNA, 21 bp, Artificial Sequence
  Description of Artificial Sequence: Synthetic oligonucleotide
tagctgctcggggagccgggc

SEQ ID NO: 125895 - DNA, 20 bp, Artificial Sequence
  Description of Artificial Sequence: Synthetic oligonucleotide
agctgctcggggagccgggc

SEQ ID NO: 125896 - DNA, 20 bp, Artificial Sequence
  Description of Artificial Sequence: Synthetic oligonucleotide
gctgctcggggagccgggct

SEQ ID NO: 125897 - DNA, 20 bp, Artificial Sequence
  Description of Artificial Sequence: Synthetic oligonucleotide
ctgctcggggagccgggcca

SEQ ID NO: 125898 - DNA, 20 bp, Artificial Sequence
  Description of Artificial Sequence: Synthetic oligonucleotide
tgctcggggagccgggccag

SEQ ID NO: 125899 - DNA, 20 bp, Artificial Sequence
  Description of Artificial Sequence: Synthetic oligonucleotide
gctcggggagccgggccagt

SEQ ID NO: 125900 - DNA, 20 bp, Artificial Sequence
  Description of Artificial Sequence: Synthetic oligonucleotide
ctcggggagccgggccagca

SEQ ID NO: 125901 - DNA, 20 bp, Artificial Sequence
  Description of Artificial Sequence: Synthetic oligonucleotide
tcggggagccgggccagcac

SEQ ID NO: 125902 - DNA, 20 bp, Artificial Sequence
  Description of Artificial Sequence: Synthetic oligonucleotide
cggggagccgggccagcact

SEQ ID NO: 125903 - DNA, 20 bp, Artificial Sequence
  Description of Artificial Sequence: Synthetic oligonucleotide
ggggagccgggccagcacct

SEQ ID NO: 125904 - DNA, 20 bp, Artificial Sequence
  Description of Artificial Sequence: Synthetic oligonucleotide
gggagccgggccagcaccgt

SEQ ID NO: 125905 - DNA, 20 bp, Artificial Sequence
  Description of Artificial Sequence: Synthetic oligonucleotide
ggagccgggccagcaccggt

SEQ ID NO: 125906 - DNA, 21 bp, Artificial Sequence
  Description of Artificial Sequence: Synthetic oligonucleotide
gagccgggccagcaccggctt

SEQ ID NO: 125907 - DNA, 21 bp, Artificial Sequence
  Description of Artificial Sequence: Synthetic oligonucleotide
agccgggccagcaccggcttg

SEQ ID NO: 125908 - DNA, 20 bp, Artificial Sequence
  Description of Artificial Sequence: Synthetic oligonucleotide
gccgggccagcaccggcttg

SEQ ID NO: 125909 - DNA, 20 bp, Artificial Sequence
  Description of Artificial Sequence: Synthetic oligonucleotide
ccgggccagcaccggcttgg

SEQ ID NO: 125910 - DNA, 20 bp, Artificial Sequence
  Description of Artificial Sequence: Synthetic oligonucleotide
cgggccagcaccggcttggg

SEQ ID NO: 125911 - DNA, 20 bp, Artificial Sequence
  Description of Artificial Sequence: Synthetic oligonucleotide
gggccagcaccggcttgggg

SEQ ID NO: 125912 - DNA, 20 bp, Artificial Sequence
  Description of Artificial Sequence: Synthetic oligonucleotide
ggccagcaccggcttggggg

SEQ ID NO: 125913 - DNA, 20 bp, Artificial Sequence
  Description of Artificial Sequence: Synthetic oligonucleotide
gccagcaccggcttgggggc

SEQ ID NO: 125914 - DNA, 20 bp, Artificial Sequence
  Description of Artificial Sequence: Synthetic oligonucleotide
ccagcaccggcttgggggcc

SEQ ID NO: 125915 - DNA, 20 bp, Artificial Sequence
  Description of Artificial Sequence: Synthetic oligonucleotide
cagcaccggcttgggggccg

SEQ ID NO: 125916 - DNA, 21 bp, Artificial Sequence
  Description of Artificial Sequence: Synthetic oligonucleotide
agcaccggcttgggggccgga

SEQ ID NO: 125917 - DNA, 20 bp, Artificial Sequence
  Description of Artificial Sequence: Synthetic oligonucleotide
gcaccggcttgggggccgga

SEQ ID NO: 125918 - DNA, 20 bp, Artificial Sequence
  Description of Artificial Sequence: Synthetic oligonucleotide
caccggcttgggggccggag

SEQ ID NO: 125919 - DNA, 20 bp, Artificial Sequence
  Description of Artificial Sequence: Synthetic oligonucleotide
accggcttgggggccggagg

SEQ ID NO: 125920 - DNA, 20 bp, Artificial Sequence
  Description of Artificial Sequence: Synthetic oligonucleotide
ccggcttgggggccggaggt

SEQ ID NO: 125921 - DNA, 20 bp, Artificial Sequence
  Description of Artificial Sequence: Synthetic oligonucleotide
cggcttgggggccggaggct

SEQ ID NO: 125922 - DNA, 21 bp, Artificial Sequence
  Description of Artificial Sequence: Synthetic oligonucleotide
ggcttgggggccggaggcgtt

SEQ ID NO: 125923 - DNA, 22 bp, Artificial Sequence
  Description of Artificial Sequence: Synthetic oligonucleotide
gcttgggggccggaggcgttca

SEQ ID NO: 125924 - DNA, 23 bp, Artificial Sequence
  Description of Artificial Sequence: Synthetic oligonucleotide
cttgggggccggaggcgttcact

SEQ ID NO: 125925 - DNA, 23 bp, Artificial Sequence
  Description of Artificial Sequence: Synthetic oligonucleotide
ttgggggccggaggcgttcactc

SEQ ID NO: 125926 - DNA, 22 bp, Artificial Sequence
  Description of Artificial Sequence: Synthetic oligonucleotide
tgggggccggaggcgttcactc

SEQ ID NO: 125927 - DNA, 21 bp, Artificial Sequence
  Description of Artificial Sequence: Synthetic oligonucleotide
gggggccggaggcgttcactc

SEQ ID NO: 125928 - DNA, 22 bp, Artificial Sequence
  Description of Artificial Sequence: Synthetic oligonucleotide
ggggccggaggcgttcactcca

SEQ ID NO: 125929 - DNA, 23 bp, Artificial Sequence
  Description of Artificial Sequence: Synthetic oligonucleotide
gggccggaggcgttcactccaga

SEQ ID NO: 125930 - DNA, 24 bp, Artificial Sequence
  Description of Artificial Sequence: Synthetic oligonucleotide
ggccggaggcgttcactccagact

SEQ ID NO: 125931 - DNA, 24 bp, Artificial Sequence
  Description of Artificial Sequence: Synthetic oligonucleotide
gccggaggcgttcactccagactg

SEQ ID NO: 125932 - DNA, 24 bp, Artificial Sequence
  Description of Artificial Sequence: Synthetic oligonucleotide
ccggaggcgttcactccagactgg

SEQ ID NO: 125933 - DNA, 27 bp, Artificial Sequence
  Description of Artificial Sequence: Synthetic oligonucleotide
cggaggcgttcactccagactgggaaa

SEQ ID NO: 125934 - DNA, 27 bp, Artificial Sequence
  Description of Artificial Sequence: Synthetic oligonucleotide
ggaggcgttcactccagactgggaaag

SEQ ID NO: 125935 - DNA, 27 bp, Artificial Sequence
  Description of Artificial Sequence: Synthetic oligonucleotide
gaggcgttcactccagactgggaaagc

SEQ ID NO: 125936 - DNA, 27 bp, Artificial Sequence
  Description of Artificial Sequence: Synthetic oligonucleotide
aggcgttcactccagactgggaaagcc

SEQ ID NO: 125937 - DNA, 26 bp, Artificial Sequence
  Description of Artificial Sequence: Synthetic oligonucleotide
ggcgttcactccagactgggaaagcc

SEQ ID NO: 125938 - DNA, 27 bp, Artificial Sequence
  Description of Artificial Sequence: Synthetic oligonucleotide
gcgttcactccagactgggaaagccga

SEQ ID NO: 125939 - DNA, 27 bp, Artificial Sequence
  Description of Artificial Sequence: Synthetic oligonucleotide
cgttcactccagactgggaaagccgag

SEQ ID NO: 125940 - DNA, 29 bp, Artificial Sequence
  Description of Artificial Sequence: Synthetic oligonucleotide
gttcactccagactgggaaagccgagaag

SEQ ID NO: 125941 - DNA, 32 bp, Artificial Sequence
  Description of Artificial Sequence: Synthetic oligonucleotide
ttcactccagactgggaaagccgagaagtttc

SEQ ID NO: 125942 - DNA, 31 bp, Artificial Sequence
  Description of Artificial Sequence: Synthetic oligonucleotide
tcactccagactgggaaagccgagaagtttc

SEQ ID NO: 125943 - DNA, 30 bp, Artificial Sequence
  Description of Artificial Sequence: Synthetic oligonucleotide
cactccagactgggaaagccgagaagtttc

SEQ ID NO: 125944 - DNA, 30 bp, Artificial Sequence
  Description of Artificial Sequence: Synthetic oligonucleotide
actccagactgggaaagccgagaagtttcc

SEQ ID NO: 125945 - DNA, 29 bp, Artificial Sequence
  Description of Artificial Sequence: Synthetic oligonucleotide
ctccagactgggaaagccgagaagtttcc

SEQ ID NO: 125946 - DNA, 30 bp, Artificial Sequence
  Description of Artificial Sequence: Synthetic oligonucleotide
tccagactgggaaagccgagaagtttccac

SEQ ID NO: 125947 - DNA, 29 bp, Artificial Sequence
  Description of Artificial Sequence: Synthetic oligonucleotide
ccagactgggaaagccgagaagtttccac

SEQ ID NO: 125948 - DNA, 30 bp, Artificial Sequence
  Description of Artificial Sequence: Synthetic oligonucleotide
cagactgggaaagccgagaagtttccactg

SEQ ID NO: 125949 - DNA, 30 bp, Artificial Sequence
  Description of Artificial Sequence: Synthetic oligonucleotide
agactgggaaagccgagaagtttccactgg

SEQ ID NO: 125950 - DNA, 29 bp, Artificial Sequence
  Description of Artificial Sequence: Synthetic oligonucleotide
gactgggaaagccgagaagtttccactgg

SEQ ID NO: 125951 - DNA, 29 bp, Artificial Sequence
  Description of Artificial Sequence: Synthetic oligonucleotide
actgggaaagccgagaagtttccactggg

SEQ ID NO: 125952 - DNA, 28 bp, Artificial Sequence
  Description of Artificial Sequence: Synthetic oligonucleotide
ctgggaaagccgagaagtttccactggg

SEQ ID NO: 125953 - DNA, 29 bp, Artificial Sequence
  Description of Artificial Sequence: Synthetic oligonucleotide
tgggaaagccgagaagtttccactgggac

SEQ ID NO: 125954 - DNA, 28 bp, Artificial Sequence
  Description of Artificial Sequence: Synthetic oligonucleotide
gggaaagccgagaagtttccactgggac

SEQ ID NO: 125955 - DNA, 28 bp, Artificial Sequence
  Description of Artificial Sequence: Synthetic oligonucleotide
ggaaagccgagaagtttccactgggacc

SEQ ID NO: 125956 - DNA, 29 bp, Artificial Sequence
  Description of Artificial Sequence: Synthetic oligonucleotide
gaaagccgagaagtttccactgggaccac

SEQ ID NO: 125957 - DNA, 32 bp, Artificial Sequence
  Description of Artificial Sequence: Synthetic oligonucleotide
aaagccgagaagtttccactgggaccactatc

SEQ ID NO: 125958 - DNA, 31 bp, Artificial Sequence
  Description of Artificial Sequence: Synthetic oligonucleotide
aagccgagaagtttccactgggaccactatc

SEQ ID NO: 125959 - DNA, 30 bp, Artificial Sequence
  Description of Artificial Sequence: Synthetic oligonucleotide
agccgagaagtttccactgggaccactatc

SEQ ID NO: 125960 - DNA, 29 bp, Artificial Sequence
  Description of Artificial Sequence: Synthetic oligonucleotide
gccgagaagtttccactgggaccactatc

SEQ ID NO: 125961 - DNA, 31 bp, Artificial Sequence
  Description of Artificial Sequence: Synthetic oligonucleotide
ccgagaagtttccactgggaccactatcatg

SEQ ID NO: 125962 - DNA, 31 bp, Artificial Sequence
  Description of Artificial Sequence: Synthetic oligonucleotide
cgagaagtttccactgggaccactatcatgg

SEQ ID NO: 125963 - DNA, 31 bp, Artificial Sequence
  Description of Artificial Sequence: Synthetic oligonucleotide
gagaagtttccactgggaccactatcatggc

SEQ ID NO: 125964 - DNA, 31 bp, Artificial Sequence
  Description of Artificial Sequence: Synthetic oligonucleotide
agaagtttccactgggaccactatcatggcc

SEQ ID NO: 125965 - DNA, 30 bp, Artificial Sequence
  Description of Artificial Sequence: Synthetic oligonucleotide
gaagtttccactgggaccactatcatggcc

SEQ ID NO: 125966 - DNA, 30 bp, Artificial Sequence
  Description of Artificial Sequence: Synthetic oligonucleotide
aagtttccactgggaccactatcatggccg

SEQ ID NO: 125967 - DNA, 29 bp, Artificial Sequence
  Description of Artificial Sequence: Synthetic oligonucleotide
agtttccactgggaccactatcatggccg

SEQ ID NO: 125968 - DNA, 28 bp, Artificial Sequence
  Description of Artificial Sequence: Synthetic oligonucleotide
gtttccactgggaccactatcatggccg

SEQ ID NO: 125969 - DNA, 29 bp, Artificial Sequence
  Description of Artificial Sequence: Synthetic oligonucleotide
tttccactgggaccactatcatggccgtg

SEQ ID NO: 125970 - DNA, 28 bp, Artificial Sequence
  Description of Artificial Sequence: Synthetic oligonucleotide
ttccactgggaccactatcatggccgtg

SEQ ID NO: 125971 - DNA, 27 bp, Artificial Sequence
  Description of Artificial Sequence: Synthetic oligonucleotide
tccactgggaccactatcatggccgtg

SEQ ID NO: 125972 - DNA, 26 bp, Artificial Sequence
  Description of Artificial Sequence: Synthetic oligonucleotide
ccactgggaccactatcatggccgtg

SEQ ID NO: 125973 - DNA, 27 bp, Artificial Sequence
  Description of Artificial Sequence: Synthetic oligonucleotide
cactgggaccactatcatggccgtgca

SEQ ID NO: 125974 - DNA, 27 bp, Artificial Sequence
  Description of Artificial Sequence: Synthetic oligonucleotide
actgggaccactatcatggccgtgcag

SEQ ID NO: 125975 - DNA, 27 bp, Artificial Sequence
  Description of Artificial Sequence: Synthetic oligonucleotide
ctgggaccactatcatggccgtgcagt

SEQ ID NO: 125976 - DNA, 29 bp, Artificial Sequence
  Description of Artificial Sequence: Synthetic oligonucleotide
tgggaccactatcatggccgtgcagtttg

SEQ ID NO: 125977 - DNA, 28 bp, Artificial Sequence
  Description of Artificial Sequence: Synthetic oligonucleotide
gggaccactatcatggccgtgcagtttg

SEQ ID NO: 125978 - DNA, 29 bp, Artificial Sequence
  Description of Artificial Sequence: Synthetic oligonucleotide
ggaccactatcatggccgtgcagtttgac

SEQ ID NO: 125979 - DNA, 29 bp, Artificial Sequence
  Description of Artificial Sequence: Synthetic oligonucleotide
gaccactatcatggccgtgcagtttgacg

SEQ ID NO: 125980 - DNA, 29 bp, Artificial Sequence
  Description of Artificial Sequence: Synthetic oligonucleotide
accactatcatggccgtgcagtttgacgg

SEQ ID NO: 125981 - DNA, 28 bp, Artificial Sequence
  Description of Artificial Sequence: Synthetic oligonucleotide
ccactatcatggccgtgcagtttgacgg

SEQ ID NO: 125982 - DNA, 28 bp, Artificial Sequence
  Description of Artificial Sequence: Synthetic oligonucleotide
cactatcatggccgtgcagtttgacggg

SEQ ID NO: 125983 - DNA, 28 bp, Artificial Sequence
  Description of Artificial Sequence: Synthetic oligonucleotide
actatcatggccgtgcagtttgacgggg

SEQ ID NO: 125984 - DNA, 27 bp, Artificial Sequence
  Description of Artificial Sequence: Synthetic oligonucleotide
ctatcatggccgtgcagtttgacgggg

SEQ ID NO: 125985 - DNA, 27 bp, Artificial Sequence
  Description of Artificial Sequence: Synthetic oligonucleotide
tatcatggccgtgcagtttgacggggg

SEQ ID NO: 125986 - DNA, 26 bp, Artificial Sequence
  Description of Artificial Sequence: Synthetic oligonucleotide
atcatggccgtgcagtttgacggggg

SEQ ID NO: 125987 - DNA, 25 bp, Artificial Sequence
  Description of Artificial Sequence: Synthetic oligonucleotide
tcatggccgtgcagtttgacggggg

SEQ ID NO: 125988 - DNA, 24 bp, Artificial Sequence
  Description of Artificial Sequence: Synthetic oligonucleotide
catggccgtgcagtttgacggggg

SEQ ID NO: 125989 - DNA, 24 bp, Artificial Sequence
  Description of Artificial Sequence: Synthetic oligonucleotide
atggccgtgcagtttgacgggggc

SEQ ID NO: 125990 - DNA, 23 bp, Artificial Sequence
  Description of Artificial Sequence: Synthetic oligonucleotide
tggccgtgcagtttgacgggggc

SEQ ID NO: 125991 - DNA, 22 bp, Artificial Sequence
  Description of Artificial Sequence: Synthetic oligonucleotide
ggccgtgcagtttgacgggggc

SEQ ID NO: 125992 - DNA, 23 bp, Artificial Sequence
  Description of Artificial Sequence: Synthetic oligonucleotide
gccgtgcagtttgacgggggcgt

SEQ ID NO: 125993 - DNA, 23 bp, Artificial Sequence
  Description of Artificial Sequence: Synthetic oligonucleotide
ccgtgcagtttgacgggggcgtg

SEQ ID NO: 125994 - DNA, 25 bp, Artificial Sequence
  Description of Artificial Sequence: Synthetic oligonucleotide
cgtgcagtttgacgggggcgtggtt

SEQ ID NO: 125995 - DNA, 26 bp, Artificial Sequence
  Description of Artificial Sequence: Synthetic oligonucleotide
gtgcagtttgacgggggcgtggttct

SEQ ID NO: 125996 - DNA, 26 bp, Artificial Sequence
  Description of Artificial Sequence: Synthetic oligonucleotide
tgcagtttgacgggggcgtggttctg

SEQ ID NO: 125997 - DNA, 25 bp, Artificial Sequence
  Description of Artificial Sequence: Synthetic oligonucleotide
gcagtttgacgggggcgtggttctg

SEQ ID NO: 125998 - DNA, 25 bp, Artificial Sequence
  Description of Artificial Sequence: Synthetic oligonucleotide
cagtttgacgggggcgtggttctgg

SEQ ID NO: 125999 - DNA, 25 bp, Artificial Sequence
  Description of Artificial Sequence: Synthetic oligonucleotide
agtttgacgggggcgtggttctggg

SEQ ID NO: 126000 - DNA, 24 bp, Artificial Sequence
  Description of Artificial Sequence: Synthetic oligonucleotide
gtttgacgggggcgtggttctggg

SEQ ID NO: 126001 - DNA, 24 bp, Artificial Sequence
  Description of Artificial Sequence: Synthetic oligonucleotide
tttgacgggggcgtggttctgggg

SEQ ID NO: 126002 - DNA, 23 bp, Artificial Sequence
  Description of Artificial Sequence: Synthetic oligonucleotide
ttgacgggggcgtggttctgggg

SEQ ID NO: 126003 - DNA, 22 bp, Artificial Sequence
  Description of Artificial Sequence: Synthetic oligonucleotide
tgacgggggcgtggttctgggg

SEQ ID NO: 126004 - DNA, 21 bp, Artificial Sequence
  Description of Artificial Sequence: Synthetic oligonucleotide
gacgggggcgtggttctgggg

SEQ ID NO: 126005 - DNA, 21 bp, Artificial Sequence
  Description of Artificial Sequence: Synthetic oligonucleotide
acgggggcgtggttctggggg

SEQ ID NO: 126006 - DNA, 20 bp, Artificial Sequence
  Description of Artificial Sequence: Synthetic oligonucleotide
cgggggcgtggttctggggg

SEQ ID NO: 126007 - DNA, 20 bp, Artificial Sequence
  Description of Artificial Sequence: Synthetic oligonucleotide
gggggcgtggttctgggggc

SEQ ID NO: 126008 - DNA, 20 bp, Artificial Sequence
  Description of Artificial Sequence: Synthetic oligonucleotide
ggggcgtggttctgggggcg

SEQ ID NO: 126009 - DNA, 21 bp, Artificial Sequence
  Description of Artificial Sequence: Synthetic oligonucleotide
gggcgtggttctgggggcgga

SEQ ID NO: 126010 - DNA, 22 bp, Artificial Sequence
  Description of Artificial Sequence: Synthetic oligonucleotide
ggcgtggttctgggggcggact

SEQ ID NO: 126011 - DNA, 22 bp, Artificial Sequence
  Description of Artificial Sequence: Synthetic oligonucleotide
gcgtggttctgggggcggactc

SEQ ID NO: 126012 - DNA, 23 bp, Artificial Sequence
  Description of Artificial Sequence: Synthetic oligonucleotide
cgtggttctgggggcggactcca

SEQ ID NO: 126013 - DNA, 25 bp, Artificial Sequence
  Description of Artificial Sequence: Synthetic oligonucleotide
gtggttctgggggcggactccagaa

SEQ ID NO: 126014 - DNA, 27 bp, Artificial Sequence
  Description of Artificial Sequence: Synthetic oligonucleotide
tggttctgggggcggactccagaacaa

SEQ ID NO: 126015 - DNA, 26 bp, Artificial Sequence
  Description of Artificial Sequence: Synthetic oligonucleotide
ggttctgggggcggactccagaacaa

SEQ ID NO: 126016 - DNA, 26 bp, Artificial Sequence
  Description of Artificial Sequence: Synthetic oligonucleotide
gttctgggggcggactccagaacaac

SEQ ID NO: 126017 - DNA, 27 bp, Artificial Sequence
  Description of Artificial Sequence: Synthetic oligonucleotide
ttctgggggcggactccagaacaacca

SEQ ID NO: 126018 - DNA, 26 bp, Artificial Sequence
  Description of Artificial Sequence: Synthetic oligonucleotide
tctgggggcggactccagaacaacca

SEQ ID NO: 126019 - DNA, 25 bp, Artificial Sequence
  Description of Artificial Sequence: Synthetic oligonucleotide
ctgggggcggactccagaacaacca

SEQ ID NO: 126020 - DNA, 26 bp, Artificial Sequence
  Description of Artificial Sequence: Synthetic oligonucleotide
tgggggcggactccagaacaaccact

SEQ ID NO: 126021 - DNA, 25 bp, Artificial Sequence
  Description of Artificial Sequence: Synthetic oligonucleotide
gggggcggactccagaacaaccact

SEQ ID NO: 126022 - DNA, 25 bp, Artificial Sequence
  Description of Artificial Sequence: Synthetic oligonucleotide
ggggcggactccagaacaaccactg

SEQ ID NO: 126023 - DNA, 25 bp, Artificial Sequence
  Description of Artificial Sequence: Synthetic oligonucleotide
gggcggactccagaacaaccactgg

SEQ ID NO: 126024 - DNA, 26 bp, Artificial Sequence
  Description of Artificial Sequence: Synthetic oligonucleotide
ggcggactccagaacaaccactgggt

SEQ ID NO: 126025 - DNA, 26 bp, Artificial Sequence
  Description of Artificial Sequence: Synthetic oligonucleotide
gcggactccagaacaaccactgggtc

SEQ ID NO: 126026 - DNA, 27 bp, Artificial Sequence
  Description of Artificial Sequence: Synthetic oligonucleotide
cggactccagaacaaccactgggtcct

SEQ ID NO: 126027 - DNA, 28 bp, Artificial Sequence
  Description of Artificial Sequence: Synthetic oligonucleotide
ggactccagaacaaccactgggtcctac

SEQ ID NO: 126028 - DNA, 30 bp, Artificial Sequence
  Description of Artificial Sequence: Synthetic oligonucleotide
gactccagaacaaccactgggtcctacatc

SEQ ID NO: 126029 - DNA, 30 bp, Artificial Sequence
  Description of Artificial Sequence: Synthetic oligonucleotide
actccagaacaaccactgggtcctacatcg

SEQ ID NO: 126030 - DNA, 29 bp, Artificial Sequence
  Description of Artificial Sequence: Synthetic oligonucleotide
ctccagaacaaccactgggtcctacatcg

SEQ ID NO: 126031 - DNA, 29 bp, Artificial Sequence
  Description of Artificial Sequence: Synthetic oligonucleotide
tccagaacaaccactgggtcctacatcgc

SEQ ID NO: 126032 - DNA, 28 bp, Artificial Sequence
  Description of Artificial Sequence: Synthetic oligonucleotide
ccagaacaaccactgggtcctacatcgc

SEQ ID NO: 126033 - DNA, 28 bp, Artificial Sequence
  Description of Artificial Sequence: Synthetic oligonucleotide
cagaacaaccactgggtcctacatcgcc

SEQ ID NO: 126034 - DNA, 31 bp, Artificial Sequence
  Description of Artificial Sequence: Synthetic oligonucleotide
agaacaaccactgggtcctacatcgccaatc

SEQ ID NO: 126035 - DNA, 30 bp, Artificial Sequence
  Description of Artificial Sequence: Synthetic oligonucleotide
gaacaaccactgggtcctacatcgccaatc

SEQ ID NO: 126036 - DNA, 30 bp, Artificial Sequence
  Description of Artificial Sequence: Synthetic oligonucleotide
aacaaccactgggtcctacatcgccaatcg

SEQ ID NO: 126037 - DNA, 29 bp, Artificial Sequence
  Description of Artificial Sequence: Synthetic oligonucleotide
acaaccactgggtcctacatcgccaatcg

SEQ ID NO: 126038 - DNA, 28 bp, Artificial Sequence
  Description of Artificial Sequence: Synthetic oligonucleotide
caaccactgggtcctacatcgccaatcg

SEQ ID NO: 126039 - DNA, 29 bp, Artificial Sequence
  Description of Artificial Sequence: Synthetic oligonucleotide
aaccactgggtcctacatcgccaatcgag

SEQ ID NO: 126040 - DNA, 28 bp, Artificial Sequence
  Description of Artificial Sequence: Synthetic oligonucleotide
accactgggtcctacatcgccaatcgag

SEQ ID NO: 126041 - DNA, 27 bp, Artificial Sequence
  Description of Artificial Sequence: Synthetic oligonucleotide
ccactgggtcctacatcgccaatcgag

SEQ ID NO: 126042 - DNA, 28 bp, Artificial Sequence
  Description of Artificial Sequence: Synthetic oligonucleotide
cactgggtcctacatcgccaatcgagtg

SEQ ID NO: 126043 - DNA, 29 bp, Artificial Sequence
  Description of Artificial Sequence: Synthetic oligonucleotide
actgggtcctacatcgccaatcgagtgac

SEQ ID NO: 126044 - DNA, 28 bp, Artificial Sequence
  Description of Artificial Sequence: Synthetic oligonucleotide
ctgggtcctacatcgccaatcgagtgac

SEQ ID NO: 126045 - DNA, 29 bp, Artificial Sequence
  Description of Artificial Sequence: Synthetic oligonucleotide
tgggtcctacatcgccaatcgagtgactg

SEQ ID NO: 126046 - DNA, 28 bp, Artificial Sequence
  Description of Artificial Sequence: Synthetic oligonucleotide
gggtcctacatcgccaatcgagtgactg

SEQ ID NO: 126047 - DNA, 29 bp, Artificial Sequence
  Description of Artificial Sequence: Synthetic oligonucleotide
ggtcctacatcgccaatcgagtgactgac

SEQ ID NO: 126048 - DNA, 31 bp, Artificial Sequence
  Description of Artificial Sequence: Synthetic oligonucleotide
gtcctacatcgccaatcgagtgactgacaag

SEQ ID NO: 126049 - DNA, 31 bp, Artificial Sequence
  Description of Artificial Sequence: Synthetic oligonucleotide
tcctacatcgccaatcgagtgactgacaagc

SEQ ID NO: 126050 - DNA, 30 bp, Artificial Sequence
  Description of Artificial Sequence: Synthetic oligonucleotide
cctacatcgccaatcgagtgactgacaagc

SEQ ID NO: 126051 - DNA, 31 bp, Artificial Sequence
  Description of Artificial Sequence: Synthetic oligonucleotide
ctacatcgccaatcgagtgactgacaagctg

SEQ ID NO: 126052 - DNA, 32 bp, Artificial Sequence
  Description of Artificial Sequence: Synthetic oligonucleotide
tacatcgccaatcgagtgactgacaagctgac

SEQ ID NO: 126053 - DNA, 31 bp, Artificial Sequence
  Description of Artificial Sequence: Synthetic oligonucleotide
acatcgccaatcgagtgactgacaagctgac

SEQ ID NO: 126054 - DNA, 30 bp, Artificial Sequence
  Description of Artificial Sequence: Synthetic oligonucleotide
catcgccaatcgagtgactgacaagctgac

SEQ ID NO: 126055 - DNA, 31 bp, Artificial Sequence
  Description of Artificial Sequence: Synthetic oligonucleotide
atcgccaatcgagtgactgacaagctgacac

SEQ ID NO: 126056 - DNA, 30 bp, Artificial Sequence
  Description of Artificial Sequence: Synthetic oligonucleotide
tcgccaatcgagtgactgacaagctgacac

SEQ ID NO: 126057 - DNA, 29 bp, Artificial Sequence
  Description of Artificial Sequence: Synthetic oligonucleotide
cgccaatcgagtgactgacaagctgacac

SEQ ID NO: 126058 - DNA, 29 bp, Artificial Sequence
  Description of Artificial Sequence: Synthetic oligonucleotide
gccaatcgagtgactgacaagctgacacc

SEQ ID NO: 126059 - DNA, 33 bp, Artificial Sequence
  Description of Artificial Sequence: Synthetic oligonucleotide
ccaatcgagtgactgacaagctgacacctattc

SEQ ID NO: 126060 - DNA, 34 bp, Artificial Sequence
  Description of Artificial Sequence: Synthetic oligonucleotide
caatcgagtgactgacaagctgacacctattcac

SEQ ID NO: 126061 - DNA, 34 bp, Artificial Sequence
  Description of Artificial Sequence: Synthetic oligonucleotide
aatcgagtgactgacaagctgacacctattcacg

SEQ ID NO: 126062 - DNA, 33 bp, Artificial Sequence
  Description of Artificial Sequence: Synthetic oligonucleotide
atcgagtgactgacaagctgacacctattcacg

SEQ ID NO: 126063 - DNA, 32 bp, Artificial Sequence
  Description of Artificial Sequence: Synthetic oligonucleotide
tcgagtgactgacaagctgacacctattcacg

SEQ ID NO: 126064 - DNA, 31 bp, Artificial Sequence
  Description of Artificial Sequence: Synthetic oligonucleotide
cgagtgactgacaagctgacacctattcacg

SEQ ID NO: 126065 - DNA, 32 bp, Artificial Sequence
  Description of Artificial Sequence: Synthetic oligonucleotide
gagtgactgacaagctgacacctattcacgac

SEQ ID NO: 126066 - DNA, 32 bp, Artificial Sequence
  Description of Artificial Sequence: Synthetic oligonucleotide
agtgactgacaagctgacacctattcacgacc

SEQ ID NO: 126067 - DNA, 31 bp, Artificial Sequence
  Description of Artificial Sequence: Synthetic oligonucleotide
gtgactgacaagctgacacctattcacgacc

SEQ ID NO: 126068 - DNA, 31 bp, Artificial Sequence
  Description of Artificial Sequence: Synthetic oligonucleotide
tgactgacaagctgacacctattcacgaccg

SEQ ID NO: 126069 - DNA, 30 bp, Artificial Sequence
  Description of Artificial Sequence: Synthetic oligonucleotide
gactgacaagctgacacctattcacgaccg

SEQ ID NO: 126070 - DNA, 30 bp, Artificial Sequence
  Description of Artificial Sequence: Synthetic oligonucleotide
actgacaagctgacacctattcacgaccgc

SEQ ID NO: 126071 - DNA, 29 bp, Artificial Sequence
  Description of Artificial Sequence: Synthetic oligonucleotide
ctgacaagctgacacctattcacgaccgc

SEQ ID NO: 126072 - DNA, 34 bp, Artificial Sequence
  Description of Artificial Sequence: Synthetic oligonucleotide
tgacaagctgacacctattcacgaccgcattttc

SEQ ID NO: 126073 - DNA, 33 bp, Artificial Sequence
  Description of Artificial Sequence: Synthetic oligonucleotide
gacaagctgacacctattcacgaccgcattttc

SEQ ID NO: 126074 - DNA, 34 bp, Artificial Sequence
  Description of Artificial Sequence: Synthetic oligonucleotide
acaagctgacacctattcacgaccgcattttctg

SEQ ID NO: 126075 - DNA, 33 bp, Artificial Sequence
  Description of Artificial Sequence: Synthetic oligonucleotide
caagctgacacctattcacgaccgcattttctg

SEQ ID NO: 126076 - DNA, 33 bp, Artificial Sequence
  Description of Artificial Sequence: Synthetic oligonucleotide
aagctgacacctattcacgaccgcattttctgc

SEQ ID NO: 126077 - DNA, 32 bp, Artificial Sequence
  Description of Artificial Sequence: Synthetic oligonucleotide
agctgacacctattcacgaccgcattttctgc

SEQ ID NO: 126078 - DNA, 31 bp, Artificial Sequence
  Description of Artificial Sequence: Synthetic oligonucleotide
gctgacacctattcacgaccgcattttctgc

SEQ ID NO: 126079 - DNA, 32 bp, Artificial Sequence
  Description of Artificial Sequence: Synthetic oligonucleotide
ctgacacctattcacgaccgcattttctgctg

SEQ ID NO: 126080 - DNA, 33 bp, Artificial Sequence
  Description of Artificial Sequence: Synthetic oligonucleotide
tgacacctattcacgaccgcattttctgctgtc

SEQ ID NO: 126081 - DNA, 32 bp, Artificial Sequence
  Description of Artificial Sequence: Synthetic oligonucleotide
gacacctattcacgaccgcattttctgctgtc

SEQ ID NO: 126082 - DNA, 32 bp, Artificial Sequence
  Description of Artificial Sequence: Synthetic oligonucleotide
acacctattcacgaccgcattttctgctgtcg

SEQ ID NO: 126083 - DNA, 31 bp, Artificial Sequence
  Description of Artificial Sequence: Synthetic oligonucleotide
cacctattcacgaccgcattttctgctgtcg

SEQ ID NO: 126084 - DNA, 31 bp, Artificial Sequence
  Description of Artificial Sequence: Synthetic oligonucleotide
acctattcacgaccgcattttctgctgtcgc

SEQ ID NO: 126085 - DNA, 30 bp, Artificial Sequence
  Description of Artificial Sequence: Synthetic oligonucleotide
cctattcacgaccgcattttctgctgtcgc

SEQ ID NO: 126086 - DNA, 31 bp, Artificial Sequence
  Description of Artificial Sequence: Synthetic oligonucleotide
ctattcacgaccgcattttctgctgtcgctc

SEQ ID NO: 126087 - DNA, 32 bp, Artificial Sequence
  Description of Artificial Sequence: Synthetic oligonucleotide
tattcacgaccgcattttctgctgtcgctcag

SEQ ID NO: 126088 - DNA, 31 bp, Artificial Sequence
  Description of Artificial Sequence: Synthetic oligonucleotide
attcacgaccgcattttctgctgtcgctcag

SEQ ID NO: 126089 - DNA, 30 bp, Artificial Sequence
  Description of Artificial Sequence: Synthetic oligonucleotide
ttcacgaccgcattttctgctgtcgctcag

SEQ ID NO: 126090 - DNA, 29 bp, Artificial Sequence
  Description of Artificial Sequence: Synthetic oligonucleotide
tcacgaccgcattttctgctgtcgctcag

SEQ ID NO: 126091 - DNA, 28 bp, Artificial Sequence
  Description of Artificial Sequence: Synthetic oligonucleotide
cacgaccgcattttctgctgtcgctcag

SEQ ID NO: 126092 - DNA, 28 bp, Artificial Sequence
  Description of Artificial Sequence: Synthetic oligonucleotide
acgaccgcattttctgctgtcgctcagg

SEQ ID NO: 126093 - DNA, 27 bp, Artificial Sequence
  Description of Artificial Sequence: Synthetic oligonucleotide
cgaccgcattttctgctgtcgctcagg

SEQ ID NO: 126094 - DNA, 27 bp, Artificial Sequence
  Description of Artificial Sequence: Synthetic oligonucleotide
gaccgcattttctgctgtcgctcaggc

SEQ ID NO: 126095 - DNA, 28 bp, Artificial Sequence
  Description of Artificial Sequence: Synthetic oligonucleotide
accgcattttctgctgtcgctcaggctc

SEQ ID NO: 126096 - DNA, 27 bp, Artificial Sequence
  Description of Artificial Sequence: Synthetic oligonucleotide
ccgcattttctgctgtcgctcaggctc

SEQ ID NO: 126097 - DNA, 28 bp, Artificial Sequence
  Description of Artificial Sequence: Synthetic oligonucleotide
cgcattttctgctgtcgctcaggctcag

SEQ ID NO: 126098 - DNA, 28 bp, Artificial Sequence
  Description of Artificial Sequence: Synthetic oligonucleotide
gcattttctgctgtcgctcaggctcagc

SEQ ID NO: 126099 - DNA, 29 bp, Artificial Sequence
  Description of Artificial Sequence: Synthetic oligonucleotide
cattttctgctgtcgctcaggctcagctg

SEQ ID NO: 126100 - DNA, 29 bp, Artificial Sequence
  Description of Artificial Sequence: Synthetic oligonucleotide
attttctgctgtcgctcaggctcagctgc

SEQ ID NO: 126101 - DNA, 28 bp, Artificial Sequence
  Description of Artificial Sequence: Synthetic oligonucleotide
ttttctgctgtcgctcaggctcagctgc

SEQ ID NO: 126102 - DNA, 27 bp, Artificial Sequence
  Description of Artificial Sequence: Synthetic oligonucleotide
tttctgctgtcgctcaggctcagctgc

SEQ ID NO: 126103 - DNA, 27 bp, Artificial Sequence
  Description of Artificial Sequence: Synthetic oligonucleotide
ttctgctgtcgctcaggctcagctgct

SEQ ID NO: 126104 - DNA, 26 bp, Artificial Sequence
  Description of Artificial Sequence: Synthetic oligonucleotide
tctgctgtcgctcaggctcagctgct

SEQ ID NO: 126105 - DNA, 25 bp, Artificial Sequence
  Description of Artificial Sequence: Synthetic oligonucleotide
ctgctgtcgctcaggctcagctgct

SEQ ID NO: 126106 - DNA, 27 bp, Artificial Sequence
  Description of Artificial Sequence: Synthetic oligonucleotide
tgctgtcgctcaggctcagctgctgat

SEQ ID NO: 126107 - DNA, 27 bp, Artificial Sequence
  Description of Artificial Sequence: Synthetic oligonucleotide
gctgtcgctcaggctcagctgctgata

SEQ ID NO: 126108 - DNA, 27 bp, Artificial Sequence
  Description of Artificial Sequence: Synthetic oligonucleotide
ctgtcgctcaggctcagctgctgatac

SEQ ID NO: 126109 - DNA, 27 bp, Artificial Sequence
  Description of Artificial Sequence: Synthetic oligonucleotide
tgtcgctcaggctcagctgctgatacc

SEQ ID NO: 126110 - DNA, 26 bp, Artificial Sequence
  Description of Artificial Sequence: Synthetic oligonucleotide
gtcgctcaggctcagctgctgatacc

SEQ ID NO: 126111 - DNA, 27 bp, Artificial Sequence
  Description of Artificial Sequence: Synthetic oligonucleotide
tcgctcaggctcagctgctgataccca

SEQ ID NO: 126112 - DNA, 26 bp, Artificial Sequence
  Description of Artificial Sequence: Synthetic oligonucleotide
cgctcaggctcagctgctgataccca

SEQ ID NO: 126113 - DNA, 26 bp, Artificial Sequence
  Description of Artificial Sequence: Synthetic oligonucleotide
gctcaggctcagctgctgatacccag

SEQ ID NO: 126114 - DNA, 26 bp, Artificial Sequence
  Description of Artificial Sequence: Synthetic oligonucleotide
ctcaggctcagctgctgatacccagg

SEQ ID NO: 126115 - DNA, 27 bp, Artificial Sequence
  Description of Artificial Sequence: Synthetic oligonucleotide
tcaggctcagctgctgatacccaggca

SEQ ID NO: 126116 - DNA, 26 bp, Artificial Sequence
  Description of Artificial Sequence: Synthetic oligonucleotide
caggctcagctgctgatacccaggca

SEQ ID NO: 126117 - DNA, 27 bp, Artificial Sequence
  Description of Artificial Sequence: Synthetic oligonucleotide
aggctcagctgctgatacccaggcagt

SEQ ID NO: 126118 - DNA, 27 bp, Artificial Sequence
  Description of Artificial Sequence: Synthetic oligonucleotide
ggctcagctgctgatacccaggcagta

SEQ ID NO: 126119 - DNA, 27 bp, Artificial Sequence
  Description of Artificial Sequence: Synthetic oligonucleotide
gctcagctgctgatacccaggcagtag

SEQ ID NO: 126120 - DNA, 27 bp, Artificial Sequence
  Description of Artificial Sequence: Synthetic oligonucleotide
ctcagctgctgatacccaggcagtagc

SEQ ID NO: 126121 - DNA, 28 bp, Artificial Sequence
  Description of Artificial Sequence: Synthetic oligonucleotide
tcagctgctgatacccaggcagtagctg

SEQ ID NO: 126122 - DNA, 27 bp, Artificial Sequence
  Description of Artificial Sequence: Synthetic oligonucleotide
cagctgctgatacccaggcagtagctg

SEQ ID NO: 126123 - DNA, 29 bp, Artificial Sequence
  Description of Artificial Sequence: Synthetic oligonucleotide
agctgctgatacccaggcagtagctgatg

SEQ ID NO: 126124 - DNA, 28 bp, Artificial Sequence
  Description of Artificial Sequence: Synthetic oligonucleotide
gctgctgatacccaggcagtagctgatg

SEQ ID NO: 126125 - DNA, 28 bp, Artificial Sequence
  Description of Artificial Sequence: Synthetic oligonucleotide
ctgctgatacccaggcagtagctgatgc

SEQ ID NO: 126126 - DNA, 29 bp, Artificial Sequence
  Description of Artificial Sequence: Synthetic oligonucleotide
tgctgatacccaggcagtagctgatgctg

SEQ ID NO: 126127 - DNA, 28 bp, Artificial Sequence
  Description of Artificial Sequence: Synthetic oligonucleotide
gctgatacccaggcagtagctgatgctg

SEQ ID NO: 126128 - DNA, 29 bp, Artificial Sequence
  Description of Artificial Sequence: Synthetic oligonucleotide
ctgatacccaggcagtagctgatgctgtc

SEQ ID NO: 126129 - DNA, 30 bp, Artificial Sequence
  Description of Artificial Sequence: Synthetic oligonucleotide
tgatacccaggcagtagctgatgctgtcac

SEQ ID NO: 126130 - DNA, 29 bp, Artificial Sequence
  Description of Artificial Sequence: Synthetic oligonucleotide
gatacccaggcagtagctgatgctgtcac

SEQ ID NO: 126131 - DNA, 29 bp, Artificial Sequence
  Description of Artificial Sequence: Synthetic oligonucleotide
atacccaggcagtagctgatgctgtcacc

SEQ ID NO: 126132 - DNA, 28 bp, Artificial Sequence
  Description of Artificial Sequence: Synthetic oligonucleotide
tacccaggcagtagctgatgctgtcacc

SEQ ID NO: 126133 - DNA, 27 bp, Artificial Sequence
  Description of Artificial Sequence: Synthetic oligonucleotide
acccaggcagtagctgatgctgtcacc

SEQ ID NO: 126134 - DNA, 27 bp, Artificial Sequence
  Description of Artificial Sequence: Synthetic oligonucleotide
cccaggcagtagctgatgctgtcacct

SEQ ID NO: 126135 - DNA, 28 bp, Artificial Sequence
  Description of Artificial Sequence: Synthetic oligonucleotide
ccaggcagtagctgatgctgtcacctac

SEQ ID NO: 126136 - DNA, 28 bp, Artificial Sequence
  Description of Artificial Sequence: Synthetic oligonucleotide
caggcagtagctgatgctgtcacctacc

SEQ ID NO: 126137 - DNA, 29 bp, Artificial Sequence
  Description of Artificial Sequence: Synthetic oligonucleotide
aggcagtagctgatgctgtcacctaccag

SEQ ID NO: 126138 - DNA, 28 bp, Artificial Sequence
  Description of Artificial Sequence: Synthetic oligonucleotide
ggcagtagctgatgctgtcacctaccag

SEQ ID NO: 126139 - DNA, 28 bp, Artificial Sequence
  Description of Artificial Sequence: Synthetic oligonucleotide
gcagtagctgatgctgtcacctaccagc

SEQ ID NO: 126140 - DNA, 29 bp, Artificial Sequence
  Description of Artificial Sequence: Synthetic oligonucleotide
cagtagctgatgctgtcacctaccagctc

SEQ ID NO: 126141 - DNA, 29 bp, Artificial Sequence
  Description of Artificial Sequence: Synthetic oligonucleotide
agtagctgatgctgtcacctaccagctcg

SEQ ID NO: 126142 - DNA, 28 bp, Artificial Sequence
  Description of Artificial Sequence: Synthetic oligonucleotide
gtagctgatgctgtcacctaccagctcg

SEQ ID NO: 126143 - DNA, 28 bp, Artificial Sequence
  Description of Artificial Sequence: Synthetic oligonucleotide
tagctgatgctgtcacctaccagctcgg

SEQ ID NO: 126144 - DNA, 27 bp, Artificial Sequence
  Description of Artificial Sequence: Synthetic oligonucleotide
agctgatgctgtcacctaccagctcgg

SEQ ID NO: 126145 - DNA, 27 bp, Artificial Sequence
  Description of Artificial Sequence: Synthetic oligonucleotide
gctgatgctgtcacctaccagctcggt

SEQ ID NO: 126146 - DNA, 29 bp, Artificial Sequence
  Description of Artificial Sequence: Synthetic oligonucleotide
ctgatgctgtcacctaccagctcggtttc

SEQ ID NO: 126147 - DNA, 29 bp, Artificial Sequence
  Description of Artificial Sequence: Synthetic oligonucleotide
tgatgctgtcacctaccagctcggtttcc

SEQ ID NO: 126148 - DNA, 28 bp, Artificial Sequence
  Description of Artificial Sequence: Synthetic oligonucleotide
gatgctgtcacctaccagctcggtttcc

SEQ ID NO: 126149 - DNA, 29 bp, Artificial Sequence
  Description of Artificial Sequence: Synthetic oligonucleotide
atgctgtcacctaccagctcggtttccac

SEQ ID NO: 126150 - DNA, 28 bp, Artificial Sequence
  Description of Artificial Sequence: Synthetic oligonucleotide
tgctgtcacctaccagctcggtttccac

SEQ ID NO: 126151 - DNA, 27 bp, Artificial Sequence
  Description of Artificial Sequence: Synthetic oligonucleotide
gctgtcacctaccagctcggtttccac

SEQ ID NO: 126152 - DNA, 28 bp, Artificial Sequence
  Description of Artificial Sequence: Synthetic oligonucleotide
ctgtcacctaccagctcggtttccacag

SEQ ID NO: 126153 - DNA, 28 bp, Artificial Sequence
  Description of Artificial Sequence: Synthetic oligonucleotide
tgtcacctaccagctcggtttccacagc

SEQ ID NO: 126154 - DNA, 27 bp, Artificial Sequence
  Description of Artificial Sequence: Synthetic oligonucleotide
gtcacctaccagctcggtttccacagc

SEQ ID NO: 126155 - DNA, 30 bp, Artificial Sequence
  Description of Artificial Sequence: Synthetic oligonucleotide
tcacctaccagctcggtttccacagcattg

SEQ ID NO: 126156 - DNA, 29 bp, Artificial Sequence
  Description of Artificial Sequence: Synthetic oligonucleotide
cacctaccagctcggtttccacagcattg

SEQ ID NO: 126157 - DNA, 31 bp, Artificial Sequence
  Description of Artificial Sequence: Synthetic oligonucleotide
acctaccagctcggtttccacagcattgaac

SEQ ID NO: 126158 - DNA, 30 bp, Artificial Sequence
  Description of Artificial Sequence: Synthetic oligonucleotide
cctaccagctcggtttccacagcattgaac

SEQ ID NO: 126159 - DNA, 31 bp, Artificial Sequence
  Description of Artificial Sequence: Synthetic oligonucleotide
ctaccagctcggtttccacagcattgaactg

SEQ ID NO: 126160 - DNA, 34 bp, Artificial Sequence
  Description of Artificial Sequence: Synthetic oligonucleotide
taccagctcggtttccacagcattgaactgaatg

SEQ ID NO: 126161 - DNA, 33 bp, Artificial Sequence
  Description of Artificial Sequence: Synthetic oligonucleotide
accagctcggtttccacagcattgaactgaatg

SEQ ID NO: 126162 - DNA, 32 bp, Artificial Sequence
  Description of Artificial Sequence: Synthetic oligonucleotide
ccagctcggtttccacagcattgaactgaatg

SEQ ID NO: 126163 - DNA, 33 bp, Artificial Sequence
  Description of Artificial Sequence: Synthetic oligonucleotide
cagctcggtttccacagcattgaactgaatgag

SEQ ID NO: 126164 - DNA, 33 bp, Artificial Sequence
  Description of Artificial Sequence: Synthetic oligonucleotide
agctcggtttccacagcattgaactgaatgagc

SEQ ID NO: 126165 - DNA, 32 bp, Artificial Sequence
  Description of Artificial Sequence: Synthetic oligonucleotide
gctcggtttccacagcattgaactgaatgagc

SEQ ID NO: 126166 - DNA, 32 bp, Artificial Sequence
  Description of Artificial Sequence: Synthetic oligonucleotide
ctcggtttccacagcattgaactgaatgagcc

SEQ ID NO: 126167 - DNA, 33 bp, Artificial Sequence
  Description of Artificial Sequence: Synthetic oligonucleotide
tcggtttccacagcattgaactgaatgagcctc

SEQ ID NO: 126168 - DNA, 32 bp, Artificial Sequence
  Description of Artificial Sequence: Synthetic oligonucleotide
cggtttccacagcattgaactgaatgagcctc

SEQ ID NO: 126169 - DNA, 32 bp, Artificial Sequence
  Description of Artificial Sequence: Synthetic oligonucleotide
ggtttccacagcattgaactgaatgagcctcc

SEQ ID NO: 126170 - DNA, 33 bp, Artificial Sequence
  Description of Artificial Sequence: Synthetic oligonucleotide
gtttccacagcattgaactgaatgagcctccac

SEQ ID NO: 126171 - DNA, 34 bp, Artificial Sequence
  Description of Artificial Sequence: Synthetic oligonucleotide
tttccacagcattgaactgaatgagcctccactg

SEQ ID NO: 126172 - DNA, 33 bp, Artificial Sequence
  Description of Artificial Sequence: Synthetic oligonucleotide
ttccacagcattgaactgaatgagcctccactg

SEQ ID NO: 126173 - DNA, 32 bp, Artificial Sequence
  Description of Artificial Sequence: Synthetic oligonucleotide
tccacagcattgaactgaatgagcctccactg

SEQ ID NO: 126174 - DNA, 31 bp, Artificial Sequence
  Description of Artificial Sequence: Synthetic oligonucleotide
ccacagcattgaactgaatgagcctccactg

SEQ ID NO: 126175 - DNA, 31 bp, Artificial Sequence
  Description of Artificial Sequence: Synthetic oligonucleotide
cacagcattgaactgaatgagcctccactgg

SEQ ID NO: 126176 - DNA, 32 bp, Artificial Sequence
  Description of Artificial Sequence: Synthetic oligonucleotide
acagcattgaactgaatgagcctccactggtc

SEQ ID NO: 126177 - DNA, 31 bp, Artificial Sequence
  Description of Artificial Sequence: Synthetic oligonucleotide
cagcattgaactgaatgagcctccactggtc

SEQ ID NO: 126178 - DNA, 31 bp, Artificial Sequence
  Description of Artificial Sequence: Synthetic oligonucleotide
agcattgaactgaatgagcctccactggtcc

SEQ ID NO: 126179 - DNA, 30 bp, Artificial Sequence
  Description of Artificial Sequence: Synthetic oligonucleotide
gcattgaactgaatgagcctccactggtcc

SEQ ID NO: 126180 - DNA, 31 bp, Artificial Sequence
  Description of Artificial Sequence: Synthetic oligonucleotide
cattgaactgaatgagcctccactggtccac

SEQ ID NO: 126181 - DNA, 32 bp, Artificial Sequence
  Description of Artificial Sequence: Synthetic oligonucleotide
attgaactgaatgagcctccactggtccacac

SEQ ID NO: 126182 - DNA, 31 bp, Artificial Sequence
  Description of Artificial Sequence: Synthetic oligonucleotide
ttgaactgaatgagcctccactggtccacac

SEQ ID NO: 126183 - DNA, 30 bp, Artificial Sequence
  Description of Artificial Sequence: Synthetic oligonucleotide
tgaactgaatgagcctccactggtccacac

SEQ ID NO: 126184 - DNA, 29 bp, Artificial Sequence
  Description of Artificial Sequence: Synthetic oligonucleotide
gaactgaatgagcctccactggtccacac

SEQ ID NO: 126185 - DNA, 30 bp, Artificial Sequence
  Description of Artificial Sequence: Synthetic oligonucleotide
aactgaatgagcctccactggtccacacag

SEQ ID NO: 126186 - DNA, 29 bp, Artificial Sequence
  Description of Artificial Sequence: Synthetic oligonucleotide
actgaatgagcctccactggtccacacag

SEQ ID NO: 126187 - DNA, 28 bp, Artificial Sequence
  Description of Artificial Sequence: Synthetic oligonucleotide
ctgaatgagcctccactggtccacacag

SEQ ID NO: 126188 - DNA, 28 bp, Artificial Sequence
  Description of Artificial Sequence: Synthetic oligonucleotide
tgaatgagcctccactggtccacacagc

SEQ ID NO: 126189 - DNA, 27 bp, Artificial Sequence
  Description of Artificial Sequence: Synthetic oligonucleotide
gaatgagcctccactggtccacacagc

SEQ ID NO: 126190 - DNA, 28 bp, Artificial Sequence
  Description of Artificial Sequence: Synthetic oligonucleotide
aatgagcctccactggtccacacagcag

SEQ ID NO: 126191 - DNA, 27 bp, Artificial Sequence
  Description of Artificial Sequence: Synthetic oligonucleotide
atgagcctccactggtccacacagcag

SEQ ID NO: 126192 - DNA, 26 bp, Artificial Sequence
  Description of Artificial Sequence: Synthetic oligonucleotide
tgagcctccactggtccacacagcag

SEQ ID NO: 126193 - DNA, 25 bp, Artificial Sequence
  Description of Artificial Sequence: Synthetic oligonucleotide
gagcctccactggtccacacagcag

SEQ ID NO: 126194 - DNA, 25 bp, Artificial Sequence
  Description of Artificial Sequence: Synthetic oligonucleotide
agcctccactggtccacacagcagc

SEQ ID NO: 126195 - DNA, 24 bp, Artificial Sequence
  Description of Artificial Sequence: Synthetic oligonucleotide
gcctccactggtccacacagcagc

SEQ ID NO: 126196 - DNA, 25 bp, Artificial Sequence
  Description of Artificial Sequence: Synthetic oligonucleotide
cctccactggtccacacagcagcca

SEQ ID NO: 126197 - DNA, 25 bp, Artificial Sequence
  Description of Artificial Sequence: Synthetic oligonucleotide
ctccactggtccacacagcagccag

SEQ ID NO: 126198 - DNA, 25 bp, Artificial Sequence
  Description of Artificial Sequence: Synthetic oligonucleotide
tccactggtccacacagcagccagc

SEQ ID NO: 126199 - DNA, 24 bp, Artificial Sequence
  Description of Artificial Sequence: Synthetic oligonucleotide
ccactggtccacacagcagccagc

SEQ ID NO: 126200 - DNA, 25 bp, Artificial Sequence
  Description of Artificial Sequence: Synthetic oligonucleotide
cactggtccacacagcagccagcct

SEQ ID NO: 126201 - DNA, 27 bp, Artificial Sequence
  Description of Artificial Sequence: Synthetic oligonucleotide
actggtccacacagcagccagcctctt

SEQ ID NO: 126202 - DNA, 27 bp, Artificial Sequence
  Description of Artificial Sequence: Synthetic oligonucleotide
ctggtccacacagcagccagcctcttt

SEQ ID NO: 126203 - DNA, 29 bp, Artificial Sequence
  Description of Artificial Sequence: Synthetic oligonucleotide
tggtccacacagcagccagcctctttaag

SEQ ID NO: 126204 - DNA, 28 bp, Artificial Sequence
  Description of Artificial Sequence: Synthetic oligonucleotide
ggtccacacagcagccagcctctttaag

SEQ ID NO: 126205 - DNA, 28 bp, Artificial Sequence
  Description of Artificial Sequence: Synthetic oligonucleotide
gtccacacagcagccagcctctttaagg

SEQ ID NO: 126206 - DNA, 29 bp, Artificial Sequence
  Description of Artificial Sequence: Synthetic oligonucleotide
tccacacagcagccagcctctttaaggag

SEQ ID NO: 126207 - DNA, 28 bp, Artificial Sequence
  Description of Artificial Sequence: Synthetic oligonucleotide
ccacacagcagccagcctctttaaggag

SEQ ID NO: 126208 - DNA, 30 bp, Artificial Sequence
  Description of Artificial Sequence: Synthetic oligonucleotide
cacacagcagccagcctctttaaggagatg

SEQ ID NO: 126209 - DNA, 31 bp, Artificial Sequence
  Description of Artificial Sequence: Synthetic oligonucleotide
acacagcagccagcctctttaaggagatgtg

SEQ ID NO: 126210 - DNA, 30 bp, Artificial Sequence
  Description of Artificial Sequence: Synthetic oligonucleotide
cacagcagccagcctctttaaggagatgtg

SEQ ID NO: 126211 - DNA, 33 bp, Artificial Sequence
  Description of Artificial Sequence: Synthetic oligonucleotide
acagcagccagcctctttaaggagatgtgttac

SEQ ID NO: 126212 - DNA, 32 bp, Artificial Sequence
  Description of Artificial Sequence: Synthetic oligonucleotide
cagcagccagcctctttaaggagatgtgttac

SEQ ID NO: 126213 - DNA, 32 bp, Artificial Sequence
  Description of Artificial Sequence: Synthetic oligonucleotide
agcagccagcctctttaaggagatgtgttacc

SEQ ID NO: 126214 - DNA, 31 bp, Artificial Sequence
  Description of Artificial Sequence: Synthetic oligonucleotide
gcagccagcctctttaaggagatgtgttacc

SEQ ID NO: 126215 - DNA, 31 bp, Artificial Sequence
  Description of Artificial Sequence: Synthetic oligonucleotide
cagccagcctctttaaggagatgtgttaccg

SEQ ID NO: 126216 - DNA, 34 bp, Artificial Sequence
  Description of Artificial Sequence: Synthetic oligonucleotide
agccagcctctttaaggagatgtgttaccgatac

SEQ ID NO: 126217 - DNA, 33 bp, Artificial Sequence
  Description of Artificial Sequence: Synthetic oligonucleotide
gccagcctctttaaggagatgtgttaccgatac

SEQ ID NO: 126218 - DNA, 33 bp, Artificial Sequence
  Description of Artificial Sequence: Synthetic oligonucleotide
ccagcctctttaaggagatgtgttaccgatacc

SEQ ID NO: 126219 - DNA, 33 bp, Artificial Sequence
  Description of Artificial Sequence: Synthetic oligonucleotide
cagcctctttaaggagatgtgttaccgataccg

SEQ ID NO: 126220 - DNA, 33 bp, Artificial Sequence
  Description of Artificial Sequence: Synthetic oligonucleotide
agcctctttaaggagatgtgttaccgataccgg

SEQ ID NO: 126221 - DNA, 32 bp, Artificial Sequence
  Description of Artificial Sequence: Synthetic oligonucleotide
gcctctttaaggagatgtgttaccgataccgg

SEQ ID NO: 126222 - DNA, 32 bp, Artificial Sequence
  Description of Artificial Sequence: Synthetic oligonucleotide
cctctttaaggagatgtgttaccgataccggg

SEQ ID NO: 126223 - DNA, 34 bp, Artificial Sequence
  Description of Artificial Sequence: Synthetic oligonucleotide
ctctttaaggagatgtgttaccgataccgggaag

SEQ ID NO: 126224 - DNA, 35 bp, Artificial Sequence
  Description of Artificial Sequence: Synthetic oligonucleotide
tctttaaggagatgtgttaccgataccgggaagac

SEQ ID NO: 126225 - DNA, 34 bp, Artificial Sequence
  Description of Artificial Sequence: Synthetic oligonucleotide
ctttaaggagatgtgttaccgataccgggaagac

SEQ ID NO: 126226 - DNA, 34 bp, Artificial Sequence
  Description of Artificial Sequence: Synthetic oligonucleotide
tttaaggagatgtgttaccgataccgggaagacc

SEQ ID NO: 126227 - DNA, 33 bp, Artificial Sequence
  Description of Artificial Sequence: Synthetic oligonucleotide
ttaaggagatgtgttaccgataccgggaagacc

SEQ ID NO: 126228 - DNA, 32 bp, Artificial Sequence
  Description of Artificial Sequence: Synthetic oligonucleotide
taaggagatgtgttaccgataccgggaagacc

SEQ ID NO: 126229 - DNA, 31 bp, Artificial Sequence
  Description of Artificial Sequence: Synthetic oligonucleotide
aaggagatgtgttaccgataccgggaagacc

SEQ ID NO: 126230 - DNA, 30 bp, Artificial Sequence
  Description of Artificial Sequence: Synthetic oligonucleotide
aggagatgtgttaccgataccgggaagacc

SEQ ID NO: 126231 - DNA, 29 bp, Artificial Sequence
  Description of Artificial Sequence: Synthetic oligonucleotide
ggagatgtgttaccgataccgggaagacc

SEQ ID NO: 126232 - DNA, 30 bp, Artificial Sequence
  Description of Artificial Sequence: Synthetic oligonucleotide
gagatgtgttaccgataccgggaagacctg

SEQ ID NO: 126233 - DNA, 32 bp, Artificial Sequence
  Description of Artificial Sequence: Synthetic oligonucleotide
agatgtgttaccgataccgggaagacctgatg

SEQ ID NO: 126234 - DNA, 31 bp, Artificial Sequence
  Description of Artificial Sequence: Synthetic oligonucleotide
gatgtgttaccgataccgggaagacctgatg

SEQ ID NO: 126235 - DNA, 31 bp, Artificial Sequence
  Description of Artificial Sequence: Synthetic oligonucleotide
atgtgttaccgataccgggaagacctgatgg

SEQ ID NO: 126236 - DNA, 30 bp, Artificial Sequence
  Description of Artificial Sequence: Synthetic oligonucleotide
tgtgttaccgataccgggaagacctgatgg

SEQ ID NO: 126237 - DNA, 29 bp, Artificial Sequence
  Description of Artificial Sequence: Synthetic oligonucleotide
gtgttaccgataccgggaagacctgatgg

SEQ ID NO: 126238 - DNA, 29 bp, Artificial Sequence
  Description of Artificial Sequence: Synthetic oligonucleotide
tgttaccgataccgggaagacctgatggc

SEQ ID NO: 126239 - DNA, 28 bp, Artificial Sequence
  Description of Artificial Sequence: Synthetic oligonucleotide
gttaccgataccgggaagacctgatggc

SEQ ID NO: 126240 - DNA, 28 bp, Artificial Sequence
  Description of Artificial Sequence: Synthetic oligonucleotide
ttaccgataccgggaagacctgatggcg

SEQ ID NO: 126241 - DNA, 27 bp, Artificial Sequence
  Description of Artificial Sequence: Synthetic oligonucleotide
taccgataccgggaagacctgatggcg

SEQ ID NO: 126242 - DNA, 26 bp, Artificial Sequence
  Description of Artificial Sequence: Synthetic oligonucleotide
accgataccgggaagacctgatggcg

SEQ ID NO: 126243 - DNA, 25 bp, Artificial Sequence
  Description of Artificial Sequence: Synthetic oligonucleotide
ccgataccgggaagacctgatggcg

SEQ ID NO: 126244 - DNA, 25 bp, Artificial Sequence
  Description of Artificial Sequence: Synthetic oligonucleotide
cgataccgggaagacctgatggcgg

SEQ ID NO: 126245 - DNA, 27 bp, Artificial Sequence
  Description of Artificial Sequence: Synthetic oligonucleotide
gataccgggaagacctgatggcgggaa

SEQ ID NO: 126246 - DNA, 28 bp, Artificial Sequence
  Description of Artificial Sequence: Synthetic oligonucleotide
ataccgggaagacctgatggcgggaatc

SEQ ID NO: 126247 - DNA, 27 bp, Artificial Sequence
  Description of Artificial Sequence: Synthetic oligonucleotide
taccgggaagacctgatggcgggaatc

SEQ ID NO: 126248 - DNA, 27 bp, Artificial Sequence
  Description of Artificial Sequence: Synthetic oligonucleotide
accgggaagacctgatggcgggaatca

SEQ ID NO: 126249 - DNA, 27 bp, Artificial Sequence
  Description of Artificial Sequence: Synthetic oligonucleotide
ccgggaagacctgatggcgggaatcat

SEQ ID NO: 126250 - DNA, 27 bp, Artificial Sequence
  Description of Artificial Sequence: Synthetic oligonucleotide
cgggaagacctgatggcgggaatcatc

SEQ ID NO: 126251 - DNA, 29 bp, Artificial Sequence
  Description of Artificial Sequence: Synthetic oligonucleotide
gggaagacctgatggcgggaatcatcatc

SEQ ID NO: 126252 - DNA, 29 bp, Artificial Sequence
  Description of Artificial Sequence: Synthetic oligonucleotide
ggaagacctgatggcgggaatcatcatcg

SEQ ID NO: 126253 - DNA, 29 bp, Artificial Sequence
  Description of Artificial Sequence: Synthetic oligonucleotide
gaagacctgatggcgggaatcatcatcgc

SEQ ID NO: 126254 - DNA, 30 bp, Artificial Sequence
  Description of Artificial Sequence: Synthetic oligonucleotide
aagacctgatggcgggaatcatcatcgcag

SEQ ID NO: 126255 - DNA, 29 bp, Artificial Sequence
  Description of Artificial Sequence: Synthetic oligonucleotide
agacctgatggcgggaatcatcatcgcag

SEQ ID NO: 126256 - DNA, 28 bp, Artificial Sequence
  Description of Artificial Sequence: Synthetic oligonucleotide
gacctgatggcgggaatcatcatcgcag

SEQ ID NO: 126257 - DNA, 28 bp, Artificial Sequence
  Description of Artificial Sequence: Synthetic oligonucleotide
acctgatggcgggaatcatcatcgcagg

SEQ ID NO: 126258 - DNA, 27 bp, Artificial Sequence
  Description of Artificial Sequence: Synthetic oligonucleotide
cctgatggcgggaatcatcatcgcagg

SEQ ID NO: 126259 - DNA, 27 bp, Artificial Sequence
  Description of Artificial Sequence: Synthetic oligonucleotide
ctgatggcgggaatcatcatcgcaggc

SEQ ID NO: 126260 - DNA, 28 bp, Artificial Sequence
  Description of Artificial Sequence: Synthetic oligonucleotide
tgatggcgggaatcatcatcgcaggctg

SEQ ID NO: 126261 - DNA, 27 bp, Artificial Sequence
  Description of Artificial Sequence: Synthetic oligonucleotide
gatggcgggaatcatcatcgcaggctg

SEQ ID NO: 126262 - DNA, 27 bp, Artificial Sequence
  Description of Artificial Sequence: Synthetic oligonucleotide
atggcgggaatcatcatcgcaggctgg

SEQ ID NO: 126263 - DNA, 26 bp, Artificial Sequence
  Description of Artificial Sequence: Synthetic oligonucleotide
tggcgggaatcatcatcgcaggctgg

SEQ ID NO: 126264 - DNA, 25 bp, Artificial Sequence
  Description of Artificial Sequence: Synthetic oligonucleotide
ggcgggaatcatcatcgcaggctgg

SEQ ID NO: 126265 - DNA, 26 bp, Artificial Sequence
  Description of Artificial Sequence: Synthetic oligonucleotide
gcgggaatcatcatcgcaggctggga

SEQ ID NO: 126266 - DNA, 26 bp, Artificial Sequence
  Description of Artificial Sequence: Synthetic oligonucleotide
cgggaatcatcatcgcaggctgggac

SEQ ID NO: 126267 - DNA, 26 bp, Artificial Sequence
  Description of Artificial Sequence: Synthetic oligonucleotide
gggaatcatcatcgcaggctgggacc

SEQ ID NO: 126268 - DNA, 27 bp, Artificial Sequence
  Description of Artificial Sequence: Synthetic oligonucleotide
ggaatcatcatcgcaggctgggaccct

SEQ ID NO: 126269 - DNA, 27 bp, Artificial Sequence
  Description of Artificial Sequence: Synthetic oligonucleotide
gaatcatcatcgcaggctgggaccctc

SEQ ID NO: 126270 - DNA, 29 bp, Artificial Sequence
  Description of Artificial Sequence: Synthetic oligonucleotide
aatcatcatcgcaggctgggaccctcaag

SEQ ID NO: 126271 - DNA, 28 bp, Artificial Sequence
  Description of Artificial Sequence: Synthetic oligonucleotide
atcatcatcgcaggctgggaccctcaag

SEQ ID NO: 126272 - DNA, 27 bp, Artificial Sequence
  Description of Artificial Sequence: Synthetic oligonucleotide
tcatcatcgcaggctgggaccctcaag

SEQ ID NO: 126273 - DNA, 27 bp, Artificial Sequence
  Description of Artificial Sequence: Synthetic oligonucleotide
catcatcgcaggctgggaccctcaaga

SEQ ID NO: 126274 - DNA, 28 bp, Artificial Sequence
  Description of Artificial Sequence: Synthetic oligonucleotide
atcatcgcaggctgggaccctcaagaag

SEQ ID NO: 126275 - DNA, 27 bp, Artificial Sequence
  Description of Artificial Sequence: Synthetic oligonucleotide
tcatcgcaggctgggaccctcaagaag

SEQ ID NO: 126276 - DNA, 26 bp, Artificial Sequence
  Description of Artificial Sequence: Synthetic oligonucleotide
catcgcaggctgggaccctcaagaag

SEQ ID NO: 126277 - DNA, 27 bp, Artificial Sequence
  Description of Artificial Sequence: Synthetic oligonucleotide
atcgcaggctgggaccctcaagaagga

SEQ ID NO: 126278 - DNA, 26 bp, Artificial Sequence
  Description of Artificial Sequence: Synthetic oligonucleotide
tcgcaggctgggaccctcaagaagga

SEQ ID NO: 126279 - DNA, 25 bp, Artificial Sequence
  Description of Artificial Sequence: Synthetic oligonucleotide
cgcaggctgggaccctcaagaagga

SEQ ID NO: 126280 - DNA, 25 bp, Artificial Sequence
  Description of Artificial Sequence: Synthetic oligonucleotide
gcaggctgggaccctcaagaaggag

SEQ ID NO: 126281 - DNA, 25 bp, Artificial Sequence
  Description of Artificial Sequence: Synthetic oligonucleotide
caggctgggaccctcaagaaggagg

SEQ ID NO: 126282 - DNA, 25 bp, Artificial Sequence
  Description of Artificial Sequence: Synthetic oligonucleotide
aggctgggaccctcaagaaggaggg

SEQ ID NO: 126283 - DNA, 24 bp, Artificial Sequence
  Description of Artificial Sequence: Synthetic oligonucleotide
ggctgggaccctcaagaaggaggg

SEQ ID NO: 126284 - DNA, 25 bp, Artificial Sequence
  Description of Artificial Sequence: Synthetic oligonucleotide
gctgggaccctcaagaaggagggca

SEQ ID NO: 126285 - DNA, 25 bp, Artificial Sequence
  Description of Artificial Sequence: Synthetic oligonucleotide
ctgggaccctcaagaaggagggcag

SEQ ID NO: 126286 - DNA, 26 bp, Artificial Sequence
  Description of Artificial Sequence: Synthetic oligonucleotide
tgggaccctcaagaaggagggcaggt

SEQ ID NO: 126287 - DNA, 25 bp, Artificial Sequence
  Description of Artificial Sequence: Synthetic oligonucleotide
gggaccctcaagaaggagggcaggt

SEQ ID NO: 126288 - DNA, 27 bp, Artificial Sequence
  Description of Artificial Sequence: Synthetic oligonucleotide
ggaccctcaagaaggagggcaggtgta

SEQ ID NO: 126289 - DNA, 27 bp, Artificial Sequence
  Description of Artificial Sequence: Synthetic oligonucleotide
gaccctcaagaaggagggcaggtgtac

SEQ ID NO: 126290 - DNA, 28 bp, Artificial Sequence
  Description of Artificial Sequence: Synthetic oligonucleotide
accctcaagaaggagggcaggtgtactc

SEQ ID NO: 126291 - DNA, 27 bp, Artificial Sequence
  Description of Artificial Sequence: Synthetic oligonucleotide
ccctcaagaaggagggcaggtgtactc

SEQ ID NO: 126292 - DNA, 28 bp, Artificial Sequence
  Description of Artificial Sequence: Synthetic oligonucleotide
cctcaagaaggagggcaggtgtactcag

SEQ ID NO: 126293 - DNA, 29 bp, Artificial Sequence
  Description of Artificial Sequence: Synthetic oligonucleotide
ctcaagaaggagggcaggtgtactcagtg

SEQ ID NO: 126294 - DNA, 29 bp, Artificial Sequence
  Description of Artificial Sequence: Synthetic oligonucleotide
tcaagaaggagggcaggtgtactcagtgc

SEQ ID NO: 126295 - DNA, 28 bp, Artificial Sequence
  Description of Artificial Sequence: Synthetic oligonucleotide
caagaaggagggcaggtgtactcagtgc

SEQ ID NO: 126296 - DNA, 28 bp, Artificial Sequence
  Description of Artificial Sequence: Synthetic oligonucleotide
aagaaggagggcaggtgtactcagtgcc

SEQ ID NO: 126297 - DNA, 27 bp, Artificial Sequence
  Description of Artificial Sequence: Synthetic oligonucleotide
agaaggagggcaggtgtactcagtgcc

SEQ ID NO: 126298 - DNA, 27 bp, Artificial Sequence
  Description of Artificial Sequence: Synthetic oligonucleotide
gaaggagggcaggtgtactcagtgcct

SEQ ID NO: 126299 - DNA, 29 bp, Artificial Sequence
  Description of Artificial Sequence: Synthetic oligonucleotide
aaggagggcaggtgtactcagtgcctatg

SEQ ID NO: 126300 - DNA, 28 bp, Artificial Sequence
  Description of Artificial Sequence: Synthetic oligonucleotide
aggagggcaggtgtactcagtgcctatg

SEQ ID NO: 126301 - DNA, 27 bp, Artificial Sequence
  Description of Artificial Sequence: Synthetic oligonucleotide
ggagggcaggtgtactcagtgcctatg

SEQ ID NO: 126302 - DNA, 27 bp, Artificial Sequence
  Description of Artificial Sequence: Synthetic oligonucleotide
gagggcaggtgtactcagtgcctatgg

SEQ ID NO: 126303 - DNA, 27 bp, Artificial Sequence
  Description of Artificial Sequence: Synthetic oligonucleotide
agggcaggtgtactcagtgcctatggg

SEQ ID NO: 126304 - DNA, 26 bp, Artificial Sequence
  Description of Artificial Sequence: Synthetic oligonucleotide
gggcaggtgtactcagtgcctatggg

SEQ ID NO: 126305 - DNA, 26 bp, Artificial Sequence
  Description of Artificial Sequence: Synthetic oligonucleotide
ggcaggtgtactcagtgcctatgggg

SEQ ID NO: 126306 - DNA, 26 bp, Artificial Sequence
  Description of Artificial Sequence: Synthetic oligonucleotide
gcaggtgtactcagtgcctatggggg

SEQ ID NO: 126307 - DNA, 27 bp, Artificial Sequence
  Description of Artificial Sequence: Synthetic oligonucleotide
caggtgtactcagtgcctatggggggt

SEQ ID NO: 126308 - DNA, 29 bp, Artificial Sequence
  Description of Artificial Sequence: Synthetic oligonucleotide
aggtgtactcagtgcctatggggggtatg

SEQ ID NO: 126309 - DNA, 28 bp, Artificial Sequence
  Description of Artificial Sequence: Synthetic oligonucleotide
ggtgtactcagtgcctatggggggtatg

SEQ ID NO: 126310 - DNA, 30 bp, Artificial Sequence
  Description of Artificial Sequence: Synthetic oligonucleotide
gtgtactcagtgcctatggggggtatgatg

SEQ ID NO: 126311 - DNA, 30 bp, Artificial Sequence
  Description of Artificial Sequence: Synthetic oligonucleotide
tgtactcagtgcctatggggggtatgatgg

SEQ ID NO: 126312 - DNA, 29 bp, Artificial Sequence
  Description of Artificial Sequence: Synthetic oligonucleotide
gtactcagtgcctatggggggtatgatgg

SEQ ID NO: 126313 - DNA, 32 bp, Artificial Sequence
  Description of Artificial Sequence: Synthetic oligonucleotide
tactcagtgcctatggggggtatgatggtaag

SEQ ID NO: 126314 - DNA, 31 bp, Artificial Sequence
  Description of Artificial Sequence: Synthetic oligonucleotide
actcagtgcctatggggggtatgatggtaag

SEQ ID NO: 126315 - DNA, 30 bp, Artificial Sequence
  Description of Artificial Sequence: Synthetic oligonucleotide
ctcagtgcctatggggggtatgatggtaag

SEQ ID NO: 126316 - DNA, 30 bp, Artificial Sequence
  Description of Artificial Sequence: Synthetic oligonucleotide
tcagtgcctatggggggtatgatggtaagg

SEQ ID NO: 126317 - DNA, 29 bp, Artificial Sequence
  Description of Artificial Sequence: Synthetic oligonucleotide
cagtgcctatggggggtatgatggtaagg

SEQ ID NO: 126318 - DNA, 29 bp, Artificial Sequence
  Description of Artificial Sequence: Synthetic oligonucleotide
agtgcctatggggggtatgatggtaaggc

SEQ ID NO: 126319 - DNA, 28 bp, Artificial Sequence
  Description of Artificial Sequence: Synthetic oligonucleotide
gtgcctatggggggtatgatggtaaggc

SEQ ID NO: 126320 - DNA, 29 bp, Artificial Sequence
  Description of Artificial Sequence: Synthetic oligonucleotide
tgcctatggggggtatgatggtaaggcag

SEQ ID NO: 126321 - DNA, 28 bp, Artificial Sequence
  Description of Artificial Sequence: Synthetic oligonucleotide
gcctatggggggtatgatggtaaggcag

SEQ ID NO: 126322 - DNA, 29 bp, Artificial Sequence
  Description of Artificial Sequence: Synthetic oligonucleotide
cctatggggggtatgatggtaaggcagtc

SEQ ID NO: 126323 - DNA, 29 bp, Artificial Sequence
  Description of Artificial Sequence: Synthetic oligonucleotide
ctatggggggtatgatggtaaggcagtcc

SEQ ID NO: 126324 - DNA, 32 bp, Artificial Sequence
  Description of Artificial Sequence: Synthetic oligonucleotide
tatggggggtatgatggtaaggcagtcctttg

SEQ ID NO: 126325 - DNA, 31 bp, Artificial Sequence
  Description of Artificial Sequence: Synthetic oligonucleotide
atggggggtatgatggtaaggcagtcctttg

SEQ ID NO: 126326 - DNA, 30 bp, Artificial Sequence
  Description of Artificial Sequence: Synthetic oligonucleotide
tggggggtatgatggtaaggcagtcctttg

SEQ ID NO: 126327 - DNA, 29 bp, Artificial Sequence
  Description of Artificial Sequence: Synthetic oligonucleotide
ggggggtatgatggtaaggcagtcctttg

SEQ ID NO: 126328 - DNA, 29 bp, Artificial Sequence
  Description of Artificial Sequence: Synthetic oligonucleotide
gggggtatgatggtaaggcagtcctttgc

SEQ ID NO: 126329 - DNA, 29 bp, Artificial Sequence
  Description of Artificial Sequence: Synthetic oligonucleotide
ggggtatgatggtaaggcagtcctttgcc

SEQ ID NO: 126330 - DNA, 32 bp, Artificial Sequence
  Description of Artificial Sequence: Synthetic oligonucleotide
gggtatgatggtaaggcagtcctttgccattg

SEQ ID NO: 126331 - DNA, 32 bp, Artificial Sequence
  Description of Artificial Sequence: Synthetic oligonucleotide
ggtatgatggtaaggcagtcctttgccattgg

SEQ ID NO: 126332 - DNA, 33 bp, Artificial Sequence
  Description of Artificial Sequence: Synthetic oligonucleotide
gtatgatggtaaggcagtcctttgccattggag

SEQ ID NO: 126333 - DNA, 33 bp, Artificial Sequence
  Description of Artificial Sequence: Synthetic oligonucleotide
tatgatggtaaggcagtcctttgccattggagg

SEQ ID NO: 126334 - DNA, 32 bp, Artificial Sequence
  Description of Artificial Sequence: Synthetic oligonucleotide
atgatggtaaggcagtcctttgccattggagg

SEQ ID NO: 126335 - DNA, 31 bp, Artificial Sequence
  Description of Artificial Sequence: Synthetic oligonucleotide
tgatggtaaggcagtcctttgccattggagg

SEQ ID NO: 126336 - DNA, 30 bp, Artificial Sequence
  Description of Artificial Sequence: Synthetic oligonucleotide
gatggtaaggcagtcctttgccattggagg

SEQ ID NO: 126337 - DNA, 30 bp, Artificial Sequence
  Description of Artificial Sequence: Synthetic oligonucleotide
atggtaaggcagtcctttgccattggaggc

SEQ ID NO: 126338 - DNA, 29 bp, Artificial Sequence
  Description of Artificial Sequence: Synthetic oligonucleotide
tggtaaggcagtcctttgccattggaggc

SEQ ID NO: 126339 - DNA, 28 bp, Artificial Sequence
  Description of Artificial Sequence: Synthetic oligonucleotide
ggtaaggcagtcctttgccattggaggc

SEQ ID NO: 126340 - DNA, 29 bp, Artificial Sequence
  Description of Artificial Sequence: Synthetic oligonucleotide
gtaaggcagtcctttgccattggaggctc

SEQ ID NO: 126341 - DNA, 29 bp, Artificial Sequence
  Description of Artificial Sequence: Synthetic oligonucleotide
taaggcagtcctttgccattggaggctcc

SEQ ID NO: 126342 - DNA, 28 bp, Artificial Sequence
  Description of Artificial Sequence: Synthetic oligonucleotide
aaggcagtcctttgccattggaggctcc

SEQ ID NO: 126343 - DNA, 27 bp, Artificial Sequence
  Description of Artificial Sequence: Synthetic oligonucleotide
aggcagtcctttgccattggaggctcc

SEQ ID NO: 126344 - DNA, 26 bp, Artificial Sequence
  Description of Artificial Sequence: Synthetic oligonucleotide
ggcagtcctttgccattggaggctcc

SEQ ID NO: 126345 - DNA, 26 bp, Artificial Sequence
  Description of Artificial Sequence: Synthetic oligonucleotide
gcagtcctttgccattggaggctccg

SEQ ID NO: 126346 - DNA, 26 bp, Artificial Sequence
  Description of Artificial Sequence: Synthetic oligonucleotide
cagtcctttgccattggaggctccgg

SEQ ID NO: 126347 - DNA, 27 bp, Artificial Sequence
  Description of Artificial Sequence: Synthetic oligonucleotide
agtcctttgccattggaggctccggga

SEQ ID NO: 126348 - DNA, 26 bp, Artificial Sequence
  Description of Artificial Sequence: Synthetic oligonucleotide
gtcctttgccattggaggctccggga

SEQ ID NO: 126349 - DNA, 26 bp, Artificial Sequence
  Description of Artificial Sequence: Synthetic oligonucleotide
tcctttgccattggaggctccgggag

SEQ ID NO: 126350 - DNA, 25 bp, Artificial Sequence
  Description of Artificial Sequence: Synthetic oligonucleotide
cctttgccattggaggctccgggag

SEQ ID NO: 126351 - DNA, 26 bp, Artificial Sequence
  Description of Artificial Sequence: Synthetic oligonucleotide
ctttgccattggaggctccgggagct

SEQ ID NO: 126352 - DNA, 26 bp, Artificial Sequence
  Description of Artificial Sequence: Synthetic oligonucleotide
tttgccattggaggctccgggagctc

SEQ ID NO: 126353 - DNA, 25 bp, Artificial Sequence
  Description of Artificial Sequence: Synthetic oligonucleotide
ttgccattggaggctccgggagctc

SEQ ID NO: 126354 - DNA, 24 bp, Artificial Sequence
  Description of Artificial Sequence: Synthetic oligonucleotide
tgccattggaggctccgggagctc

SEQ ID NO: 126355 - DNA, 23 bp, Artificial Sequence
  Description of Artificial Sequence: Synthetic oligonucleotide
gccattggaggctccgggagctc

SEQ ID NO: 126356 - DNA, 25 bp, Artificial Sequence
  Description of Artificial Sequence: Synthetic oligonucleotide
ccattggaggctccgggagctccta

SEQ ID NO: 126357 - DNA, 27 bp, Artificial Sequence
  Description of Artificial Sequence: Synthetic oligonucleotide
cattggaggctccgggagctcctacat

SEQ ID NO: 126358 - DNA, 27 bp, Artificial Sequence
  Description of Artificial Sequence: Synthetic oligonucleotide
attggaggctccgggagctcctacatc

SEQ ID NO: 126359 - DNA, 27 bp, Artificial Sequence
  Description of Artificial Sequence: Synthetic oligonucleotide
ttggaggctccgggagctcctacatct

SEQ ID NO: 126360 - DNA, 27 bp, Artificial Sequence
  Description of Artificial Sequence: Synthetic oligonucleotide
tggaggctccgggagctcctacatcta

SEQ ID NO: 126361 - DNA, 27 bp, Artificial Sequence
  Description of Artificial Sequence: Synthetic oligonucleotide
ggaggctccgggagctcctacatctat

SEQ ID NO: 126362 - DNA, 27 bp, Artificial Sequence
  Description of Artificial Sequence: Synthetic oligonucleotide
gaggctccgggagctcctacatctatg

SEQ ID NO: 126363 - DNA, 27 bp, Artificial Sequence
  Description of Artificial Sequence: Synthetic oligonucleotide
aggctccgggagctcctacatctatgg

SEQ ID NO: 126364 - DNA, 26 bp, Artificial Sequence
  Description of Artificial Sequence: Synthetic oligonucleotide
ggctccgggagctcctacatctatgg

SEQ ID NO: 126365 - DNA, 27 bp, Artificial Sequence
  Description of Artificial Sequence: Synthetic oligonucleotide
gctccgggagctcctacatctatggct

SEQ ID NO: 126366 - DNA, 29 bp, Artificial Sequence
  Description of Artificial Sequence: Synthetic oligonucleotide
ctccgggagctcctacatctatggctatg

SEQ ID NO: 126367 - DNA, 31 bp, Artificial Sequence
  Description of Artificial Sequence: Synthetic oligonucleotide
tccgggagctcctacatctatggctatgttg

SEQ ID NO: 126368 - DNA, 30 bp, Artificial Sequence
  Description of Artificial Sequence: Synthetic oligonucleotide
ccgggagctcctacatctatggctatgttg

SEQ ID NO: 126369 - DNA, 32 bp, Artificial Sequence
  Description of Artificial Sequence: Synthetic oligonucleotide
cgggagctcctacatctatggctatgttgatg

SEQ ID NO: 126370 - DNA, 32 bp, Artificial Sequence
  Description of Artificial Sequence: Synthetic oligonucleotide
gggagctcctacatctatggctatgttgatgc

SEQ ID NO: 126371 - DNA, 34 bp, Artificial Sequence
  Description of Artificial Sequence: Synthetic oligonucleotide
ggagctcctacatctatggctatgttgatgctac

SEQ ID NO: 126372 - DNA, 34 bp, Artificial Sequence
  Description of Artificial Sequence: Synthetic oligonucleotide
gagctcctacatctatggctatgttgatgctacc

SEQ ID NO: 126373 - DNA, 36 bp, Artificial Sequence
  Description of Artificial Sequence: Synthetic oligonucleotide
agctcctacatctatggctatgttgatgctacctac

SEQ ID NO: 126374 - DNA, 35 bp, Artificial Sequence
  Description of Artificial Sequence: Synthetic oligonucleotide
gctcctacatctatggctatgttgatgctacctac

SEQ ID NO: 126375 - DNA, 35 bp, Artificial Sequence
  Description of Artificial Sequence: Synthetic oligonucleotide
ctcctacatctatggctatgttgatgctacctacc

SEQ ID NO: 126376 - DNA, 35 bp, Artificial Sequence
  Description of Artificial Sequence: Synthetic oligonucleotide
tcctacatctatggctatgttgatgctacctaccg

SEQ ID NO: 126377 - DNA, 34 bp, Artificial Sequence
  Description of Artificial Sequence: Synthetic oligonucleotide
cctacatctatggctatgttgatgctacctaccg

SEQ ID NO: 126378 - DNA, 34 bp, Artificial Sequence
  Description of Artificial Sequence: Synthetic oligonucleotide
ctacatctatggctatgttgatgctacctaccgg

SEQ ID NO: 126379 - DNA, 34 bp, Artificial Sequence
  Description of Artificial Sequence: Synthetic oligonucleotide
tacatctatggctatgttgatgctacctaccggg

SEQ ID NO: 126380 - DNA, 33 bp, Artificial Sequence
  Description of Artificial Sequence: Synthetic oligonucleotide
acatctatggctatgttgatgctacctaccggg

SEQ ID NO: 126381 - DNA, 32 bp, Artificial Sequence
  Description of Artificial Sequence: Synthetic oligonucleotide
catctatggctatgttgatgctacctaccggg

SEQ ID NO: 126382 - DNA, 34 bp, Artificial Sequence
  Description of Artificial Sequence: Synthetic oligonucleotide
atctatggctatgttgatgctacctaccgggaag

SEQ ID NO: 126383 - DNA, 33 bp, Artificial Sequence
  Description of Artificial Sequence: Synthetic oligonucleotide
tctatggctatgttgatgctacctaccgggaag

SEQ ID NO: 126384 - DNA, 32 bp, Artificial Sequence
  Description of Artificial Sequence: Synthetic oligonucleotide
ctatggctatgttgatgctacctaccgggaag

SEQ ID NO: 126385 - DNA, 32 bp, Artificial Sequence
  Description of Artificial Sequence: Synthetic oligonucleotide
tatggctatgttgatgctacctaccgggaagg

SEQ ID NO: 126386 - DNA, 31 bp, Artificial Sequence
  Description of Artificial Sequence: Synthetic oligonucleotide
atggctatgttgatgctacctaccgggaagg

SEQ ID NO: 126387 - DNA, 30 bp, Artificial Sequence
  Description of Artificial Sequence: Synthetic oligonucleotide
tggctatgttgatgctacctaccgggaagg

SEQ ID NO: 126388 - DNA, 29 bp, Artificial Sequence
  Description of Artificial Sequence: Synthetic oligonucleotide
ggctatgttgatgctacctaccgggaagg

SEQ ID NO: 126389 - DNA, 29 bp, Artificial Sequence
  Description of Artificial Sequence: Synthetic oligonucleotide
gctatgttgatgctacctaccgggaaggc

SEQ ID NO: 126390 - DNA, 31 bp, Artificial Sequence
  Description of Artificial Sequence: Synthetic oligonucleotide
ctatgttgatgctacctaccgggaaggcatg

SEQ ID NO: 126391 - DNA, 32 bp, Artificial Sequence
  Description of Artificial Sequence: Synthetic oligonucleotide
tatgttgatgctacctaccgggaaggcatgac

SEQ ID NO: 126392 - DNA, 31 bp, Artificial Sequence
  Description of Artificial Sequence: Synthetic oligonucleotide
atgttgatgctacctaccgggaaggcatgac

SEQ ID NO: 126393 - DNA, 30 bp, Artificial Sequence
  Description of Artificial Sequence: Synthetic oligonucleotide
tgttgatgctacctaccgggaaggcatgac

SEQ ID NO: 126394 - DNA, 29 bp, Artificial Sequence
  Description of Artificial Sequence: Synthetic oligonucleotide
gttgatgctacctaccgggaaggcatgac

SEQ ID NO: 126395 - DNA, 29 bp, Artificial Sequence
  Description of Artificial Sequence: Synthetic oligonucleotide
ttgatgctacctaccgggaaggcatgacc

SEQ ID NO: 126396 - DNA, 28 bp, Artificial Sequence
  Description of Artificial Sequence: Synthetic oligonucleotide
tgatgctacctaccgggaaggcatgacc

SEQ ID NO: 126397 - DNA, 27 bp, Artificial Sequence
  Description of Artificial Sequence: Synthetic oligonucleotide
gatgctacctaccgggaaggcatgacc

SEQ ID NO: 126398 - DNA, 29 bp, Artificial Sequence
  Description of Artificial Sequence: Synthetic oligonucleotide
atgctacctaccgggaaggcatgaccaag

SEQ ID NO: 126399 - DNA, 28 bp, Artificial Sequence
  Description of Artificial Sequence: Synthetic oligonucleotide
tgctacctaccgggaaggcatgaccaag

SEQ ID NO: 126400 - DNA, 27 bp, Artificial Sequence
  Description of Artificial Sequence: Synthetic oligonucleotide
gctacctaccgggaaggcatgaccaag

SEQ ID NO: 126401 - DNA, 27 bp, Artificial Sequence
  Description of Artificial Sequence: Synthetic oligonucleotide
ctacctaccgggaaggcatgaccaagg

SEQ ID NO: 126402 - DNA, 29 bp, Artificial Sequence
  Description of Artificial Sequence: Synthetic oligonucleotide
tacctaccgggaaggcatgaccaaggaag

SEQ ID NO: 126403 - DNA, 28 bp, Artificial Sequence
  Description of Artificial Sequence: Synthetic oligonucleotide
acctaccgggaaggcatgaccaaggaag

SEQ ID NO: 126404 - DNA, 27 bp, Artificial Sequence
  Description of Artificial Sequence: Synthetic oligonucleotide
cctaccgggaaggcatgaccaaggaag

SEQ ID NO: 126405 - DNA, 28 bp, Artificial Sequence
  Description of Artificial Sequence: Synthetic oligonucleotide
ctaccgggaaggcatgaccaaggaagag

SEQ ID NO: 126406 - DNA, 29 bp, Artificial Sequence
  Description of Artificial Sequence: Synthetic oligonucleotide
taccgggaaggcatgaccaaggaagagtg

SEQ ID NO: 126407 - DNA, 28 bp, Artificial Sequence
  Description of Artificial Sequence: Synthetic oligonucleotide
accgggaaggcatgaccaaggaagagtg

SEQ ID NO: 126408 - DNA, 27 bp, Artificial Sequence
  Description of Artificial Sequence: Synthetic oligonucleotide
ccgggaaggcatgaccaaggaagagtg

SEQ ID NO: 126409 - DNA, 28 bp, Artificial Sequence
  Description of Artificial Sequence: Synthetic oligonucleotide
cgggaaggcatgaccaaggaagagtgtc

SEQ ID NO: 126410 - DNA, 29 bp, Artificial Sequence
  Description of Artificial Sequence: Synthetic oligonucleotide
gggaaggcatgaccaaggaagagtgtctg

SEQ ID NO: 126411 - DNA, 29 bp, Artificial Sequence
  Description of Artificial Sequence: Synthetic oligonucleotide
ggaaggcatgaccaaggaagagtgtctgc

SEQ ID NO: 126412 - DNA, 33 bp, Artificial Sequence
  Description of Artificial Sequence: Synthetic oligonucleotide
gaaggcatgaccaaggaagagtgtctgcaattc

SEQ ID NO: 126413 - DNA, 34 bp, Artificial Sequence
  Description of Artificial Sequence: Synthetic oligonucleotide
aaggcatgaccaaggaagagtgtctgcaattcac

SEQ ID NO: 126414 - DNA, 33 bp, Artificial Sequence
  Description of Artificial Sequence: Synthetic oligonucleotide
aggcatgaccaaggaagagtgtctgcaattcac

SEQ ID NO: 126415 - DNA, 32 bp, Artificial Sequence
  Description of Artificial Sequence: Synthetic oligonucleotide
ggcatgaccaaggaagagtgtctgcaattcac

SEQ ID NO: 126416 - DNA, 33 bp, Artificial Sequence
  Description of Artificial Sequence: Synthetic oligonucleotide
gcatgaccaaggaagagtgtctgcaattcactg

SEQ ID NO: 126417 - DNA, 33 bp, Artificial Sequence
  Description of Artificial Sequence: Synthetic oligonucleotide
catgaccaaggaagagtgtctgcaattcactgc

SEQ ID NO: 126418 - DNA, 33 bp, Artificial Sequence
  Description of Artificial Sequence: Synthetic oligonucleotide
atgaccaaggaagagtgtctgcaattcactgcc

SEQ ID NO: 126419 - DNA, 32 bp, Artificial Sequence
  Description of Artificial Sequence: Synthetic oligonucleotide
tgaccaaggaagagtgtctgcaattcactgcc

SEQ ID NO: 126420 - DNA, 31 bp, Artificial Sequence
  Description of Artificial Sequence: Synthetic oligonucleotide
gaccaaggaagagtgtctgcaattcactgcc

SEQ ID NO: 126421 - DNA, 34 bp, Artificial Sequence
  Description of Artificial Sequence: Synthetic oligonucleotide
accaaggaagagtgtctgcaattcactgccaatg

SEQ ID NO: 126422 - DNA, 33 bp, Artificial Sequence
  Description of Artificial Sequence: Synthetic oligonucleotide
ccaaggaagagtgtctgcaattcactgccaatg

SEQ ID NO: 126423 - DNA, 33 bp, Artificial Sequence
  Description of Artificial Sequence: Synthetic oligonucleotide
caaggaagagtgtctgcaattcactgccaatgc

SEQ ID NO: 126424 - DNA, 34 bp, Artificial Sequence
  Description of Artificial Sequence: Synthetic oligonucleotide
aaggaagagtgtctgcaattcactgccaatgctc

SEQ ID NO: 126425 - DNA, 33 bp, Artificial Sequence
  Description of Artificial Sequence: Synthetic oligonucleotide
aggaagagtgtctgcaattcactgccaatgctc

SEQ ID NO: 126426 - DNA, 32 bp, Artificial Sequence
  Description of Artificial Sequence: Synthetic oligonucleotide
ggaagagtgtctgcaattcactgccaatgctc

SEQ ID NO: 126427 - DNA, 33 bp, Artificial Sequence
  Description of Artificial Sequence: Synthetic oligonucleotide
gaagagtgtctgcaattcactgccaatgctctc

SEQ ID NO: 126428 - DNA, 33 bp, Artificial Sequence
  Description of Artificial Sequence: Synthetic oligonucleotide
aagagtgtctgcaattcactgccaatgctctcg

SEQ ID NO: 126429 - DNA, 32 bp, Artificial Sequence
  Description of Artificial Sequence: Synthetic oligonucleotide
agagtgtctgcaattcactgccaatgctctcg

SEQ ID NO: 126430 - DNA, 31 bp, Artificial Sequence
  Description of Artificial Sequence: Synthetic oligonucleotide
gagtgtctgcaattcactgccaatgctctcg

SEQ ID NO: 126431 - DNA, 31 bp, Artificial Sequence
  Description of Artificial Sequence: Synthetic oligonucleotide
agtgtctgcaattcactgccaatgctctcgc

SEQ ID NO: 126432 - DNA, 30 bp, Artificial Sequence
  Description of Artificial Sequence: Synthetic oligonucleotide
gtgtctgcaattcactgccaatgctctcgc

SEQ ID NO: 126433 - DNA, 33 bp, Artificial Sequence
  Description of Artificial Sequence: Synthetic oligonucleotide
tgtctgcaattcactgccaatgctctcgctttg

SEQ ID NO: 126434 - DNA, 32 bp, Artificial Sequence
  Description of Artificial Sequence: Synthetic oligonucleotide
gtctgcaattcactgccaatgctctcgctttg

SEQ ID NO: 126435 - DNA, 32 bp, Artificial Sequence
  Description of Artificial Sequence: Synthetic oligonucleotide
tctgcaattcactgccaatgctctcgctttgg

SEQ ID NO: 126436 - DNA, 31 bp, Artificial Sequence
  Description of Artificial Sequence: Synthetic oligonucleotide
ctgcaattcactgccaatgctctcgctttgg

SEQ ID NO: 126437 - DNA, 31 bp, Artificial Sequence
  Description of Artificial Sequence: Synthetic oligonucleotide
tgcaattcactgccaatgctctcgctttggc

SEQ ID NO: 126438 - DNA, 30 bp, Artificial Sequence
  Description of Artificial Sequence: Synthetic oligonucleotide
gcaattcactgccaatgctctcgctttggc

SEQ ID NO: 126439 - DNA, 30 bp, Artificial Sequence
  Description of Artificial Sequence: Synthetic oligonucleotide
caattcactgccaatgctctcgctttggcc

SEQ ID NO: 126440 - DNA, 32 bp, Artificial Sequence
  Description of Artificial Sequence: Synthetic oligonucleotide
aattcactgccaatgctctcgctttggccatg

SEQ ID NO: 126441 - DNA, 31 bp, Artificial Sequence
  Description of Artificial Sequence: Synthetic oligonucleotide
attcactgccaatgctctcgctttggccatg

SEQ ID NO: 126442 - DNA, 30 bp, Artificial Sequence
  Description of Artificial Sequence: Synthetic oligonucleotide
ttcactgccaatgctctcgctttggccatg

SEQ ID NO: 126443 - DNA, 29 bp, Artificial Sequence
  Description of Artificial Sequence: Synthetic oligonucleotide
tcactgccaatgctctcgctttggccatg

SEQ ID NO: 126444 - DNA, 28 bp, Artificial Sequence
  Description of Artificial Sequence: Synthetic oligonucleotide
cactgccaatgctctcgctttggccatg

SEQ ID NO: 126445 - DNA, 28 bp, Artificial Sequence
  Description of Artificial Sequence: Synthetic oligonucleotide
actgccaatgctctcgctttggccatgg

SEQ ID NO: 126446 - DNA, 27 bp, Artificial Sequence
  Description of Artificial Sequence: Synthetic oligonucleotide
ctgccaatgctctcgctttggccatgg

SEQ ID NO: 126447 - DNA, 28 bp, Artificial Sequence
  Description of Artificial Sequence: Synthetic oligonucleotide
tgccaatgctctcgctttggccatggag

SEQ ID NO: 126448 - DNA, 27 bp, Artificial Sequence
  Description of Artificial Sequence: Synthetic oligonucleotide
gccaatgctctcgctttggccatggag

SEQ ID NO: 126449 - DNA, 27 bp, Artificial Sequence
  Description of Artificial Sequence: Synthetic oligonucleotide
ccaatgctctcgctttggccatggagc

SEQ ID NO: 126450 - DNA, 27 bp, Artificial Sequence
  Description of Artificial Sequence: Synthetic oligonucleotide
caatgctctcgctttggccatggagcg

SEQ ID NO: 126451 - DNA, 27 bp, Artificial Sequence
  Description of Artificial Sequence: Synthetic oligonucleotide
aatgctctcgctttggccatggagcgg

SEQ ID NO: 126452 - DNA, 26 bp, Artificial Sequence
  Description of Artificial Sequence: Synthetic oligonucleotide
atgctctcgctttggccatggagcgg

SEQ ID NO: 126453 - DNA, 25 bp, Artificial Sequence
  Description of Artificial Sequence: Synthetic oligonucleotide
tgctctcgctttggccatggagcgg

SEQ ID NO: 126454 - DNA, 24 bp, Artificial Sequence
  Description of Artificial Sequence: Synthetic oligonucleotide
gctctcgctttggccatggagcgg

SEQ ID NO: 126455 - DNA, 26 bp, Artificial Sequence
  Description of Artificial Sequence: Synthetic oligonucleotide
ctctcgctttggccatggagcgggat

SEQ ID NO: 126456 - DNA, 26 bp, Artificial Sequence
  Description of Artificial Sequence: Synthetic oligonucleotide
tctcgctttggccatggagcgggatg

SEQ ID NO: 126457 - DNA, 25 bp, Artificial Sequence
  Description of Artificial Sequence: Synthetic oligonucleotide
ctcgctttggccatggagcgggatg

SEQ ID NO: 126458 - DNA, 25 bp, Artificial Sequence
  Description of Artificial Sequence: Synthetic oligonucleotide
tcgctttggccatggagcgggatgg

SEQ ID NO: 126459 - DNA, 24 bp, Artificial Sequence
  Description of Artificial Sequence: Synthetic oligonucleotide
cgctttggccatggagcgggatgg

SEQ ID NO: 126460 - DNA, 25 bp, Artificial Sequence
  Description of Artificial Sequence: Synthetic oligonucleotide
gctttggccatggagcgggatggct

SEQ ID NO: 126461 - DNA, 25 bp, Artificial Sequence
  Description of Artificial Sequence: Synthetic oligonucleotide
ctttggccatggagcgggatggctc

SEQ ID NO: 126462 - DNA, 26 bp, Artificial Sequence
  Description of Artificial Sequence: Synthetic oligonucleotide
tttggccatggagcgggatggctcca

SEQ ID NO: 126463 - DNA, 25 bp, Artificial Sequence
  Description of Artificial Sequence: Synthetic oligonucleotide
ttggccatggagcgggatggctcca

SEQ ID NO: 126464 - DNA, 24 bp, Artificial Sequence
  Description of Artificial Sequence: Synthetic oligonucleotide
tggccatggagcgggatggctcca

SEQ ID NO: 126465 - DNA, 23 bp, Artificial Sequence
  Description of Artificial Sequence: Synthetic oligonucleotide
ggccatggagcgggatggctcca

SEQ ID NO: 126466 - DNA, 24 bp, Artificial Sequence
  Description of Artificial Sequence: Synthetic oligonucleotide
gccatggagcgggatggctccagt

SEQ ID NO: 126467 - DNA, 24 bp, Artificial Sequence
  Description of Artificial Sequence: Synthetic oligonucleotide
ccatggagcgggatggctccagtg

SEQ ID NO: 126468 - DNA, 25 bp, Artificial Sequence
  Description of Artificial Sequence: Synthetic oligonucleotide
catggagcgggatggctccagtgga

SEQ ID NO: 126469 - DNA, 25 bp, Artificial Sequence
  Description of Artificial Sequence: Synthetic oligonucleotide
atggagcgggatggctccagtggag

SEQ ID NO: 126470 - DNA, 24 bp, Artificial Sequence
  Description of Artificial Sequence: Synthetic oligonucleotide
tggagcgggatggctccagtggag

SEQ ID NO: 126471 - DNA, 23 bp, Artificial Sequence
  Description of Artificial Sequence: Synthetic oligonucleotide
ggagcgggatggctccagtggag

SEQ ID NO: 126472 - DNA, 24 bp, Artificial Sequence
  Description of Artificial Sequence: Synthetic oligonucleotide
gagcgggatggctccagtggagga

SEQ ID NO: 126473 - DNA, 25 bp, Artificial Sequence
  Description of Artificial Sequence: Synthetic oligonucleotide
agcgggatggctccagtggaggagt

SEQ ID NO: 126474 - DNA, 24 bp, Artificial Sequence
  Description of Artificial Sequence: Synthetic oligonucleotide
gcgggatggctccagtggaggagt

SEQ ID NO: 126475 - DNA, 26 bp, Artificial Sequence
  Description of Artificial Sequence: Synthetic oligonucleotide
cgggatggctccagtggaggagtgat

SEQ ID NO: 126476 - DNA, 26 bp, Artificial Sequence
  Description of Artificial Sequence: Synthetic oligonucleotide
gggatggctccagtggaggagtgatc

SEQ ID NO: 126477 - DNA, 26 bp, Artificial Sequence
  Description of Artificial Sequence: Synthetic oligonucleotide
ggatggctccagtggaggagtgatcc

SEQ ID NO: 126478 - DNA, 26 bp, Artificial Sequence
  Description of Artificial Sequence: Synthetic oligonucleotide
gatggctccagtggaggagtgatccg

SEQ ID NO: 126479 - DNA, 26 bp, Artificial Sequence
  Description of Artificial Sequence: Synthetic oligonucleotide
atggctccagtggaggagtgatccgc

SEQ ID NO: 126480 - DNA, 25 bp, Artificial Sequence
  Description of Artificial Sequence: Synthetic oligonucleotide
tggctccagtggaggagtgatccgc

SEQ ID NO: 126481 - DNA, 24 bp, Artificial Sequence
  Description of Artificial Sequence: Synthetic oligonucleotide
ggctccagtggaggagtgatccgc

SEQ ID NO: 126482 - DNA, 25 bp, Artificial Sequence
  Description of Artificial Sequence: Synthetic oligonucleotide
gctccagtggaggagtgatccgcct

SEQ ID NO: 126483 - DNA, 25 bp, Artificial Sequence
  Description of Artificial Sequence: Synthetic oligonucleotide
ctccagtggaggagtgatccgcctg

SEQ ID NO: 126484 - DNA, 25 bp, Artificial Sequence
  Description of Artificial Sequence: Synthetic oligonucleotide
tccagtggaggagtgatccgcctgg

SEQ ID NO: 126485 - DNA, 24 bp, Artificial Sequence
  Description of Artificial Sequence: Synthetic oligonucleotide
ccagtggaggagtgatccgcctgg

SEQ ID NO: 126486 - DNA, 25 bp, Artificial Sequence
  Description of Artificial Sequence: Synthetic oligonucleotide
cagtggaggagtgatccgcctggca

SEQ ID NO: 126487 - DNA, 25 bp, Artificial Sequence
  Description of Artificial Sequence: Synthetic oligonucleotide
agtggaggagtgatccgcctggcag

SEQ ID NO: 126488 - DNA, 24 bp, Artificial Sequence
  Description of Artificial Sequence: Synthetic oligonucleotide
gtggaggagtgatccgcctggcag

SEQ ID NO: 126489 - DNA, 24 bp, Artificial Sequence
  Description of Artificial Sequence: Synthetic oligonucleotide
tggaggagtgatccgcctggcagc

SEQ ID NO: 126490 - DNA, 23 bp, Artificial Sequence
  Description of Artificial Sequence: Synthetic oligonucleotide
ggaggagtgatccgcctggcagc

SEQ ID NO: 126491 - DNA, 26 bp, Artificial Sequence
  Description of Artificial Sequence: Synthetic oligonucleotide
gaggagtgatccgcctggcagccatt

SEQ ID NO: 126492 - DNA, 26 bp, Artificial Sequence
  Description of Artificial Sequence: Synthetic oligonucleotide
aggagtgatccgcctggcagccattg

SEQ ID NO: 126493 - DNA, 25 bp, Artificial Sequence
  Description of Artificial Sequence: Synthetic oligonucleotide
ggagtgatccgcctggcagccattg

SEQ ID NO: 126494 - DNA, 26 bp, Artificial Sequence
  Description of Artificial Sequence: Synthetic oligonucleotide
gagtgatccgcctggcagccattgca

SEQ ID NO: 126495 - DNA, 27 bp, Artificial Sequence
  Description of Artificial Sequence: Synthetic oligonucleotide
agtgatccgcctggcagccattgcaga

SEQ ID NO: 126496 - DNA, 26 bp, Artificial Sequence
  Description of Artificial Sequence: Synthetic oligonucleotide
gtgatccgcctggcagccattgcaga

SEQ ID NO: 126497 - DNA, 27 bp, Artificial Sequence
  Description of Artificial Sequence: Synthetic oligonucleotide
tgatccgcctggcagccattgcagagt

SEQ ID NO: 126498 - DNA, 26 bp, Artificial Sequence
  Description of Artificial Sequence: Synthetic oligonucleotide
gatccgcctggcagccattgcagagt

SEQ ID NO: 126499 - DNA, 27 bp, Artificial Sequence
  Description of Artificial Sequence: Synthetic oligonucleotide
atccgcctggcagccattgcagagtca

SEQ ID NO: 126500 - DNA, 26 bp, Artificial Sequence
  Description of Artificial Sequence: Synthetic oligonucleotide
tccgcctggcagccattgcagagtca

SEQ ID NO: 126501 - DNA, 25 bp, Artificial Sequence
  Description of Artificial Sequence: Synthetic oligonucleotide
ccgcctggcagccattgcagagtca

SEQ ID NO: 126502 - DNA, 25 bp, Artificial Sequence
  Description of Artificial Sequence: Synthetic oligonucleotide
cgcctggcagccattgcagagtcag

SEQ ID NO: 126503 - DNA, 25 bp, Artificial Sequence
  Description of Artificial Sequence: Synthetic oligonucleotide
gcctggcagccattgcagagtcagg

SEQ ID NO: 126504 - DNA, 25 bp, Artificial Sequence
  Description of Artificial Sequence: Synthetic oligonucleotide
cctggcagccattgcagagtcaggg

SEQ ID NO: 126505 - DNA, 27 bp, Artificial Sequence
  Description of Artificial Sequence: Synthetic oligonucleotide
ctggcagccattgcagagtcaggggta

SEQ ID NO: 126506 - DNA, 27 bp, Artificial Sequence
  Description of Artificial Sequence: Synthetic oligonucleotide
tggcagccattgcagagtcaggggtag

SEQ ID NO: 126507 - DNA, 27 bp, Artificial Sequence
  Description of Artificial Sequence: Synthetic oligonucleotide
ggcagccattgcagagtcaggggtaga

SEQ ID NO: 126508 - DNA, 27 bp, Artificial Sequence
  Description of Artificial Sequence: Synthetic oligonucleotide
gcagccattgcagagtcaggggtagag

SEQ ID NO: 126509 - DNA, 27 bp, Artificial Sequence
  Description of Artificial Sequence: Synthetic oligonucleotide
cagccattgcagagtcaggggtagagc

SEQ ID NO: 126510 - DNA, 27 bp, Artificial Sequence
  Description of Artificial Sequence: Synthetic oligonucleotide
agccattgcagagtcaggggtagagcg

SEQ ID NO: 126511 - DNA, 26 bp, Artificial Sequence
  Description of Artificial Sequence: Synthetic oligonucleotide
gccattgcagagtcaggggtagagcg

SEQ ID NO: 126512 - DNA, 26 bp, Artificial Sequence
  Description of Artificial Sequence: Synthetic oligonucleotide
ccattgcagagtcaggggtagagcgg

SEQ ID NO: 126513 - DNA, 27 bp, Artificial Sequence
  Description of Artificial Sequence: Synthetic oligonucleotide
cattgcagagtcaggggtagagcggca

SEQ ID NO: 126514 - DNA, 28 bp, Artificial Sequence
  Description of Artificial Sequence: Synthetic oligonucleotide
attgcagagtcaggggtagagcggcaag

SEQ ID NO: 126515 - DNA, 27 bp, Artificial Sequence
  Description of Artificial Sequence: Synthetic oligonucleotide
ttgcagagtcaggggtagagcggcaag

SEQ ID NO: 126516 - DNA, 27 bp, Artificial Sequence
  Description of Artificial Sequence: Synthetic oligonucleotide
tgcagagtcaggggtagagcggcaagt

SEQ ID NO: 126517 - DNA, 27 bp, Artificial Sequence
  Description of Artificial Sequence: Synthetic oligonucleotide
gcagagtcaggggtagagcggcaagta

SEQ ID NO: 126518 - DNA, 27 bp, Artificial Sequence
  Description of Artificial Sequence: Synthetic oligonucleotide
cagagtcaggggtagagcggcaagtac

SEQ ID NO: 126519 - DNA, 31 bp, Artificial Sequence
  Description of Artificial Sequence: Synthetic oligonucleotide
agagtcaggggtagagcggcaagtacttttg

SEQ ID NO: 126520 - DNA, 30 bp, Artificial Sequence
  Description of Artificial Sequence: Synthetic oligonucleotide
gagtcaggggtagagcggcaagtacttttg

SEQ ID NO: 126521 - DNA, 30 bp, Artificial Sequence
  Description of Artificial Sequence: Synthetic oligonucleotide
agtcaggggtagagcggcaagtacttttgg

SEQ ID NO: 126522 - DNA, 29 bp, Artificial Sequence
  Description of Artificial Sequence: Synthetic oligonucleotide
gtcaggggtagagcggcaagtacttttgg

SEQ ID NO: 126523 - DNA, 29 bp, Artificial Sequence
  Description of Artificial Sequence: Synthetic oligonucleotide
tcaggggtagagcggcaagtacttttggg

SEQ ID NO: 126524 - DNA, 28 bp, Artificial Sequence
  Description of Artificial Sequence: Synthetic oligonucleotide
caggggtagagcggcaagtacttttggg

SEQ ID NO: 126525 - DNA, 29 bp, Artificial Sequence
  Description of Artificial Sequence: Synthetic oligonucleotide
aggggtagagcggcaagtacttttgggag

SEQ ID NO: 126526 - DNA, 28 bp, Artificial Sequence
  Description of Artificial Sequence: Synthetic oligonucleotide
ggggtagagcggcaagtacttttgggag

SEQ ID NO: 126527 - DNA, 29 bp, Artificial Sequence
  Description of Artificial Sequence: Synthetic oligonucleotide
gggtagagcggcaagtacttttgggagac

SEQ ID NO: 126528 - DNA, 29 bp, Artificial Sequence
  Description of Artificial Sequence: Synthetic oligonucleotide
ggtagagcggcaagtacttttgggagacc

SEQ ID NO: 126529 - DNA, 30 bp, Artificial Sequence
  Description of Artificial Sequence: Synthetic oligonucleotide
gtagagcggcaagtacttttgggagaccag

SEQ ID NO: 126530 - DNA, 33 bp, Artificial Sequence
  Description of Artificial Sequence: Synthetic oligonucleotide
tagagcggcaagtacttttgggagaccagatac

SEQ ID NO: 126531 - DNA, 32 bp, Artificial Sequence
  Description of Artificial Sequence: Synthetic oligonucleotide
agagcggcaagtacttttgggagaccagatac

SEQ ID NO: 126532 - DNA, 31 bp, Artificial Sequence
  Description of Artificial Sequence: Synthetic oligonucleotide
gagcggcaagtacttttgggagaccagatac

SEQ ID NO: 126533 - DNA, 31 bp, Artificial Sequence
  Description of Artificial Sequence: Synthetic oligonucleotide
agcggcaagtacttttgggagaccagatacc

SEQ ID NO: 126534 - DNA, 30 bp, Artificial Sequence
  Description of Artificial Sequence: Synthetic oligonucleotide
gcggcaagtacttttgggagaccagatacc

SEQ ID NO: 126535 - DNA, 30 bp, Artificial Sequence
  Description of Artificial Sequence: Synthetic oligonucleotide
cggcaagtacttttgggagaccagataccc

SEQ ID NO: 126536 - DNA, 35 bp, Artificial Sequence
  Description of Artificial Sequence: Synthetic oligonucleotide
ggcaagtacttttgggagaccagatacccaaattc

SEQ ID NO: 126537 - DNA, 35 bp, Artificial Sequence
  Description of Artificial Sequence: Synthetic oligonucleotide
gcaagtacttttgggagaccagatacccaaattcg

SEQ ID NO: 126538 - DNA, 35 bp, Artificial Sequence
  Description of Artificial Sequence: Synthetic oligonucleotide
caagtacttttgggagaccagatacccaaattcgc

SEQ ID NO: 126539 - DNA, 35 bp, Artificial Sequence
  Description of Artificial Sequence: Synthetic oligonucleotide
aagtacttttgggagaccagatacccaaattcgcc

SEQ ID NO: 126540 - DNA, 34 bp, Artificial Sequence
  Description of Artificial Sequence: Synthetic oligonucleotide
agtacttttgggagaccagatacccaaattcgcc

SEQ ID NO: 126541 - DNA, 33 bp, Artificial Sequence
  Description of Artificial Sequence: Synthetic oligonucleotide
gtacttttgggagaccagatacccaaattcgcc

SEQ ID NO: 126542 - DNA, 33 bp, Artificial Sequence
  Description of Artificial Sequence: Synthetic oligonucleotide
tacttttgggagaccagatacccaaattcgccg

SEQ ID NO: 126543 - DNA, 32 bp, Artificial Sequence
  Description of Artificial Sequence: Synthetic oligonucleotide
acttttgggagaccagatacccaaattcgccg

SEQ ID NO: 126544 - DNA, 31 bp, Artificial Sequence
  Description of Artificial Sequence: Synthetic oligonucleotide
cttttgggagaccagatacccaaattcgccg

SEQ ID NO: 126545 - DNA, 33 bp, Artificial Sequence
  Description of Artificial Sequence: Synthetic oligonucleotide
ttttgggagaccagatacccaaattcgccgttg

SEQ ID NO: 126546 - DNA, 32 bp, Artificial Sequence
  Description of Artificial Sequence: Synthetic oligonucleotide
tttgggagaccagatacccaaattcgccgttg

SEQ ID NO: 126547 - DNA, 31 bp, Artificial Sequence
  Description of Artificial Sequence: Synthetic oligonucleotide
ttgggagaccagatacccaaattcgccgttg

SEQ ID NO: 126548 - DNA, 30 bp, Artificial Sequence
  Description of Artificial Sequence: Synthetic oligonucleotide
tgggagaccagatacccaaattcgccgttg

SEQ ID NO: 126549 - DNA, 29 bp, Artificial Sequence
  Description of Artificial Sequence: Synthetic oligonucleotide
gggagaccagatacccaaattcgccgttg

SEQ ID NO: 126550 - DNA, 29 bp, Artificial Sequence
  Description of Artificial Sequence: Synthetic oligonucleotide
ggagaccagatacccaaattcgccgttgc

SEQ ID NO: 126551 - DNA, 29 bp, Artificial Sequence
  Description of Artificial Sequence: Synthetic oligonucleotide
gagaccagatacccaaattcgccgttgcc

SEQ ID NO: 126552 - DNA, 30 bp, Artificial Sequence
  Description of Artificial Sequence: Synthetic oligonucleotide
agaccagatacccaaattcgccgttgccac

SEQ ID NO: 126553 - DNA, 29 bp, Artificial Sequence
  Description of Artificial Sequence: Synthetic oligonucleotide
gaccagatacccaaattcgccgttgccac

SEQ ID NO: 126554 - DNA, 33 bp, Artificial Sequence
  Description of Artificial Sequence: Synthetic oligonucleotide
accagatacccaaattcgccgttgccactttac

SEQ ID NO: 126555 - DNA, 32 bp, Artificial Sequence
  Description of Artificial Sequence: Synthetic oligonucleotide
ccagatacccaaattcgccgttgccactttac

SEQ ID NO: 126556 - DNA, 32 bp, Artificial Sequence
  Description of Artificial Sequence: Synthetic oligonucleotide
cagatacccaaattcgccgttgccactttacc

SEQ ID NO: 126557 - DNA, 33 bp, Artificial Sequence
  Description of Artificial Sequence: Synthetic oligonucleotide
agatacccaaattcgccgttgccactttaccac

SEQ ID NO: 126558 - DNA, 32 bp, Artificial Sequence
  Description of Artificial Sequence: Synthetic oligonucleotide
gatacccaaattcgccgttgccactttaccac

SEQ ID NO: 126559 - DNA, 32 bp, Artificial Sequence
  Description of Artificial Sequence: Synthetic oligonucleotide
atacccaaattcgccgttgccactttaccacc

SEQ ID NO: 126560 - DNA, 31 bp, Artificial Sequence
  Description of Artificial Sequence: Synthetic oligonucleotide
tacccaaattcgccgttgccactttaccacc

SEQ ID NO: 126561 - DNA, 30 bp, Artificial Sequence
  Description of Artificial Sequence: Synthetic oligonucleotide
acccaaattcgccgttgccactttaccacc

SEQ ID NO: 126562 - DNA, 29 bp, Artificial Sequence
  Description of Artificial Sequence: Synthetic oligonucleotide
cccaaattcgccgttgccactttaccacc

SEQ ID NO: 126563 - DNA, 29 bp, Artificial Sequence
  Description of Artificial Sequence: Synthetic oligonucleotide
ccaaattcgccgttgccactttaccaccc

SEQ ID NO: 126564 - DNA, 29 bp, Artificial Sequence
  Description of Artificial Sequence: Synthetic oligonucleotide
caaattcgccgttgccactttaccacccg

SEQ ID NO: 126565 - DNA, 29 bp, Artificial Sequence
  Description of Artificial Sequence: Synthetic oligonucleotide
aaattcgccgttgccactttaccacccgc

SEQ ID NO: 126566 - DNA, 28 bp, Artificial Sequence
  Description of Artificial Sequence: Synthetic oligonucleotide
aattcgccgttgccactttaccacccgc

SEQ ID NO: 126567 - DNA, 27 bp, Artificial Sequence
  Description of Artificial Sequence: Synthetic oligonucleotide
attcgccgttgccactttaccacccgc

SEQ ID NO: 126568 - DNA, 26 bp, Artificial Sequence
  Description of Artificial Sequence: Synthetic oligonucleotide
ttcgccgttgccactttaccacccgc

SEQ ID NO: 126569 - DNA, 25 bp, Artificial Sequence
  Description of Artificial Sequence: Synthetic oligonucleotide
tcgccgttgccactttaccacccgc

SEQ ID NO: 126570 - DNA, 24 bp, Artificial Sequence
  Description of Artificial Sequence: Synthetic oligonucleotide
cgccgttgccactttaccacccgc

SEQ ID NO: 126571 - DNA, 25 bp, Artificial Sequence
  Description of Artificial Sequence: Synthetic oligonucleotide
gccgttgccactttaccacccgcct

SEQ ID NO: 126572 - DNA, 26 bp, Artificial Sequence
  Description of Artificial Sequence: Synthetic oligonucleotide
ccgttgccactttaccacccgcctga

SEQ ID NO: 126573 - DNA, 27 bp, Artificial Sequence
  Description of Artificial Sequence: Synthetic oligonucleotide
atggcggctgtgtcggtgtatgctcca

SEQ ID NO: 126574 - DNA, 26 bp, Artificial Sequence
  Description of Artificial Sequence: Synthetic oligonucleotide
tggcggctgtgtcggtgtatgctcca

SEQ ID NO: 126575 - DNA, 25 bp, Artificial Sequence
  Description of Artificial Sequence: Synthetic oligonucleotide
ggcggctgtgtcggtgtatgctcca

SEQ ID NO: 126576 - DNA, 25 bp, Artificial Sequence
  Description of Artificial Sequence: Synthetic oligonucleotide
gcggctgtgtcggtgtatgctccac

SEQ ID NO: 126577 - DNA, 26 bp, Artificial Sequence
  Description of Artificial Sequence: Synthetic oligonucleotide
cggctgtgtcggtgtatgctccacca

SEQ ID NO: 126578 - DNA, 27 bp, Artificial Sequence
  Description of Artificial Sequence: Synthetic oligonucleotide
ggctgtgtcggtgtatgctccaccagt

SEQ ID NO: 126579 - DNA, 28 bp, Artificial Sequence
  Description of Artificial Sequence: Synthetic oligonucleotide
gctgtgtcggtgtatgctccaccagttg

SEQ ID NO: 126580 - DNA, 28 bp, Artificial Sequence
  Description of Artificial Sequence: Synthetic oligonucleotide
ctgtgtcggtgtatgctccaccagttgg

SEQ ID NO: 126581 - DNA, 29 bp, Artificial Sequence
  Description of Artificial Sequence: Synthetic oligonucleotide
tgtgtcggtgtatgctccaccagttggag

SEQ ID NO: 126582 - DNA, 28 bp, Artificial Sequence
  Description of Artificial Sequence: Synthetic oligonucleotide
gtgtcggtgtatgctccaccagttggag

SEQ ID NO: 126583 - DNA, 28 bp, Artificial Sequence
  Description of Artificial Sequence: Synthetic oligonucleotide
tgtcggtgtatgctccaccagttggagg

SEQ ID NO: 126584 - DNA, 27 bp, Artificial Sequence
  Description of Artificial Sequence: Synthetic oligonucleotide
gtcggtgtatgctccaccagttggagg

SEQ ID NO: 126585 - DNA, 27 bp, Artificial Sequence
  Description of Artificial Sequence: Synthetic oligonucleotide
tcggtgtatgctccaccagttggaggc

SEQ ID NO: 126586 - DNA, 27 bp, Artificial Sequence
  Description of Artificial Sequence: Synthetic oligonucleotide
cggtgtatgctccaccagttggaggct

SEQ ID NO: 126587 - DNA, 28 bp, Artificial Sequence
  Description of Artificial Sequence: Synthetic oligonucleotide
ggtgtatgctccaccagttggaggcttc

SEQ ID NO: 126588 - DNA, 29 bp, Artificial Sequence
  Description of Artificial Sequence: Synthetic oligonucleotide
gtgtatgctccaccagttggaggcttctc

SEQ ID NO: 126589 - DNA, 33 bp, Artificial Sequence
  Description of Artificial Sequence: Synthetic oligonucleotide
tgtatgctccaccagttggaggcttctcttttg

SEQ ID NO: 126590 - DNA, 32 bp, Artificial Sequence
  Description of Artificial Sequence: Synthetic oligonucleotide
gtatgctccaccagttggaggcttctcttttg

SEQ ID NO: 126591 - DNA, 36 bp, Artificial Sequence
  Description of Artificial Sequence: Synthetic oligonucleotide
tatgctccaccagttggaggcttctcttttgataac

SEQ ID NO: 126592 - DNA, 35 bp, Artificial Sequence
  Description of Artificial Sequence: Synthetic oligonucleotide
atgctccaccagttggaggcttctcttttgataac

SEQ ID NO: 126593 - DNA, 34 bp, Artificial Sequence
  Description of Artificial Sequence: Synthetic oligonucleotide
tgctccaccagttggaggcttctcttttgataac

SEQ ID NO: 126594 - DNA, 33 bp, Artificial Sequence
  Description of Artificial Sequence: Synthetic oligonucleotide
gctccaccagttggaggcttctcttttgataac

SEQ ID NO: 126595 - DNA, 34 bp, Artificial Sequence
  Description of Artificial Sequence: Synthetic oligonucleotide
ctccaccagttggaggcttctcttttgataactg

SEQ ID NO: 126596 - DNA, 34 bp, Artificial Sequence
  Description of Artificial Sequence: Synthetic oligonucleotide
tccaccagttggaggcttctcttttgataactgc

SEQ ID NO: 126597 - DNA, 33 bp, Artificial Sequence
  Description of Artificial Sequence: Synthetic oligonucleotide
ccaccagttggaggcttctcttttgataactgc

SEQ ID NO: 126598 - DNA, 33 bp, Artificial Sequence
  Description of Artificial Sequence: Synthetic oligonucleotide
caccagttggaggcttctcttttgataactgcc

SEQ ID NO: 126599 - DNA, 33 bp, Artificial Sequence
  Description of Artificial Sequence: Synthetic oligonucleotide
accagttggaggcttctcttttgataactgccg

SEQ ID NO: 126600 - DNA, 32 bp, Artificial Sequence
  Description of Artificial Sequence: Synthetic oligonucleotide
ccagttggaggcttctcttttgataactgccg

SEQ ID NO: 126601 - DNA, 32 bp, Artificial Sequence
  Description of Artificial Sequence: Synthetic oligonucleotide
cagttggaggcttctcttttgataactgccgc

SEQ ID NO: 126602 - DNA, 33 bp, Artificial Sequence
  Description of Artificial Sequence: Synthetic oligonucleotide
agttggaggcttctcttttgataactgccgcag

SEQ ID NO: 126603 - DNA, 32 bp, Artificial Sequence
  Description of Artificial Sequence: Synthetic oligonucleotide
gttggaggcttctcttttgataactgccgcag

SEQ ID NO: 126604 - DNA, 32 bp, Artificial Sequence
  Description of Artificial Sequence: Synthetic oligonucleotide
ttggaggcttctcttttgataactgccgcagg

SEQ ID NO: 126605 - DNA, 31 bp, Artificial Sequence
  Description of Artificial Sequence: Synthetic oligonucleotide
tggaggcttctcttttgataactgccgcagg

SEQ ID NO: 126606 - DNA, 30 bp, Artificial Sequence
  Description of Artificial Sequence: Synthetic oligonucleotide
ggaggcttctcttttgataactgccgcagg

SEQ ID NO: 126607 - DNA, 33 bp, Artificial Sequence
  Description of Artificial Sequence: Synthetic oligonucleotide
gaggcttctcttttgataactgccgcaggaatg

SEQ ID NO: 126608 - DNA, 33 bp, Artificial Sequence
  Description of Artificial Sequence: Synthetic oligonucleotide
aggcttctcttttgataactgccgcaggaatgc

SEQ ID NO: 126609 - DNA, 32 bp, Artificial Sequence
  Description of Artificial Sequence: Synthetic oligonucleotide
ggcttctcttttgataactgccgcaggaatgc

SEQ ID NO: 126610 - DNA, 32 bp, Artificial Sequence
  Description of Artificial Sequence: Synthetic oligonucleotide
gcttctcttttgataactgccgcaggaatgcc

SEQ ID NO: 126611 - DNA, 32 bp, Artificial Sequence
  Description of Artificial Sequence: Synthetic oligonucleotide
cttctcttttgataactgccgcaggaatgccg

SEQ ID NO: 126612 - DNA, 33 bp, Artificial Sequence
  Description of Artificial Sequence: Synthetic oligonucleotide
ttctcttttgataactgccgcaggaatgccgtc

SEQ ID NO: 126613 - DNA, 32 bp, Artificial Sequence
  Description of Artificial Sequence: Synthetic oligonucleotide
tctcttttgataactgccgcaggaatgccgtc

SEQ ID NO: 126614 - DNA, 31 bp, Artificial Sequence
  Description of Artificial Sequence: Synthetic oligonucleotide
ctcttttgataactgccgcaggaatgccgtc

SEQ ID NO: 126615 - DNA, 33 bp, Artificial Sequence
  Description of Artificial Sequence: Synthetic oligonucleotide
tcttttgataactgccgcaggaatgccgtcttg

SEQ ID NO: 126616 - DNA, 32 bp, Artificial Sequence
  Description of Artificial Sequence: Synthetic oligonucleotide
cttttgataactgccgcaggaatgccgtcttg

SEQ ID NO: 126617 - DNA, 32 bp, Artificial Sequence
  Description of Artificial Sequence: Synthetic oligonucleotide
ttttgataactgccgcaggaatgccgtcttgg

SEQ ID NO: 126618 - DNA, 31 bp, Artificial Sequence
  Description of Artificial Sequence: Synthetic oligonucleotide
tttgataactgccgcaggaatgccgtcttgg

SEQ ID NO: 126619 - DNA, 30 bp, Artificial Sequence
  Description of Artificial Sequence: Synthetic oligonucleotide
ttgataactgccgcaggaatgccgtcttgg

SEQ ID NO: 126620 - DNA, 29 bp, Artificial Sequence
  Description of Artificial Sequence: Synthetic oligonucleotide
tgataactgccgcaggaatgccgtcttgg

SEQ ID NO: 126621 - DNA, 28 bp, Artificial Sequence
  Description of Artificial Sequence: Synthetic oligonucleotide
gataactgccgcaggaatgccgtcttgg

SEQ ID NO: 126622 - DNA, 30 bp, Artificial Sequence
  Description of Artificial Sequence: Synthetic oligonucleotide
ataactgccgcaggaatgccgtcttggaag

SEQ ID NO: 126623 - DNA, 29 bp, Artificial Sequence
  Description of Artificial Sequence: Synthetic oligonucleotide
taactgccgcaggaatgccgtcttggaag

SEQ ID NO: 126624 - DNA, 28 bp, Artificial Sequence
  Description of Artificial Sequence: Synthetic oligonucleotide
aactgccgcaggaatgccgtcttggaag

SEQ ID NO: 126625 - DNA, 27 bp, Artificial Sequence
  Description of Artificial Sequence: Synthetic oligonucleotide
actgccgcaggaatgccgtcttggaag

SEQ ID NO: 126626 - DNA, 26 bp, Artificial Sequence
  Description of Artificial Sequence: Synthetic oligonucleotide
ctgccgcaggaatgccgtcttggaag

SEQ ID NO: 126627 - DNA, 26 bp, Artificial Sequence
  Description of Artificial Sequence: Synthetic oligonucleotide
tgccgcaggaatgccgtcttggaagc

SEQ ID NO: 126628 - DNA, 25 bp, Artificial Sequence
  Description of Artificial Sequence: Synthetic oligonucleotide
gccgcaggaatgccgtcttggaagc

SEQ ID NO: 126629 - DNA, 25 bp, Artificial Sequence
  Description of Artificial Sequence: Synthetic oligonucleotide
ccgcaggaatgccgtcttggaagcc

SEQ ID NO: 126630 - DNA, 27 bp, Artificial Sequence
  Description of Artificial Sequence: Synthetic oligonucleotide
cgcaggaatgccgtcttggaagccgat

SEQ ID NO: 126631 - DNA, 30 bp, Artificial Sequence
  Description of Artificial Sequence: Synthetic oligonucleotide
gcaggaatgccgtcttggaagccgattttg

SEQ ID NO: 126632 - DNA, 30 bp, Artificial Sequence
  Description of Artificial Sequence: Synthetic oligonucleotide
caggaatgccgtcttggaagccgattttgc

SEQ ID NO: 126633 - DNA, 33 bp, Artificial Sequence
  Description of Artificial Sequence: Synthetic oligonucleotide
aggaatgccgtcttggaagccgattttgcaaag

SEQ ID NO: 126634 - DNA, 32 bp, Artificial Sequence
  Description of Artificial Sequence: Synthetic oligonucleotide
ggaatgccgtcttggaagccgattttgcaaag

SEQ ID NO: 126635 - DNA, 33 bp, Artificial Sequence
  Description of Artificial Sequence: Synthetic oligonucleotide
gaatgccgtcttggaagccgattttgcaaagag

SEQ ID NO: 126636 - DNA, 33 bp, Artificial Sequence
  Description of Artificial Sequence: Synthetic oligonucleotide
aatgccgtcttggaagccgattttgcaaagagg

SEQ ID NO: 126637 - DNA, 32 bp, Artificial Sequence
  Description of Artificial Sequence: Synthetic oligonucleotide
atgccgtcttggaagccgattttgcaaagagg

SEQ ID NO: 126638 - DNA, 31 bp, Artificial Sequence
  Description of Artificial Sequence: Synthetic oligonucleotide
tgccgtcttggaagccgattttgcaaagagg

SEQ ID NO: 126639 - DNA, 30 bp, Artificial Sequence
  Description of Artificial Sequence: Synthetic oligonucleotide
gccgtcttggaagccgattttgcaaagagg

SEQ ID NO: 126640 - DNA, 30 bp, Artificial Sequence
  Description of Artificial Sequence: Synthetic oligonucleotide
ccgtcttggaagccgattttgcaaagaggg

SEQ ID NO: 126641 - DNA, 30 bp, Artificial Sequence
  Description of Artificial Sequence: Synthetic oligonucleotide
cgtcttggaagccgattttgcaaagagggg

SEQ ID NO: 126642 - DNA, 33 bp, Artificial Sequence
  Description of Artificial Sequence: Synthetic oligonucleotide
gtcttggaagccgattttgcaaagaggggatac

SEQ ID NO: 126643 - DNA, 35 bp, Artificial Sequence
  Description of Artificial Sequence: Synthetic oligonucleotide
tcttggaagccgattttgcaaagaggggatacaag

SEQ ID NO: 126644 - DNA, 34 bp, Artificial Sequence
  Description of Artificial Sequence: Synthetic oligonucleotide
cttggaagccgattttgcaaagaggggatacaag

SEQ ID NO: 126645 - DNA, 34 bp, Artificial Sequence
  Description of Artificial Sequence: Synthetic oligonucleotide
ttggaagccgattttgcaaagaggggatacaagc

SEQ ID NO: 126646 - DNA, 33 bp, Artificial Sequence
  Description of Artificial Sequence: Synthetic oligonucleotide
tggaagccgattttgcaaagaggggatacaagc

SEQ ID NO: 126647 - DNA, 32 bp, Artificial Sequence
  Description of Artificial Sequence: Synthetic oligonucleotide
ggaagccgattttgcaaagaggggatacaagc

SEQ ID NO: 126648 - DNA, 34 bp, Artificial Sequence
  Description of Artificial Sequence: Synthetic oligonucleotide
gaagccgattttgcaaagaggggatacaagcttc

SEQ ID NO: 126649 - DNA, 34 bp, Artificial Sequence
  Description of Artificial Sequence: Synthetic oligonucleotide
aagccgattttgcaaagaggggatacaagcttcc

SEQ ID NO: 126650 - DNA, 33 bp, Artificial Sequence
  Description of Artificial Sequence: Synthetic oligonucleotide
agccgattttgcaaagaggggatacaagcttcc

SEQ ID NO: 126651 - DNA, 32 bp, Artificial Sequence
  Description of Artificial Sequence: Synthetic oligonucleotide
gccgattttgcaaagaggggatacaagcttcc

SEQ ID NO: 126652 - DNA, 35 bp, Artificial Sequence
  Description of Artificial Sequence: Synthetic oligonucleotide
ccgattttgcaaagaggggatacaagcttccaaag

SEQ ID NO: 126653 - DNA, 35 bp, Artificial Sequence
  Description of Artificial Sequence: Synthetic oligonucleotide
cgattttgcaaagaggggatacaagcttccaaagg

SEQ ID NO: 126654 - DNA, 36 bp, Artificial Sequence
  Description of Artificial Sequence: Synthetic oligonucleotide
gattttgcaaagaggggatacaagcttccaaaggtc

SEQ ID NO: 126655 - DNA, 36 bp, Artificial Sequence
  Description of Artificial Sequence: Synthetic oligonucleotide
attttgcaaagaggggatacaagcttccaaaggtcc

SEQ ID NO: 126656 - DNA, 35 bp, Artificial Sequence
  Description of Artificial Sequence: Synthetic oligonucleotide
ttttgcaaagaggggatacaagcttccaaaggtcc

SEQ ID NO: 126657 - DNA, 34 bp, Artificial Sequence
  Description of Artificial Sequence: Synthetic oligonucleotide
tttgcaaagaggggatacaagcttccaaaggtcc

SEQ ID NO: 126658 - DNA, 33 bp, Artificial Sequence
  Description of Artificial Sequence: Synthetic oligonucleotide
ttgcaaagaggggatacaagcttccaaaggtcc

SEQ ID NO: 126659 - DNA, 32 bp, Artificial Sequence
  Description of Artificial Sequence: Synthetic oligonucleotide
tgcaaagaggggatacaagcttccaaaggtcc

SEQ ID NO: 126660 - DNA, 31 bp, Artificial Sequence
  Description of Artificial Sequence: Synthetic oligonucleotide
gcaaagaggggatacaagcttccaaaggtcc

SEQ ID NO: 126661 - DNA, 31 bp, Artificial Sequence
  Description of Artificial Sequence: Synthetic oligonucleotide
caaagaggggatacaagcttccaaaggtccg

SEQ ID NO: 126662 - DNA, 31 bp, Artificial Sequence
  Description of Artificial Sequence: Synthetic oligonucleotide
aaagaggggatacaagcttccaaaggtccgg

SEQ ID NO: 126663 - DNA, 30 bp, Artificial Sequence
  Description of Artificial Sequence: Synthetic oligonucleotide
aagaggggatacaagcttccaaaggtccgg

SEQ ID NO: 126664 - DNA, 29 bp, Artificial Sequence
  Description of Artificial Sequence: Synthetic oligonucleotide
agaggggatacaagcttccaaaggtccgg

SEQ ID NO: 126665 - DNA, 28 bp, Artificial Sequence
  Description of Artificial Sequence: Synthetic oligonucleotide
gaggggatacaagcttccaaaggtccgg

SEQ ID NO: 126666 - DNA, 32 bp, Artificial Sequence
  Description of Artificial Sequence: Synthetic oligonucleotide
aggggatacaagcttccaaaggtccggaaaac

SEQ ID NO: 126667 - DNA, 31 bp, Artificial Sequence
  Description of Artificial Sequence: Synthetic oligonucleotide
ggggatacaagcttccaaaggtccggaaaac

SEQ ID NO: 126668 - DNA, 32 bp, Artificial Sequence
  Description of Artificial Sequence: Synthetic oligonucleotide
gggatacaagcttccaaaggtccggaaaactg

SEQ ID NO: 126669 - DNA, 32 bp, Artificial Sequence
  Description of Artificial Sequence: Synthetic oligonucleotide
ggatacaagcttccaaaggtccggaaaactgg

SEQ ID NO: 126670 - DNA, 32 bp, Artificial Sequence
  Description of Artificial Sequence: Synthetic oligonucleotide
gatacaagcttccaaaggtccggaaaactggc

SEQ ID NO: 126671 - DNA, 33 bp, Artificial Sequence
  Description of Artificial Sequence: Synthetic oligonucleotide
atacaagcttccaaaggtccggaaaactggcac

SEQ ID NO: 126672 - DNA, 32 bp, Artificial Sequence
  Description of Artificial Sequence: Synthetic oligonucleotide
tacaagcttccaaaggtccggaaaactggcac

SEQ ID NO: 126673 - DNA, 31 bp, Artificial Sequence
  Description of Artificial Sequence: Synthetic oligonucleotide
acaagcttccaaaggtccggaaaactggcac

SEQ ID NO: 126674 - DNA, 30 bp, Artificial Sequence
  Description of Artificial Sequence: Synthetic oligonucleotide
caagcttccaaaggtccggaaaactggcac

SEQ ID NO: 126675 - DNA, 30 bp, Artificial Sequence
  Description of Artificial Sequence: Synthetic oligonucleotide
aagcttccaaaggtccggaaaactggcacg

SEQ ID NO: 126676 - DNA, 29 bp, Artificial Sequence
  Description of Artificial Sequence: Synthetic oligonucleotide
agcttccaaaggtccggaaaactggcacg

SEQ ID NO: 126677 - DNA, 28 bp, Artificial Sequence
  Description of Artificial Sequence: Synthetic oligonucleotide
gcttccaaaggtccggaaaactggcacg

SEQ ID NO: 126678 - DNA, 29 bp, Artificial Sequence
  Description of Artificial Sequence: Synthetic oligonucleotide
cttccaaaggtccggaaaactggcacgac

SEQ ID NO: 126679 - DNA, 29 bp, Artificial Sequence
  Description of Artificial Sequence: Synthetic oligonucleotide
ttccaaaggtccggaaaactggcacgacc

SEQ ID NO: 126680 - DNA, 28 bp, Artificial Sequence
  Description of Artificial Sequence: Synthetic oligonucleotide
tccaaaggtccggaaaactggcacgacc

SEQ ID NO: 126681 - DNA, 27 bp, Artificial Sequence
  Description of Artificial Sequence: Synthetic oligonucleotide
ccaaaggtccggaaaactggcacgacc

SEQ ID NO: 126682 - DNA, 29 bp, Artificial Sequence
  Description of Artificial Sequence: Synthetic oligonucleotide
caaaggtccggaaaactggcacgaccatc

SEQ ID NO: 126683 - DNA, 29 bp, Artificial Sequence
  Description of Artificial Sequence: Synthetic oligonucleotide
aaaggtccggaaaactggcacgaccatcg

SEQ ID NO: 126684 - DNA, 28 bp, Artificial Sequence
  Description of Artificial Sequence: Synthetic oligonucleotide
aaggtccggaaaactggcacgaccatcg

SEQ ID NO: 126685 - DNA, 27 bp, Artificial Sequence
  Description of Artificial Sequence: Synthetic oligonucleotide
aggtccggaaaactggcacgaccatcg

SEQ ID NO: 126686 - DNA, 26 bp, Artificial Sequence
  Description of Artificial Sequence: Synthetic oligonucleotide
ggtccggaaaactggcacgaccatcg

SEQ ID NO: 126687 - DNA, 27 bp, Artificial Sequence
  Description of Artificial Sequence: Synthetic oligonucleotide
gtccggaaaactggcacgaccatcgct

SEQ ID NO: 126688 - DNA, 27 bp, Artificial Sequence
  Description of Artificial Sequence: Synthetic oligonucleotide
tccggaaaactggcacgaccatcgctg

SEQ ID NO: 126689 - DNA, 26 bp, Artificial Sequence
  Description of Artificial Sequence: Synthetic oligonucleotide
ccggaaaactggcacgaccatcgctg

SEQ ID NO: 126690 - DNA, 26 bp, Artificial Sequence
  Description of Artificial Sequence: Synthetic oligonucleotide
cggaaaactggcacgaccatcgctgg

SEQ ID NO: 126691 - DNA, 26 bp, Artificial Sequence
  Description of Artificial Sequence: Synthetic oligonucleotide
ggaaaactggcacgaccatcgctggg

SEQ ID NO: 126692 - DNA, 27 bp, Artificial Sequence
  Description of Artificial Sequence: Synthetic oligonucleotide
gaaaactggcacgaccatcgctggggt

SEQ ID NO: 126693 - DNA, 27 bp, Artificial Sequence
  Description of Artificial Sequence: Synthetic oligonucleotide
aaaactggcacgaccatcgctggggtg

SEQ ID NO: 126694 - DNA, 26 bp, Artificial Sequence
  Description of Artificial Sequence: Synthetic oligonucleotide
aaactggcacgaccatcgctggggtg

SEQ ID NO: 126695 - DNA, 25 bp, Artificial Sequence
  Description of Artificial Sequence: Synthetic oligonucleotide
aactggcacgaccatcgctggggtg

SEQ ID NO: 126696 - DNA, 24 bp, Artificial Sequence
  Description of Artificial Sequence: Synthetic oligonucleotide
actggcacgaccatcgctggggtg

SEQ ID NO: 126697 - DNA, 23 bp, Artificial Sequence
  Description of Artificial Sequence: Synthetic oligonucleotide
ctggcacgaccatcgctggggtg

SEQ ID NO: 126698 - DNA, 24 bp, Artificial Sequence
  Description of Artificial Sequence: Synthetic oligonucleotide
tggcacgaccatcgctggggtggt

SEQ ID NO: 126699 - DNA, 23 bp, Artificial Sequence
  Description of Artificial Sequence: Synthetic oligonucleotide
ggcacgaccatcgctggggtggt

SEQ ID NO: 126700 - DNA, 27 bp, Artificial Sequence
  Description of Artificial Sequence: Synthetic oligonucleotide
gcacgaccatcgctggggtggtctata

SEQ ID NO: 126701 - DNA, 28 bp, Artificial Sequence
  Description of Artificial Sequence: Synthetic oligonucleotide
cacgaccatcgctggggtggtctataag

SEQ ID NO: 126702 - DNA, 28 bp, Artificial Sequence
  Description of Artificial Sequence: Synthetic oligonucleotide
acgaccatcgctggggtggtctataagg

SEQ ID NO: 126703 - DNA, 27 bp, Artificial Sequence
  Description of Artificial Sequence: Synthetic oligonucleotide
cgaccatcgctggggtggtctataagg

SEQ ID NO: 126704 - DNA, 29 bp, Artificial Sequence
  Description of Artificial Sequence: Synthetic oligonucleotide
gaccatcgctggggtggtctataaggatg

SEQ ID NO: 126705 - DNA, 29 bp, Artificial Sequence
  Description of Artificial Sequence: Synthetic oligonucleotide
accatcgctggggtggtctataaggatgg

SEQ ID NO: 126706 - DNA, 28 bp, Artificial Sequence
  Description of Artificial Sequence: Synthetic oligonucleotide
ccatcgctggggtggtctataaggatgg

SEQ ID NO: 126707 - DNA, 28 bp, Artificial Sequence
  Description of Artificial Sequence: Synthetic oligonucleotide
catcgctggggtggtctataaggatggc

SEQ ID NO: 126708 - DNA, 31 bp, Artificial Sequence
  Description of Artificial Sequence: Synthetic oligonucleotide
atcgctggggtggtctataaggatggcatag

SEQ ID NO: 126709 - DNA, 30 bp, Artificial Sequence
  Description of Artificial Sequence: Synthetic oligonucleotide
tcgctggggtggtctataaggatggcatag

SEQ ID NO: 126710 - DNA, 29 bp, Artificial Sequence
  Description of Artificial Sequence: Synthetic oligonucleotide
cgctggggtggtctataaggatggcatag

SEQ ID NO: 126711 - DNA, 31 bp, Artificial Sequence
  Description of Artificial Sequence: Synthetic oligonucleotide
gctggggtggtctataaggatggcatagttc

SEQ ID NO: 126712 - DNA, 33 bp, Artificial Sequence
  Description of Artificial Sequence: Synthetic oligonucleotide
ctggggtggtctataaggatggcatagttcttg

SEQ ID NO: 126713 - DNA, 33 bp, Artificial Sequence
  Description of Artificial Sequence: Synthetic oligonucleotide
tggggtggtctataaggatggcatagttcttgg

SEQ ID NO: 126714 - DNA, 32 bp, Artificial Sequence
  Description of Artificial Sequence: Synthetic oligonucleotide
ggggtggtctataaggatggcatagttcttgg

SEQ ID NO: 126715 - DNA, 33 bp, Artificial Sequence
  Description of Artificial Sequence: Synthetic oligonucleotide
gggtggtctataaggatggcatagttcttggag

SEQ ID NO: 126716 - DNA, 33 bp, Artificial Sequence
  Description of Artificial Sequence: Synthetic oligonucleotide
ggtggtctataaggatggcatagttcttggagc

SEQ ID NO: 126717 - DNA, 34 bp, Artificial Sequence
  Description of Artificial Sequence: Synthetic oligonucleotide
gtggtctataaggatggcatagttcttggagcag

SEQ ID NO: 126718 - DNA, 37 bp, Artificial Sequence
  Description of Artificial Sequence: Synthetic oligonucleotide
tggtctataaggatggcatagttcttggagcagatac

SEQ ID NO: 126719 - DNA, 36 bp, Artificial Sequence
  Description of Artificial Sequence: Synthetic oligonucleotide
ggtctataaggatggcatagttcttggagcagatac

SEQ ID NO: 126720 - DNA, 38 bp, Artificial Sequence
  Description of Artificial Sequence: Synthetic oligonucleotide
gtctataaggatggcatagttcttggagcagatacaag

SEQ ID NO: 126721 - DNA, 39 bp, Artificial Sequence
  Description of Artificial Sequence: Synthetic oligonucleotide
tctataaggatggcatagttcttggagcagatacaagag

SEQ ID NO: 126722 - DNA, 38 bp, Artificial Sequence
  Description of Artificial Sequence: Synthetic oligonucleotide
ctataaggatggcatagttcttggagcagatacaagag

SEQ ID NO: 126723 - DNA, 38 bp, Artificial Sequence
  Description of Artificial Sequence: Synthetic oligonucleotide
tataaggatggcatagttcttggagcagatacaagagc

SEQ ID NO: 126724 - DNA, 37 bp, Artificial Sequence
  Description of Artificial Sequence: Synthetic oligonucleotide
ataaggatggcatagttcttggagcagatacaagagc

SEQ ID NO: 126725 - DNA, 36 bp, Artificial Sequence
  Description of Artificial Sequence: Synthetic oligonucleotide
taaggatggcatagttcttggagcagatacaagagc

SEQ ID NO: 126726 - DNA, 35 bp, Artificial Sequence
  Description of Artificial Sequence: Synthetic oligonucleotide
aaggatggcatagttcttggagcagatacaagagc

SEQ ID NO: 126727 - DNA, 34 bp, Artificial Sequence
  Description of Artificial Sequence: Synthetic oligonucleotide
aggatggcatagttcttggagcagatacaagagc

SEQ ID NO: 126728 - DNA, 33 bp, Artificial Sequence
  Description of Artificial Sequence: Synthetic oligonucleotide
ggatggcatagttcttggagcagatacaagagc

SEQ ID NO: 126729 - DNA, 35 bp, Artificial Sequence
  Description of Artificial Sequence: Synthetic oligonucleotide
gatggcatagttcttggagcagatacaagagcaac

SEQ ID NO: 126730 - DNA, 36 bp, Artificial Sequence
  Description of Artificial Sequence: Synthetic oligonucleotide
atggcatagttcttggagcagatacaagagcaactg

SEQ ID NO: 126731 - DNA, 35 bp, Artificial Sequence
  Description of Artificial Sequence: Synthetic oligonucleotide
tggcatagttcttggagcagatacaagagcaactg

SEQ ID NO: 126732 - DNA, 34 bp, Artificial Sequence
  Description of Artificial Sequence: Synthetic oligonucleotide
ggcatagttcttggagcagatacaagagcaactg

SEQ ID NO: 126733 - DNA, 36 bp, Artificial Sequence
  Description of Artificial Sequence: Synthetic oligonucleotide
gcatagttcttggagcagatacaagagcaactgaag

SEQ ID NO: 126734 - DNA, 36 bp, Artificial Sequence
  Description of Artificial Sequence: Synthetic oligonucleotide
catagttcttggagcagatacaagagcaactgaagg

SEQ ID NO: 126735 - DNA, 36 bp, Artificial Sequence
  Description of Artificial Sequence: Synthetic oligonucleotide
atagttcttggagcagatacaagagcaactgaaggg

SEQ ID NO: 126736 - DNA, 35 bp, Artificial Sequence
  Description of Artificial Sequence: Synthetic oligonucleotide
tagttcttggagcagatacaagagcaactgaaggg

SEQ ID NO: 126737 - DNA, 34 bp, Artificial Sequence
  Description of Artificial Sequence: Synthetic oligonucleotide
agttcttggagcagatacaagagcaactgaaggg

SEQ ID NO: 126738 - DNA, 33 bp, Artificial Sequence
  Description of Artificial Sequence: Synthetic oligonucleotide
gttcttggagcagatacaagagcaactgaaggg

SEQ ID NO: 126739 - DNA, 35 bp, Artificial Sequence
  Description of Artificial Sequence: Synthetic oligonucleotide
ttcttggagcagatacaagagcaactgaagggatg

SEQ ID NO: 126740 - DNA, 34 bp, Artificial Sequence
  Description of Artificial Sequence: Synthetic oligonucleotide
tcttggagcagatacaagagcaactgaagggatg

SEQ ID NO: 126741 - DNA, 33 bp, Artificial Sequence
  Description of Artificial Sequence: Synthetic oligonucleotide
cttggagcagatacaagagcaactgaagggatg

SEQ ID NO: 126742 - DNA, 33 bp, Artificial Sequence
  Description of Artificial Sequence: Synthetic oligonucleotide
ttggagcagatacaagagcaactgaagggatgg

SEQ ID NO: 126743 - DNA, 32 bp, Artificial Sequence
  Description of Artificial Sequence: Synthetic oligonucleotide
tggagcagatacaagagcaactgaagggatgg

SEQ ID NO: 126744 - DNA, 31 bp, Artificial Sequence
  Description of Artificial Sequence: Synthetic oligonucleotide
ggagcagatacaagagcaactgaagggatgg

SEQ ID NO: 126745 - DNA, 33 bp, Artificial Sequence
  Description of Artificial Sequence: Synthetic oligonucleotide
gagcagatacaagagcaactgaagggatggttg

SEQ ID NO: 126746 - DNA, 35 bp, Artificial Sequence
  Description of Artificial Sequence: Synthetic oligonucleotide
agcagatacaagagcaactgaagggatggttgttg

SEQ ID NO: 126747 - DNA, 34 bp, Artificial Sequence
  Description of Artificial Sequence: Synthetic oligonucleotide
gcagatacaagagcaactgaagggatggttgttg

SEQ ID NO: 126748 - DNA, 34 bp, Artificial Sequence
  Description of Artificial Sequence: Synthetic oligonucleotide
cagatacaagagcaactgaagggatggttgttgc

SEQ ID NO: 126749 - DNA, 35 bp, Artificial Sequence
  Description of Artificial Sequence: Synthetic oligonucleotide
agatacaagagcaactgaagggatggttgttgctg

SEQ ID NO: 126750 - DNA, 34 bp, Artificial Sequence
  Description of Artificial Sequence: Synthetic oligonucleotide
gatacaagagcaactgaagggatggttgttgctg

SEQ ID NO: 126751 - DNA, 35 bp, Artificial Sequence
  Description of Artificial Sequence: Synthetic oligonucleotide
atacaagagcaactgaagggatggttgttgctgac

SEQ ID NO: 126752 - DNA, 34 bp, Artificial Sequence
  Description of Artificial Sequence: Synthetic oligonucleotide
tacaagagcaactgaagggatggttgttgctgac

SEQ ID NO: 126753 - DNA, 33 bp, Artificial Sequence
  Description of Artificial Sequence: Synthetic oligonucleotide
acaagagcaactgaagggatggttgttgctgac

SEQ ID NO: 126754 - DNA, 32 bp, Artificial Sequence
  Description of Artificial Sequence: Synthetic oligonucleotide
caagagcaactgaagggatggttgttgctgac

SEQ ID NO: 126755 - DNA, 34 bp, Artificial Sequence
  Description of Artificial Sequence: Synthetic oligonucleotide
aagagcaactgaagggatggttgttgctgacaag

SEQ ID NO: 126756 - DNA, 33 bp, Artificial Sequence
  Description of Artificial Sequence: Synthetic oligonucleotide
agagcaactgaagggatggttgttgctgacaag

SEQ ID NO: 126757 - DNA, 32 bp, Artificial Sequence
  Description of Artificial Sequence: Synthetic oligonucleotide
gagcaactgaagggatggttgttgctgacaag

SEQ ID NO: 126758 - DNA, 34 bp, Artificial Sequence
  Description of Artificial Sequence: Synthetic oligonucleotide
agcaactgaagggatggttgttgctgacaagaac

SEQ ID NO: 126759 - DNA, 33 bp, Artificial Sequence
  Description of Artificial Sequence: Synthetic oligonucleotide
gcaactgaagggatggttgttgctgacaagaac

SEQ ID NO: 126760 - DNA, 34 bp, Artificial Sequence
  Description of Artificial Sequence: Synthetic oligonucleotide
caactgaagggatggttgttgctgacaagaactg

SEQ ID NO: 126761 - DNA, 36 bp, Artificial Sequence
  Description of Artificial Sequence: Synthetic oligonucleotide
aactgaagggatggttgttgctgacaagaactgttc

SEQ ID NO: 126762 - DNA, 35 bp, Artificial Sequence
  Description of Artificial Sequence: Synthetic oligonucleotide
actgaagggatggttgttgctgacaagaactgttc

SEQ ID NO: 126763 - DNA, 34 bp, Artificial Sequence
  Description of Artificial Sequence: Synthetic oligonucleotide
ctgaagggatggttgttgctgacaagaactgttc

SEQ ID NO: 126764 - DNA, 41 bp, Artificial Sequence
  Description of Artificial Sequence: Synthetic oligonucleotide
tgaagggatggttgttgctgacaagaactgttcaaaaatac

SEQ ID NO: 126765 - DNA, 40 bp, Artificial Sequence
  Description of Artificial Sequence: Synthetic oligonucleotide
gaagggatggttgttgctgacaagaactgttcaaaaatac

SEQ ID NO: 126766 - DNA, 41 bp, Artificial Sequence
  Description of Artificial Sequence: Synthetic oligonucleotide
aagggatggttgttgctgacaagaactgttcaaaaatacac

SEQ ID NO: 126767 - DNA, 40 bp, Artificial Sequence
  Description of Artificial Sequence: Synthetic oligonucleotide
agggatggttgttgctgacaagaactgttcaaaaatacac

SEQ ID NO: 126768 - DNA, 39 bp, Artificial Sequence
  Description of Artificial Sequence: Synthetic oligonucleotide
gggatggttgttgctgacaagaactgttcaaaaatacac

SEQ ID NO: 126769 - DNA, 41 bp, Artificial Sequence
  Description of Artificial Sequence: Synthetic oligonucleotide
ggatggttgttgctgacaagaactgttcaaaaatacacttc

SEQ ID NO: 126770 - DNA, 45 bp, Artificial Sequence
  Description of Artificial Sequence: Synthetic oligonucleotide
gatggttgttgctgacaagaactgttcaaaaatacacttcatatc

SEQ ID NO: 126771 - DNA, 46 bp, Artificial Sequence
  Description of Artificial Sequence: Synthetic oligonucleotide
atggttgttgctgacaagaactgttcaaaaatacacttcatatctc

SEQ ID NO: 126772 - DNA, 45 bp, Artificial Sequence
  Description of Artificial Sequence: Synthetic oligonucleotide
tggttgttgctgacaagaactgttcaaaaatacacttcatatctc

SEQ ID NO: 126773 - DNA, 44 bp, Artificial Sequence
  Description of Artificial Sequence: Synthetic oligonucleotide
ggttgttgctgacaagaactgttcaaaaatacacttcatatctc

SEQ ID NO: 126774 - DNA, 44 bp, Artificial Sequence
  Description of Artificial Sequence: Synthetic oligonucleotide
gttgttgctgacaagaactgttcaaaaatacacttcatatctcc

SEQ ID NO: 126775 - DNA, 55 bp, Artificial Sequence
  Description of Artificial Sequence: Synthetic oligonucleotide
ttgttgctgacaagaactgttcaaaaatacacttcatatctcctaatatttattg

SEQ ID NO: 126776 - DNA, 54 bp, Artificial Sequence
  Description of Artificial Sequence: Synthetic oligonucleotide
tgttgctgacaagaactgttcaaaaatacacttcatatctcctaatatttattg

SEQ ID NO: 126777 - DNA, 53 bp, Artificial Sequence
  Description of Artificial Sequence: Synthetic oligonucleotide
gttgctgacaagaactgttcaaaaatacacttcatatctcctaatatttattg

SEQ ID NO: 126778 - DNA, 55 bp, Artificial Sequence
  Description of Artificial Sequence: Synthetic oligonucleotide
ttgctgacaagaactgttcaaaaatacacttcatatctcctaatatttattgttg

SEQ ID NO: 126779 - DNA, 54 bp, Artificial Sequence
  Description of Artificial Sequence: Synthetic oligonucleotide
tgctgacaagaactgttcaaaaatacacttcatatctcctaatatttattgttg

SEQ ID NO: 126780 - DNA, 53 bp, Artificial Sequence
  Description of Artificial Sequence: Synthetic oligonucleotide
gctgacaagaactgttcaaaaatacacttcatatctcctaatatttattgttg

SEQ ID NO: 126781 - DNA, 54 bp, Artificial Sequence
  Description of Artificial Sequence: Synthetic oligonucleotide
ctgacaagaactgttcaaaaatacacttcatatctcctaatatttattgttgtg

SEQ ID NO: 126782 - DNA, 54 bp, Artificial Sequence
  Description of Artificial Sequence: Synthetic oligonucleotide
tgacaagaactgttcaaaaatacacttcatatctcctaatatttattgttgtgg

SEQ ID NO: 126783 - DNA, 53 bp, Artificial Sequence
  Description of Artificial Sequence: Synthetic oligonucleotide
gacaagaactgttcaaaaatacacttcatatctcctaatatttattgttgtgg

SEQ ID NO: 126784 - DNA, 54 bp, Artificial Sequence
  Description of Artificial Sequence: Synthetic oligonucleotide
acaagaactgttcaaaaatacacttcatatctcctaatatttattgttgtggtg

SEQ ID NO: 126785 - DNA, 53 bp, Artificial Sequence
  Description of Artificial Sequence: Synthetic oligonucleotide
caagaactgttcaaaaatacacttcatatctcctaatatttattgttgtggtg

SEQ ID NO: 126786 - DNA, 53 bp, Artificial Sequence
  Description of Artificial Sequence: Synthetic oligonucleotide
aagaactgttcaaaaatacacttcatatctcctaatatttattgttgtggtgc

SEQ ID NO: 126787 - DNA, 52 bp, Artificial Sequence
  Description of Artificial Sequence: Synthetic oligonucleotide
agaactgttcaaaaatacacttcatatctcctaatatttattgttgtggtgc

SEQ ID NO: 126788 - DNA, 51 bp, Artificial Sequence
  Description of Artificial Sequence: Synthetic oligonucleotide
gaactgttcaaaaatacacttcatatctcctaatatttattgttgtggtgc

SEQ ID NO: 126789 - DNA, 52 bp, Artificial Sequence
  Description of Artificial Sequence: Synthetic oligonucleotide
aactgttcaaaaatacacttcatatctcctaatatttattgttgtggtgctg

SEQ ID NO: 126790 - DNA, 51 bp, Artificial Sequence
  Description of Artificial Sequence: Synthetic oligonucleotide
actgttcaaaaatacacttcatatctcctaatatttattgttgtggtgctg

SEQ ID NO: 126791 - DNA, 50 bp, Artificial Sequence
  Description of Artificial Sequence: Synthetic oligonucleotide
ctgttcaaaaatacacttcatatctcctaatatttattgttgtggtgctg

SEQ ID NO: 126792 - DNA, 50 bp, Artificial Sequence
  Description of Artificial Sequence: Synthetic oligonucleotide
tgttcaaaaatacacttcatatctcctaatatttattgttgtggtgctgg

SEQ ID NO: 126793 - DNA, 49 bp, Artificial Sequence
  Description of Artificial Sequence: Synthetic oligonucleotide
gttcaaaaatacacttcatatctcctaatatttattgttgtggtgctgg

SEQ ID NO: 126794 - DNA, 49 bp, Artificial Sequence
  Description of Artificial Sequence: Synthetic oligonucleotide
ttcaaaaatacacttcatatctcctaatatttattgttgtggtgctggg

SEQ ID NO: 126795 - DNA, 48 bp, Artificial Sequence
  Description of Artificial Sequence: Synthetic oligonucleotide
tcaaaaatacacttcatatctcctaatatttattgttgtggtgctggg

SEQ ID NO: 126796 - DNA, 47 bp, Artificial Sequence
  Description of Artificial Sequence: Synthetic oligonucleotide
caaaaatacacttcatatctcctaatatttattgttgtggtgctggg

SEQ ID NO: 126797 - DNA, 48 bp, Artificial Sequence
  Description of Artificial Sequence: Synthetic oligonucleotide
aaaaatacacttcatatctcctaatatttattgttgtggtgctgggac

SEQ ID NO: 126798 - DNA, 47 bp, Artificial Sequence
  Description of Artificial Sequence: Synthetic oligonucleotide
aaaatacacttcatatctcctaatatttattgttgtggtgctgggac

SEQ ID NO: 126799 - DNA, 46 bp, Artificial Sequence
  Description of Artificial Sequence: Synthetic oligonucleotide
aaatacacttcatatctcctaatatttattgttgtggtgctgggac

SEQ ID NO: 126800 - DNA, 45 bp, Artificial Sequence
  Description of Artificial Sequence: Synthetic oligonucleotide
aatacacttcatatctcctaatatttattgttgtggtgctgggac

SEQ ID NO: 126801 - DNA, 44 bp, Artificial Sequence
  Description of Artificial Sequence: Synthetic oligonucleotide
atacacttcatatctcctaatatttattgttgtggtgctgggac

SEQ ID NO: 126802 - DNA, 43 bp, Artificial Sequence
  Description of Artificial Sequence: Synthetic oligonucleotide
tacacttcatatctcctaatatttattgttgtggtgctgggac

SEQ ID NO: 126803 - DNA, 42 bp, Artificial Sequence
  Description of Artificial Sequence: Synthetic oligonucleotide
acacttcatatctcctaatatttattgttgtggtgctgggac

SEQ ID NO: 126804 - DNA, 41 bp, Artificial Sequence
  Description of Artificial Sequence: Synthetic oligonucleotide
cacttcatatctcctaatatttattgttgtggtgctgggac

SEQ ID NO: 126805 - DNA, 42 bp, Artificial Sequence
  Description of Artificial Sequence: Synthetic oligonucleotide
acttcatatctcctaatatttattgttgtggtgctgggacag

SEQ ID NO: 126806 - DNA, 41 bp, Artificial Sequence
  Description of Artificial Sequence: Synthetic oligonucleotide
cttcatatctcctaatatttattgttgtggtgctgggacag

SEQ ID NO: 126807 - DNA, 41 bp, Artificial Sequence
  Description of Artificial Sequence: Synthetic oligonucleotide
ttcatatctcctaatatttattgttgtggtgctgggacagc

SEQ ID NO: 126808 - DNA, 40 bp, Artificial Sequence
  Description of Artificial Sequence: Synthetic oligonucleotide
tcatatctcctaatatttattgttgtggtgctgggacagc

SEQ ID NO: 126809 - DNA, 39 bp, Artificial Sequence
  Description of Artificial Sequence: Synthetic oligonucleotide
catatctcctaatatttattgttgtggtgctgggacagc

SEQ ID NO: 126810 - DNA, 40 bp, Artificial Sequence
  Description of Artificial Sequence: Synthetic oligonucleotide
atatctcctaatatttattgttgtggtgctgggacagctg

SEQ ID NO: 126811 - DNA, 39 bp, Artificial Sequence
  Description of Artificial Sequence: Synthetic oligonucleotide
tatctcctaatatttattgttgtggtgctgggacagctg

SEQ ID NO: 126812 - DNA, 38 bp, Artificial Sequence
  Description of Artificial Sequence: Synthetic oligonucleotide
atctcctaatatttattgttgtggtgctgggacagctg

SEQ ID NO: 126813 - DNA, 37 bp, Artificial Sequence
  Description of Artificial Sequence: Synthetic oligonucleotide
tctcctaatatttattgttgtggtgctgggacagctg

SEQ ID NO: 126814 - DNA, 36 bp, Artificial Sequence
  Description of Artificial Sequence: Synthetic oligonucleotide
ctcctaatatttattgttgtggtgctgggacagctg

SEQ ID NO: 126815 - DNA, 36 bp, Artificial Sequence
  Description of Artificial Sequence: Synthetic oligonucleotide
tcctaatatttattgttgtggtgctgggacagctgc

SEQ ID NO: 126816 - DNA, 35 bp, Artificial Sequence
  Description of Artificial Sequence: Synthetic oligonucleotide
cctaatatttattgttgtggtgctgggacagctgc

SEQ ID NO: 126817 - DNA, 36 bp, Artificial Sequence
  Description of Artificial Sequence: Synthetic oligonucleotide
ctaatatttattgttgtggtgctgggacagctgcag

SEQ ID NO: 126818 - DNA, 37 bp, Artificial Sequence
  Description of Artificial Sequence: Synthetic oligonucleotide
taatatttattgttgtggtgctgggacagctgcagac

SEQ ID NO: 126819 - DNA, 36 bp, Artificial Sequence
  Description of Artificial Sequence: Synthetic oligonucleotide
aatatttattgttgtggtgctgggacagctgcagac

SEQ ID NO: 126820 - DNA, 35 bp, Artificial Sequence
  Description of Artificial Sequence: Synthetic oligonucleotide
atatttattgttgtggtgctgggacagctgcagac

SEQ ID NO: 126821 - DNA, 34 bp, Artificial Sequence
  Description of Artificial Sequence: Synthetic oligonucleotide
tatttattgttgtggtgctgggacagctgcagac

SEQ ID NO: 126822 - DNA, 33 bp, Artificial Sequence
  Description of Artificial Sequence: Synthetic oligonucleotide
atttattgttgtggtgctgggacagctgcagac

SEQ ID NO: 126823 - DNA, 32 bp, Artificial Sequence
  Description of Artificial Sequence: Synthetic oligonucleotide
tttattgttgtggtgctgggacagctgcagac

SEQ ID NO: 126824 - DNA, 31 bp, Artificial Sequence
  Description of Artificial Sequence: Synthetic oligonucleotide
ttattgttgtggtgctgggacagctgcagac

SEQ ID NO: 126825 - DNA, 30 bp, Artificial Sequence
  Description of Artificial Sequence: Synthetic oligonucleotide
tattgttgtggtgctgggacagctgcagac

SEQ ID NO: 126826 - DNA, 29 bp, Artificial Sequence
  Description of Artificial Sequence: Synthetic oligonucleotide
attgttgtggtgctgggacagctgcagac

SEQ ID NO: 126827 - DNA, 28 bp, Artificial Sequence
  Description of Artificial Sequence: Synthetic oligonucleotide
ttgttgtggtgctgggacagctgcagac

SEQ ID NO: 126828 - DNA, 27 bp, Artificial Sequence
  Description of Artificial Sequence: Synthetic oligonucleotide
tgttgtggtgctgggacagctgcagac

SEQ ID NO: 126829 - DNA, 27 bp, Artificial Sequence
  Description of Artificial Sequence: Synthetic oligonucleotide
gttgtggtgctgggacagctgcagaca

SEQ ID NO: 126830 - DNA, 27 bp, Artificial Sequence
  Description of Artificial Sequence: Synthetic oligonucleotide
ttgtggtgctgggacagctgcagacac

SEQ ID NO: 126831 - DNA, 27 bp, Artificial Sequence
  Description of Artificial Sequence: Synthetic oligonucleotide
tgtggtgctgggacagctgcagacaca

SEQ ID NO: 126832 - DNA, 26 bp, Artificial Sequence
  Description of Artificial Sequence: Synthetic oligonucleotide
gtggtgctgggacagctgcagacaca

SEQ ID NO: 126833 - DNA, 27 bp, Artificial Sequence
  Description of Artificial Sequence: Synthetic oligonucleotide
tggtgctgggacagctgcagacacaga

SEQ ID NO: 126834 - DNA, 26 bp, Artificial Sequence
  Description of Artificial Sequence: Synthetic oligonucleotide
ggtgctgggacagctgcagacacaga

SEQ ID NO: 126835 - DNA, 27 bp, Artificial Sequence
  Description of Artificial Sequence: Synthetic oligonucleotide
gtgctgggacagctgcagacacagaca

SEQ ID NO: 126836 - DNA, 28 bp, Artificial Sequence
  Description of Artificial Sequence: Synthetic oligonucleotide
tgctgggacagctgcagacacagacatg

SEQ ID NO: 126837 - DNA, 27 bp, Artificial Sequence
  Description of Artificial Sequence: Synthetic oligonucleotide
gctgggacagctgcagacacagacatg

SEQ ID NO: 126838 - DNA, 28 bp, Artificial Sequence
  Description of Artificial Sequence: Synthetic oligonucleotide
ctgggacagctgcagacacagacatgac

SEQ ID NO: 126839 - DNA, 30 bp, Artificial Sequence
  Description of Artificial Sequence: Synthetic oligonucleotide
tgggacagctgcagacacagacatgacaac

SEQ ID NO: 126840 - DNA, 29 bp, Artificial Sequence
  Description of Artificial Sequence: Synthetic oligonucleotide
gggacagctgcagacacagacatgacaac

SEQ ID NO: 126841 - DNA, 29 bp, Artificial Sequence
  Description of Artificial Sequence: Synthetic oligonucleotide
ggacagctgcagacacagacatgacaacc

SEQ ID NO: 126842 - DNA, 29 bp, Artificial Sequence
  Description of Artificial Sequence: Synthetic oligonucleotide
gacagctgcagacacagacatgacaaccc

SEQ ID NO: 126843 - DNA, 30 bp, Artificial Sequence
  Description of Artificial Sequence: Synthetic oligonucleotide
acagctgcagacacagacatgacaacccag

SEQ ID NO: 126844 - DNA, 29 bp, Artificial Sequence
  Description of Artificial Sequence: Synthetic oligonucleotide
cagctgcagacacagacatgacaacccag

SEQ ID NO: 126845 - DNA, 29 bp, Artificial Sequence
  Description of Artificial Sequence: Synthetic oligonucleotide
agctgcagacacagacatgacaacccagc

SEQ ID NO: 126846 - DNA, 28 bp, Artificial Sequence
  Description of Artificial Sequence: Synthetic oligonucleotide
gctgcagacacagacatgacaacccagc

SEQ ID NO: 126847 - DNA, 29 bp, Artificial Sequence
  Description of Artificial Sequence: Synthetic oligonucleotide
ctgcagacacagacatgacaacccagctc

SEQ ID NO: 126848 - DNA, 33 bp, Artificial Sequence
  Description of Artificial Sequence: Synthetic oligonucleotide
tgcagacacagacatgacaacccagctcatttc

SEQ ID NO: 126849 - DNA, 32 bp, Artificial Sequence
  Description of Artificial Sequence: Synthetic oligonucleotide
gcagacacagacatgacaacccagctcatttc

SEQ ID NO: 126850 - DNA, 34 bp, Artificial Sequence
  Description of Artificial Sequence: Synthetic oligonucleotide
cagacacagacatgacaacccagctcatttcttc

SEQ ID NO: 126851 - DNA, 34 bp, Artificial Sequence
  Description of Artificial Sequence: Synthetic oligonucleotide
agacacagacatgacaacccagctcatttcttcc

SEQ ID NO: 126852 - DNA, 33 bp, Artificial Sequence
  Description of Artificial Sequence: Synthetic oligonucleotide
gacacagacatgacaacccagctcatttcttcc

SEQ ID NO: 126853 - DNA, 35 bp, Artificial Sequence
  Description of Artificial Sequence: Synthetic oligonucleotide
acacagacatgacaacccagctcatttcttccaac

SEQ ID NO: 126854 - DNA, 34 bp, Artificial Sequence
  Description of Artificial Sequence: Synthetic oligonucleotide
cacagacatgacaacccagctcatttcttccaac

SEQ ID NO: 126855 - DNA, 34 bp, Artificial Sequence
  Description of Artificial Sequence: Synthetic oligonucleotide
acagacatgacaacccagctcatttcttccaacc

SEQ ID NO: 126856 - DNA, 33 bp, Artificial Sequence
  Description of Artificial Sequence: Synthetic oligonucleotide
cagacatgacaacccagctcatttcttccaacc

SEQ ID NO: 126857 - DNA, 34 bp, Artificial Sequence
  Description of Artificial Sequence: Synthetic oligonucleotide
agacatgacaacccagctcatttcttccaacctg

SEQ ID NO: 126858 - DNA, 33 bp, Artificial Sequence
  Description of Artificial Sequence: Synthetic oligonucleotide
gacatgacaacccagctcatttcttccaacctg

SEQ ID NO: 126859 - DNA, 33 bp, Artificial Sequence
  Description of Artificial Sequence: Synthetic oligonucleotide
acatgacaacccagctcatttcttccaacctgg

SEQ ID NO: 126860 - DNA, 32 bp, Artificial Sequence
  Description of Artificial Sequence: Synthetic oligonucleotide
catgacaacccagctcatttcttccaacctgg

SEQ ID NO: 126861 - DNA, 33 bp, Artificial Sequence
  Description of Artificial Sequence: Synthetic oligonucleotide
atgacaacccagctcatttcttccaacctggag

SEQ ID NO: 126862 - DNA, 32 bp, Artificial Sequence
  Description of Artificial Sequence: Synthetic oligonucleotide
tgacaacccagctcatttcttccaacctggag

SEQ ID NO: 126863 - DNA, 31 bp, Artificial Sequence
  Description of Artificial Sequence: Synthetic oligonucleotide
gacaacccagctcatttcttccaacctggag

SEQ ID NO: 126864 - DNA, 31 bp, Artificial Sequence
  Description of Artificial Sequence: Synthetic oligonucleotide
acaacccagctcatttcttccaacctggagc

SEQ ID NO: 126865 - DNA, 30 bp, Artificial Sequence
  Description of Artificial Sequence: Synthetic oligonucleotide
caacccagctcatttcttccaacctggagc

SEQ ID NO: 126866 - DNA, 31 bp, Artificial Sequence
  Description of Artificial Sequence: Synthetic oligonucleotide
aacccagctcatttcttccaacctggagctc

SEQ ID NO: 126867 - DNA, 30 bp, Artificial Sequence
  Description of Artificial Sequence: Synthetic oligonucleotide
acccagctcatttcttccaacctggagctc

SEQ ID NO: 126868 - DNA, 29 bp, Artificial Sequence
  Description of Artificial Sequence: Synthetic oligonucleotide
cccagctcatttcttccaacctggagctc

SEQ ID NO: 126869 - DNA, 29 bp, Artificial Sequence
  Description of Artificial Sequence: Synthetic oligonucleotide
ccagctcatttcttccaacctggagctcc

SEQ ID NO: 126870 - DNA, 30 bp, Artificial Sequence
  Description of Artificial Sequence: Synthetic oligonucleotide
cagctcatttcttccaacctggagctccac

SEQ ID NO: 126871 - DNA, 31 bp, Artificial Sequence
  Description of Artificial Sequence: Synthetic oligonucleotide
agctcatttcttccaacctggagctccactc

SEQ ID NO: 126872 - DNA, 30 bp, Artificial Sequence
  Description of Artificial Sequence: Synthetic oligonucleotide
gctcatttcttccaacctggagctccactc

SEQ ID NO: 126873 - DNA, 30 bp, Artificial Sequence
  Description of Artificial Sequence: Synthetic oligonucleotide
ctcatttcttccaacctggagctccactcc

SEQ ID NO: 126874 - DNA, 30 bp, Artificial Sequence
  Description of Artificial Sequence: Synthetic oligonucleotide
tcatttcttccaacctggagctccactccc

SEQ ID NO: 126875 - DNA, 29 bp, Artificial Sequence
  Description of Artificial Sequence: Synthetic oligonucleotide
catttcttccaacctggagctccactccc

SEQ ID NO: 126876 - DNA, 30 bp, Artificial Sequence
  Description of Artificial Sequence: Synthetic oligonucleotide
atttcttccaacctggagctccactccctc

SEQ ID NO: 126877 - DNA, 29 bp, Artificial Sequence
  Description of Artificial Sequence: Synthetic oligonucleotide
tttcttccaacctggagctccactccctc

SEQ ID NO: 126878 - DNA, 28 bp, Artificial Sequence
  Description of Artificial Sequence: Synthetic oligonucleotide
ttcttccaacctggagctccactccctc

SEQ ID NO: 126879 - DNA, 27 bp, Artificial Sequence
  Description of Artificial Sequence: Synthetic oligonucleotide
tcttccaacctggagctccactccctc

SEQ ID NO: 126880 - DNA, 27 bp, Artificial Sequence
  Description of Artificial Sequence: Synthetic oligonucleotide
cttccaacctggagctccactccctct

SEQ ID NO: 126881 - DNA, 27 bp, Artificial Sequence
  Description of Artificial Sequence: Synthetic oligonucleotide
ttccaacctggagctccactccctctc

SEQ ID NO: 126882 - DNA, 26 bp, Artificial Sequence
  Description of Artificial Sequence: Synthetic oligonucleotide
tccaacctggagctccactccctctc

SEQ ID NO: 126883 - DNA, 25 bp, Artificial Sequence
  Description of Artificial Sequence: Synthetic oligonucleotide
ccaacctggagctccactccctctc

SEQ ID NO: 126884 - DNA, 26 bp, Artificial Sequence
  Description of Artificial Sequence: Synthetic oligonucleotide
caacctggagctccactccctctcca

SEQ ID NO: 126885 - DNA, 27 bp, Artificial Sequence
  Description of Artificial Sequence: Synthetic oligonucleotide
aacctggagctccactccctctccact

SEQ ID NO: 126886 - DNA, 26 bp, Artificial Sequence
  Description of Artificial Sequence: Synthetic oligonucleotide
acctggagctccactccctctccact

SEQ ID NO: 126887 - DNA, 25 bp, Artificial Sequence
  Description of Artificial Sequence: Synthetic oligonucleotide
cctggagctccactccctctccact

SEQ ID NO: 126888 - DNA, 25 bp, Artificial Sequence
  Description of Artificial Sequence: Synthetic oligonucleotide
ctggagctccactccctctccactg

SEQ ID NO: 126889 - DNA, 25 bp, Artificial Sequence
  Description of Artificial Sequence: Synthetic oligonucleotide
tggagctccactccctctccactgg

SEQ ID NO: 126890 - DNA, 24 bp, Artificial Sequence
  Description of Artificial Sequence: Synthetic oligonucleotide
ggagctccactccctctccactgg

SEQ ID NO: 126891 - DNA, 24 bp, Artificial Sequence
  Description of Artificial Sequence: Synthetic oligonucleotide
gagctccactccctctccactggc

SEQ ID NO: 126892 - DNA, 24 bp, Artificial Sequence
  Description of Artificial Sequence: Synthetic oligonucleotide
agctccactccctctccactggcc

SEQ ID NO: 126893 - DNA, 23 bp, Artificial Sequence
  Description of Artificial Sequence: Synthetic oligonucleotide
gctccactccctctccactggcc

SEQ ID NO: 126894 - DNA, 24 bp, Artificial Sequence
  Description of Artificial Sequence: Synthetic oligonucleotide
ctccactccctctccactggccgt

SEQ ID NO: 126895 - DNA, 26 bp, Artificial Sequence
  Description of Artificial Sequence: Synthetic oligonucleotide
tccactccctctccactggccgtctt

SEQ ID NO: 126896 - DNA, 25 bp, Artificial Sequence
  Description of Artificial Sequence: Synthetic oligonucleotide
ccactccctctccactggccgtctt

SEQ ID NO: 126897 - DNA, 25 bp, Artificial Sequence
  Description of Artificial Sequence: Synthetic oligonucleotide
cactccctctccactggccgtcttc

SEQ ID NO: 126898 - DNA, 25 bp, Artificial Sequence
  Description of Artificial Sequence: Synthetic oligonucleotide
actccctctccactggccgtcttcc

SEQ ID NO: 126899 - DNA, 24 bp, Artificial Sequence
  Description of Artificial Sequence: Synthetic oligonucleotide
ctccctctccactggccgtcttcc

SEQ ID NO: 126900 - DNA, 25 bp, Artificial Sequence
  Description of Artificial Sequence: Synthetic oligonucleotide
tccctctccactggccgtcttccca

SEQ ID NO: 126901 - DNA, 24 bp, Artificial Sequence
  Description of Artificial Sequence: Synthetic oligonucleotide
ccctctccactggccgtcttccca

SEQ ID NO: 126902 - DNA, 25 bp, Artificial Sequence
  Description of Artificial Sequence: Synthetic oligonucleotide
cctctccactggccgtcttcccaga

SEQ ID NO: 126903 - DNA, 27 bp, Artificial Sequence
  Description of Artificial Sequence: Synthetic oligonucleotide
ctctccactggccgtcttcccagagtt

SEQ ID NO: 126904 - DNA, 27 bp, Artificial Sequence
  Description of Artificial Sequence: Synthetic oligonucleotide
tctccactggccgtcttcccagagttg

SEQ ID NO: 126905 - DNA, 27 bp, Artificial Sequence
  Description of Artificial Sequence: Synthetic oligonucleotide
ctccactggccgtcttcccagagttgt

SEQ ID NO: 126906 - DNA, 27 bp, Artificial Sequence
  Description of Artificial Sequence: Synthetic oligonucleotide
tccactggccgtcttcccagagttgtg

SEQ ID NO: 126907 - DNA, 27 bp, Artificial Sequence
  Description of Artificial Sequence: Synthetic oligonucleotide
ccactggccgtcttcccagagttgtga

SEQ ID NO: 126908 - DNA, 27 bp, Artificial Sequence
  Description of Artificial Sequence: Synthetic oligonucleotide
cactggccgtcttcccagagttgtgac

SEQ ID NO: 126909 - DNA, 28 bp, Artificial Sequence
  Description of Artificial Sequence: Synthetic oligonucleotide
actggccgtcttcccagagttgtgacag

SEQ ID NO: 126910 - DNA, 27 bp, Artificial Sequence
  Description of Artificial Sequence: Synthetic oligonucleotide
ctggccgtcttcccagagttgtgacag

SEQ ID NO: 126911 - DNA, 27 bp, Artificial Sequence
  Description of Artificial Sequence: Synthetic oligonucleotide
tggccgtcttcccagagttgtgacagc

SEQ ID NO: 126912 - DNA, 26 bp, Artificial Sequence
  Description of Artificial Sequence: Synthetic oligonucleotide
ggccgtcttcccagagttgtgacagc

SEQ ID NO: 126913 - DNA, 27 bp, Artificial Sequence
  Description of Artificial Sequence: Synthetic oligonucleotide
gccgtcttcccagagttgtgacagcca

SEQ ID NO: 126914 - DNA, 29 bp, Artificial Sequence
  Description of Artificial Sequence: Synthetic oligonucleotide
ccgtcttcccagagttgtgacagccaatc

SEQ ID NO: 126915 - DNA, 29 bp, Artificial Sequence
  Description of Artificial Sequence: Synthetic oligonucleotide
cgtcttcccagagttgtgacagccaatcg

SEQ ID NO: 126916 - DNA, 29 bp, Artificial Sequence
  Description of Artificial Sequence: Synthetic oligonucleotide
gtcttcccagagttgtgacagccaatcgg

SEQ ID NO: 126917 - DNA, 31 bp, Artificial Sequence
  Description of Artificial Sequence: Synthetic oligonucleotide
tcttcccagagttgtgacagccaatcggatg

SEQ ID NO: 126918 - DNA, 30 bp, Artificial Sequence
  Description of Artificial Sequence: Synthetic oligonucleotide
cttcccagagttgtgacagccaatcggatg

SEQ ID NO: 126919 - DNA, 30 bp, Artificial Sequence
  Description of Artificial Sequence: Synthetic oligonucleotide
ttcccagagttgtgacagccaatcggatgc

SEQ ID NO: 126920 - DNA, 29 bp, Artificial Sequence
  Description of Artificial Sequence: Synthetic oligonucleotide
tcccagagttgtgacagccaatcggatgc

SEQ ID NO: 126921 - DNA, 28 bp, Artificial Sequence
  Description of Artificial Sequence: Synthetic oligonucleotide
cccagagttgtgacagccaatcggatgc

SEQ ID NO: 126922 - DNA, 29 bp, Artificial Sequence
  Description of Artificial Sequence: Synthetic oligonucleotide
ccagagttgtgacagccaatcggatgctg

SEQ ID NO: 126923 - DNA, 31 bp, Artificial Sequence
  Description of Artificial Sequence: Synthetic oligonucleotide
cagagttgtgacagccaatcggatgctgaag

SEQ ID NO: 126924 - DNA, 31 bp, Artificial Sequence
  Description of Artificial Sequence: Synthetic oligonucleotide
agagttgtgacagccaatcggatgctgaagc

SEQ ID NO: 126925 - DNA, 30 bp, Artificial Sequence
  Description of Artificial Sequence: Synthetic oligonucleotide
gagttgtgacagccaatcggatgctgaagc

SEQ ID NO: 126926 - DNA, 31 bp, Artificial Sequence
  Description of Artificial Sequence: Synthetic oligonucleotide
agttgtgacagccaatcggatgctgaagcag

SEQ ID NO: 126927 - DNA, 30 bp, Artificial Sequence
  Description of Artificial Sequence: Synthetic oligonucleotide
gttgtgacagccaatcggatgctgaagcag

SEQ ID NO: 126928 - DNA, 32 bp, Artificial Sequence
  Description of Artificial Sequence: Synthetic oligonucleotide
ttgtgacagccaatcggatgctgaagcagatg

SEQ ID NO: 126929 - DNA, 31 bp, Artificial Sequence
  Description of Artificial Sequence: Synthetic oligonucleotide
tgtgacagccaatcggatgctgaagcagatg

SEQ ID NO: 126930 - DNA, 30 bp, Artificial Sequence
  Description of Artificial Sequence: Synthetic oligonucleotide
gtgacagccaatcggatgctgaagcagatg

SEQ ID NO: 126931 - DNA, 30 bp, Artificial Sequence
  Description of Artificial Sequence: Synthetic oligonucleotide
tgacagccaatcggatgctgaagcagatgc

SEQ ID NO: 126932 - DNA, 29 bp, Artificial Sequence
  Description of Artificial Sequence: Synthetic oligonucleotide
gacagccaatcggatgctgaagcagatgc

SEQ ID NO: 126933 - DNA, 33 bp, Artificial Sequence
  Description of Artificial Sequence: Synthetic oligonucleotide
acagccaatcggatgctgaagcagatgcttttc

SEQ ID NO: 126934 - DNA, 32 bp, Artificial Sequence
  Description of Artificial Sequence: Synthetic oligonucleotide
cagccaatcggatgctgaagcagatgcttttc

SEQ ID NO: 126935 - DNA, 33 bp, Artificial Sequence
  Description of Artificial Sequence: Synthetic oligonucleotide
agccaatcggatgctgaagcagatgcttttcag

SEQ ID NO: 126936 - DNA, 32 bp, Artificial Sequence
  Description of Artificial Sequence: Synthetic oligonucleotide
gccaatcggatgctgaagcagatgcttttcag

SEQ ID NO: 126937 - DNA, 32 bp, Artificial Sequence
  Description of Artificial Sequence: Synthetic oligonucleotide
ccaatcggatgctgaagcagatgcttttcagg

SEQ ID NO: 126938 - DNA, 35 bp, Artificial Sequence
  Description of Artificial Sequence: Synthetic oligonucleotide
caatcggatgctgaagcagatgcttttcaggtatc

SEQ ID NO: 126939 - DNA, 37 bp, Artificial Sequence
  Description of Artificial Sequence: Synthetic oligonucleotide
aatcggatgctgaagcagatgcttttcaggtatcaag

SEQ ID NO: 126940 - DNA, 36 bp, Artificial Sequence
  Description of Artificial Sequence: Synthetic oligonucleotide
atcggatgctgaagcagatgcttttcaggtatcaag

SEQ ID NO: 126941 - DNA, 35 bp, Artificial Sequence
  Description of Artificial Sequence: Synthetic oligonucleotide
tcggatgctgaagcagatgcttttcaggtatcaag

SEQ ID NO: 126942 - DNA, 34 bp, Artificial Sequence
  Description of Artificial Sequence: Synthetic oligonucleotide
cggatgctgaagcagatgcttttcaggtatcaag

SEQ ID NO: 126943 - DNA, 34 bp, Artificial Sequence
  Description of Artificial Sequence: Synthetic oligonucleotide
ggatgctgaagcagatgcttttcaggtatcaagg

SEQ ID NO: 126944 - DNA, 37 bp, Artificial Sequence
  Description of Artificial Sequence: Synthetic oligonucleotide
gatgctgaagcagatgcttttcaggtatcaaggttac

SEQ ID NO: 126945 - DNA, 40 bp, Artificial Sequence
  Description of Artificial Sequence: Synthetic oligonucleotide
atgctgaagcagatgcttttcaggtatcaaggttacattg

SEQ ID NO: 126946 - DNA, 39 bp, Artificial Sequence
  Description of Artificial Sequence: Synthetic oligonucleotide
tgctgaagcagatgcttttcaggtatcaaggttacattg

SEQ ID NO: 126947 - DNA, 38 bp, Artificial Sequence
  Description of Artificial Sequence: Synthetic oligonucleotide
gctgaagcagatgcttttcaggtatcaaggttacattg

SEQ ID NO: 126948 - DNA, 38 bp, Artificial Sequence
  Description of Artificial Sequence: Synthetic oligonucleotide
ctgaagcagatgcttttcaggtatcaaggttacattgg

SEQ ID NO: 126949 - DNA, 39 bp, Artificial Sequence
  Description of Artificial Sequence: Synthetic oligonucleotide
tgaagcagatgcttttcaggtatcaaggttacattggtg

SEQ ID NO: 126950 - DNA, 38 bp, Artificial Sequence
  Description of Artificial Sequence: Synthetic oligonucleotide
gaagcagatgcttttcaggtatcaaggttacattggtg

SEQ ID NO: 126951 - DNA, 38 bp, Artificial Sequence
  Description of Artificial Sequence: Synthetic oligonucleotide
aagcagatgcttttcaggtatcaaggttacattggtgc

SEQ ID NO: 126952 - DNA, 37 bp, Artificial Sequence
  Description of Artificial Sequence: Synthetic oligonucleotide
agcagatgcttttcaggtatcaaggttacattggtgc

SEQ ID NO: 126953 - DNA, 36 bp, Artificial Sequence
  Description of Artificial Sequence: Synthetic oligonucleotide
gcagatgcttttcaggtatcaaggttacattggtgc

SEQ ID NO: 126954 - DNA, 37 bp, Artificial Sequence
  Description of Artificial Sequence: Synthetic oligonucleotide
cagatgcttttcaggtatcaaggttacattggtgcag

SEQ ID NO: 126955 - DNA, 37 bp, Artificial Sequence
  Description of Artificial Sequence: Synthetic oligonucleotide
agatgcttttcaggtatcaaggttacattggtgcagc

SEQ ID NO: 126956 - DNA, 36 bp, Artificial Sequence
  Description of Artificial Sequence: Synthetic oligonucleotide
gatgcttttcaggtatcaaggttacattggtgcagc

SEQ ID NO: 126957 - DNA, 36 bp, Artificial Sequence
  Description of Artificial Sequence: Synthetic oligonucleotide
atgcttttcaggtatcaaggttacattggtgcagcc

SEQ ID NO: 126958 - DNA, 35 bp, Artificial Sequence
  Description of Artificial Sequence: Synthetic oligonucleotide
tgcttttcaggtatcaaggttacattggtgcagcc

SEQ ID NO: 126959 - DNA, 34 bp, Artificial Sequence
  Description of Artificial Sequence: Synthetic oligonucleotide
gcttttcaggtatcaaggttacattggtgcagcc

SEQ ID NO: 126960 - DNA, 34 bp, Artificial Sequence
  Description of Artificial Sequence: Synthetic oligonucleotide
cttttcaggtatcaaggttacattggtgcagccc

SEQ ID NO: 126961 - DNA, 36 bp, Artificial Sequence
  Description of Artificial Sequence: Synthetic oligonucleotide
ttttcaggtatcaaggttacattggtgcagccctag

SEQ ID NO: 126962 - DNA, 35 bp, Artificial Sequence
  Description of Artificial Sequence: Synthetic oligonucleotide
tttcaggtatcaaggttacattggtgcagccctag

SEQ ID NO: 126963 - DNA, 34 bp, Artificial Sequence
  Description of Artificial Sequence: Synthetic oligonucleotide
ttcaggtatcaaggttacattggtgcagccctag

SEQ ID NO: 126964 - DNA, 33 bp, Artificial Sequence
  Description of Artificial Sequence: Synthetic oligonucleotide
tcaggtatcaaggttacattggtgcagccctag

SEQ ID NO: 126965 - DNA, 32 bp, Artificial Sequence
  Description of Artificial Sequence: Synthetic oligonucleotide
caggtatcaaggttacattggtgcagccctag

SEQ ID NO: 126966 - DNA, 37 bp, Artificial Sequence
  Description of Artificial Sequence: Synthetic oligonucleotide
aggtatcaaggttacattggtgcagccctagttttag

SEQ ID NO: 126967 - DNA, 36 bp, Artificial Sequence
  Description of Artificial Sequence: Synthetic oligonucleotide
ggtatcaaggttacattggtgcagccctagttttag

SEQ ID NO: 126968 - DNA, 36 bp, Artificial Sequence
  Description of Artificial Sequence: Synthetic oligonucleotide
gtatcaaggttacattggtgcagccctagttttagg

SEQ ID NO: 126969 - DNA, 36 bp, Artificial Sequence
  Description of Artificial Sequence: Synthetic oligonucleotide
tatcaaggttacattggtgcagccctagttttaggg

SEQ ID NO: 126970 - DNA, 35 bp, Artificial Sequence
  Description of Artificial Sequence: Synthetic oligonucleotide
atcaaggttacattggtgcagccctagttttaggg

SEQ ID NO: 126971 - DNA, 34 bp, Artificial Sequence
  Description of Artificial Sequence: Synthetic oligonucleotide
tcaaggttacattggtgcagccctagttttaggg

SEQ ID NO: 126972 - DNA, 33 bp, Artificial Sequence
  Description of Artificial Sequence: Synthetic oligonucleotide
caaggttacattggtgcagccctagttttaggg

SEQ ID NO: 126973 - DNA, 33 bp, Artificial Sequence
  Description of Artificial Sequence: Synthetic oligonucleotide
aaggttacattggtgcagccctagttttagggg

SEQ ID NO: 126974 - DNA, 32 bp, Artificial Sequence
  Description of Artificial Sequence: Synthetic oligonucleotide
aggttacattggtgcagccctagttttagggg

SEQ ID NO: 126975 - DNA, 31 bp, Artificial Sequence
  Description of Artificial Sequence: Synthetic oligonucleotide
ggttacattggtgcagccctagttttagggg

SEQ ID NO: 126976 - DNA, 31 bp, Artificial Sequence
  Description of Artificial Sequence: Synthetic oligonucleotide
gttacattggtgcagccctagttttaggggg

SEQ ID NO: 126977 - DNA, 32 bp, Artificial Sequence
  Description of Artificial Sequence: Synthetic oligonucleotide
ttacattggtgcagccctagttttagggggag

SEQ ID NO: 126978 - DNA, 31 bp, Artificial Sequence
  Description of Artificial Sequence: Synthetic oligonucleotide
tacattggtgcagccctagttttagggggag

SEQ ID NO: 126979 - DNA, 30 bp, Artificial Sequence
  Description of Artificial Sequence: Synthetic oligonucleotide
acattggtgcagccctagttttagggggag

SEQ ID NO: 126980 - DNA, 29 bp, Artificial Sequence
  Description of Artificial Sequence: Synthetic oligonucleotide
cattggtgcagccctagttttagggggag

SEQ ID NO: 126981 - DNA, 31 bp, Artificial Sequence
  Description of Artificial Sequence: Synthetic oligonucleotide
attggtgcagccctagttttagggggagtag

SEQ ID NO: 126982 - DNA, 30 bp, Artificial Sequence
  Description of Artificial Sequence: Synthetic oligonucleotide
ttggtgcagccctagttttagggggagtag

SEQ ID NO: 126983 - DNA, 29 bp, Artificial Sequence
  Description of Artificial Sequence: Synthetic oligonucleotide
tggtgcagccctagttttagggggagtag

SEQ ID NO: 126984 - DNA, 28 bp, Artificial Sequence
  Description of Artificial Sequence: Synthetic oligonucleotide
ggtgcagccctagttttagggggagtag

SEQ ID NO: 126985 - DNA, 30 bp, Artificial Sequence
  Description of Artificial Sequence: Synthetic oligonucleotide
gtgcagccctagttttagggggagtagatg

SEQ ID NO: 126986 - DNA, 33 bp, Artificial Sequence
  Description of Artificial Sequence: Synthetic oligonucleotide
tgcagccctagttttagggggagtagatgttac

SEQ ID NO: 126987 - DNA, 32 bp, Artificial Sequence
  Description of Artificial Sequence: Synthetic oligonucleotide
gcagccctagttttagggggagtagatgttac

SEQ ID NO: 126988 - DNA, 33 bp, Artificial Sequence
  Description of Artificial Sequence: Synthetic oligonucleotide
cagccctagttttagggggagtagatgttactg

SEQ ID NO: 126989 - DNA, 33 bp, Artificial Sequence
  Description of Artificial Sequence: Synthetic oligonucleotide
agccctagttttagggggagtagatgttactgg

SEQ ID NO: 126990 - DNA, 32 bp, Artificial Sequence
  Description of Artificial Sequence: Synthetic oligonucleotide
gccctagttttagggggagtagatgttactgg

SEQ ID NO: 126991 - DNA, 33 bp, Artificial Sequence
  Description of Artificial Sequence: Synthetic oligonucleotide
ccctagttttagggggagtagatgttactggac

SEQ ID NO: 126992 - DNA, 33 bp, Artificial Sequence
  Description of Artificial Sequence: Synthetic oligonucleotide
cctagttttagggggagtagatgttactggacc

SEQ ID NO: 126993 - DNA, 34 bp, Artificial Sequence
  Description of Artificial Sequence: Synthetic oligonucleotide
ctagttttagggggagtagatgttactggacctc

SEQ ID NO: 126994 - DNA, 35 bp, Artificial Sequence
  Description of Artificial Sequence: Synthetic oligonucleotide
tagttttagggggagtagatgttactggacctcac

SEQ ID NO: 126995 - DNA, 34 bp, Artificial Sequence
  Description of Artificial Sequence: Synthetic oligonucleotide
agttttagggggagtagatgttactggacctcac

SEQ ID NO: 126996 - DNA, 33 bp, Artificial Sequence
  Description of Artificial Sequence: Synthetic oligonucleotide
gttttagggggagtagatgttactggacctcac

SEQ ID NO: 126997 - DNA, 33 bp, Artificial Sequence
  Description of Artificial Sequence: Synthetic oligonucleotide
ttttagggggagtagatgttactggacctcacc

SEQ ID NO: 126998 - DNA, 32 bp, Artificial Sequence
  Description of Artificial Sequence: Synthetic oligonucleotide
tttagggggagtagatgttactggacctcacc

SEQ ID NO: 126999 - DNA, 31 bp, Artificial Sequence
  Description of Artificial Sequence: Synthetic oligonucleotide
ttagggggagtagatgttactggacctcacc

SEQ ID NO: 127000 - DNA, 30 bp, Artificial Sequence
  Description of Artificial Sequence: Synthetic oligonucleotide
tagggggagtagatgttactggacctcacc

SEQ ID NO: 127001 - DNA, 29 bp, Artificial Sequence
  Description of Artificial Sequence: Synthetic oligonucleotide
agggggagtagatgttactggacctcacc

SEQ ID NO: 127002 - DNA, 28 bp, Artificial Sequence
  Description of Artificial Sequence: Synthetic oligonucleotide
gggggagtagatgttactggacctcacc

SEQ ID NO: 127003 - DNA, 29 bp, Artificial Sequence
  Description of Artificial Sequence: Synthetic oligonucleotide
ggggagtagatgttactggacctcacctc

SEQ ID NO: 127004 - DNA, 31 bp, Artificial Sequence
  Description of Artificial Sequence: Synthetic oligonucleotide
gggagtagatgttactggacctcacctctac

SEQ ID NO: 127005 - DNA, 32 bp, Artificial Sequence
  Description of Artificial Sequence: Synthetic oligonucleotide
ggagtagatgttactggacctcacctctacag

SEQ ID NO: 127006 - DNA, 32 bp, Artificial Sequence
  Description of Artificial Sequence: Synthetic oligonucleotide
gagtagatgttactggacctcacctctacagc

SEQ ID NO: 127007 - DNA, 34 bp, Artificial Sequence
  Description of Artificial Sequence: Synthetic oligonucleotide
agtagatgttactggacctcacctctacagcatc

SEQ ID NO: 127008 - DNA, 33 bp, Artificial Sequence
  Description of Artificial Sequence: Synthetic oligonucleotide
gtagatgttactggacctcacctctacagcatc

SEQ ID NO: 127009 - DNA, 36 bp, Artificial Sequence
  Description of Artificial Sequence: Synthetic oligonucleotide
tagatgttactggacctcacctctacagcatctatc

SEQ ID NO: 127010 - DNA, 35 bp, Artificial Sequence
  Description of Artificial Sequence: Synthetic oligonucleotide
agatgttactggacctcacctctacagcatctatc

SEQ ID NO: 127011 - DNA, 34 bp, Artificial Sequence
  Description of Artificial Sequence: Synthetic oligonucleotide
gatgttactggacctcacctctacagcatctatc

SEQ ID NO: 127012 - DNA, 34 bp, Artificial Sequence
  Description of Artificial Sequence: Synthetic oligonucleotide
atgttactggacctcacctctacagcatctatcc

SEQ ID NO: 127013 - DNA, 33 bp, Artificial Sequence
  Description of Artificial Sequence: Synthetic oligonucleotide
tgttactggacctcacctctacagcatctatcc

SEQ ID NO: 127014 - DNA, 32 bp, Artificial Sequence
  Description of Artificial Sequence: Synthetic oligonucleotide
gttactggacctcacctctacagcatctatcc

SEQ ID NO: 127015 - DNA, 33 bp, Artificial Sequence
  Description of Artificial Sequence: Synthetic oligonucleotide
ttactggacctcacctctacagcatctatcctc

SEQ ID NO: 127016 - DNA, 32 bp, Artificial Sequence
  Description of Artificial Sequence: Synthetic oligonucleotide
tactggacctcacctctacagcatctatcctc

SEQ ID NO: 127017 - DNA, 31 bp, Artificial Sequence
  Description of Artificial Sequence: Synthetic oligonucleotide
actggacctcacctctacagcatctatcctc

SEQ ID NO: 127018 - DNA, 30 bp, Artificial Sequence
  Description of Artificial Sequence: Synthetic oligonucleotide
ctggacctcacctctacagcatctatcctc

SEQ ID NO: 127019 - DNA, 32 bp, Artificial Sequence
  Description of Artificial Sequence: Synthetic oligonucleotide
tggacctcacctctacagcatctatcctcatg

SEQ ID NO: 127020 - DNA, 31 bp, Artificial Sequence
  Description of Artificial Sequence: Synthetic oligonucleotide
ggacctcacctctacagcatctatcctcatg

SEQ ID NO: 127021 - DNA, 31 bp, Artificial Sequence
  Description of Artificial Sequence: Synthetic oligonucleotide
gacctcacctctacagcatctatcctcatgg

SEQ ID NO: 127022 - DNA, 33 bp, Artificial Sequence
  Description of Artificial Sequence: Synthetic oligonucleotide
acctcacctctacagcatctatcctcatggatc

SEQ ID NO: 127023 - DNA, 32 bp, Artificial Sequence
  Description of Artificial Sequence: Synthetic oligonucleotide
cctcacctctacagcatctatcctcatggatc

SEQ ID NO: 127024 - DNA, 34 bp, Artificial Sequence
  Description of Artificial Sequence: Synthetic oligonucleotide
ctcacctctacagcatctatcctcatggatcaac

SEQ ID NO: 127025 - DNA, 35 bp, Artificial Sequence
  Description of Artificial Sequence: Synthetic oligonucleotide
tcacctctacagcatctatcctcatggatcaactg

SEQ ID NO: 127026 - DNA, 34 bp, Artificial Sequence
  Description of Artificial Sequence: Synthetic oligonucleotide
cacctctacagcatctatcctcatggatcaactg

SEQ ID NO: 127027 - DNA, 38 bp, Artificial Sequence
  Description of Artificial Sequence: Synthetic oligonucleotide
acctctacagcatctatcctcatggatcaactgataag

SEQ ID NO: 127028 - DNA, 37 bp, Artificial Sequence
  Description of Artificial Sequence: Synthetic oligonucleotide
cctctacagcatctatcctcatggatcaactgataag

SEQ ID NO: 127029 - DNA, 39 bp, Artificial Sequence
  Description of Artificial Sequence: Synthetic oligonucleotide
ctctacagcatctatcctcatggatcaactgataagttg

SEQ ID NO: 127030 - DNA, 39 bp, Artificial Sequence
  Description of Artificial Sequence: Synthetic oligonucleotide
tctacagcatctatcctcatggatcaactgataagttgc

SEQ ID NO: 127031 - DNA, 38 bp, Artificial Sequence
  Description of Artificial Sequence: Synthetic oligonucleotide
ctacagcatctatcctcatggatcaactgataagttgc

SEQ ID NO: 127032 - DNA, 38 bp, Artificial Sequence
  Description of Artificial Sequence: Synthetic oligonucleotide
tacagcatctatcctcatggatcaactgataagttgcc

SEQ ID NO: 127033 - DNA, 37 bp, Artificial Sequence
  Description of Artificial Sequence: Synthetic oligonucleotide
acagcatctatcctcatggatcaactgataagttgcc

SEQ ID NO: 127034 - DNA, 36 bp, Artificial Sequence
  Description of Artificial Sequence: Synthetic oligonucleotide
cagcatctatcctcatggatcaactgataagttgcc

SEQ ID NO: 127035 - DNA, 40 bp, Artificial Sequence
  Description of Artificial Sequence: Synthetic oligonucleotide
agcatctatcctcatggatcaactgataagttgccttatg

SEQ ID NO: 127036 - DNA, 39 bp, Artificial Sequence
  Description of Artificial Sequence: Synthetic oligonucleotide
gcatctatcctcatggatcaactgataagttgccttatg

SEQ ID NO: 127037 - DNA, 40 bp, Artificial Sequence
  Description of Artificial Sequence: Synthetic oligonucleotide
catctatcctcatggatcaactgataagttgccttatgtc

SEQ ID NO: 127038 - DNA, 41 bp, Artificial Sequence
  Description of Artificial Sequence: Synthetic oligonucleotide
atctatcctcatggatcaactgataagttgccttatgtcac

SEQ ID NO: 127039 - DNA, 40 bp, Artificial Sequence
  Description of Artificial Sequence: Synthetic oligonucleotide
tctatcctcatggatcaactgataagttgccttatgtcac

SEQ ID NO: 127040 - DNA, 39 bp, Artificial Sequence
  Description of Artificial Sequence: Synthetic oligonucleotide
ctatcctcatggatcaactgataagttgccttatgtcac

SEQ ID NO: 127041 - DNA, 39 bp, Artificial Sequence
  Description of Artificial Sequence: Synthetic oligonucleotide
tatcctcatggatcaactgataagttgccttatgtcacc

SEQ ID NO: 127042 - DNA, 38 bp, Artificial Sequence
  Description of Artificial Sequence: Synthetic oligonucleotide
atcctcatggatcaactgataagttgccttatgtcacc

SEQ ID NO: 127043 - DNA, 37 bp, Artificial Sequence
  Description of Artificial Sequence: Synthetic oligonucleotide
tcctcatggatcaactgataagttgccttatgtcacc

SEQ ID NO: 127044 - DNA, 36 bp, Artificial Sequence
  Description of Artificial Sequence: Synthetic oligonucleotide
cctcatggatcaactgataagttgccttatgtcacc

SEQ ID NO: 127045 - DNA, 38 bp, Artificial Sequence
  Description of Artificial Sequence: Synthetic oligonucleotide
ctcatggatcaactgataagttgccttatgtcaccatg

SEQ ID NO: 127046 - DNA, 38 bp, Artificial Sequence
  Description of Artificial Sequence: Synthetic oligonucleotide
tcatggatcaactgataagttgccttatgtcaccatgg

SEQ ID NO: 127047 - DNA, 37 bp, Artificial Sequence
  Description of Artificial Sequence: Synthetic oligonucleotide
catggatcaactgataagttgccttatgtcaccatgg

SEQ ID NO: 127048 - DNA, 37 bp, Artificial Sequence
  Description of Artificial Sequence: Synthetic oligonucleotide
atggatcaactgataagttgccttatgtcaccatggg

SEQ ID NO: 127049 - DNA, 36 bp, Artificial Sequence
  Description of Artificial Sequence: Synthetic oligonucleotide
tggatcaactgataagttgccttatgtcaccatggg

SEQ ID NO: 127050 - DNA, 35 bp, Artificial Sequence
  Description of Artificial Sequence: Synthetic oligonucleotide
ggatcaactgataagttgccttatgtcaccatggg

SEQ ID NO: 127051 - DNA, 37 bp, Artificial Sequence
  Description of Artificial Sequence: Synthetic oligonucleotide
gatcaactgataagttgccttatgtcaccatgggttc

SEQ ID NO: 127052 - DNA, 38 bp, Artificial Sequence
  Description of Artificial Sequence: Synthetic oligonucleotide
atcaactgataagttgccttatgtcaccatgggttctg

SEQ ID NO: 127053 - DNA, 37 bp, Artificial Sequence
  Description of Artificial Sequence: Synthetic oligonucleotide
tcaactgataagttgccttatgtcaccatgggttctg

SEQ ID NO: 127054 - DNA, 36 bp, Artificial Sequence
  Description of Artificial Sequence: Synthetic oligonucleotide
caactgataagttgccttatgtcaccatgggttctg

SEQ ID NO: 127055 - DNA, 36 bp, Artificial Sequence
  Description of Artificial Sequence: Synthetic oligonucleotide
aactgataagttgccttatgtcaccatgggttctgg

SEQ ID NO: 127056 - DNA, 35 bp, Artificial Sequence
  Description of Artificial Sequence: Synthetic oligonucleotide
actgataagttgccttatgtcaccatgggttctgg

SEQ ID NO: 127057 - DNA, 34 bp, Artificial Sequence
  Description of Artificial Sequence: Synthetic oligonucleotide
ctgataagttgccttatgtcaccatgggttctgg

SEQ ID NO: 127058 - DNA, 34 bp, Artificial Sequence
  Description of Artificial Sequence: Synthetic oligonucleotide
tgataagttgccttatgtcaccatgggttctggc

SEQ ID NO: 127059 - DNA, 33 bp, Artificial Sequence
  Description of Artificial Sequence: Synthetic oligonucleotide
gataagttgccttatgtcaccatgggttctggc

SEQ ID NO: 127060 - DNA, 34 bp, Artificial Sequence
  Description of Artificial Sequence: Synthetic oligonucleotide
ataagttgccttatgtcaccatgggttctggctc

SEQ ID NO: 127061 - DNA, 33 bp, Artificial Sequence
  Description of Artificial Sequence: Synthetic oligonucleotide
taagttgccttatgtcaccatgggttctggctc

SEQ ID NO: 127062 - DNA, 32 bp, Artificial Sequence
  Description of Artificial Sequence: Synthetic oligonucleotide
aagttgccttatgtcaccatgggttctggctc

SEQ ID NO: 127063 - DNA, 31 bp, Artificial Sequence
  Description of Artificial Sequence: Synthetic oligonucleotide
agttgccttatgtcaccatgggttctggctc

SEQ ID NO: 127064 - DNA, 30 bp, Artificial Sequence
  Description of Artificial Sequence: Synthetic oligonucleotide
gttgccttatgtcaccatgggttctggctc

SEQ ID NO: 127065 - DNA, 30 bp, Artificial Sequence
  Description of Artificial Sequence: Synthetic oligonucleotide
ttgccttatgtcaccatgggttctggctcc

SEQ ID NO: 127066 - DNA, 29 bp, Artificial Sequence
  Description of Artificial Sequence: Synthetic oligonucleotide
tgccttatgtcaccatgggttctggctcc

SEQ ID NO: 127067 - DNA, 28 bp, Artificial Sequence
  Description of Artificial Sequence: Synthetic oligonucleotide
gccttatgtcaccatgggttctggctcc

SEQ ID NO: 127068 - DNA, 30 bp, Artificial Sequence
  Description of Artificial Sequence: Synthetic oligonucleotide
ccttatgtcaccatgggttctggctccttg

SEQ ID NO: 127069 - DNA, 30 bp, Artificial Sequence
  Description of Artificial Sequence: Synthetic oligonucleotide
cttatgtcaccatgggttctggctccttgg

SEQ ID NO: 127070 - DNA, 30 bp, Artificial Sequence
  Description of Artificial Sequence: Synthetic oligonucleotide
ttatgtcaccatgggttctggctccttggc

SEQ ID NO: 127071 - DNA, 29 bp, Artificial Sequence
  Description of Artificial Sequence: Synthetic oligonucleotide
tatgtcaccatgggttctggctccttggc

SEQ ID NO: 127072 - DNA, 28 bp, Artificial Sequence
  Description of Artificial Sequence: Synthetic oligonucleotide
atgtcaccatgggttctggctccttggc

SEQ ID NO: 127073 - DNA, 27 bp, Artificial Sequence
  Description of Artificial Sequence: Synthetic oligonucleotide
tgtcaccatgggttctggctccttggc

SEQ ID NO: 127074 - DNA, 27 bp, Artificial Sequence
  Description of Artificial Sequence: Synthetic oligonucleotide
gtcaccatgggttctggctccttggca

SEQ ID NO: 127075 - DNA, 27 bp, Artificial Sequence
  Description of Artificial Sequence: Synthetic oligonucleotide
tcaccatgggttctggctccttggcag

SEQ ID NO: 127076 - DNA, 26 bp, Artificial Sequence
  Description of Artificial Sequence: Synthetic oligonucleotide
caccatgggttctggctccttggcag

SEQ ID NO: 127077 - DNA, 27 bp, Artificial Sequence
  Description of Artificial Sequence: Synthetic oligonucleotide
accatgggttctggctccttggcagca

SEQ ID NO: 127078 - DNA, 27 bp, Artificial Sequence
  Description of Artificial Sequence: Synthetic oligonucleotide
ccatgggttctggctccttggcagcaa

SEQ ID NO: 127079 - DNA, 28 bp, Artificial Sequence
  Description of Artificial Sequence: Synthetic oligonucleotide
catgggttctggctccttggcagcaatg

SEQ ID NO: 127080 - DNA, 28 bp, Artificial Sequence
  Description of Artificial Sequence: Synthetic oligonucleotide
atgggttctggctccttggcagcaatgg

SEQ ID NO: 127081 - DNA, 27 bp, Artificial Sequence
  Description of Artificial Sequence: Synthetic oligonucleotide
tgggttctggctccttggcagcaatgg

SEQ ID NO: 127082 - DNA, 26 bp, Artificial Sequence
  Description of Artificial Sequence: Synthetic oligonucleotide
gggttctggctccttggcagcaatgg

SEQ ID NO: 127083 - DNA, 27 bp, Artificial Sequence
  Description of Artificial Sequence: Synthetic oligonucleotide
ggttctggctccttggcagcaatggct

SEQ ID NO: 127084 - DNA, 27 bp, Artificial Sequence
  Description of Artificial Sequence: Synthetic oligonucleotide
gttctggctccttggcagcaatggctg

SEQ ID NO: 127085 - DNA, 32 bp, Artificial Sequence
  Description of Artificial Sequence: Synthetic oligonucleotide
ttctggctccttggcagcaatggctgtatttg

SEQ ID NO: 127086 - DNA, 31 bp, Artificial Sequence
  Description of Artificial Sequence: Synthetic oligonucleotide
tctggctccttggcagcaatggctgtatttg

SEQ ID NO: 127087 - DNA, 30 bp, Artificial Sequence
  Description of Artificial Sequence: Synthetic oligonucleotide
ctggctccttggcagcaatggctgtatttg

SEQ ID NO: 127088 - DNA, 32 bp, Artificial Sequence
  Description of Artificial Sequence: Synthetic oligonucleotide
tggctccttggcagcaatggctgtatttgaag

SEQ ID NO: 127089 - DNA, 31 bp, Artificial Sequence
  Description of Artificial Sequence: Synthetic oligonucleotide
ggctccttggcagcaatggctgtatttgaag

SEQ ID NO: 127090 - DNA, 35 bp, Artificial Sequence
  Description of Artificial Sequence: Synthetic oligonucleotide
gctccttggcagcaatggctgtatttgaagataag

SEQ ID NO: 127091 - DNA, 39 bp, Artificial Sequence
  Description of Artificial Sequence: Synthetic oligonucleotide
ctccttggcagcaatggctgtatttgaagataagtttag

SEQ ID NO: 127092 - DNA, 39 bp, Artificial Sequence
  Description of Artificial Sequence: Synthetic oligonucleotide
tccttggcagcaatggctgtatttgaagataagtttagg

SEQ ID NO: 127093 - DNA, 38 bp, Artificial Sequence
  Description of Artificial Sequence: Synthetic oligonucleotide
ccttggcagcaatggctgtatttgaagataagtttagg

SEQ ID NO: 127094 - DNA, 38 bp, Artificial Sequence
  Description of Artificial Sequence: Synthetic oligonucleotide
cttggcagcaatggctgtatttgaagataagtttaggc

SEQ ID NO: 127095 - DNA, 38 bp, Artificial Sequence
  Description of Artificial Sequence: Synthetic oligonucleotide
ttggcagcaatggctgtatttgaagataagtttaggcc

SEQ ID NO: 127096 - DNA, 37 bp, Artificial Sequence
  Description of Artificial Sequence: Synthetic oligonucleotide
tggcagcaatggctgtatttgaagataagtttaggcc

SEQ ID NO: 127097 - DNA, 36 bp, Artificial Sequence
  Description of Artificial Sequence: Synthetic oligonucleotide
ggcagcaatggctgtatttgaagataagtttaggcc

SEQ ID NO: 127098 - DNA, 37 bp, Artificial Sequence
  Description of Artificial Sequence: Synthetic oligonucleotide
gcagcaatggctgtatttgaagataagtttaggccag

SEQ ID NO: 127099 - DNA, 38 bp, Artificial Sequence
  Description of Artificial Sequence: Synthetic oligonucleotide
cagcaatggctgtatttgaagataagtttaggccagac

SEQ ID NO: 127100 - DNA, 40 bp, Artificial Sequence
  Description of Artificial Sequence: Synthetic oligonucleotide
agcaatggctgtatttgaagataagtttaggccagacatg

SEQ ID NO: 127101 - DNA, 39 bp, Artificial Sequence
  Description of Artificial Sequence: Synthetic oligonucleotide
gcaatggctgtatttgaagataagtttaggccagacatg

SEQ ID NO: 127102 - DNA, 39 bp, Artificial Sequence
  Description of Artificial Sequence: Synthetic oligonucleotide
caatggctgtatttgaagataagtttaggccagacatgg

SEQ ID NO: 127103 - DNA, 40 bp, Artificial Sequence
  Description of Artificial Sequence: Synthetic oligonucleotide
aatggctgtatttgaagataagtttaggccagacatggag

SEQ ID NO: 127104 - DNA, 39 bp, Artificial Sequence
  Description of Artificial Sequence: Synthetic oligonucleotide
atggctgtatttgaagataagtttaggccagacatggag

SEQ ID NO: 127105 - DNA, 38 bp, Artificial Sequence
  Description of Artificial Sequence: Synthetic oligonucleotide
tggctgtatttgaagataagtttaggccagacatggag

SEQ ID NO: 127106 - DNA, 37 bp, Artificial Sequence
  Description of Artificial Sequence: Synthetic oligonucleotide
ggctgtatttgaagataagtttaggccagacatggag

SEQ ID NO: 127107 - DNA, 37 bp, Artificial Sequence
  Description of Artificial Sequence: Synthetic oligonucleotide
gctgtatttgaagataagtttaggccagacatggagg

SEQ ID NO: 127108 - DNA, 38 bp, Artificial Sequence
  Description of Artificial Sequence: Synthetic oligonucleotide
ctgtatttgaagataagtttaggccagacatggaggag

SEQ ID NO: 127109 - DNA, 38 bp, Artificial Sequence
  Description of Artificial Sequence: Synthetic oligonucleotide
tgtatttgaagataagtttaggccagacatggaggagg

SEQ ID NO: 127110 - DNA, 37 bp, Artificial Sequence
  Description of Artificial Sequence: Synthetic oligonucleotide
gtatttgaagataagtttaggccagacatggaggagg

SEQ ID NO: 127111 - DNA, 38 bp, Artificial Sequence
  Description of Artificial Sequence: Synthetic oligonucleotide
tatttgaagataagtttaggccagacatggaggaggag

SEQ ID NO: 127112 - DNA, 37 bp, Artificial Sequence
  Description of Artificial Sequence: Synthetic oligonucleotide
atttgaagataagtttaggccagacatggaggaggag

SEQ ID NO: 127113 - DNA, 36 bp, Artificial Sequence
  Description of Artificial Sequence: Synthetic oligonucleotide
tttgaagataagtttaggccagacatggaggaggag

SEQ ID NO: 127114 - DNA, 35 bp, Artificial Sequence
  Description of Artificial Sequence: Synthetic oligonucleotide
ttgaagataagtttaggccagacatggaggaggag

SEQ ID NO: 127115 - DNA, 34 bp, Artificial Sequence
  Description of Artificial Sequence: Synthetic oligonucleotide
tgaagataagtttaggccagacatggaggaggag

SEQ ID NO: 127116 - DNA, 33 bp, Artificial Sequence
  Description of Artificial Sequence: Synthetic oligonucleotide
gaagataagtttaggccagacatggaggaggag

SEQ ID NO: 127117 - DNA, 33 bp, Artificial Sequence
  Description of Artificial Sequence: Synthetic oligonucleotide
aagataagtttaggccagacatggaggaggagg

SEQ ID NO: 127118 - DNA, 32 bp, Artificial Sequence
  Description of Artificial Sequence: Synthetic oligonucleotide
agataagtttaggccagacatggaggaggagg

SEQ ID NO: 127119 - DNA, 31 bp, Artificial Sequence
  Description of Artificial Sequence: Synthetic oligonucleotide
gataagtttaggccagacatggaggaggagg

SEQ ID NO: 127120 - DNA, 33 bp, Artificial Sequence
  Description of Artificial Sequence: Synthetic oligonucleotide
ataagtttaggccagacatggaggaggaggaag

SEQ ID NO: 127121 - DNA, 32 bp, Artificial Sequence
  Description of Artificial Sequence: Synthetic oligonucleotide
taagtttaggccagacatggaggaggaggaag

SEQ ID NO: 127122 - DNA, 31 bp, Artificial Sequence
  Description of Artificial Sequence: Synthetic oligonucleotide
aagtttaggccagacatggaggaggaggaag

SEQ ID NO: 127123 - DNA, 30 bp, Artificial Sequence
  Description of Artificial Sequence: Synthetic oligonucleotide
agtttaggccagacatggaggaggaggaag

SEQ ID NO: 127124 - DNA, 29 bp, Artificial Sequence
  Description of Artificial Sequence: Synthetic oligonucleotide
gtttaggccagacatggaggaggaggaag

SEQ ID NO: 127125 - DNA, 29 bp, Artificial Sequence
  Description of Artificial Sequence: Synthetic oligonucleotide
tttaggccagacatggaggaggaggaagc

SEQ ID NO: 127126 - DNA, 28 bp, Artificial Sequence
  Description of Artificial Sequence: Synthetic oligonucleotide
ttaggccagacatggaggaggaggaagc

SEQ ID NO: 127127 - DNA, 27 bp, Artificial Sequence
  Description of Artificial Sequence: Synthetic oligonucleotide
taggccagacatggaggaggaggaagc

SEQ ID NO: 127128 - DNA, 26 bp, Artificial Sequence
  Description of Artificial Sequence: Synthetic oligonucleotide
aggccagacatggaggaggaggaagc

SEQ ID NO: 127129 - DNA, 25 bp, Artificial Sequence
  Description of Artificial Sequence: Synthetic oligonucleotide
ggccagacatggaggaggaggaagc

SEQ ID NO: 127130 - DNA, 27 bp, Artificial Sequence
  Description of Artificial Sequence: Synthetic oligonucleotide
gccagacatggaggaggaggaagccaa

SEQ ID NO: 127131 - DNA, 27 bp, Artificial Sequence
  Description of Artificial Sequence: Synthetic oligonucleotide
ccagacatggaggaggaggaagccaag

SEQ ID NO: 127132 - DNA, 30 bp, Artificial Sequence
  Description of Artificial Sequence: Synthetic oligonucleotide
cagacatggaggaggaggaagccaagaatc

SEQ ID NO: 127133 - DNA, 31 bp, Artificial Sequence
  Description of Artificial Sequence: Synthetic oligonucleotide
agacatggaggaggaggaagccaagaatctg

SEQ ID NO: 127134 - DNA, 30 bp, Artificial Sequence
  Description of Artificial Sequence: Synthetic oligonucleotide
gacatggaggaggaggaagccaagaatctg

SEQ ID NO: 127135 - DNA, 30 bp, Artificial Sequence
  Description of Artificial Sequence: Synthetic oligonucleotide
acatggaggaggaggaagccaagaatctgg

SEQ ID NO: 127136 - DNA, 29 bp, Artificial Sequence
  Description of Artificial Sequence: Synthetic oligonucleotide
catggaggaggaggaagccaagaatctgg

SEQ ID NO: 127137 - DNA, 30 bp, Artificial Sequence
  Description of Artificial Sequence: Synthetic oligonucleotide
atggaggaggaggaagccaagaatctggtg

SEQ ID NO: 127138 - DNA, 29 bp, Artificial Sequence
  Description of Artificial Sequence: Synthetic oligonucleotide
tggaggaggaggaagccaagaatctggtg

SEQ ID NO: 127139 - DNA, 28 bp, Artificial Sequence
  Description of Artificial Sequence: Synthetic oligonucleotide
ggaggaggaggaagccaagaatctggtg

SEQ ID NO: 127140 - DNA, 29 bp, Artificial Sequence
  Description of Artificial Sequence: Synthetic oligonucleotide
gaggaggaggaagccaagaatctggtgag

SEQ ID NO: 127141 - DNA, 29 bp, Artificial Sequence
  Description of Artificial Sequence: Synthetic oligonucleotide
aggaggaggaagccaagaatctggtgagc

SEQ ID NO: 127142 - DNA, 28 bp, Artificial Sequence
  Description of Artificial Sequence: Synthetic oligonucleotide
ggaggaggaagccaagaatctggtgagc

SEQ ID NO: 127143 - DNA, 28 bp, Artificial Sequence
  Description of Artificial Sequence: Synthetic oligonucleotide
gaggaggaagccaagaatctggtgagcg

SEQ ID NO: 127144 - DNA, 30 bp, Artificial Sequence
  Description of Artificial Sequence: Synthetic oligonucleotide
aggaggaagccaagaatctggtgagcgaag

SEQ ID NO: 127145 - DNA, 29 bp, Artificial Sequence
  Description of Artificial Sequence: Synthetic oligonucleotide
ggaggaagccaagaatctggtgagcgaag

SEQ ID NO: 127146 - DNA, 29 bp, Artificial Sequence
  Description of Artificial Sequence: Synthetic oligonucleotide
gaggaagccaagaatctggtgagcgaagc

SEQ ID NO: 127147 - DNA, 29 bp, Artificial Sequence
  Description of Artificial Sequence: Synthetic oligonucleotide
aggaagccaagaatctggtgagcgaagcc

SEQ ID NO: 127148 - DNA, 28 bp, Artificial Sequence
  Description of Artificial Sequence: Synthetic oligonucleotide
ggaagccaagaatctggtgagcgaagcc

SEQ ID NO: 127149 - DNA, 30 bp, Artificial Sequence
  Description of Artificial Sequence: Synthetic oligonucleotide
gaagccaagaatctggtgagcgaagccatc

SEQ ID NO: 127150 - DNA, 30 bp, Artificial Sequence
  Description of Artificial Sequence: Synthetic oligonucleotide
aagccaagaatctggtgagcgaagccatcg

SEQ ID NO: 127151 - DNA, 29 bp, Artificial Sequence
  Description of Artificial Sequence: Synthetic oligonucleotide
agccaagaatctggtgagcgaagccatcg

SEQ ID NO: 127152 - DNA, 28 bp, Artificial Sequence
  Description of Artificial Sequence: Synthetic oligonucleotide
gccaagaatctggtgagcgaagccatcg

SEQ ID NO: 127153 - DNA, 28 bp, Artificial Sequence
  Description of Artificial Sequence: Synthetic oligonucleotide
ccaagaatctggtgagcgaagccatcgc

SEQ ID NO: 127154 - DNA, 29 bp, Artificial Sequence
  Description of Artificial Sequence: Synthetic oligonucleotide
caagaatctggtgagcgaagccatcgcag

SEQ ID NO: 127155 - DNA, 29 bp, Artificial Sequence
  Description of Artificial Sequence: Synthetic oligonucleotide
aagaatctggtgagcgaagccatcgcagc

SEQ ID NO: 127156 - DNA, 28 bp, Artificial Sequence
  Description of Artificial Sequence: Synthetic oligonucleotide
agaatctggtgagcgaagccatcgcagc

SEQ ID NO: 127157 - DNA, 27 bp, Artificial Sequence
  Description of Artificial Sequence: Synthetic oligonucleotide
gaatctggtgagcgaagccatcgcagc

SEQ ID NO: 127158 - DNA, 28 bp, Artificial Sequence
  Description of Artificial Sequence: Synthetic oligonucleotide
aatctggtgagcgaagccatcgcagctg

SEQ ID NO: 127159 - DNA, 27 bp, Artificial Sequence
  Description of Artificial Sequence: Synthetic oligonucleotide
atctggtgagcgaagccatcgcagctg

SEQ ID NO: 127160 - DNA, 26 bp, Artificial Sequence
  Description of Artificial Sequence: Synthetic oligonucleotide
tctggtgagcgaagccatcgcagctg

SEQ ID NO: 127161 - DNA, 25 bp, Artificial Sequence
  Description of Artificial Sequence: Synthetic oligonucleotide
ctggtgagcgaagccatcgcagctg

SEQ ID NO: 127162 - DNA, 25 bp, Artificial Sequence
  Description of Artificial Sequence: Synthetic oligonucleotide
tggtgagcgaagccatcgcagctgg

SEQ ID NO: 127163 - DNA, 24 bp, Artificial Sequence
  Description of Artificial Sequence: Synthetic oligonucleotide
ggtgagcgaagccatcgcagctgg

SEQ ID NO: 127164 - DNA, 26 bp, Artificial Sequence
  Description of Artificial Sequence: Synthetic oligonucleotide
gtgagcgaagccatcgcagctggcat

SEQ ID NO: 127165 - DNA, 27 bp, Artificial Sequence
  Description of Artificial Sequence: Synthetic oligonucleotide
tgagcgaagccatcgcagctggcatct

SEQ ID NO: 127166 - DNA, 27 bp, Artificial Sequence
  Description of Artificial Sequence: Synthetic oligonucleotide
gagcgaagccatcgcagctggcatctt

SEQ ID NO: 127167 - DNA, 27 bp, Artificial Sequence
  Description of Artificial Sequence: Synthetic oligonucleotide
agcgaagccatcgcagctggcatcttc

SEQ ID NO: 127168 - DNA, 27 bp, Artificial Sequence
  Description of Artificial Sequence: Synthetic oligonucleotide
gcgaagccatcgcagctggcatcttca

SEQ ID NO: 127169 - DNA, 28 bp, Artificial Sequence
  Description of Artificial Sequence: Synthetic oligonucleotide
cgaagccatcgcagctggcatcttcaac

SEQ ID NO: 127170 - DNA, 28 bp, Artificial Sequence
  Description of Artificial Sequence: Synthetic oligonucleotide
gaagccatcgcagctggcatcttcaacg

SEQ ID NO: 127171 - DNA, 29 bp, Artificial Sequence
  Description of Artificial Sequence: Synthetic oligonucleotide
aagccatcgcagctggcatcttcaacgac

SEQ ID NO: 127172 - DNA, 28 bp, Artificial Sequence
  Description of Artificial Sequence: Synthetic oligonucleotide
agccatcgcagctggcatcttcaacgac

SEQ ID NO: 127173 - DNA, 27 bp, Artificial Sequence
  Description of Artificial Sequence: Synthetic oligonucleotide
gccatcgcagctggcatcttcaacgac

SEQ ID NO: 127174 - DNA, 27 bp, Artificial Sequence
  Description of Artificial Sequence: Synthetic oligonucleotide
ccatcgcagctggcatcttcaacgacc

SEQ ID NO: 127175 - DNA, 28 bp, Artificial Sequence
  Description of Artificial Sequence: Synthetic oligonucleotide
catcgcagctggcatcttcaacgacctg

SEQ ID NO: 127176 - DNA, 28 bp, Artificial Sequence
  Description of Artificial Sequence: Synthetic oligonucleotide
atcgcagctggcatcttcaacgacctgg

SEQ ID NO: 127177 - DNA, 27 bp, Artificial Sequence
  Description of Artificial Sequence: Synthetic oligonucleotide
tcgcagctggcatcttcaacgacctgg

SEQ ID NO: 127178 - DNA, 26 bp, Artificial Sequence
  Description of Artificial Sequence: Synthetic oligonucleotide
cgcagctggcatcttcaacgacctgg

SEQ ID NO: 127179 - DNA, 26 bp, Artificial Sequence
  Description of Artificial Sequence: Synthetic oligonucleotide
gcagctggcatcttcaacgacctggg

SEQ ID NO: 127180 - DNA, 27 bp, Artificial Sequence
  Description of Artificial Sequence: Synthetic oligonucleotide
cagctggcatcttcaacgacctgggct

SEQ ID NO: 127181 - DNA, 27 bp, Artificial Sequence
  Description of Artificial Sequence: Synthetic oligonucleotide
agctggcatcttcaacgacctgggctc

SEQ ID NO: 127182 - DNA, 26 bp, Artificial Sequence
  Description of Artificial Sequence: Synthetic oligonucleotide
gctggcatcttcaacgacctgggctc

SEQ ID NO: 127183 - DNA, 26 bp, Artificial Sequence
  Description of Artificial Sequence: Synthetic oligonucleotide
ctggcatcttcaacgacctgggctcc

SEQ ID NO: 127184 - DNA, 26 bp, Artificial Sequence
  Description of Artificial Sequence: Synthetic oligonucleotide
tggcatcttcaacgacctgggctccg

SEQ ID NO: 127185 - DNA, 25 bp, Artificial Sequence
  Description of Artificial Sequence: Synthetic oligonucleotide
ggcatcttcaacgacctgggctccg

SEQ ID NO: 127186 - DNA, 27 bp, Artificial Sequence
  Description of Artificial Sequence: Synthetic oligonucleotide
gcatcttcaacgacctgggctccggaa

SEQ ID NO: 127187 - DNA, 27 bp, Artificial Sequence
  Description of Artificial Sequence: Synthetic oligonucleotide
catcttcaacgacctgggctccggaag

SEQ ID NO: 127188 - DNA, 27 bp, Artificial Sequence
  Description of Artificial Sequence: Synthetic oligonucleotide
atcttcaacgacctgggctccggaagc

SEQ ID NO: 127189 - DNA, 27 bp, Artificial Sequence
  Description of Artificial Sequence: Synthetic oligonucleotide
tcttcaacgacctgggctccggaagca

SEQ ID NO: 127190 - DNA, 27 bp, Artificial Sequence
  Description of Artificial Sequence: Synthetic oligonucleotide
cttcaacgacctgggctccggaagcaa

SEQ ID NO: 127191 - DNA, 27 bp, Artificial Sequence
  Description of Artificial Sequence: Synthetic oligonucleotide
ttcaacgacctgggctccggaagcaac

SEQ ID NO: 127192 - DNA, 27 bp, Artificial Sequence
  Description of Artificial Sequence: Synthetic oligonucleotide
tcaacgacctgggctccggaagcaaca

SEQ ID NO: 127193 - DNA, 27 bp, Artificial Sequence
  Description of Artificial Sequence: Synthetic oligonucleotide
caacgacctgggctccggaagcaacat

SEQ ID NO: 127194 - DNA, 28 bp, Artificial Sequence
  Description of Artificial Sequence: Synthetic oligonucleotide
aacgacctgggctccggaagcaacattg

SEQ ID NO: 127195 - DNA, 27 bp, Artificial Sequence
  Description of Artificial Sequence: Synthetic oligonucleotide
acgacctgggctccggaagcaacattg

SEQ ID NO: 127196 - DNA, 27 bp, Artificial Sequence
  Description of Artificial Sequence: Synthetic oligonucleotide
cgacctgggctccggaagcaacattga

SEQ ID NO: 127197 - DNA, 27 bp, Artificial Sequence
  Description of Artificial Sequence: Synthetic oligonucleotide
gacctgggctccggaagcaacattgac

SEQ ID NO: 127198 - DNA, 27 bp, Artificial Sequence
  Description of Artificial Sequence: Synthetic oligonucleotide
acctgggctccggaagcaacattgacc

SEQ ID NO: 127199 - DNA, 27 bp, Artificial Sequence
  Description of Artificial Sequence: Synthetic oligonucleotide
cctgggctccggaagcaacattgacct

SEQ ID NO: 127200 - DNA, 27 bp, Artificial Sequence
  Description of Artificial Sequence: Synthetic oligonucleotide
ctgggctccggaagcaacattgacctc

SEQ ID NO: 127201 - DNA, 28 bp, Artificial Sequence
  Description of Artificial Sequence: Synthetic oligonucleotide
tgggctccggaagcaacattgacctctg

SEQ ID NO: 127202 - DNA, 27 bp, Artificial Sequence
  Description of Artificial Sequence: Synthetic oligonucleotide
gggctccggaagcaacattgacctctg

SEQ ID NO: 127203 - DNA, 27 bp, Artificial Sequence
  Description of Artificial Sequence: Synthetic oligonucleotide
ggctccggaagcaacattgacctctgc

SEQ ID NO: 127204 - DNA, 27 bp, Artificial Sequence
  Description of Artificial Sequence: Synthetic oligonucleotide
gctccggaagcaacattgacctctgcg

SEQ ID NO: 127205 - DNA, 28 bp, Artificial Sequence
  Description of Artificial Sequence: Synthetic oligonucleotide
ctccggaagcaacattgacctctgcgtc

SEQ ID NO: 127206 - DNA, 30 bp, Artificial Sequence
  Description of Artificial Sequence: Synthetic oligonucleotide
tccggaagcaacattgacctctgcgtcatc

SEQ ID NO: 127207 - DNA, 29 bp, Artificial Sequence
  Description of Artificial Sequence: Synthetic oligonucleotide
ccggaagcaacattgacctctgcgtcatc

SEQ ID NO: 127208 - DNA, 30 bp, Artificial Sequence
  Description of Artificial Sequence: Synthetic oligonucleotide
cggaagcaacattgacctctgcgtcatcag

SEQ ID NO: 127209 - DNA, 30 bp, Artificial Sequence
  Description of Artificial Sequence: Synthetic oligonucleotide
ggaagcaacattgacctctgcgtcatcagc

SEQ ID NO: 127210 - DNA, 32 bp, Artificial Sequence
  Description of Artificial Sequence: Synthetic oligonucleotide
gaagcaacattgacctctgcgtcatcagcaag

SEQ ID NO: 127211 - DNA, 34 bp, Artificial Sequence
  Description of Artificial Sequence: Synthetic oligonucleotide
aagcaacattgacctctgcgtcatcagcaagaac

SEQ ID NO: 127212 - DNA, 33 bp, Artificial Sequence
  Description of Artificial Sequence: Synthetic oligonucleotide
agcaacattgacctctgcgtcatcagcaagaac

SEQ ID NO: 127213 - DNA, 32 bp, Artificial Sequence
  Description of Artificial Sequence: Synthetic oligonucleotide
gcaacattgacctctgcgtcatcagcaagaac

SEQ ID NO: 127214 - DNA, 34 bp, Artificial Sequence
  Description of Artificial Sequence: Synthetic oligonucleotide
caacattgacctctgcgtcatcagcaagaacaag

SEQ ID NO: 127215 - DNA, 34 bp, Artificial Sequence
  Description of Artificial Sequence: Synthetic oligonucleotide
aacattgacctctgcgtcatcagcaagaacaagc

SEQ ID NO: 127216 - DNA, 33 bp, Artificial Sequence
  Description of Artificial Sequence: Synthetic oligonucleotide
acattgacctctgcgtcatcagcaagaacaagc

SEQ ID NO: 127217 - DNA, 32 bp, Artificial Sequence
  Description of Artificial Sequence: Synthetic oligonucleotide
cattgacctctgcgtcatcagcaagaacaagc

SEQ ID NO: 127218 - DNA, 33 bp, Artificial Sequence
  Description of Artificial Sequence: Synthetic oligonucleotide
attgacctctgcgtcatcagcaagaacaagctg

SEQ ID NO: 127219 - DNA, 32 bp, Artificial Sequence
  Description of Artificial Sequence: Synthetic oligonucleotide
ttgacctctgcgtcatcagcaagaacaagctg

SEQ ID NO: 127220 - DNA, 31 bp, Artificial Sequence
  Description of Artificial Sequence: Synthetic oligonucleotide
tgacctctgcgtcatcagcaagaacaagctg

SEQ ID NO: 127221 - DNA, 30 bp, Artificial Sequence
  Description of Artificial Sequence: Synthetic oligonucleotide
gacctctgcgtcatcagcaagaacaagctg

SEQ ID NO: 127222 - DNA, 30 bp, Artificial Sequence
  Description of Artificial Sequence: Synthetic oligonucleotide
acctctgcgtcatcagcaagaacaagctgg

SEQ ID NO: 127223 - DNA, 29 bp, Artificial Sequence
  Description of Artificial Sequence: Synthetic oligonucleotide
cctctgcgtcatcagcaagaacaagctgg

SEQ ID NO: 127224 - DNA, 34 bp, Artificial Sequence
  Description of Artificial Sequence: Synthetic oligonucleotide
ctctgcgtcatcagcaagaacaagctggattttc

SEQ ID NO: 127225 - DNA, 35 bp, Artificial Sequence
  Description of Artificial Sequence: Synthetic oligonucleotide
tctgcgtcatcagcaagaacaagctggattttctc

SEQ ID NO: 127226 - DNA, 34 bp, Artificial Sequence
  Description of Artificial Sequence: Synthetic oligonucleotide
ctgcgtcatcagcaagaacaagctggattttctc

SEQ ID NO: 127227 - DNA, 34 bp, Artificial Sequence
  Description of Artificial Sequence: Synthetic oligonucleotide
tgcgtcatcagcaagaacaagctggattttctcc

SEQ ID NO: 127228 - DNA, 33 bp, Artificial Sequence
  Description of Artificial Sequence: Synthetic oligonucleotide
gcgtcatcagcaagaacaagctggattttctcc

SEQ ID NO: 127229 - DNA, 33 bp, Artificial Sequence
  Description of Artificial Sequence: Synthetic oligonucleotide
cgtcatcagcaagaacaagctggattttctccg

SEQ ID NO: 127230 - DNA, 33 bp, Artificial Sequence
  Description of Artificial Sequence: Synthetic oligonucleotide
gtcatcagcaagaacaagctggattttctccgc

SEQ ID NO: 127231 - DNA, 33 bp, Artificial Sequence
  Description of Artificial Sequence: Synthetic oligonucleotide
tcatcagcaagaacaagctggattttctccgcc

SEQ ID NO: 127232 - DNA, 32 bp, Artificial Sequence
  Description of Artificial Sequence: Synthetic oligonucleotide
catcagcaagaacaagctggattttctccgcc

SEQ ID NO: 127233 - DNA, 32 bp, Artificial Sequence
  Description of Artificial Sequence: Synthetic oligonucleotide
atcagcaagaacaagctggattttctccgccc

SEQ ID NO: 127234 - DNA, 31 bp, Artificial Sequence
  Description of Artificial Sequence: Synthetic oligonucleotide
tcagcaagaacaagctggattttctccgccc

SEQ ID NO: 127235 - DNA, 30 bp, Artificial Sequence
  Description of Artificial Sequence: Synthetic oligonucleotide
cagcaagaacaagctggattttctccgccc

SEQ ID NO: 127236 - DNA, 33 bp, Artificial Sequence
  Description of Artificial Sequence: Synthetic oligonucleotide
agcaagaacaagctggattttctccgcccatac

SEQ ID NO: 127237 - DNA, 32 bp, Artificial Sequence
  Description of Artificial Sequence: Synthetic oligonucleotide
gcaagaacaagctggattttctccgcccatac

SEQ ID NO: 127238 - DNA, 33 bp, Artificial Sequence
  Description of Artificial Sequence: Synthetic oligonucleotide
caagaacaagctggattttctccgcccatacac

SEQ ID NO: 127239 - DNA, 34 bp, Artificial Sequence
  Description of Artificial Sequence: Synthetic oligonucleotide
aagaacaagctggattttctccgcccatacacag

SEQ ID NO: 127240 - DNA, 33 bp, Artificial Sequence
  Description of Artificial Sequence: Synthetic oligonucleotide
agaacaagctggattttctccgcccatacacag

SEQ ID NO: 127241 - DNA, 32 bp, Artificial Sequence
  Description of Artificial Sequence: Synthetic oligonucleotide
gaacaagctggattttctccgcccatacacag

SEQ ID NO: 127242 - DNA, 33 bp, Artificial Sequence
  Description of Artificial Sequence: Synthetic oligonucleotide
aacaagctggattttctccgcccatacacagtg

SEQ ID NO: 127243 - DNA, 32 bp, Artificial Sequence
  Description of Artificial Sequence: Synthetic oligonucleotide
acaagctggattttctccgcccatacacagtg

SEQ ID NO: 127244 - DNA, 31 bp, Artificial Sequence
  Description of Artificial Sequence: Synthetic oligonucleotide
caagctggattttctccgcccatacacagtg

SEQ ID NO: 127245 - DNA, 31 bp, Artificial Sequence
  Description of Artificial Sequence: Synthetic oligonucleotide
aagctggattttctccgcccatacacagtgc

SEQ ID NO: 127246 - DNA, 30 bp, Artificial Sequence
  Description of Artificial Sequence: Synthetic oligonucleotide
agctggattttctccgcccatacacagtgc

SEQ ID NO: 127247 - DNA, 29 bp, Artificial Sequence
  Description of Artificial Sequence: Synthetic oligonucleotide
gctggattttctccgcccatacacagtgc

SEQ ID NO: 127248 - DNA, 29 bp, Artificial Sequence
  Description of Artificial Sequence: Synthetic oligonucleotide
ctggattttctccgcccatacacagtgcc

SEQ ID NO: 127249 - DNA, 29 bp, Artificial Sequence
  Description of Artificial Sequence: Synthetic oligonucleotide
tggattttctccgcccatacacagtgccc

SEQ ID NO: 127250 - DNA, 28 bp, Artificial Sequence
  Description of Artificial Sequence: Synthetic oligonucleotide
ggattttctccgcccatacacagtgccc

SEQ ID NO: 127251 - DNA, 30 bp, Artificial Sequence
  Description of Artificial Sequence: Synthetic oligonucleotide
gattttctccgcccatacacagtgcccaac

SEQ ID NO: 127252 - DNA, 32 bp, Artificial Sequence
  Description of Artificial Sequence: Synthetic oligonucleotide
attttctccgcccatacacagtgcccaacaag

SEQ ID NO: 127253 - DNA, 31 bp, Artificial Sequence
  Description of Artificial Sequence: Synthetic oligonucleotide
ttttctccgcccatacacagtgcccaacaag

SEQ ID NO: 127254 - DNA, 30 bp, Artificial Sequence
  Description of Artificial Sequence: Synthetic oligonucleotide
tttctccgcccatacacagtgcccaacaag

SEQ ID NO: 127255 - DNA, 29 bp, Artificial Sequence
  Description of Artificial Sequence: Synthetic oligonucleotide
ttctccgcccatacacagtgcccaacaag

SEQ ID NO: 127256 - DNA, 28 bp, Artificial Sequence
  Description of Artificial Sequence: Synthetic oligonucleotide
tctccgcccatacacagtgcccaacaag

SEQ ID NO: 127257 - DNA, 27 bp, Artificial Sequence
  Description of Artificial Sequence: Synthetic oligonucleotide
ctccgcccatacacagtgcccaacaag

SEQ ID NO: 127258 - DNA, 29 bp, Artificial Sequence
  Description of Artificial Sequence: Synthetic oligonucleotide
tccgcccatacacagtgcccaacaagaag

SEQ ID NO: 127259 - DNA, 28 bp, Artificial Sequence
  Description of Artificial Sequence: Synthetic oligonucleotide
ccgcccatacacagtgcccaacaagaag

SEQ ID NO: 127260 - DNA, 28 bp, Artificial Sequence
  Description of Artificial Sequence: Synthetic oligonucleotide
cgcccatacacagtgcccaacaagaagg

SEQ ID NO: 127261 - DNA, 28 bp, Artificial Sequence
  Description of Artificial Sequence: Synthetic oligonucleotide
gcccatacacagtgcccaacaagaaggg

SEQ ID NO: 127262 - DNA, 28 bp, Artificial Sequence
  Description of Artificial Sequence: Synthetic oligonucleotide
cccatacacagtgcccaacaagaagggg

SEQ ID NO: 127263 - DNA, 29 bp, Artificial Sequence
  Description of Artificial Sequence: Synthetic oligonucleotide
ccatacacagtgcccaacaagaaggggac

SEQ ID NO: 127264 - DNA, 29 bp, Artificial Sequence
  Description of Artificial Sequence: Synthetic oligonucleotide
catacacagtgcccaacaagaaggggacc

SEQ ID NO: 127265 - DNA, 30 bp, Artificial Sequence
  Description of Artificial Sequence: Synthetic oligonucleotide
atacacagtgcccaacaagaaggggaccag

SEQ ID NO: 127266 - DNA, 29 bp, Artificial Sequence
  Description of Artificial Sequence: Synthetic oligonucleotide
tacacagtgcccaacaagaaggggaccag

SEQ ID NO: 127267 - DNA, 28 bp, Artificial Sequence
  Description of Artificial Sequence: Synthetic oligonucleotide
acacagtgcccaacaagaaggggaccag

SEQ ID NO: 127268 - DNA, 27 bp, Artificial Sequence
  Description of Artificial Sequence: Synthetic oligonucleotide
cacagtgcccaacaagaaggggaccag

SEQ ID NO: 127269 - DNA, 27 bp, Artificial Sequence
  Description of Artificial Sequence: Synthetic oligonucleotide
acagtgcccaacaagaaggggaccagg

SEQ ID NO: 127270 - DNA, 26 bp, Artificial Sequence
  Description of Artificial Sequence: Synthetic oligonucleotide
cagtgcccaacaagaaggggaccagg

SEQ ID NO: 127271 - DNA, 27 bp, Artificial Sequence
  Description of Artificial Sequence: Synthetic oligonucleotide
agtgcccaacaagaaggggaccaggct

SEQ ID NO: 127272 - DNA, 27 bp, Artificial Sequence
  Description of Artificial Sequence: Synthetic oligonucleotide
gtgcccaacaagaaggggaccaggctt

SEQ ID NO: 127273 - DNA, 27 bp, Artificial Sequence
  Description of Artificial Sequence: Synthetic oligonucleotide
tgcccaacaagaaggggaccaggcttg

SEQ ID NO: 127274 - DNA, 26 bp, Artificial Sequence
  Description of Artificial Sequence: Synthetic oligonucleotide
gcccaacaagaaggggaccaggcttg

SEQ ID NO: 127275 - DNA, 26 bp, Artificial Sequence
  Description of Artificial Sequence: Synthetic oligonucleotide
cccaacaagaaggggaccaggcttgg

SEQ ID NO: 127276 - DNA, 26 bp, Artificial Sequence
  Description of Artificial Sequence: Synthetic oligonucleotide
ccaacaagaaggggaccaggcttggc

SEQ ID NO: 127277 - DNA, 26 bp, Artificial Sequence
  Description of Artificial Sequence: Synthetic oligonucleotide
caacaagaaggggaccaggcttggcc

SEQ ID NO: 127278 - DNA, 26 bp, Artificial Sequence
  Description of Artificial Sequence: Synthetic oligonucleotide
aacaagaaggggaccaggcttggccg

SEQ ID NO: 127279 - DNA, 25 bp, Artificial Sequence
  Description of Artificial Sequence: Synthetic oligonucleotide
acaagaaggggaccaggcttggccg

SEQ ID NO: 127280 - DNA, 24 bp, Artificial Sequence
  Description of Artificial Sequence: Synthetic oligonucleotide
caagaaggggaccaggcttggccg

SEQ ID NO: 127281 - DNA, 26 bp, Artificial Sequence
  Description of Artificial Sequence: Synthetic oligonucleotide
aagaaggggaccaggcttggccggta

SEQ ID NO: 127282 - DNA, 25 bp, Artificial Sequence
  Description of Artificial Sequence: Synthetic oligonucleotide
agaaggggaccaggcttggccggta

SEQ ID NO: 127283 - DNA, 24 bp, Artificial Sequence
  Description of Artificial Sequence: Synthetic oligonucleotide
gaaggggaccaggcttggccggta

SEQ ID NO: 127284 - DNA, 25 bp, Artificial Sequence
  Description of Artificial Sequence: Synthetic oligonucleotide
aaggggaccaggcttggccggtaca

SEQ ID NO: 127285 - DNA, 24 bp, Artificial Sequence
  Description of Artificial Sequence: Synthetic oligonucleotide
aggggaccaggcttggccggtaca

SEQ ID NO: 127286 - DNA, 23 bp, Artificial Sequence
  Description of Artificial Sequence: Synthetic oligonucleotide
ggggaccaggcttggccggtaca

SEQ ID NO: 127287 - DNA, 23 bp, Artificial Sequence
  Description of Artificial Sequence: Synthetic oligonucleotide
gggaccaggcttggccggtacag

SEQ ID NO: 127288 - DNA, 24 bp, Artificial Sequence
  Description of Artificial Sequence: Synthetic oligonucleotide
ggaccaggcttggccggtacaggt

SEQ ID NO: 127289 - DNA, 25 bp, Artificial Sequence
  Description of Artificial Sequence: Synthetic oligonucleotide
gaccaggcttggccggtacaggtgt

SEQ ID NO: 127290 - DNA, 26 bp, Artificial Sequence
  Description of Artificial Sequence: Synthetic oligonucleotide
accaggcttggccggtacaggtgtga

SEQ ID NO: 127291 - DNA, 25 bp, Artificial Sequence
  Description of Artificial Sequence: Synthetic oligonucleotide
ccaggcttggccggtacaggtgtga

SEQ ID NO: 127292 - DNA, 27 bp, Artificial Sequence
  Description of Artificial Sequence: Synthetic oligonucleotide
caggcttggccggtacaggtgtgagaa

SEQ ID NO: 127293 - DNA, 28 bp, Artificial Sequence
  Description of Artificial Sequence: Synthetic oligonucleotide
aggcttggccggtacaggtgtgagaaag

SEQ ID NO: 127294 - DNA, 27 bp, Artificial Sequence
  Description of Artificial Sequence: Synthetic oligonucleotide
ggcttggccggtacaggtgtgagaaag

SEQ ID NO: 127295 - DNA, 27 bp, Artificial Sequence
  Description of Artificial Sequence: Synthetic oligonucleotide
gcttggccggtacaggtgtgagaaagg

SEQ ID NO: 127296 - DNA, 27 bp, Artificial Sequence
  Description of Artificial Sequence: Synthetic oligonucleotide
cttggccggtacaggtgtgagaaaggg

SEQ ID NO: 127297 - DNA, 28 bp, Artificial Sequence
  Description of Artificial Sequence: Synthetic oligonucleotide
ttggccggtacaggtgtgagaaagggac

SEQ ID NO: 127298 - DNA, 27 bp, Artificial Sequence
  Description of Artificial Sequence: Synthetic oligonucleotide
tggccggtacaggtgtgagaaagggac

SEQ ID NO: 127299 - DNA, 27 bp, Artificial Sequence
  Description of Artificial Sequence: Synthetic oligonucleotide
ggccggtacaggtgtgagaaagggact

SEQ ID NO: 127300 - DNA, 28 bp, Artificial Sequence
  Description of Artificial Sequence: Synthetic oligonucleotide
gccggtacaggtgtgagaaagggactac

SEQ ID NO: 127301 - DNA, 29 bp, Artificial Sequence
  Description of Artificial Sequence: Synthetic oligonucleotide
ccggtacaggtgtgagaaagggactactg

SEQ ID NO: 127302 - DNA, 29 bp, Artificial Sequence
  Description of Artificial Sequence: Synthetic oligonucleotide
cggtacaggtgtgagaaagggactactgc

SEQ ID NO: 127303 - DNA, 30 bp, Artificial Sequence
  Description of Artificial Sequence: Synthetic oligonucleotide
ggtacaggtgtgagaaagggactactgcag

SEQ ID NO: 127304 - DNA, 31 bp, Artificial Sequence
  Description of Artificial Sequence: Synthetic oligonucleotide
gtacaggtgtgagaaagggactactgcagtc

SEQ ID NO: 127305 - DNA, 31 bp, Artificial Sequence
  Description of Artificial Sequence: Synthetic oligonucleotide
tacaggtgtgagaaagggactactgcagtcc

SEQ ID NO: 127306 - DNA, 30 bp, Artificial Sequence
  Description of Artificial Sequence: Synthetic oligonucleotide
acaggtgtgagaaagggactactgcagtcc

SEQ ID NO: 127307 - DNA, 29 bp, Artificial Sequence
  Description of Artificial Sequence: Synthetic oligonucleotide
caggtgtgagaaagggactactgcagtcc

SEQ ID NO: 127308 - DNA, 30 bp, Artificial Sequence
  Description of Artificial Sequence: Synthetic oligonucleotide
aggtgtgagaaagggactactgcagtcctc

SEQ ID NO: 127309 - DNA, 29 bp, Artificial Sequence
  Description of Artificial Sequence: Synthetic oligonucleotide
ggtgtgagaaagggactactgcagtcctc

SEQ ID NO: 127310 - DNA, 30 bp, Artificial Sequence
  Description of Artificial Sequence: Synthetic oligonucleotide
gtgtgagaaagggactactgcagtcctcac

SEQ ID NO: 127311 - DNA, 31 bp, Artificial Sequence
  Description of Artificial Sequence: Synthetic oligonucleotide
tgtgagaaagggactactgcagtcctcactg

SEQ ID NO: 127312 - DNA, 30 bp, Artificial Sequence
  Description of Artificial Sequence: Synthetic oligonucleotide
gtgagaaagggactactgcagtcctcactg

SEQ ID NO: 127313 - DNA, 31 bp, Artificial Sequence
  Description of Artificial Sequence: Synthetic oligonucleotide
tgagaaagggactactgcagtcctcactgag

SEQ ID NO: 127314 - DNA, 30 bp, Artificial Sequence
  Description of Artificial Sequence: Synthetic oligonucleotide
gagaaagggactactgcagtcctcactgag

SEQ ID NO: 127315 - DNA, 35 bp, Artificial Sequence
  Description of Artificial Sequence: Synthetic oligonucleotide
agaaagggactactgcagtcctcactgagaaaatc

SEQ ID NO: 127316 - DNA, 34 bp, Artificial Sequence
  Description of Artificial Sequence: Synthetic oligonucleotide
gaaagggactactgcagtcctcactgagaaaatc

SEQ ID NO: 127317 - DNA, 35 bp, Artificial Sequence
  Description of Artificial Sequence: Synthetic oligonucleotide
aaagggactactgcagtcctcactgagaaaatcac

SEQ ID NO: 127318 - DNA, 34 bp, Artificial Sequence
  Description of Artificial Sequence: Synthetic oligonucleotide
aagggactactgcagtcctcactgagaaaatcac

SEQ ID NO: 127319 - DNA, 33 bp, Artificial Sequence
  Description of Artificial Sequence: Synthetic oligonucleotide
agggactactgcagtcctcactgagaaaatcac

SEQ ID NO: 127320 - DNA, 32 bp, Artificial Sequence
  Description of Artificial Sequence: Synthetic oligonucleotide
gggactactgcagtcctcactgagaaaatcac

SEQ ID NO: 127321 - DNA, 33 bp, Artificial Sequence
  Description of Artificial Sequence: Synthetic oligonucleotide
ggactactgcagtcctcactgagaaaatcactc

SEQ ID NO: 127322 - DNA, 33 bp, Artificial Sequence
  Description of Artificial Sequence: Synthetic oligonucleotide
gactactgcagtcctcactgagaaaatcactcc

SEQ ID NO: 127323 - DNA, 34 bp, Artificial Sequence
  Description of Artificial Sequence: Synthetic oligonucleotide
actactgcagtcctcactgagaaaatcactcctc

SEQ ID NO: 127324 - DNA, 33 bp, Artificial Sequence
  Description of Artificial Sequence: Synthetic oligonucleotide
ctactgcagtcctcactgagaaaatcactcctc

SEQ ID NO: 127325 - DNA, 34 bp, Artificial Sequence
  Description of Artificial Sequence: Synthetic oligonucleotide
tactgcagtcctcactgagaaaatcactcctctg

SEQ ID NO: 127326 - DNA, 33 bp, Artificial Sequence
  Description of Artificial Sequence: Synthetic oligonucleotide
actgcagtcctcactgagaaaatcactcctctg

SEQ ID NO: 127327 - DNA, 32 bp, Artificial Sequence
  Description of Artificial Sequence: Synthetic oligonucleotide
ctgcagtcctcactgagaaaatcactcctctg

SEQ ID NO: 127328 - DNA, 32 bp, Artificial Sequence
  Description of Artificial Sequence: Synthetic oligonucleotide
tgcagtcctcactgagaaaatcactcctctgg

SEQ ID NO: 127329 - DNA, 31 bp, Artificial Sequence
  Description of Artificial Sequence: Synthetic oligonucleotide
gcagtcctcactgagaaaatcactcctctgg

SEQ ID NO: 127330 - DNA, 32 bp, Artificial Sequence
  Description of Artificial Sequence: Synthetic oligonucleotide
cagtcctcactgagaaaatcactcctctggag

SEQ ID NO: 127331 - DNA, 35 bp, Artificial Sequence
  Description of Artificial Sequence: Synthetic oligonucleotide
agtcctcactgagaaaatcactcctctggagattg

SEQ ID NO: 127332 - DNA, 34 bp, Artificial Sequence
  Description of Artificial Sequence: Synthetic oligonucleotide
gtcctcactgagaaaatcactcctctggagattg

SEQ ID NO: 127333 - DNA, 35 bp, Artificial Sequence
  Description of Artificial Sequence: Synthetic oligonucleotide
tcctcactgagaaaatcactcctctggagattgag

SEQ ID NO: 127334 - DNA, 34 bp, Artificial Sequence
  Description of Artificial Sequence: Synthetic oligonucleotide
cctcactgagaaaatcactcctctggagattgag

SEQ ID NO: 127335 - DNA, 34 bp, Artificial Sequence
  Description of Artificial Sequence: Synthetic oligonucleotide
ctcactgagaaaatcactcctctggagattgagg

SEQ ID NO: 127336 - DNA, 35 bp, Artificial Sequence
  Description of Artificial Sequence: Synthetic oligonucleotide
tcactgagaaaatcactcctctggagattgaggtg

SEQ ID NO: 127337 - DNA, 34 bp, Artificial Sequence
  Description of Artificial Sequence: Synthetic oligonucleotide
cactgagaaaatcactcctctggagattgaggtg

SEQ ID NO: 127338 - DNA, 34 bp, Artificial Sequence
  Description of Artificial Sequence: Synthetic oligonucleotide
actgagaaaatcactcctctggagattgaggtgc

SEQ ID NO: 127339 - DNA, 33 bp, Artificial Sequence
  Description of Artificial Sequence: Synthetic oligonucleotide
ctgagaaaatcactcctctggagattgaggtgc

SEQ ID NO: 127340 - DNA, 34 bp, Artificial Sequence
  Description of Artificial Sequence: Synthetic oligonucleotide
tgagaaaatcactcctctggagattgaggtgctg

SEQ ID NO: 127341 - DNA, 33 bp, Artificial Sequence
  Description of Artificial Sequence: Synthetic oligonucleotide
gagaaaatcactcctctggagattgaggtgctg

SEQ ID NO: 127342 - DNA, 33 bp, Artificial Sequence
  Description of Artificial Sequence: Synthetic oligonucleotide
agaaaatcactcctctggagattgaggtgctgg

SEQ ID NO: 127343 - DNA, 32 bp, Artificial Sequence
  Description of Artificial Sequence: Synthetic oligonucleotide
gaaaatcactcctctggagattgaggtgctgg

SEQ ID NO: 127344 - DNA, 34 bp, Artificial Sequence
  Description of Artificial Sequence: Synthetic oligonucleotide
aaaatcactcctctggagattgaggtgctggaag

SEQ ID NO: 127345 - DNA, 33 bp, Artificial Sequence
  Description of Artificial Sequence: Synthetic oligonucleotide
aaatcactcctctggagattgaggtgctggaag

SEQ ID NO: 127346 - DNA, 32 bp, Artificial Sequence
  Description of Artificial Sequence: Synthetic oligonucleotide
aatcactcctctggagattgaggtgctggaag

SEQ ID NO: 127347 - DNA, 31 bp, Artificial Sequence
  Description of Artificial Sequence: Synthetic oligonucleotide
atcactcctctggagattgaggtgctggaag

SEQ ID NO: 127348 - DNA, 30 bp, Artificial Sequence
  Description of Artificial Sequence: Synthetic oligonucleotide
tcactcctctggagattgaggtgctggaag

SEQ ID NO: 127349 - DNA, 29 bp, Artificial Sequence
  Description of Artificial Sequence: Synthetic oligonucleotide
cactcctctggagattgaggtgctggaag

SEQ ID NO: 127350 - DNA, 32 bp, Artificial Sequence
  Description of Artificial Sequence: Synthetic oligonucleotide
actcctctggagattgaggtgctggaagaaac

SEQ ID NO: 127351 - DNA, 31 bp, Artificial Sequence
  Description of Artificial Sequence: Synthetic oligonucleotide
ctcctctggagattgaggtgctggaagaaac

SEQ ID NO: 127352 - DNA, 32 bp, Artificial Sequence
  Description of Artificial Sequence: Synthetic oligonucleotide
tcctctggagattgaggtgctggaagaaacag

SEQ ID NO: 127353 - DNA, 31 bp, Artificial Sequence
  Description of Artificial Sequence: Synthetic oligonucleotide
cctctggagattgaggtgctggaagaaacag

SEQ ID NO: 127354 - DNA, 32 bp, Artificial Sequence
  Description of Artificial Sequence: Synthetic oligonucleotide
ctctggagattgaggtgctggaagaaacagtc

SEQ ID NO: 127355 - DNA, 32 bp, Artificial Sequence
  Description of Artificial Sequence: Synthetic oligonucleotide
tctggagattgaggtgctggaagaaacagtcc

SEQ ID NO: 127356 - DNA, 31 bp, Artificial Sequence
  Description of Artificial Sequence: Synthetic oligonucleotide
ctggagattgaggtgctggaagaaacagtcc

SEQ ID NO: 127357 - DNA, 34 bp, Artificial Sequence
  Description of Artificial Sequence: Synthetic oligonucleotide
tggagattgaggtgctggaagaaacagtccaaac

SEQ ID NO: 127358 - DNA, 33 bp, Artificial Sequence
  Description of Artificial Sequence: Synthetic oligonucleotide
ggagattgaggtgctggaagaaacagtccaaac

SEQ ID NO: 127359 - DNA, 36 bp, Artificial Sequence
  Description of Artificial Sequence: Synthetic oligonucleotide
gagattgaggtgctggaagaaacagtccaaacaatg

SEQ ID NO: 127360 - DNA, 36 bp, Artificial Sequence
  Description of Artificial Sequence: Synthetic oligonucleotide
agattgaggtgctggaagaaacagtccaaacaatgg

SEQ ID NO: 127361 - DNA, 35 bp, Artificial Sequence
  Description of Artificial Sequence: Synthetic oligonucleotide
gattgaggtgctggaagaaacagtccaaacaatgg

SEQ ID NO: 127362 - DNA, 36 bp, Artificial Sequence
  Description of Artificial Sequence: Synthetic oligonucleotide
attgaggtgctggaagaaacagtccaaacaatggac

SEQ ID NO: 127363 - DNA, 35 bp, Artificial Sequence
  Description of Artificial Sequence: Synthetic oligonucleotide
ttgaggtgctggaagaaacagtccaaacaatggac

SEQ ID NO: 127364 - DNA, 34 bp, Artificial Sequence
  Description of Artificial Sequence: Synthetic oligonucleotide
tgaggtgctggaagaaacagtccaaacaatggac

SEQ ID NO: 127365 - DNA, 33 bp, Artificial Sequence
  Description of Artificial Sequence: Synthetic oligonucleotide
gaggtgctggaagaaacagtccaaacaatggac

SEQ ID NO: 127366 - DNA, 34 bp, Artificial Sequence
  Description of Artificial Sequence: Synthetic oligonucleotide
aggtgctggaagaaacagtccaaacaatggacac

SEQ ID NO: 127367 - DNA, 33 bp, Artificial Sequence
  Description of Artificial Sequence: Synthetic oligonucleotide
ggtgctggaagaaacagtccaaacaatggacac

SEQ ID NO: 127368 - DNA, 35 bp, Artificial Sequence
  Description of Artificial Sequence: Synthetic oligonucleotide
gtgctggaagaaacagtccaaacaatggacacttc

SEQ ID NO: 127369 - DNA, 35 bp, Artificial Sequence
  Description of Artificial Sequence: Synthetic oligonucleotide
tgctggaagaaacagtccaaacaatggacacttcc

SEQ ID NO: 127370 - DNA, 34 bp, Artificial Sequence
  Description of Artificial Sequence: Synthetic oligonucleotide
gctggaagaaacagtccaaacaatggacacttcc

SEQ ID NO: 127371 - DNA, 35 bp, Artificial Sequence
  Description of Artificial Sequence: Synthetic oligonucleotide
ctggaagaaacagtccaaacaatggacacttcctg

SEQ ID NO: 127372 - DNA, 23 bp, Artificial Sequence
  Description of Artificial Sequence: Synthetic oligonucleotide
atgctgcgggcgggagcaccaac

SEQ ID NO: 127373 - DNA, 22 bp, Artificial Sequence
  Description of Artificial Sequence: Synthetic oligonucleotide
tgctgcgggcgggagcaccaac

SEQ ID NO: 127374 - DNA, 21 bp, Artificial Sequence
  Description of Artificial Sequence: Synthetic oligonucleotide
gctgcgggcgggagcaccaac

SEQ ID NO: 127375 - DNA, 21 bp, Artificial Sequence
  Description of Artificial Sequence: Synthetic oligonucleotide
ctgcgggcgggagcaccaacc

SEQ ID NO: 127376 - DNA, 21 bp, Artificial Sequence
  Description of Artificial Sequence: Synthetic oligonucleotide
tgcgggcgggagcaccaaccg

SEQ ID NO: 127377 - DNA, 20 bp, Artificial Sequence
  Description of Artificial Sequence: Synthetic oligonucleotide
gcgggcgggagcaccaaccg

SEQ ID NO: 127378 - DNA, 20 bp, Artificial Sequence
  Description of Artificial Sequence: Synthetic oligonucleotide
cgggcgggagcaccaaccgg

SEQ ID NO: 127379 - DNA, 20 bp, Artificial Sequence
  Description of Artificial Sequence: Synthetic oligonucleotide
gggcgggagcaccaaccggg

SEQ ID NO: 127380 - DNA, 21 bp, Artificial Sequence
  Description of Artificial Sequence: Synthetic oligonucleotide
ggcgggagcaccaaccgggga

SEQ ID NO: 127381 - DNA, 24 bp, Artificial Sequence
  Description of Artificial Sequence: Synthetic oligonucleotide
gcgggagcaccaaccggggactta

SEQ ID NO: 127382 - DNA, 24 bp, Artificial Sequence
  Description of Artificial Sequence: Synthetic oligonucleotide
cgggagcaccaaccggggacttac

SEQ ID NO: 127383 - DNA, 24 bp, Artificial Sequence
  Description of Artificial Sequence: Synthetic oligonucleotide
gggagcaccaaccggggacttacc

SEQ ID NO: 127384 - DNA, 24 bp, Artificial Sequence
  Description of Artificial Sequence: Synthetic oligonucleotide
ggagcaccaaccggggacttaccc

SEQ ID NO: 127385 - DNA, 24 bp, Artificial Sequence
  Description of Artificial Sequence: Synthetic oligonucleotide
gagcaccaaccggggacttacccc

SEQ ID NO: 127386 - DNA, 24 bp, Artificial Sequence
  Description of Artificial Sequence: Synthetic oligonucleotide
agcaccaaccggggacttaccccg

SEQ ID NO: 127387 - DNA, 23 bp, Artificial Sequence
  Description of Artificial Sequence: Synthetic oligonucleotide
gcaccaaccggggacttaccccg

SEQ ID NO: 127388 - DNA, 23 bp, Artificial Sequence
  Description of Artificial Sequence: Synthetic oligonucleotide
caccaaccggggacttaccccgg

SEQ ID NO: 127389 - DNA, 23 bp, Artificial Sequence
  Description of Artificial Sequence: Synthetic oligonucleotide
accaaccggggacttaccccggg

SEQ ID NO: 127390 - DNA, 22 bp, Artificial Sequence
  Description of Artificial Sequence: Synthetic oligonucleotide
ccaaccggggacttaccccggg

SEQ ID NO: 127391 - DNA, 22 bp, Artificial Sequence
  Description of Artificial Sequence: Synthetic oligonucleotide
caaccggggacttaccccgggc

SEQ ID NO: 127392 - DNA, 22 bp, Artificial Sequence
  Description of Artificial Sequence: Synthetic oligonucleotide
aaccggggacttaccccgggcg

SEQ ID NO: 127393 - DNA, 21 bp, Artificial Sequence
  Description of Artificial Sequence: Synthetic oligonucleotide
accggggacttaccccgggcg

SEQ ID NO: 127394 - DNA, 20 bp, Artificial Sequence
  Description of Artificial Sequence: Synthetic oligonucleotide
ccggggacttaccccgggcg

SEQ ID NO: 127395 - DNA, 20 bp, Artificial Sequence
  Description of Artificial Sequence: Synthetic oligonucleotide
cggggacttaccccgggcgg

SEQ ID NO: 127396 - DNA, 21 bp, Artificial Sequence
  Description of Artificial Sequence: Synthetic oligonucleotide
ggggacttaccccgggcggga

SEQ ID NO: 127397 - DNA, 23 bp, Artificial Sequence
  Description of Artificial Sequence: Synthetic oligonucleotide
gggacttaccccgggcgggagaa

SEQ ID NO: 127398 - DNA, 24 bp, Artificial Sequence
  Description of Artificial Sequence: Synthetic oligonucleotide
ggacttaccccgggcgggagaagt

SEQ ID NO: 127399 - DNA, 24 bp, Artificial Sequence
  Description of Artificial Sequence: Synthetic oligonucleotide
gacttaccccgggcgggagaagtc

SEQ ID NO: 127400 - DNA, 25 bp, Artificial Sequence
  Description of Artificial Sequence: Synthetic oligonucleotide
acttaccccgggcgggagaagtcca

SEQ ID NO: 127401 - DNA, 24 bp, Artificial Sequence
  Description of Artificial Sequence: Synthetic oligonucleotide
cttaccccgggcgggagaagtcca

SEQ ID NO: 127402 - DNA, 25 bp, Artificial Sequence
  Description of Artificial Sequence: Synthetic oligonucleotide
ttaccccgggcgggagaagtccaca

SEQ ID NO: 127403 - DNA, 24 bp, Artificial Sequence
  Description of Artificial Sequence: Synthetic oligonucleotide
taccccgggcgggagaagtccaca

SEQ ID NO: 127404 - DNA, 23 bp, Artificial Sequence
  Description of Artificial Sequence: Synthetic oligonucleotide
accccgggcgggagaagtccaca

SEQ ID NO: 127405 - DNA, 22 bp, Artificial Sequence
  Description of Artificial Sequence: Synthetic oligonucleotide
ccccgggcgggagaagtccaca

SEQ ID NO: 127406 - DNA, 22 bp, Artificial Sequence
  Description of Artificial Sequence: Synthetic oligonucleotide
cccgggcgggagaagtccacac

SEQ ID NO: 127407 - DNA, 22 bp, Artificial Sequence
  Description of Artificial Sequence: Synthetic oligonucleotide
ccgggcgggagaagtccacacc

SEQ ID NO: 127408 - DNA, 22 bp, Artificial Sequence
  Description of Artificial Sequence: Synthetic oligonucleotide
cgggcgggagaagtccacaccg

SEQ ID NO: 127409 - DNA, 22 bp, Artificial Sequence
  Description of Artificial Sequence: Synthetic oligonucleotide
gggcgggagaagtccacaccgg

SEQ ID NO: 127410 - DNA, 23 bp, Artificial Sequence
  Description of Artificial Sequence: Synthetic oligonucleotide
ggcgggagaagtccacaccggga

SEQ ID NO: 127411 - DNA, 23 bp, Artificial Sequence
  Description of Artificial Sequence: Synthetic oligonucleotide
gcgggagaagtccacaccgggac

SEQ ID NO: 127412 - DNA, 24 bp, Artificial Sequence
  Description of Artificial Sequence: Synthetic oligonucleotide
cgggagaagtccacaccgggacca

SEQ ID NO: 127413 - DNA, 24 bp, Artificial Sequence
  Description of Artificial Sequence: Synthetic oligonucleotide
gggagaagtccacaccgggaccac

SEQ ID NO: 127414 - DNA, 26 bp, Artificial Sequence
  Description of Artificial Sequence: Synthetic oligonucleotide
ggagaagtccacaccgggaccaccat

SEQ ID NO: 127415 - DNA, 27 bp, Artificial Sequence
  Description of Artificial Sequence: Synthetic oligonucleotide
gagaagtccacaccgggaccaccatca

SEQ ID NO: 127416 - DNA, 28 bp, Artificial Sequence
  Description of Artificial Sequence: Synthetic oligonucleotide
agaagtccacaccgggaccaccatcatg

SEQ ID NO: 127417 - DNA, 27 bp, Artificial Sequence
  Description of Artificial Sequence: Synthetic oligonucleotide
gaagtccacaccgggaccaccatcatg

SEQ ID NO: 127418 - DNA, 27 bp, Artificial Sequence
  Description of Artificial Sequence: Synthetic oligonucleotide
aagtccacaccgggaccaccatcatgg

SEQ ID NO: 127419 - DNA, 26 bp, Artificial Sequence
  Description of Artificial Sequence: Synthetic oligonucleotide
agtccacaccgggaccaccatcatgg

SEQ ID NO: 127420 - DNA, 25 bp, Artificial Sequence
  Description of Artificial Sequence: Synthetic oligonucleotide
gtccacaccgggaccaccatcatgg

SEQ ID NO: 127421 - DNA, 26 bp, Artificial Sequence
  Description of Artificial Sequence: Synthetic oligonucleotide
tccacaccgggaccaccatcatggca

SEQ ID NO: 127422 - DNA, 25 bp, Artificial Sequence
  Description of Artificial Sequence: Synthetic oligonucleotide
ccacaccgggaccaccatcatggca

SEQ ID NO: 127423 - DNA, 26 bp, Artificial Sequence
  Description of Artificial Sequence: Synthetic oligonucleotide
cacaccgggaccaccatcatggcagt

SEQ ID NO: 127424 - DNA, 26 bp, Artificial Sequence
  Description of Artificial Sequence: Synthetic oligonucleotide
acaccgggaccaccatcatggcagtg

SEQ ID NO: 127425 - DNA, 25 bp, Artificial Sequence
  Description of Artificial Sequence: Synthetic oligonucleotide
caccgggaccaccatcatggcagtg

SEQ ID NO: 127426 - DNA, 26 bp, Artificial Sequence
  Description of Artificial Sequence: Synthetic oligonucleotide
accgggaccaccatcatggcagtgga

SEQ ID NO: 127427 - DNA, 25 bp, Artificial Sequence
  Description of Artificial Sequence: Synthetic oligonucleotide
ccgggaccaccatcatggcagtgga

SEQ ID NO: 127428 - DNA, 27 bp, Artificial Sequence
  Description of Artificial Sequence: Synthetic oligonucleotide
cgggaccaccatcatggcagtggagtt

SEQ ID NO: 127429 - DNA, 28 bp, Artificial Sequence
  Description of Artificial Sequence: Synthetic oligonucleotide
gggaccaccatcatggcagtggagtttg

SEQ ID NO: 127430 - DNA, 29 bp, Artificial Sequence
  Description of Artificial Sequence: Synthetic oligonucleotide
ggaccaccatcatggcagtggagtttgac

SEQ ID NO: 127431 - DNA, 29 bp, Artificial Sequence
  Description of Artificial Sequence: Synthetic oligonucleotide
gaccaccatcatggcagtggagtttgacg

SEQ ID NO: 127432 - DNA, 29 bp, Artificial Sequence
  Description of Artificial Sequence: Synthetic oligonucleotide
accaccatcatggcagtggagtttgacgg

SEQ ID NO: 127433 - DNA, 28 bp, Artificial Sequence
  Description of Artificial Sequence: Synthetic oligonucleotide
ccaccatcatggcagtggagtttgacgg

SEQ ID NO: 127434 - DNA, 28 bp, Artificial Sequence
  Description of Artificial Sequence: Synthetic oligonucleotide
caccatcatggcagtggagtttgacggg

SEQ ID NO: 127435 - DNA, 28 bp, Artificial Sequence
  Description of Artificial Sequence: Synthetic oligonucleotide
accatcatggcagtggagtttgacgggg

SEQ ID NO: 127436 - DNA, 27 bp, Artificial Sequence
  Description of Artificial Sequence: Synthetic oligonucleotide
ccatcatggcagtggagtttgacgggg

SEQ ID NO: 127437 - DNA, 27 bp, Artificial Sequence
  Description of Artificial Sequence: Synthetic oligonucleotide
catcatggcagtggagtttgacggggg

SEQ ID NO: 127438 - DNA, 27 bp, Artificial Sequence
  Description of Artificial Sequence: Synthetic oligonucleotide
atcatggcagtggagtttgacgggggc

SEQ ID NO: 127439 - DNA, 26 bp, Artificial Sequence
  Description of Artificial Sequence: Synthetic oligonucleotide
tcatggcagtggagtttgacgggggc

SEQ ID NO: 127440 - DNA, 25 bp, Artificial Sequence
  Description of Artificial Sequence: Synthetic oligonucleotide
catggcagtggagtttgacgggggc

SEQ ID NO: 127441 - DNA, 27 bp, Artificial Sequence
  Description of Artificial Sequence: Synthetic oligonucleotide
atggcagtggagtttgacgggggcgtt

SEQ ID NO: 127442 - DNA, 26 bp, Artificial Sequence
  Description of Artificial Sequence: Synthetic oligonucleotide
tggcagtggagtttgacgggggcgtt

SEQ ID NO: 127443 - DNA, 25 bp, Artificial Sequence
  Description of Artificial Sequence: Synthetic oligonucleotide
ggcagtggagtttgacgggggcgtt

SEQ ID NO: 127444 - DNA, 26 bp, Artificial Sequence
  Description of Artificial Sequence: Synthetic oligonucleotide
gcagtggagtttgacgggggcgttgt

SEQ ID NO: 127445 - DNA, 27 bp, Artificial Sequence
  Description of Artificial Sequence: Synthetic oligonucleotide
cagtggagtttgacgggggcgttgtga

SEQ ID NO: 127446 - DNA, 28 bp, Artificial Sequence
  Description of Artificial Sequence: Synthetic oligonucleotide
agtggagtttgacgggggcgttgtgatg

SEQ ID NO: 127447 - DNA, 27 bp, Artificial Sequence
  Description of Artificial Sequence: Synthetic oligonucleotide
gtggagtttgacgggggcgttgtgatg

SEQ ID NO: 127448 - DNA, 27 bp, Artificial Sequence
  Description of Artificial Sequence: Synthetic oligonucleotide
tggagtttgacgggggcgttgtgatgg

SEQ ID NO: 127449 - DNA, 26 bp, Artificial Sequence
  Description of Artificial Sequence: Synthetic oligonucleotide
ggagtttgacgggggcgttgtgatgg

SEQ ID NO: 127450 - DNA, 27 bp, Artificial Sequence
  Description of Artificial Sequence: Synthetic oligonucleotide
gagtttgacgggggcgttgtgatgggt

SEQ ID NO: 127451 - DNA, 28 bp, Artificial Sequence
  Description of Artificial Sequence: Synthetic oligonucleotide
agtttgacgggggcgttgtgatgggttc

SEQ ID NO: 127452 - DNA, 27 bp, Artificial Sequence
  Description of Artificial Sequence: Synthetic oligonucleotide
gtttgacgggggcgttgtgatgggttc

SEQ ID NO: 127453 - DNA, 28 bp, Artificial Sequence
  Description of Artificial Sequence: Synthetic oligonucleotide
tttgacgggggcgttgtgatgggttctg

SEQ ID NO: 127454 - DNA, 27 bp, Artificial Sequence
  Description of Artificial Sequence: Synthetic oligonucleotide
ttgacgggggcgttgtgatgggttctg

SEQ ID NO: 127455 - DNA, 27 bp, Artificial Sequence
  Description of Artificial Sequence: Synthetic oligonucleotide
tgacgggggcgttgtgatgggttctga

SEQ ID NO: 127456 - DNA, 27 bp, Artificial Sequence
  Description of Artificial Sequence: Synthetic oligonucleotide
gacgggggcgttgtgatgggttctgat

SEQ ID NO: 127457 - DNA, 28 bp, Artificial Sequence
  Description of Artificial Sequence: Synthetic oligonucleotide
acgggggcgttgtgatgggttctgattc

SEQ ID NO: 127458 - DNA, 27 bp, Artificial Sequence
  Description of Artificial Sequence: Synthetic oligonucleotide
cgggggcgttgtgatgggttctgattc

SEQ ID NO: 127459 - DNA, 27 bp, Artificial Sequence
  Description of Artificial Sequence: Synthetic oligonucleotide
gggggcgttgtgatgggttctgattcc

SEQ ID NO: 127460 - DNA, 27 bp, Artificial Sequence
  Description of Artificial Sequence: Synthetic oligonucleotide
ggggcgttgtgatgggttctgattccc

SEQ ID NO: 127461 - DNA, 27 bp, Artificial Sequence
  Description of Artificial Sequence: Synthetic oligonucleotide
gggcgttgtgatgggttctgattcccg

SEQ ID NO: 127462 - DNA, 28 bp, Artificial Sequence
  Description of Artificial Sequence: Synthetic oligonucleotide
ggcgttgtgatgggttctgattcccgag

SEQ ID NO: 127463 - DNA, 29 bp, Artificial Sequence
  Description of Artificial Sequence: Synthetic oligonucleotide
gcgttgtgatgggttctgattcccgagtg

SEQ ID NO: 127464 - DNA, 30 bp, Artificial Sequence
  Description of Artificial Sequence: Synthetic oligonucleotide
cgttgtgatgggttctgattcccgagtgtc

SEQ ID NO: 127465 - DNA, 31 bp, Artificial Sequence
  Description of Artificial Sequence: Synthetic oligonucleotide
gttgtgatgggttctgattcccgagtgtctg

SEQ ID NO: 127466 - DNA, 31 bp, Artificial Sequence
  Description of Artificial Sequence: Synthetic oligonucleotide
ttgtgatgggttctgattcccgagtgtctgc

SEQ ID NO: 127467 - DNA, 30 bp, Artificial Sequence
  Description of Artificial Sequence: Synthetic oligonucleotide
tgtgatgggttctgattcccgagtgtctgc

SEQ ID NO: 127468 - DNA, 29 bp, Artificial Sequence
  Description of Artificial Sequence: Synthetic oligonucleotide
gtgatgggttctgattcccgagtgtctgc

SEQ ID NO: 127469 - DNA, 30 bp, Artificial Sequence
  Description of Artificial Sequence: Synthetic oligonucleotide
tgatgggttctgattcccgagtgtctgcag

SEQ ID NO: 127470 - DNA, 29 bp, Artificial Sequence
  Description of Artificial Sequence: Synthetic oligonucleotide
gatgggttctgattcccgagtgtctgcag

SEQ ID NO: 127471 - DNA, 29 bp, Artificial Sequence
  Description of Artificial Sequence: Synthetic oligonucleotide
atgggttctgattcccgagtgtctgcagg

SEQ ID NO: 127472 - DNA, 28 bp, Artificial Sequence
  Description of Artificial Sequence: Synthetic oligonucleotide
tgggttctgattcccgagtgtctgcagg

SEQ ID NO: 127473 - DNA, 27 bp, Artificial Sequence
  Description of Artificial Sequence: Synthetic oligonucleotide
gggttctgattcccgagtgtctgcagg

SEQ ID NO: 127474 - DNA, 27 bp, Artificial Sequence
  Description of Artificial Sequence: Synthetic oligonucleotide
ggttctgattcccgagtgtctgcaggc

SEQ ID NO: 127475 - DNA, 27 bp, Artificial Sequence
  Description of Artificial Sequence: Synthetic oligonucleotide
gttctgattcccgagtgtctgcaggcg

SEQ ID NO: 127476 - DNA, 28 bp, Artificial Sequence
  Description of Artificial Sequence: Synthetic oligonucleotide
ttctgattcccgagtgtctgcaggcgag

SEQ ID NO: 127477 - DNA, 27 bp, Artificial Sequence
  Description of Artificial Sequence: Synthetic oligonucleotide
tctgattcccgagtgtctgcaggcgag

SEQ ID NO: 127478 - DNA, 26 bp, Artificial Sequence
  Description of Artificial Sequence: Synthetic oligonucleotide
ctgattcccgagtgtctgcaggcgag

SEQ ID NO: 127479 - DNA, 26 bp, Artificial Sequence
  Description of Artificial Sequence: Synthetic oligonucleotide
tgattcccgagtgtctgcaggcgagg

SEQ ID NO: 127480 - DNA, 25 bp, Artificial Sequence
  Description of Artificial Sequence: Synthetic oligonucleotide
gattcccgagtgtctgcaggcgagg

SEQ ID NO: 127481 - DNA, 25 bp, Artificial Sequence
  Description of Artificial Sequence: Synthetic oligonucleotide
attcccgagtgtctgcaggcgaggc

SEQ ID NO: 127482 - DNA, 24 bp, Artificial Sequence
  Description of Artificial Sequence: Synthetic oligonucleotide
ttcccgagtgtctgcaggcgaggc

SEQ ID NO: 127483 - DNA, 23 bp, Artificial Sequence
  Description of Artificial Sequence: Synthetic oligonucleotide
tcccgagtgtctgcaggcgaggc

SEQ ID NO: 127484 - DNA, 22 bp, Artificial Sequence
  Description of Artificial Sequence: Synthetic oligonucleotide
cccgagtgtctgcaggcgaggc

SEQ ID NO: 127485 - DNA, 22 bp, Artificial Sequence
  Description of Artificial Sequence: Synthetic oligonucleotide
ccgagtgtctgcaggcgaggcg

SEQ ID NO: 127486 - DNA, 23 bp, Artificial Sequence
  Description of Artificial Sequence: Synthetic oligonucleotide
cgagtgtctgcaggcgaggcggt

SEQ ID NO: 127487 - DNA, 23 bp, Artificial Sequence
  Description of Artificial Sequence: Synthetic oligonucleotide
gagtgtctgcaggcgaggcggtg

SEQ ID NO: 127488 - DNA, 24 bp, Artificial Sequence
  Description of Artificial Sequence: Synthetic oligonucleotide
agtgtctgcaggcgaggcggtggt

SEQ ID NO: 127489 - DNA, 23 bp, Artificial Sequence
  Description of Artificial Sequence: Synthetic oligonucleotide
gtgtctgcaggcgaggcggtggt

SEQ ID NO: 127490 - DNA, 25 bp, Artificial Sequence
  Description of Artificial Sequence: Synthetic oligonucleotide
tgtctgcaggcgaggcggtggtgaa

SEQ ID NO: 127491 - DNA, 24 bp, Artificial Sequence
  Description of Artificial Sequence: Synthetic oligonucleotide
gtctgcaggcgaggcggtggtgaa

SEQ ID NO: 127492 - DNA, 24 bp, Artificial Sequence
  Description of Artificial Sequence: Synthetic oligonucleotide
tctgcaggcgaggcggtggtgaac

SEQ ID NO: 127493 - DNA, 23 bp, Artificial Sequence
  Description of Artificial Sequence: Synthetic oligonucleotide
ctgcaggcgaggcggtggtgaac

SEQ ID NO: 127494 - DNA, 23 bp, Artificial Sequence
  Description of Artificial Sequence: Synthetic oligonucleotide
tgcaggcgaggcggtggtgaacc

SEQ ID NO: 127495 - DNA, 22 bp, Artificial Sequence
  Description of Artificial Sequence: Synthetic oligonucleotide
gcaggcgaggcggtggtgaacc

SEQ ID NO: 127496 - DNA, 23 bp, Artificial Sequence
  Description of Artificial Sequence: Synthetic oligonucleotide
caggcgaggcggtggtgaaccga

SEQ ID NO: 127497 - DNA, 24 bp, Artificial Sequence
  Description of Artificial Sequence: Synthetic oligonucleotide
aggcgaggcggtggtgaaccgagt

SEQ ID NO: 127498 - DNA, 23 bp, Artificial Sequence
  Description of Artificial Sequence: Synthetic oligonucleotide
ggcgaggcggtggtgaaccgagt

SEQ ID NO: 127499 - DNA, 26 bp, Artificial Sequence
  Description of Artificial Sequence: Synthetic oligonucleotide
gcgaggcggtggtgaaccgagtgttt

SEQ ID NO: 127500 - DNA, 27 bp, Artificial Sequence
  Description of Artificial Sequence: Synthetic oligonucleotide
cgaggcggtggtgaaccgagtgtttga

SEQ ID NO: 127501 - DNA, 27 bp, Artificial Sequence
  Description of Artificial Sequence: Synthetic oligonucleotide
gaggcggtggtgaaccgagtgtttgac

SEQ ID NO: 127502 - DNA, 29 bp, Artificial Sequence
  Description of Artificial Sequence: Synthetic oligonucleotide
aggcggtggtgaaccgagtgtttgacaag

SEQ ID NO: 127503 - DNA, 28 bp, Artificial Sequence
  Description of Artificial Sequence: Synthetic oligonucleotide
ggcggtggtgaaccgagtgtttgacaag

SEQ ID NO: 127504 - DNA, 28 bp, Artificial Sequence
  Description of Artificial Sequence: Synthetic oligonucleotide
gcggtggtgaaccgagtgtttgacaagc

SEQ ID NO: 127505 - DNA, 29 bp, Artificial Sequence
  Description of Artificial Sequence: Synthetic oligonucleotide
cggtggtgaaccgagtgtttgacaagctg

SEQ ID NO: 127506 - DNA, 30 bp, Artificial Sequence
  Description of Artificial Sequence: Synthetic oligonucleotide
ggtggtgaaccgagtgtttgacaagctgtc

SEQ ID NO: 127507 - DNA, 30 bp, Artificial Sequence
  Description of Artificial Sequence: Synthetic oligonucleotide
gtggtgaaccgagtgtttgacaagctgtcc

SEQ ID NO: 127508 - DNA, 30 bp, Artificial Sequence
  Description of Artificial Sequence: Synthetic oligonucleotide
tggtgaaccgagtgtttgacaagctgtccc

SEQ ID NO: 127509 - DNA, 29 bp, Artificial Sequence
  Description of Artificial Sequence: Synthetic oligonucleotide
ggtgaaccgagtgtttgacaagctgtccc

SEQ ID NO: 127510 - DNA, 29 bp, Artificial Sequence
  Description of Artificial Sequence: Synthetic oligonucleotide
gtgaaccgagtgtttgacaagctgtcccc

SEQ ID NO: 127511 - DNA, 29 bp, Artificial Sequence
  Description of Artificial Sequence: Synthetic oligonucleotide
tgaaccgagtgtttgacaagctgtccccg

SEQ ID NO: 127512 - DNA, 28 bp, Artificial Sequence
  Description of Artificial Sequence: Synthetic oligonucleotide
gaaccgagtgtttgacaagctgtccccg

SEQ ID NO: 127513 - DNA, 28 bp, Artificial Sequence
  Description of Artificial Sequence: Synthetic oligonucleotide
aaccgagtgtttgacaagctgtccccgc

SEQ ID NO: 127514 - DNA, 27 bp, Artificial Sequence
  Description of Artificial Sequence: Synthetic oligonucleotide
accgagtgtttgacaagctgtccccgc

SEQ ID NO: 127515 - DNA, 27 bp, Artificial Sequence
  Description of Artificial Sequence: Synthetic oligonucleotide
ccgagtgtttgacaagctgtccccgct

SEQ ID NO: 127516 - DNA, 27 bp, Artificial Sequence
  Description of Artificial Sequence: Synthetic oligonucleotide
cgagtgtttgacaagctgtccccgctg

SEQ ID NO: 127517 - DNA, 27 bp, Artificial Sequence
  Description of Artificial Sequence: Synthetic oligonucleotide
gagtgtttgacaagctgtccccgctgc

SEQ ID NO: 127518 - DNA, 28 bp, Artificial Sequence
  Description of Artificial Sequence: Synthetic oligonucleotide
agtgtttgacaagctgtccccgctgcac

SEQ ID NO: 127519 - DNA, 27 bp, Artificial Sequence
  Description of Artificial Sequence: Synthetic oligonucleotide
gtgtttgacaagctgtccccgctgcac

SEQ ID NO: 127520 - DNA, 27 bp, Artificial Sequence
  Description of Artificial Sequence: Synthetic oligonucleotide
tgtttgacaagctgtccccgctgcacg

SEQ ID NO: 127521 - DNA, 27 bp, Artificial Sequence
  Description of Artificial Sequence: Synthetic oligonucleotide
gtttgacaagctgtccccgctgcacga

SEQ ID NO: 127522 - DNA, 27 bp, Artificial Sequence
  Description of Artificial Sequence: Synthetic oligonucleotide
tttgacaagctgtccccgctgcacgag

SEQ ID NO: 127523 - DNA, 26 bp, Artificial Sequence
  Description of Artificial Sequence: Synthetic oligonucleotide
ttgacaagctgtccccgctgcacgag

SEQ ID NO: 127524 - DNA, 25 bp, Artificial Sequence
  Description of Artificial Sequence: Synthetic oligonucleotide
tgacaagctgtccccgctgcacgag

SEQ ID NO: 127525 - DNA, 24 bp, Artificial Sequence
  Description of Artificial Sequence: Synthetic oligonucleotide
gacaagctgtccccgctgcacgag

SEQ ID NO: 127526 - DNA, 24 bp, Artificial Sequence
  Description of Artificial Sequence: Synthetic oligonucleotide
acaagctgtccccgctgcacgagc

SEQ ID NO: 127527 - DNA, 23 bp, Artificial Sequence
  Description of Artificial Sequence: Synthetic oligonucleotide
caagctgtccccgctgcacgagc

SEQ ID NO: 127528 - DNA, 23 bp, Artificial Sequence
  Description of Artificial Sequence: Synthetic oligonucleotide
aagctgtccccgctgcacgagcg

SEQ ID NO: 127529 - DNA, 22 bp, Artificial Sequence
  Description of Artificial Sequence: Synthetic oligonucleotide
agctgtccccgctgcacgagcg

SEQ ID NO: 127530 - DNA, 21 bp, Artificial Sequence
  Description of Artificial Sequence: Synthetic oligonucleotide
gctgtccccgctgcacgagcg

SEQ ID NO: 127531 - DNA, 23 bp, Artificial Sequence
  Description of Artificial Sequence: Synthetic oligonucleotide
ctgtccccgctgcacgagcgcat

SEQ ID NO: 127532 - DNA, 25 bp, Artificial Sequence
  Description of Artificial Sequence: Synthetic oligonucleotide
tgtccccgctgcacgagcgcatcta

SEQ ID NO: 127533 - DNA, 24 bp, Artificial Sequence
  Description of Artificial Sequence: Synthetic oligonucleotide
gtccccgctgcacgagcgcatcta

SEQ ID NO: 127534 - DNA, 25 bp, Artificial Sequence
  Description of Artificial Sequence: Synthetic oligonucleotide
tccccgctgcacgagcgcatctact

SEQ ID NO: 127535 - DNA, 24 bp, Artificial Sequence
  Description of Artificial Sequence: Synthetic oligonucleotide
ccccgctgcacgagcgcatctact

SEQ ID NO: 127536 - DNA, 25 bp, Artificial Sequence
  Description of Artificial Sequence: Synthetic oligonucleotide
cccgctgcacgagcgcatctactgt

SEQ ID NO: 127537 - DNA, 25 bp, Artificial Sequence
  Description of Artificial Sequence: Synthetic oligonucleotide
ccgctgcacgagcgcatctactgtg

SEQ ID NO: 127538 - DNA, 26 bp, Artificial Sequence
  Description of Artificial Sequence: Synthetic oligonucleotide
cgctgcacgagcgcatctactgtgca

SEQ ID NO: 127539 - DNA, 27 bp, Artificial Sequence
  Description of Artificial Sequence: Synthetic oligonucleotide
gctgcacgagcgcatctactgtgcact

SEQ ID NO: 127540 - DNA, 27 bp, Artificial Sequence
  Description of Artificial Sequence: Synthetic oligonucleotide
ctgcacgagcgcatctactgtgcactc

SEQ ID NO: 127541 - DNA, 28 bp, Artificial Sequence
  Description of Artificial Sequence: Synthetic oligonucleotide
tgcacgagcgcatctactgtgcactctc

SEQ ID NO: 127542 - DNA, 27 bp, Artificial Sequence
  Description of Artificial Sequence: Synthetic oligonucleotide
gcacgagcgcatctactgtgcactctc

SEQ ID NO: 127543 - DNA, 28 bp, Artificial Sequence
  Description of Artificial Sequence: Synthetic oligonucleotide
cacgagcgcatctactgtgcactctctg

SEQ ID NO: 127544 - DNA, 28 bp, Artificial Sequence
  Description of Artificial Sequence: Synthetic oligonucleotide
acgagcgcatctactgtgcactctctgg

SEQ ID NO: 127545 - DNA, 27 bp, Artificial Sequence
  Description of Artificial Sequence: Synthetic oligonucleotide
cgagcgcatctactgtgcactctctgg

SEQ ID NO: 127546 - DNA, 29 bp, Artificial Sequence
  Description of Artificial Sequence: Synthetic oligonucleotide
gagcgcatctactgtgcactctctggttc

SEQ ID NO: 127547 - DNA, 30 bp, Artificial Sequence
  Description of Artificial Sequence: Synthetic oligonucleotide
agcgcatctactgtgcactctctggttcag

SEQ ID NO: 127548 - DNA, 29 bp, Artificial Sequence
  Description of Artificial Sequence: Synthetic oligonucleotide
gcgcatctactgtgcactctctggttcag

SEQ ID NO: 127549 - DNA, 29 bp, Artificial Sequence
  Description of Artificial Sequence: Synthetic oligonucleotide
cgcatctactgtgcactctctggttcagc

SEQ ID NO: 127550 - DNA, 30 bp, Artificial Sequence
  Description of Artificial Sequence: Synthetic oligonucleotide
gcatctactgtgcactctctggttcagctg

SEQ ID NO: 127551 - DNA, 30 bp, Artificial Sequence
  Description of Artificial Sequence: Synthetic oligonucleotide
catctactgtgcactctctggttcagctgc

SEQ ID NO: 127552 - DNA, 31 bp, Artificial Sequence
  Description of Artificial Sequence: Synthetic oligonucleotide
atctactgtgcactctctggttcagctgctg

SEQ ID NO: 127553 - DNA, 30 bp, Artificial Sequence
  Description of Artificial Sequence: Synthetic oligonucleotide
tctactgtgcactctctggttcagctgctg

SEQ ID NO: 127554 - DNA, 29 bp, Artificial Sequence
  Description of Artificial Sequence: Synthetic oligonucleotide
ctactgtgcactctctggttcagctgctg

SEQ ID NO: 127555 - DNA, 31 bp, Artificial Sequence
  Description of Artificial Sequence: Synthetic oligonucleotide
tactgtgcactctctggttcagctgctgatg

SEQ ID NO: 127556 - DNA, 30 bp, Artificial Sequence
  Description of Artificial Sequence: Synthetic oligonucleotide
actgtgcactctctggttcagctgctgatg

SEQ ID NO: 127557 - DNA, 29 bp, Artificial Sequence
  Description of Artificial Sequence: Synthetic oligonucleotide
ctgtgcactctctggttcagctgctgatg

SEQ ID NO: 127558 - DNA, 29 bp, Artificial Sequence
  Description of Artificial Sequence: Synthetic oligonucleotide
tgtgcactctctggttcagctgctgatgc

SEQ ID NO: 127559 - DNA, 28 bp, Artificial Sequence
  Description of Artificial Sequence: Synthetic oligonucleotide
gtgcactctctggttcagctgctgatgc

SEQ ID NO: 127560 - DNA, 28 bp, Artificial Sequence
  Description of Artificial Sequence: Synthetic oligonucleotide
tgcactctctggttcagctgctgatgcc

SEQ ID NO: 127561 - DNA, 27 bp, Artificial Sequence
  Description of Artificial Sequence: Synthetic oligonucleotide
gcactctctggttcagctgctgatgcc

SEQ ID NO: 127562 - DNA, 27 bp, Artificial Sequence
  Description of Artificial Sequence: Synthetic oligonucleotide
cactctctggttcagctgctgatgccc

SEQ ID NO: 127563 - DNA, 29 bp, Artificial Sequence
  Description of Artificial Sequence: Synthetic oligonucleotide
actctctggttcagctgctgatgcccaag

SEQ ID NO: 127564 - DNA, 28 bp, Artificial Sequence
  Description of Artificial Sequence: Synthetic oligonucleotide
ctctctggttcagctgctgatgcccaag

SEQ ID NO: 127565 - DNA, 28 bp, Artificial Sequence
  Description of Artificial Sequence: Synthetic oligonucleotide
tctctggttcagctgctgatgcccaagc

SEQ ID NO: 127566 - DNA, 27 bp, Artificial Sequence
  Description of Artificial Sequence: Synthetic oligonucleotide
ctctggttcagctgctgatgcccaagc

SEQ ID NO: 127567 - DNA, 27 bp, Artificial Sequence
  Description of Artificial Sequence: Synthetic oligonucleotide
tctggttcagctgctgatgcccaagcc

SEQ ID NO: 127568 - DNA, 26 bp, Artificial Sequence
  Description of Artificial Sequence: Synthetic oligonucleotide
ctggttcagctgctgatgcccaagcc

SEQ ID NO: 127569 - DNA, 27 bp, Artificial Sequence
  Description of Artificial Sequence: Synthetic oligonucleotide
tggttcagctgctgatgcccaagccgt

SEQ ID NO: 127570 - DNA, 26 bp, Artificial Sequence
  Description of Artificial Sequence: Synthetic oligonucleotide
ggttcagctgctgatgcccaagccgt

SEQ ID NO: 127571 - DNA, 26 bp, Artificial Sequence
  Description of Artificial Sequence: Synthetic oligonucleotide
gttcagctgctgatgcccaagccgtg

SEQ ID NO: 127572 - DNA, 26 bp, Artificial Sequence
  Description of Artificial Sequence: Synthetic oligonucleotide
ttcagctgctgatgcccaagccgtgg

SEQ ID NO: 127573 - DNA, 25 bp, Artificial Sequence
  Description of Artificial Sequence: Synthetic oligonucleotide
tcagctgctgatgcccaagccgtgg

SEQ ID NO: 127574 - DNA, 24 bp, Artificial Sequence
  Description of Artificial Sequence: Synthetic oligonucleotide
cagctgctgatgcccaagccgtgg

SEQ ID NO: 127575 - DNA, 24 bp, Artificial Sequence
  Description of Artificial Sequence: Synthetic oligonucleotide
agctgctgatgcccaagccgtggc

SEQ ID NO: 127576 - DNA, 23 bp, Artificial Sequence
  Description of Artificial Sequence: Synthetic oligonucleotide
gctgctgatgcccaagccgtggc

SEQ ID NO: 127577 - DNA, 23 bp, Artificial Sequence
  Description of Artificial Sequence: Synthetic oligonucleotide
ctgctgatgcccaagccgtggcc

SEQ ID NO: 127578 - DNA, 24 bp, Artificial Sequence
  Description of Artificial Sequence: Synthetic oligonucleotide
tgctgatgcccaagccgtggccga

SEQ ID NO: 127579 - DNA, 23 bp, Artificial Sequence
  Description of Artificial Sequence: Synthetic oligonucleotide
gctgatgcccaagccgtggccga

SEQ ID NO: 127580 - DNA, 25 bp, Artificial Sequence
  Description of Artificial Sequence: Synthetic oligonucleotide
ctgatgcccaagccgtggccgacat

SEQ ID NO: 127581 - DNA, 25 bp, Artificial Sequence
  Description of Artificial Sequence: Synthetic oligonucleotide
tgatgcccaagccgtggccgacatg

SEQ ID NO: 127582 - DNA, 24 bp, Artificial Sequence
  Description of Artificial Sequence: Synthetic oligonucleotide
gatgcccaagccgtggccgacatg

SEQ ID NO: 127583 - DNA, 24 bp, Artificial Sequence
  Description of Artificial Sequence: Synthetic oligonucleotide
atgcccaagccgtggccgacatgg

SEQ ID NO: 127584 - DNA, 23 bp, Artificial Sequence
  Description of Artificial Sequence: Synthetic oligonucleotide
tgcccaagccgtggccgacatgg

SEQ ID NO: 127585 - DNA, 22 bp, Artificial Sequence
  Description of Artificial Sequence: Synthetic oligonucleotide
gcccaagccgtggccgacatgg

SEQ ID NO: 127586 - DNA, 22 bp, Artificial Sequence
  Description of Artificial Sequence: Synthetic oligonucleotide
cccaagccgtggccgacatggc

SEQ ID NO: 127587 - DNA, 22 bp, Artificial Sequence
  Description of Artificial Sequence: Synthetic oligonucleotide
ccaagccgtggccgacatggcc

SEQ ID NO: 127588 - DNA, 22 bp, Artificial Sequence
  Description of Artificial Sequence: Synthetic oligonucleotide
caagccgtggccgacatggccg

SEQ ID NO: 127589 - DNA, 22 bp, Artificial Sequence
  Description of Artificial Sequence: Synthetic oligonucleotide
aagccgtggccgacatggccgc

SEQ ID NO: 127590 - DNA, 21 bp, Artificial Sequence
  Description of Artificial Sequence: Synthetic oligonucleotide
agccgtggccgacatggccgc

SEQ ID NO: 127591 - DNA, 20 bp, Artificial Sequence
  Description of Artificial Sequence: Synthetic oligonucleotide
gccgtggccgacatggccgc

SEQ ID NO: 127592 - DNA, 22 bp, Artificial Sequence
  Description of Artificial Sequence: Synthetic oligonucleotide
ccgtggccgacatggccgccta

SEQ ID NO: 127593 - DNA, 22 bp, Artificial Sequence
  Description of Artificial Sequence: Synthetic oligonucleotide
cgtggccgacatggccgcctac

SEQ ID NO: 127594 - DNA, 23 bp, Artificial Sequence
  Description of Artificial Sequence: Synthetic oligonucleotide
gtggccgacatggccgcctacca

SEQ ID NO: 127595 - DNA, 23 bp, Artificial Sequence
  Description of Artificial Sequence: Synthetic oligonucleotide
tggccgacatggccgcctaccag

SEQ ID NO: 127596 - DNA, 22 bp, Artificial Sequence
  Description of Artificial Sequence: Synthetic oligonucleotide
ggccgacatggccgcctaccag

SEQ ID NO: 127597 - DNA, 23 bp, Artificial Sequence
  Description of Artificial Sequence: Synthetic oligonucleotide
gccgacatggccgcctaccagct

SEQ ID NO: 127598 - DNA, 23 bp, Artificial Sequence
  Description of Artificial Sequence: Synthetic oligonucleotide
ccgacatggccgcctaccagctg

SEQ ID NO: 127599 - DNA, 24 bp, Artificial Sequence
  Description of Artificial Sequence: Synthetic oligonucleotide
cgacatggccgcctaccagctgga

SEQ ID NO: 127600 - DNA, 24 bp, Artificial Sequence
  Description of Artificial Sequence: Synthetic oligonucleotide
gacatggccgcctaccagctggag

SEQ ID NO: 127601 - DNA, 25 bp, Artificial Sequence
  Description of Artificial Sequence: Synthetic oligonucleotide
acatggccgcctaccagctggagct

SEQ ID NO: 127602 - DNA, 24 bp, Artificial Sequence
  Description of Artificial Sequence: Synthetic oligonucleotide
catggccgcctaccagctggagct

SEQ ID NO: 127603 - DNA, 24 bp, Artificial Sequence
  Description of Artificial Sequence: Synthetic oligonucleotide
atggccgcctaccagctggagctc

SEQ ID NO: 127604 - DNA, 23 bp, Artificial Sequence
  Description of Artificial Sequence: Synthetic oligonucleotide
tggccgcctaccagctggagctc

SEQ ID NO: 127605 - DNA, 22 bp, Artificial Sequence
  Description of Artificial Sequence: Synthetic oligonucleotide
ggccgcctaccagctggagctc

SEQ ID NO: 127606 - DNA, 24 bp, Artificial Sequence
  Description of Artificial Sequence: Synthetic oligonucleotide
gccgcctaccagctggagctccat

SEQ ID NO: 127607 - DNA, 24 bp, Artificial Sequence
  Description of Artificial Sequence: Synthetic oligonucleotide
ccgcctaccagctggagctccatg

SEQ ID NO: 127608 - DNA, 24 bp, Artificial Sequence
  Description of Artificial Sequence: Synthetic oligonucleotide
cgcctaccagctggagctccatgg

SEQ ID NO: 127609 - DNA, 27 bp, Artificial Sequence
  Description of Artificial Sequence: Synthetic oligonucleotide
gcctaccagctggagctccatgggata

SEQ ID NO: 127610 - DNA, 27 bp, Artificial Sequence
  Description of Artificial Sequence: Synthetic oligonucleotide
cctaccagctggagctccatgggatag

SEQ ID NO: 127611 - DNA, 29 bp, Artificial Sequence
  Description of Artificial Sequence: Synthetic oligonucleotide
ctaccagctggagctccatgggatagaac

SEQ ID NO: 127612 - DNA, 30 bp, Artificial Sequence
  Description of Artificial Sequence: Synthetic oligonucleotide
taccagctggagctccatgggatagaactg

SEQ ID NO: 127613 - DNA, 29 bp, Artificial Sequence
  Description of Artificial Sequence: Synthetic oligonucleotide
accagctggagctccatgggatagaactg

SEQ ID NO: 127614 - DNA, 28 bp, Artificial Sequence
  Description of Artificial Sequence: Synthetic oligonucleotide
ccagctggagctccatgggatagaactg

SEQ ID NO: 127615 - DNA, 28 bp, Artificial Sequence
  Description of Artificial Sequence: Synthetic oligonucleotide
cagctggagctccatgggatagaactgg

SEQ ID NO: 127616 - DNA, 29 bp, Artificial Sequence
  Description of Artificial Sequence: Synthetic oligonucleotide
agctggagctccatgggatagaactggag

SEQ ID NO: 127617 - DNA, 28 bp, Artificial Sequence
  Description of Artificial Sequence: Synthetic oligonucleotide
gctggagctccatgggatagaactggag

SEQ ID NO: 127618 - DNA, 28 bp, Artificial Sequence
  Description of Artificial Sequence: Synthetic oligonucleotide
ctggagctccatgggatagaactggagg

SEQ ID NO: 127619 - DNA, 30 bp, Artificial Sequence
  Description of Artificial Sequence: Synthetic oligonucleotide
tggagctccatgggatagaactggaggaac

SEQ ID NO: 127620 - DNA, 29 bp, Artificial Sequence
  Description of Artificial Sequence: Synthetic oligonucleotide
ggagctccatgggatagaactggaggaac

SEQ ID NO: 127621 - DNA, 29 bp, Artificial Sequence
  Description of Artificial Sequence: Synthetic oligonucleotide
gagctccatgggatagaactggaggaacc

SEQ ID NO: 127622 - DNA, 30 bp, Artificial Sequence
  Description of Artificial Sequence: Synthetic oligonucleotide
agctccatgggatagaactggaggaacctc

SEQ ID NO: 127623 - DNA, 29 bp, Artificial Sequence
  Description of Artificial Sequence: Synthetic oligonucleotide
gctccatgggatagaactggaggaacctc

SEQ ID NO: 127624 - DNA, 29 bp, Artificial Sequence
  Description of Artificial Sequence: Synthetic oligonucleotide
ctccatgggatagaactggaggaacctcc

SEQ ID NO: 127625 - DNA, 30 bp, Artificial Sequence
  Description of Artificial Sequence: Synthetic oligonucleotide
tccatgggatagaactggaggaacctccac

SEQ ID NO: 127626 - DNA, 29 bp, Artificial Sequence
  Description of Artificial Sequence: Synthetic oligonucleotide
ccatgggatagaactggaggaacctccac

SEQ ID NO: 127627 - DNA, 31 bp, Artificial Sequence
  Description of Artificial Sequence: Synthetic oligonucleotide
catgggatagaactggaggaacctccacttg

SEQ ID NO: 127628 - DNA, 35 bp, Artificial Sequence
  Description of Artificial Sequence: Synthetic oligonucleotide
atgggatagaactggaggaacctccacttgttttg

SEQ ID NO: 127629 - DNA, 34 bp, Artificial Sequence
  Description of Artificial Sequence: Synthetic oligonucleotide
tgggatagaactggaggaacctccacttgttttg

SEQ ID NO: 127630 - DNA, 33 bp, Artificial Sequence
  Description of Artificial Sequence: Synthetic oligonucleotide
gggatagaactggaggaacctccacttgttttg

SEQ ID NO: 127631 - DNA, 33 bp, Artificial Sequence
  Description of Artificial Sequence: Synthetic oligonucleotide
ggatagaactggaggaacctccacttgttttgg

SEQ ID NO: 127632 - DNA, 33 bp, Artificial Sequence
  Description of Artificial Sequence: Synthetic oligonucleotide
gatagaactggaggaacctccacttgttttggc

SEQ ID NO: 127633 - DNA, 34 bp, Artificial Sequence
  Description of Artificial Sequence: Synthetic oligonucleotide
atagaactggaggaacctccacttgttttggctg

SEQ ID NO: 127634 - DNA, 33 bp, Artificial Sequence
  Description of Artificial Sequence: Synthetic oligonucleotide
tagaactggaggaacctccacttgttttggctg

SEQ ID NO: 127635 - DNA, 32 bp, Artificial Sequence
  Description of Artificial Sequence: Synthetic oligonucleotide
agaactggaggaacctccacttgttttggctg

SEQ ID NO: 127636 - DNA, 31 bp, Artificial Sequence
  Description of Artificial Sequence: Synthetic oligonucleotide
gaactggaggaacctccacttgttttggctg

SEQ ID NO: 127637 - DNA, 31 bp, Artificial Sequence
  Description of Artificial Sequence: Synthetic oligonucleotide
aactggaggaacctccacttgttttggctgc

SEQ ID NO: 127638 - DNA, 30 bp, Artificial Sequence
  Description of Artificial Sequence: Synthetic oligonucleotide
actggaggaacctccacttgttttggctgc

SEQ ID NO: 127639 - DNA, 29 bp, Artificial Sequence
  Description of Artificial Sequence: Synthetic oligonucleotide
ctggaggaacctccacttgttttggctgc

SEQ ID NO: 127640 - DNA, 30 bp, Artificial Sequence
  Description of Artificial Sequence: Synthetic oligonucleotide
tggaggaacctccacttgttttggctgctg

SEQ ID NO: 127641 - DNA, 29 bp, Artificial Sequence
  Description of Artificial Sequence: Synthetic oligonucleotide
ggaggaacctccacttgttttggctgctg

SEQ ID NO: 127642 - DNA, 29 bp, Artificial Sequence
  Description of Artificial Sequence: Synthetic oligonucleotide
gaggaacctccacttgttttggctgctgc

SEQ ID NO: 127643 - DNA, 33 bp, Artificial Sequence
  Description of Artificial Sequence: Synthetic oligonucleotide
aggaacctccacttgttttggctgctgcaaatg

SEQ ID NO: 127644 - DNA, 32 bp, Artificial Sequence
  Description of Artificial Sequence: Synthetic oligonucleotide
ggaacctccacttgttttggctgctgcaaatg

SEQ ID NO: 127645 - DNA, 33 bp, Artificial Sequence
  Description of Artificial Sequence: Synthetic oligonucleotide
gaacctccacttgttttggctgctgcaaatgtg

SEQ ID NO: 127646 - DNA, 33 bp, Artificial Sequence
  Description of Artificial Sequence: Synthetic oligonucleotide
aacctccacttgttttggctgctgcaaatgtgg

SEQ ID NO: 127647 - DNA, 32 bp, Artificial Sequence
  Description of Artificial Sequence: Synthetic oligonucleotide
acctccacttgttttggctgctgcaaatgtgg

SEQ ID NO: 127648 - DNA, 31 bp, Artificial Sequence
  Description of Artificial Sequence: Synthetic oligonucleotide
cctccacttgttttggctgctgcaaatgtgg

SEQ ID NO: 127649 - DNA, 32 bp, Artificial Sequence
  Description of Artificial Sequence: Synthetic oligonucleotide
ctccacttgttttggctgctgcaaatgtggtg

SEQ ID NO: 127650 - DNA, 33 bp, Artificial Sequence
  Description of Artificial Sequence: Synthetic oligonucleotide
tccacttgttttggctgctgcaaatgtggtgag

SEQ ID NO: 127651 - DNA, 32 bp, Artificial Sequence
  Description of Artificial Sequence: Synthetic oligonucleotide
ccacttgttttggctgctgcaaatgtggtgag

SEQ ID NO: 127652 - DNA, 38 bp, Artificial Sequence
  Description of Artificial Sequence: Synthetic oligonucleotide
cacttgttttggctgctgcaaatgtggtgagaaatatc

SEQ ID NO: 127653 - DNA, 39 bp, Artificial Sequence
  Description of Artificial Sequence: Synthetic oligonucleotide
acttgttttggctgctgcaaatgtggtgagaaatatcag

SEQ ID NO: 127654 - DNA, 38 bp, Artificial Sequence
  Description of Artificial Sequence: Synthetic oligonucleotide
cttgttttggctgctgcaaatgtggtgagaaatatcag

SEQ ID NO: 127655 - DNA, 38 bp, Artificial Sequence
  Description of Artificial Sequence: Synthetic oligonucleotide
ttgttttggctgctgcaaatgtggtgagaaatatcagc

SEQ ID NO: 127656 - DNA, 37 bp, Artificial Sequence
  Description of Artificial Sequence: Synthetic oligonucleotide
tgttttggctgctgcaaatgtggtgagaaatatcagc

SEQ ID NO: 127657 - DNA, 36 bp, Artificial Sequence
  Description of Artificial Sequence: Synthetic oligonucleotide
gttttggctgctgcaaatgtggtgagaaatatcagc

SEQ ID NO: 127658 - DNA, 45 bp, Artificial Sequence
  Description of Artificial Sequence: Synthetic oligonucleotide
ttttggctgctgcaaatgtggtgagaaatatcagctataaatatc

SEQ ID NO: 127659 - DNA, 44 bp, Artificial Sequence
  Description of Artificial Sequence: Synthetic oligonucleotide
tttggctgctgcaaatgtggtgagaaatatcagctataaatatc

SEQ ID NO: 127660 - DNA, 43 bp, Artificial Sequence
  Description of Artificial Sequence: Synthetic oligonucleotide
ttggctgctgcaaatgtggtgagaaatatcagctataaatatc

SEQ ID NO: 127661 - DNA, 42 bp, Artificial Sequence
  Description of Artificial Sequence: Synthetic oligonucleotide
tggctgctgcaaatgtggtgagaaatatcagctataaatatc

SEQ ID NO: 127662 - DNA, 41 bp, Artificial Sequence
  Description of Artificial Sequence: Synthetic oligonucleotide
ggctgctgcaaatgtggtgagaaatatcagctataaatatc

SEQ ID NO: 127663 - DNA, 41 bp, Artificial Sequence
  Description of Artificial Sequence: Synthetic oligonucleotide
gctgctgcaaatgtggtgagaaatatcagctataaatatcg

SEQ ID NO: 127664 - DNA, 42 bp, Artificial Sequence
  Description of Artificial Sequence: Synthetic oligonucleotide
ctgctgcaaatgtggtgagaaatatcagctataaatatcgag

SEQ ID NO: 127665 - DNA, 43 bp, Artificial Sequence
  Description of Artificial Sequence: Synthetic oligonucleotide
tgctgcaaatgtggtgagaaatatcagctataaatatcgagag

SEQ ID NO: 127666 - DNA, 42 bp, Artificial Sequence
  Description of Artificial Sequence: Synthetic oligonucleotide
gctgcaaatgtggtgagaaatatcagctataaatatcgagag

SEQ ID NO: 127667 - DNA, 42 bp, Artificial Sequence
  Description of Artificial Sequence: Synthetic oligonucleotide
ctgcaaatgtggtgagaaatatcagctataaatatcgagagg

SEQ ID NO: 127668 - DNA, 43 bp, Artificial Sequence
  Description of Artificial Sequence: Synthetic oligonucleotide
tgcaaatgtggtgagaaatatcagctataaatatcgagaggac

SEQ ID NO: 127669 - DNA, 42 bp, Artificial Sequence
  Description of Artificial Sequence: Synthetic oligonucleotide
gcaaatgtggtgagaaatatcagctataaatatcgagaggac

SEQ ID NO: 127670 - DNA, 44 bp, Artificial Sequence
  Description of Artificial Sequence: Synthetic oligonucleotide
caaatgtggtgagaaatatcagctataaatatcgagaggacttg

SEQ ID NO: 127671 - DNA, 45 bp, Artificial Sequence
  Description of Artificial Sequence: Synthetic oligonucleotide
aaatgtggtgagaaatatcagctataaatatcgagaggacttgtc

SEQ ID NO: 127672 - DNA, 44 bp, Artificial Sequence
  Description of Artificial Sequence: Synthetic oligonucleotide
aatgtggtgagaaatatcagctataaatatcgagaggacttgtc

SEQ ID NO: 127673 - DNA, 43 bp, Artificial Sequence
  Description of Artificial Sequence: Synthetic oligonucleotide
atgtggtgagaaatatcagctataaatatcgagaggacttgtc

SEQ ID NO: 127674 - DNA, 42 bp, Artificial Sequence
  Description of Artificial Sequence: Synthetic oligonucleotide
tgtggtgagaaatatcagctataaatatcgagaggacttgtc

SEQ ID NO: 127675 - DNA, 41 bp, Artificial Sequence
  Description of Artificial Sequence: Synthetic oligonucleotide
gtggtgagaaatatcagctataaatatcgagaggacttgtc

SEQ ID NO: 127676 - DNA, 42 bp, Artificial Sequence
  Description of Artificial Sequence: Synthetic oligonucleotide
tggtgagaaatatcagctataaatatcgagaggacttgtctg

SEQ ID NO: 127677 - DNA, 41 bp, Artificial Sequence
  Description of Artificial Sequence: Synthetic oligonucleotide
ggtgagaaatatcagctataaatatcgagaggacttgtctg

SEQ ID NO: 127678 - DNA, 41 bp, Artificial Sequence
  Description of Artificial Sequence: Synthetic oligonucleotide
gtgagaaatatcagctataaatatcgagaggacttgtctgc

SEQ ID NO: 127679 - DNA, 42 bp, Artificial Sequence
  Description of Artificial Sequence: Synthetic oligonucleotide
tgagaaatatcagctataaatatcgagaggacttgtctgcac

SEQ ID NO: 127680 - DNA, 41 bp, Artificial Sequence
  Description of Artificial Sequence: Synthetic oligonucleotide
gagaaatatcagctataaatatcgagaggacttgtctgcac

SEQ ID NO: 127681 - DNA, 43 bp, Artificial Sequence
  Description of Artificial Sequence: Synthetic oligonucleotide
agaaatatcagctataaatatcgagaggacttgtctgcacatc

SEQ ID NO: 127682 - DNA, 42 bp, Artificial Sequence
  Description of Artificial Sequence: Synthetic oligonucleotide
gaaatatcagctataaatatcgagaggacttgtctgcacatc

SEQ ID NO: 127683 - DNA, 43 bp, Artificial Sequence
  Description of Artificial Sequence: Synthetic oligonucleotide
aaatatcagctataaatatcgagaggacttgtctgcacatctc

SEQ ID NO: 127684 - DNA, 42 bp, Artificial Sequence
  Description of Artificial Sequence: Synthetic oligonucleotide
aatatcagctataaatatcgagaggacttgtctgcacatctc

SEQ ID NO: 127685 - DNA, 41 bp, Artificial Sequence
  Description of Artificial Sequence: Synthetic oligonucleotide
atatcagctataaatatcgagaggacttgtctgcacatctc

SEQ ID NO: 127686 - DNA, 40 bp, Artificial Sequence
  Description of Artificial Sequence: Synthetic oligonucleotide
tatcagctataaatatcgagaggacttgtctgcacatctc

SEQ ID NO: 127687 - DNA, 39 bp, Artificial Sequence
  Description of Artificial Sequence: Synthetic oligonucleotide
atcagctataaatatcgagaggacttgtctgcacatctc

SEQ ID NO: 127688 - DNA, 38 bp, Artificial Sequence
  Description of Artificial Sequence: Synthetic oligonucleotide
tcagctataaatatcgagaggacttgtctgcacatctc

SEQ ID NO: 127689 - DNA, 37 bp, Artificial Sequence
  Description of Artificial Sequence: Synthetic oligonucleotide
cagctataaatatcgagaggacttgtctgcacatctc

SEQ ID NO: 127690 - DNA, 39 bp, Artificial Sequence
  Description of Artificial Sequence: Synthetic oligonucleotide
agctataaatatcgagaggacttgtctgcacatctcatg

SEQ ID NO: 127691 - DNA, 38 bp, Artificial Sequence
  Description of Artificial Sequence: Synthetic oligonucleotide
gctataaatatcgagaggacttgtctgcacatctcatg

SEQ ID NO: 127692 - DNA, 38 bp, Artificial Sequence
  Description of Artificial Sequence: Synthetic oligonucleotide
ctataaatatcgagaggacttgtctgcacatctcatgg

SEQ ID NO: 127693 - DNA, 40 bp, Artificial Sequence
  Description of Artificial Sequence: Synthetic oligonucleotide
tataaatatcgagaggacttgtctgcacatctcatggtag

SEQ ID NO: 127694 - DNA, 39 bp, Artificial Sequence
  Description of Artificial Sequence: Synthetic oligonucleotide
ataaatatcgagaggacttgtctgcacatctcatggtag

SEQ ID NO: 127695 - DNA, 38 bp, Artificial Sequence
  Description of Artificial Sequence: Synthetic oligonucleotide
taaatatcgagaggacttgtctgcacatctcatggtag

SEQ ID NO: 127696 - DNA, 37 bp, Artificial Sequence
  Description of Artificial Sequence: Synthetic oligonucleotide
aaatatcgagaggacttgtctgcacatctcatggtag

SEQ ID NO: 127697 - DNA, 36 bp, Artificial Sequence
  Description of Artificial Sequence: Synthetic oligonucleotide
aatatcgagaggacttgtctgcacatctcatggtag

SEQ ID NO: 127698 - DNA, 35 bp, Artificial Sequence
  Description of Artificial Sequence: Synthetic oligonucleotide
atatcgagaggacttgtctgcacatctcatggtag

SEQ ID NO: 127699 - DNA, 34 bp, Artificial Sequence
  Description of Artificial Sequence: Synthetic oligonucleotide
tatcgagaggacttgtctgcacatctcatggtag

SEQ ID NO: 127700 - DNA, 33 bp, Artificial Sequence
  Description of Artificial Sequence: Synthetic oligonucleotide
atcgagaggacttgtctgcacatctcatggtag

SEQ ID NO: 127701 - DNA, 32 bp, Artificial Sequence
  Description of Artificial Sequence: Synthetic oligonucleotide
tcgagaggacttgtctgcacatctcatggtag

SEQ ID NO: 127702 - DNA, 31 bp, Artificial Sequence
  Description of Artificial Sequence: Synthetic oligonucleotide
cgagaggacttgtctgcacatctcatggtag

SEQ ID NO: 127703 - DNA, 31 bp, Artificial Sequence
  Description of Artificial Sequence: Synthetic oligonucleotide
gagaggacttgtctgcacatctcatggtagc

SEQ ID NO: 127704 - DNA, 32 bp, Artificial Sequence
  Description of Artificial Sequence: Synthetic oligonucleotide
agaggacttgtctgcacatctcatggtagctg

SEQ ID NO: 127705 - DNA, 31 bp, Artificial Sequence
  Description of Artificial Sequence: Synthetic oligonucleotide
gaggacttgtctgcacatctcatggtagctg

SEQ ID NO: 127706 - DNA, 31 bp, Artificial Sequence
  Description of Artificial Sequence: Synthetic oligonucleotide
aggacttgtctgcacatctcatggtagctgg

SEQ ID NO: 127707 - DNA, 30 bp, Artificial Sequence
  Description of Artificial Sequence: Synthetic oligonucleotide
ggacttgtctgcacatctcatggtagctgg

SEQ ID NO: 127708 - DNA, 30 bp, Artificial Sequence
  Description of Artificial Sequence: Synthetic oligonucleotide
gacttgtctgcacatctcatggtagctggc

SEQ ID NO: 127709 - DNA, 31 bp, Artificial Sequence
  Description of Artificial Sequence: Synthetic oligonucleotide
acttgtctgcacatctcatggtagctggctg

SEQ ID NO: 127710 - DNA, 30 bp, Artificial Sequence
  Description of Artificial Sequence: Synthetic oligonucleotide
cttgtctgcacatctcatggtagctggctg

SEQ ID NO: 127711 - DNA, 30 bp, Artificial Sequence
  Description of Artificial Sequence: Synthetic oligonucleotide
ttgtctgcacatctcatggtagctggctgg

SEQ ID NO: 127712 - DNA, 29 bp, Artificial Sequence
  Description of Artificial Sequence: Synthetic oligonucleotide
tgtctgcacatctcatggtagctggctgg

SEQ ID NO: 127713 - DNA, 28 bp, Artificial Sequence
  Description of Artificial Sequence: Synthetic oligonucleotide
gtctgcacatctcatggtagctggctgg

SEQ ID NO: 127714 - DNA, 28 bp, Artificial Sequence
  Description of Artificial Sequence: Synthetic oligonucleotide
tctgcacatctcatggtagctggctggg

SEQ ID NO: 127715 - DNA, 27 bp, Artificial Sequence
  Description of Artificial Sequence: Synthetic oligonucleotide
ctgcacatctcatggtagctggctggg

SEQ ID NO: 127716 - DNA, 28 bp, Artificial Sequence
  Description of Artificial Sequence: Synthetic oligonucleotide
tgcacatctcatggtagctggctgggac

SEQ ID NO: 127717 - DNA, 27 bp, Artificial Sequence
  Description of Artificial Sequence: Synthetic oligonucleotide
gcacatctcatggtagctggctgggac

SEQ ID NO: 127718 - DNA, 27 bp, Artificial Sequence
  Description of Artificial Sequence: Synthetic oligonucleotide
cacatctcatggtagctggctgggacc

SEQ ID NO: 127719 - DNA, 29 bp, Artificial Sequence
  Description of Artificial Sequence: Synthetic oligonucleotide
acatctcatggtagctggctgggaccaac

SEQ ID NO: 127720 - DNA, 28 bp, Artificial Sequence
  Description of Artificial Sequence: Synthetic oligonucleotide
catctcatggtagctggctgggaccaac

SEQ ID NO: 127721 - DNA, 28 bp, Artificial Sequence
  Description of Artificial Sequence: Synthetic oligonucleotide
atctcatggtagctggctgggaccaacg

SEQ ID NO: 127722 - DNA, 27 bp, Artificial Sequence
  Description of Artificial Sequence: Synthetic oligonucleotide
tctcatggtagctggctgggaccaacg

SEQ ID NO: 127723 - DNA, 27 bp, Artificial Sequence
  Description of Artificial Sequence: Synthetic oligonucleotide
ctcatggtagctggctgggaccaacgt

SEQ ID NO: 127724 - DNA, 27 bp, Artificial Sequence
  Description of Artificial Sequence: Synthetic oligonucleotide
tcatggtagctggctgggaccaacgtg

SEQ ID NO: 127725 - DNA, 27 bp, Artificial Sequence
  Description of Artificial Sequence: Synthetic oligonucleotide
catggtagctggctgggaccaacgtga

SEQ ID NO: 127726 - DNA, 28 bp, Artificial Sequence
  Description of Artificial Sequence: Synthetic oligonucleotide
atggtagctggctgggaccaacgtgaag

SEQ ID NO: 127727 - DNA, 27 bp, Artificial Sequence
  Description of Artificial Sequence: Synthetic oligonucleotide
tggtagctggctgggaccaacgtgaag

SEQ ID NO: 127728 - DNA, 26 bp, Artificial Sequence
  Description of Artificial Sequence: Synthetic oligonucleotide
ggtagctggctgggaccaacgtgaag

SEQ ID NO: 127729 - DNA, 27 bp, Artificial Sequence
  Description of Artificial Sequence: Synthetic oligonucleotide
gtagctggctgggaccaacgtgaagga

SEQ ID NO: 127730 - DNA, 27 bp, Artificial Sequence
  Description of Artificial Sequence: Synthetic oligonucleotide
tagctggctgggaccaacgtgaaggag

SEQ ID NO: 127731 - DNA, 26 bp, Artificial Sequence
  Description of Artificial Sequence: Synthetic oligonucleotide
agctggctgggaccaacgtgaaggag

SEQ ID NO: 127732 - DNA, 25 bp, Artificial Sequence
  Description of Artificial Sequence: Synthetic oligonucleotide
gctggctgggaccaacgtgaaggag

SEQ ID NO: 127733 - DNA, 26 bp, Artificial Sequence
  Description of Artificial Sequence: Synthetic oligonucleotide
ctggctgggaccaacgtgaaggaggt

SEQ ID NO: 127734 - DNA, 27 bp, Artificial Sequence
  Description of Artificial Sequence: Synthetic oligonucleotide
tggctgggaccaacgtgaaggaggtca

SEQ ID NO: 127735 - DNA, 26 bp, Artificial Sequence
  Description of Artificial Sequence: Synthetic oligonucleotide
ggctgggaccaacgtgaaggaggtca

SEQ ID NO: 127736 - DNA, 26 bp, Artificial Sequence
  Description of Artificial Sequence: Synthetic oligonucleotide
gctgggaccaacgtgaaggaggtcag

SEQ ID NO: 127737 - DNA, 27 bp, Artificial Sequence
  Description of Artificial Sequence: Synthetic oligonucleotide
ctgggaccaacgtgaaggaggtcaggt

SEQ ID NO: 127738 - DNA, 31 bp, Artificial Sequence
  Description of Artificial Sequence: Synthetic oligonucleotide
tgggaccaacgtgaaggaggtcaggtatatg

SEQ ID NO: 127739 - DNA, 30 bp, Artificial Sequence
  Description of Artificial Sequence: Synthetic oligonucleotide
gggaccaacgtgaaggaggtcaggtatatg

SEQ ID NO: 127740 - DNA, 30 bp, Artificial Sequence
  Description of Artificial Sequence: Synthetic oligonucleotide
ggaccaacgtgaaggaggtcaggtatatgg

SEQ ID NO: 127741 - DNA, 32 bp, Artificial Sequence
  Description of Artificial Sequence: Synthetic oligonucleotide
gaccaacgtgaaggaggtcaggtatatggaac

SEQ ID NO: 127742 - DNA, 32 bp, Artificial Sequence
  Description of Artificial Sequence: Synthetic oligonucleotide
accaacgtgaaggaggtcaggtatatggaacc

SEQ ID NO: 127743 - DNA, 31 bp, Artificial Sequence
  Description of Artificial Sequence: Synthetic oligonucleotide
ccaacgtgaaggaggtcaggtatatggaacc

SEQ ID NO: 127744 - DNA, 31 bp, Artificial Sequence
  Description of Artificial Sequence: Synthetic oligonucleotide
caacgtgaaggaggtcaggtatatggaaccc

SEQ ID NO: 127745 - DNA, 32 bp, Artificial Sequence
  Description of Artificial Sequence: Synthetic oligonucleotide
aacgtgaaggaggtcaggtatatggaaccctg

SEQ ID NO: 127746 - DNA, 31 bp, Artificial Sequence
  Description of Artificial Sequence: Synthetic oligonucleotide
acgtgaaggaggtcaggtatatggaaccctg

SEQ ID NO: 127747 - DNA, 30 bp, Artificial Sequence
  Description of Artificial Sequence: Synthetic oligonucleotide
cgtgaaggaggtcaggtatatggaaccctg

SEQ ID NO: 127748 - DNA, 30 bp, Artificial Sequence
  Description of Artificial Sequence: Synthetic oligonucleotide
gtgaaggaggtcaggtatatggaaccctgg

SEQ ID NO: 127749 - DNA, 30 bp, Artificial Sequence
  Description of Artificial Sequence: Synthetic oligonucleotide
tgaaggaggtcaggtatatggaaccctggg

SEQ ID NO: 127750 - DNA, 29 bp, Artificial Sequence
  Description of Artificial Sequence: Synthetic oligonucleotide
gaaggaggtcaggtatatggaaccctggg

SEQ ID NO: 127751 - DNA, 30 bp, Artificial Sequence
  Description of Artificial Sequence: Synthetic oligonucleotide
aaggaggtcaggtatatggaaccctgggag

SEQ ID NO: 127752 - DNA, 29 bp, Artificial Sequence
  Description of Artificial Sequence: Synthetic oligonucleotide
aggaggtcaggtatatggaaccctgggag

SEQ ID NO: 127753 - DNA, 28 bp, Artificial Sequence
  Description of Artificial Sequence: Synthetic oligonucleotide
ggaggtcaggtatatggaaccctgggag

SEQ ID NO: 127754 - DNA, 28 bp, Artificial Sequence
  Description of Artificial Sequence: Synthetic oligonucleotide
gaggtcaggtatatggaaccctgggagg

SEQ ID NO: 127755 - DNA, 31 bp, Artificial Sequence
  Description of Artificial Sequence: Synthetic oligonucleotide
aggtcaggtatatggaaccctgggaggaatg

SEQ ID NO: 127756 - DNA, 30 bp, Artificial Sequence
  Description of Artificial Sequence: Synthetic oligonucleotide
ggtcaggtatatggaaccctgggaggaatg

SEQ ID NO: 127757 - DNA, 30 bp, Artificial Sequence
  Description of Artificial Sequence: Synthetic oligonucleotide
gtcaggtatatggaaccctgggaggaatgc

SEQ ID NO: 127758 - DNA, 31 bp, Artificial Sequence
  Description of Artificial Sequence: Synthetic oligonucleotide
tcaggtatatggaaccctgggaggaatgctg

SEQ ID NO: 127759 - DNA, 30 bp, Artificial Sequence
  Description of Artificial Sequence: Synthetic oligonucleotide
caggtatatggaaccctgggaggaatgctg

SEQ ID NO: 127760 - DNA, 31 bp, Artificial Sequence
  Description of Artificial Sequence: Synthetic oligonucleotide
aggtatatggaaccctgggaggaatgctgac

SEQ ID NO: 127761 - DNA, 30 bp, Artificial Sequence
  Description of Artificial Sequence: Synthetic oligonucleotide
ggtatatggaaccctgggaggaatgctgac

SEQ ID NO: 127762 - DNA, 31 bp, Artificial Sequence
  Description of Artificial Sequence: Synthetic oligonucleotide
gtatatggaaccctgggaggaatgctgactc

SEQ ID NO: 127763 - DNA, 31 bp, Artificial Sequence
  Description of Artificial Sequence: Synthetic oligonucleotide
tatatggaaccctgggaggaatgctgactcg

SEQ ID NO: 127764 - DNA, 30 bp, Artificial Sequence
  Description of Artificial Sequence: Synthetic oligonucleotide
atatggaaccctgggaggaatgctgactcg

SEQ ID NO: 127765 - DNA, 29 bp, Artificial Sequence
  Description of Artificial Sequence: Synthetic oligonucleotide
tatggaaccctgggaggaatgctgactcg

SEQ ID NO: 127766 - DNA, 28 bp, Artificial Sequence
  Description of Artificial Sequence: Synthetic oligonucleotide
atggaaccctgggaggaatgctgactcg

SEQ ID NO: 127767 - DNA, 27 bp, Artificial Sequence
  Description of Artificial Sequence: Synthetic oligonucleotide
tggaaccctgggaggaatgctgactcg

SEQ ID NO: 127768 - DNA, 27 bp, Artificial Sequence
  Description of Artificial Sequence: Synthetic oligonucleotide
ggaaccctgggaggaatgctgactcga

SEQ ID NO: 127769 - DNA, 27 bp, Artificial Sequence
  Description of Artificial Sequence: Synthetic oligonucleotide
gaaccctgggaggaatgctgactcgac

SEQ ID NO: 127770 - DNA, 28 bp, Artificial Sequence
  Description of Artificial Sequence: Synthetic oligonucleotide
aaccctgggaggaatgctgactcgacag

SEQ ID NO: 127771 - DNA, 27 bp, Artificial Sequence
  Description of Artificial Sequence: Synthetic oligonucleotide
accctgggaggaatgctgactcgacag

SEQ ID NO: 127772 - DNA, 26 bp, Artificial Sequence
  Description of Artificial Sequence: Synthetic oligonucleotide
ccctgggaggaatgctgactcgacag

SEQ ID NO: 127773 - DNA, 26 bp, Artificial Sequence
  Description of Artificial Sequence: Synthetic oligonucleotide
cctgggaggaatgctgactcgacagc

SEQ ID NO: 127774 - DNA, 27 bp, Artificial Sequence
  Description of Artificial Sequence: Synthetic oligonucleotide
ctgggaggaatgctgactcgacagcct

SEQ ID NO: 127775 - DNA, 30 bp, Artificial Sequence
  Description of Artificial Sequence: Synthetic oligonucleotide
tgggaggaatgctgactcgacagccttttg

SEQ ID NO: 127776 - DNA, 29 bp, Artificial Sequence
  Description of Artificial Sequence: Synthetic oligonucleotide
gggaggaatgctgactcgacagccttttg

SEQ ID NO: 127777 - DNA, 29 bp, Artificial Sequence
  Description of Artificial Sequence: Synthetic oligonucleotide
ggaggaatgctgactcgacagccttttgc

SEQ ID NO: 127778 - DNA, 29 bp, Artificial Sequence
  Description of Artificial Sequence: Synthetic oligonucleotide
gaggaatgctgactcgacagccttttgcc

SEQ ID NO: 127779 - DNA, 32 bp, Artificial Sequence
  Description of Artificial Sequence: Synthetic oligonucleotide
aggaatgctgactcgacagccttttgccattg

SEQ ID NO: 127780 - DNA, 31 bp, Artificial Sequence
  Description of Artificial Sequence: Synthetic oligonucleotide
ggaatgctgactcgacagccttttgccattg

SEQ ID NO: 127781 - DNA, 31 bp, Artificial Sequence
  Description of Artificial Sequence: Synthetic oligonucleotide
gaatgctgactcgacagccttttgccattgg

SEQ ID NO: 127782 - DNA, 32 bp, Artificial Sequence
  Description of Artificial Sequence: Synthetic oligonucleotide
aatgctgactcgacagccttttgccattggtg

SEQ ID NO: 127783 - DNA, 31 bp, Artificial Sequence
  Description of Artificial Sequence: Synthetic oligonucleotide
atgctgactcgacagccttttgccattggtg

SEQ ID NO: 127784 - DNA, 30 bp, Artificial Sequence
  Description of Artificial Sequence: Synthetic oligonucleotide
tgctgactcgacagccttttgccattggtg

SEQ ID NO: 127785 - DNA, 29 bp, Artificial Sequence
  Description of Artificial Sequence: Synthetic oligonucleotide
gctgactcgacagccttttgccattggtg

SEQ ID NO: 127786 - DNA, 29 bp, Artificial Sequence
  Description of Artificial Sequence: Synthetic oligonucleotide
ctgactcgacagccttttgccattggtgg

SEQ ID NO: 127787 - DNA, 29 bp, Artificial Sequence
  Description of Artificial Sequence: Synthetic oligonucleotide
tgactcgacagccttttgccattggtggc

SEQ ID NO: 127788 - DNA, 28 bp, Artificial Sequence
  Description of Artificial Sequence: Synthetic oligonucleotide
gactcgacagccttttgccattggtggc

SEQ ID NO: 127789 - DNA, 29 bp, Artificial Sequence
  Description of Artificial Sequence: Synthetic oligonucleotide
actcgacagccttttgccattggtggctc

SEQ ID NO: 127790 - DNA, 28 bp, Artificial Sequence
  Description of Artificial Sequence: Synthetic oligonucleotide
ctcgacagccttttgccattggtggctc

SEQ ID NO: 127791 - DNA, 28 bp, Artificial Sequence
  Description of Artificial Sequence: Synthetic oligonucleotide
tcgacagccttttgccattggtggctcc

SEQ ID NO: 127792 - DNA, 27 bp, Artificial Sequence
  Description of Artificial Sequence: Synthetic oligonucleotide
cgacagccttttgccattggtggctcc

SEQ ID NO: 127793 - DNA, 27 bp, Artificial Sequence
  Description of Artificial Sequence: Synthetic oligonucleotide
gacagccttttgccattggtggctccg

SEQ ID NO: 127794 - DNA, 27 bp, Artificial Sequence
  Description of Artificial Sequence: Synthetic oligonucleotide
acagccttttgccattggtggctccgg

SEQ ID NO: 127795 - DNA, 26 bp, Artificial Sequence
  Description of Artificial Sequence: Synthetic oligonucleotide
cagccttttgccattggtggctccgg

SEQ ID NO: 127796 - DNA, 27 bp, Artificial Sequence
  Description of Artificial Sequence: Synthetic oligonucleotide
agccttttgccattggtggctccggca

SEQ ID NO: 127797 - DNA, 26 bp, Artificial Sequence
  Description of Artificial Sequence: Synthetic oligonucleotide
gccttttgccattggtggctccggca

SEQ ID NO: 127798 - DNA, 26 bp, Artificial Sequence
  Description of Artificial Sequence: Synthetic oligonucleotide
ccttttgccattggtggctccggcag

SEQ ID NO: 127799 - DNA, 27 bp, Artificial Sequence
  Description of Artificial Sequence: Synthetic oligonucleotide
cttttgccattggtggctccggcagca

SEQ ID NO: 127800 - DNA, 27 bp, Artificial Sequence
  Description of Artificial Sequence: Synthetic oligonucleotide
ttttgccattggtggctccggcagcac

SEQ ID NO: 127801 - DNA, 26 bp, Artificial Sequence
  Description of Artificial Sequence: Synthetic oligonucleotide
tttgccattggtggctccggcagcac

SEQ ID NO: 127802 - DNA, 25 bp, Artificial Sequence
  Description of Artificial Sequence: Synthetic oligonucleotide
ttgccattggtggctccggcagcac

SEQ ID NO: 127803 - DNA, 24 bp, Artificial Sequence
  Description of Artificial Sequence: Synthetic oligonucleotide
tgccattggtggctccggcagcac

SEQ ID NO: 127804 - DNA, 23 bp, Artificial Sequence
  Description of Artificial Sequence: Synthetic oligonucleotide
gccattggtggctccggcagcac

SEQ ID NO: 127805 - DNA, 27 bp, Artificial Sequence
  Description of Artificial Sequence: Synthetic oligonucleotide
ccattggtggctccggcagcaccttta

SEQ ID NO: 127806 - DNA, 28 bp, Artificial Sequence
  Description of Artificial Sequence: Synthetic oligonucleotide
cattggtggctccggcagcacctttatc

SEQ ID NO: 127807 - DNA, 31 bp, Artificial Sequence
  Description of Artificial Sequence: Synthetic oligonucleotide
attggtggctccggcagcacctttatctatg

SEQ ID NO: 127808 - DNA, 30 bp, Artificial Sequence
  Description of Artificial Sequence: Synthetic oligonucleotide
ttggtggctccggcagcacctttatctatg

SEQ ID NO: 127809 - DNA, 29 bp, Artificial Sequence
  Description of Artificial Sequence: Synthetic oligonucleotide
tggtggctccggcagcacctttatctatg

SEQ ID NO: 127810 - DNA, 28 bp, Artificial Sequence
  Description of Artificial Sequence: Synthetic oligonucleotide
ggtggctccggcagcacctttatctatg

SEQ ID NO: 127811 - DNA, 28 bp, Artificial Sequence
  Description of Artificial Sequence: Synthetic oligonucleotide
gtggctccggcagcacctttatctatgg

SEQ ID NO: 127812 - DNA, 32 bp, Artificial Sequence
  Description of Artificial Sequence: Synthetic oligonucleotide
tggctccggcagcacctttatctatggttatg

SEQ ID NO: 127813 - DNA, 31 bp, Artificial Sequence
  Description of Artificial Sequence: Synthetic oligonucleotide
ggctccggcagcacctttatctatggttatg

SEQ ID NO: 127814 - DNA, 32 bp, Artificial Sequence
  Description of Artificial Sequence: Synthetic oligonucleotide
gctccggcagcacctttatctatggttatgtg

SEQ ID NO: 127815 - DNA, 32 bp, Artificial Sequence
  Description of Artificial Sequence: Synthetic oligonucleotide
ctccggcagcacctttatctatggttatgtgg

SEQ ID NO: 127816 - DNA, 34 bp, Artificial Sequence
  Description of Artificial Sequence: Synthetic oligonucleotide
tccggcagcacctttatctatggttatgtggatg

SEQ ID NO: 127817 - DNA, 33 bp, Artificial Sequence
  Description of Artificial Sequence: Synthetic oligonucleotide
ccggcagcacctttatctatggttatgtggatg

SEQ ID NO: 127818 - DNA, 33 bp, Artificial Sequence
  Description of Artificial Sequence: Synthetic oligonucleotide
cggcagcacctttatctatggttatgtggatgc

SEQ ID NO: 127819 - DNA, 34 bp, Artificial Sequence
  Description of Artificial Sequence: Synthetic oligonucleotide
ggcagcacctttatctatggttatgtggatgcag

SEQ ID NO: 127820 - DNA, 34 bp, Artificial Sequence
  Description of Artificial Sequence: Synthetic oligonucleotide
gcagcacctttatctatggttatgtggatgcagc

SEQ ID NO: 127821 - DNA, 40 bp, Artificial Sequence
  Description of Artificial Sequence: Synthetic oligonucleotide
cagcacctttatctatggttatgtggatgcagcatataag

SEQ ID NO: 127822 - DNA, 40 bp, Artificial Sequence
  Description of Artificial Sequence: Synthetic oligonucleotide
agcacctttatctatggttatgtggatgcagcatataagc

SEQ ID NO: 127823 - DNA, 39 bp, Artificial Sequence
  Description of Artificial Sequence: Synthetic oligonucleotide
gcacctttatctatggttatgtggatgcagcatataagc

SEQ ID NO: 127824 - DNA, 39 bp, Artificial Sequence
  Description of Artificial Sequence: Synthetic oligonucleotide
cacctttatctatggttatgtggatgcagcatataagcc

SEQ ID NO: 127825 - DNA, 40 bp, Artificial Sequence
  Description of Artificial Sequence: Synthetic oligonucleotide
acctttatctatggttatgtggatgcagcatataagccag

SEQ ID NO: 127826 - DNA, 39 bp, Artificial Sequence
  Description of Artificial Sequence: Synthetic oligonucleotide
cctttatctatggttatgtggatgcagcatataagccag

SEQ ID NO: 127827 - DNA, 39 bp, Artificial Sequence
  Description of Artificial Sequence: Synthetic oligonucleotide
ctttatctatggttatgtggatgcagcatataagccagg

SEQ ID NO: 127828 - DNA, 39 bp, Artificial Sequence
  Description of Artificial Sequence: Synthetic oligonucleotide
tttatctatggttatgtggatgcagcatataagccaggc

SEQ ID NO: 127829 - DNA, 38 bp, Artificial Sequence
  Description of Artificial Sequence: Synthetic oligonucleotide
ttatctatggttatgtggatgcagcatataagccaggc

SEQ ID NO: 127830 - DNA, 37 bp, Artificial Sequence
  Description of Artificial Sequence: Synthetic oligonucleotide
tatctatggttatgtggatgcagcatataagccaggc

SEQ ID NO: 127831 - DNA, 36 bp, Artificial Sequence
  Description of Artificial Sequence: Synthetic oligonucleotide
atctatggttatgtggatgcagcatataagccaggc

SEQ ID NO: 127832 - DNA, 35 bp, Artificial Sequence
  Description of Artificial Sequence: Synthetic oligonucleotide
tctatggttatgtggatgcagcatataagccaggc

SEQ ID NO: 127833 - DNA, 34 bp, Artificial Sequence
  Description of Artificial Sequence: Synthetic oligonucleotide
ctatggttatgtggatgcagcatataagccaggc

SEQ ID NO: 127834 - DNA, 36 bp, Artificial Sequence
  Description of Artificial Sequence: Synthetic oligonucleotide
tatggttatgtggatgcagcatataagccaggcatg

SEQ ID NO: 127835 - DNA, 35 bp, Artificial Sequence
  Description of Artificial Sequence: Synthetic oligonucleotide
atggttatgtggatgcagcatataagccaggcatg

SEQ ID NO: 127836 - DNA, 34 bp, Artificial Sequence
  Description of Artificial Sequence: Synthetic oligonucleotide
tggttatgtggatgcagcatataagccaggcatg

SEQ ID NO: 127837 - DNA, 33 bp, Artificial Sequence
  Description of Artificial Sequence: Synthetic oligonucleotide
ggttatgtggatgcagcatataagccaggcatg

SEQ ID NO: 127838 - DNA, 34 bp, Artificial Sequence
  Description of Artificial Sequence: Synthetic oligonucleotide
gttatgtggatgcagcatataagccaggcatgtc

SEQ ID NO: 127839 - DNA, 35 bp, Artificial Sequence
  Description of Artificial Sequence: Synthetic oligonucleotide
ttatgtggatgcagcatataagccaggcatgtctc

SEQ ID NO: 127840 - DNA, 34 bp, Artificial Sequence
  Description of Artificial Sequence: Synthetic oligonucleotide
tatgtggatgcagcatataagccaggcatgtctc

SEQ ID NO: 127841 - DNA, 33 bp, Artificial Sequence
  Description of Artificial Sequence: Synthetic oligonucleotide
atgtggatgcagcatataagccaggcatgtctc

SEQ ID NO: 127842 - DNA, 32 bp, Artificial Sequence
  Description of Artificial Sequence: Synthetic oligonucleotide
tgtggatgcagcatataagccaggcatgtctc

SEQ ID NO: 127843 - DNA, 31 bp, Artificial Sequence
  Description of Artificial Sequence: Synthetic oligonucleotide
gtggatgcagcatataagccaggcatgtctc

SEQ ID NO: 127844 - DNA, 31 bp, Artificial Sequence
  Description of Artificial Sequence: Synthetic oligonucleotide
tggatgcagcatataagccaggcatgtctcc

SEQ ID NO: 127845 - DNA, 30 bp, Artificial Sequence
  Description of Artificial Sequence: Synthetic oligonucleotide
ggatgcagcatataagccaggcatgtctcc

SEQ ID NO: 127846 - DNA, 30 bp, Artificial Sequence
  Description of Artificial Sequence: Synthetic oligonucleotide
gatgcagcatataagccaggcatgtctccc

SEQ ID NO: 127847 - DNA, 30 bp, Artificial Sequence
  Description of Artificial Sequence: Synthetic oligonucleotide
atgcagcatataagccaggcatgtctcccg

SEQ ID NO: 127848 - DNA, 29 bp, Artificial Sequence
  Description of Artificial Sequence: Synthetic oligonucleotide
tgcagcatataagccaggcatgtctcccg

SEQ ID NO: 127849 - DNA, 28 bp, Artificial Sequence
  Description of Artificial Sequence: Synthetic oligonucleotide
gcagcatataagccaggcatgtctcccg

SEQ ID NO: 127850 - DNA, 29 bp, Artificial Sequence
  Description of Artificial Sequence: Synthetic oligonucleotide
cagcatataagccaggcatgtctcccgag

SEQ ID NO: 127851 - DNA, 29 bp, Artificial Sequence
  Description of Artificial Sequence: Synthetic oligonucleotide
agcatataagccaggcatgtctcccgagg

SEQ ID NO: 127852 - DNA, 28 bp, Artificial Sequence
  Description of Artificial Sequence: Synthetic oligonucleotide
gcatataagccaggcatgtctcccgagg

SEQ ID NO: 127853 - DNA, 29 bp, Artificial Sequence
  Description of Artificial Sequence: Synthetic oligonucleotide
catataagccaggcatgtctcccgaggag

SEQ ID NO: 127854 - DNA, 30 bp, Artificial Sequence
  Description of Artificial Sequence: Synthetic oligonucleotide
atataagccaggcatgtctcccgaggagtg

SEQ ID NO: 127855 - DNA, 29 bp, Artificial Sequence
  Description of Artificial Sequence: Synthetic oligonucleotide
tataagccaggcatgtctcccgaggagtg

SEQ ID NO: 127856 - DNA, 28 bp, Artificial Sequence
  Description of Artificial Sequence: Synthetic oligonucleotide
ataagccaggcatgtctcccgaggagtg

SEQ ID NO: 127857 - DNA, 27 bp, Artificial Sequence
  Description of Artificial Sequence: Synthetic oligonucleotide
taagccaggcatgtctcccgaggagtg

SEQ ID NO: 127858 - DNA, 26 bp, Artificial Sequence
  Description of Artificial Sequence: Synthetic oligonucleotide
aagccaggcatgtctcccgaggagtg

SEQ ID NO: 127859 - DNA, 25 bp, Artificial Sequence
  Description of Artificial Sequence: Synthetic oligonucleotide
agccaggcatgtctcccgaggagtg

SEQ ID NO: 127860 - DNA, 24 bp, Artificial Sequence
  Description of Artificial Sequence: Synthetic oligonucleotide
gccaggcatgtctcccgaggagtg

SEQ ID NO: 127861 - DNA, 25 bp, Artificial Sequence
  Description of Artificial Sequence: Synthetic oligonucleotide
ccaggcatgtctcccgaggagtgca

SEQ ID NO: 127862 - DNA, 25 bp, Artificial Sequence
  Description of Artificial Sequence: Synthetic oligonucleotide
caggcatgtctcccgaggagtgcag

SEQ ID NO: 127863 - DNA, 25 bp, Artificial Sequence
  Description of Artificial Sequence: Synthetic oligonucleotide
aggcatgtctcccgaggagtgcagg

SEQ ID NO: 127864 - DNA, 24 bp, Artificial Sequence
  Description of Artificial Sequence: Synthetic oligonucleotide
ggcatgtctcccgaggagtgcagg

SEQ ID NO: 127865 - DNA, 24 bp, Artificial Sequence
  Description of Artificial Sequence: Synthetic oligonucleotide
gcatgtctcccgaggagtgcaggc

SEQ ID NO: 127866 - DNA, 24 bp, Artificial Sequence
  Description of Artificial Sequence: Synthetic oligonucleotide
catgtctcccgaggagtgcaggcg

SEQ ID NO: 127867 - DNA, 26 bp, Artificial Sequence
  Description of Artificial Sequence: Synthetic oligonucleotide
atgtctcccgaggagtgcaggcgctt

SEQ ID NO: 127868 - DNA, 25 bp, Artificial Sequence
  Description of Artificial Sequence: Synthetic oligonucleotide
tgtctcccgaggagtgcaggcgctt

SEQ ID NO: 127869 - DNA, 24 bp, Artificial Sequence
  Description of Artificial Sequence: Synthetic oligonucleotide
gtctcccgaggagtgcaggcgctt

SEQ ID NO: 127870 - DNA, 25 bp, Artificial Sequence
  Description of Artificial Sequence: Synthetic oligonucleotide
tctcccgaggagtgcaggcgcttca

SEQ ID NO: 127871 - DNA, 24 bp, Artificial Sequence
  Description of Artificial Sequence: Synthetic oligonucleotide
ctcccgaggagtgcaggcgcttca

SEQ ID NO: 127872 - DNA, 24 bp, Artificial Sequence
  Description of Artificial Sequence: Synthetic oligonucleotide
tcccgaggagtgcaggcgcttcac

SEQ ID NO: 127873 - DNA, 23 bp, Artificial Sequence
  Description of Artificial Sequence: Synthetic oligonucleotide
cccgaggagtgcaggcgcttcac

SEQ ID NO: 127874 - DNA, 24 bp, Artificial Sequence
  Description of Artificial Sequence: Synthetic oligonucleotide
ccgaggagtgcaggcgcttcacca

SEQ ID NO: 127875 - DNA, 25 bp, Artificial Sequence
  Description of Artificial Sequence: Synthetic oligonucleotide
cgaggagtgcaggcgcttcaccaca

SEQ ID NO: 127876 - DNA, 26 bp, Artificial Sequence
  Description of Artificial Sequence: Synthetic oligonucleotide
gaggagtgcaggcgcttcaccacaga

SEQ ID NO: 127877 - DNA, 26 bp, Artificial Sequence
  Description of Artificial Sequence: Synthetic oligonucleotide
aggagtgcaggcgcttcaccacagac

SEQ ID NO: 127878 - DNA, 25 bp, Artificial Sequence
  Description of Artificial Sequence: Synthetic oligonucleotide
ggagtgcaggcgcttcaccacagac

SEQ ID NO: 127879 - DNA, 25 bp, Artificial Sequence
  Description of Artificial Sequence: Synthetic oligonucleotide
gagtgcaggcgcttcaccacagacg

SEQ ID NO: 127880 - DNA, 27 bp, Artificial Sequence
  Description of Artificial Sequence: Synthetic oligonucleotide
agtgcaggcgcttcaccacagacgcta

SEQ ID NO: 127881 - DNA, 27 bp, Artificial Sequence
  Description of Artificial Sequence: Synthetic oligonucleotide
gtgcaggcgcttcaccacagacgctat

SEQ ID NO: 127882 - DNA, 28 bp, Artificial Sequence
  Description of Artificial Sequence: Synthetic oligonucleotide
tgcaggcgcttcaccacagacgctattg

SEQ ID NO: 127883 - DNA, 27 bp, Artificial Sequence
  Description of Artificial Sequence: Synthetic oligonucleotide
gcaggcgcttcaccacagacgctattg

SEQ ID NO: 127884 - DNA, 27 bp, Artificial Sequence
  Description of Artificial Sequence: Synthetic oligonucleotide
caggcgcttcaccacagacgctattgc

SEQ ID NO: 127885 - DNA, 28 bp, Artificial Sequence
  Description of Artificial Sequence: Synthetic oligonucleotide
aggcgcttcaccacagacgctattgctc

SEQ ID NO: 127886 - DNA, 27 bp, Artificial Sequence
  Description of Artificial Sequence: Synthetic oligonucleotide
ggcgcttcaccacagacgctattgctc

SEQ ID NO: 127887 - DNA, 28 bp, Artificial Sequence
  Description of Artificial Sequence: Synthetic oligonucleotide
gcgcttcaccacagacgctattgctctg

SEQ ID NO: 127888 - DNA, 28 bp, Artificial Sequence
  Description of Artificial Sequence: Synthetic oligonucleotide
cgcttcaccacagacgctattgctctgg

SEQ ID NO: 127889 - DNA, 28 bp, Artificial Sequence
  Description of Artificial Sequence: Synthetic oligonucleotide
gcttcaccacagacgctattgctctggc

SEQ ID NO: 127890 - DNA, 28 bp, Artificial Sequence
  Description of Artificial Sequence: Synthetic oligonucleotide
cttcaccacagacgctattgctctggcc

SEQ ID NO: 127891 - DNA, 30 bp, Artificial Sequence
  Description of Artificial Sequence: Synthetic oligonucleotide
ttcaccacagacgctattgctctggccatg

SEQ ID NO: 127892 - DNA, 29 bp, Artificial Sequence
  Description of Artificial Sequence: Synthetic oligonucleotide
tcaccacagacgctattgctctggccatg

SEQ ID NO: 127893 - DNA, 28 bp, Artificial Sequence
  Description of Artificial Sequence: Synthetic oligonucleotide
caccacagacgctattgctctggccatg

SEQ ID NO: 127894 - DNA, 29 bp, Artificial Sequence
  Description of Artificial Sequence: Synthetic oligonucleotide
accacagacgctattgctctggccatgag

SEQ ID NO: 127895 - DNA, 28 bp, Artificial Sequence
  Description of Artificial Sequence: Synthetic oligonucleotide
ccacagacgctattgctctggccatgag

SEQ ID NO: 127896 - DNA, 28 bp, Artificial Sequence
  Description of Artificial Sequence: Synthetic oligonucleotide
cacagacgctattgctctggccatgagc

SEQ ID NO: 127897 - DNA, 28 bp, Artificial Sequence
  Description of Artificial Sequence: Synthetic oligonucleotide
acagacgctattgctctggccatgagcc

SEQ ID NO: 127898 - DNA, 27 bp, Artificial Sequence
  Description of Artificial Sequence: Synthetic oligonucleotide
cagacgctattgctctggccatgagcc

SEQ ID NO: 127899 - DNA, 27 bp, Artificial Sequence
  Description of Artificial Sequence: Synthetic oligonucleotide
agacgctattgctctggccatgagccg

SEQ ID NO: 127900 - DNA, 26 bp, Artificial Sequence
  Description of Artificial Sequence: Synthetic oligonucleotide
gacgctattgctctggccatgagccg

SEQ ID NO: 127901 - DNA, 26 bp, Artificial Sequence
  Description of Artificial Sequence: Synthetic oligonucleotide
acgctattgctctggccatgagccgg

SEQ ID NO: 127902 - DNA, 25 bp, Artificial Sequence
  Description of Artificial Sequence: Synthetic oligonucleotide
cgctattgctctggccatgagccgg

SEQ ID NO: 127903 - DNA, 27 bp, Artificial Sequence
  Description of Artificial Sequence: Synthetic oligonucleotide
gctattgctctggccatgagccgggat

SEQ ID NO: 127904 - DNA, 27 bp, Artificial Sequence
  Description of Artificial Sequence: Synthetic oligonucleotide
ctattgctctggccatgagccgggatg

SEQ ID NO: 127905 - DNA, 27 bp, Artificial Sequence
  Description of Artificial Sequence: Synthetic oligonucleotide
tattgctctggccatgagccgggatgg

SEQ ID NO: 127906 - DNA, 26 bp, Artificial Sequence
  Description of Artificial Sequence: Synthetic oligonucleotide
attgctctggccatgagccgggatgg

SEQ ID NO: 127907 - DNA, 25 bp, Artificial Sequence
  Description of Artificial Sequence: Synthetic oligonucleotide
ttgctctggccatgagccgggatgg

SEQ ID NO: 127908 - DNA, 24 bp, Artificial Sequence
  Description of Artificial Sequence: Synthetic oligonucleotide
tgctctggccatgagccgggatgg

SEQ ID NO: 127909 - DNA, 23 bp, Artificial Sequence
  Description of Artificial Sequence: Synthetic oligonucleotide
gctctggccatgagccgggatgg

SEQ ID NO: 127910 - DNA, 24 bp, Artificial Sequence
  Description of Artificial Sequence: Synthetic oligonucleotide
ctctggccatgagccgggatggct

SEQ ID NO: 127911 - DNA, 26 bp, Artificial Sequence
  Description of Artificial Sequence: Synthetic oligonucleotide
tctggccatgagccgggatggctcaa

SEQ ID NO: 127912 - DNA, 25 bp, Artificial Sequence
  Description of Artificial Sequence: Synthetic oligonucleotide
ctggccatgagccgggatggctcaa

SEQ ID NO: 127913 - DNA, 25 bp, Artificial Sequence
  Description of Artificial Sequence: Synthetic oligonucleotide
tggccatgagccgggatggctcaag

SEQ ID NO: 127914 - DNA, 24 bp, Artificial Sequence
  Description of Artificial Sequence: Synthetic oligonucleotide
ggccatgagccgggatggctcaag

SEQ ID NO: 127915 - DNA, 24 bp, Artificial Sequence
  Description of Artificial Sequence: Synthetic oligonucleotide
gccatgagccgggatggctcaagc

SEQ ID NO: 127916 - DNA, 24 bp, Artificial Sequence
  Description of Artificial Sequence: Synthetic oligonucleotide
ccatgagccgggatggctcaagcg

SEQ ID NO: 127917 - DNA, 24 bp, Artificial Sequence
  Description of Artificial Sequence: Synthetic oligonucleotide
catgagccgggatggctcaagcgg

SEQ ID NO: 127918 - DNA, 24 bp, Artificial Sequence
  Description of Artificial Sequence: Synthetic oligonucleotide
atgagccgggatggctcaagcggg

SEQ ID NO: 127919 - DNA, 23 bp, Artificial Sequence
  Description of Artificial Sequence: Synthetic oligonucleotide
tgagccgggatggctcaagcggg

SEQ ID NO: 127920 - DNA, 22 bp, Artificial Sequence
  Description of Artificial Sequence: Synthetic oligonucleotide
gagccgggatggctcaagcggg

SEQ ID NO: 127921 - DNA, 22 bp, Artificial Sequence
  Description of Artificial Sequence: Synthetic oligonucleotide
agccgggatggctcaagcgggg

SEQ ID NO: 127922 - DNA, 21 bp, Artificial Sequence
  Description of Artificial Sequence: Synthetic oligonucleotide
gccgggatggctcaagcgggg

SEQ ID NO: 127923 - DNA, 22 bp, Artificial Sequence
  Description of Artificial Sequence: Synthetic oligonucleotide
ccgggatggctcaagcgggggt

SEQ ID NO: 127924 - DNA, 23 bp, Artificial Sequence
  Description of Artificial Sequence: Synthetic oligonucleotide
cgggatggctcaagcgggggtgt

SEQ ID NO: 127925 - DNA, 25 bp, Artificial Sequence
  Description of Artificial Sequence: Synthetic oligonucleotide
gggatggctcaagcgggggtgtcat

SEQ ID NO: 127926 - DNA, 27 bp, Artificial Sequence
  Description of Artificial Sequence: Synthetic oligonucleotide
ggatggctcaagcgggggtgtcatcta

SEQ ID NO: 127927 - DNA, 27 bp, Artificial Sequence
  Description of Artificial Sequence: Synthetic oligonucleotide
gatggctcaagcgggggtgtcatctac

SEQ ID NO: 127928 - DNA, 27 bp, Artificial Sequence
  Description of Artificial Sequence: Synthetic oligonucleotide
atggctcaagcgggggtgtcatctacc

SEQ ID NO: 127929 - DNA, 27 bp, Artificial Sequence
  Description of Artificial Sequence: Synthetic oligonucleotide
tggctcaagcgggggtgtcatctacct

SEQ ID NO: 127930 - DNA, 26 bp, Artificial Sequence
  Description of Artificial Sequence: Synthetic oligonucleotide
ggctcaagcgggggtgtcatctacct

SEQ ID NO: 127931 - DNA, 26 bp, Artificial Sequence
  Description of Artificial Sequence: Synthetic oligonucleotide
gctcaagcgggggtgtcatctacctg

SEQ ID NO: 127932 - DNA, 27 bp, Artificial Sequence
  Description of Artificial Sequence: Synthetic oligonucleotide
ctcaagcgggggtgtcatctacctggt

SEQ ID NO: 127933 - DNA, 27 bp, Artificial Sequence
  Description of Artificial Sequence: Synthetic oligonucleotide
tcaagcgggggtgtcatctacctggtc

SEQ ID NO: 127934 - DNA, 27 bp, Artificial Sequence
  Description of Artificial Sequence: Synthetic oligonucleotide
caagcgggggtgtcatctacctggtca

SEQ ID NO: 127935 - DNA, 27 bp, Artificial Sequence
  Description of Artificial Sequence: Synthetic oligonucleotide
aagcgggggtgtcatctacctggtcac

SEQ ID NO: 127936 - DNA, 27 bp, Artificial Sequence
  Description of Artificial Sequence: Synthetic oligonucleotide
agcgggggtgtcatctacctggtcact

SEQ ID NO: 127937 - DNA, 27 bp, Artificial Sequence
  Description of Artificial Sequence: Synthetic oligonucleotide
gcgggggtgtcatctacctggtcacta

SEQ ID NO: 127938 - DNA, 30 bp, Artificial Sequence
  Description of Artificial Sequence: Synthetic oligonucleotide
cgggggtgtcatctacctggtcactattac

SEQ ID NO: 127939 - DNA, 31 bp, Artificial Sequence
  Description of Artificial Sequence: Synthetic oligonucleotide
gggggtgtcatctacctggtcactattacag

SEQ ID NO: 127940 - DNA, 31 bp, Artificial Sequence
  Description of Artificial Sequence: Synthetic oligonucleotide
ggggtgtcatctacctggtcactattacagc

SEQ ID NO: 127941 - DNA, 32 bp, Artificial Sequence
  Description of Artificial Sequence: Synthetic oligonucleotide
gggtgtcatctacctggtcactattacagctg

SEQ ID NO: 127942 - DNA, 32 bp, Artificial Sequence
  Description of Artificial Sequence: Synthetic oligonucleotide
ggtgtcatctacctggtcactattacagctgc

SEQ ID NO: 127943 - DNA, 32 bp, Artificial Sequence
  Description of Artificial Sequence: Synthetic oligonucleotide
gtgtcatctacctggtcactattacagctgcc

SEQ ID NO: 127944 - DNA, 32 bp, Artificial Sequence
  Description of Artificial Sequence: Synthetic oligonucleotide
tgtcatctacctggtcactattacagctgccg

SEQ ID NO: 127945 - DNA, 31 bp, Artificial Sequence
  Description of Artificial Sequence: Synthetic oligonucleotide
gtcatctacctggtcactattacagctgccg

SEQ ID NO: 127946 - DNA, 31 bp, Artificial Sequence
  Description of Artificial Sequence: Synthetic oligonucleotide
tcatctacctggtcactattacagctgccgg

SEQ ID NO: 127947 - DNA, 30 bp, Artificial Sequence
  Description of Artificial Sequence: Synthetic oligonucleotide
catctacctggtcactattacagctgccgg

SEQ ID NO: 127948 - DNA, 31 bp, Artificial Sequence
  Description of Artificial Sequence: Synthetic oligonucleotide
atctacctggtcactattacagctgccggtg

SEQ ID NO: 127949 - DNA, 30 bp, Artificial Sequence
  Description of Artificial Sequence: Synthetic oligonucleotide
tctacctggtcactattacagctgccggtg

SEQ ID NO: 127950 - DNA, 29 bp, Artificial Sequence
  Description of Artificial Sequence: Synthetic oligonucleotide
ctacctggtcactattacagctgccggtg

SEQ ID NO: 127951 - DNA, 30 bp, Artificial Sequence
  Description of Artificial Sequence: Synthetic oligonucleotide
tacctggtcactattacagctgccggtgtg

SEQ ID NO: 127952 - DNA, 29 bp, Artificial Sequence
  Description of Artificial Sequence: Synthetic oligonucleotide
acctggtcactattacagctgccggtgtg

SEQ ID NO: 127953 - DNA, 28 bp, Artificial Sequence
  Description of Artificial Sequence: Synthetic oligonucleotide
cctggtcactattacagctgccggtgtg

SEQ ID NO: 127954 - DNA, 28 bp, Artificial Sequence
  Description of Artificial Sequence: Synthetic oligonucleotide
ctggtcactattacagctgccggtgtgg

SEQ ID NO: 127955 - DNA, 29 bp, Artificial Sequence
  Description of Artificial Sequence: Synthetic oligonucleotide
tggtcactattacagctgccggtgtggac

SEQ ID NO: 127956 - DNA, 28 bp, Artificial Sequence
  Description of Artificial Sequence: Synthetic oligonucleotide
ggtcactattacagctgccggtgtggac

SEQ ID NO: 127957 - DNA, 28 bp, Artificial Sequence
  Description of Artificial Sequence: Synthetic oligonucleotide
gtcactattacagctgccggtgtggacc

SEQ ID NO: 127958 - DNA, 30 bp, Artificial Sequence
  Description of Artificial Sequence: Synthetic oligonucleotide
tcactattacagctgccggtgtggaccatc

SEQ ID NO: 127959 - DNA, 29 bp, Artificial Sequence
  Description of Artificial Sequence: Synthetic oligonucleotide
cactattacagctgccggtgtggaccatc

SEQ ID NO: 127960 - DNA, 29 bp, Artificial Sequence
  Description of Artificial Sequence: Synthetic oligonucleotide
actattacagctgccggtgtggaccatcg

SEQ ID NO: 127961 - DNA, 28 bp, Artificial Sequence
  Description of Artificial Sequence: Synthetic oligonucleotide
ctattacagctgccggtgtggaccatcg

SEQ ID NO: 127962 - DNA, 29 bp, Artificial Sequence
  Description of Artificial Sequence: Synthetic oligonucleotide
tattacagctgccggtgtggaccatcgag

SEQ ID NO: 127963 - DNA, 28 bp, Artificial Sequence
  Description of Artificial Sequence: Synthetic oligonucleotide
attacagctgccggtgtggaccatcgag

SEQ ID NO: 127964 - DNA, 27 bp, Artificial Sequence
  Description of Artificial Sequence: Synthetic oligonucleotide
ttacagctgccggtgtggaccatcgag

SEQ ID NO: 127965 - DNA, 27 bp, Artificial Sequence
  Description of Artificial Sequence: Synthetic oligonucleotide
tacagctgccggtgtggaccatcgagt

SEQ ID NO: 127966 - DNA, 26 bp, Artificial Sequence
  Description of Artificial Sequence: Synthetic oligonucleotide
acagctgccggtgtggaccatcgagt

SEQ ID NO: 127967 - DNA, 25 bp, Artificial Sequence
  Description of Artificial Sequence: Synthetic oligonucleotide
cagctgccggtgtggaccatcgagt

SEQ ID NO: 127968 - DNA, 27 bp, Artificial Sequence
  Description of Artificial Sequence: Synthetic oligonucleotide
agctgccggtgtggaccatcgagtcat

SEQ ID NO: 127969 - DNA, 26 bp, Artificial Sequence
  Description of Artificial Sequence: Synthetic oligonucleotide
gctgccggtgtggaccatcgagtcat

SEQ ID NO: 127970 - DNA, 27 bp, Artificial Sequence
  Description of Artificial Sequence: Synthetic oligonucleotide
ctgccggtgtggaccatcgagtcatct

SEQ ID NO: 127971 - DNA, 28 bp, Artificial Sequence
  Description of Artificial Sequence: Synthetic oligonucleotide
tgccggtgtggaccatcgagtcatcttg

SEQ ID NO: 127972 - DNA, 27 bp, Artificial Sequence
  Description of Artificial Sequence: Synthetic oligonucleotide
gccggtgtggaccatcgagtcatcttg

SEQ ID NO: 127973 - DNA, 27 bp, Artificial Sequence
  Description of Artificial Sequence: Synthetic oligonucleotide
ccggtgtggaccatcgagtcatcttgg

SEQ ID NO: 127974 - DNA, 27 bp, Artificial Sequence
  Description of Artificial Sequence: Synthetic oligonucleotide
cggtgtggaccatcgagtcatcttggg

SEQ ID NO: 127975 - DNA, 27 bp, Artificial Sequence
  Description of Artificial Sequence: Synthetic oligonucleotide
ggtgtggaccatcgagtcatcttgggc

SEQ ID NO: 127976 - DNA, 30 bp, Artificial Sequence
  Description of Artificial Sequence: Synthetic oligonucleotide
gtgtggaccatcgagtcatcttgggcaatg

SEQ ID NO: 127977 - DNA, 32 bp, Artificial Sequence
  Description of Artificial Sequence: Synthetic oligonucleotide
tgtggaccatcgagtcatcttgggcaatgaac

SEQ ID NO: 127978 - DNA, 31 bp, Artificial Sequence
  Description of Artificial Sequence: Synthetic oligonucleotide
gtggaccatcgagtcatcttgggcaatgaac

SEQ ID NO: 127979 - DNA, 32 bp, Artificial Sequence
  Description of Artificial Sequence: Synthetic oligonucleotide
tggaccatcgagtcatcttgggcaatgaactg

SEQ ID NO: 127980 - DNA, 31 bp, Artificial Sequence
  Description of Artificial Sequence: Synthetic oligonucleotide
ggaccatcgagtcatcttgggcaatgaactg

SEQ ID NO: 127981 - DNA, 31 bp, Artificial Sequence
  Description of Artificial Sequence: Synthetic oligonucleotide
gaccatcgagtcatcttgggcaatgaactgc

SEQ ID NO: 127982 - DNA, 31 bp, Artificial Sequence
  Description of Artificial Sequence: Synthetic oligonucleotide
accatcgagtcatcttgggcaatgaactgcc

SEQ ID NO: 127983 - DNA, 30 bp, Artificial Sequence
  Description of Artificial Sequence: Synthetic oligonucleotide
ccatcgagtcatcttgggcaatgaactgcc

SEQ ID NO: 127984 - DNA, 36 bp, Artificial Sequence
  Description of Artificial Sequence: Synthetic oligonucleotide
catcgagtcatcttgggcaatgaactgccaaaattc

SEQ ID NO: 127985 - DNA, 39 bp, Artificial Sequence
  Description of Artificial Sequence: Synthetic oligonucleotide
atcgagtcatcttgggcaatgaactgccaaaattctatg

SEQ ID NO: 127986 - DNA, 38 bp, Artificial Sequence
  Description of Artificial Sequence: Synthetic oligonucleotide
tcgagtcatcttgggcaatgaactgccaaaattctatg

SEQ ID NO: 127987 - DNA, 37 bp, Artificial Sequence
  Description of Artificial Sequence: Synthetic oligonucleotide
cgagtcatcttgggcaatgaactgccaaaattctatg

SEQ ID NO: 127988 - DNA, 39 bp, Artificial Sequence
  Description of Artificial Sequence: Synthetic oligonucleotide
gagtcatcttgggcaatgaactgccaaaattctatgatg

SEQ ID NO: 127989 - DNA, 40 bp, Artificial Sequence
  Description of Artificial Sequence: Synthetic oligonucleotide
agtcatcttgggcaatgaactgccaaaattctatgatgag

SEQ ID NO: 127990 - DNA, 39 bp, Artificial Sequence
  Description of Artificial Sequence: Synthetic oligonucleotide
gtcatcttgggcaatgaactgccaaaattctatgatgag

SEQ ID NO: 127991 - DNA, 40 bp, Artificial Sequence
  Description of Artificial Sequence: Synthetic oligonucleotide
tcatcttgggcaatgaactgccaaaattctatgatgagtg

SEQ ID NO: 127992 - DNA, 39 bp, Artificial Sequence
  Description of Artificial Sequence: Synthetic oligonucleotide
catcttgggcaatgaactgccaaaattctatgatgagtg

SEQ ID NO: 127993 - DNA, 24 bp, Artificial Sequence
  Description of Artificial Sequence: Synthetic oligonucleotide
atgctgaagccagccctggagccc

SEQ ID NO: 127994 - DNA, 23 bp, Artificial Sequence
  Description of Artificial Sequence: Synthetic oligonucleotide
tgctgaagccagccctggagccc

SEQ ID NO: 127995 - DNA, 22 bp, Artificial Sequence
  Description of Artificial Sequence: Synthetic oligonucleotide
gctgaagccagccctggagccc

SEQ ID NO: 127996 - DNA, 22 bp, Artificial Sequence
  Description of Artificial Sequence: Synthetic oligonucleotide
ctgaagccagccctggagcccc

SEQ ID NO: 127997 - DNA, 23 bp, Artificial Sequence
  Description of Artificial Sequence: Synthetic oligonucleotide
tgaagccagccctggagccccga

SEQ ID NO: 127998 - DNA, 22 bp, Artificial Sequence
  Description of Artificial Sequence: Synthetic oligonucleotide
gaagccagccctggagccccga

SEQ ID NO: 127999 - DNA, 22 bp, Artificial Sequence
  Description of Artificial Sequence: Synthetic oligonucleotide
aagccagccctggagccccgag

SEQ ID NO: 128000 - DNA, 21 bp, Artificial Sequence
  Description of Artificial Sequence: Synthetic oligonucleotide
agccagccctggagccccgag

SEQ ID NO: 128001 - DNA, 20 bp, Artificial Sequence
  Description of Artificial Sequence: Synthetic oligonucleotide
gccagccctggagccccgag

SEQ ID NO: 128002 - DNA, 20 bp, Artificial Sequence
  Description of Artificial Sequence: Synthetic oligonucleotide
ccagccctggagccccgagg

SEQ ID NO: 128003 - DNA, 20 bp, Artificial Sequence
  Description of Artificial Sequence: Synthetic oligonucleotide
cagccctggagccccgaggg

SEQ ID NO: 128004 - DNA, 20 bp, Artificial Sequence
  Description of Artificial Sequence: Synthetic oligonucleotide
agccctggagccccgagggg

SEQ ID NO: 128005 - DNA, 20 bp, Artificial Sequence
  Description of Artificial Sequence: Synthetic oligonucleotide
gccctggagccccgaggggt

SEQ ID NO: 128006 - DNA, 20 bp, Artificial Sequence
  Description of Artificial Sequence: Synthetic oligonucleotide
ccctggagccccgagggggt

SEQ ID NO: 128007 - DNA, 21 bp, Artificial Sequence
  Description of Artificial Sequence: Synthetic oligonucleotide
cctggagccccgagggggctt

SEQ ID NO: 128008 - DNA, 22 bp, Artificial Sequence
  Description of Artificial Sequence: Synthetic oligonucleotide
ctggagccccgagggggcttct

SEQ ID NO: 128009 - DNA, 22 bp, Artificial Sequence
  Description of Artificial Sequence: Synthetic oligonucleotide
tggagccccgagggggcttctc

SEQ ID NO: 128010 - DNA, 21 bp, Artificial Sequence
  Description of Artificial Sequence: Synthetic oligonucleotide
ggagccccgagggggcttctc

SEQ ID NO: 128011 - DNA, 23 bp, Artificial Sequence
  Description of Artificial Sequence: Synthetic oligonucleotide
gagccccgagggggcttctcctt

SEQ ID NO: 128012 - DNA, 23 bp, Artificial Sequence
  Description of Artificial Sequence: Synthetic oligonucleotide
agccccgagggggcttctccttc

SEQ ID NO: 128013 - DNA, 22 bp, Artificial Sequence
  Description of Artificial Sequence: Synthetic oligonucleotide
gccccgagggggcttctccttc

SEQ ID NO: 128014 - DNA, 23 bp, Artificial Sequence
  Description of Artificial Sequence: Synthetic oligonucleotide
ccccgagggggcttctccttcga

SEQ ID NO: 128015 - DNA, 25 bp, Artificial Sequence
  Description of Artificial Sequence: Synthetic oligonucleotide
cccgagggggcttctccttcgagaa

SEQ ID NO: 128016 - DNA, 26 bp, Artificial Sequence
  Description of Artificial Sequence: Synthetic oligonucleotide
ccgagggggcttctccttcgagaact

SEQ ID NO: 128017 - DNA, 26 bp, Artificial Sequence
  Description of Artificial Sequence: Synthetic oligonucleotide
cgagggggcttctccttcgagaactg

SEQ ID NO: 128018 - DNA, 26 bp, Artificial Sequence
  Description of Artificial Sequence: Synthetic oligonucleotide
gagggggcttctccttcgagaactgc

SEQ ID NO: 128019 - DNA, 27 bp, Artificial Sequence
  Description of Artificial Sequence: Synthetic oligonucleotide
agggggcttctccttcgagaactgcca

SEQ ID NO: 128020 - DNA, 27 bp, Artificial Sequence
  Description of Artificial Sequence: Synthetic oligonucleotide
gggggcttctccttcgagaactgccaa

SEQ ID NO: 128021 - DNA, 28 bp, Artificial Sequence
  Description of Artificial Sequence: Synthetic oligonucleotide
ggggcttctccttcgagaactgccaaag

SEQ ID NO: 128022 - DNA, 32 bp, Artificial Sequence
  Description of Artificial Sequence: Synthetic oligonucleotide
gggcttctccttcgagaactgccaaagaaatg

SEQ ID NO: 128023 - DNA, 32 bp, Artificial Sequence
  Description of Artificial Sequence: Synthetic oligonucleotide
ggcttctccttcgagaactgccaaagaaatgc

SEQ ID NO: 128024 - DNA, 34 bp, Artificial Sequence
  Description of Artificial Sequence: Synthetic oligonucleotide
gcttctccttcgagaactgccaaagaaatgcatc

SEQ ID NO: 128025 - DNA, 37 bp, Artificial Sequence
  Description of Artificial Sequence: Synthetic oligonucleotide
cttctccttcgagaactgccaaagaaatgcatcattg

SEQ ID NO: 128026 - DNA, 37 bp, Artificial Sequence
  Description of Artificial Sequence: Synthetic oligonucleotide
ttctccttcgagaactgccaaagaaatgcatcattgg

SEQ ID NO: 128027 - DNA, 36 bp, Artificial Sequence
  Description of Artificial Sequence: Synthetic oligonucleotide
tctccttcgagaactgccaaagaaatgcatcattgg

SEQ ID NO: 128028 - DNA, 35 bp, Artificial Sequence
  Description of Artificial Sequence: Synthetic oligonucleotide
ctccttcgagaactgccaaagaaatgcatcattgg

SEQ ID NO: 128029 - DNA, 37 bp, Artificial Sequence
  Description of Artificial Sequence: Synthetic oligonucleotide
tccttcgagaactgccaaagaaatgcatcattggaac

SEQ ID NO: 128030 - DNA, 36 bp, Artificial Sequence
  Description of Artificial Sequence: Synthetic oligonucleotide
ccttcgagaactgccaaagaaatgcatcattggaac

SEQ ID NO: 128031 - DNA, 36 bp, Artificial Sequence
  Description of Artificial Sequence: Synthetic oligonucleotide
cttcgagaactgccaaagaaatgcatcattggaacg

SEQ ID NO: 128032 - DNA, 36 bp, Artificial Sequence
  Description of Artificial Sequence: Synthetic oligonucleotide
ttcgagaactgccaaagaaatgcatcattggaacgc

SEQ ID NO: 128033 - DNA, 35 bp, Artificial Sequence
  Description of Artificial Sequence: Synthetic oligonucleotide
tcgagaactgccaaagaaatgcatcattggaacgc

SEQ ID NO: 128034 - DNA, 34 bp, Artificial Sequence
  Description of Artificial Sequence: Synthetic oligonucleotide
cgagaactgccaaagaaatgcatcattggaacgc

SEQ ID NO: 128035 - DNA, 34 bp, Artificial Sequence
  Description of Artificial Sequence: Synthetic oligonucleotide
gagaactgccaaagaaatgcatcattggaacgcg

SEQ ID NO: 128036 - DNA, 35 bp, Artificial Sequence
  Description of Artificial Sequence: Synthetic oligonucleotide
agaactgccaaagaaatgcatcattggaacgcgtc

SEQ ID NO: 128037 - DNA, 34 bp, Artificial Sequence
  Description of Artificial Sequence: Synthetic oligonucleotide
gaactgccaaagaaatgcatcattggaacgcgtc

SEQ ID NO: 128038 - DNA, 34 bp, Artificial Sequence
  Description of Artificial Sequence: Synthetic oligonucleotide
aactgccaaagaaatgcatcattggaacgcgtcc

SEQ ID NO: 128039 - DNA, 33 bp, Artificial Sequence
  Description of Artificial Sequence: Synthetic oligonucleotide
actgccaaagaaatgcatcattggaacgcgtcc

SEQ ID NO: 128040 - DNA, 32 bp, Artificial Sequence
  Description of Artificial Sequence: Synthetic oligonucleotide
ctgccaaagaaatgcatcattggaacgcgtcc

SEQ ID NO: 128041 - DNA, 33 bp, Artificial Sequence
  Description of Artificial Sequence: Synthetic oligonucleotide
tgccaaagaaatgcatcattggaacgcgtcctc

SEQ ID NO: 128042 - DNA, 32 bp, Artificial Sequence
  Description of Artificial Sequence: Synthetic oligonucleotide
gccaaagaaatgcatcattggaacgcgtcctc

SEQ ID NO: 128043 - DNA, 32 bp, Artificial Sequence
  Description of Artificial Sequence: Synthetic oligonucleotide
ccaaagaaatgcatcattggaacgcgtcctcc

SEQ ID NO: 128044 - DNA, 32 bp, Artificial Sequence
  Description of Artificial Sequence: Synthetic oligonucleotide
caaagaaatgcatcattggaacgcgtcctccc

SEQ ID NO: 128045 - DNA, 32 bp, Artificial Sequence
  Description of Artificial Sequence: Synthetic oligonucleotide
aaagaaatgcatcattggaacgcgtcctcccg

SEQ ID NO: 128046 - DNA, 31 bp, Artificial Sequence
  Description of Artificial Sequence: Synthetic oligonucleotide
aagaaatgcatcattggaacgcgtcctcccg

SEQ ID NO: 128047 - DNA, 30 bp, Artificial Sequence
  Description of Artificial Sequence: Synthetic oligonucleotide
agaaatgcatcattggaacgcgtcctcccg

SEQ ID NO: 128048 - DNA, 29 bp, Artificial Sequence
  Description of Artificial Sequence: Synthetic oligonucleotide
gaaatgcatcattggaacgcgtcctcccg

SEQ ID NO: 128049 - DNA, 29 bp, Artificial Sequence
  Description of Artificial Sequence: Synthetic oligonucleotide
aaatgcatcattggaacgcgtcctcccgg

SEQ ID NO: 128050 - DNA, 28 bp, Artificial Sequence
  Description of Artificial Sequence: Synthetic oligonucleotide
aatgcatcattggaacgcgtcctcccgg

SEQ ID NO: 128051 - DNA, 27 bp, Artificial Sequence
  Description of Artificial Sequence: Synthetic oligonucleotide
atgcatcattggaacgcgtcctcccgg

SEQ ID NO: 128052 - DNA, 26 bp, Artificial Sequence
  Description of Artificial Sequence: Synthetic oligonucleotide
tgcatcattggaacgcgtcctcccgg

SEQ ID NO: 128053 - DNA, 25 bp, Artificial Sequence
  Description of Artificial Sequence: Synthetic oligonucleotide
gcatcattggaacgcgtcctcccgg

SEQ ID NO: 128054 - DNA, 25 bp, Artificial Sequence
  Description of Artificial Sequence: Synthetic oligonucleotide
catcattggaacgcgtcctcccggg

SEQ ID NO: 128055 - DNA, 25 bp, Artificial Sequence
  Description of Artificial Sequence: Synthetic oligonucleotide
atcattggaacgcgtcctcccgggg

SEQ ID NO: 128056 - DNA, 24 bp, Artificial Sequence
  Description of Artificial Sequence: Synthetic oligonucleotide
tcattggaacgcgtcctcccgggg

SEQ ID NO: 128057 - DNA, 23 bp, Artificial Sequence
  Description of Artificial Sequence: Synthetic oligonucleotide
cattggaacgcgtcctcccgggg

SEQ ID NO: 128058 - DNA, 24 bp, Artificial Sequence
  Description of Artificial Sequence: Synthetic oligonucleotide
attggaacgcgtcctcccggggct

SEQ ID NO: 128059 - DNA, 23 bp, Artificial Sequence
  Description of Artificial Sequence: Synthetic oligonucleotide
ttggaacgcgtcctcccggggct

SEQ ID NO: 128060 - DNA, 22 bp, Artificial Sequence
  Description of Artificial Sequence: Synthetic oligonucleotide
tggaacgcgtcctcccggggct

SEQ ID NO: 128061 - DNA, 21 bp, Artificial Sequence
  Description of Artificial Sequence: Synthetic oligonucleotide
ggaacgcgtcctcccggggct

SEQ ID NO: 128062 - DNA, 23 bp, Artificial Sequence
  Description of Artificial Sequence: Synthetic oligonucleotide
gaacgcgtcctcccggggctcaa

SEQ ID NO: 128063 - DNA, 23 bp, Artificial Sequence
  Description of Artificial Sequence: Synthetic oligonucleotide
aacgcgtcctcccggggctcaag

SEQ ID NO: 128064 - DNA, 22 bp, Artificial Sequence
  Description of Artificial Sequence: Synthetic oligonucleotide
acgcgtcctcccggggctcaag

SEQ ID NO: 128065 - DNA, 21 bp, Artificial Sequence
  Description of Artificial Sequence: Synthetic oligonucleotide
cgcgtcctcccggggctcaag

SEQ ID NO: 128066 - DNA, 22 bp, Artificial Sequence
  Description of Artificial Sequence: Synthetic oligonucleotide
gcgtcctcccggggctcaaggt

SEQ ID NO: 128067 - DNA, 22 bp, Artificial Sequence
  Description of Artificial Sequence: Synthetic oligonucleotide
cgtcctcccggggctcaaggtc

SEQ ID NO: 128068 - DNA, 22 bp, Artificial Sequence
  Description of Artificial Sequence: Synthetic oligonucleotide
gtcctcccggggctcaaggtcc

SEQ ID NO: 128069 - DNA, 23 bp, Artificial Sequence
  Description of Artificial Sequence: Synthetic oligonucleotide
tcctcccggggctcaaggtccct

SEQ ID NO: 128070 - DNA, 22 bp, Artificial Sequence
  Description of Artificial Sequence: Synthetic oligonucleotide
cctcccggggctcaaggtccct

SEQ ID NO: 128071 - DNA, 23 bp, Artificial Sequence
  Description of Artificial Sequence: Synthetic oligonucleotide
ctcccggggctcaaggtccctca

SEQ ID NO: 128072 - DNA, 23 bp, Artificial Sequence
  Description of Artificial Sequence: Synthetic oligonucleotide
tcccggggctcaaggtccctcac

SEQ ID NO: 128073 - DNA, 22 bp, Artificial Sequence
  Description of Artificial Sequence: Synthetic oligonucleotide
cccggggctcaaggtccctcac

SEQ ID NO: 128074 - DNA, 22 bp, Artificial Sequence
  Description of Artificial Sequence: Synthetic oligonucleotide
ccggggctcaaggtccctcacg

SEQ ID NO: 128075 - DNA, 23 bp, Artificial Sequence
  Description of Artificial Sequence: Synthetic oligonucleotide
cggggctcaaggtccctcacgca

SEQ ID NO: 128076 - DNA, 23 bp, Artificial Sequence
  Description of Artificial Sequence: Synthetic oligonucleotide
ggggctcaaggtccctcacgcac

SEQ ID NO: 128077 - DNA, 23 bp, Artificial Sequence
  Description of Artificial Sequence: Synthetic oligonucleotide
gggctcaaggtccctcacgcacg

SEQ ID NO: 128078 - DNA, 25 bp, Artificial Sequence
  Description of Artificial Sequence: Synthetic oligonucleotide
ggctcaaggtccctcacgcacgcaa

SEQ ID NO: 128079 - DNA, 26 bp, Artificial Sequence
  Description of Artificial Sequence: Synthetic oligonucleotide
gctcaaggtccctcacgcacgcaaga

SEQ ID NO: 128080 - DNA, 26 bp, Artificial Sequence
  Description of Artificial Sequence: Synthetic oligonucleotide
ctcaaggtccctcacgcacgcaagac

SEQ ID NO: 128081 - DNA, 26 bp, Artificial Sequence
  Description of Artificial Sequence: Synthetic oligonucleotide
tcaaggtccctcacgcacgcaagacc

SEQ ID NO: 128082 - DNA, 25 bp, Artificial Sequence
  Description of Artificial Sequence: Synthetic oligonucleotide
caaggtccctcacgcacgcaagacc

SEQ ID NO: 128083 - DNA, 25 bp, Artificial Sequence
  Description of Artificial Sequence: Synthetic oligonucleotide
aaggtccctcacgcacgcaagaccg

SEQ ID NO: 128084 - DNA, 24 bp, Artificial Sequence
  Description of Artificial Sequence: Synthetic oligonucleotide
aggtccctcacgcacgcaagaccg

SEQ ID NO: 128085 - DNA, 23 bp, Artificial Sequence
  Description of Artificial Sequence: Synthetic oligonucleotide
ggtccctcacgcacgcaagaccg

SEQ ID NO: 128086 - DNA, 23 bp, Artificial Sequence
  Description of Artificial Sequence: Synthetic oligonucleotide
gtccctcacgcacgcaagaccgg

SEQ ID NO: 128087 - DNA, 24 bp, Artificial Sequence
  Description of Artificial Sequence: Synthetic oligonucleotide
tccctcacgcacgcaagaccggga

SEQ ID NO: 128088 - DNA, 23 bp, Artificial Sequence
  Description of Artificial Sequence: Synthetic oligonucleotide
ccctcacgcacgcaagaccggga

SEQ ID NO: 128089 - DNA, 23 bp, Artificial Sequence
  Description of Artificial Sequence: Synthetic oligonucleotide
cctcacgcacgcaagaccgggac

SEQ ID NO: 128090 - DNA, 24 bp, Artificial Sequence
  Description of Artificial Sequence: Synthetic oligonucleotide
ctcacgcacgcaagaccgggacca

SEQ ID NO: 128091 - DNA, 24 bp, Artificial Sequence
  Description of Artificial Sequence: Synthetic oligonucleotide
tcacgcacgcaagaccgggaccac

SEQ ID NO: 128092 - DNA, 23 bp, Artificial Sequence
  Description of Artificial Sequence: Synthetic oligonucleotide
cacgcacgcaagaccgggaccac

SEQ ID NO: 128093 - DNA, 25 bp, Artificial Sequence
  Description of Artificial Sequence: Synthetic oligonucleotide
acgcacgcaagaccgggaccaccat

SEQ ID NO: 128094 - DNA, 24 bp, Artificial Sequence
  Description of Artificial Sequence: Synthetic oligonucleotide
cgcacgcaagaccgggaccaccat

SEQ ID NO: 128095 - DNA, 24 bp, Artificial Sequence
  Description of Artificial Sequence: Synthetic oligonucleotide
gcacgcaagaccgggaccaccatc

SEQ ID NO: 128096 - DNA, 24 bp, Artificial Sequence
  Description of Artificial Sequence: Synthetic oligonucleotide
cacgcaagaccgggaccaccatcg

SEQ ID NO: 128097 - DNA, 24 bp, Artificial Sequence
  Description of Artificial Sequence: Synthetic oligonucleotide
acgcaagaccgggaccaccatcgc

SEQ ID NO: 128098 - DNA, 23 bp, Artificial Sequence
  Description of Artificial Sequence: Synthetic oligonucleotide
cgcaagaccgggaccaccatcgc

SEQ ID NO: 128099 - DNA, 23 bp, Artificial Sequence
  Description of Artificial Sequence: Synthetic oligonucleotide
gcaagaccgggaccaccatcgcg

SEQ ID NO: 128100 - DNA, 23 bp, Artificial Sequence
  Description of Artificial Sequence: Synthetic oligonucleotide
caagaccgggaccaccatcgcgg

SEQ ID NO: 128101 - DNA, 23 bp, Artificial Sequence
  Description of Artificial Sequence: Synthetic oligonucleotide
aagaccgggaccaccatcgcggg

SEQ ID NO: 128102 - DNA, 22 bp, Artificial Sequence
  Description of Artificial Sequence: Synthetic oligonucleotide
agaccgggaccaccatcgcggg

SEQ ID NO: 128103 - DNA, 21 bp, Artificial Sequence
  Description of Artificial Sequence: Synthetic oligonucleotide
gaccgggaccaccatcgcggg

SEQ ID NO: 128104 - DNA, 21 bp, Artificial Sequence
  Description of Artificial Sequence: Synthetic oligonucleotide
accgggaccaccatcgcgggc

SEQ ID NO: 128105 - DNA, 20 bp, Artificial Sequence
  Description of Artificial Sequence: Synthetic oligonucleotide
ccgggaccaccatcgcgggc

SEQ ID NO: 128106 - DNA, 21 bp, Artificial Sequence
  Description of Artificial Sequence: Synthetic oligonucleotide
cgggaccaccatcgcgggcct

SEQ ID NO: 128107 - DNA, 21 bp, Artificial Sequence
  Description of Artificial Sequence: Synthetic oligonucleotide
gggaccaccatcgcgggcctg

SEQ ID NO: 128108 - DNA, 22 bp, Artificial Sequence
  Description of Artificial Sequence: Synthetic oligonucleotide
ggaccaccatcgcgggcctggt

SEQ ID NO: 128109 - DNA, 24 bp, Artificial Sequence
  Description of Artificial Sequence: Synthetic oligonucleotide
gaccaccatcgcgggcctggtgtt

SEQ ID NO: 128110 - DNA, 24 bp, Artificial Sequence
  Description of Artificial Sequence: Synthetic oligonucleotide
accaccatcgcgggcctggtgttc

SEQ ID NO: 128111 - DNA, 23 bp, Artificial Sequence
  Description of Artificial Sequence: Synthetic oligonucleotide
ccaccatcgcgggcctggtgttc

SEQ ID NO: 128112 - DNA, 25 bp, Artificial Sequence
  Description of Artificial Sequence: Synthetic oligonucleotide
caccatcgcgggcctggtgttccaa

SEQ ID NO: 128113 - DNA, 26 bp, Artificial Sequence
  Description of Artificial Sequence: Synthetic oligonucleotide
accatcgcgggcctggtgttccaaga

SEQ ID NO: 128114 - DNA, 25 bp, Artificial Sequence
  Description of Artificial Sequence: Synthetic oligonucleotide
ccatcgcgggcctggtgttccaaga

SEQ ID NO: 128115 - DNA, 25 bp, Artificial Sequence
  Description of Artificial Sequence: Synthetic oligonucleotide
catcgcgggcctggtgttccaagac

SEQ ID NO: 128116 - DNA, 25 bp, Artificial Sequence
  Description of Artificial Sequence: Synthetic oligonucleotide
atcgcgggcctggtgttccaagacg

SEQ ID NO: 128117 - DNA, 24 bp, Artificial Sequence
  Description of Artificial Sequence: Synthetic oligonucleotide
tcgcgggcctggtgttccaagacg

SEQ ID NO: 128118 - DNA, 23 bp, Artificial Sequence
  Description of Artificial Sequence: Synthetic oligonucleotide
cgcgggcctggtgttccaagacg

SEQ ID NO: 128119 - DNA, 23 bp, Artificial Sequence
  Description of Artificial Sequence: Synthetic oligonucleotide
gcgggcctggtgttccaagacgg

SEQ ID NO: 128120 - DNA, 23 bp, Artificial Sequence
  Description of Artificial Sequence: Synthetic oligonucleotide
cgggcctggtgttccaagacggg

SEQ ID NO: 128121 - DNA, 24 bp, Artificial Sequence
  Description of Artificial Sequence: Synthetic oligonucleotide
gggcctggtgttccaagacggggt

SEQ ID NO: 128122 - DNA, 27 bp, Artificial Sequence
  Description of Artificial Sequence: Synthetic oligonucleotide
ggcctggtgttccaagacggggtcatt

SEQ ID NO: 128123 - DNA, 27 bp, Artificial Sequence
  Description of Artificial Sequence: Synthetic oligonucleotide
gcctggtgttccaagacggggtcattc

SEQ ID NO: 128124 - DNA, 28 bp, Artificial Sequence
  Description of Artificial Sequence: Synthetic oligonucleotide
cctggtgttccaagacggggtcattctg

SEQ ID NO: 128125 - DNA, 28 bp, Artificial Sequence
  Description of Artificial Sequence: Synthetic oligonucleotide
ctggtgttccaagacggggtcattctgg

SEQ ID NO: 128126 - DNA, 28 bp, Artificial Sequence
  Description of Artificial Sequence: Synthetic oligonucleotide
tggtgttccaagacggggtcattctggg

SEQ ID NO: 128127 - DNA, 27 bp, Artificial Sequence
  Description of Artificial Sequence: Synthetic oligonucleotide
ggtgttccaagacggggtcattctggg

SEQ ID NO: 128128 - DNA, 27 bp, Artificial Sequence
  Description of Artificial Sequence: Synthetic oligonucleotide
gtgttccaagacggggtcattctgggc

SEQ ID NO: 128129 - DNA, 27 bp, Artificial Sequence
  Description of Artificial Sequence: Synthetic oligonucleotide
tgttccaagacggggtcattctgggcg

SEQ ID NO: 128130 - DNA, 26 bp, Artificial Sequence
  Description of Artificial Sequence: Synthetic oligonucleotide
gttccaagacggggtcattctgggcg

SEQ ID NO: 128131 - DNA, 26 bp, Artificial Sequence
  Description of Artificial Sequence: Synthetic oligonucleotide
ttccaagacggggtcattctgggcgc

SEQ ID NO: 128132 - DNA, 25 bp, Artificial Sequence
  Description of Artificial Sequence: Synthetic oligonucleotide
tccaagacggggtcattctgggcgc

SEQ ID NO: 128133 - DNA, 24 bp, Artificial Sequence
  Description of Artificial Sequence: Synthetic oligonucleotide
ccaagacggggtcattctgggcgc

SEQ ID NO: 128134 - DNA, 24 bp, Artificial Sequence
  Description of Artificial Sequence: Synthetic oligonucleotide
caagacggggtcattctgggcgcc

SEQ ID NO: 128135 - DNA, 27 bp, Artificial Sequence
  Description of Artificial Sequence: Synthetic oligonucleotide
aagacggggtcattctgggcgccgata

SEQ ID NO: 128136 - DNA, 26 bp, Artificial Sequence
  Description of Artificial Sequence: Synthetic oligonucleotide
agacggggtcattctgggcgccgata

SEQ ID NO: 128137 - DNA, 25 bp, Artificial Sequence
  Description of Artificial Sequence: Synthetic oligonucleotide
gacggggtcattctgggcgccgata

SEQ ID NO: 128138 - DNA, 25 bp, Artificial Sequence
  Description of Artificial Sequence: Synthetic oligonucleotide
acggggtcattctgggcgccgatac

SEQ ID NO: 128139 - DNA, 24 bp, Artificial Sequence
  Description of Artificial Sequence: Synthetic oligonucleotide
cggggtcattctgggcgccgatac

SEQ ID NO: 128140 - DNA, 24 bp, Artificial Sequence
  Description of Artificial Sequence: Synthetic oligonucleotide
ggggtcattctgggcgccgatacg

SEQ ID NO: 128141 - DNA, 24 bp, Artificial Sequence
  Description of Artificial Sequence: Synthetic oligonucleotide
gggtcattctgggcgccgatacgc

SEQ ID NO: 128142 - DNA, 25 bp, Artificial Sequence
  Description of Artificial Sequence: Synthetic oligonucleotide
ggtcattctgggcgccgatacgcga

SEQ ID NO: 128143 - DNA, 25 bp, Artificial Sequence
  Description of Artificial Sequence: Synthetic oligonucleotide
gtcattctgggcgccgatacgcgag

SEQ ID NO: 128144 - DNA, 25 bp, Artificial Sequence
  Description of Artificial Sequence: Synthetic oligonucleotide
tcattctgggcgccgatacgcgagc

SEQ ID NO: 128145 - DNA, 24 bp, Artificial Sequence
  Description of Artificial Sequence: Synthetic oligonucleotide
cattctgggcgccgatacgcgagc

SEQ ID NO: 128146 - DNA, 25 bp, Artificial Sequence
  Description of Artificial Sequence: Synthetic oligonucleotide
attctgggcgccgatacgcgagcca

SEQ ID NO: 128147 - DNA, 24 bp, Artificial Sequence
  Description of Artificial Sequence: Synthetic oligonucleotide
ttctgggcgccgatacgcgagcca

SEQ ID NO: 128148 - DNA, 23 bp, Artificial Sequence
  Description of Artificial Sequence: Synthetic oligonucleotide
tctgggcgccgatacgcgagcca

SEQ ID NO: 128149 - DNA, 22 bp, Artificial Sequence
  Description of Artificial Sequence: Synthetic oligonucleotide
ctgggcgccgatacgcgagcca

SEQ ID NO: 128150 - DNA, 25 bp, Artificial Sequence
  Description of Artificial Sequence: Synthetic oligonucleotide
tgggcgccgatacgcgagccactaa

SEQ ID NO: 128151 - DNA, 24 bp, Artificial Sequence
  Description of Artificial Sequence: Synthetic oligonucleotide
gggcgccgatacgcgagccactaa

SEQ ID NO: 128152 - DNA, 24 bp, Artificial Sequence
  Description of Artificial Sequence: Synthetic oligonucleotide
ggcgccgatacgcgagccactaac

SEQ ID NO: 128153 - DNA, 27 bp, Artificial Sequence
  Description of Artificial Sequence: Synthetic oligonucleotide
gcgccgatacgcgagccactaacgatt

SEQ ID NO: 128154 - DNA, 27 bp, Artificial Sequence
  Description of Artificial Sequence: Synthetic oligonucleotide
cgccgatacgcgagccactaacgattc

SEQ ID NO: 128155 - DNA, 27 bp, Artificial Sequence
  Description of Artificial Sequence: Synthetic oligonucleotide
gccgatacgcgagccactaacgattcg

SEQ ID NO: 128156 - DNA, 27 bp, Artificial Sequence
  Description of Artificial Sequence: Synthetic oligonucleotide
ccgatacgcgagccactaacgattcgg

SEQ ID NO: 128157 - DNA, 28 bp, Artificial Sequence
  Description of Artificial Sequence: Synthetic oligonucleotide
cgatacgcgagccactaacgattcggtc

SEQ ID NO: 128158 - DNA, 28 bp, Artificial Sequence
  Description of Artificial Sequence: Synthetic oligonucleotide
gatacgcgagccactaacgattcggtcg

SEQ ID NO: 128159 - DNA, 29 bp, Artificial Sequence
  Description of Artificial Sequence: Synthetic oligonucleotide
atacgcgagccactaacgattcggtcgtg

SEQ ID NO: 128160 - DNA, 28 bp, Artificial Sequence
  Description of Artificial Sequence: Synthetic oligonucleotide
tacgcgagccactaacgattcggtcgtg

SEQ ID NO: 128161 - DNA, 27 bp, Artificial Sequence
  Description of Artificial Sequence: Synthetic oligonucleotide
acgcgagccactaacgattcggtcgtg

SEQ ID NO: 128162 - DNA, 26 bp, Artificial Sequence
  Description of Artificial Sequence: Synthetic oligonucleotide
cgcgagccactaacgattcggtcgtg

SEQ ID NO: 128163 - DNA, 26 bp, Artificial Sequence
  Description of Artificial Sequence: Synthetic oligonucleotide
gcgagccactaacgattcggtcgtgg

SEQ ID NO: 128164 - DNA, 26 bp, Artificial Sequence
  Description of Artificial Sequence: Synthetic oligonucleotide
cgagccactaacgattcggtcgtggc

SEQ ID NO: 128165 - DNA, 26 bp, Artificial Sequence
  Description of Artificial Sequence: Synthetic oligonucleotide
gagccactaacgattcggtcgtggcg

SEQ ID NO: 128166 - DNA, 27 bp, Artificial Sequence
  Description of Artificial Sequence: Synthetic oligonucleotide
agccactaacgattcggtcgtggcgga

SEQ ID NO: 128167 - DNA, 26 bp, Artificial Sequence
  Description of Artificial Sequence: Synthetic oligonucleotide
gccactaacgattcggtcgtggcgga

SEQ ID NO: 128168 - DNA, 27 bp, Artificial Sequence
  Description of Artificial Sequence: Synthetic oligonucleotide
ccactaacgattcggtcgtggcggaca

SEQ ID NO: 128169 - DNA, 28 bp, Artificial Sequence
  Description of Artificial Sequence: Synthetic oligonucleotide
cactaacgattcggtcgtggcggacaag

SEQ ID NO: 128170 - DNA, 29 bp, Artificial Sequence
  Description of Artificial Sequence: Synthetic oligonucleotide
actaacgattcggtcgtggcggacaagag

SEQ ID NO: 128171 - DNA, 28 bp, Artificial Sequence
  Description of Artificial Sequence: Synthetic oligonucleotide
ctaacgattcggtcgtggcggacaagag

SEQ ID NO: 128172 - DNA, 28 bp, Artificial Sequence
  Description of Artificial Sequence: Synthetic oligonucleotide
taacgattcggtcgtggcggacaagagc

SEQ ID NO: 128173 - DNA, 27 bp, Artificial Sequence
  Description of Artificial Sequence: Synthetic oligonucleotide
aacgattcggtcgtggcggacaagagc

SEQ ID NO: 128174 - DNA, 27 bp, Artificial Sequence
  Description of Artificial Sequence: Synthetic oligonucleotide
acgattcggtcgtggcggacaagagct

SEQ ID NO: 128175 - DNA, 26 bp, Artificial Sequence
  Description of Artificial Sequence: Synthetic oligonucleotide
cgattcggtcgtggcggacaagagct

SEQ ID NO: 128176 - DNA, 26 bp, Artificial Sequence
  Description of Artificial Sequence: Synthetic oligonucleotide
gattcggtcgtggcggacaagagctg

SEQ ID NO: 128177 - DNA, 26 bp, Artificial Sequence
  Description of Artificial Sequence: Synthetic oligonucleotide
attcggtcgtggcggacaagagctgc

SEQ ID NO: 128178 - DNA, 25 bp, Artificial Sequence
  Description of Artificial Sequence: Synthetic oligonucleotide
ttcggtcgtggcggacaagagctgc

SEQ ID NO: 128179 - DNA, 24 bp, Artificial Sequence
  Description of Artificial Sequence: Synthetic oligonucleotide
tcggtcgtggcggacaagagctgc

SEQ ID NO: 128180 - DNA, 23 bp, Artificial Sequence
  Description of Artificial Sequence: Synthetic oligonucleotide
cggtcgtggcggacaagagctgc

SEQ ID NO: 128181 - DNA, 24 bp, Artificial Sequence
  Description of Artificial Sequence: Synthetic oligonucleotide
ggtcgtggcggacaagagctgcga

SEQ ID NO: 128182 - DNA, 26 bp, Artificial Sequence
  Description of Artificial Sequence: Synthetic oligonucleotide
gtcgtggcggacaagagctgcgagaa

SEQ ID NO: 128183 - DNA, 27 bp, Artificial Sequence
  Description of Artificial Sequence: Synthetic oligonucleotide
tcgtggcggacaagagctgcgagaaga

SEQ ID NO: 128184 - DNA, 27 bp, Artificial Sequence
  Description of Artificial Sequence: Synthetic oligonucleotide
cgtggcggacaagagctgcgagaagat

SEQ ID NO: 128185 - DNA, 27 bp, Artificial Sequence
  Description of Artificial Sequence: Synthetic oligonucleotide
gtggcggacaagagctgcgagaagatc

SEQ ID NO: 128186 - DNA, 27 bp, Artificial Sequence
  Description of Artificial Sequence: Synthetic oligonucleotide
tggcggacaagagctgcgagaagatcc

SEQ ID NO: 128187 - DNA, 27 bp, Artificial Sequence
  Description of Artificial Sequence: Synthetic oligonucleotide
ggcggacaagagctgcgagaagatcca

SEQ ID NO: 128188 - DNA, 27 bp, Artificial Sequence
  Description of Artificial Sequence: Synthetic oligonucleotide
gcggacaagagctgcgagaagatccac

SEQ ID NO: 128189 - DNA, 29 bp, Artificial Sequence
  Description of Artificial Sequence: Synthetic oligonucleotide
cggacaagagctgcgagaagatccacttc

SEQ ID NO: 128190 - DNA, 31 bp, Artificial Sequence
  Description of Artificial Sequence: Synthetic oligonucleotide
ggacaagagctgcgagaagatccacttcatc

SEQ ID NO: 128191 - DNA, 31 bp, Artificial Sequence
  Description of Artificial Sequence: Synthetic oligonucleotide
gacaagagctgcgagaagatccacttcatcg

SEQ ID NO: 128192 - DNA, 31 bp, Artificial Sequence
  Description of Artificial Sequence: Synthetic oligonucleotide
acaagagctgcgagaagatccacttcatcgc

SEQ ID NO: 128193 - DNA, 30 bp, Artificial Sequence
  Description of Artificial Sequence: Synthetic oligonucleotide
caagagctgcgagaagatccacttcatcgc

SEQ ID NO: 128194 - DNA, 30 bp, Artificial Sequence
  Description of Artificial Sequence: Synthetic oligonucleotide
aagagctgcgagaagatccacttcatcgcc

SEQ ID NO: 128195 - DNA, 29 bp, Artificial Sequence
  Description of Artificial Sequence: Synthetic oligonucleotide
agagctgcgagaagatccacttcatcgcc

SEQ ID NO: 128196 - DNA, 28 bp, Artificial Sequence
  Description of Artificial Sequence: Synthetic oligonucleotide
gagctgcgagaagatccacttcatcgcc

SEQ ID NO: 128197 - DNA, 28 bp, Artificial Sequence
  Description of Artificial Sequence: Synthetic oligonucleotide
agctgcgagaagatccacttcatcgccc

SEQ ID NO: 128198 - DNA, 27 bp, Artificial Sequence
  Description of Artificial Sequence: Synthetic oligonucleotide
gctgcgagaagatccacttcatcgccc

SEQ ID NO: 128199 - DNA, 27 bp, Artificial Sequence
  Description of Artificial Sequence: Synthetic oligonucleotide
ctgcgagaagatccacttcatcgcccc

SEQ ID NO: 128200 - DNA, 27 bp, Artificial Sequence
  Description of Artificial Sequence: Synthetic oligonucleotide
tgcgagaagatccacttcatcgccccc

SEQ ID NO: 128201 - DNA, 27 bp, Artificial Sequence
  Description of Artificial Sequence: Synthetic oligonucleotide
gcgagaagatccacttcatcgccccca

SEQ ID NO: 128202 - DNA, 31 bp, Artificial Sequence
  Description of Artificial Sequence: Synthetic oligonucleotide
cgagaagatccacttcatcgcccccaaaatc

SEQ ID NO: 128203 - DNA, 33 bp, Artificial Sequence
  Description of Artificial Sequence: Synthetic oligonucleotide
gagaagatccacttcatcgcccccaaaatctac

SEQ ID NO: 128204 - DNA, 34 bp, Artificial Sequence
  Description of Artificial Sequence: Synthetic oligonucleotide
agaagatccacttcatcgcccccaaaatctactg

SEQ ID NO: 128205 - DNA, 33 bp, Artificial Sequence
  Description of Artificial Sequence: Synthetic oligonucleotide
gaagatccacttcatcgcccccaaaatctactg

SEQ ID NO: 128206 - DNA, 33 bp, Artificial Sequence
  Description of Artificial Sequence: Synthetic oligonucleotide
aagatccacttcatcgcccccaaaatctactgc

SEQ ID NO: 128207 - DNA, 32 bp, Artificial Sequence
  Description of Artificial Sequence: Synthetic oligonucleotide
agatccacttcatcgcccccaaaatctactgc

SEQ ID NO: 128208 - DNA, 31 bp, Artificial Sequence
  Description of Artificial Sequence: Synthetic oligonucleotide
gatccacttcatcgcccccaaaatctactgc

SEQ ID NO: 128209 - DNA, 32 bp, Artificial Sequence
  Description of Artificial Sequence: Synthetic oligonucleotide
atccacttcatcgcccccaaaatctactgctg

SEQ ID NO: 128210 - DNA, 31 bp, Artificial Sequence
  Description of Artificial Sequence: Synthetic oligonucleotide
tccacttcatcgcccccaaaatctactgctg

SEQ ID NO: 128211 - DNA, 30 bp, Artificial Sequence
  Description of Artificial Sequence: Synthetic oligonucleotide
ccacttcatcgcccccaaaatctactgctg

SEQ ID NO: 128212 - DNA, 31 bp, Artificial Sequence
  Description of Artificial Sequence: Synthetic oligonucleotide
cacttcatcgcccccaaaatctactgctgtg

SEQ ID NO: 128213 - DNA, 31 bp, Artificial Sequence
  Description of Artificial Sequence: Synthetic oligonucleotide
acttcatcgcccccaaaatctactgctgtgg

SEQ ID NO: 128214 - DNA, 30 bp, Artificial Sequence
  Description of Artificial Sequence: Synthetic oligonucleotide
cttcatcgcccccaaaatctactgctgtgg

SEQ ID NO: 128215 - DNA, 30 bp, Artificial Sequence
  Description of Artificial Sequence: Synthetic oligonucleotide
ttcatcgcccccaaaatctactgctgtggg

SEQ ID NO: 128216 - DNA, 29 bp, Artificial Sequence
  Description of Artificial Sequence: Synthetic oligonucleotide
tcatcgcccccaaaatctactgctgtggg

SEQ ID NO: 128217 - DNA, 28 bp, Artificial Sequence
  Description of Artificial Sequence: Synthetic oligonucleotide
catcgcccccaaaatctactgctgtggg

SEQ ID NO: 128218 - DNA, 28 bp, Artificial Sequence
  Description of Artificial Sequence: Synthetic oligonucleotide
atcgcccccaaaatctactgctgtgggg

SEQ ID NO: 128219 - DNA, 27 bp, Artificial Sequence
  Description of Artificial Sequence: Synthetic oligonucleotide
tcgcccccaaaatctactgctgtgggg

SEQ ID NO: 128220 - DNA, 26 bp, Artificial Sequence
  Description of Artificial Sequence: Synthetic oligonucleotide
cgcccccaaaatctactgctgtgggg

SEQ ID NO: 128221 - DNA, 27 bp, Artificial Sequence
  Description of Artificial Sequence: Synthetic oligonucleotide
gcccccaaaatctactgctgtggggct

SEQ ID NO: 128222 - DNA, 27 bp, Artificial Sequence
  Description of Artificial Sequence: Synthetic oligonucleotide
cccccaaaatctactgctgtggggctg

SEQ ID NO: 128223 - DNA, 27 bp, Artificial Sequence
  Description of Artificial Sequence: Synthetic oligonucleotide
ccccaaaatctactgctgtggggctgg

SEQ ID NO: 128224 - DNA, 28 bp, Artificial Sequence
  Description of Artificial Sequence: Synthetic oligonucleotide
cccaaaatctactgctgtggggctggag

SEQ ID NO: 128225 - DNA, 30 bp, Artificial Sequence
  Description of Artificial Sequence: Synthetic oligonucleotide
ccaaaatctactgctgtggggctggagtag

SEQ ID NO: 128226 - DNA, 30 bp, Artificial Sequence
  Description of Artificial Sequence: Synthetic oligonucleotide
caaaatctactgctgtggggctggagtagc

SEQ ID NO: 128227 - DNA, 30 bp, Artificial Sequence
  Description of Artificial Sequence: Synthetic oligonucleotide
aaaatctactgctgtggggctggagtagcc

SEQ ID NO: 128228 - DNA, 29 bp, Artificial Sequence
  Description of Artificial Sequence: Synthetic oligonucleotide
aaatctactgctgtggggctggagtagcc

SEQ ID NO: 128229 - DNA, 28 bp, Artificial Sequence
  Description of Artificial Sequence: Synthetic oligonucleotide
aatctactgctgtggggctggagtagcc

SEQ ID NO: 128230 - DNA, 27 bp, Artificial Sequence
  Description of Artificial Sequence: Synthetic oligonucleotide
atctactgctgtggggctggagtagcc

SEQ ID NO: 128231 - DNA, 26 bp, Artificial Sequence
  Description of Artificial Sequence: Synthetic oligonucleotide
tctactgctgtggggctggagtagcc

SEQ ID NO: 128232 - DNA, 25 bp, Artificial Sequence
  Description of Artificial Sequence: Synthetic oligonucleotide
ctactgctgtggggctggagtagcc

SEQ ID NO: 128233 - DNA, 25 bp, Artificial Sequence
  Description of Artificial Sequence: Synthetic oligonucleotide
tactgctgtggggctggagtagccg

SEQ ID NO: 128234 - DNA, 24 bp, Artificial Sequence
  Description of Artificial Sequence: Synthetic oligonucleotide
actgctgtggggctggagtagccg

SEQ ID NO: 128235 - DNA, 23 bp, Artificial Sequence
  Description of Artificial Sequence: Synthetic oligonucleotide
ctgctgtggggctggagtagccg

SEQ ID NO: 128236 - DNA, 23 bp, Artificial Sequence
  Description of Artificial Sequence: Synthetic oligonucleotide
tgctgtggggctggagtagccgc

SEQ ID NO: 128237 - DNA, 22 bp, Artificial Sequence
  Description of Artificial Sequence: Synthetic oligonucleotide
gctgtggggctggagtagccgc

SEQ ID NO: 128238 - DNA, 22 bp, Artificial Sequence
  Description of Artificial Sequence: Synthetic oligonucleotide
ctgtggggctggagtagccgcg

SEQ ID NO: 128239 - DNA, 23 bp, Artificial Sequence
  Description of Artificial Sequence: Synthetic oligonucleotide
tgtggggctggagtagccgcgga

SEQ ID NO: 128240 - DNA, 22 bp, Artificial Sequence
  Description of Artificial Sequence: Synthetic oligonucleotide
gtggggctggagtagccgcgga

SEQ ID NO: 128241 - DNA, 22 bp, Artificial Sequence
  Description of Artificial Sequence: Synthetic oligonucleotide
tggggctggagtagccgcggac

SEQ ID NO: 128242 - DNA, 21 bp, Artificial Sequence
  Description of Artificial Sequence: Synthetic oligonucleotide
ggggctggagtagccgcggac

SEQ ID NO: 128243 - DNA, 21 bp, Artificial Sequence
  Description of Artificial Sequence: Synthetic oligonucleotide
gggctggagtagccgcggacg

SEQ ID NO: 128244 - DNA, 21 bp, Artificial Sequence
  Description of Artificial Sequence: Synthetic oligonucleotide
ggctggagtagccgcggacgc

SEQ ID NO: 128245 - DNA, 21 bp, Artificial Sequence
  Description of Artificial Sequence: Synthetic oligonucleotide
gctggagtagccgcggacgcc

SEQ ID NO: 128246 - DNA, 22 bp, Artificial Sequence
  Description of Artificial Sequence: Synthetic oligonucleotide
ctggagtagccgcggacgccga

SEQ ID NO: 128247 - DNA, 24 bp, Artificial Sequence
  Description of Artificial Sequence: Synthetic oligonucleotide
tggagtagccgcggacgccgagat

SEQ ID NO: 128248 - DNA, 23 bp, Artificial Sequence
  Description of Artificial Sequence: Synthetic oligonucleotide
ggagtagccgcggacgccgagat

SEQ ID NO: 128249 - DNA, 24 bp, Artificial Sequence
  Description of Artificial Sequence: Synthetic oligonucleotide
gagtagccgcggacgccgagatga

SEQ ID NO: 128250 - DNA, 24 bp, Artificial Sequence
  Description of Artificial Sequence: Synthetic oligonucleotide
agtagccgcggacgccgagatgac

SEQ ID NO: 128251 - DNA, 23 bp, Artificial Sequence
  Description of Artificial Sequence: Synthetic oligonucleotide
gtagccgcggacgccgagatgac

SEQ ID NO: 128252 - DNA, 24 bp, Artificial Sequence
  Description of Artificial Sequence: Synthetic oligonucleotide
tagccgcggacgccgagatgacca

SEQ ID NO: 128253 - DNA, 23 bp, Artificial Sequence
  Description of Artificial Sequence: Synthetic oligonucleotide
agccgcggacgccgagatgacca

SEQ ID NO: 128254 - DNA, 22 bp, Artificial Sequence
  Description of Artificial Sequence: Synthetic oligonucleotide
gccgcggacgccgagatgacca

SEQ ID NO: 128255 - DNA, 23 bp, Artificial Sequence
  Description of Artificial Sequence: Synthetic oligonucleotide
ccgcggacgccgagatgaccaca

SEQ ID NO: 128256 - DNA, 23 bp, Artificial Sequence
  Description of Artificial Sequence: Synthetic oligonucleotide
cgcggacgccgagatgaccacac

SEQ ID NO: 128257 - DNA, 23 bp, Artificial Sequence
  Description of Artificial Sequence: Synthetic oligonucleotide
gcggacgccgagatgaccacacg

SEQ ID NO: 128258 - DNA, 25 bp, Artificial Sequence
  Description of Artificial Sequence: Synthetic oligonucleotide
cggacgccgagatgaccacacggat

SEQ ID NO: 128259 - DNA, 25 bp, Artificial Sequence
  Description of Artificial Sequence: Synthetic oligonucleotide
ggacgccgagatgaccacacggatg

SEQ ID NO: 128260 - DNA, 26 bp, Artificial Sequence
  Description of Artificial Sequence: Synthetic oligonucleotide
gacgccgagatgaccacacggatggt

SEQ ID NO: 128261 - DNA, 26 bp, Artificial Sequence
  Description of Artificial Sequence: Synthetic oligonucleotide
acgccgagatgaccacacggatggtg

SEQ ID NO: 128262 - DNA, 25 bp, Artificial Sequence
  Description of Artificial Sequence: Synthetic oligonucleotide
cgccgagatgaccacacggatggtg

SEQ ID NO: 128263 - DNA, 25 bp, Artificial Sequence
  Description of Artificial Sequence: Synthetic oligonucleotide
gccgagatgaccacacggatggtgg

SEQ ID NO: 128264 - DNA, 25 bp, Artificial Sequence
  Description of Artificial Sequence: Synthetic oligonucleotide
ccgagatgaccacacggatggtggc

SEQ ID NO: 128265 - DNA, 26 bp, Artificial Sequence
  Description of Artificial Sequence: Synthetic oligonucleotide
cgagatgaccacacggatggtggcgt

SEQ ID NO: 128266 - DNA, 26 bp, Artificial Sequence
  Description of Artificial Sequence: Synthetic oligonucleotide
gagatgaccacacggatggtggcgtc

SEQ ID NO: 128267 - DNA, 27 bp, Artificial Sequence
  Description of Artificial Sequence: Synthetic oligonucleotide
agatgaccacacggatggtggcgtcca

SEQ ID NO: 128268 - DNA, 27 bp, Artificial Sequence
  Description of Artificial Sequence: Synthetic oligonucleotide
gatgaccacacggatggtggcgtccaa

SEQ ID NO: 128269 - DNA, 27 bp, Artificial Sequence
  Description of Artificial Sequence: Synthetic oligonucleotide
atgaccacacggatggtggcgtccaag

SEQ ID NO: 128270 - DNA, 27 bp, Artificial Sequence
  Description of Artificial Sequence: Synthetic oligonucleotide
tgaccacacggatggtggcgtccaaga

SEQ ID NO: 128271 - DNA, 27 bp, Artificial Sequence
  Description of Artificial Sequence: Synthetic oligonucleotide
gaccacacggatggtggcgtccaagat

SEQ ID NO: 128272 - DNA, 27 bp, Artificial Sequence
  Description of Artificial Sequence: Synthetic oligonucleotide
accacacggatggtggcgtccaagatg

SEQ ID NO: 128273 - DNA, 26 bp, Artificial Sequence
  Description of Artificial Sequence: Synthetic oligonucleotide
ccacacggatggtggcgtccaagatg

SEQ ID NO: 128274 - DNA, 27 bp, Artificial Sequence
  Description of Artificial Sequence: Synthetic oligonucleotide
cacacggatggtggcgtccaagatgga

SEQ ID NO: 128275 - DNA, 27 bp, Artificial Sequence
  Description of Artificial Sequence: Synthetic oligonucleotide
acacggatggtggcgtccaagatggag

SEQ ID NO: 128276 - DNA, 26 bp, Artificial Sequence
  Description of Artificial Sequence: Synthetic oligonucleotide
cacggatggtggcgtccaagatggag

SEQ ID NO: 128277 - DNA, 27 bp, Artificial Sequence
  Description of Artificial Sequence: Synthetic oligonucleotide
acggatggtggcgtccaagatggagct

SEQ ID NO: 128278 - DNA, 27 bp, Artificial Sequence
  Description of Artificial Sequence: Synthetic oligonucleotide
cggatggtggcgtccaagatggagcta

SEQ ID NO: 128279 - DNA, 27 bp, Artificial Sequence
  Description of Artificial Sequence: Synthetic oligonucleotide
ggatggtggcgtccaagatggagctac

SEQ ID NO: 128280 - DNA, 28 bp, Artificial Sequence
  Description of Artificial Sequence: Synthetic oligonucleotide
gatggtggcgtccaagatggagctacac

SEQ ID NO: 128281 - DNA, 28 bp, Artificial Sequence
  Description of Artificial Sequence: Synthetic oligonucleotide
atggtggcgtccaagatggagctacacg

SEQ ID NO: 128282 - DNA, 27 bp, Artificial Sequence
  Description of Artificial Sequence: Synthetic oligonucleotide
tggtggcgtccaagatggagctacacg

SEQ ID NO: 128283 - DNA, 26 bp, Artificial Sequence
  Description of Artificial Sequence: Synthetic oligonucleotide
ggtggcgtccaagatggagctacacg

SEQ ID NO: 128284 - DNA, 26 bp, Artificial Sequence
  Description of Artificial Sequence: Synthetic oligonucleotide
gtggcgtccaagatggagctacacgc

SEQ ID NO: 128285 - DNA, 27 bp, Artificial Sequence
  Description of Artificial Sequence: Synthetic oligonucleotide
tggcgtccaagatggagctacacgcgt

SEQ ID NO: 128286 - DNA, 27 bp, Artificial Sequence
  Description of Artificial Sequence: Synthetic oligonucleotide
ggcgtccaagatggagctacacgcgtt

SEQ ID NO: 128287 - DNA, 29 bp, Artificial Sequence
  Description of Artificial Sequence: Synthetic oligonucleotide
gcgtccaagatggagctacacgcgttatc

SEQ ID NO: 128288 - DNA, 31 bp, Artificial Sequence
  Description of Artificial Sequence: Synthetic oligonucleotide
cgtccaagatggagctacacgcgttatctac

SEQ ID NO: 128289 - DNA, 31 bp, Artificial Sequence
  Description of Artificial Sequence: Synthetic oligonucleotide
gtccaagatggagctacacgcgttatctacg

SEQ ID NO: 128290 - DNA, 31 bp, Artificial Sequence
  Description of Artificial Sequence: Synthetic oligonucleotide
tccaagatggagctacacgcgttatctacgg

SEQ ID NO: 128291 - DNA, 30 bp, Artificial Sequence
  Description of Artificial Sequence: Synthetic oligonucleotide
ccaagatggagctacacgcgttatctacgg

SEQ ID NO: 128292 - DNA, 30 bp, Artificial Sequence
  Description of Artificial Sequence: Synthetic oligonucleotide
caagatggagctacacgcgttatctacggg

SEQ ID NO: 128293 - DNA, 30 bp, Artificial Sequence
  Description of Artificial Sequence: Synthetic oligonucleotide
aagatggagctacacgcgttatctacgggc

SEQ ID NO: 128294 - DNA, 29 bp, Artificial Sequence
  Description of Artificial Sequence: Synthetic oligonucleotide
agatggagctacacgcgttatctacgggc

SEQ ID NO: 128295 - DNA, 28 bp, Artificial Sequence
  Description of Artificial Sequence: Synthetic oligonucleotide
gatggagctacacgcgttatctacgggc

SEQ ID NO: 128296 - DNA, 28 bp, Artificial Sequence
  Description of Artificial Sequence: Synthetic oligonucleotide
atggagctacacgcgttatctacgggcc

SEQ ID NO: 128297 - DNA, 27 bp, Artificial Sequence
  Description of Artificial Sequence: Synthetic oligonucleotide
tggagctacacgcgttatctacgggcc

SEQ ID NO: 128298 - DNA, 26 bp, Artificial Sequence
  Description of Artificial Sequence: Synthetic oligonucleotide
ggagctacacgcgttatctacgggcc

SEQ ID NO: 128299 - DNA, 26 bp, Artificial Sequence
  Description of Artificial Sequence: Synthetic oligonucleotide
gagctacacgcgttatctacgggccg

SEQ ID NO: 128300 - DNA, 26 bp, Artificial Sequence
  Description of Artificial Sequence: Synthetic oligonucleotide
agctacacgcgttatctacgggccgc

SEQ ID NO: 128301 - DNA, 25 bp, Artificial Sequence
  Description of Artificial Sequence: Synthetic oligonucleotide
gctacacgcgttatctacgggccgc

SEQ ID NO: 128302 - DNA, 26 bp, Artificial Sequence
  Description of Artificial Sequence: Synthetic oligonucleotide
ctacacgcgttatctacgggccgcga

SEQ ID NO: 128303 - DNA, 26 bp, Artificial Sequence
  Description of Artificial Sequence: Synthetic oligonucleotide
tacacgcgttatctacgggccgcgag

SEQ ID NO: 128304 - DNA, 25 bp, Artificial Sequence
  Description of Artificial Sequence: Synthetic oligonucleotide
acacgcgttatctacgggccgcgag

SEQ ID NO: 128305 - DNA, 24 bp, Artificial Sequence
  Description of Artificial Sequence: Synthetic oligonucleotide
cacgcgttatctacgggccgcgag

SEQ ID NO: 128306 - DNA, 24 bp, Artificial Sequence
  Description of Artificial Sequence: Synthetic oligonucleotide
acgcgttatctacgggccgcgagc

SEQ ID NO: 128307 - DNA, 23 bp, Artificial Sequence
  Description of Artificial Sequence: Synthetic oligonucleotide
cgcgttatctacgggccgcgagc

SEQ ID NO: 128308 - DNA, 23 bp, Artificial Sequence
  Description of Artificial Sequence: Synthetic oligonucleotide
gcgttatctacgggccgcgagcc

SEQ ID NO: 128309 - DNA, 23 bp, Artificial Sequence
  Description of Artificial Sequence: Synthetic oligonucleotide
cgttatctacgggccgcgagccc

SEQ ID NO: 128310 - DNA, 23 bp, Artificial Sequence
  Description of Artificial Sequence: Synthetic oligonucleotide
gttatctacgggccgcgagcccc

SEQ ID NO: 128311 - DNA, 23 bp, Artificial Sequence
  Description of Artificial Sequence: Synthetic oligonucleotide
ttatctacgggccgcgagccccg

SEQ ID NO: 128312 - DNA, 22 bp, Artificial Sequence
  Description of Artificial Sequence: Synthetic oligonucleotide
tatctacgggccgcgagccccg

SEQ ID NO: 128313 - DNA, 21 bp, Artificial Sequence
  Description of Artificial Sequence: Synthetic oligonucleotide
atctacgggccgcgagccccg

SEQ ID NO: 128314 - DNA, 20 bp, Artificial Sequence
  Description of Artificial Sequence: Synthetic oligonucleotide
tctacgggccgcgagccccg

SEQ ID NO: 128315 - DNA, 20 bp, Artificial Sequence
  Description of Artificial Sequence: Synthetic oligonucleotide
ctacgggccgcgagccccgt

SEQ ID NO: 128316 - DNA, 20 bp, Artificial Sequence
  Description of Artificial Sequence: Synthetic oligonucleotide
tacgggccgcgagccccgct

SEQ ID NO: 128317 - DNA, 20 bp, Artificial Sequence
  Description of Artificial Sequence: Synthetic oligonucleotide
acgggccgcgagccccgctt

SEQ ID NO: 128318 - DNA, 20 bp, Artificial Sequence
  Description of Artificial Sequence: Synthetic oligonucleotide
cgggccgcgagccccgcttt

SEQ ID NO: 128319 - DNA, 20 bp, Artificial Sequence
  Description of Artificial Sequence: Synthetic oligonucleotide
gggccgcgagccccgcgttt

SEQ ID NO: 128320 - DNA, 20 bp, Artificial Sequence
  Description of Artificial Sequence: Synthetic oligonucleotide
ggccgcgagccccgcgtgtt

SEQ ID NO: 128321 - DNA, 20 bp, Artificial Sequence
  Description of Artificial Sequence: Synthetic oligonucleotide
gccgcgagccccgcgtggtt

SEQ ID NO: 128322 - DNA, 20 bp, Artificial Sequence
  Description of Artificial Sequence: Synthetic oligonucleotide
ccgcgagccccgcgtggctt

SEQ ID NO: 128323 - DNA, 20 bp, Artificial Sequence
  Description of Artificial Sequence: Synthetic oligonucleotide
cgcgagccccgcgtggccat

SEQ ID NO: 128324 - DNA, 20 bp, Artificial Sequence
  Description of Artificial Sequence: Synthetic oligonucleotide
gcgagccccgcgtggccact

SEQ ID NO: 128325 - DNA, 20 bp, Artificial Sequence
  Description of Artificial Sequence: Synthetic oligonucleotide
cgagccccgcgtggccacgt

SEQ ID NO: 128326 - DNA, 20 bp, Artificial Sequence
  Description of Artificial Sequence: Synthetic oligonucleotide
gagccccgcgtggccacggt

SEQ ID NO: 128327 - DNA, 21 bp, Artificial Sequence
  Description of Artificial Sequence: Synthetic oligonucleotide
agccccgcgtggccacggtca

SEQ ID NO: 128328 - DNA, 20 bp, Artificial Sequence
  Description of Artificial Sequence: Synthetic oligonucleotide
gccccgcgtggccacggtca

SEQ ID NO: 128329 - DNA, 21 bp, Artificial Sequence
  Description of Artificial Sequence: Synthetic oligonucleotide
ccccgcgtggccacggtcact

SEQ ID NO: 128330 - DNA, 21 bp, Artificial Sequence
  Description of Artificial Sequence: Synthetic oligonucleotide
cccgcgtggccacggtcactc

SEQ ID NO: 128331 - DNA, 21 bp, Artificial Sequence
  Description of Artificial Sequence: Synthetic oligonucleotide
ccgcgtggccacggtcactcg

SEQ ID NO: 128332 - DNA, 23 bp, Artificial Sequence
  Description of Artificial Sequence: Synthetic oligonucleotide
cgcgtggccacggtcactcgcat

SEQ ID NO: 128333 - DNA, 23 bp, Artificial Sequence
  Description of Artificial Sequence: Synthetic oligonucleotide
gcgtggccacggtcactcgcatc

SEQ ID NO: 128334 - DNA, 24 bp, Artificial Sequence
  Description of Artificial Sequence: Synthetic oligonucleotide
cgtggccacggtcactcgcatcct

SEQ ID NO: 128335 - DNA, 24 bp, Artificial Sequence
  Description of Artificial Sequence: Synthetic oligonucleotide
gtggccacggtcactcgcatcctg

SEQ ID NO: 128336 - DNA, 24 bp, Artificial Sequence
  Description of Artificial Sequence: Synthetic oligonucleotide
tggccacggtcactcgcatcctgc

SEQ ID NO: 128337 - DNA, 23 bp, Artificial Sequence
  Description of Artificial Sequence: Synthetic oligonucleotide
ggccacggtcactcgcatcctgc

SEQ ID NO: 128338 - DNA, 23 bp, Artificial Sequence
  Description of Artificial Sequence: Synthetic oligonucleotide
gccacggtcactcgcatcctgcg

SEQ ID NO: 128339 - DNA, 23 bp, Artificial Sequence
  Description of Artificial Sequence: Synthetic oligonucleotide
ccacggtcactcgcatcctgcgc

SEQ ID NO: 128340 - DNA, 24 bp, Artificial Sequence
  Description of Artificial Sequence: Synthetic oligonucleotide
cacggtcactcgcatcctgcgcca

SEQ ID NO: 128341 - DNA, 25 bp, Artificial Sequence
  Description of Artificial Sequence: Synthetic oligonucleotide
acggtcactcgcatcctgcgccaga

SEQ ID NO: 128342 - DNA, 24 bp, Artificial Sequence
  Description of Artificial Sequence: Synthetic oligonucleotide
cggtcactcgcatcctgcgccaga

SEQ ID NO: 128343 - DNA, 24 bp, Artificial Sequence
  Description of Artificial Sequence: Synthetic oligonucleotide
ggtcactcgcatcctgcgccagac

SEQ ID NO: 128344 - DNA, 24 bp, Artificial Sequence
  Description of Artificial Sequence: Synthetic oligonucleotide
gtcactcgcatcctgcgccagacg

SEQ ID NO: 128345 - DNA, 25 bp, Artificial Sequence
  Description of Artificial Sequence: Synthetic oligonucleotide
tcactcgcatcctgcgccagacgct

SEQ ID NO: 128346 - DNA, 24 bp, Artificial Sequence
  Description of Artificial Sequence: Synthetic oligonucleotide
cactcgcatcctgcgccagacgct

SEQ ID NO: 128347 - DNA, 26 bp, Artificial Sequence
  Description of Artificial Sequence: Synthetic oligonucleotide
actcgcatcctgcgccagacgctctt

SEQ ID NO: 128348 - DNA, 25 bp, Artificial Sequence
  Description of Artificial Sequence: Synthetic oligonucleotide
ctcgcatcctgcgccagacgctctt

SEQ ID NO: 128349 - DNA, 26 bp, Artificial Sequence
  Description of Artificial Sequence: Synthetic oligonucleotide
tcgcatcctgcgccagacgctcttca

SEQ ID NO: 128350 - DNA, 25 bp, Artificial Sequence
  Description of Artificial Sequence: Synthetic oligonucleotide
cgcatcctgcgccagacgctcttca

SEQ ID NO: 128351 - DNA, 25 bp, Artificial Sequence
  Description of Artificial Sequence: Synthetic oligonucleotide
gcatcctgcgccagacgctcttcag

SEQ ID NO: 128352 - DNA, 27 bp, Artificial Sequence
  Description of Artificial Sequence: Synthetic oligonucleotide
catcctgcgccagacgctcttcaggta

SEQ ID NO: 128353 - DNA, 27 bp, Artificial Sequence
  Description of Artificial Sequence: Synthetic oligonucleotide
atcctgcgccagacgctcttcaggtac

SEQ ID NO: 128354 - DNA, 26 bp, Artificial Sequence
  Description of Artificial Sequence: Synthetic oligonucleotide
tcctgcgccagacgctcttcaggtac

SEQ ID NO: 128355 - DNA, 25 bp, Artificial Sequence
  Description of Artificial Sequence: Synthetic oligonucleotide
cctgcgccagacgctcttcaggtac

SEQ ID NO: 128356 - DNA, 26 bp, Artificial Sequence
  Description of Artificial Sequence: Synthetic oligonucleotide
ctgcgccagacgctcttcaggtacca

SEQ ID NO: 128357 - DNA, 26 bp, Artificial Sequence
  Description of Artificial Sequence: Synthetic oligonucleotide
tgcgccagacgctcttcaggtaccag

SEQ ID NO: 128358 - DNA, 25 bp, Artificial Sequence
  Description of Artificial Sequence: Synthetic oligonucleotide
gcgccagacgctcttcaggtaccag

SEQ ID NO: 128359 - DNA, 25 bp, Artificial Sequence
  Description of Artificial Sequence: Synthetic oligonucleotide
cgccagacgctcttcaggtaccagg

SEQ ID NO: 128360 - DNA, 25 bp, Artificial Sequence
  Description of Artificial Sequence: Synthetic oligonucleotide
gccagacgctcttcaggtaccaggg

SEQ ID NO: 128361 - DNA, 25 bp, Artificial Sequence
  Description of Artificial Sequence: Synthetic oligonucleotide
ccagacgctcttcaggtaccagggc

SEQ ID NO: 128362 - DNA, 26 bp, Artificial Sequence
  Description of Artificial Sequence: Synthetic oligonucleotide
cagacgctcttcaggtaccagggcca

SEQ ID NO: 128363 - DNA, 26 bp, Artificial Sequence
  Description of Artificial Sequence: Synthetic oligonucleotide
agacgctcttcaggtaccagggccac

SEQ ID NO: 128364 - DNA, 25 bp, Artificial Sequence
  Description of Artificial Sequence: Synthetic oligonucleotide
gacgctcttcaggtaccagggccac

SEQ ID NO: 128365 - DNA, 26 bp, Artificial Sequence
  Description of Artificial Sequence: Synthetic oligonucleotide
acgctcttcaggtaccagggccacgt

SEQ ID NO: 128366 - DNA, 25 bp, Artificial Sequence
  Description of Artificial Sequence: Synthetic oligonucleotide
cgctcttcaggtaccagggccacgt

SEQ ID NO: 128367 - DNA, 25 bp, Artificial Sequence
  Description of Artificial Sequence: Synthetic oligonucleotide
gctcttcaggtaccagggccacgtg

SEQ ID NO: 128368 - DNA, 25 bp, Artificial Sequence
  Description of Artificial Sequence: Synthetic oligonucleotide
ctcttcaggtaccagggccacgtgg

SEQ ID NO: 128369 - DNA, 26 bp, Artificial Sequence
  Description of Artificial Sequence: Synthetic oligonucleotide
tcttcaggtaccagggccacgtgggt

SEQ ID NO: 128370 - DNA, 25 bp, Artificial Sequence
  Description of Artificial Sequence: Synthetic oligonucleotide
cttcaggtaccagggccacgtgggt

SEQ ID NO: 128371 - DNA, 25 bp, Artificial Sequence
  Description of Artificial Sequence: Synthetic oligonucleotide
ttcaggtaccagggccacgtgggtg

SEQ ID NO: 128372 - DNA, 24 bp, Artificial Sequence
  Description of Artificial Sequence: Synthetic oligonucleotide
tcaggtaccagggccacgtgggtg

SEQ ID NO: 128373 - DNA, 23 bp, Artificial Sequence
  Description of Artificial Sequence: Synthetic oligonucleotide
caggtaccagggccacgtgggtg

SEQ ID NO: 128374 - DNA, 25 bp, Artificial Sequence
  Description of Artificial Sequence: Synthetic oligonucleotide
aggtaccagggccacgtgggtgcat

SEQ ID NO: 128375 - DNA, 24 bp, Artificial Sequence
  Description of Artificial Sequence: Synthetic oligonucleotide
ggtaccagggccacgtgggtgcat

SEQ ID NO: 128376 - DNA, 24 bp, Artificial Sequence
  Description of Artificial Sequence: Synthetic oligonucleotide
gtaccagggccacgtgggtgcatc

SEQ ID NO: 128377 - DNA, 24 bp, Artificial Sequence
  Description of Artificial Sequence: Synthetic oligonucleotide
taccagggccacgtgggtgcatcg

SEQ ID NO: 128378 - DNA, 23 bp, Artificial Sequence
  Description of Artificial Sequence: Synthetic oligonucleotide
accagggccacgtgggtgcatcg

SEQ ID NO: 128379 - DNA, 22 bp, Artificial Sequence
  Description of Artificial Sequence: Synthetic oligonucleotide
ccagggccacgtgggtgcatcg

SEQ ID NO: 128380 - DNA, 23 bp, Artificial Sequence
  Description of Artificial Sequence: Synthetic oligonucleotide
cagggccacgtgggtgcatcgct

SEQ ID NO: 128381 - DNA, 25 bp, Artificial Sequence
  Description of Artificial Sequence: Synthetic oligonucleotide
agggccacgtgggtgcatcgctgat

SEQ ID NO: 128382 - DNA, 24 bp, Artificial Sequence
  Description of Artificial Sequence: Synthetic oligonucleotide
gggccacgtgggtgcatcgctgat

SEQ ID NO: 128383 - DNA, 24 bp, Artificial Sequence
  Description of Artificial Sequence: Synthetic oligonucleotide
ggccacgtgggtgcatcgctgatc

SEQ ID NO: 128384 - DNA, 25 bp, Artificial Sequence
  Description of Artificial Sequence: Synthetic oligonucleotide
gccacgtgggtgcatcgctgatcgt

SEQ ID NO: 128385 - DNA, 25 bp, Artificial Sequence
  Description of Artificial Sequence: Synthetic oligonucleotide
ccacgtgggtgcatcgctgatcgtg

SEQ ID NO: 128386 - DNA, 25 bp, Artificial Sequence
  Description of Artificial Sequence: Synthetic oligonucleotide
cacgtgggtgcatcgctgatcgtgg

SEQ ID NO: 128387 - DNA, 25 bp, Artificial Sequence
  Description of Artificial Sequence: Synthetic oligonucleotide
acgtgggtgcatcgctgatcgtggg

SEQ ID NO: 128388 - DNA, 24 bp, Artificial Sequence
  Description of Artificial Sequence: Synthetic oligonucleotide
cgtgggtgcatcgctgatcgtggg

SEQ ID NO: 128389 - DNA, 24 bp, Artificial Sequence
  Description of Artificial Sequence: Synthetic oligonucleotide
gtgggtgcatcgctgatcgtgggc

SEQ ID NO: 128390 - DNA, 24 bp, Artificial Sequence
  Description of Artificial Sequence: Synthetic oligonucleotide
tgggtgcatcgctgatcgtgggcg

SEQ ID NO: 128391 - DNA, 23 bp, Artificial Sequence
  Description of Artificial Sequence: Synthetic oligonucleotide
gggtgcatcgctgatcgtgggcg

SEQ ID NO: 128392 - DNA, 23 bp, Artificial Sequence
  Description of Artificial Sequence: Synthetic oligonucleotide
ggtgcatcgctgatcgtgggcgg

SEQ ID NO: 128393 - DNA, 23 bp, Artificial Sequence
  Description of Artificial Sequence: Synthetic oligonucleotide
gtgcatcgctgatcgtgggcggc

SEQ ID NO: 128394 - DNA, 25 bp, Artificial Sequence
  Description of Artificial Sequence: Synthetic oligonucleotide
tgcatcgctgatcgtgggcggcgta

SEQ ID NO: 128395 - DNA, 24 bp, Artificial Sequence
  Description of Artificial Sequence: Synthetic oligonucleotide
gcatcgctgatcgtgggcggcgta

SEQ ID NO: 128396 - DNA, 25 bp, Artificial Sequence
  Description of Artificial Sequence: Synthetic oligonucleotide
catcgctgatcgtgggcggcgtaga

SEQ ID NO: 128397 - DNA, 25 bp, Artificial Sequence
  Description of Artificial Sequence: Synthetic oligonucleotide
atcgctgatcgtgggcggcgtagac

SEQ ID NO: 128398 - DNA, 24 bp, Artificial Sequence
  Description of Artificial Sequence: Synthetic oligonucleotide
tcgctgatcgtgggcggcgtagac

SEQ ID NO: 128399 - DNA, 23 bp, Artificial Sequence
  Description of Artificial Sequence: Synthetic oligonucleotide
cgctgatcgtgggcggcgtagac

SEQ ID NO: 128400 - DNA, 24 bp, Artificial Sequence
  Description of Artificial Sequence: Synthetic oligonucleotide
gctgatcgtgggcggcgtagacct

SEQ ID NO: 128401 - DNA, 25 bp, Artificial Sequence
  Description of Artificial Sequence: Synthetic oligonucleotide
ctgatcgtgggcggcgtagacctga

SEQ ID NO: 128402 - DNA, 26 bp, Artificial Sequence
  Description of Artificial Sequence: Synthetic oligonucleotide
tgatcgtgggcggcgtagacctgact

SEQ ID NO: 128403 - DNA, 25 bp, Artificial Sequence
  Description of Artificial Sequence: Synthetic oligonucleotide
gatcgtgggcggcgtagacctgact

SEQ ID NO: 128404 - DNA, 25 bp, Artificial Sequence
  Description of Artificial Sequence: Synthetic oligonucleotide
atcgtgggcggcgtagacctgactg

SEQ ID NO: 128405 - DNA, 24 bp, Artificial Sequence
  Description of Artificial Sequence: Synthetic oligonucleotide
tcgtgggcggcgtagacctgactg

SEQ ID NO: 128406 - DNA, 23 bp, Artificial Sequence
  Description of Artificial Sequence: Synthetic oligonucleotide
cgtgggcggcgtagacctgactg

SEQ ID NO: 128407 - DNA, 24 bp, Artificial Sequence
  Description of Artificial Sequence: Synthetic oligonucleotide
gtgggcggcgtagacctgactgga

SEQ ID NO: 128408 - DNA, 24 bp, Artificial Sequence
  Description of Artificial Sequence: Synthetic oligonucleotide
tgggcggcgtagacctgactggac

SEQ ID NO: 128409 - DNA, 23 bp, Artificial Sequence
  Description of Artificial Sequence: Synthetic oligonucleotide
gggcggcgtagacctgactggac

SEQ ID NO: 128410 - DNA, 23 bp, Artificial Sequence
  Description of Artificial Sequence: Synthetic oligonucleotide
ggcggcgtagacctgactggacc

SEQ ID NO: 128411 - DNA, 23 bp, Artificial Sequence
  Description of Artificial Sequence: Synthetic oligonucleotide
gcggcgtagacctgactggaccg

SEQ ID NO: 128412 - DNA, 24 bp, Artificial Sequence
  Description of Artificial Sequence: Synthetic oligonucleotide
cggcgtagacctgactggaccgca

SEQ ID NO: 128413 - DNA, 24 bp, Artificial Sequence
  Description of Artificial Sequence: Synthetic oligonucleotide
ggcgtagacctgactggaccgcag

SEQ ID NO: 128414 - DNA, 25 bp, Artificial Sequence
  Description of Artificial Sequence: Synthetic oligonucleotide
gcgtagacctgactggaccgcagct

SEQ ID NO: 128415 - DNA, 27 bp, Artificial Sequence
  Description of Artificial Sequence: Synthetic oligonucleotide
cgtagacctgactggaccgcagctcta

SEQ ID NO: 128416 - DNA, 27 bp, Artificial Sequence
  Description of Artificial Sequence: Synthetic oligonucleotide
gtagacctgactggaccgcagctctac

SEQ ID NO: 128417 - DNA, 27 bp, Artificial Sequence
  Description of Artificial Sequence: Synthetic oligonucleotide
tagacctgactggaccgcagctctacg

SEQ ID NO: 128418 - DNA, 26 bp, Artificial Sequence
  Description of Artificial Sequence: Synthetic oligonucleotide
agacctgactggaccgcagctctacg

SEQ ID NO: 128419 - DNA, 25 bp, Artificial Sequence
  Description of Artificial Sequence: Synthetic oligonucleotide
gacctgactggaccgcagctctacg

SEQ ID NO: 128420 - DNA, 25 bp, Artificial Sequence
  Description of Artificial Sequence: Synthetic oligonucleotide
acctgactggaccgcagctctacgg

SEQ ID NO: 128421 - DNA, 24 bp, Artificial Sequence
  Description of Artificial Sequence: Synthetic oligonucleotide
cctgactggaccgcagctctacgg

SEQ ID NO: 128422 - DNA, 24 bp, Artificial Sequence
  Description of Artificial Sequence: Synthetic oligonucleotide
ctgactggaccgcagctctacggc

SEQ ID NO: 128423 - DNA, 25 bp, Artificial Sequence
  Description of Artificial Sequence: Synthetic oligonucleotide
tgactggaccgcagctctacggcgt

SEQ ID NO: 128424 - DNA, 24 bp, Artificial Sequence
  Description of Artificial Sequence: Synthetic oligonucleotide
gactggaccgcagctctacggcgt

SEQ ID NO: 128425 - DNA, 24 bp, Artificial Sequence
  Description of Artificial Sequence: Synthetic oligonucleotide
actggaccgcagctctacggcgtg

SEQ ID NO: 128426 - DNA, 23 bp, Artificial Sequence
  Description of Artificial Sequence: Synthetic oligonucleotide
ctggaccgcagctctacggcgtg

SEQ ID NO: 128427 - DNA, 25 bp, Artificial Sequence
  Description of Artificial Sequence: Synthetic oligonucleotide
tggaccgcagctctacggcgtgcat

SEQ ID NO: 128428 - DNA, 24 bp, Artificial Sequence
  Description of Artificial Sequence: Synthetic oligonucleotide
ggaccgcagctctacggcgtgcat

SEQ ID NO: 128429 - DNA, 24 bp, Artificial Sequence
  Description of Artificial Sequence: Synthetic oligonucleotide
gaccgcagctctacggcgtgcatc

SEQ ID NO: 128430 - DNA, 24 bp, Artificial Sequence
  Description of Artificial Sequence: Synthetic oligonucleotide
accgcagctctacggcgtgcatcc

SEQ ID NO: 128431 - DNA, 23 bp, Artificial Sequence
  Description of Artificial Sequence: Synthetic oligonucleotide
ccgcagctctacggcgtgcatcc

SEQ ID NO: 128432 - DNA, 23 bp, Artificial Sequence
  Description of Artificial Sequence: Synthetic oligonucleotide
cgcagctctacggcgtgcatccc

SEQ ID NO: 128433 - DNA, 25 bp, Artificial Sequence
  Description of Artificial Sequence: Synthetic oligonucleotide
gcagctctacggcgtgcatccccat

SEQ ID NO: 128434 - DNA, 25 bp, Artificial Sequence
  Description of Artificial Sequence: Synthetic oligonucleotide
cagctctacggcgtgcatccccatg

SEQ ID NO: 128435 - DNA, 25 bp, Artificial Sequence
  Description of Artificial Sequence: Synthetic oligonucleotide
agctctacggcgtgcatccccatgg

SEQ ID NO: 128436 - DNA, 24 bp, Artificial Sequence
  Description of Artificial Sequence: Synthetic oligonucleotide
gctctacggcgtgcatccccatgg

SEQ ID NO: 128437 - DNA, 25 bp, Artificial Sequence
  Description of Artificial Sequence: Synthetic oligonucleotide
ctctacggcgtgcatccccatggct

SEQ ID NO: 128438 - DNA, 25 bp, Artificial Sequence
  Description of Artificial Sequence: Synthetic oligonucleotide
tctacggcgtgcatccccatggctc

SEQ ID NO: 128439 - DNA, 24 bp, Artificial Sequence
  Description of Artificial Sequence: Synthetic oligonucleotide
ctacggcgtgcatccccatggctc

SEQ ID NO: 128440 - DNA, 26 bp, Artificial Sequence
  Description of Artificial Sequence: Synthetic oligonucleotide
tacggcgtgcatccccatggctccta

SEQ ID NO: 128441 - DNA, 25 bp, Artificial Sequence
  Description of Artificial Sequence: Synthetic oligonucleotide
acggcgtgcatccccatggctccta

SEQ ID NO: 128442 - DNA, 24 bp, Artificial Sequence
  Description of Artificial Sequence: Synthetic oligonucleotide
cggcgtgcatccccatggctccta

SEQ ID NO: 128443 - DNA, 25 bp, Artificial Sequence
  Description of Artificial Sequence: Synthetic oligonucleotide
ggcgtgcatccccatggctcctaca

SEQ ID NO: 128444 - DNA, 25 bp, Artificial Sequence
  Description of Artificial Sequence: Synthetic oligonucleotide
gcgtgcatccccatggctcctacag

SEQ ID NO: 128445 - DNA, 25 bp, Artificial Sequence
  Description of Artificial Sequence: Synthetic oligonucleotide
cgtgcatccccatggctcctacagc

SEQ ID NO: 128446 - DNA, 25 bp, Artificial Sequence
  Description of Artificial Sequence: Synthetic oligonucleotide
gtgcatccccatggctcctacagcc

SEQ ID NO: 128447 - DNA, 26 bp, Artificial Sequence
  Description of Artificial Sequence: Synthetic oligonucleotide
tgcatccccatggctcctacagccgt

SEQ ID NO: 128448 - DNA, 25 bp, Artificial Sequence
  Description of Artificial Sequence: Synthetic oligonucleotide
gcatccccatggctcctacagccgt

SEQ ID NO: 128449 - DNA, 26 bp, Artificial Sequence
  Description of Artificial Sequence: Synthetic oligonucleotide
catccccatggctcctacagccgtct

SEQ ID NO: 128450 - DNA, 26 bp, Artificial Sequence
  Description of Artificial Sequence: Synthetic oligonucleotide
atccccatggctcctacagccgtctg

SEQ ID NO: 128451 - DNA, 25 bp, Artificial Sequence
  Description of Artificial Sequence: Synthetic oligonucleotide
tccccatggctcctacagccgtctg

SEQ ID NO: 128452 - DNA, 24 bp, Artificial Sequence
  Description of Artificial Sequence: Synthetic oligonucleotide
ccccatggctcctacagccgtctg

SEQ ID NO: 128453 - DNA, 24 bp, Artificial Sequence
  Description of Artificial Sequence: Synthetic oligonucleotide
cccatggctcctacagccgtctgc

SEQ ID NO: 128454 - DNA, 24 bp, Artificial Sequence
  Description of Artificial Sequence: Synthetic oligonucleotide
ccatggctcctacagccgtctgcc

SEQ ID NO: 128455 - DNA, 26 bp, Artificial Sequence
  Description of Artificial Sequence: Synthetic oligonucleotide
catggctcctacagccgtctgccctt

SEQ ID NO: 128456 - DNA, 27 bp, Artificial Sequence
  Description of Artificial Sequence: Synthetic oligonucleotide
atggctcctacagccgtctgcccttca

SEQ ID NO: 128457 - DNA, 26 bp, Artificial Sequence
  Description of Artificial Sequence: Synthetic oligonucleotide
tggctcctacagccgtctgcccttca

SEQ ID NO: 128458 - DNA, 25 bp, Artificial Sequence
  Description of Artificial Sequence: Synthetic oligonucleotide
ggctcctacagccgtctgcccttca

SEQ ID NO: 128459 - DNA, 26 bp, Artificial Sequence
  Description of Artificial Sequence: Synthetic oligonucleotide
gctcctacagccgtctgcccttcaca

SEQ ID NO: 128460 - DNA, 26 bp, Artificial Sequence
  Description of Artificial Sequence: Synthetic oligonucleotide
ctcctacagccgtctgcccttcacag

SEQ ID NO: 128461 - DNA, 26 bp, Artificial Sequence
  Description of Artificial Sequence: Synthetic oligonucleotide
tcctacagccgtctgcccttcacagc

SEQ ID NO: 128462 - DNA, 25 bp, Artificial Sequence
  Description of Artificial Sequence: Synthetic oligonucleotide
cctacagccgtctgcccttcacagc

SEQ ID NO: 128463 - DNA, 25 bp, Artificial Sequence
  Description of Artificial Sequence: Synthetic oligonucleotide
ctacagccgtctgcccttcacagcc

SEQ ID NO: 128464 - DNA, 26 bp, Artificial Sequence
  Description of Artificial Sequence: Synthetic oligonucleotide
tacagccgtctgcccttcacagccct

SEQ ID NO: 128465 - DNA, 25 bp, Artificial Sequence
  Description of Artificial Sequence: Synthetic oligonucleotide
acagccgtctgcccttcacagccct

SEQ ID NO: 128466 - DNA, 24 bp, Artificial Sequence
  Description of Artificial Sequence: Synthetic oligonucleotide
cagccgtctgcccttcacagccct

SEQ ID NO: 128467 - DNA, 24 bp, Artificial Sequence
  Description of Artificial Sequence: Synthetic oligonucleotide
agccgtctgcccttcacagccctg

SEQ ID NO: 128468 - DNA, 23 bp, Artificial Sequence
  Description of Artificial Sequence: Synthetic oligonucleotide
gccgtctgcccttcacagccctg

SEQ ID NO: 128469 - DNA, 23 bp, Artificial Sequence
  Description of Artificial Sequence: Synthetic oligonucleotide
ccgtctgcccttcacagccctgg

SEQ ID NO: 128470 - DNA, 23 bp, Artificial Sequence
  Description of Artificial Sequence: Synthetic oligonucleotide
cgtctgcccttcacagccctggg

SEQ ID NO: 128471 - DNA, 24 bp, Artificial Sequence
  Description of Artificial Sequence: Synthetic oligonucleotide
gtctgcccttcacagccctgggct

SEQ ID NO: 128472 - DNA, 25 bp, Artificial Sequence
  Description of Artificial Sequence: Synthetic oligonucleotide
tctgcccttcacagccctgggctct

SEQ ID NO: 128473 - DNA, 24 bp, Artificial Sequence
  Description of Artificial Sequence: Synthetic oligonucleotide
ctgcccttcacagccctgggctct

SEQ ID NO: 128474 - DNA, 24 bp, Artificial Sequence
  Description of Artificial Sequence: Synthetic oligonucleotide
tgcccttcacagccctgggctctg

SEQ ID NO: 128475 - DNA, 23 bp, Artificial Sequence
  Description of Artificial Sequence: Synthetic oligonucleotide
gcccttcacagccctgggctctg

SEQ ID NO: 128476 - DNA, 24 bp, Artificial Sequence
  Description of Artificial Sequence: Synthetic oligonucleotide
cccttcacagccctgggctctggt

SEQ ID NO: 128477 - DNA, 25 bp, Artificial Sequence
  Description of Artificial Sequence: Synthetic oligonucleotide
ccttcacagccctgggctctggtca

SEQ ID NO: 128478 - DNA, 25 bp, Artificial Sequence
  Description of Artificial Sequence: Synthetic oligonucleotide
cttcacagccctgggctctggtcag

SEQ ID NO: 128479 - DNA, 26 bp, Artificial Sequence
  Description of Artificial Sequence: Synthetic oligonucleotide
ttcacagccctgggctctggtcagga

SEQ ID NO: 128480 - DNA, 25 bp, Artificial Sequence
  Description of Artificial Sequence: Synthetic oligonucleotide
tcacagccctgggctctggtcagga

SEQ ID NO: 128481 - DNA, 24 bp, Artificial Sequence
  Description of Artificial Sequence: Synthetic oligonucleotide
cacagccctgggctctggtcagga

SEQ ID NO: 128482 - DNA, 24 bp, Artificial Sequence
  Description of Artificial Sequence: Synthetic oligonucleotide
acagccctgggctctggtcaggac

SEQ ID NO: 128483 - DNA, 23 bp, Artificial Sequence
  Description of Artificial Sequence: Synthetic oligonucleotide
cagccctgggctctggtcaggac

SEQ ID NO: 128484 - DNA, 23 bp, Artificial Sequence
  Description of Artificial Sequence: Synthetic oligonucleotide
agccctgggctctggtcaggacg

SEQ ID NO: 128485 - DNA, 22 bp, Artificial Sequence
  Description of Artificial Sequence: Synthetic oligonucleotide
gccctgggctctggtcaggacg

SEQ ID NO: 128486 - DNA, 22 bp, Artificial Sequence
  Description of Artificial Sequence: Synthetic oligonucleotide
ccctgggctctggtcaggacgc

SEQ ID NO: 128487 - DNA, 22 bp, Artificial Sequence
  Description of Artificial Sequence: Synthetic oligonucleotide
cctgggctctggtcaggacgcg

SEQ ID NO: 128488 - DNA, 22 bp, Artificial Sequence
  Description of Artificial Sequence: Synthetic oligonucleotide
ctgggctctggtcaggacgcgg

SEQ ID NO: 128489 - DNA, 22 bp, Artificial Sequence
  Description of Artificial Sequence: Synthetic oligonucleotide
tgggctctggtcaggacgcggc

SEQ ID NO: 128490 - DNA, 21 bp, Artificial Sequence
  Description of Artificial Sequence: Synthetic oligonucleotide
gggctctggtcaggacgcggc

SEQ ID NO: 128491 - DNA, 21 bp, Artificial Sequence
  Description of Artificial Sequence: Synthetic oligonucleotide
ggctctggtcaggacgcggcc

SEQ ID NO: 128492 - DNA, 22 bp, Artificial Sequence
  Description of Artificial Sequence: Synthetic oligonucleotide
gctctggtcaggacgcggccct

SEQ ID NO: 128493 - DNA, 22 bp, Artificial Sequence
  Description of Artificial Sequence: Synthetic oligonucleotide
ctctggtcaggacgcggccctg

SEQ ID NO: 128494 - DNA, 22 bp, Artificial Sequence
  Description of Artificial Sequence: Synthetic oligonucleotide
tctggtcaggacgcggccctgg

SEQ ID NO: 128495 - DNA, 21 bp, Artificial Sequence
  Description of Artificial Sequence: Synthetic oligonucleotide
ctggtcaggacgcggccctgg

SEQ ID NO: 128496 - DNA, 21 bp, Artificial Sequence
  Description of Artificial Sequence: Synthetic oligonucleotide
tggtcaggacgcggccctggc

SEQ ID NO: 128497 - DNA, 20 bp, Artificial Sequence
  Description of Artificial Sequence: Synthetic oligonucleotide
ggtcaggacgcggccctggc

SEQ ID NO: 128498 - DNA, 20 bp, Artificial Sequence
  Description of Artificial Sequence: Synthetic oligonucleotide
gtcaggacgcggccctggcg

SEQ ID NO: 128499 - DNA, 21 bp, Artificial Sequence
  Description of Artificial Sequence: Synthetic oligonucleotide
tcaggacgcggccctggcggt

SEQ ID NO: 128500 - DNA, 20 bp, Artificial Sequence
  Description of Artificial Sequence: Synthetic oligonucleotide
caggacgcggccctggcggt

SEQ ID NO: 128501 - DNA, 20 bp, Artificial Sequence
  Description of Artificial Sequence: Synthetic oligonucleotide
aggacgcggccctggcggtg

SEQ ID NO: 128502 - DNA, 20 bp, Artificial Sequence
  Description of Artificial Sequence: Synthetic oligonucleotide
ggacgcggccctggcggtgt

SEQ ID NO: 128503 - DNA, 21 bp, Artificial Sequence
  Description of Artificial Sequence: Synthetic oligonucleotide
gacgcggccctggcggtgcta

SEQ ID NO: 128504 - DNA, 23 bp, Artificial Sequence
  Description of Artificial Sequence: Synthetic oligonucleotide
acgcggccctggcggtgctagaa

SEQ ID NO: 128505 - DNA, 22 bp, Artificial Sequence
  Description of Artificial Sequence: Synthetic oligonucleotide
cgcggccctggcggtgctagaa

SEQ ID NO: 128506 - DNA, 23 bp, Artificial Sequence
  Description of Artificial Sequence: Synthetic oligonucleotide
gcggccctggcggtgctagaaga

SEQ ID NO: 128507 - DNA, 23 bp, Artificial Sequence
  Description of Artificial Sequence: Synthetic oligonucleotide
cggccctggcggtgctagaagac

SEQ ID NO: 128508 - DNA, 23 bp, Artificial Sequence
  Description of Artificial Sequence: Synthetic oligonucleotide
ggccctggcggtgctagaagacc

SEQ ID NO: 128509 - DNA, 23 bp, Artificial Sequence
  Description of Artificial Sequence: Synthetic oligonucleotide
gccctggcggtgctagaagaccg

SEQ ID NO: 128510 - DNA, 25 bp, Artificial Sequence
  Description of Artificial Sequence: Synthetic oligonucleotide
ccctggcggtgctagaagaccggtt

SEQ ID NO: 128511 - DNA, 25 bp, Artificial Sequence
  Description of Artificial Sequence: Synthetic oligonucleotide
cctggcggtgctagaagaccggttc

SEQ ID NO: 128512 - DNA, 26 bp, Artificial Sequence
  Description of Artificial Sequence: Synthetic oligonucleotide
ctggcggtgctagaagaccggttcca

SEQ ID NO: 128513 - DNA, 26 bp, Artificial Sequence
  Description of Artificial Sequence: Synthetic oligonucleotide
tggcggtgctagaagaccggttccag

SEQ ID NO: 128514 - DNA, 25 bp, Artificial Sequence
  Description of Artificial Sequence: Synthetic oligonucleotide
ggcggtgctagaagaccggttccag

SEQ ID NO: 128515 - DNA, 25 bp, Artificial Sequence
  Description of Artificial Sequence: Synthetic oligonucleotide
gcggtgctagaagaccggttccagc

SEQ ID NO: 128516 - DNA, 25 bp, Artificial Sequence
  Description of Artificial Sequence: Synthetic oligonucleotide
cggtgctagaagaccggttccagcc

SEQ ID NO: 128517 - DNA, 27 bp, Artificial Sequence
  Description of Artificial Sequence: Synthetic oligonucleotide
ggtgctagaagaccggttccagccgaa

SEQ ID NO: 128518 - DNA, 27 bp, Artificial Sequence
  Description of Artificial Sequence: Synthetic oligonucleotide
gtgctagaagaccggttccagccgaac

SEQ ID NO: 128519 - DNA, 29 bp, Artificial Sequence
  Description of Artificial Sequence: Synthetic oligonucleotide
tgctagaagaccggttccagccgaacatg

SEQ ID NO: 128520 - DNA, 28 bp, Artificial Sequence
  Description of Artificial Sequence: Synthetic oligonucleotide
gctagaagaccggttccagccgaacatg

SEQ ID NO: 128521 - DNA, 29 bp, Artificial Sequence
  Description of Artificial Sequence: Synthetic oligonucleotide
ctagaagaccggttccagccgaacatgac

SEQ ID NO: 128522 - DNA, 29 bp, Artificial Sequence
  Description of Artificial Sequence: Synthetic oligonucleotide
tagaagaccggttccagccgaacatgacg

SEQ ID NO: 128523 - DNA, 28 bp, Artificial Sequence
  Description of Artificial Sequence: Synthetic oligonucleotide
agaagaccggttccagccgaacatgacg

SEQ ID NO: 128524 - DNA, 27 bp, Artificial Sequence
  Description of Artificial Sequence: Synthetic oligonucleotide
gaagaccggttccagccgaacatgacg

SEQ ID NO: 128525 - DNA, 27 bp, Artificial Sequence
  Description of Artificial Sequence: Synthetic oligonucleotide
aagaccggttccagccgaacatgacgc

SEQ ID NO: 128526 - DNA, 27 bp, Artificial Sequence
  Description of Artificial Sequence: Synthetic oligonucleotide
agaccggttccagccgaacatgacgct

SEQ ID NO: 128527 - DNA, 26 bp, Artificial Sequence
  Description of Artificial Sequence: Synthetic oligonucleotide
gaccggttccagccgaacatgacgct

SEQ ID NO: 128528 - DNA, 26 bp, Artificial Sequence
  Description of Artificial Sequence: Synthetic oligonucleotide
accggttccagccgaacatgacgctg

SEQ ID NO: 128529 - DNA, 25 bp, Artificial Sequence
  Description of Artificial Sequence: Synthetic oligonucleotide
ccggttccagccgaacatgacgctg

SEQ ID NO: 128530 - DNA, 26 bp, Artificial Sequence
  Description of Artificial Sequence: Synthetic oligonucleotide
cggttccagccgaacatgacgctgga

SEQ ID NO: 128531 - DNA, 26 bp, Artificial Sequence
  Description of Artificial Sequence: Synthetic oligonucleotide
ggttccagccgaacatgacgctggag

SEQ ID NO: 128532 - DNA, 26 bp, Artificial Sequence
  Description of Artificial Sequence: Synthetic oligonucleotide
gttccagccgaacatgacgctggagg

SEQ ID NO: 128533 - DNA, 27 bp, Artificial Sequence
  Description of Artificial Sequence: Synthetic oligonucleotide
ttccagccgaacatgacgctggaggct

SEQ ID NO: 128534 - DNA, 26 bp, Artificial Sequence
  Description of Artificial Sequence: Synthetic oligonucleotide
tccagccgaacatgacgctggaggct

SEQ ID NO: 128535 - DNA, 25 bp, Artificial Sequence
  Description of Artificial Sequence: Synthetic oligonucleotide
ccagccgaacatgacgctggaggct

SEQ ID NO: 128536 - DNA, 25 bp, Artificial Sequence
  Description of Artificial Sequence: Synthetic oligonucleotide
cagccgaacatgacgctggaggctg

SEQ ID NO: 128537 - DNA, 26 bp, Artificial Sequence
  Description of Artificial Sequence: Synthetic oligonucleotide
agccgaacatgacgctggaggctgct

SEQ ID NO: 128538 - DNA, 25 bp, Artificial Sequence
  Description of Artificial Sequence: Synthetic oligonucleotide
gccgaacatgacgctggaggctgct

SEQ ID NO: 128539 - DNA, 26 bp, Artificial Sequence
  Description of Artificial Sequence: Synthetic oligonucleotide
ccgaacatgacgctggaggctgctca

SEQ ID NO: 128540 - DNA, 26 bp, Artificial Sequence
  Description of Artificial Sequence: Synthetic oligonucleotide
cgaacatgacgctggaggctgctcag

SEQ ID NO: 128541 - DNA, 26 bp, Artificial Sequence
  Description of Artificial Sequence: Synthetic oligonucleotide
gaacatgacgctggaggctgctcagg

SEQ ID NO: 128542 - DNA, 26 bp, Artificial Sequence
  Description of Artificial Sequence: Synthetic oligonucleotide
aacatgacgctggaggctgctcaggg

SEQ ID NO: 128543 - DNA, 25 bp, Artificial Sequence
  Description of Artificial Sequence: Synthetic oligonucleotide
acatgacgctggaggctgctcaggg

SEQ ID NO: 128544 - DNA, 24 bp, Artificial Sequence
  Description of Artificial Sequence: Synthetic oligonucleotide
catgacgctggaggctgctcaggg

SEQ ID NO: 128545 - DNA, 24 bp, Artificial Sequence
  Description of Artificial Sequence: Synthetic oligonucleotide
atgacgctggaggctgctcagggg

SEQ ID NO: 128546 - DNA, 23 bp, Artificial Sequence
  Description of Artificial Sequence: Synthetic oligonucleotide
tgacgctggaggctgctcagggg

SEQ ID NO: 128547 - DNA, 22 bp, Artificial Sequence
  Description of Artificial Sequence: Synthetic oligonucleotide
gacgctggaggctgctcagggg

SEQ ID NO: 128548 - DNA, 23 bp, Artificial Sequence
  Description of Artificial Sequence: Synthetic oligonucleotide
acgctggaggctgctcaggggct

SEQ ID NO: 128549 - DNA, 22 bp, Artificial Sequence
  Description of Artificial Sequence: Synthetic oligonucleotide
cgctggaggctgctcaggggct

SEQ ID NO: 128550 - DNA, 22 bp, Artificial Sequence
  Description of Artificial Sequence: Synthetic oligonucleotide
gctggaggctgctcaggggctg

SEQ ID NO: 128551 - DNA, 23 bp, Artificial Sequence
  Description of Artificial Sequence: Synthetic oligonucleotide
ctggaggctgctcaggggctgct

SEQ ID NO: 128552 - DNA, 23 bp, Artificial Sequence
  Description of Artificial Sequence: Synthetic oligonucleotide
tggaggctgctcaggggctgctg

SEQ ID NO: 128553 - DNA, 22 bp, Artificial Sequence
  Description of Artificial Sequence: Synthetic oligonucleotide
ggaggctgctcaggggctgctg

SEQ ID NO: 128554 - DNA, 23 bp, Artificial Sequence
  Description of Artificial Sequence: Synthetic oligonucleotide
gaggctgctcaggggctgctggt

SEQ ID NO: 128555 - DNA, 23 bp, Artificial Sequence
  Description of Artificial Sequence: Synthetic oligonucleotide
aggctgctcaggggctgctggtg

SEQ ID NO: 128556 - DNA, 22 bp, Artificial Sequence
  Description of Artificial Sequence: Synthetic oligonucleotide
ggctgctcaggggctgctggtg

SEQ ID NO: 128557 - DNA, 24 bp, Artificial Sequence
  Description of Artificial Sequence: Synthetic oligonucleotide
gctgctcaggggctgctggtggaa

SEQ ID NO: 128558 - DNA, 24 bp, Artificial Sequence
  Description of Artificial Sequence: Synthetic oligonucleotide
ctgctcaggggctgctggtggaag

SEQ ID NO: 128559 - DNA, 24 bp, Artificial Sequence
  Description of Artificial Sequence: Synthetic oligonucleotide
tgctcaggggctgctggtggaagc

SEQ ID NO: 128560 - DNA, 23 bp, Artificial Sequence
  Description of Artificial Sequence: Synthetic oligonucleotide
gctcaggggctgctggtggaagc

SEQ ID NO: 128561 - DNA, 23 bp, Artificial Sequence
  Description of Artificial Sequence: Synthetic oligonucleotide
ctcaggggctgctggtggaagcc

SEQ ID NO: 128562 - DNA, 24 bp, Artificial Sequence
  Description of Artificial Sequence: Synthetic oligonucleotide
tcaggggctgctggtggaagccgt

SEQ ID NO: 128563 - DNA, 23 bp, Artificial Sequence
  Description of Artificial Sequence: Synthetic oligonucleotide
caggggctgctggtggaagccgt

SEQ ID NO: 128564 - DNA, 24 bp, Artificial Sequence
  Description of Artificial Sequence: Synthetic oligonucleotide
aggggctgctggtggaagccgtca

SEQ ID NO: 128565 - DNA, 23 bp, Artificial Sequence
  Description of Artificial Sequence: Synthetic oligonucleotide
ggggctgctggtggaagccgtca

SEQ ID NO: 128566 - DNA, 23 bp, Artificial Sequence
  Description of Artificial Sequence: Synthetic oligonucleotide
gggctgctggtggaagccgtcac

SEQ ID NO: 128567 - DNA, 23 bp, Artificial Sequence
  Description of Artificial Sequence: Synthetic oligonucleotide
ggctgctggtggaagccgtcacc

SEQ ID NO: 128568 - DNA, 23 bp, Artificial Sequence
  Description of Artificial Sequence: Synthetic oligonucleotide
gctgctggtggaagccgtcaccg

SEQ ID NO: 128569 - DNA, 23 bp, Artificial Sequence
  Description of Artificial Sequence: Synthetic oligonucleotide
ctgctggtggaagccgtcaccgc

SEQ ID NO: 128570 - DNA, 23 bp, Artificial Sequence
  Description of Artificial Sequence: Synthetic oligonucleotide
tgctggtggaagccgtcaccgcc

SEQ ID NO: 128571 - DNA, 22 bp, Artificial Sequence
  Description of Artificial Sequence: Synthetic oligonucleotide
gctggtggaagccgtcaccgcc

SEQ ID NO: 128572 - DNA, 22 bp, Artificial Sequence
  Description of Artificial Sequence: Synthetic oligonucleotide
ctggtggaagccgtcaccgccg

SEQ ID NO: 128573 - DNA, 22 bp, Artificial Sequence
  Description of Artificial Sequence: Synthetic oligonucleotide
tggtggaagccgtcaccgccgg

SEQ ID NO: 128574 - DNA, 21 bp, Artificial Sequence
  Description of Artificial Sequence: Synthetic oligonucleotide
ggtggaagccgtcaccgccgg

SEQ ID NO: 128575 - DNA, 23 bp, Artificial Sequence
  Description of Artificial Sequence: Synthetic oligonucleotide
gtggaagccgtcaccgccgggat

SEQ ID NO: 128576 - DNA, 25 bp, Artificial Sequence
  Description of Artificial Sequence: Synthetic oligonucleotide
tggaagccgtcaccgccgggatctt

SEQ ID NO: 128577 - DNA, 24 bp, Artificial Sequence
  Description of Artificial Sequence: Synthetic oligonucleotide
ggaagccgtcaccgccgggatctt

SEQ ID NO: 128578 - DNA, 24 bp, Artificial Sequence
  Description of Artificial Sequence: Synthetic oligonucleotide
gaagccgtcaccgccgggatcttg

SEQ ID NO: 128579 - DNA, 24 bp, Artificial Sequence
  Description of Artificial Sequence: Synthetic oligonucleotide
aagccgtcaccgccgggatcttgg

SEQ ID NO: 128580 - DNA, 23 bp, Artificial Sequence
  Description of Artificial Sequence: Synthetic oligonucleotide
agccgtcaccgccgggatcttgg

SEQ ID NO: 128581 - DNA, 22 bp, Artificial Sequence
  Description of Artificial Sequence: Synthetic oligonucleotide
gccgtcaccgccgggatcttgg

SEQ ID NO: 128582 - DNA, 23 bp, Artificial Sequence
  Description of Artificial Sequence: Synthetic oligonucleotide
ccgtcaccgccgggatcttgggt

SEQ ID NO: 128583 - DNA, 24 bp, Artificial Sequence
  Description of Artificial Sequence: Synthetic oligonucleotide
cgtcaccgccgggatcttgggtga

SEQ ID NO: 128584 - DNA, 24 bp, Artificial Sequence
  Description of Artificial Sequence: Synthetic oligonucleotide
gtcaccgccgggatcttgggtgac

SEQ ID NO: 128585 - DNA, 25 bp, Artificial Sequence
  Description of Artificial Sequence: Synthetic oligonucleotide
tcaccgccgggatcttgggtgacct

SEQ ID NO: 128586 - DNA, 24 bp, Artificial Sequence
  Description of Artificial Sequence: Synthetic oligonucleotide
caccgccgggatcttgggtgacct

SEQ ID NO: 128587 - DNA, 24 bp, Artificial Sequence
  Description of Artificial Sequence: Synthetic oligonucleotide
accgccgggatcttgggtgacctg

SEQ ID NO: 128588 - DNA, 23 bp, Artificial Sequence
  Description of Artificial Sequence: Synthetic oligonucleotide
ccgccgggatcttgggtgacctg

SEQ ID NO: 128589 - DNA, 23 bp, Artificial Sequence
  Description of Artificial Sequence: Synthetic oligonucleotide
cgccgggatcttgggtgacctgg

SEQ ID NO: 128590 - DNA, 23 bp, Artificial Sequence
  Description of Artificial Sequence: Synthetic oligonucleotide
gccgggatcttgggtgacctggg

SEQ ID NO: 128591 - DNA, 24 bp, Artificial Sequence
  Description of Artificial Sequence: Synthetic oligonucleotide
ccgggatcttgggtgacctgggct

SEQ ID NO: 128592 - DNA, 24 bp, Artificial Sequence
  Description of Artificial Sequence: Synthetic oligonucleotide
cgggatcttgggtgacctgggctc

SEQ ID NO: 128593 - DNA, 24 bp, Artificial Sequence
  Description of Artificial Sequence: Synthetic oligonucleotide
gggatcttgggtgacctgggctcc

SEQ ID NO: 128594 - DNA, 24 bp, Artificial Sequence
  Description of Artificial Sequence: Synthetic oligonucleotide
ggatcttgggtgacctgggctccg

SEQ ID NO: 128595 - DNA, 24 bp, Artificial Sequence
  Description of Artificial Sequence: Synthetic oligonucleotide
gatcttgggtgacctgggctccgg

SEQ ID NO: 128596 - DNA, 24 bp, Artificial Sequence
  Description of Artificial Sequence: Synthetic oligonucleotide
atcttgggtgacctgggctccggg

SEQ ID NO: 128597 - DNA, 23 bp, Artificial Sequence
  Description of Artificial Sequence: Synthetic oligonucleotide
tcttgggtgacctgggctccggg

SEQ ID NO: 128598 - DNA, 22 bp, Artificial Sequence
  Description of Artificial Sequence: Synthetic oligonucleotide
cttgggtgacctgggctccggg

SEQ ID NO: 128599 - DNA, 22 bp, Artificial Sequence
  Description of Artificial Sequence: Synthetic oligonucleotide
ttgggtgacctgggctccgggg

SEQ ID NO: 128600 - DNA, 21 bp, Artificial Sequence
  Description of Artificial Sequence: Synthetic oligonucleotide
tgggtgacctgggctccgggg

SEQ ID NO: 128601 - DNA, 20 bp, Artificial Sequence
  Description of Artificial Sequence: Synthetic oligonucleotide
gggtgacctgggctccgggg

SEQ ID NO: 128602 - DNA, 20 bp, Artificial Sequence
  Description of Artificial Sequence: Synthetic oligonucleotide
ggtgacctgggctccggggg

SEQ ID NO: 128603 - DNA, 23 bp, Artificial Sequence
  Description of Artificial Sequence: Synthetic oligonucleotide
gtgacctgggctccgggggcaat

SEQ ID NO: 128604 - DNA, 24 bp, Artificial Sequence
  Description of Artificial Sequence: Synthetic oligonucleotide
tgacctgggctccgggggcaatgt

SEQ ID NO: 128605 - DNA, 23 bp, Artificial Sequence
  Description of Artificial Sequence: Synthetic oligonucleotide
gacctgggctccgggggcaatgt

SEQ ID NO: 128606 - DNA, 23 bp, Artificial Sequence
  Description of Artificial Sequence: Synthetic oligonucleotide
acctgggctccgggggcaatgtg

SEQ ID NO: 128607 - DNA, 22 bp, Artificial Sequence
  Description of Artificial Sequence: Synthetic oligonucleotide
cctgggctccgggggcaatgtg

SEQ ID NO: 128608 - DNA, 23 bp, Artificial Sequence
  Description of Artificial Sequence: Synthetic oligonucleotide
ctgggctccgggggcaatgtgga

SEQ ID NO: 128609 - DNA, 23 bp, Artificial Sequence
  Description of Artificial Sequence: Synthetic oligonucleotide
tgggctccgggggcaatgtggac

SEQ ID NO: 128610 - DNA, 22 bp, Artificial Sequence
  Description of Artificial Sequence: Synthetic oligonucleotide
gggctccgggggcaatgtggac

SEQ ID NO: 128611 - DNA, 22 bp, Artificial Sequence
  Description of Artificial Sequence: Synthetic oligonucleotide
ggctccgggggcaatgtggacg

SEQ ID NO: 128612 - DNA, 24 bp, Artificial Sequence
  Description of Artificial Sequence: Synthetic oligonucleotide
gctccgggggcaatgtggacgcat

SEQ ID NO: 128613 - DNA, 25 bp, Artificial Sequence
  Description of Artificial Sequence: Synthetic oligonucleotide
ctccgggggcaatgtggacgcatgt

SEQ ID NO: 128614 - DNA, 26 bp, Artificial Sequence
  Description of Artificial Sequence: Synthetic oligonucleotide
tccgggggcaatgtggacgcatgtgt

SEQ ID NO: 128615 - DNA, 25 bp, Artificial Sequence
  Description of Artificial Sequence: Synthetic oligonucleotide
ccgggggcaatgtggacgcatgtgt

SEQ ID NO: 128616 - DNA, 27 bp, Artificial Sequence
  Description of Artificial Sequence: Synthetic oligonucleotide
cgggggcaatgtggacgcatgtgtgat

SEQ ID NO: 128617 - DNA, 27 bp, Artificial Sequence
  Description of Artificial Sequence: Synthetic oligonucleotide
gggggcaatgtggacgcatgtgtgatc

SEQ ID NO: 128618 - DNA, 28 bp, Artificial Sequence
  Description of Artificial Sequence: Synthetic oligonucleotide
ggggcaatgtggacgcatgtgtgatcac

SEQ ID NO: 128619 - DNA, 31 bp, Artificial Sequence
  Description of Artificial Sequence: Synthetic oligonucleotide
gggcaatgtggacgcatgtgtgatcacaaag

SEQ ID NO: 128620 - DNA, 32 bp, Artificial Sequence
  Description of Artificial Sequence: Synthetic oligonucleotide
ggcaatgtggacgcatgtgtgatcacaaagac

SEQ ID NO: 128621 - DNA, 33 bp, Artificial Sequence
  Description of Artificial Sequence: Synthetic oligonucleotide
gcaatgtggacgcatgtgtgatcacaaagactg

SEQ ID NO: 128622 - DNA, 33 bp, Artificial Sequence
  Description of Artificial Sequence: Synthetic oligonucleotide
caatgtggacgcatgtgtgatcacaaagactgg

SEQ ID NO: 128623 - DNA, 33 bp, Artificial Sequence
  Description of Artificial Sequence: Synthetic oligonucleotide
aatgtggacgcatgtgtgatcacaaagactggc

SEQ ID NO: 128624 - DNA, 32 bp, Artificial Sequence
  Description of Artificial Sequence: Synthetic oligonucleotide
atgtggacgcatgtgtgatcacaaagactggc

SEQ ID NO: 128625 - DNA, 31 bp, Artificial Sequence
  Description of Artificial Sequence: Synthetic oligonucleotide
tgtggacgcatgtgtgatcacaaagactggc

SEQ ID NO: 128626 - DNA, 30 bp, Artificial Sequence
  Description of Artificial Sequence: Synthetic oligonucleotide
gtggacgcatgtgtgatcacaaagactggc

SEQ ID NO: 128627 - DNA, 30 bp, Artificial Sequence
  Description of Artificial Sequence: Synthetic oligonucleotide
tggacgcatgtgtgatcacaaagactggcg

SEQ ID NO: 128628 - DNA, 29 bp, Artificial Sequence
  Description of Artificial Sequence: Synthetic oligonucleotide
ggacgcatgtgtgatcacaaagactggcg

SEQ ID NO: 128629 - DNA, 29 bp, Artificial Sequence
  Description of Artificial Sequence: Synthetic oligonucleotide
gacgcatgtgtgatcacaaagactggcgc

SEQ ID NO: 128630 - DNA, 29 bp, Artificial Sequence
  Description of Artificial Sequence: Synthetic oligonucleotide
acgcatgtgtgatcacaaagactggcgcc

SEQ ID NO: 128631 - DNA, 28 bp, Artificial Sequence
  Description of Artificial Sequence: Synthetic oligonucleotide
cgcatgtgtgatcacaaagactggcgcc

SEQ ID NO: 128632 - DNA, 30 bp, Artificial Sequence
  Description of Artificial Sequence: Synthetic oligonucleotide
gcatgtgtgatcacaaagactggcgccaag

SEQ ID NO: 128633 - DNA, 30 bp, Artificial Sequence
  Description of Artificial Sequence: Synthetic oligonucleotide
catgtgtgatcacaaagactggcgccaagc

SEQ ID NO: 128634 - DNA, 31 bp, Artificial Sequence
  Description of Artificial Sequence: Synthetic oligonucleotide
atgtgtgatcacaaagactggcgccaagctg

SEQ ID NO: 128635 - DNA, 30 bp, Artificial Sequence
  Description of Artificial Sequence: Synthetic oligonucleotide
tgtgtgatcacaaagactggcgccaagctg

SEQ ID NO: 128636 - DNA, 29 bp, Artificial Sequence
  Description of Artificial Sequence: Synthetic oligonucleotide
gtgtgatcacaaagactggcgccaagctg

SEQ ID NO: 128637 - DNA, 29 bp, Artificial Sequence
  Description of Artificial Sequence: Synthetic oligonucleotide
tgtgatcacaaagactggcgccaagctgc

SEQ ID NO: 128638 - DNA, 28 bp, Artificial Sequence
  Description of Artificial Sequence: Synthetic oligonucleotide
gtgatcacaaagactggcgccaagctgc

SEQ ID NO: 128639 - DNA, 29 bp, Artificial Sequence
  Description of Artificial Sequence: Synthetic oligonucleotide
tgatcacaaagactggcgccaagctgctg

SEQ ID NO: 128640 - DNA, 28 bp, Artificial Sequence
  Description of Artificial Sequence: Synthetic oligonucleotide
gatcacaaagactggcgccaagctgctg

SEQ ID NO: 128641 - DNA, 28 bp, Artificial Sequence
  Description of Artificial Sequence: Synthetic oligonucleotide
atcacaaagactggcgccaagctgctgc

SEQ ID NO: 128642 - DNA, 27 bp, Artificial Sequence
  Description of Artificial Sequence: Synthetic oligonucleotide
tcacaaagactggcgccaagctgctgc

SEQ ID NO: 128643 - DNA, 26 bp, Artificial Sequence
  Description of Artificial Sequence: Synthetic oligonucleotide
cacaaagactggcgccaagctgctgc

SEQ ID NO: 128644 - DNA, 26 bp, Artificial Sequence
  Description of Artificial Sequence: Synthetic oligonucleotide
acaaagactggcgccaagctgctgcg

SEQ ID NO: 128645 - DNA, 25 bp, Artificial Sequence
  Description of Artificial Sequence: Synthetic oligonucleotide
caaagactggcgccaagctgctgcg

SEQ ID NO: 128646 - DNA, 26 bp, Artificial Sequence
  Description of Artificial Sequence: Synthetic oligonucleotide
aaagactggcgccaagctgctgcgga

SEQ ID NO: 128647 - DNA, 25 bp, Artificial Sequence
  Description of Artificial Sequence: Synthetic oligonucleotide
aagactggcgccaagctgctgcgga

SEQ ID NO: 128648 - DNA, 24 bp, Artificial Sequence
  Description of Artificial Sequence: Synthetic oligonucleotide
agactggcgccaagctgctgcgga

SEQ ID NO: 128649 - DNA, 23 bp, Artificial Sequence
  Description of Artificial Sequence: Synthetic oligonucleotide
gactggcgccaagctgctgcgga

SEQ ID NO: 128650 - DNA, 24 bp, Artificial Sequence
  Description of Artificial Sequence: Synthetic oligonucleotide
actggcgccaagctgctgcggaca

SEQ ID NO: 128651 - DNA, 23 bp, Artificial Sequence
  Description of Artificial Sequence: Synthetic oligonucleotide
ctggcgccaagctgctgcggaca

SEQ ID NO: 128652 - DNA, 24 bp, Artificial Sequence
  Description of Artificial Sequence: Synthetic oligonucleotide
tggcgccaagctgctgcggacact

SEQ ID NO: 128653 - DNA, 23 bp, Artificial Sequence
  Description of Artificial Sequence: Synthetic oligonucleotide
ggcgccaagctgctgcggacact

SEQ ID NO: 128654 - DNA, 24 bp, Artificial Sequence
  Description of Artificial Sequence: Synthetic oligonucleotide
gcgccaagctgctgcggacactga

SEQ ID NO: 128655 - DNA, 24 bp, Artificial Sequence
  Description of Artificial Sequence: Synthetic oligonucleotide
cgccaagctgctgcggacactgag

SEQ ID NO: 128656 - DNA, 25 bp, Artificial Sequence
  Description of Artificial Sequence: Synthetic oligonucleotide
gccaagctgctgcggacactgagct

SEQ ID NO: 128657 - DNA, 26 bp, Artificial Sequence
  Description of Artificial Sequence: Synthetic oligonucleotide
ccaagctgctgcggacactgagctca

SEQ ID NO: 128658 - DNA, 26 bp, Artificial Sequence
  Description of Artificial Sequence: Synthetic oligonucleotide
caagctgctgcggacactgagctcac

SEQ ID NO: 128659 - DNA, 26 bp, Artificial Sequence
  Description of Artificial Sequence: Synthetic oligonucleotide
aagctgctgcggacactgagctcacc

SEQ ID NO: 128660 - DNA, 25 bp, Artificial Sequence
  Description of Artificial Sequence: Synthetic oligonucleotide
agctgctgcggacactgagctcacc

SEQ ID NO: 128661 - DNA, 24 bp, Artificial Sequence
  Description of Artificial Sequence: Synthetic oligonucleotide
gctgctgcggacactgagctcacc

SEQ ID NO: 128662 - DNA, 25 bp, Artificial Sequence
  Description of Artificial Sequence: Synthetic oligonucleotide
ctgctgcggacactgagctcaccca

SEQ ID NO: 128663 - DNA, 26 bp, Artificial Sequence
  Description of Artificial Sequence: Synthetic oligonucleotide
tgctgcggacactgagctcacccaca

SEQ ID NO: 128664 - DNA, 25 bp, Artificial Sequence
  Description of Artificial Sequence: Synthetic oligonucleotide
gctgcggacactgagctcacccaca

SEQ ID NO: 128665 - DNA, 26 bp, Artificial Sequence
  Description of Artificial Sequence: Synthetic oligonucleotide
ctgcggacactgagctcacccacaga

SEQ ID NO: 128666 - DNA, 26 bp, Artificial Sequence
  Description of Artificial Sequence: Synthetic oligonucleotide
tgcggacactgagctcacccacagag

SEQ ID NO: 128667 - DNA, 25 bp, Artificial Sequence
  Description of Artificial Sequence: Synthetic oligonucleotide
gcggacactgagctcacccacagag

SEQ ID NO: 128668 - DNA, 25 bp, Artificial Sequence
  Description of Artificial Sequence: Synthetic oligonucleotide
cggacactgagctcacccacagagc

SEQ ID NO: 128669 - DNA, 25 bp, Artificial Sequence
  Description of Artificial Sequence: Synthetic oligonucleotide
ggacactgagctcacccacagagcc

SEQ ID NO: 128670 - DNA, 25 bp, Artificial Sequence
  Description of Artificial Sequence: Synthetic oligonucleotide
gacactgagctcacccacagagccc

SEQ ID NO: 128671 - DNA, 26 bp, Artificial Sequence
  Description of Artificial Sequence: Synthetic oligonucleotide
acactgagctcacccacagagcccgt

SEQ ID NO: 128672 - DNA, 25 bp, Artificial Sequence
  Description of Artificial Sequence: Synthetic oligonucleotide
cactgagctcacccacagagcccgt

SEQ ID NO: 128673 - DNA, 27 bp, Artificial Sequence
  Description of Artificial Sequence: Synthetic oligonucleotide
actgagctcacccacagagcccgtgaa

SEQ ID NO: 128674 - DNA, 26 bp, Artificial Sequence
  Description of Artificial Sequence: Synthetic oligonucleotide
ctgagctcacccacagagcccgtgaa

SEQ ID NO: 128675 - DNA, 27 bp, Artificial Sequence
  Description of Artificial Sequence: Synthetic oligonucleotide
tgagctcacccacagagcccgtgaaga

SEQ ID NO: 128676 - DNA, 26 bp, Artificial Sequence
  Description of Artificial Sequence: Synthetic oligonucleotide
gagctcacccacagagcccgtgaaga

SEQ ID NO: 128677 - DNA, 26 bp, Artificial Sequence
  Description of Artificial Sequence: Synthetic oligonucleotide
agctcacccacagagcccgtgaagag

SEQ ID NO: 128678 - DNA, 25 bp, Artificial Sequence
  Description of Artificial Sequence: Synthetic oligonucleotide
gctcacccacagagcccgtgaagag

SEQ ID NO: 128679 - DNA, 26 bp, Artificial Sequence
  Description of Artificial Sequence: Synthetic oligonucleotide
ctcacccacagagcccgtgaagaggt

SEQ ID NO: 128680 - DNA, 27 bp, Artificial Sequence
  Description of Artificial Sequence: Synthetic oligonucleotide
tcacccacagagcccgtgaagaggtct

SEQ ID NO: 128681 - DNA, 26 bp, Artificial Sequence
  Description of Artificial Sequence: Synthetic oligonucleotide
cacccacagagcccgtgaagaggtct

SEQ ID NO: 128682 - DNA, 26 bp, Artificial Sequence
  Description of Artificial Sequence: Synthetic oligonucleotide
acccacagagcccgtgaagaggtctg

SEQ ID NO: 128683 - DNA, 25 bp, Artificial Sequence
  Description of Artificial Sequence: Synthetic oligonucleotide
cccacagagcccgtgaagaggtctg

SEQ ID NO: 128684 - DNA, 25 bp, Artificial Sequence
  Description of Artificial Sequence: Synthetic oligonucleotide
ccacagagcccgtgaagaggtctgg

SEQ ID NO: 128685 - DNA, 25 bp, Artificial Sequence
  Description of Artificial Sequence: Synthetic oligonucleotide
cacagagcccgtgaagaggtctggc

SEQ ID NO: 128686 - DNA, 25 bp, Artificial Sequence
  Description of Artificial Sequence: Synthetic oligonucleotide
acagagcccgtgaagaggtctggcc

SEQ ID NO: 128687 - DNA, 24 bp, Artificial Sequence
  Description of Artificial Sequence: Synthetic oligonucleotide
cagagcccgtgaagaggtctggcc

SEQ ID NO: 128688 - DNA, 24 bp, Artificial Sequence
  Description of Artificial Sequence: Synthetic oligonucleotide
agagcccgtgaagaggtctggccg

SEQ ID NO: 128689 - DNA, 23 bp, Artificial Sequence
  Description of Artificial Sequence: Synthetic oligonucleotide
gagcccgtgaagaggtctggccg

SEQ ID NO: 128690 - DNA, 25 bp, Artificial Sequence
  Description of Artificial Sequence: Synthetic oligonucleotide
agcccgtgaagaggtctggccgcta

SEQ ID NO: 128691 - DNA, 24 bp, Artificial Sequence
  Description of Artificial Sequence: Synthetic oligonucleotide
gcccgtgaagaggtctggccgcta

SEQ ID NO: 128692 - DNA, 24 bp, Artificial Sequence
  Description of Artificial Sequence: Synthetic oligonucleotide
cccgtgaagaggtctggccgctac

SEQ ID NO: 128693 - DNA, 25 bp, Artificial Sequence
  Description of Artificial Sequence: Synthetic oligonucleotide
ccgtgaagaggtctggccgctacca

SEQ ID NO: 128694 - DNA, 27 bp, Artificial Sequence
  Description of Artificial Sequence: Synthetic oligonucleotide
cgtgaagaggtctggccgctaccactt

SEQ ID NO: 128695 - DNA, 28 bp, Artificial Sequence
  Description of Artificial Sequence: Synthetic oligonucleotide
gtgaagaggtctggccgctaccactttg

SEQ ID NO: 128696 - DNA, 29 bp, Artificial Sequence
  Description of Artificial Sequence: Synthetic oligonucleotide
tgaagaggtctggccgctaccactttgtg

SEQ ID NO: 128697 - DNA, 28 bp, Artificial Sequence
  Description of Artificial Sequence: Synthetic oligonucleotide
gaagaggtctggccgctaccactttgtg

SEQ ID NO: 128698 - DNA, 28 bp, Artificial Sequence
  Description of Artificial Sequence: Synthetic oligonucleotide
aagaggtctggccgctaccactttgtgc

SEQ ID NO: 128699 - DNA, 27 bp, Artificial Sequence
  Description of Artificial Sequence: Synthetic oligonucleotide
agaggtctggccgctaccactttgtgc

SEQ ID NO: 128700 - DNA, 26 bp, Artificial Sequence
  Description of Artificial Sequence: Synthetic oligonucleotide
gaggtctggccgctaccactttgtgc

SEQ ID NO: 128701 - DNA, 27 bp, Artificial Sequence
  Description of Artificial Sequence: Synthetic oligonucleotide
aggtctggccgctaccactttgtgcct

SEQ ID NO: 128702 - DNA, 26 bp, Artificial Sequence
  Description of Artificial Sequence: Synthetic oligonucleotide
ggtctggccgctaccactttgtgcct

SEQ ID NO: 128703 - DNA, 26 bp, Artificial Sequence
  Description of Artificial Sequence: Synthetic oligonucleotide
gtctggccgctaccactttgtgcctg

SEQ ID NO: 128704 - DNA, 27 bp, Artificial Sequence
  Description of Artificial Sequence: Synthetic oligonucleotide
tctggccgctaccactttgtgcctgga

SEQ ID NO: 128705 - DNA, 27 bp, Artificial Sequence
  Description of Artificial Sequence: Synthetic oligonucleotide
ctggccgctaccactttgtgcctggaa

SEQ ID NO: 128706 - DNA, 27 bp, Artificial Sequence
  Description of Artificial Sequence: Synthetic oligonucleotide
tggccgctaccactttgtgcctggaac

SEQ ID NO: 128707 - DNA, 26 bp, Artificial Sequence
  Description of Artificial Sequence: Synthetic oligonucleotide
ggccgctaccactttgtgcctggaac

SEQ ID NO: 128708 - DNA, 27 bp, Artificial Sequence
  Description of Artificial Sequence: Synthetic oligonucleotide
gccgctaccactttgtgcctggaacca

SEQ ID NO: 128709 - DNA, 27 bp, Artificial Sequence
  Description of Artificial Sequence: Synthetic oligonucleotide
ccgctaccactttgtgcctggaaccac

SEQ ID NO: 128710 - DNA, 28 bp, Artificial Sequence
  Description of Artificial Sequence: Synthetic oligonucleotide
cgctaccactttgtgcctggaaccacag

SEQ ID NO: 128711 - DNA, 28 bp, Artificial Sequence
  Description of Artificial Sequence: Synthetic oligonucleotide
gctaccactttgtgcctggaaccacagc

SEQ ID NO: 128712 - DNA, 29 bp, Artificial Sequence
  Description of Artificial Sequence: Synthetic oligonucleotide
ctaccactttgtgcctggaaccacagctg

SEQ ID NO: 128713 - DNA, 30 bp, Artificial Sequence
  Description of Artificial Sequence: Synthetic oligonucleotide
taccactttgtgcctggaaccacagctgtc

SEQ ID NO: 128714 - DNA, 29 bp, Artificial Sequence
  Description of Artificial Sequence: Synthetic oligonucleotide
accactttgtgcctggaaccacagctgtc

SEQ ID NO: 128715 - DNA, 28 bp, Artificial Sequence
  Description of Artificial Sequence: Synthetic oligonucleotide
ccactttgtgcctggaaccacagctgtc

SEQ ID NO: 128716 - DNA, 28 bp, Artificial Sequence
  Description of Artificial Sequence: Synthetic oligonucleotide
cactttgtgcctggaaccacagctgtcc

SEQ ID NO: 128717 - DNA, 29 bp, Artificial Sequence
  Description of Artificial Sequence: Synthetic oligonucleotide
actttgtgcctggaaccacagctgtcctg

SEQ ID NO: 128718 - DNA, 28 bp, Artificial Sequence
  Description of Artificial Sequence: Synthetic oligonucleotide
ctttgtgcctggaaccacagctgtcctg

SEQ ID NO: 128719 - DNA, 29 bp, Artificial Sequence
  Description of Artificial Sequence: Synthetic oligonucleotide
tttgtgcctggaaccacagctgtcctgac

SEQ ID NO: 128720 - DNA, 28 bp, Artificial Sequence
  Description of Artificial Sequence: Synthetic oligonucleotide
ttgtgcctggaaccacagctgtcctgac

SEQ ID NO: 128721 - DNA, 27 bp, Artificial Sequence
  Description of Artificial Sequence: Synthetic oligonucleotide
tgtgcctggaaccacagctgtcctgac

SEQ ID NO: 128722 - DNA, 26 bp, Artificial Sequence
  Description of Artificial Sequence: Synthetic oligonucleotide
gtgcctggaaccacagctgtcctgac

SEQ ID NO: 128723 - DNA, 26 bp, Artificial Sequence
  Description of Artificial Sequence: Synthetic oligonucleotide
tgcctggaaccacagctgtcctgacc

SEQ ID NO: 128724 - DNA, 25 bp, Artificial Sequence
  Description of Artificial Sequence: Synthetic oligonucleotide
gcctggaaccacagctgtcctgacc

SEQ ID NO: 128725 - DNA, 26 bp, Artificial Sequence
  Description of Artificial Sequence: Synthetic oligonucleotide
cctggaaccacagctgtcctgaccca

SEQ ID NO: 128726 - DNA, 27 bp, Artificial Sequence
  Description of Artificial Sequence: Synthetic oligonucleotide
ctggaaccacagctgtcctgacccaga

SEQ ID NO: 128727 - DNA, 27 bp, Artificial Sequence
  Description of Artificial Sequence: Synthetic oligonucleotide
tggaaccacagctgtcctgacccagac

SEQ ID NO: 128728 - DNA, 27 bp, Artificial Sequence
  Description of Artificial Sequence: Synthetic oligonucleotide
ggaaccacagctgtcctgacccagaca

SEQ ID NO: 128729 - DNA, 27 bp, Artificial Sequence
  Description of Artificial Sequence: Synthetic oligonucleotide
gaaccacagctgtcctgacccagacag

SEQ ID NO: 128730 - DNA, 28 bp, Artificial Sequence
  Description of Artificial Sequence: Synthetic oligonucleotide
aaccacagctgtcctgacccagacagtg

SEQ ID NO: 128731 - DNA, 27 bp, Artificial Sequence
  Description of Artificial Sequence: Synthetic oligonucleotide
accacagctgtcctgacccagacagtg

SEQ ID NO: 128732 - DNA, 27 bp, Artificial Sequence
  Description of Artificial Sequence: Synthetic oligonucleotide
ccacagctgtcctgacccagacagtga

SEQ ID NO: 128733 - DNA, 28 bp, Artificial Sequence
  Description of Artificial Sequence: Synthetic oligonucleotide
cacagctgtcctgacccagacagtgaag

SEQ ID NO: 128734 - DNA, 28 bp, Artificial Sequence
  Description of Artificial Sequence: Synthetic oligonucleotide
acagctgtcctgacccagacagtgaagc

SEQ ID NO: 128735 - DNA, 27 bp, Artificial Sequence
  Description of Artificial Sequence: Synthetic oligonucleotide
cagctgtcctgacccagacagtgaagc

SEQ ID NO: 128736 - DNA, 27 bp, Artificial Sequence
  Description of Artificial Sequence: Synthetic oligonucleotide
agctgtcctgacccagacagtgaagcc

SEQ ID NO: 128737 - DNA, 27 bp, Artificial Sequence
  Description of Artificial Sequence: Synthetic oligonucleotide
gctgtcctgacccagacagtgaagcca

SEQ ID NO: 128738 - DNA, 27 bp, Artificial Sequence
  Description of Artificial Sequence: Synthetic oligonucleotide
ctgtcctgacccagacagtgaagccac

SEQ ID NO: 128739 - DNA, 30 bp, Artificial Sequence
  Description of Artificial Sequence: Synthetic oligonucleotide
tgtcctgacccagacagtgaagccactaac

SEQ ID NO: 128740 - DNA, 29 bp, Artificial Sequence
  Description of Artificial Sequence: Synthetic oligonucleotide
gtcctgacccagacagtgaagccactaac

SEQ ID NO: 128741 - DNA, 29 bp, Artificial Sequence
  Description of Artificial Sequence: Synthetic oligonucleotide
tcctgacccagacagtgaagccactaacc

SEQ ID NO: 128742 - DNA, 28 bp, Artificial Sequence
  Description of Artificial Sequence: Synthetic oligonucleotide
cctgacccagacagtgaagccactaacc

SEQ ID NO: 128743 - DNA, 28 bp, Artificial Sequence
  Description of Artificial Sequence: Synthetic oligonucleotide
ctgacccagacagtgaagccactaaccc

SEQ ID NO: 128744 - DNA, 29 bp, Artificial Sequence
  Description of Artificial Sequence: Synthetic oligonucleotide
tgacccagacagtgaagccactaaccctg

SEQ ID NO: 128745 - DNA, 28 bp, Artificial Sequence
  Description of Artificial Sequence: Synthetic oligonucleotide
gacccagacagtgaagccactaaccctg

SEQ ID NO: 128746 - DNA, 28 bp, Artificial Sequence
  Description of Artificial Sequence: Synthetic oligonucleotide
acccagacagtgaagccactaaccctgg

SEQ ID NO: 128747 - DNA, 27 bp, Artificial Sequence
  Description of Artificial Sequence: Synthetic oligonucleotide
cccagacagtgaagccactaaccctgg

SEQ ID NO: 128748 - DNA, 28 bp, Artificial Sequence
  Description of Artificial Sequence: Synthetic oligonucleotide
ccagacagtgaagccactaaccctggag

SEQ ID NO: 128749 - DNA, 28 bp, Artificial Sequence
  Description of Artificial Sequence: Synthetic oligonucleotide
cagacagtgaagccactaaccctggagc

SEQ ID NO: 128750 - DNA, 30 bp, Artificial Sequence
  Description of Artificial Sequence: Synthetic oligonucleotide
agacagtgaagccactaaccctggagctag

SEQ ID NO: 128751 - DNA, 29 bp, Artificial Sequence
  Description of Artificial Sequence: Synthetic oligonucleotide
gacagtgaagccactaaccctggagctag

SEQ ID NO: 128752 - DNA, 30 bp, Artificial Sequence
  Description of Artificial Sequence: Synthetic oligonucleotide
acagtgaagccactaaccctggagctagtg

SEQ ID NO: 128753 - DNA, 29 bp, Artificial Sequence
  Description of Artificial Sequence: Synthetic oligonucleotide
cagtgaagccactaaccctggagctagtg

SEQ ID NO: 128754 - DNA, 29 bp, Artificial Sequence
  Description of Artificial Sequence: Synthetic oligonucleotide
agtgaagccactaaccctggagctagtgg

SEQ ID NO: 128755 - DNA, 28 bp, Artificial Sequence
  Description of Artificial Sequence: Synthetic oligonucleotide
gtgaagccactaaccctggagctagtgg

SEQ ID NO: 128756 - DNA, 29 bp, Artificial Sequence
  Description of Artificial Sequence: Synthetic oligonucleotide
tgaagccactaaccctggagctagtggag

SEQ ID NO: 128757 - DNA, 28 bp, Artificial Sequence
  Description of Artificial Sequence: Synthetic oligonucleotide
gaagccactaaccctggagctagtggag

SEQ ID NO: 128758 - DNA, 28 bp, Artificial Sequence
  Description of Artificial Sequence: Synthetic oligonucleotide
aagccactaaccctggagctagtggagg

SEQ ID NO: 128759 - DNA, 27 bp, Artificial Sequence
  Description of Artificial Sequence: Synthetic oligonucleotide
agccactaaccctggagctagtggagg

SEQ ID NO: 128760 - DNA, 27 bp, Artificial Sequence
  Description of Artificial Sequence: Synthetic oligonucleotide
gccactaaccctggagctagtggagga

SEQ ID NO: 128761 - DNA, 29 bp, Artificial Sequence
  Description of Artificial Sequence: Synthetic oligonucleotide
ccactaaccctggagctagtggaggaaac

SEQ ID NO: 128762 - DNA, 30 bp, Artificial Sequence
  Description of Artificial Sequence: Synthetic oligonucleotide
cactaaccctggagctagtggaggaaactg

SEQ ID NO: 128763 - DNA, 31 bp, Artificial Sequence
  Description of Artificial Sequence: Synthetic oligonucleotide
actaaccctggagctagtggaggaaactgtg

SEQ ID NO: 128764 - DNA, 30 bp, Artificial Sequence
  Description of Artificial Sequence: Synthetic oligonucleotide
ctaaccctggagctagtggaggaaactgtg

SEQ ID NO: 128765 - DNA, 30 bp, Artificial Sequence
  Description of Artificial Sequence: Synthetic oligonucleotide
taaccctggagctagtggaggaaactgtgc

SEQ ID NO: 128766 - DNA, 29 bp, Artificial Sequence
  Description of Artificial Sequence: Synthetic oligonucleotide
aaccctggagctagtggaggaaactgtgc

SEQ ID NO: 128767 - DNA, 28 bp, Artificial Sequence
  Description of Artificial Sequence: Synthetic oligonucleotide
accctggagctagtggaggaaactgtgc

SEQ ID NO: 128768 - DNA, 27 bp, Artificial Sequence
  Description of Artificial Sequence: Synthetic oligonucleotide
ccctggagctagtggaggaaactgtgc

SEQ ID NO: 128769 - DNA, 28 bp, Artificial Sequence
  Description of Artificial Sequence: Synthetic oligonucleotide
cctggagctagtggaggaaactgtgcag

SEQ ID NO: 128770 - DNA, 28 bp, Artificial Sequence
  Description of Artificial Sequence: Synthetic oligonucleotide
ctggagctagtggaggaaactgtgcagg

SEQ ID NO: 128771 - DNA, 28 bp, Artificial Sequence
  Description of Artificial Sequence: Synthetic oligonucleotide
tggagctagtggaggaaactgtgcaggc

SEQ ID NO: 128772 - DNA, 27 bp, Artificial Sequence
  Description of Artificial Sequence: Synthetic oligonucleotide
ggagctagtggaggaaactgtgcaggc

SEQ ID NO: 128773 - DNA, 30 bp, Artificial Sequence
  Description of Artificial Sequence: Synthetic oligonucleotide
gagctagtggaggaaactgtgcaggctatg

SEQ ID NO: 128774 - DNA, 30 bp, Artificial Sequence
  Description of Artificial Sequence: Synthetic oligonucleotide
agctagtggaggaaactgtgcaggctatgg

SEQ ID NO: 128775 - DNA, 29 bp, Artificial Sequence
  Description of Artificial Sequence: Synthetic oligonucleotide
gctagtggaggaaactgtgcaggctatgg

SEQ ID NO: 128776 - DNA, 30 bp, Artificial Sequence
  Description of Artificial Sequence: Synthetic oligonucleotide
ctagtggaggaaactgtgcaggctatggag

SEQ ID NO: 128777 - DNA, 30 bp, Artificial Sequence
  Description of Artificial Sequence: Synthetic oligonucleotide
tagtggaggaaactgtgcaggctatggagg

SEQ ID NO: 128778 - DNA, 29 bp, Artificial Sequence
  Description of Artificial Sequence: Synthetic oligonucleotide
agtggaggaaactgtgcaggctatggagg

SEQ ID NO: 128779 - DNA, 28 bp, Artificial Sequence
  Description of Artificial Sequence: Synthetic oligonucleotide
gtggaggaaactgtgcaggctatggagg

SEQ ID NO: 128780 - DNA, 29 bp, Artificial Sequence
  Description of Artificial Sequence: Synthetic oligonucleotide
tggaggaaactgtgcaggctatggaggtg

SEQ ID NO: 128781 - DNA, 28 bp, Artificial Sequence
  Description of Artificial Sequence: Synthetic oligonucleotide
ggaggaaactgtgcaggctatggaggtg

SEQ ID NO: 128782 - DNA, 28 bp, Artificial Sequence
  Description of Artificial Sequence: Synthetic oligonucleotide
gaggaaactgtgcaggctatggaggtgg

SEQ ID NO: 128783 - DNA, 29 bp, Artificial Sequence
  Description of Artificial Sequence: Synthetic oligonucleotide
aggaaactgtgcaggctatggaggtggag

SEQ ID NO: 128784 - DNA, 28 bp, Artificial Sequence
  Description of Artificial Sequence: Synthetic oligonucleotide
ggaaactgtgcaggctatggaggtggag

SEQ ID NO: 128785 - DNA, 28 bp, Artificial Sequence
  Description of Artificial Sequence: Synthetic oligonucleotide
atggctctgcaggatgtgtgcaagtggc

SEQ ID NO: 128786 - DNA, 27 bp, Artificial Sequence
  Description of Artificial Sequence: Synthetic oligonucleotide
tggctctgcaggatgtgtgcaagtggc

SEQ ID NO: 128787 - DNA, 27 bp, Artificial Sequence
  Description of Artificial Sequence: Synthetic oligonucleotide
ggctctgcaggatgtgtgcaagtggca

SEQ ID NO: 128788 - DNA, 27 bp, Artificial Sequence
  Description of Artificial Sequence: Synthetic oligonucleotide
gctctgcaggatgtgtgcaagtggcag

SEQ ID NO: 128789 - DNA, 28 bp, Artificial Sequence
  Description of Artificial Sequence: Synthetic oligonucleotide
ctctgcaggatgtgtgcaagtggcagtc

SEQ ID NO: 128790 - DNA, 28 bp, Artificial Sequence
  Description of Artificial Sequence: Synthetic oligonucleotide
tctgcaggatgtgtgcaagtggcagtcc

SEQ ID NO: 128791 - DNA, 27 bp, Artificial Sequence
  Description of Artificial Sequence: Synthetic oligonucleotide
ctgcaggatgtgtgcaagtggcagtcc

SEQ ID NO: 128792 - DNA, 27 bp, Artificial Sequence
  Description of Artificial Sequence: Synthetic oligonucleotide
tgcaggatgtgtgcaagtggcagtccc

SEQ ID NO: 128793 - DNA, 26 bp, Artificial Sequence
  Description of Artificial Sequence: Synthetic oligonucleotide
gcaggatgtgtgcaagtggcagtccc

SEQ ID NO: 128794 - DNA, 27 bp, Artificial Sequence
  Description of Artificial Sequence: Synthetic oligonucleotide
caggatgtgtgcaagtggcagtcccct

SEQ ID NO: 128795 - DNA, 27 bp, Artificial Sequence
  Description of Artificial Sequence: Synthetic oligonucleotide
aggatgtgtgcaagtggcagtcccctg

SEQ ID NO: 128796 - DNA, 27 bp, Artificial Sequence
  Description of Artificial Sequence: Synthetic oligonucleotide
ggatgtgtgcaagtggcagtcccctga

SEQ ID NO: 128797 - DNA, 27 bp, Artificial Sequence
  Description of Artificial Sequence: Synthetic oligonucleotide
gatgtgtgcaagtggcagtcccctgac

SEQ ID NO: 128798 - DNA, 28 bp, Artificial Sequence
  Description of Artificial Sequence: Synthetic oligonucleotide
atgtgtgcaagtggcagtcccctgacac

SEQ ID NO: 128799 - DNA, 27 bp, Artificial Sequence
  Description of Artificial Sequence: Synthetic oligonucleotide
tgtgtgcaagtggcagtcccctgacac

SEQ ID NO: 128800 - DNA, 26 bp, Artificial Sequence
  Description of Artificial Sequence: Synthetic oligonucleotide
gtgtgcaagtggcagtcccctgacac

SEQ ID NO: 128801 - DNA, 26 bp, Artificial Sequence
  Description of Artificial Sequence: Synthetic oligonucleotide
tgtgcaagtggcagtcccctgacacc

SEQ ID NO: 128802 - DNA, 25 bp, Artificial Sequence
  Description of Artificial Sequence: Synthetic oligonucleotide
gtgcaagtggcagtcccctgacacc

SEQ ID NO: 128803 - DNA, 26 bp, Artificial Sequence
  Description of Artificial Sequence: Synthetic oligonucleotide
tgcaagtggcagtcccctgacaccca

SEQ ID NO: 128804 - DNA, 25 bp, Artificial Sequence
  Description of Artificial Sequence: Synthetic oligonucleotide
gcaagtggcagtcccctgacaccca

SEQ ID NO: 128805 - DNA, 25 bp, Artificial Sequence
  Description of Artificial Sequence: Synthetic oligonucleotide
caagtggcagtcccctgacacccag

SEQ ID NO: 128806 - DNA, 25 bp, Artificial Sequence
  Description of Artificial Sequence: Synthetic oligonucleotide
aagtggcagtcccctgacacccagg

SEQ ID NO: 128807 - DNA, 24 bp, Artificial Sequence
  Description of Artificial Sequence: Synthetic oligonucleotide
agtggcagtcccctgacacccagg

SEQ ID NO: 128808 - DNA, 23 bp, Artificial Sequence
  Description of Artificial Sequence: Synthetic oligonucleotide
gtggcagtcccctgacacccagg

SEQ ID NO: 128809 - DNA, 24 bp, Artificial Sequence
  Description of Artificial Sequence: Synthetic oligonucleotide
tggcagtcccctgacacccaggga

SEQ ID NO: 128810 - DNA, 23 bp, Artificial Sequence
  Description of Artificial Sequence: Synthetic oligonucleotide
ggcagtcccctgacacccaggga

SEQ ID NO: 128811 - DNA, 23 bp, Artificial Sequence
  Description of Artificial Sequence: Synthetic oligonucleotide
gcagtcccctgacacccagggac

SEQ ID NO: 128812 - DNA, 25 bp, Artificial Sequence
  Description of Artificial Sequence: Synthetic oligonucleotide
cagtcccctgacacccagggaccat

SEQ ID NO: 128813 - DNA, 26 bp, Artificial Sequence
  Description of Artificial Sequence: Synthetic oligonucleotide
agtcccctgacacccagggaccatca

SEQ ID NO: 128814 - DNA, 25 bp, Artificial Sequence
  Description of Artificial Sequence: Synthetic oligonucleotide
gtcccctgacacccagggaccatca

SEQ ID NO: 128815 - DNA, 25 bp, Artificial Sequence
  Description of Artificial Sequence: Synthetic oligonucleotide
tcccctgacacccagggaccatcac

SEQ ID NO: 128816 - DNA, 24 bp, Artificial Sequence
  Description of Artificial Sequence: Synthetic oligonucleotide
cccctgacacccagggaccatcac

SEQ ID NO: 128817 - DNA, 25 bp, Artificial Sequence
  Description of Artificial Sequence: Synthetic oligonucleotide
ccctgacacccagggaccatcacct

SEQ ID NO: 128818 - DNA, 26 bp, Artificial Sequence
  Description of Artificial Sequence: Synthetic oligonucleotide
cctgacacccagggaccatcacctca

SEQ ID NO: 128819 - DNA, 26 bp, Artificial Sequence
  Description of Artificial Sequence: Synthetic oligonucleotide
ctgacacccagggaccatcacctcac

SEQ ID NO: 128820 - DNA, 27 bp, Artificial Sequence
  Description of Artificial Sequence: Synthetic oligonucleotide
tgacacccagggaccatcacctcacct

SEQ ID NO: 128821 - DNA, 26 bp, Artificial Sequence
  Description of Artificial Sequence: Synthetic oligonucleotide
gacacccagggaccatcacctcacct

SEQ ID NO: 128822 - DNA, 26 bp, Artificial Sequence
  Description of Artificial Sequence: Synthetic oligonucleotide
acacccagggaccatcacctcacctg

SEQ ID NO: 128823 - DNA, 25 bp, Artificial Sequence
  Description of Artificial Sequence: Synthetic oligonucleotide
cacccagggaccatcacctcacctg

SEQ ID NO: 128824 - DNA, 25 bp, Artificial Sequence
  Description of Artificial Sequence: Synthetic oligonucleotide
acccagggaccatcacctcacctgc

SEQ ID NO: 128825 - DNA, 24 bp, Artificial Sequence
  Description of Artificial Sequence: Synthetic oligonucleotide
cccagggaccatcacctcacctgc

SEQ ID NO: 128826 - DNA, 25 bp, Artificial Sequence
  Description of Artificial Sequence: Synthetic oligonucleotide
ccagggaccatcacctcacctgcct

SEQ ID NO: 128827 - DNA, 25 bp, Artificial Sequence
  Description of Artificial Sequence: Synthetic oligonucleotide
cagggaccatcacctcacctgcctc

SEQ ID NO: 128828 - DNA, 25 bp, Artificial Sequence
  Description of Artificial Sequence: Synthetic oligonucleotide
agggaccatcacctcacctgcctcg

SEQ ID NO: 128829 - DNA, 24 bp, Artificial Sequence
  Description of Artificial Sequence: Synthetic oligonucleotide
gggaccatcacctcacctgcctcg

SEQ ID NO: 128830 - DNA, 24 bp, Artificial Sequence
  Description of Artificial Sequence: Synthetic oligonucleotide
ggaccatcacctcacctgcctcgg

SEQ ID NO: 128831 - DNA, 24 bp, Artificial Sequence
  Description of Artificial Sequence: Synthetic oligonucleotide
gaccatcacctcacctgcctcggg

SEQ ID NO: 128832 - DNA, 25 bp, Artificial Sequence
  Description of Artificial Sequence: Synthetic oligonucleotide
accatcacctcacctgcctcgggct

SEQ ID NO: 128833 - DNA, 24 bp, Artificial Sequence
  Description of Artificial Sequence: Synthetic oligonucleotide
ccatcacctcacctgcctcgggct

SEQ ID NO: 128834 - DNA, 24 bp, Artificial Sequence
  Description of Artificial Sequence: Synthetic oligonucleotide
catcacctcacctgcctcgggctg

SEQ ID NO: 128835 - DNA, 24 bp, Artificial Sequence
  Description of Artificial Sequence: Synthetic oligonucleotide
atcacctcacctgcctcgggctgg

SEQ ID NO: 128836 - DNA, 23 bp, Artificial Sequence
  Description of Artificial Sequence: Synthetic oligonucleotide
tcacctcacctgcctcgggctgg

SEQ ID NO: 128837 - DNA, 22 bp, Artificial Sequence
  Description of Artificial Sequence: Synthetic oligonucleotide
cacctcacctgcctcgggctgg

SEQ ID NO: 128838 - DNA, 22 bp, Artificial Sequence
  Description of Artificial Sequence: Synthetic oligonucleotide
acctcacctgcctcgggctggc

SEQ ID NO: 128839 - DNA, 21 bp, Artificial Sequence
  Description of Artificial Sequence: Synthetic oligonucleotide
cctcacctgcctcgggctggc

SEQ ID NO: 128840 - DNA, 21 bp, Artificial Sequence
  Description of Artificial Sequence: Synthetic oligonucleotide
ctcacctgcctcgggctggcg

SEQ ID NO: 128841 - DNA, 21 bp, Artificial Sequence
  Description of Artificial Sequence: Synthetic oligonucleotide
tcacctgcctcgggctggcgg

SEQ ID NO: 128842 - DNA, 20 bp, Artificial Sequence
  Description of Artificial Sequence: Synthetic oligonucleotide
cacctgcctcgggctggcgg

SEQ ID NO: 128843 - DNA, 21 bp, Artificial Sequence
  Description of Artificial Sequence: Synthetic oligonucleotide
acctgcctcgggctggcggct

SEQ ID NO: 128844 - DNA, 20 bp, Artificial Sequence
  Description of Artificial Sequence: Synthetic oligonucleotide
cctgcctcgggctggcggct

SEQ ID NO: 128845 - DNA, 20 bp, Artificial Sequence
  Description of Artificial Sequence: Synthetic oligonucleotide
ctgcctcgggctggcggctg

SEQ ID NO: 128846 - DNA, 20 bp, Artificial Sequence
  Description of Artificial Sequence: Synthetic oligonucleotide
tgcctcgggctggcggctgg

SEQ ID NO: 128847 - DNA, 20 bp, Artificial Sequence
  Description of Artificial Sequence: Synthetic oligonucleotide
gcctcgggctggcggctggt

SEQ ID NO: 128848 - DNA, 20 bp, Artificial Sequence
  Description of Artificial Sequence: Synthetic oligonucleotide
cctcgggctggcggctgggt

SEQ ID NO: 128849 - DNA, 20 bp, Artificial Sequence
  Description of Artificial Sequence: Synthetic oligonucleotide
ctcgggctggcggctgggct

SEQ ID NO: 128850 - DNA, 21 bp, Artificial Sequence
  Description of Artificial Sequence: Synthetic oligonucleotide
tcgggctggcggctgggctgt

SEQ ID NO: 128851 - DNA, 20 bp, Artificial Sequence
  Description of Artificial Sequence: Synthetic oligonucleotide
cgggctggcggctgggctgt

SEQ ID NO: 128852 - DNA, 20 bp, Artificial Sequence
  Description of Artificial Sequence: Synthetic oligonucleotide
gggctggcggctgggctgtg

SEQ ID NO: 128853 - DNA, 20 bp, Artificial Sequence
  Description of Artificial Sequence: Synthetic oligonucleotide
ggctggcggctgggctgtgc

SEQ ID NO: 128854 - DNA, 20 bp, Artificial Sequence
  Description of Artificial Sequence: Synthetic oligonucleotide
gctggcggctgggctgtgcc

SEQ ID NO: 128855 - DNA, 20 bp, Artificial Sequence
  Description of Artificial Sequence: Synthetic oligonucleotide
ctggcggctgggctgtgccc

SEQ ID NO: 128856 - DNA, 20 bp, Artificial Sequence
  Description of Artificial Sequence: Synthetic oligonucleotide
tggcggctgggctgtgcccc

SEQ ID NO: 128857 - DNA, 20 bp, Artificial Sequence
  Description of Artificial Sequence: Synthetic oligonucleotide
ggcggctgggctgtgcccct

SEQ ID NO: 128858 - DNA, 20 bp, Artificial Sequence
  Description of Artificial Sequence: Synthetic oligonucleotide
gcggctgggctgtgccccgt

SEQ ID NO: 128859 - DNA, 20 bp, Artificial Sequence
  Description of Artificial Sequence: Synthetic oligonucleotide
cggctgggctgtgccccggt

SEQ ID NO: 128860 - DNA, 20 bp, Artificial Sequence
  Description of Artificial Sequence: Synthetic oligonucleotide
ggctgggctgtgccccgggt

SEQ ID NO: 128861 - DNA, 21 bp, Artificial Sequence
  Description of Artificial Sequence: Synthetic oligonucleotide
gctgggctgtgccccggggtt

SEQ ID NO: 128862 - DNA, 22 bp, Artificial Sequence
  Description of Artificial Sequence: Synthetic oligonucleotide
ctgggctgtgccccggggttgt

SEQ ID NO: 128863 - DNA, 23 bp, Artificial Sequence
  Description of Artificial Sequence: Synthetic oligonucleotide
tgggctgtgccccggggttgtga

SEQ ID NO: 128864 - DNA, 22 bp, Artificial Sequence
  Description of Artificial Sequence: Synthetic oligonucleotide
gggctgtgccccggggttgtga

SEQ ID NO: 128865 - DNA, 22 bp, Artificial Sequence
  Description of Artificial Sequence: Synthetic oligonucleotide
ggctgtgccccggggttgtgac

SEQ ID NO: 128866 - DNA, 22 bp, Artificial Sequence
  Description of Artificial Sequence: Synthetic oligonucleotide
gctgtgccccggggttgtgacc

SEQ ID NO: 128867 - DNA, 23 bp, Artificial Sequence
  Description of Artificial Sequence: Synthetic oligonucleotide
ctgtgccccggggttgtgaccct

SEQ ID NO: 128868 - DNA, 26 bp, Artificial Sequence
  Description of Artificial Sequence: Synthetic oligonucleotide
tgtgccccggggttgtgaccctcaaa

SEQ ID NO: 128869 - DNA, 25 bp, Artificial Sequence
  Description of Artificial Sequence: Synthetic oligonucleotide
gtgccccggggttgtgaccctcaaa

SEQ ID NO: 128870 - DNA, 25 bp, Artificial Sequence
  Description of Artificial Sequence: Synthetic oligonucleotide
tgccccggggttgtgaccctcaaac

SEQ ID NO: 128871 - DNA, 24 bp, Artificial Sequence
  Description of Artificial Sequence: Synthetic oligonucleotide
gccccggggttgtgaccctcaaac

SEQ ID NO: 128872 - DNA, 26 bp, Artificial Sequence
  Description of Artificial Sequence: Synthetic oligonucleotide
ccccggggttgtgaccctcaaacctt

SEQ ID NO: 128873 - DNA, 26 bp, Artificial Sequence
  Description of Artificial Sequence: Synthetic oligonucleotide
cccggggttgtgaccctcaaaccttc

SEQ ID NO: 128874 - DNA, 27 bp, Artificial Sequence
  Description of Artificial Sequence: Synthetic oligonucleotide
ccggggttgtgaccctcaaaccttcct

SEQ ID NO: 128875 - DNA, 27 bp, Artificial Sequence
  Description of Artificial Sequence: Synthetic oligonucleotide
cggggttgtgaccctcaaaccttcctg

SEQ ID NO: 128876 - DNA, 27 bp, Artificial Sequence
  Description of Artificial Sequence: Synthetic oligonucleotide
ggggttgtgaccctcaaaccttcctgc

SEQ ID NO: 128877 - DNA, 28 bp, Artificial Sequence
  Description of Artificial Sequence: Synthetic oligonucleotide
gggttgtgaccctcaaaccttcctgcag

SEQ ID NO: 128878 - DNA, 30 bp, Artificial Sequence
  Description of Artificial Sequence: Synthetic oligonucleotide
ggttgtgaccctcaaaccttcctgcagatc

SEQ ID NO: 128879 - DNA, 30 bp, Artificial Sequence
  Description of Artificial Sequence: Synthetic oligonucleotide
gttgtgaccctcaaaccttcctgcagatcc

SEQ ID NO: 128880 - DNA, 32 bp, Artificial Sequence
  Description of Artificial Sequence: Synthetic oligonucleotide
ttgtgaccctcaaaccttcctgcagatccatg

SEQ ID NO: 128881 - DNA, 31 bp, Artificial Sequence
  Description of Artificial Sequence: Synthetic oligonucleotide
tgtgaccctcaaaccttcctgcagatccatg

SEQ ID NO: 128882 - DNA, 30 bp, Artificial Sequence
  Description of Artificial Sequence: Synthetic oligonucleotide
gtgaccctcaaaccttcctgcagatccatg

SEQ ID NO: 128883 - DNA, 30 bp, Artificial Sequence
  Description of Artificial Sequence: Synthetic oligonucleotide
tgaccctcaaaccttcctgcagatccatgg

SEQ ID NO: 128884 - DNA, 29 bp, Artificial Sequence
  Description of Artificial Sequence: Synthetic oligonucleotide
gaccctcaaaccttcctgcagatccatgg

SEQ ID NO: 128885 - DNA, 29 bp, Artificial Sequence
  Description of Artificial Sequence: Synthetic oligonucleotide
accctcaaaccttcctgcagatccatggc

SEQ ID NO: 128886 - DNA, 28 bp, Artificial Sequence
  Description of Artificial Sequence: Synthetic oligonucleotide
ccctcaaaccttcctgcagatccatggc

SEQ ID NO: 128887 - DNA, 28 bp, Artificial Sequence
  Description of Artificial Sequence: Synthetic oligonucleotide
cctcaaaccttcctgcagatccatggcc

SEQ ID NO: 128888 - DNA, 28 bp, Artificial Sequence
  Description of Artificial Sequence: Synthetic oligonucleotide
ctcaaaccttcctgcagatccatggccc

SEQ ID NO: 128889 - DNA, 28 bp, Artificial Sequence
  Description of Artificial Sequence: Synthetic oligonucleotide
tcaaaccttcctgcagatccatggcccc

SEQ ID NO: 128890 - DNA, 27 bp, Artificial Sequence
  Description of Artificial Sequence: Synthetic oligonucleotide
caaaccttcctgcagatccatggcccc

SEQ ID NO: 128891 - DNA, 28 bp, Artificial Sequence
  Description of Artificial Sequence: Synthetic oligonucleotide
aaaccttcctgcagatccatggccccag

SEQ ID NO: 128892 - DNA, 27 bp, Artificial Sequence
  Description of Artificial Sequence: Synthetic oligonucleotide
aaccttcctgcagatccatggccccag

SEQ ID NO: 128893 - DNA, 27 bp, Artificial Sequence
  Description of Artificial Sequence: Synthetic oligonucleotide
accttcctgcagatccatggccccaga

SEQ ID NO: 128894 - DNA, 26 bp, Artificial Sequence
  Description of Artificial Sequence: Synthetic oligonucleotide
ccttcctgcagatccatggccccaga

SEQ ID NO: 128895 - DNA, 27 bp, Artificial Sequence
  Description of Artificial Sequence: Synthetic oligonucleotide
cttcctgcagatccatggccccagact

SEQ ID NO: 128896 - DNA, 27 bp, Artificial Sequence
  Description of Artificial Sequence: Synthetic oligonucleotide
ttcctgcagatccatggccccagactg

SEQ ID NO: 128897 - DNA, 26 bp, Artificial Sequence
  Description of Artificial Sequence: Synthetic oligonucleotide
tcctgcagatccatggccccagactg

SEQ ID NO: 128898 - DNA, 25 bp, Artificial Sequence
  Description of Artificial Sequence: Synthetic oligonucleotide
cctgcagatccatggccccagactg

SEQ ID NO: 128899 - DNA, 25 bp, Artificial Sequence
  Description of Artificial Sequence: Synthetic oligonucleotide
ctgcagatccatggccccagactgg

SEQ ID NO: 128900 - DNA, 25 bp, Artificial Sequence
  Description of Artificial Sequence: Synthetic oligonucleotide
tgcagatccatggccccagactggc

SEQ ID NO: 128901 - DNA, 24 bp, Artificial Sequence
  Description of Artificial Sequence: Synthetic oligonucleotide
gcagatccatggccccagactggc

SEQ ID NO: 128902 - DNA, 24 bp, Artificial Sequence
  Description of Artificial Sequence: Synthetic oligonucleotide
cagatccatggccccagactggcc

SEQ ID NO: 128903 - DNA, 25 bp, Artificial Sequence
  Description of Artificial Sequence: Synthetic oligonucleotide
agatccatggccccagactggccca

SEQ ID NO: 128904 - DNA, 24 bp, Artificial Sequence
  Description of Artificial Sequence: Synthetic oligonucleotide
gatccatggccccagactggccca

SEQ ID NO: 128905 - DNA, 24 bp, Artificial Sequence
  Description of Artificial Sequence: Synthetic oligonucleotide
atccatggccccagactggcccac

SEQ ID NO: 128906 - DNA, 23 bp, Artificial Sequence
  Description of Artificial Sequence: Synthetic oligonucleotide
tccatggccccagactggcccac

SEQ ID NO: 128907 - DNA, 22 bp, Artificial Sequence
  Description of Artificial Sequence: Synthetic oligonucleotide
ccatggccccagactggcccac

SEQ ID NO: 128908 - DNA, 22 bp, Artificial Sequence
  Description of Artificial Sequence: Synthetic oligonucleotide
catggccccagactggcccacg

SEQ ID NO: 128909 - DNA, 22 bp, Artificial Sequence
  Description of Artificial Sequence: Synthetic oligonucleotide
atggccccagactggcccacgg

SEQ ID NO: 128910 - DNA, 21 bp, Artificial Sequence
  Description of Artificial Sequence: Synthetic oligonucleotide
tggccccagactggcccacgg

SEQ ID NO: 128911 - DNA, 20 bp, Artificial Sequence
  Description of Artificial Sequence: Synthetic oligonucleotide
ggccccagactggcccacgg

SEQ ID NO: 128912 - DNA, 21 bp, Artificial Sequence
  Description of Artificial Sequence: Synthetic oligonucleotide
gccccagactggcccacggca

SEQ ID NO: 128913 - DNA, 21 bp, Artificial Sequence
  Description of Artificial Sequence: Synthetic oligonucleotide
ccccagactggcccacggcac

SEQ ID NO: 128914 - DNA, 22 bp, Artificial Sequence
  Description of Artificial Sequence: Synthetic oligonucleotide
cccagactggcccacggcacca

SEQ ID NO: 128915 - DNA, 22 bp, Artificial Sequence
  Description of Artificial Sequence: Synthetic oligonucleotide
ccagactggcccacggcaccac

SEQ ID NO: 128916 - DNA, 23 bp, Artificial Sequence
  Description of Artificial Sequence: Synthetic oligonucleotide
cagactggcccacggcaccacca

SEQ ID NO: 128917 - DNA, 24 bp, Artificial Sequence
  Description of Artificial Sequence: Synthetic oligonucleotide
agactggcccacggcaccaccact

SEQ ID NO: 128918 - DNA, 23 bp, Artificial Sequence
  Description of Artificial Sequence: Synthetic oligonucleotide
gactggcccacggcaccaccact

SEQ ID NO: 128919 - DNA, 24 bp, Artificial Sequence
  Description of Artificial Sequence: Synthetic oligonucleotide
actggcccacggcaccaccactct

SEQ ID NO: 128920 - DNA, 23 bp, Artificial Sequence
  Description of Artificial Sequence: Synthetic oligonucleotide
ctggcccacggcaccaccactct

SEQ ID NO: 128921 - DNA, 23 bp, Artificial Sequence
  Description of Artificial Sequence: Synthetic oligonucleotide
tggcccacggcaccaccactctg

SEQ ID NO: 128922 - DNA, 22 bp, Artificial Sequence
  Description of Artificial Sequence: Synthetic oligonucleotide
ggcccacggcaccaccactctg

SEQ ID NO: 128923 - DNA, 22 bp, Artificial Sequence
  Description of Artificial Sequence: Synthetic oligonucleotide
gcccacggcaccaccactctgg

SEQ ID NO: 128924 - DNA, 22 bp, Artificial Sequence
  Description of Artificial Sequence: Synthetic oligonucleotide
cccacggcaccaccactctggc

SEQ ID NO: 128925 - DNA, 24 bp, Artificial Sequence
  Description of Artificial Sequence: Synthetic oligonucleotide
ccacggcaccaccactctggcctt

SEQ ID NO: 128926 - DNA, 24 bp, Artificial Sequence
  Description of Artificial Sequence: Synthetic oligonucleotide
cacggcaccaccactctggccttc

SEQ ID NO: 128927 - DNA, 24 bp, Artificial Sequence
  Description of Artificial Sequence: Synthetic oligonucleotide
acggcaccaccactctggccttcc

SEQ ID NO: 128928 - DNA, 23 bp, Artificial Sequence
  Description of Artificial Sequence: Synthetic oligonucleotide
cggcaccaccactctggccttcc

SEQ ID NO: 128929 - DNA, 23 bp, Artificial Sequence
  Description of Artificial Sequence: Synthetic oligonucleotide
ggcaccaccactctggccttccg

SEQ ID NO: 128930 - DNA, 25 bp, Artificial Sequence
  Description of Artificial Sequence: Synthetic oligonucleotide
gcaccaccactctggccttccgctt

SEQ ID NO: 128931 - DNA, 25 bp, Artificial Sequence
  Description of Artificial Sequence: Synthetic oligonucleotide
caccaccactctggccttccgcttc

SEQ ID NO: 128932 - DNA, 25 bp, Artificial Sequence
  Description of Artificial Sequence: Synthetic oligonucleotide
accaccactctggccttccgcttcc

SEQ ID NO: 128933 - DNA, 24 bp, Artificial Sequence
  Description of Artificial Sequence: Synthetic oligonucleotide
ccaccactctggccttccgcttcc

SEQ ID NO: 128934 - DNA, 25 bp, Artificial Sequence
  Description of Artificial Sequence: Synthetic oligonucleotide
caccactctggccttccgcttccgt

SEQ ID NO: 128935 - DNA, 27 bp, Artificial Sequence
  Description of Artificial Sequence: Synthetic oligonucleotide
accactctggccttccgcttccgtcat

SEQ ID NO: 128936 - DNA, 26 bp, Artificial Sequence
  Description of Artificial Sequence: Synthetic oligonucleotide
ccactctggccttccgcttccgtcat

SEQ ID NO: 128937 - DNA, 26 bp, Artificial Sequence
  Description of Artificial Sequence: Synthetic oligonucleotide
cactctggccttccgcttccgtcatg

SEQ ID NO: 128938 - DNA, 27 bp, Artificial Sequence
  Description of Artificial Sequence: Synthetic oligonucleotide
actctggccttccgcttccgtcatgga

SEQ ID NO: 128939 - DNA, 26 bp, Artificial Sequence
  Description of Artificial Sequence: Synthetic oligonucleotide
ctctggccttccgcttccgtcatgga

SEQ ID NO: 128940 - DNA, 27 bp, Artificial Sequence
  Description of Artificial Sequence: Synthetic oligonucleotide
tctggccttccgcttccgtcatggagt

SEQ ID NO: 128941 - DNA, 26 bp, Artificial Sequence
  Description of Artificial Sequence: Synthetic oligonucleotide
ctggccttccgcttccgtcatggagt

SEQ ID NO: 128942 - DNA, 27 bp, Artificial Sequence
  Description of Artificial Sequence: Synthetic oligonucleotide
tggccttccgcttccgtcatggagtca

SEQ ID NO: 128943 - DNA, 27 bp, Artificial Sequence
  Description of Artificial Sequence: Synthetic oligonucleotide
ggccttccgcttccgtcatggagtcat

SEQ ID NO: 128944 - DNA, 28 bp, Artificial Sequence
  Description of Artificial Sequence: Synthetic oligonucleotide
gccttccgcttccgtcatggagtcattg

SEQ ID NO: 128945 - DNA, 28 bp, Artificial Sequence
  Description of Artificial Sequence: Synthetic oligonucleotide
ccttccgcttccgtcatggagtcattgc

SEQ ID NO: 128946 - DNA, 29 bp, Artificial Sequence
  Description of Artificial Sequence: Synthetic oligonucleotide
cttccgcttccgtcatggagtcattgctg

SEQ ID NO: 128947 - DNA, 29 bp, Artificial Sequence
  Description of Artificial Sequence: Synthetic oligonucleotide
ttccgcttccgtcatggagtcattgctgc

SEQ ID NO: 128948 - DNA, 28 bp, Artificial Sequence
  Description of Artificial Sequence: Synthetic oligonucleotide
tccgcttccgtcatggagtcattgctgc

SEQ ID NO: 128949 - DNA, 27 bp, Artificial Sequence
  Description of Artificial Sequence: Synthetic oligonucleotide
ccgcttccgtcatggagtcattgctgc

SEQ ID NO: 128950 - DNA, 28 bp, Artificial Sequence
  Description of Artificial Sequence: Synthetic oligonucleotide
cgcttccgtcatggagtcattgctgcag

SEQ ID NO: 128951 - DNA, 28 bp, Artificial Sequence
  Description of Artificial Sequence: Synthetic oligonucleotide
gcttccgtcatggagtcattgctgcagc

SEQ ID NO: 128952 - DNA, 29 bp, Artificial Sequence
  Description of Artificial Sequence: Synthetic oligonucleotide
cttccgtcatggagtcattgctgcagctg

SEQ ID NO: 128953 - DNA, 30 bp, Artificial Sequence
  Description of Artificial Sequence: Synthetic oligonucleotide
ttccgtcatggagtcattgctgcagctgac

SEQ ID NO: 128954 - DNA, 29 bp, Artificial Sequence
  Description of Artificial Sequence: Synthetic oligonucleotide
tccgtcatggagtcattgctgcagctgac

SEQ ID NO: 128955 - DNA, 28 bp, Artificial Sequence
  Description of Artificial Sequence: Synthetic oligonucleotide
ccgtcatggagtcattgctgcagctgac

SEQ ID NO: 128956 - DNA, 29 bp, Artificial Sequence
  Description of Artificial Sequence: Synthetic oligonucleotide
cgtcatggagtcattgctgcagctgacac

SEQ ID NO: 128957 - DNA, 29 bp, Artificial Sequence
  Description of Artificial Sequence: Synthetic oligonucleotide
gtcatggagtcattgctgcagctgacacg

SEQ ID NO: 128958 - DNA, 29 bp, Artificial Sequence
  Description of Artificial Sequence: Synthetic oligonucleotide
tcatggagtcattgctgcagctgacacgc

SEQ ID NO: 128959 - DNA, 28 bp, Artificial Sequence
  Description of Artificial Sequence: Synthetic oligonucleotide
catggagtcattgctgcagctgacacgc

SEQ ID NO: 128960 - DNA, 28 bp, Artificial Sequence
  Description of Artificial Sequence: Synthetic oligonucleotide
atggagtcattgctgcagctgacacgcg

SEQ ID NO: 128961 - DNA, 27 bp, Artificial Sequence
  Description of Artificial Sequence: Synthetic oligonucleotide
tggagtcattgctgcagctgacacgcg

SEQ ID NO: 128962 - DNA, 27 bp, Artificial Sequence
  Description of Artificial Sequence: Synthetic oligonucleotide
ggagtcattgctgcagctgacacgcgt

SEQ ID NO: 128963 - DNA, 28 bp, Artificial Sequence
  Description of Artificial Sequence: Synthetic oligonucleotide
gagtcattgctgcagctgacacgcgttc

SEQ ID NO: 128964 - DNA, 28 bp, Artificial Sequence
  Description of Artificial Sequence: Synthetic oligonucleotide
agtcattgctgcagctgacacgcgttcc

SEQ ID NO: 128965 - DNA, 27 bp, Artificial Sequence
  Description of Artificial Sequence: Synthetic oligonucleotide
gtcattgctgcagctgacacgcgttcc

SEQ ID NO: 128966 - DNA, 28 bp, Artificial Sequence
  Description of Artificial Sequence: Synthetic oligonucleotide
tcattgctgcagctgacacgcgttcctc

SEQ ID NO: 128967 - DNA, 27 bp, Artificial Sequence
  Description of Artificial Sequence: Synthetic oligonucleotide
cattgctgcagctgacacgcgttcctc

SEQ ID NO: 128968 - DNA, 27 bp, Artificial Sequence
  Description of Artificial Sequence: Synthetic oligonucleotide
attgctgcagctgacacgcgttcctcc

SEQ ID NO: 128969 - DNA, 27 bp, Artificial Sequence
  Description of Artificial Sequence: Synthetic oligonucleotide
ttgctgcagctgacacgcgttcctcct

SEQ ID NO: 128970 - DNA, 26 bp, Artificial Sequence
  Description of Artificial Sequence: Synthetic oligonucleotide
tgctgcagctgacacgcgttcctcct

SEQ ID NO: 128971 - DNA, 25 bp, Artificial Sequence
  Description of Artificial Sequence: Synthetic oligonucleotide
gctgcagctgacacgcgttcctcct

SEQ ID NO: 128972 - DNA, 26 bp, Artificial Sequence
  Description of Artificial Sequence: Synthetic oligonucleotide
ctgcagctgacacgcgttcctcctgt

SEQ ID NO: 128973 - DNA, 26 bp, Artificial Sequence
  Description of Artificial Sequence: Synthetic oligonucleotide
tgcagctgacacgcgttcctcctgtg

SEQ ID NO: 128974 - DNA, 25 bp, Artificial Sequence
  Description of Artificial Sequence: Synthetic oligonucleotide
gcagctgacacgcgttcctcctgtg

SEQ ID NO: 128975 - DNA, 25 bp, Artificial Sequence
  Description of Artificial Sequence: Synthetic oligonucleotide
cagctgacacgcgttcctcctgtgg

SEQ ID NO: 128976 - DNA, 26 bp, Artificial Sequence
  Description of Artificial Sequence: Synthetic oligonucleotide
agctgacacgcgttcctcctgtggca

SEQ ID NO: 128977 - DNA, 25 bp, Artificial Sequence
  Description of Artificial Sequence: Synthetic oligonucleotide
gctgacacgcgttcctcctgtggca

SEQ ID NO: 128978 - DNA, 25 bp, Artificial Sequence
  Description of Artificial Sequence: Synthetic oligonucleotide
ctgacacgcgttcctcctgtggcag

SEQ ID NO: 128979 - DNA, 27 bp, Artificial Sequence
  Description of Artificial Sequence: Synthetic oligonucleotide
tgacacgcgttcctcctgtggcagcta

SEQ ID NO: 128980 - DNA, 27 bp, Artificial Sequence
  Description of Artificial Sequence: Synthetic oligonucleotide
gacacgcgttcctcctgtggcagctat

SEQ ID NO: 128981 - DNA, 27 bp, Artificial Sequence
  Description of Artificial Sequence: Synthetic oligonucleotide
acacgcgttcctcctgtggcagctatg

SEQ ID NO: 128982 - DNA, 27 bp, Artificial Sequence
  Description of Artificial Sequence: Synthetic oligonucleotide
cacgcgttcctcctgtggcagctatgt

SEQ ID NO: 128983 - DNA, 27 bp, Artificial Sequence
  Description of Artificial Sequence: Synthetic oligonucleotide
acgcgttcctcctgtggcagctatgtg

SEQ ID NO: 128984 - DNA, 26 bp, Artificial Sequence
  Description of Artificial Sequence: Synthetic oligonucleotide
cgcgttcctcctgtggcagctatgtg

SEQ ID NO: 128985 - DNA, 26 bp, Artificial Sequence
  Description of Artificial Sequence: Synthetic oligonucleotide
gcgttcctcctgtggcagctatgtgg

SEQ ID NO: 128986 - DNA, 26 bp, Artificial Sequence
  Description of Artificial Sequence: Synthetic oligonucleotide
cgttcctcctgtggcagctatgtggc

SEQ ID NO: 128987 - DNA, 27 bp, Artificial Sequence
  Description of Artificial Sequence: Synthetic oligonucleotide
gttcctcctgtggcagctatgtggcgt

SEQ ID NO: 128988 - DNA, 27 bp, Artificial Sequence
  Description of Artificial Sequence: Synthetic oligonucleotide
ttcctcctgtggcagctatgtggcgtg

SEQ ID NO: 128989 - DNA, 27 bp, Artificial Sequence
  Description of Artificial Sequence: Synthetic oligonucleotide
tcctcctgtggcagctatgtggcgtgt

SEQ ID NO: 128990 - DNA, 26 bp, Artificial Sequence
  Description of Artificial Sequence: Synthetic oligonucleotide
cctcctgtggcagctatgtggcgtgt

SEQ ID NO: 128991 - DNA, 26 bp, Artificial Sequence
  Description of Artificial Sequence: Synthetic oligonucleotide
ctcctgtggcagctatgtggcgtgtc

SEQ ID NO: 128992 - DNA, 27 bp, Artificial Sequence
  Description of Artificial Sequence: Synthetic oligonucleotide
tcctgtggcagctatgtggcgtgtcca

SEQ ID NO: 128993 - DNA, 26 bp, Artificial Sequence
  Description of Artificial Sequence: Synthetic oligonucleotide
cctgtggcagctatgtggcgtgtcca

SEQ ID NO: 128994 - DNA, 26 bp, Artificial Sequence
  Description of Artificial Sequence: Synthetic oligonucleotide
ctgtggcagctatgtggcgtgtccag

SEQ ID NO: 128995 - DNA, 26 bp, Artificial Sequence
  Description of Artificial Sequence: Synthetic oligonucleotide
tgtggcagctatgtggcgtgtccagc

SEQ ID NO: 128996 - DNA, 25 bp, Artificial Sequence
  Description of Artificial Sequence: Synthetic oligonucleotide
gtggcagctatgtggcgtgtccagc

SEQ ID NO: 128997 - DNA, 26 bp, Artificial Sequence
  Description of Artificial Sequence: Synthetic oligonucleotide
tggcagctatgtggcgtgtccagcct

SEQ ID NO: 128998 - DNA, 25 bp, Artificial Sequence
  Description of Artificial Sequence: Synthetic oligonucleotide
ggcagctatgtggcgtgtccagcct

SEQ ID NO: 128999 - DNA, 27 bp, Artificial Sequence
  Description of Artificial Sequence: Synthetic oligonucleotide
gcagctatgtggcgtgtccagcctcat

SEQ ID NO: 129000 - DNA, 27 bp, Artificial Sequence
  Description of Artificial Sequence: Synthetic oligonucleotide
cagctatgtggcgtgtccagcctcatg

SEQ ID NO: 129001 - DNA, 27 bp, Artificial Sequence
  Description of Artificial Sequence: Synthetic oligonucleotide
agctatgtggcgtgtccagcctcatgc

SEQ ID NO: 129002 - DNA, 27 bp, Artificial Sequence
  Description of Artificial Sequence: Synthetic oligonucleotide
gctatgtggcgtgtccagcctcatgca

SEQ ID NO: 129003 - DNA, 28 bp, Artificial Sequence
  Description of Artificial Sequence: Synthetic oligonucleotide
ctatgtggcgtgtccagcctcatgcaag

SEQ ID NO: 129004 - DNA, 28 bp, Artificial Sequence
  Description of Artificial Sequence: Synthetic oligonucleotide
tatgtggcgtgtccagcctcatgcaagg

SEQ ID NO: 129005 - DNA, 27 bp, Artificial Sequence
  Description of Artificial Sequence: Synthetic oligonucleotide
atgtggcgtgtccagcctcatgcaagg

SEQ ID NO: 129006 - DNA, 27 bp, Artificial Sequence
  Description of Artificial Sequence: Synthetic oligonucleotide
tgtggcgtgtccagcctcatgcaaggt

SEQ ID NO: 129007 - DNA, 26 bp, Artificial Sequence
  Description of Artificial Sequence: Synthetic oligonucleotide
gtggcgtgtccagcctcatgcaaggt

SEQ ID NO: 129008 - DNA, 27 bp, Artificial Sequence
  Description of Artificial Sequence: Synthetic oligonucleotide
tggcgtgtccagcctcatgcaaggtca

SEQ ID NO: 129009 - DNA, 27 bp, Artificial Sequence
  Description of Artificial Sequence: Synthetic oligonucleotide
ggcgtgtccagcctcatgcaaggtcat

SEQ ID NO: 129010 - DNA, 27 bp, Artificial Sequence
  Description of Artificial Sequence: Synthetic oligonucleotide
gcgtgtccagcctcatgcaaggtcatc

SEQ ID NO: 129011 - DNA, 27 bp, Artificial Sequence
  Description of Artificial Sequence: Synthetic oligonucleotide
cgtgtccagcctcatgcaaggtcatcc

SEQ ID NO: 129012 - DNA, 27 bp, Artificial Sequence
  Description of Artificial Sequence: Synthetic oligonucleotide
gtgtccagcctcatgcaaggtcatccc

SEQ ID NO: 129013 - DNA, 28 bp, Artificial Sequence
  Description of Artificial Sequence: Synthetic oligonucleotide
tgtccagcctcatgcaaggtcatccctg

SEQ ID NO: 129014 - DNA, 27 bp, Artificial Sequence
  Description of Artificial Sequence: Synthetic oligonucleotide
gtccagcctcatgcaaggtcatccctg

SEQ ID NO: 129015 - DNA, 28 bp, Artificial Sequence
  Description of Artificial Sequence: Synthetic oligonucleotide
tccagcctcatgcaaggtcatccctgtg

SEQ ID NO: 129016 - DNA, 27 bp, Artificial Sequence
  Description of Artificial Sequence: Synthetic oligonucleotide
ccagcctcatgcaaggtcatccctgtg

SEQ ID NO: 129017 - DNA, 27 bp, Artificial Sequence
  Description of Artificial Sequence: Synthetic oligonucleotide
cagcctcatgcaaggtcatccctgtgc

SEQ ID NO: 129018 - DNA, 28 bp, Artificial Sequence
  Description of Artificial Sequence: Synthetic oligonucleotide
agcctcatgcaaggtcatccctgtgcac

SEQ ID NO: 129019 - DNA, 27 bp, Artificial Sequence
  Description of Artificial Sequence: Synthetic oligonucleotide
gcctcatgcaaggtcatccctgtgcac

SEQ ID NO: 129020 - DNA, 27 bp, Artificial Sequence
  Description of Artificial Sequence: Synthetic oligonucleotide
cctcatgcaaggtcatccctgtgcacc

SEQ ID NO: 129021 - DNA, 28 bp, Artificial Sequence
  Description of Artificial Sequence: Synthetic oligonucleotide
ctcatgcaaggtcatccctgtgcaccag

SEQ ID NO: 129022 - DNA, 28 bp, Artificial Sequence
  Description of Artificial Sequence: Synthetic oligonucleotide
tcatgcaaggtcatccctgtgcaccagc

SEQ ID NO: 129023 - DNA, 27 bp, Artificial Sequence
  Description of Artificial Sequence: Synthetic oligonucleotide
catgcaaggtcatccctgtgcaccagc

SEQ ID NO: 129024 - DNA, 28 bp, Artificial Sequence
  Description of Artificial Sequence: Synthetic oligonucleotide
atgcaaggtcatccctgtgcaccagcac

SEQ ID NO: 129025 - DNA, 27 bp, Artificial Sequence
  Description of Artificial Sequence: Synthetic oligonucleotide
tgcaaggtcatccctgtgcaccagcac

SEQ ID NO: 129026 - DNA, 26 bp, Artificial Sequence
  Description of Artificial Sequence: Synthetic oligonucleotide
gcaaggtcatccctgtgcaccagcac

SEQ ID NO: 129027 - DNA, 27 bp, Artificial Sequence
  Description of Artificial Sequence: Synthetic oligonucleotide
caaggtcatccctgtgcaccagcacct

SEQ ID NO: 129028 - DNA, 27 bp, Artificial Sequence
  Description of Artificial Sequence: Synthetic oligonucleotide
aaggtcatccctgtgcaccagcacctc

SEQ ID NO: 129029 - DNA, 26 bp, Artificial Sequence
  Description of Artificial Sequence: Synthetic oligonucleotide
aggtcatccctgtgcaccagcacctc

SEQ ID NO: 129030 - DNA, 25 bp, Artificial Sequence
  Description of Artificial Sequence: Synthetic oligonucleotide
ggtcatccctgtgcaccagcacctc

SEQ ID NO: 129031 - DNA, 26 bp, Artificial Sequence
  Description of Artificial Sequence: Synthetic oligonucleotide
gtcatccctgtgcaccagcacctcct

SEQ ID NO: 129032 - DNA, 26 bp, Artificial Sequence
  Description of Artificial Sequence: Synthetic oligonucleotide
tcatccctgtgcaccagcacctcctg

SEQ ID NO: 129033 - DNA, 25 bp, Artificial Sequence
  Description of Artificial Sequence: Synthetic oligonucleotide
catccctgtgcaccagcacctcctg

SEQ ID NO: 129034 - DNA, 25 bp, Artificial Sequence
  Description of Artificial Sequence: Synthetic oligonucleotide
atccctgtgcaccagcacctcctgg

SEQ ID NO: 129035 - DNA, 24 bp, Artificial Sequence
  Description of Artificial Sequence: Synthetic oligonucleotide
tccctgtgcaccagcacctcctgg

SEQ ID NO: 129036 - DNA, 23 bp, Artificial Sequence
  Description of Artificial Sequence: Synthetic oligonucleotide
ccctgtgcaccagcacctcctgg

SEQ ID NO: 129037 - DNA, 25 bp, Artificial Sequence
  Description of Artificial Sequence: Synthetic oligonucleotide
cctgtgcaccagcacctcctgggta

SEQ ID NO: 129038 - DNA, 25 bp, Artificial Sequence
  Description of Artificial Sequence: Synthetic oligonucleotide
ctgtgcaccagcacctcctgggtac

SEQ ID NO: 129039 - DNA, 26 bp, Artificial Sequence
  Description of Artificial Sequence: Synthetic oligonucleotide
tgtgcaccagcacctcctgggtacca

SEQ ID NO: 129040 - DNA, 25 bp, Artificial Sequence
  Description of Artificial Sequence: Synthetic oligonucleotide
gtgcaccagcacctcctgggtacca

SEQ ID NO: 129041 - DNA, 25 bp, Artificial Sequence
  Description of Artificial Sequence: Synthetic oligonucleotide
tgcaccagcacctcctgggtaccac

SEQ ID NO: 129042 - DNA, 24 bp, Artificial Sequence
  Description of Artificial Sequence: Synthetic oligonucleotide
gcaccagcacctcctgggtaccac

SEQ ID NO: 129043 - DNA, 25 bp, Artificial Sequence
  Description of Artificial Sequence: Synthetic oligonucleotide
caccagcacctcctgggtaccacct

SEQ ID NO: 129044 - DNA, 26 bp, Artificial Sequence
  Description of Artificial Sequence: Synthetic oligonucleotide
accagcacctcctgggtaccacctct

SEQ ID NO: 129045 - DNA, 25 bp, Artificial Sequence
  Description of Artificial Sequence: Synthetic oligonucleotide
ccagcacctcctgggtaccacctct

SEQ ID NO: 129046 - DNA, 25 bp, Artificial Sequence
  Description of Artificial Sequence: Synthetic oligonucleotide
cagcacctcctgggtaccacctctg

SEQ ID NO: 129047 - DNA, 25 bp, Artificial Sequence
  Description of Artificial Sequence: Synthetic oligonucleotide
agcacctcctgggtaccacctctgg

SEQ ID NO: 129048 - DNA, 24 bp, Artificial Sequence
  Description of Artificial Sequence: Synthetic oligonucleotide
gcacctcctgggtaccacctctgg

SEQ ID NO: 129049 - DNA, 25 bp, Artificial Sequence
  Description of Artificial Sequence: Synthetic oligonucleotide
cacctcctgggtaccacctctggca

SEQ ID NO: 129050 - DNA, 25 bp, Artificial Sequence
  Description of Artificial Sequence: Synthetic oligonucleotide
acctcctgggtaccacctctggcac

SEQ ID NO: 129051 - DNA, 24 bp, Artificial Sequence
  Description of Artificial Sequence: Synthetic oligonucleotide
cctcctgggtaccacctctggcac

SEQ ID NO: 129052 - DNA, 25 bp, Artificial Sequence
  Description of Artificial Sequence: Synthetic oligonucleotide
ctcctgggtaccacctctggcacct

SEQ ID NO: 129053 - DNA, 26 bp, Artificial Sequence
  Description of Artificial Sequence: Synthetic oligonucleotide
tcctgggtaccacctctggcacctct

SEQ ID NO: 129054 - DNA, 25 bp, Artificial Sequence
  Description of Artificial Sequence: Synthetic oligonucleotide
cctgggtaccacctctggcacctct

SEQ ID NO: 129055 - DNA, 25 bp, Artificial Sequence
  Description of Artificial Sequence: Synthetic oligonucleotide
ctgggtaccacctctggcacctctg

SEQ ID NO: 129056 - DNA, 25 bp, Artificial Sequence
  Description of Artificial Sequence: Synthetic oligonucleotide
tgggtaccacctctggcacctctgc

SEQ ID NO: 129057 - DNA, 24 bp, Artificial Sequence
  Description of Artificial Sequence: Synthetic oligonucleotide
gggtaccacctctggcacctctgc

SEQ ID NO: 129058 - DNA, 24 bp, Artificial Sequence
  Description of Artificial Sequence: Synthetic oligonucleotide
ggtaccacctctggcacctctgcc

SEQ ID NO: 129059 - DNA, 25 bp, Artificial Sequence
  Description of Artificial Sequence: Synthetic oligonucleotide
gtaccacctctggcacctctgccga

SEQ ID NO: 129060 - DNA, 26 bp, Artificial Sequence
  Description of Artificial Sequence: Synthetic oligonucleotide
taccacctctggcacctctgccgact

SEQ ID NO: 129061 - DNA, 25 bp, Artificial Sequence
  Description of Artificial Sequence: Synthetic oligonucleotide
accacctctggcacctctgccgact

SEQ ID NO: 129062 - DNA, 24 bp, Artificial Sequence
  Description of Artificial Sequence: Synthetic oligonucleotide
ccacctctggcacctctgccgact

SEQ ID NO: 129063 - DNA, 25 bp, Artificial Sequence
  Description of Artificial Sequence: Synthetic oligonucleotide
cacctctggcacctctgccgactgt

SEQ ID NO: 129064 - DNA, 25 bp, Artificial Sequence
  Description of Artificial Sequence: Synthetic oligonucleotide
acctctggcacctctgccgactgtg

SEQ ID NO: 129065 - DNA, 24 bp, Artificial Sequence
  Description of Artificial Sequence: Synthetic oligonucleotide
cctctggcacctctgccgactgtg

SEQ ID NO: 129066 - DNA, 26 bp, Artificial Sequence
  Description of Artificial Sequence: Synthetic oligonucleotide
ctctggcacctctgccgactgtgcta

SEQ ID NO: 129067 - DNA, 26 bp, Artificial Sequence
  Description of Artificial Sequence: Synthetic oligonucleotide
tctggcacctctgccgactgtgctac

SEQ ID NO: 129068 - DNA, 25 bp, Artificial Sequence
  Description of Artificial Sequence: Synthetic oligonucleotide
ctggcacctctgccgactgtgctac

SEQ ID NO: 129069 - DNA, 26 bp, Artificial Sequence
  Description of Artificial Sequence: Synthetic oligonucleotide
tggcacctctgccgactgtgctacct

SEQ ID NO: 129070 - DNA, 25 bp, Artificial Sequence
  Description of Artificial Sequence: Synthetic oligonucleotide
ggcacctctgccgactgtgctacct

SEQ ID NO: 129071 - DNA, 25 bp, Artificial Sequence
  Description of Artificial Sequence: Synthetic oligonucleotide
gcacctctgccgactgtgctacctg

SEQ ID NO: 129072 - DNA, 27 bp, Artificial Sequence
  Description of Artificial Sequence: Synthetic oligonucleotide
cacctctgccgactgtgctacctggta

SEQ ID NO: 129073 - DNA, 28 bp, Artificial Sequence
  Description of Artificial Sequence: Synthetic oligonucleotide
acctctgccgactgtgctacctggtatc

SEQ ID NO: 129074 - DNA, 27 bp, Artificial Sequence
  Description of Artificial Sequence: Synthetic oligonucleotide
cctctgccgactgtgctacctggtatc

SEQ ID NO: 129075 - DNA, 27 bp, Artificial Sequence
  Description of Artificial Sequence: Synthetic oligonucleotide
ctctgccgactgtgctacctggtatcg

SEQ ID NO: 129076 - DNA, 27 bp, Artificial Sequence
  Description of Artificial Sequence: Synthetic oligonucleotide
tctgccgactgtgctacctggtatcgg

SEQ ID NO: 129077 - DNA, 26 bp, Artificial Sequence
  Description of Artificial Sequence: Synthetic oligonucleotide
ctgccgactgtgctacctggtatcgg

SEQ ID NO: 129078 - DNA, 27 bp, Artificial Sequence
  Description of Artificial Sequence: Synthetic oligonucleotide
tgccgactgtgctacctggtatcgggt

SEQ ID NO: 129079 - DNA, 27 bp, Artificial Sequence
  Description of Artificial Sequence: Synthetic oligonucleotide
gccgactgtgctacctggtatcgggta

SEQ ID NO: 129080 - DNA, 30 bp, Artificial Sequence
  Description of Artificial Sequence: Synthetic oligonucleotide
ccgactgtgctacctggtatcgggtattac

SEQ ID NO: 129081 - DNA, 31 bp, Artificial Sequence
  Description of Artificial Sequence: Synthetic oligonucleotide
cgactgtgctacctggtatcgggtattacag

SEQ ID NO: 129082 - DNA, 31 bp, Artificial Sequence
  Description of Artificial Sequence: Synthetic oligonucleotide
gactgtgctacctggtatcgggtattacagc

SEQ ID NO: 129083 - DNA, 31 bp, Artificial Sequence
  Description of Artificial Sequence: Synthetic oligonucleotide
actgtgctacctggtatcgggtattacagcg

SEQ ID NO: 129084 - DNA, 30 bp, Artificial Sequence
  Description of Artificial Sequence: Synthetic oligonucleotide
ctgtgctacctggtatcgggtattacagcg

SEQ ID NO: 129085 - DNA, 30 bp, Artificial Sequence
  Description of Artificial Sequence: Synthetic oligonucleotide
tgtgctacctggtatcgggtattacagcgg

SEQ ID NO: 129086 - DNA, 29 bp, Artificial Sequence
  Description of Artificial Sequence: Synthetic oligonucleotide
gtgctacctggtatcgggtattacagcgg

SEQ ID NO: 129087 - DNA, 29 bp, Artificial Sequence
  Description of Artificial Sequence: Synthetic oligonucleotide
tgctacctggtatcgggtattacagcggg

SEQ ID NO: 129088 - DNA, 28 bp, Artificial Sequence
  Description of Artificial Sequence: Synthetic oligonucleotide
gctacctggtatcgggtattacagcggg

SEQ ID NO: 129089 - DNA, 29 bp, Artificial Sequence
  Description of Artificial Sequence: Synthetic oligonucleotide
ctacctggtatcgggtattacagcgggag

SEQ ID NO: 129090 - DNA, 29 bp, Artificial Sequence
  Description of Artificial Sequence: Synthetic oligonucleotide
tacctggtatcgggtattacagcgggagc

SEQ ID NO: 129091 - DNA, 28 bp, Artificial Sequence
  Description of Artificial Sequence: Synthetic oligonucleotide
acctggtatcgggtattacagcgggagc

SEQ ID NO: 129092 - DNA, 27 bp, Artificial Sequence
  Description of Artificial Sequence: Synthetic oligonucleotide
cctggtatcgggtattacagcgggagc

SEQ ID NO: 129093 - DNA, 28 bp, Artificial Sequence
  Description of Artificial Sequence: Synthetic oligonucleotide
ctggtatcgggtattacagcgggagctg

SEQ ID NO: 129094 - DNA, 28 bp, Artificial Sequence
  Description of Artificial Sequence: Synthetic oligonucleotide
tggtatcgggtattacagcgggagctgc

SEQ ID NO: 129095 - DNA, 27 bp, Artificial Sequence
  Description of Artificial Sequence: Synthetic oligonucleotide
ggtatcgggtattacagcgggagctgc

SEQ ID NO: 129096 - DNA, 27 bp, Artificial Sequence
  Description of Artificial Sequence: Synthetic oligonucleotide
gtatcgggtattacagcgggagctgcg

SEQ ID NO: 129097 - DNA, 27 bp, Artificial Sequence
  Description of Artificial Sequence: Synthetic oligonucleotide
tatcgggtattacagcgggagctgcgg

SEQ ID NO: 129098 - DNA, 26 bp, Artificial Sequence
  Description of Artificial Sequence: Synthetic oligonucleotide
atcgggtattacagcgggagctgcgg

SEQ ID NO: 129099 - DNA, 25 bp, Artificial Sequence
  Description of Artificial Sequence: Synthetic oligonucleotide
tcgggtattacagcgggagctgcgg

SEQ ID NO: 129100 - DNA, 24 bp, Artificial Sequence
  Description of Artificial Sequence: Synthetic oligonucleotide
cgggtattacagcgggagctgcgg

SEQ ID NO: 129101 - DNA, 26 bp, Artificial Sequence
  Description of Artificial Sequence: Synthetic oligonucleotide
gggtattacagcgggagctgcggctt

SEQ ID NO: 129102 - DNA, 26 bp, Artificial Sequence
  Description of Artificial Sequence: Synthetic oligonucleotide
ggtattacagcgggagctgcggcttc

SEQ ID NO: 129103 - DNA, 26 bp, Artificial Sequence
  Description of Artificial Sequence: Synthetic oligonucleotide
gtattacagcgggagctgcggcttcg

SEQ ID NO: 129104 - DNA, 26 bp, Artificial Sequence
  Description of Artificial Sequence: Synthetic oligonucleotide
tattacagcgggagctgcggcttcgg

SEQ ID NO: 129105 - DNA, 25 bp, Artificial Sequence
  Description of Artificial Sequence: Synthetic oligonucleotide
attacagcgggagctgcggcttcgg

SEQ ID NO: 129106 - DNA, 24 bp, Artificial Sequence
  Description of Artificial Sequence: Synthetic oligonucleotide
ttacagcgggagctgcggcttcgg

SEQ ID NO: 129107 - DNA, 23 bp, Artificial Sequence
  Description of Artificial Sequence: Synthetic oligonucleotide
tacagcgggagctgcggcttcgg

SEQ ID NO: 129108 - DNA, 22 bp, Artificial Sequence
  Description of Artificial Sequence: Synthetic oligonucleotide
acagcgggagctgcggcttcgg

SEQ ID NO: 129109 - DNA, 21 bp, Artificial Sequence
  Description of Artificial Sequence: Synthetic oligonucleotide
cagcgggagctgcggcttcgg

SEQ ID NO: 129110 - DNA, 23 bp, Artificial Sequence
  Description of Artificial Sequence: Synthetic oligonucleotide
agcgggagctgcggcttcgggaa

SEQ ID NO: 129111 - DNA, 22 bp, Artificial Sequence
  Description of Artificial Sequence: Synthetic oligonucleotide
gcgggagctgcggcttcgggaa

SEQ ID NO: 129112 - DNA, 23 bp, Artificial Sequence
  Description of Artificial Sequence: Synthetic oligonucleotide
cgggagctgcggcttcgggaact

SEQ ID NO: 129113 - DNA, 24 bp, Artificial Sequence
  Description of Artificial Sequence: Synthetic oligonucleotide
gggagctgcggcttcgggaactga

SEQ ID NO: 129114 - DNA, 24 bp, Artificial Sequence
  Description of Artificial Sequence: Synthetic oligonucleotide
ggagctgcggcttcgggaactgag

SEQ ID NO: 129115 - DNA, 24 bp, Artificial Sequence
  Description of Artificial Sequence: Synthetic oligonucleotide
gagctgcggcttcgggaactgagg

SEQ ID NO: 129116 - DNA, 25 bp, Artificial Sequence
  Description of Artificial Sequence: Synthetic oligonucleotide
agctgcggcttcgggaactgaggga

SEQ ID NO: 129117 - DNA, 24 bp, Artificial Sequence
  Description of Artificial Sequence: Synthetic oligonucleotide
gctgcggcttcgggaactgaggga

SEQ ID NO: 129118 - DNA, 24 bp, Artificial Sequence
  Description of Artificial Sequence: Synthetic oligonucleotide
ctgcggcttcgggaactgagggag

SEQ ID NO: 129119 - DNA, 24 bp, Artificial Sequence
  Description of Artificial Sequence: Synthetic oligonucleotide
tgcggcttcgggaactgagggagg

SEQ ID NO: 129120 - DNA, 23 bp, Artificial Sequence
  Description of Artificial Sequence: Synthetic oligonucleotide
gcggcttcgggaactgagggagg

SEQ ID NO: 129121 - DNA, 24 bp, Artificial Sequence
  Description of Artificial Sequence: Synthetic oligonucleotide
cggcttcgggaactgagggagggt

SEQ ID NO: 129122 - DNA, 25 bp, Artificial Sequence
  Description of Artificial Sequence: Synthetic oligonucleotide
ggcttcgggaactgagggagggtca

SEQ ID NO: 129123 - DNA, 25 bp, Artificial Sequence
  Description of Artificial Sequence: Synthetic oligonucleotide
gcttcgggaactgagggagggtcag

SEQ ID NO: 129124 - DNA, 26 bp, Artificial Sequence
  Description of Artificial Sequence: Synthetic oligonucleotide
cttcgggaactgagggagggtcagct

SEQ ID NO: 129125 - DNA, 26 bp, Artificial Sequence
  Description of Artificial Sequence: Synthetic oligonucleotide
ttcgggaactgagggagggtcagctg

SEQ ID NO: 129126 - DNA, 25 bp, Artificial Sequence
  Description of Artificial Sequence: Synthetic oligonucleotide
tcgggaactgagggagggtcagctg

SEQ ID NO: 129127 - DNA, 24 bp, Artificial Sequence
  Description of Artificial Sequence: Synthetic oligonucleotide
cgggaactgagggagggtcagctg

SEQ ID NO: 129128 - DNA, 24 bp, Artificial Sequence
  Description of Artificial Sequence: Synthetic oligonucleotide
gggaactgagggagggtcagctgc

SEQ ID NO: 129129 - DNA, 24 bp, Artificial Sequence
  Description of Artificial Sequence: Synthetic oligonucleotide
ggaactgagggagggtcagctgcc

SEQ ID NO: 129130 - DNA, 25 bp, Artificial Sequence
  Description of Artificial Sequence: Synthetic oligonucleotide
gaactgagggagggtcagctgccca

SEQ ID NO: 129131 - DNA, 26 bp, Artificial Sequence
  Description of Artificial Sequence: Synthetic oligonucleotide
aactgagggagggtcagctgcccagt

SEQ ID NO: 129132 - DNA, 25 bp, Artificial Sequence
  Description of Artificial Sequence: Synthetic oligonucleotide
actgagggagggtcagctgcccagt

SEQ ID NO: 129133 - DNA, 24 bp, Artificial Sequence
  Description of Artificial Sequence: Synthetic oligonucleotide
ctgagggagggtcagctgcccagt

SEQ ID NO: 129134 - DNA, 25 bp, Artificial Sequence
  Description of Artificial Sequence: Synthetic oligonucleotide
tgagggagggtcagctgcccagtgt

SEQ ID NO: 129135 - DNA, 24 bp, Artificial Sequence
  Description of Artificial Sequence: Synthetic oligonucleotide
gagggagggtcagctgcccagtgt

SEQ ID NO: 129136 - DNA, 24 bp, Artificial Sequence
  Description of Artificial Sequence: Synthetic oligonucleotide
agggagggtcagctgcccagtgtg

SEQ ID NO: 129137 - DNA, 23 bp, Artificial Sequence
  Description of Artificial Sequence: Synthetic oligonucleotide
gggagggtcagctgcccagtgtg

SEQ ID NO: 129138 - DNA, 23 bp, Artificial Sequence
  Description of Artificial Sequence: Synthetic oligonucleotide
ggagggtcagctgcccagtgtgg

SEQ ID NO: 129139 - DNA, 23 bp, Artificial Sequence
  Description of Artificial Sequence: Synthetic oligonucleotide
gagggtcagctgcccagtgtggc

SEQ ID NO: 129140 - DNA, 24 bp, Artificial Sequence
  Description of Artificial Sequence: Synthetic oligonucleotide
agggtcagctgcccagtgtggcca

SEQ ID NO: 129141 - DNA, 23 bp, Artificial Sequence
  Description of Artificial Sequence: Synthetic oligonucleotide
gggtcagctgcccagtgtggcca

SEQ ID NO: 129142 - DNA, 24 bp, Artificial Sequence
  Description of Artificial Sequence: Synthetic oligonucleotide
ggtcagctgcccagtgtggccagt

SEQ ID NO: 129143 - DNA, 24 bp, Artificial Sequence
  Description of Artificial Sequence: Synthetic oligonucleotide
gtcagctgcccagtgtggccagtg

SEQ ID NO: 129144 - DNA, 25 bp, Artificial Sequence
  Description of Artificial Sequence: Synthetic oligonucleotide
tcagctgcccagtgtggccagtgct

SEQ ID NO: 129145 - DNA, 24 bp, Artificial Sequence
  Description of Artificial Sequence: Synthetic oligonucleotide
cagctgcccagtgtggccagtgct

SEQ ID NO: 129146 - DNA, 24 bp, Artificial Sequence
  Description of Artificial Sequence: Synthetic oligonucleotide
agctgcccagtgtggccagtgctg

SEQ ID NO: 129147 - DNA, 23 bp, Artificial Sequence
  Description of Artificial Sequence: Synthetic oligonucleotide
gctgcccagtgtggccagtgctg

SEQ ID NO: 129148 - DNA, 23 bp, Artificial Sequence
  Description of Artificial Sequence: Synthetic oligonucleotide
ctgcccagtgtggccagtgctgc

SEQ ID NO: 129149 - DNA, 25 bp, Artificial Sequence
  Description of Artificial Sequence: Synthetic oligonucleotide
tgcccagtgtggccagtgctgccaa

SEQ ID NO: 129150 - DNA, 24 bp, Artificial Sequence
  Description of Artificial Sequence: Synthetic oligonucleotide
gcccagtgtggccagtgctgccaa

SEQ ID NO: 129151 - DNA, 24 bp, Artificial Sequence
  Description of Artificial Sequence: Synthetic oligonucleotide
cccagtgtggccagtgctgccaag

SEQ ID NO: 129152 - DNA, 25 bp, Artificial Sequence
  Description of Artificial Sequence: Synthetic oligonucleotide
ccagtgtggccagtgctgccaagct

SEQ ID NO: 129153 - DNA, 27 bp, Artificial Sequence
  Description of Artificial Sequence: Synthetic oligonucleotide
cagtgtggccagtgctgccaagctctt

SEQ ID NO: 129154 - DNA, 27 bp, Artificial Sequence
  Description of Artificial Sequence: Synthetic oligonucleotide
agtgtggccagtgctgccaagctcttg

SEQ ID NO: 129155 - DNA, 27 bp, Artificial Sequence
  Description of Artificial Sequence: Synthetic oligonucleotide
gtgtggccagtgctgccaagctcttgt

SEQ ID NO: 129156 - DNA, 27 bp, Artificial Sequence
  Description of Artificial Sequence: Synthetic oligonucleotide
tgtggccagtgctgccaagctcttgtc

SEQ ID NO: 129157 - DNA, 27 bp, Artificial Sequence
  Description of Artificial Sequence: Synthetic oligonucleotide
gtggccagtgctgccaagctcttgtca

SEQ ID NO: 129158 - DNA, 27 bp, Artificial Sequence
  Description of Artificial Sequence: Synthetic oligonucleotide
tggccagtgctgccaagctcttgtcag

SEQ ID NO: 129159 - DNA, 26 bp, Artificial Sequence
  Description of Artificial Sequence: Synthetic oligonucleotide
ggccagtgctgccaagctcttgtcag

SEQ ID NO: 129160 - DNA, 26 bp, Artificial Sequence
  Description of Artificial Sequence: Synthetic oligonucleotide
gccagtgctgccaagctcttgtcagc

SEQ ID NO: 129161 - DNA, 27 bp, Artificial Sequence
  Description of Artificial Sequence: Synthetic oligonucleotide
ccagtgctgccaagctcttgtcagcca

SEQ ID NO: 129162 - DNA, 28 bp, Artificial Sequence
  Description of Artificial Sequence: Synthetic oligonucleotide
cagtgctgccaagctcttgtcagccatg

SEQ ID NO: 129163 - DNA, 30 bp, Artificial Sequence
  Description of Artificial Sequence: Synthetic oligonucleotide
agtgctgccaagctcttgtcagccatgatg

SEQ ID NO: 129164 - DNA, 29 bp, Artificial Sequence
  Description of Artificial Sequence: Synthetic oligonucleotide
gtgctgccaagctcttgtcagccatgatg

SEQ ID NO: 129165 - DNA, 30 bp, Artificial Sequence
  Description of Artificial Sequence: Synthetic oligonucleotide
tgctgccaagctcttgtcagccatgatgtc

SEQ ID NO: 129166 - DNA, 29 bp, Artificial Sequence
  Description of Artificial Sequence: Synthetic oligonucleotide
gctgccaagctcttgtcagccatgatgtc

SEQ ID NO: 129167 - DNA, 30 bp, Artificial Sequence
  Description of Artificial Sequence: Synthetic oligonucleotide
ctgccaagctcttgtcagccatgatgtctc

SEQ ID NO: 129168 - DNA, 34 bp, Artificial Sequence
  Description of Artificial Sequence: Synthetic oligonucleotide
tgccaagctcttgtcagccatgatgtctcaatac

SEQ ID NO: 129169 - DNA, 33 bp, Artificial Sequence
  Description of Artificial Sequence: Synthetic oligonucleotide
gccaagctcttgtcagccatgatgtctcaatac

SEQ ID NO: 129170 - DNA, 33 bp, Artificial Sequence
  Description of Artificial Sequence: Synthetic oligonucleotide
ccaagctcttgtcagccatgatgtctcaatacc

SEQ ID NO: 129171 - DNA, 33 bp, Artificial Sequence
  Description of Artificial Sequence: Synthetic oligonucleotide
caagctcttgtcagccatgatgtctcaataccg

SEQ ID NO: 129172 - DNA, 33 bp, Artificial Sequence
  Description of Artificial Sequence: Synthetic oligonucleotide
aagctcttgtcagccatgatgtctcaataccgg

SEQ ID NO: 129173 - DNA, 32 bp, Artificial Sequence
  Description of Artificial Sequence: Synthetic oligonucleotide
agctcttgtcagccatgatgtctcaataccgg

SEQ ID NO: 129174 - DNA, 31 bp, Artificial Sequence
  Description of Artificial Sequence: Synthetic oligonucleotide
gctcttgtcagccatgatgtctcaataccgg

SEQ ID NO: 129175 - DNA, 31 bp, Artificial Sequence
  Description of Artificial Sequence: Synthetic oligonucleotide
ctcttgtcagccatgatgtctcaataccggg

SEQ ID NO: 129176 - DNA, 31 bp, Artificial Sequence
  Description of Artificial Sequence: Synthetic oligonucleotide
tcttgtcagccatgatgtctcaataccgggg

SEQ ID NO: 129177 - DNA, 30 bp, Artificial Sequence
  Description of Artificial Sequence: Synthetic oligonucleotide
cttgtcagccatgatgtctcaataccgggg

SEQ ID NO: 129178 - DNA, 31 bp, Artificial Sequence
  Description of Artificial Sequence: Synthetic oligonucleotide
ttgtcagccatgatgtctcaataccggggac

SEQ ID NO: 129179 - DNA, 30 bp, Artificial Sequence
  Description of Artificial Sequence: Synthetic oligonucleotide
tgtcagccatgatgtctcaataccggggac

SEQ ID NO: 129180 - DNA, 29 bp, Artificial Sequence
  Description of Artificial Sequence: Synthetic oligonucleotide
gtcagccatgatgtctcaataccggggac

SEQ ID NO: 129181 - DNA, 30 bp, Artificial Sequence
  Description of Artificial Sequence: Synthetic oligonucleotide
tcagccatgatgtctcaataccggggactg

SEQ ID NO: 129182 - DNA, 29 bp, Artificial Sequence
  Description of Artificial Sequence: Synthetic oligonucleotide
cagccatgatgtctcaataccggggactg

SEQ ID NO: 129183 - DNA, 29 bp, Artificial Sequence
  Description of Artificial Sequence: Synthetic oligonucleotide
agccatgatgtctcaataccggggactgg

SEQ ID NO: 129184 - DNA, 28 bp, Artificial Sequence
  Description of Artificial Sequence: Synthetic oligonucleotide
gccatgatgtctcaataccggggactgg

SEQ ID NO: 129185 - DNA, 30 bp, Artificial Sequence
  Description of Artificial Sequence: Synthetic oligonucleotide
ccatgatgtctcaataccggggactggatc

SEQ ID NO: 129186 - DNA, 31 bp, Artificial Sequence
  Description of Artificial Sequence: Synthetic oligonucleotide
catgatgtctcaataccggggactggatctc

SEQ ID NO: 129187 - DNA, 32 bp, Artificial Sequence
  Description of Artificial Sequence: Synthetic oligonucleotide
atgatgtctcaataccggggactggatctctg

SEQ ID NO: 129188 - DNA, 31 bp, Artificial Sequence
  Description of Artificial Sequence: Synthetic oligonucleotide
tgatgtctcaataccggggactggatctctg

SEQ ID NO: 129189 - DNA, 30 bp, Artificial Sequence
  Description of Artificial Sequence: Synthetic oligonucleotide
gatgtctcaataccggggactggatctctg

SEQ ID NO: 129190 - DNA, 31 bp, Artificial Sequence
  Description of Artificial Sequence: Synthetic oligonucleotide
atgtctcaataccggggactggatctctgtg

SEQ ID NO: 129191 - DNA, 30 bp, Artificial Sequence
  Description of Artificial Sequence: Synthetic oligonucleotide
tgtctcaataccggggactggatctctgtg

SEQ ID NO: 129192 - DNA, 29 bp, Artificial Sequence
  Description of Artificial Sequence: Synthetic oligonucleotide
gtctcaataccggggactggatctctgtg

SEQ ID NO: 129193 - DNA, 30 bp, Artificial Sequence
  Description of Artificial Sequence: Synthetic oligonucleotide
tctcaataccggggactggatctctgtgtg

SEQ ID NO: 129194 - DNA, 29 bp, Artificial Sequence
  Description of Artificial Sequence: Synthetic oligonucleotide
ctcaataccggggactggatctctgtgtg

SEQ ID NO: 129195 - DNA, 29 bp, Artificial Sequence
  Description of Artificial Sequence: Synthetic oligonucleotide
tcaataccggggactggatctctgtgtgg

SEQ ID NO: 129196 - DNA, 28 bp, Artificial Sequence
  Description of Artificial Sequence: Synthetic oligonucleotide
caataccggggactggatctctgtgtgg

SEQ ID NO: 129197 - DNA, 28 bp, Artificial Sequence
  Description of Artificial Sequence: Synthetic oligonucleotide
aataccggggactggatctctgtgtggc

SEQ ID NO: 129198 - DNA, 27 bp, Artificial Sequence
  Description of Artificial Sequence: Synthetic oligonucleotide
ataccggggactggatctctgtgtggc

SEQ ID NO: 129199 - DNA, 26 bp, Artificial Sequence
  Description of Artificial Sequence: Synthetic oligonucleotide
taccggggactggatctctgtgtggc

SEQ ID NO: 129200 - DNA, 25 bp, Artificial Sequence
  Description of Artificial Sequence: Synthetic oligonucleotide
accggggactggatctctgtgtggc

SEQ ID NO: 129201 - DNA, 24 bp, Artificial Sequence
  Description of Artificial Sequence: Synthetic oligonucleotide
ccggggactggatctctgtgtggc

SEQ ID NO: 129202 - DNA, 25 bp, Artificial Sequence
  Description of Artificial Sequence: Synthetic oligonucleotide
cggggactggatctctgtgtggcca

SEQ ID NO: 129203 - DNA, 26 bp, Artificial Sequence
  Description of Artificial Sequence: Synthetic oligonucleotide
ggggactggatctctgtgtggccact

SEQ ID NO: 129204 - DNA, 26 bp, Artificial Sequence
  Description of Artificial Sequence: Synthetic oligonucleotide
gggactggatctctgtgtggccactg

SEQ ID NO: 129205 - DNA, 26 bp, Artificial Sequence
  Description of Artificial Sequence: Synthetic oligonucleotide
ggactggatctctgtgtggccactgc

SEQ ID NO: 129206 - DNA, 26 bp, Artificial Sequence
  Description of Artificial Sequence: Synthetic oligonucleotide
gactggatctctgtgtggccactgcc

SEQ ID NO: 129207 - DNA, 27 bp, Artificial Sequence
  Description of Artificial Sequence: Synthetic oligonucleotide
actggatctctgtgtggccactgccct

SEQ ID NO: 129208 - DNA, 26 bp, Artificial Sequence
  Description of Artificial Sequence: Synthetic oligonucleotide
ctggatctctgtgtggccactgccct

SEQ ID NO: 129209 - DNA, 27 bp, Artificial Sequence
  Description of Artificial Sequence: Synthetic oligonucleotide
tggatctctgtgtggccactgccctct

SEQ ID NO: 129210 - DNA, 26 bp, Artificial Sequence
  Description of Artificial Sequence: Synthetic oligonucleotide
ggatctctgtgtggccactgccctct

SEQ ID NO: 129211 - DNA, 26 bp, Artificial Sequence
  Description of Artificial Sequence: Synthetic oligonucleotide
gatctctgtgtggccactgccctctg

SEQ ID NO: 129212 - DNA, 26 bp, Artificial Sequence
  Description of Artificial Sequence: Synthetic oligonucleotide
atctctgtgtggccactgccctctgc

SEQ ID NO: 129213 - DNA, 25 bp, Artificial Sequence
  Description of Artificial Sequence: Synthetic oligonucleotide
tctctgtgtggccactgccctctgc

SEQ ID NO: 129214 - DNA, 24 bp, Artificial Sequence
  Description of Artificial Sequence: Synthetic oligonucleotide
ctctgtgtggccactgccctctgc

SEQ ID NO: 129215 - DNA, 24 bp, Artificial Sequence
  Description of Artificial Sequence: Synthetic oligonucleotide
tctgtgtggccactgccctctgcg

SEQ ID NO: 129216 - DNA, 23 bp, Artificial Sequence
  Description of Artificial Sequence: Synthetic oligonucleotide
ctgtgtggccactgccctctgcg

SEQ ID NO: 129217 - DNA, 23 bp, Artificial Sequence
  Description of Artificial Sequence: Synthetic oligonucleotide
tgtgtggccactgccctctgcgg

SEQ ID NO: 129218 - DNA, 22 bp, Artificial Sequence
  Description of Artificial Sequence: Synthetic oligonucleotide
gtgtggccactgccctctgcgg

SEQ ID NO: 129219 - DNA, 23 bp, Artificial Sequence
  Description of Artificial Sequence: Synthetic oligonucleotide
tgtggccactgccctctgcggct

SEQ ID NO: 129220 - DNA, 22 bp, Artificial Sequence
  Description of Artificial Sequence: Synthetic oligonucleotide
gtggccactgccctctgcggct

SEQ ID NO: 129221 - DNA, 22 bp, Artificial Sequence
  Description of Artificial Sequence: Synthetic oligonucleotide
tggccactgccctctgcggctg

SEQ ID NO: 129222 - DNA, 21 bp, Artificial Sequence
  Description of Artificial Sequence: Synthetic oligonucleotide
ggccactgccctctgcggctg

SEQ ID NO: 129223 - DNA, 21 bp, Artificial Sequence
  Description of Artificial Sequence: Synthetic oligonucleotide
gccactgccctctgcggctgg

SEQ ID NO: 129224 - DNA, 22 bp, Artificial Sequence
  Description of Artificial Sequence: Synthetic oligonucleotide
ccactgccctctgcggctggga

SEQ ID NO: 129225 - DNA, 22 bp, Artificial Sequence
  Description of Artificial Sequence: Synthetic oligonucleotide
cactgccctctgcggctgggac

SEQ ID NO: 129226 - DNA, 22 bp, Artificial Sequence
  Description of Artificial Sequence: Synthetic oligonucleotide
actgccctctgcggctgggacc

SEQ ID NO: 129227 - DNA, 21 bp, Artificial Sequence
  Description of Artificial Sequence: Synthetic oligonucleotide
ctgccctctgcggctgggacc

SEQ ID NO: 129228 - DNA, 21 bp, Artificial Sequence
  Description of Artificial Sequence: Synthetic oligonucleotide
tgccctctgcggctgggaccg

SEQ ID NO: 129229 - DNA, 20 bp, Artificial Sequence
  Description of Artificial Sequence: Synthetic oligonucleotide
gccctctgcggctgggaccg

SEQ ID NO: 129230 - DNA, 21 bp, Artificial Sequence
  Description of Artificial Sequence: Synthetic oligonucleotide
ccctctgcggctgggaccgct

SEQ ID NO: 129231 - DNA, 22 bp, Artificial Sequence
  Description of Artificial Sequence: Synthetic oligonucleotide
cctctgcggctgggaccgctct

SEQ ID NO: 129232 - DNA, 22 bp, Artificial Sequence
  Description of Artificial Sequence: Synthetic oligonucleotide
ctctgcggctgggaccgctctg

SEQ ID NO: 129233 - DNA, 22 bp, Artificial Sequence
  Description of Artificial Sequence: Synthetic oligonucleotide
tctgcggctgggaccgctctgg

SEQ ID NO: 129234 - DNA, 21 bp, Artificial Sequence
  Description of Artificial Sequence: Synthetic oligonucleotide
ctgcggctgggaccgctctgg

SEQ ID NO: 129235 - DNA, 21 bp, Artificial Sequence
  Description of Artificial Sequence: Synthetic oligonucleotide
tgcggctgggaccgctctggc

SEQ ID NO: 129236 - DNA, 20 bp, Artificial Sequence
  Description of Artificial Sequence: Synthetic oligonucleotide
gcggctgggaccgctctggc

SEQ ID NO: 129237 - DNA, 20 bp, Artificial Sequence
  Description of Artificial Sequence: Synthetic oligonucleotide
cggctgggaccgctctggcc

SEQ ID NO: 129238 - DNA, 21 bp, Artificial Sequence
  Description of Artificial Sequence: Synthetic oligonucleotide
ggctgggaccgctctggccct

SEQ ID NO: 129239 - DNA, 22 bp, Artificial Sequence
  Description of Artificial Sequence: Synthetic oligonucleotide
gctgggaccgctctggccctga

SEQ ID NO: 129240 - DNA, 22 bp, Artificial Sequence
  Description of Artificial Sequence: Synthetic oligonucleotide
ctgggaccgctctggccctgag

SEQ ID NO: 129241 - DNA, 23 bp, Artificial Sequence
  Description of Artificial Sequence: Synthetic oligonucleotide
tgggaccgctctggccctgagct

SEQ ID NO: 129242 - DNA, 22 bp, Artificial Sequence
  Description of Artificial Sequence: Synthetic oligonucleotide
gggaccgctctggccctgagct

SEQ ID NO: 129243 - DNA, 24 bp, Artificial Sequence
  Description of Artificial Sequence: Synthetic oligonucleotide
ggaccgctctggccctgagctctt

SEQ ID NO: 129244 - DNA, 26 bp, Artificial Sequence
  Description of Artificial Sequence: Synthetic oligonucleotide
gaccgctctggccctgagctcttcta

SEQ ID NO: 129245 - DNA, 26 bp, Artificial Sequence
  Description of Artificial Sequence: Synthetic oligonucleotide
accgctctggccctgagctcttctac

SEQ ID NO: 129246 - DNA, 25 bp, Artificial Sequence
  Description of Artificial Sequence: Synthetic oligonucleotide
ccgctctggccctgagctcttctac

SEQ ID NO: 129247 - DNA, 26 bp, Artificial Sequence
  Description of Artificial Sequence: Synthetic oligonucleotide
cgctctggccctgagctcttctacgt

SEQ ID NO: 129248 - DNA, 27 bp, Artificial Sequence
  Description of Artificial Sequence: Synthetic oligonucleotide
gctctggccctgagctcttctacgtct

SEQ ID NO: 129249 - DNA, 30 bp, Artificial Sequence
  Description of Artificial Sequence: Synthetic oligonucleotide
ctctggccctgagctcttctacgtctatag

SEQ ID NO: 129250 - DNA, 30 bp, Artificial Sequence
  Description of Artificial Sequence: Synthetic oligonucleotide
tctggccctgagctcttctacgtctatagc

SEQ ID NO: 129251 - DNA, 29 bp, Artificial Sequence
  Description of Artificial Sequence: Synthetic oligonucleotide
ctggccctgagctcttctacgtctatagc

SEQ ID NO: 129252 - DNA, 29 bp, Artificial Sequence
  Description of Artificial Sequence: Synthetic oligonucleotide
tggccctgagctcttctacgtctatagcg

SEQ ID NO: 129253 - DNA, 28 bp, Artificial Sequence
  Description of Artificial Sequence: Synthetic oligonucleotide
ggccctgagctcttctacgtctatagcg

SEQ ID NO: 129254 - DNA, 29 bp, Artificial Sequence
  Description of Artificial Sequence: Synthetic oligonucleotide
gccctgagctcttctacgtctatagcgac

SEQ ID NO: 129255 - DNA, 29 bp, Artificial Sequence
  Description of Artificial Sequence: Synthetic oligonucleotide
ccctgagctcttctacgtctatagcgacg

SEQ ID NO: 129256 - DNA, 29 bp, Artificial Sequence
  Description of Artificial Sequence: Synthetic oligonucleotide
cctgagctcttctacgtctatagcgacgg

SEQ ID NO: 129257 - DNA, 29 bp, Artificial Sequence
  Description of Artificial Sequence: Synthetic oligonucleotide
ctgagctcttctacgtctatagcgacggc

SEQ ID NO: 129258 - DNA, 30 bp, Artificial Sequence
  Description of Artificial Sequence: Synthetic oligonucleotide
tgagctcttctacgtctatagcgacggcac

SEQ ID NO: 129259 - DNA, 29 bp, Artificial Sequence
  Description of Artificial Sequence: Synthetic oligonucleotide
gagctcttctacgtctatagcgacggcac

SEQ ID NO: 129260 - DNA, 29 bp, Artificial Sequence
  Description of Artificial Sequence: Synthetic oligonucleotide
agctcttctacgtctatagcgacggcacc

SEQ ID NO: 129261 - DNA, 28 bp, Artificial Sequence
  Description of Artificial Sequence: Synthetic oligonucleotide
gctcttctacgtctatagcgacggcacc

SEQ ID NO: 129262 - DNA, 28 bp, Artificial Sequence
  Description of Artificial Sequence: Synthetic oligonucleotide
ctcttctacgtctatagcgacggcaccc

SEQ ID NO: 129263 - DNA, 28 bp, Artificial Sequence
  Description of Artificial Sequence: Synthetic oligonucleotide
tcttctacgtctatagcgacggcacccg

SEQ ID NO: 129264 - DNA, 27 bp, Artificial Sequence
  Description of Artificial Sequence: Synthetic oligonucleotide
cttctacgtctatagcgacggcacccg

SEQ ID NO: 129265 - DNA, 27 bp, Artificial Sequence
  Description of Artificial Sequence: Synthetic oligonucleotide
ttctacgtctatagcgacggcacccgc

SEQ ID NO: 129266 - DNA, 26 bp, Artificial Sequence
  Description of Artificial Sequence: Synthetic oligonucleotide
tctacgtctatagcgacggcacccgc

SEQ ID NO: 129267 - DNA, 25 bp, Artificial Sequence
  Description of Artificial Sequence: Synthetic oligonucleotide
ctacgtctatagcgacggcacccgc

SEQ ID NO: 129268 - DNA, 26 bp, Artificial Sequence
  Description of Artificial Sequence: Synthetic oligonucleotide
tacgtctatagcgacggcacccgcct

SEQ ID NO: 129269 - DNA, 25 bp, Artificial Sequence
  Description of Artificial Sequence: Synthetic oligonucleotide
acgtctatagcgacggcacccgcct

SEQ ID NO: 129270 - DNA, 24 bp, Artificial Sequence
  Description of Artificial Sequence: Synthetic oligonucleotide
cgtctatagcgacggcacccgcct

SEQ ID NO: 129271 - DNA, 24 bp, Artificial Sequence
  Description of Artificial Sequence: Synthetic oligonucleotide
gtctatagcgacggcacccgcctg

SEQ ID NO: 129272 - DNA, 25 bp, Artificial Sequence
  Description of Artificial Sequence: Synthetic oligonucleotide
tctatagcgacggcacccgcctgca

SEQ ID NO: 129273 - DNA, 24 bp, Artificial Sequence
  Description of Artificial Sequence: Synthetic oligonucleotide
ctatagcgacggcacccgcctgca

SEQ ID NO: 129274 - DNA, 24 bp, Artificial Sequence
  Description of Artificial Sequence: Synthetic oligonucleotide
tatagcgacggcacccgcctgcag

SEQ ID NO: 129275 - DNA, 23 bp, Artificial Sequence
  Description of Artificial Sequence: Synthetic oligonucleotide
atagcgacggcacccgcctgcag

SEQ ID NO: 129276 - DNA, 22 bp, Artificial Sequence
  Description of Artificial Sequence: Synthetic oligonucleotide
tagcgacggcacccgcctgcag

SEQ ID NO: 129277 - DNA, 21 bp, Artificial Sequence
  Description of Artificial Sequence: Synthetic oligonucleotide
agcgacggcacccgcctgcag

SEQ ID NO: 129278 - DNA, 20 bp, Artificial Sequence
  Description of Artificial Sequence: Synthetic oligonucleotide
gcgacggcacccgcctgcag

SEQ ID NO: 129279 - DNA, 20 bp, Artificial Sequence
  Description of Artificial Sequence: Synthetic oligonucleotide
cgacggcacccgcctgcagg

SEQ ID NO: 129280 - DNA, 20 bp, Artificial Sequence
  Description of Artificial Sequence: Synthetic oligonucleotide
gacggcacccgcctgcaggg

SEQ ID NO: 129281 - DNA, 20 bp, Artificial Sequence
  Description of Artificial Sequence: Synthetic oligonucleotide
acggcacccgcctgcagggg

SEQ ID NO: 129282 - DNA, 20 bp, Artificial Sequence
  Description of Artificial Sequence: Synthetic oligonucleotide
cggcacccgcctgcaggggt

SEQ ID NO: 129283 - DNA, 20 bp, Artificial Sequence
  Description of Artificial Sequence: Synthetic oligonucleotide
ggcacccgcctgcaggggga

SEQ ID NO: 129284 - DNA, 22 bp, Artificial Sequence
  Description of Artificial Sequence: Synthetic oligonucleotide
gcacccgcctgcagggggacat

SEQ ID NO: 129285 - DNA, 24 bp, Artificial Sequence
  Description of Artificial Sequence: Synthetic oligonucleotide
cacccgcctgcagggggacatctt

SEQ ID NO: 129286 - DNA, 25 bp, Artificial Sequence
  Description of Artificial Sequence: Synthetic oligonucleotide
acccgcctgcagggggacatcttct

SEQ ID NO: 129287 - DNA, 24 bp, Artificial Sequence
  Description of Artificial Sequence: Synthetic oligonucleotide
cccgcctgcagggggacatcttct

SEQ ID NO: 129288 - DNA, 25 bp, Artificial Sequence
  Description of Artificial Sequence: Synthetic oligonucleotide
ccgcctgcagggggacatcttctct

SEQ ID NO: 129289 - DNA, 26 bp, Artificial Sequence
  Description of Artificial Sequence: Synthetic oligonucleotide
cgcctgcagggggacatcttctctgt

SEQ ID NO: 129290 - DNA, 26 bp, Artificial Sequence
  Description of Artificial Sequence: Synthetic oligonucleotide
gcctgcagggggacatcttctctgtg

SEQ ID NO: 129291 - DNA, 26 bp, Artificial Sequence
  Description of Artificial Sequence: Synthetic oligonucleotide
cctgcagggggacatcttctctgtgg

SEQ ID NO: 129292 - DNA, 26 bp, Artificial Sequence
  Description of Artificial Sequence: Synthetic oligonucleotide
ctgcagggggacatcttctctgtggg

SEQ ID NO: 129293 - DNA, 27 bp, Artificial Sequence
  Description of Artificial Sequence: Synthetic oligonucleotide
tgcagggggacatcttctctgtgggct

SEQ ID NO: 129294 - DNA, 26 bp, Artificial Sequence
  Description of Artificial Sequence: Synthetic oligonucleotide
gcagggggacatcttctctgtgggct

SEQ ID NO: 129295 - DNA, 27 bp, Artificial Sequence
  Description of Artificial Sequence: Synthetic oligonucleotide
cagggggacatcttctctgtgggctct

SEQ ID NO: 129296 - DNA, 27 bp, Artificial Sequence
  Description of Artificial Sequence: Synthetic oligonucleotide
agggggacatcttctctgtgggctctg

SEQ ID NO: 129297 - DNA, 26 bp, Artificial Sequence
  Description of Artificial Sequence: Synthetic oligonucleotide
gggggacatcttctctgtgggctctg

SEQ ID NO: 129298 - DNA, 27 bp, Artificial Sequence
  Description of Artificial Sequence: Synthetic oligonucleotide
ggggacatcttctctgtgggctctgga

SEQ ID NO: 129299 - DNA, 28 bp, Artificial Sequence
  Description of Artificial Sequence: Synthetic oligonucleotide
gggacatcttctctgtgggctctggatc

SEQ ID NO: 129300 - DNA, 29 bp, Artificial Sequence
  Description of Artificial Sequence: Synthetic oligonucleotide
ggacatcttctctgtgggctctggatctc

SEQ ID NO: 129301 - DNA, 29 bp, Artificial Sequence
  Description of Artificial Sequence: Synthetic oligonucleotide
gacatcttctctgtgggctctggatctcc

SEQ ID NO: 129302 - DNA, 29 bp, Artificial Sequence
  Description of Artificial Sequence: Synthetic oligonucleotide
acatcttctctgtgggctctggatctccc

SEQ ID NO: 129303 - DNA, 28 bp, Artificial Sequence
  Description of Artificial Sequence: Synthetic oligonucleotide
catcttctctgtgggctctggatctccc

SEQ ID NO: 129304 - DNA, 31 bp, Artificial Sequence
  Description of Artificial Sequence: Synthetic oligonucleotide
atcttctctgtgggctctggatctccctatg

SEQ ID NO: 129305 - DNA, 30 bp, Artificial Sequence
  Description of Artificial Sequence: Synthetic oligonucleotide
tcttctctgtgggctctggatctccctatg

SEQ ID NO: 129306 - DNA, 29 bp, Artificial Sequence
  Description of Artificial Sequence: Synthetic oligonucleotide
cttctctgtgggctctggatctccctatg

SEQ ID NO: 129307 - DNA, 29 bp, Artificial Sequence
  Description of Artificial Sequence: Synthetic oligonucleotide
ttctctgtgggctctggatctccctatgc

SEQ ID NO: 129308 - DNA, 28 bp, Artificial Sequence
  Description of Artificial Sequence: Synthetic oligonucleotide
tctctgtgggctctggatctccctatgc

SEQ ID NO: 129309 - DNA, 27 bp, Artificial Sequence
  Description of Artificial Sequence: Synthetic oligonucleotide
ctctgtgggctctggatctccctatgc

SEQ ID NO: 129310 - DNA, 27 bp, Artificial Sequence
  Description of Artificial Sequence: Synthetic oligonucleotide
tctgtgggctctggatctccctatgcc

SEQ ID NO: 129311 - DNA, 27 bp, Artificial Sequence
  Description of Artificial Sequence: Synthetic oligonucleotide
ctgtgggctctggatctccctatgcct

SEQ ID NO: 129312 - DNA, 28 bp, Artificial Sequence
  Description of Artificial Sequence: Synthetic oligonucleotide
tgtgggctctggatctccctatgcctac

SEQ ID NO: 129313 - DNA, 27 bp, Artificial Sequence
  Description of Artificial Sequence: Synthetic oligonucleotide
gtgggctctggatctccctatgcctac

SEQ ID NO: 129314 - DNA, 27 bp, Artificial Sequence
  Description of Artificial Sequence: Synthetic oligonucleotide
tgggctctggatctccctatgcctacg

SEQ ID NO: 129315 - DNA, 26 bp, Artificial Sequence
  Description of Artificial Sequence: Synthetic oligonucleotide
gggctctggatctccctatgcctacg

SEQ ID NO: 129316 - DNA, 26 bp, Artificial Sequence
  Description of Artificial Sequence: Synthetic oligonucleotide
ggctctggatctccctatgcctacgg

SEQ ID NO: 129317 - DNA, 26 bp, Artificial Sequence
  Description of Artificial Sequence: Synthetic oligonucleotide
gctctggatctccctatgcctacggc

SEQ ID NO: 129318 - DNA, 27 bp, Artificial Sequence
  Description of Artificial Sequence: Synthetic oligonucleotide
ctctggatctccctatgcctacggcgt

SEQ ID NO: 129319 - DNA, 27 bp, Artificial Sequence
  Description of Artificial Sequence: Synthetic oligonucleotide
tctggatctccctatgcctacggcgtg

SEQ ID NO: 129320 - DNA, 26 bp, Artificial Sequence
  Description of Artificial Sequence: Synthetic oligonucleotide
ctggatctccctatgcctacggcgtg

SEQ ID NO: 129321 - DNA, 27 bp, Artificial Sequence
  Description of Artificial Sequence: Synthetic oligonucleotide
tggatctccctatgcctacggcgtgct

SEQ ID NO: 129322 - DNA, 27 bp, Artificial Sequence
  Description of Artificial Sequence: Synthetic oligonucleotide
ggatctccctatgcctacggcgtgcta

SEQ ID NO: 129323 - DNA, 27 bp, Artificial Sequence
  Description of Artificial Sequence: Synthetic oligonucleotide
gatctccctatgcctacggcgtgctag

SEQ ID NO: 129324 - DNA, 28 bp, Artificial Sequence
  Description of Artificial Sequence: Synthetic oligonucleotide
atctccctatgcctacggcgtgctagac

SEQ ID NO: 129325 - DNA, 27 bp, Artificial Sequence
  Description of Artificial Sequence: Synthetic oligonucleotide
tctccctatgcctacggcgtgctagac

SEQ ID NO: 129326 - DNA, 26 bp, Artificial Sequence
  Description of Artificial Sequence: Synthetic oligonucleotide
ctccctatgcctacggcgtgctagac

SEQ ID NO: 129327 - DNA, 26 bp, Artificial Sequence
  Description of Artificial Sequence: Synthetic oligonucleotide
tccctatgcctacggcgtgctagacc

SEQ ID NO: 129328 - DNA, 25 bp, Artificial Sequence
  Description of Artificial Sequence: Synthetic oligonucleotide
ccctatgcctacggcgtgctagacc

SEQ ID NO: 129329 - DNA, 26 bp, Artificial Sequence
  Description of Artificial Sequence: Synthetic oligonucleotide
cctatgcctacggcgtgctagaccgt

SEQ ID NO: 129330 - DNA, 26 bp, Artificial Sequence
  Description of Artificial Sequence: Synthetic oligonucleotide
ctatgcctacggcgtgctagaccgtg

SEQ ID NO: 129331 - DNA, 26 bp, Artificial Sequence
  Description of Artificial Sequence: Synthetic oligonucleotide
tatgcctacggcgtgctagaccgtgg

SEQ ID NO: 129332 - DNA, 25 bp, Artificial Sequence
  Description of Artificial Sequence: Synthetic oligonucleotide
atgcctacggcgtgctagaccgtgg

SEQ ID NO: 129333 - DNA, 24 bp, Artificial Sequence
  Description of Artificial Sequence: Synthetic oligonucleotide
tgcctacggcgtgctagaccgtgg

SEQ ID NO: 129334 - DNA, 23 bp, Artificial Sequence
  Description of Artificial Sequence: Synthetic oligonucleotide
gcctacggcgtgctagaccgtgg

SEQ ID NO: 129335 - DNA, 26 bp, Artificial Sequence
  Description of Artificial Sequence: Synthetic oligonucleotide
cctacggcgtgctagaccgtggctat

SEQ ID NO: 129336 - DNA, 26 bp, Artificial Sequence
  Description of Artificial Sequence: Synthetic oligonucleotide
ctacggcgtgctagaccgtggctatc

SEQ ID NO: 129337 - DNA, 26 bp, Artificial Sequence
  Description of Artificial Sequence: Synthetic oligonucleotide
tacggcgtgctagaccgtggctatcg

SEQ ID NO: 129338 - DNA, 25 bp, Artificial Sequence
  Description of Artificial Sequence: Synthetic oligonucleotide
acggcgtgctagaccgtggctatcg

SEQ ID NO: 129339 - DNA, 24 bp, Artificial Sequence
  Description of Artificial Sequence: Synthetic oligonucleotide
cggcgtgctagaccgtggctatcg

SEQ ID NO: 129340 - DNA, 26 bp, Artificial Sequence
  Description of Artificial Sequence: Synthetic oligonucleotide
ggcgtgctagaccgtggctatcgcta

SEQ ID NO: 129341 - DNA, 26 bp, Artificial Sequence
  Description of Artificial Sequence: Synthetic oligonucleotide
gcgtgctagaccgtggctatcgctac

SEQ ID NO: 129342 - DNA, 27 bp, Artificial Sequence
  Description of Artificial Sequence: Synthetic oligonucleotide
cgtgctagaccgtggctatcgctacga

SEQ ID NO: 129343 - DNA, 27 bp, Artificial Sequence
  Description of Artificial Sequence: Synthetic oligonucleotide
gtgctagaccgtggctatcgctacgac

SEQ ID NO: 129344 - DNA, 29 bp, Artificial Sequence
  Description of Artificial Sequence: Synthetic oligonucleotide
tgctagaccgtggctatcgctacgacatg

SEQ ID NO: 129345 - DNA, 28 bp, Artificial Sequence
  Description of Artificial Sequence: Synthetic oligonucleotide
gctagaccgtggctatcgctacgacatg

SEQ ID NO: 129346 - DNA, 29 bp, Artificial Sequence
  Description of Artificial Sequence: Synthetic oligonucleotide
ctagaccgtggctatcgctacgacatgag

SEQ ID NO: 129347 - DNA, 29 bp, Artificial Sequence
  Description of Artificial Sequence: Synthetic oligonucleotide
tagaccgtggctatcgctacgacatgagc

SEQ ID NO: 129348 - DNA, 28 bp, Artificial Sequence
  Description of Artificial Sequence: Synthetic oligonucleotide
agaccgtggctatcgctacgacatgagc

SEQ ID NO: 129349 - DNA, 27 bp, Artificial Sequence
  Description of Artificial Sequence: Synthetic oligonucleotide
gaccgtggctatcgctacgacatgagc

SEQ ID NO: 129350 - DNA, 28 bp, Artificial Sequence
  Description of Artificial Sequence: Synthetic oligonucleotide
accgtggctatcgctacgacatgagcac

SEQ ID NO: 129351 - DNA, 27 bp, Artificial Sequence
  Description of Artificial Sequence: Synthetic oligonucleotide
ccgtggctatcgctacgacatgagcac

SEQ ID NO: 129352 - DNA, 27 bp, Artificial Sequence
  Description of Artificial Sequence: Synthetic oligonucleotide
cgtggctatcgctacgacatgagcacc

SEQ ID NO: 129353 - DNA, 27 bp, Artificial Sequence
  Description of Artificial Sequence: Synthetic oligonucleotide
gtggctatcgctacgacatgagcaccc

SEQ ID NO: 129354 - DNA, 28 bp, Artificial Sequence
  Description of Artificial Sequence: Synthetic oligonucleotide
tggctatcgctacgacatgagcacccag

SEQ ID NO: 129355 - DNA, 27 bp, Artificial Sequence
  Description of Artificial Sequence: Synthetic oligonucleotide
ggctatcgctacgacatgagcacccag

SEQ ID NO: 129356 - DNA, 27 bp, Artificial Sequence
  Description of Artificial Sequence: Synthetic oligonucleotide
gctatcgctacgacatgagcacccagg

SEQ ID NO: 129357 - DNA, 29 bp, Artificial Sequence
  Description of Artificial Sequence: Synthetic oligonucleotide
ctatcgctacgacatgagcacccaggaag

SEQ ID NO: 129358 - DNA, 29 bp, Artificial Sequence
  Description of Artificial Sequence: Synthetic oligonucleotide
tatcgctacgacatgagcacccaggaagc

SEQ ID NO: 129359 - DNA, 28 bp, Artificial Sequence
  Description of Artificial Sequence: Synthetic oligonucleotide
atcgctacgacatgagcacccaggaagc

SEQ ID NO: 129360 - DNA, 27 bp, Artificial Sequence
  Description of Artificial Sequence: Synthetic oligonucleotide
tcgctacgacatgagcacccaggaagc

SEQ ID NO: 129361 - DNA, 26 bp, Artificial Sequence
  Description of Artificial Sequence: Synthetic oligonucleotide
cgctacgacatgagcacccaggaagc

SEQ ID NO: 129362 - DNA, 27 bp, Artificial Sequence
  Description of Artificial Sequence: Synthetic oligonucleotide
gctacgacatgagcacccaggaagcct

SEQ ID NO: 129363 - DNA, 28 bp, Artificial Sequence
  Description of Artificial Sequence: Synthetic oligonucleotide
ctacgacatgagcacccaggaagcctac

SEQ ID NO: 129364 - DNA, 28 bp, Artificial Sequence
  Description of Artificial Sequence: Synthetic oligonucleotide
tacgacatgagcacccaggaagcctacg

SEQ ID NO: 129365 - DNA, 27 bp, Artificial Sequence
  Description of Artificial Sequence: Synthetic oligonucleotide
acgacatgagcacccaggaagcctacg

SEQ ID NO: 129366 - DNA, 26 bp, Artificial Sequence
  Description of Artificial Sequence: Synthetic oligonucleotide
cgacatgagcacccaggaagcctacg

SEQ ID NO: 129367 - DNA, 26 bp, Artificial Sequence
  Description of Artificial Sequence: Synthetic oligonucleotide
gacatgagcacccaggaagcctacgc

SEQ ID NO: 129368 - DNA, 26 bp, Artificial Sequence
  Description of Artificial Sequence: Synthetic oligonucleotide
acatgagcacccaggaagcctacgcc

SEQ ID NO: 129369 - DNA, 25 bp, Artificial Sequence
  Description of Artificial Sequence: Synthetic oligonucleotide
catgagcacccaggaagcctacgcc

SEQ ID NO: 129370 - DNA, 26 bp, Artificial Sequence
  Description of Artificial Sequence: Synthetic oligonucleotide
atgagcacccaggaagcctacgccct

SEQ ID NO: 129371 - DNA, 25 bp, Artificial Sequence
  Description of Artificial Sequence: Synthetic oligonucleotide
tgagcacccaggaagcctacgccct

SEQ ID NO: 129372 - DNA, 24 bp, Artificial Sequence
  Description of Artificial Sequence: Synthetic oligonucleotide
gagcacccaggaagcctacgccct

SEQ ID NO: 129373 - DNA, 24 bp, Artificial Sequence
  Description of Artificial Sequence: Synthetic oligonucleotide
agcacccaggaagcctacgccctg

SEQ ID NO: 129374 - DNA, 23 bp, Artificial Sequence
  Description of Artificial Sequence: Synthetic oligonucleotide
gcacccaggaagcctacgccctg

SEQ ID NO: 129375 - DNA, 23 bp, Artificial Sequence
  Description of Artificial Sequence: Synthetic oligonucleotide
cacccaggaagcctacgccctgg

SEQ ID NO: 129376 - DNA, 24 bp, Artificial Sequence
  Description of Artificial Sequence: Synthetic oligonucleotide
acccaggaagcctacgccctggct

SEQ ID NO: 129377 - DNA, 23 bp, Artificial Sequence
  Description of Artificial Sequence: Synthetic oligonucleotide
cccaggaagcctacgccctggct

SEQ ID NO: 129378 - DNA, 23 bp, Artificial Sequence
  Description of Artificial Sequence: Synthetic oligonucleotide
ccaggaagcctacgccctggctc

SEQ ID NO: 129379 - DNA, 23 bp, Artificial Sequence
  Description of Artificial Sequence: Synthetic oligonucleotide
caggaagcctacgccctggctcg

SEQ ID NO: 129380 - DNA, 24 bp, Artificial Sequence
  Description of Artificial Sequence: Synthetic oligonucleotide
aggaagcctacgccctggctcgct

SEQ ID NO: 129381 - DNA, 23 bp, Artificial Sequence
  Description of Artificial Sequence: Synthetic oligonucleotide
ggaagcctacgccctggctcgct

SEQ ID NO: 129382 - DNA, 23 bp, Artificial Sequence
  Description of Artificial Sequence: Synthetic oligonucleotide
gaagcctacgccctggctcgctg

SEQ ID NO: 129383 - DNA, 23 bp, Artificial Sequence
  Description of Artificial Sequence: Synthetic oligonucleotide
aagcctacgccctggctcgctgc

SEQ ID NO: 129384 - DNA, 22 bp, Artificial Sequence
  Description of Artificial Sequence: Synthetic oligonucleotide
agcctacgccctggctcgctgc

SEQ ID NO: 129385 - DNA, 21 bp, Artificial Sequence
  Description of Artificial Sequence: Synthetic oligonucleotide
gcctacgccctggctcgctgc

SEQ ID NO: 129386 - DNA, 21 bp, Artificial Sequence
  Description of Artificial Sequence: Synthetic oligonucleotide
cctacgccctggctcgctgcg

SEQ ID NO: 129387 - DNA, 21 bp, Artificial Sequence
  Description of Artificial Sequence: Synthetic oligonucleotide
ctacgccctggctcgctgcgc

SEQ ID NO: 129388 - DNA, 21 bp, Artificial Sequence
  Description of Artificial Sequence: Synthetic oligonucleotide
tacgccctggctcgctgcgcc

SEQ ID NO: 129389 - DNA, 20 bp, Artificial Sequence
  Description of Artificial Sequence: Synthetic oligonucleotide
acgccctggctcgctgcgcc

SEQ ID NO: 129390 - DNA, 20 bp, Artificial Sequence
  Description of Artificial Sequence: Synthetic oligonucleotide
cgccctggctcgctgcgcct

SEQ ID NO: 129391 - DNA, 20 bp, Artificial Sequence
  Description of Artificial Sequence: Synthetic oligonucleotide
gccctggctcgctgcgccgt

SEQ ID NO: 129392 - DNA, 20 bp, Artificial Sequence
  Description of Artificial Sequence: Synthetic oligonucleotide
ccctggctcgctgcgccgtg

SEQ ID NO: 129393 - DNA, 20 bp, Artificial Sequence
  Description of Artificial Sequence: Synthetic oligonucleotide
cctggctcgctgcgccgtgg

SEQ ID NO: 129394 - DNA, 20 bp, Artificial Sequence
  Description of Artificial Sequence: Synthetic oligonucleotide
ctggctcgctgcgccgtggc

SEQ ID NO: 129395 - DNA, 20 bp, Artificial Sequence
  Description of Artificial Sequence: Synthetic oligonucleotide
tggctcgctgcgccgtggcc

SEQ ID NO: 129396 - DNA, 20 bp, Artificial Sequence
  Description of Artificial Sequence: Synthetic oligonucleotide
ggctcgctgcgccgtggcct

SEQ ID NO: 129397 - DNA, 20 bp, Artificial Sequence
  Description of Artificial Sequence: Synthetic oligonucleotide
gctcgctgcgccgtggccca

SEQ ID NO: 129398 - DNA, 20 bp, Artificial Sequence
  Description of Artificial Sequence: Synthetic oligonucleotide
ctcgctgcgccgtggcccac

SEQ ID NO: 129399 - DNA, 20 bp, Artificial Sequence
  Description of Artificial Sequence: Synthetic oligonucleotide
tcgctgcgccgtggcccacg

SEQ ID NO: 129400 - DNA, 20 bp, Artificial Sequence
  Description of Artificial Sequence: Synthetic oligonucleotide
cgctgcgccgtggcccacgt

SEQ ID NO: 129401 - DNA, 20 bp, Artificial Sequence
  Description of Artificial Sequence: Synthetic oligonucleotide
gctgcgccgtggcccacgct

SEQ ID NO: 129402 - DNA, 20 bp, Artificial Sequence
  Description of Artificial Sequence: Synthetic oligonucleotide
ctgcgccgtggcccacgcca

SEQ ID NO: 129403 - DNA, 20 bp, Artificial Sequence
  Description of Artificial Sequence: Synthetic oligonucleotide
tgcgccgtggcccacgccac

SEQ ID NO: 129404 - DNA, 20 bp, Artificial Sequence
  Description of Artificial Sequence: Synthetic oligonucleotide
gcgccgtggcccacgccact

SEQ ID NO: 129405 - DNA, 20 bp, Artificial Sequence
  Description of Artificial Sequence: Synthetic oligonucleotide
cgccgtggcccacgccacct

SEQ ID NO: 129406 - DNA, 20 bp, Artificial Sequence
  Description of Artificial Sequence: Synthetic oligonucleotide
gccgtggcccacgccaccca

SEQ ID NO: 129407 - DNA, 20 bp, Artificial Sequence
  Description of Artificial Sequence: Synthetic oligonucleotide
ccgtggcccacgccacccac

SEQ ID NO: 129408 - DNA, 20 bp, Artificial Sequence
  Description of Artificial Sequence: Synthetic oligonucleotide
cgtggcccacgccacccacc

SEQ ID NO: 129409 - DNA, 21 bp, Artificial Sequence
  Description of Artificial Sequence: Synthetic oligonucleotide
gtggcccacgccacccaccgt

SEQ ID NO: 129410 - DNA, 23 bp, Artificial Sequence
  Description of Artificial Sequence: Synthetic oligonucleotide
tggcccacgccacccaccgtgat

SEQ ID NO: 129411 - DNA, 22 bp, Artificial Sequence
  Description of Artificial Sequence: Synthetic oligonucleotide
ggcccacgccacccaccgtgat

SEQ ID NO: 129412 - DNA, 22 bp, Artificial Sequence
  Description of Artificial Sequence: Synthetic oligonucleotide
gcccacgccacccaccgtgatg

SEQ ID NO: 129413 - DNA, 22 bp, Artificial Sequence
  Description of Artificial Sequence: Synthetic oligonucleotide
cccacgccacccaccgtgatgc

SEQ ID NO: 129414 - DNA, 26 bp, Artificial Sequence
  Description of Artificial Sequence: Synthetic oligonucleotide
ccacgccacccaccgtgatgcctatt

SEQ ID NO: 129415 - DNA, 27 bp, Artificial Sequence
  Description of Artificial Sequence: Synthetic oligonucleotide
cacgccacccaccgtgatgcctattca

SEQ ID NO: 129416 - DNA, 27 bp, Artificial Sequence
  Description of Artificial Sequence: Synthetic oligonucleotide
acgccacccaccgtgatgcctattcag

SEQ ID NO: 129417 - DNA, 26 bp, Artificial Sequence
  Description of Artificial Sequence: Synthetic oligonucleotide
cgccacccaccgtgatgcctattcag

SEQ ID NO: 129418 - DNA, 26 bp, Artificial Sequence
  Description of Artificial Sequence: Synthetic oligonucleotide
gccacccaccgtgatgcctattcagg

SEQ ID NO: 129419 - DNA, 26 bp, Artificial Sequence
  Description of Artificial Sequence: Synthetic oligonucleotide
ccacccaccgtgatgcctattcaggg

SEQ ID NO: 129420 - DNA, 26 bp, Artificial Sequence
  Description of Artificial Sequence: Synthetic oligonucleotide
cacccaccgtgatgcctattcagggg

SEQ ID NO: 129421 - DNA, 26 bp, Artificial Sequence
  Description of Artificial Sequence: Synthetic oligonucleotide
acccaccgtgatgcctattcaggggg

SEQ ID NO: 129422 - DNA, 25 bp, Artificial Sequence
  Description of Artificial Sequence: Synthetic oligonucleotide
cccaccgtgatgcctattcaggggg

SEQ ID NO: 129423 - DNA, 26 bp, Artificial Sequence
  Description of Artificial Sequence: Synthetic oligonucleotide
ccaccgtgatgcctattcagggggct

SEQ ID NO: 129424 - DNA, 27 bp, Artificial Sequence
  Description of Artificial Sequence: Synthetic oligonucleotide
caccgtgatgcctattcagggggctct

SEQ ID NO: 129425 - DNA, 27 bp, Artificial Sequence
  Description of Artificial Sequence: Synthetic oligonucleotide
accgtgatgcctattcagggggctctg

SEQ ID NO: 129426 - DNA, 27 bp, Artificial Sequence
  Description of Artificial Sequence: Synthetic oligonucleotide
ccgtgatgcctattcagggggctctgt

SEQ ID NO: 129427 - DNA, 28 bp, Artificial Sequence
  Description of Artificial Sequence: Synthetic oligonucleotide
cgtgatgcctattcagggggctctgtag

SEQ ID NO: 129428 - DNA, 29 bp, Artificial Sequence
  Description of Artificial Sequence: Synthetic oligonucleotide
gtgatgcctattcagggggctctgtagac

SEQ ID NO: 129429 - DNA, 29 bp, Artificial Sequence
  Description of Artificial Sequence: Synthetic oligonucleotide
tgatgcctattcagggggctctgtagacc

SEQ ID NO: 129430 - DNA, 28 bp, Artificial Sequence
  Description of Artificial Sequence: Synthetic oligonucleotide
gatgcctattcagggggctctgtagacc

SEQ ID NO: 129431 - DNA, 32 bp, Artificial Sequence
  Description of Artificial Sequence: Synthetic oligonucleotide
atgcctattcagggggctctgtagaccttttc

SEQ ID NO: 129432 - DNA, 31 bp, Artificial Sequence
  Description of Artificial Sequence: Synthetic oligonucleotide
tgcctattcagggggctctgtagaccttttc

SEQ ID NO: 129433 - DNA, 30 bp, Artificial Sequence
  Description of Artificial Sequence: Synthetic oligonucleotide
gcctattcagggggctctgtagaccttttc

SEQ ID NO: 129434 - DNA, 30 bp, Artificial Sequence
  Description of Artificial Sequence: Synthetic oligonucleotide
cctattcagggggctctgtagaccttttcc

SEQ ID NO: 129435 - DNA, 31 bp, Artificial Sequence
  Description of Artificial Sequence: Synthetic oligonucleotide
ctattcagggggctctgtagaccttttccac

SEQ ID NO: 129436 - DNA, 31 bp, Artificial Sequence
  Description of Artificial Sequence: Synthetic oligonucleotide
tattcagggggctctgtagaccttttccacg

SEQ ID NO: 129437 - DNA, 30 bp, Artificial Sequence
  Description of Artificial Sequence: Synthetic oligonucleotide
attcagggggctctgtagaccttttccacg

SEQ ID NO: 129438 - DNA, 29 bp, Artificial Sequence
  Description of Artificial Sequence: Synthetic oligonucleotide
ttcagggggctctgtagaccttttccacg

SEQ ID NO: 129439 - DNA, 28 bp, Artificial Sequence
  Description of Artificial Sequence: Synthetic oligonucleotide
tcagggggctctgtagaccttttccacg

SEQ ID NO: 129440 - DNA, 27 bp, Artificial Sequence
  Description of Artificial Sequence: Synthetic oligonucleotide
cagggggctctgtagaccttttccacg

SEQ ID NO: 129441 - DNA, 28 bp, Artificial Sequence
  Description of Artificial Sequence: Synthetic oligonucleotide
agggggctctgtagaccttttccacgtg

SEQ ID NO: 129442 - DNA, 27 bp, Artificial Sequence
  Description of Artificial Sequence: Synthetic oligonucleotide
gggggctctgtagaccttttccacgtg

SEQ ID NO: 129443 - DNA, 27 bp, Artificial Sequence
  Description of Artificial Sequence: Synthetic oligonucleotide
ggggctctgtagaccttttccacgtgc

SEQ ID NO: 129444 - DNA, 27 bp, Artificial Sequence
  Description of Artificial Sequence: Synthetic oligonucleotide
gggctctgtagaccttttccacgtgcg

SEQ ID NO: 129445 - DNA, 27 bp, Artificial Sequence
  Description of Artificial Sequence: Synthetic oligonucleotide
ggctctgtagaccttttccacgtgcgg

SEQ ID NO: 129446 - DNA, 27 bp, Artificial Sequence
  Description of Artificial Sequence: Synthetic oligonucleotide
gctctgtagaccttttccacgtgcggg

SEQ ID NO: 129447 - DNA, 28 bp, Artificial Sequence
  Description of Artificial Sequence: Synthetic oligonucleotide
ctctgtagaccttttccacgtgcgggag

SEQ ID NO: 129448 - DNA, 29 bp, Artificial Sequence
  Description of Artificial Sequence: Synthetic oligonucleotide
tctgtagaccttttccacgtgcgggagag

SEQ ID NO: 129449 - DNA, 28 bp, Artificial Sequence
  Description of Artificial Sequence: Synthetic oligonucleotide
ctgtagaccttttccacgtgcgggagag

SEQ ID NO: 129450 - DNA, 29 bp, Artificial Sequence
  Description of Artificial Sequence: Synthetic oligonucleotide
tgtagaccttttccacgtgcgggagagtg

SEQ ID NO: 129451 - DNA, 28 bp, Artificial Sequence
  Description of Artificial Sequence: Synthetic oligonucleotide
gtagaccttttccacgtgcgggagagtg

SEQ ID NO: 129452 - DNA, 28 bp, Artificial Sequence
  Description of Artificial Sequence: Synthetic oligonucleotide
tagaccttttccacgtgcgggagagtgg

SEQ ID NO: 129453 - DNA, 27 bp, Artificial Sequence
  Description of Artificial Sequence: Synthetic oligonucleotide
agaccttttccacgtgcgggagagtgg

SEQ ID NO: 129454 - DNA, 27 bp, Artificial Sequence
  Description of Artificial Sequence: Synthetic oligonucleotide
gaccttttccacgtgcgggagagtgga

SEQ ID NO: 129455 - DNA, 28 bp, Artificial Sequence
  Description of Artificial Sequence: Synthetic oligonucleotide
accttttccacgtgcgggagagtggatg

SEQ ID NO: 129456 - DNA, 27 bp, Artificial Sequence
  Description of Artificial Sequence: Synthetic oligonucleotide
ccttttccacgtgcgggagagtggatg

SEQ ID NO: 129457 - DNA, 27 bp, Artificial Sequence
  Description of Artificial Sequence: Synthetic oligonucleotide
cttttccacgtgcgggagagtggatgg

SEQ ID NO: 129458 - DNA, 27 bp, Artificial Sequence
  Description of Artificial Sequence: Synthetic oligonucleotide
ttttccacgtgcgggagagtggatggg

SEQ ID NO: 129459 - DNA, 27 bp, Artificial Sequence
  Description of Artificial Sequence: Synthetic oligonucleotide
tttccacgtgcgggagagtggatggga

SEQ ID NO: 129460 - DNA, 26 bp, Artificial Sequence
  Description of Artificial Sequence: Synthetic oligonucleotide
ttccacgtgcgggagagtggatggga

SEQ ID NO: 129461 - DNA, 25 bp, Artificial Sequence
  Description of Artificial Sequence: Synthetic oligonucleotide
tccacgtgcgggagagtggatggga

SEQ ID NO: 129462 - DNA, 24 bp, Artificial Sequence
  Description of Artificial Sequence: Synthetic oligonucleotide
ccacgtgcgggagagtggatggga

SEQ ID NO: 129463 - DNA, 24 bp, Artificial Sequence
  Description of Artificial Sequence: Synthetic oligonucleotide
cacgtgcgggagagtggatgggag

SEQ ID NO: 129464 - DNA, 26 bp, Artificial Sequence
  Description of Artificial Sequence: Synthetic oligonucleotide
acgtgcgggagagtggatgggagcat

SEQ ID NO: 129465 - DNA, 25 bp, Artificial Sequence
  Description of Artificial Sequence: Synthetic oligonucleotide
cgtgcgggagagtggatgggagcat

SEQ ID NO: 129466 - DNA, 26 bp, Artificial Sequence
  Description of Artificial Sequence: Synthetic oligonucleotide
gtgcgggagagtggatgggagcatgt

SEQ ID NO: 129467 - DNA, 27 bp, Artificial Sequence
  Description of Artificial Sequence: Synthetic oligonucleotide
tgcgggagagtggatgggagcatgtgt

SEQ ID NO: 129468 - DNA, 26 bp, Artificial Sequence
  Description of Artificial Sequence: Synthetic oligonucleotide
gcgggagagtggatgggagcatgtgt

SEQ ID NO: 129469 - DNA, 27 bp, Artificial Sequence
  Description of Artificial Sequence: Synthetic oligonucleotide
cgggagagtggatgggagcatgtgtca

SEQ ID NO: 129470 - DNA, 27 bp, Artificial Sequence
  Description of Artificial Sequence: Synthetic oligonucleotide
gggagagtggatgggagcatgtgtcac

SEQ ID NO: 129471 - DNA, 27 bp, Artificial Sequence
  Description of Artificial Sequence: Synthetic oligonucleotide
ggagagtggatgggagcatgtgtcacg

SEQ ID NO: 129472 - DNA, 27 bp, Artificial Sequence
  Description of Artificial Sequence: Synthetic oligonucleotide
gagagtggatgggagcatgtgtcacgc

SEQ ID NO: 129473 - DNA, 28 bp, Artificial Sequence
  Description of Artificial Sequence: Synthetic oligonucleotide
agagtggatgggagcatgtgtcacgcag

SEQ ID NO: 129474 - DNA, 27 bp, Artificial Sequence
  Description of Artificial Sequence: Synthetic oligonucleotide
gagtggatgggagcatgtgtcacgcag

SEQ ID NO: 129475 - DNA, 28 bp, Artificial Sequence
  Description of Artificial Sequence: Synthetic oligonucleotide
agtggatgggagcatgtgtcacgcagtg

SEQ ID NO: 129476 - DNA, 27 bp, Artificial Sequence
  Description of Artificial Sequence: Synthetic oligonucleotide
gtggatgggagcatgtgtcacgcagtg

SEQ ID NO: 129477 - DNA, 29 bp, Artificial Sequence
  Description of Artificial Sequence: Synthetic oligonucleotide
tggatgggagcatgtgtcacgcagtgatg

SEQ ID NO: 129478 - DNA, 28 bp, Artificial Sequence
  Description of Artificial Sequence: Synthetic oligonucleotide
ggatgggagcatgtgtcacgcagtgatg

SEQ ID NO: 129479 - DNA, 28 bp, Artificial Sequence
  Description of Artificial Sequence: Synthetic oligonucleotide
gatgggagcatgtgtcacgcagtgatgc

SEQ ID NO: 129480 - DNA, 28 bp, Artificial Sequence
  Description of Artificial Sequence: Synthetic oligonucleotide
atgggagcatgtgtcacgcagtgatgcc

SEQ ID NO: 129481 - DNA, 27 bp, Artificial Sequence
  Description of Artificial Sequence: Synthetic oligonucleotide
tgggagcatgtgtcacgcagtgatgcc

SEQ ID NO: 129482 - DNA, 27 bp, Artificial Sequence
  Description of Artificial Sequence: Synthetic oligonucleotide
gggagcatgtgtcacgcagtgatgcct

SEQ ID NO: 129483 - DNA, 27 bp, Artificial Sequence
  Description of Artificial Sequence: Synthetic oligonucleotide
ggagcatgtgtcacgcagtgatgcctg

SEQ ID NO: 129484 - DNA, 28 bp, Artificial Sequence
  Description of Artificial Sequence: Synthetic oligonucleotide
gagcatgtgtcacgcagtgatgcctgtg

SEQ ID NO: 129485 - DNA, 29 bp, Artificial Sequence
  Description of Artificial Sequence: Synthetic oligonucleotide
agcatgtgtcacgcagtgatgcctgtgtg

SEQ ID NO: 129486 - DNA, 28 bp, Artificial Sequence
  Description of Artificial Sequence: Synthetic oligonucleotide
gcatgtgtcacgcagtgatgcctgtgtg

SEQ ID NO: 129487 - DNA, 28 bp, Artificial Sequence
  Description of Artificial Sequence: Synthetic oligonucleotide
catgtgtcacgcagtgatgcctgtgtgc

SEQ ID NO: 129488 - DNA, 29 bp, Artificial Sequence
  Description of Artificial Sequence: Synthetic oligonucleotide
atgtgtcacgcagtgatgcctgtgtgctg

SEQ ID NO: 129489 - DNA, 28 bp, Artificial Sequence
  Description of Artificial Sequence: Synthetic oligonucleotide
tgtgtcacgcagtgatgcctgtgtgctg

SEQ ID NO: 129490 - DNA, 27 bp, Artificial Sequence
  Description of Artificial Sequence: Synthetic oligonucleotide
gtgtcacgcagtgatgcctgtgtgctg

SEQ ID NO: 129491 - DNA, 29 bp, Artificial Sequence
  Description of Artificial Sequence: Synthetic oligonucleotide
tgtcacgcagtgatgcctgtgtgctgtac

SEQ ID NO: 129492 - DNA, 28 bp, Artificial Sequence
  Description of Artificial Sequence: Synthetic oligonucleotide
gtcacgcagtgatgcctgtgtgctgtac

SEQ ID NO: 129493 - DNA, 28 bp, Artificial Sequence
  Description of Artificial Sequence: Synthetic oligonucleotide
tcacgcagtgatgcctgtgtgctgtacg

SEQ ID NO: 129494 - DNA, 27 bp, Artificial Sequence
  Description of Artificial Sequence: Synthetic oligonucleotide
cacgcagtgatgcctgtgtgctgtacg

SEQ ID NO: 129495 - DNA, 28 bp, Artificial Sequence
  Description of Artificial Sequence: Synthetic oligonucleotide
acgcagtgatgcctgtgtgctgtacgtg

SEQ ID NO: 129496 - DNA, 27 bp, Artificial Sequence
  Description of Artificial Sequence: Synthetic oligonucleotide
cgcagtgatgcctgtgtgctgtacgtg

SEQ ID NO: 129497 - DNA, 27 bp, Artificial Sequence
  Description of Artificial Sequence: Synthetic oligonucleotide
gcagtgatgcctgtgtgctgtacgtgg

SEQ ID NO: 129498 - DNA, 28 bp, Artificial Sequence
  Description of Artificial Sequence: Synthetic oligonucleotide
cagtgatgcctgtgtgctgtacgtggag

SEQ ID NO: 129499 - DNA, 31 bp, Artificial Sequence
  Description of Artificial Sequence: Synthetic oligonucleotide
agtgatgcctgtgtgctgtacgtggagttac

SEQ ID NO: 129500 - DNA, 30 bp, Artificial Sequence
  Description of Artificial Sequence: Synthetic oligonucleotide
gtgatgcctgtgtgctgtacgtggagttac

SEQ ID NO: 129501 - DNA, 31 bp, Artificial Sequence
  Description of Artificial Sequence: Synthetic oligonucleotide
tgatgcctgtgtgctgtacgtggagttacag

SEQ ID NO: 129502 - DNA, 30 bp, Artificial Sequence
  Description of Artificial Sequence: Synthetic oligonucleotide
gatgcctgtgtgctgtacgtggagttacag

SEQ ID NO: 129503 - DNA, 32 bp, Artificial Sequence
  Description of Artificial Sequence: Synthetic oligonucleotide
atgcctgtgtgctgtacgtggagttacagaag

SEQ ID NO: 129504 - DNA, 31 bp, Artificial Sequence
  Description of Artificial Sequence: Synthetic oligonucleotide
tgcctgtgtgctgtacgtggagttacagaag

SEQ ID NO: 129505 - DNA, 30 bp, Artificial Sequence
  Description of Artificial Sequence: Synthetic oligonucleotide
gcctgtgtgctgtacgtggagttacagaag

SEQ ID NO: 129506 - DNA, 30 bp, Artificial Sequence
  Description of Artificial Sequence: Synthetic oligonucleotide
cctgtgtgctgtacgtggagttacagaagc

SEQ ID NO: 129507 - DNA, 31 bp, Artificial Sequence
  Description of Artificial Sequence: Synthetic oligonucleotide
ctgtgtgctgtacgtggagttacagaagctc

SEQ ID NO: 129508 - DNA, 31 bp, Artificial Sequence
  Description of Artificial Sequence: Synthetic oligonucleotide
tgtgtgctgtacgtggagttacagaagctcc

SEQ ID NO: 129509 - DNA, 30 bp, Artificial Sequence
  Description of Artificial Sequence: Synthetic oligonucleotide
gtgtgctgtacgtggagttacagaagctcc

SEQ ID NO: 129510 - DNA, 31 bp, Artificial Sequence
  Description of Artificial Sequence: Synthetic oligonucleotide
tgtgctgtacgtggagttacagaagctcctg

SEQ ID NO: 129511 - DNA, 30 bp, Artificial Sequence
  Description of Artificial Sequence: Synthetic oligonucleotide
gtgctgtacgtggagttacagaagctcctg

SEQ ID NO: 129512 - DNA, 30 bp, Artificial Sequence
  Description of Artificial Sequence: Synthetic oligonucleotide
tgctgtacgtggagttacagaagctcctgg

SEQ ID NO: 129513 - DNA, 29 bp, Artificial Sequence
  Description of Artificial Sequence: Synthetic oligonucleotide
gctgtacgtggagttacagaagctcctgg

SEQ ID NO: 129514 - DNA, 30 bp, Artificial Sequence
  Description of Artificial Sequence: Synthetic oligonucleotide
ctgtacgtggagttacagaagctcctggag

SEQ ID NO: 129515 - DNA, 30 bp, Artificial Sequence
  Description of Artificial Sequence: Synthetic oligonucleotide
tgtacgtggagttacagaagctcctggagc

SEQ ID NO: 129516 - DNA, 29 bp, Artificial Sequence
  Description of Artificial Sequence: Synthetic oligonucleotide
gtacgtggagttacagaagctcctggagc

SEQ ID NO: 129517 - DNA, 29 bp, Artificial Sequence
  Description of Artificial Sequence: Synthetic oligonucleotide
tacgtggagttacagaagctcctggagcc

SEQ ID NO: 129518 - DNA, 28 bp, Artificial Sequence
  Description of Artificial Sequence: Synthetic oligonucleotide
acgtggagttacagaagctcctggagcc

SEQ ID NO: 129519 - DNA, 27 bp, Artificial Sequence
  Description of Artificial Sequence: Synthetic oligonucleotide
cgtggagttacagaagctcctggagcc

SEQ ID NO: 129520 - DNA, 27 bp, Artificial Sequence
  Description of Artificial Sequence: Synthetic oligonucleotide
gtggagttacagaagctcctggagccg

SEQ ID NO: 129521 - DNA, 27 bp, Artificial Sequence
  Description of Artificial Sequence: Synthetic oligonucleotide
tggagttacagaagctcctggagccgg

SEQ ID NO: 129522 - DNA, 27 bp, Artificial Sequence
  Description of Artificial Sequence: Synthetic oligonucleotide
ggagttacagaagctcctggagccgga

SEQ ID NO: 129523 - DNA, 27 bp, Artificial Sequence
  Description of Artificial Sequence: Synthetic oligonucleotide
gagttacagaagctcctggagccggag

SEQ ID NO: 129524 - DNA, 27 bp, Artificial Sequence
  Description of Artificial Sequence: Synthetic oligonucleotide
agttacagaagctcctggagccggagc

SEQ ID NO: 129525 - DNA, 26 bp, Artificial Sequence
  Description of Artificial Sequence: Synthetic oligonucleotide
gttacagaagctcctggagccggagc

SEQ ID NO: 129526 - DNA, 27 bp, Artificial Sequence
  Description of Artificial Sequence: Synthetic oligonucleotide
ttacagaagctcctggagccggagcca

SEQ ID NO: 129527 - DNA, 26 bp, Artificial Sequence
  Description of Artificial Sequence: Synthetic oligonucleotide
tacagaagctcctggagccggagcca

SEQ ID NO: 129528 - DNA, 25 bp, Artificial Sequence
  Description of Artificial Sequence: Synthetic oligonucleotide
acagaagctcctggagccggagcca

SEQ ID NO: 129529 - DNA, 24 bp, Artificial Sequence
  Description of Artificial Sequence: Synthetic oligonucleotide
cagaagctcctggagccggagcca

SEQ ID NO: 129530 - DNA, 25 bp, Artificial Sequence
  Description of Artificial Sequence: Synthetic oligonucleotide
agaagctcctggagccggagccaga

SEQ ID NO: 129531 - DNA, 24 bp, Artificial Sequence
  Description of Artificial Sequence: Synthetic oligonucleotide
gaagctcctggagccggagccaga

SEQ ID NO: 129532 - DNA, 24 bp, Artificial Sequence
  Description of Artificial Sequence: Synthetic oligonucleotide
aagctcctggagccggagccagag

SEQ ID NO: 129533 - DNA, 23 bp, Artificial Sequence
  Description of Artificial Sequence: Synthetic oligonucleotide
agctcctggagccggagccagag

SEQ ID NO: 129534 - DNA, 22 bp, Artificial Sequence
  Description of Artificial Sequence: Synthetic oligonucleotide
gctcctggagccggagccagag

SEQ ID NO: 129535 - DNA, 23 bp, Artificial Sequence
  Description of Artificial Sequence: Synthetic oligonucleotide
ctcctggagccggagccagagga

SEQ ID NO: 129536 - DNA, 23 bp, Artificial Sequence
  Description of Artificial Sequence: Synthetic oligonucleotide
tcctggagccggagccagaggag

SEQ ID NO: 129537 - DNA, 22 bp, Artificial Sequence
  Description of Artificial Sequence: Synthetic oligonucleotide
cctggagccggagccagaggag

SEQ ID NO: 129538 - DNA, 24 bp, Artificial Sequence
  Description of Artificial Sequence: Synthetic oligonucleotide
ctggagccggagccagaggaggat

SEQ ID NO: 129539 - DNA, 24 bp, Artificial Sequence
  Description of Artificial Sequence: Synthetic oligonucleotide
tggagccggagccagaggaggatg

SEQ ID NO: 129540 - DNA, 23 bp, Artificial Sequence
  Description of Artificial Sequence: Synthetic oligonucleotide
ggagccggagccagaggaggatg

SEQ ID NO: 129541 - DNA, 23 bp, Artificial Sequence
  Description of Artificial Sequence: Synthetic oligonucleotide
gagccggagccagaggaggatgc

SEQ ID NO: 129542 - DNA, 24 bp, Artificial Sequence
  Description of Artificial Sequence: Synthetic oligonucleotide
agccggagccagaggaggatgcca

SEQ ID NO: 129543 - DNA, 23 bp, Artificial Sequence
  Description of Artificial Sequence: Synthetic oligonucleotide
gccggagccagaggaggatgcca

SEQ ID NO: 129544 - DNA, 23 bp, Artificial Sequence
  Description of Artificial Sequence: Synthetic oligonucleotide
ccggagccagaggaggatgccag

SEQ ID NO: 129545 - DNA, 23 bp, Artificial Sequence
  Description of Artificial Sequence: Synthetic oligonucleotide
cggagccagaggaggatgccagc

SEQ ID NO: 129546 - DNA, 25 bp, Artificial Sequence
  Description of Artificial Sequence: Synthetic oligonucleotide
ggagccagaggaggatgccagccat

SEQ ID NO: 129547 - DNA, 25 bp, Artificial Sequence
  Description of Artificial Sequence: Synthetic oligonucleotide
gagccagaggaggatgccagccatg

SEQ ID NO: 129548 - DNA, 25 bp, Artificial Sequence
  Description of Artificial Sequence: Synthetic oligonucleotide
agccagaggaggatgccagccatgc

SEQ ID NO: 129549 - DNA, 24 bp, Artificial Sequence
  Description of Artificial Sequence: Synthetic oligonucleotide
gccagaggaggatgccagccatgc

SEQ ID NO: 129550 - DNA, 24 bp, Artificial Sequence
  Description of Artificial Sequence: Synthetic oligonucleotide
ccagaggaggatgccagccatgcc

SEQ ID NO: 129551 - DNA, 26 bp, Artificial Sequence
  Description of Artificial Sequence: Synthetic oligonucleotide
cagaggaggatgccagccatgcccat

SEQ ID NO: 129552 - DNA, 26 bp, Artificial Sequence
  Description of Artificial Sequence: Synthetic oligonucleotide
agaggaggatgccagccatgcccatc

SEQ ID NO: 129553 - DNA, 25 bp, Artificial Sequence
  Description of Artificial Sequence: Synthetic oligonucleotide
gaggaggatgccagccatgcccatc

SEQ ID NO: 129554 - DNA, 26 bp, Artificial Sequence
  Description of Artificial Sequence: Synthetic oligonucleotide
aggaggatgccagccatgcccatcct

SEQ ID NO: 129555 - DNA, 25 bp, Artificial Sequence
  Description of Artificial Sequence: Synthetic oligonucleotide
ggaggatgccagccatgcccatcct

SEQ ID NO: 129556 - DNA, 26 bp, Artificial Sequence
  Description of Artificial Sequence: Synthetic oligonucleotide
gaggatgccagccatgcccatcctga

SEQ ID NO: 129557 - DNA, 26 bp, Artificial Sequence
  Description of Artificial Sequence: Synthetic oligonucleotide
aggatgccagccatgcccatcctgag

SEQ ID NO: 129558 - DNA, 25 bp, Artificial Sequence
  Description of Artificial Sequence: Synthetic oligonucleotide
ggatgccagccatgcccatcctgag

SEQ ID NO: 129559 - DNA, 25 bp, Artificial Sequence
  Description of Artificial Sequence: Synthetic oligonucleotide
gatgccagccatgcccatcctgagc

SEQ ID NO: 129560 - DNA, 26 bp, Artificial Sequence
  Description of Artificial Sequence: Synthetic oligonucleotide
atgccagccatgcccatcctgagcct

SEQ ID NO: 129561 - DNA, 25 bp, Artificial Sequence
  Description of Artificial Sequence: Synthetic oligonucleotide
tgccagccatgcccatcctgagcct

SEQ ID NO: 129562 - DNA, 24 bp, Artificial Sequence
  Description of Artificial Sequence: Synthetic oligonucleotide
gccagccatgcccatcctgagcct

SEQ ID NO: 129563 - DNA, 24 bp, Artificial Sequence
  Description of Artificial Sequence: Synthetic oligonucleotide
ccagccatgcccatcctgagcctg

SEQ ID NO: 129564 - DNA, 24 bp, Artificial Sequence
  Description of Artificial Sequence: Synthetic oligonucleotide
cagccatgcccatcctgagcctgc

SEQ ID NO: 129565 - DNA, 25 bp, Artificial Sequence
  Description of Artificial Sequence: Synthetic oligonucleotide
agccatgcccatcctgagcctgcca

SEQ ID NO: 129566 - DNA, 24 bp, Artificial Sequence
  Description of Artificial Sequence: Synthetic oligonucleotide
gccatgcccatcctgagcctgcca

SEQ ID NO: 129567 - DNA, 25 bp, Artificial Sequence
  Description of Artificial Sequence: Synthetic oligonucleotide
ccatgcccatcctgagcctgccact

SEQ ID NO: 129568 - DNA, 25 bp, Artificial Sequence
  Description of Artificial Sequence: Synthetic oligonucleotide
catgcccatcctgagcctgccactg

SEQ ID NO: 129569 - DNA, 25 bp, Artificial Sequence
  Description of Artificial Sequence: Synthetic oligonucleotide
atgcccatcctgagcctgccactgc

SEQ ID NO: 129570 - DNA, 24 bp, Artificial Sequence
  Description of Artificial Sequence: Synthetic oligonucleotide
tgcccatcctgagcctgccactgc

SEQ ID NO: 129571 - DNA, 23 bp, Artificial Sequence
  Description of Artificial Sequence: Synthetic oligonucleotide
gcccatcctgagcctgccactgc

SEQ ID NO: 129572 - DNA, 23 bp, Artificial Sequence
  Description of Artificial Sequence: Synthetic oligonucleotide
cccatcctgagcctgccactgcc

SEQ ID NO: 129573 - DNA, 24 bp, Artificial Sequence
  Description of Artificial Sequence: Synthetic oligonucleotide
ccatcctgagcctgccactgccca

SEQ ID NO: 129574 - DNA, 25 bp, Artificial Sequence
  Description of Artificial Sequence: Synthetic oligonucleotide
catcctgagcctgccactgcccaca

SEQ ID NO: 129575 - DNA, 26 bp, Artificial Sequence
  Description of Artificial Sequence: Synthetic oligonucleotide
atcctgagcctgccactgcccacaga

SEQ ID NO: 129576 - DNA, 25 bp, Artificial Sequence
  Description of Artificial Sequence: Synthetic oligonucleotide
tcctgagcctgccactgcccacaga

SEQ ID NO: 129577 - DNA, 24 bp, Artificial Sequence
  Description of Artificial Sequence: Synthetic oligonucleotide
cctgagcctgccactgcccacaga

SEQ ID NO: 129578 - DNA, 24 bp, Artificial Sequence
  Description of Artificial Sequence: Synthetic oligonucleotide
ctgagcctgccactgcccacagag

SEQ ID NO: 129579 - DNA, 25 bp, Artificial Sequence
  Description of Artificial Sequence: Synthetic oligonucleotide
tgagcctgccactgcccacagagct

SEQ ID NO: 129580 - DNA, 24 bp, Artificial Sequence
  Description of Artificial Sequence: Synthetic oligonucleotide
gagcctgccactgcccacagagct

SEQ ID NO: 129581 - DNA, 24 bp, Artificial Sequence
  Description of Artificial Sequence: Synthetic oligonucleotide
agcctgccactgcccacagagctg

SEQ ID NO: 129582 - DNA, 23 bp, Artificial Sequence
  Description of Artificial Sequence: Synthetic oligonucleotide
gcctgccactgcccacagagctg

SEQ ID NO: 129583 - DNA, 24 bp, Artificial Sequence
  Description of Artificial Sequence: Synthetic oligonucleotide
cctgccactgcccacagagctgca

SEQ ID NO: 129584 - DNA, 26 bp, Artificial Sequence
  Description of Artificial Sequence: Synthetic oligonucleotide
ctgccactgcccacagagctgcagaa

SEQ ID NO: 129585 - DNA, 27 bp, Artificial Sequence
  Description of Artificial Sequence: Synthetic oligonucleotide
tgccactgcccacagagctgcagaaga

SEQ ID NO: 129586 - DNA, 27 bp, Artificial Sequence
  Description of Artificial Sequence: Synthetic oligonucleotide
gccactgcccacagagctgcagaagat

SEQ ID NO: 129587 - DNA, 28 bp, Artificial Sequence
  Description of Artificial Sequence: Synthetic oligonucleotide
ccactgcccacagagctgcagaagatag

SEQ ID NO: 129588 - DNA, 29 bp, Artificial Sequence
  Description of Artificial Sequence: Synthetic oligonucleotide
cactgcccacagagctgcagaagatagag

SEQ ID NO: 129589 - DNA, 30 bp, Artificial Sequence
  Description of Artificial Sequence: Synthetic oligonucleotide
actgcccacagagctgcagaagatagagag

SEQ ID NO: 129590 - DNA, 29 bp, Artificial Sequence
  Description of Artificial Sequence: Synthetic oligonucleotide
ctgcccacagagctgcagaagatagagag

SEQ ID NO: 129591 - DNA, 29 bp, Artificial Sequence
  Description of Artificial Sequence: Synthetic oligonucleotide
tgcccacagagctgcagaagatagagagc

SEQ ID NO: 129592 - DNA, 28 bp, Artificial Sequence
  Description of Artificial Sequence: Synthetic oligonucleotide
gcccacagagctgcagaagatagagagc

SEQ ID NO: 129593 - DNA, 29 bp, Artificial Sequence
  Description of Artificial Sequence: Synthetic oligonucleotide
cccacagagctgcagaagatagagagctc

SEQ ID NO: 129594 - DNA, 30 bp, Artificial Sequence
  Description of Artificial Sequence: Synthetic oligonucleotide
ccacagagctgcagaagatagagagctctc

SEQ ID NO: 129595 - DNA, 31 bp, Artificial Sequence
  Description of Artificial Sequence: Synthetic oligonucleotide
cacagagctgcagaagatagagagctctctg

SEQ ID NO: 129596 - DNA, 32 bp, Artificial Sequence
  Description of Artificial Sequence: Synthetic oligonucleotide
acagagctgcagaagatagagagctctctgtg

SEQ ID NO: 129597 - DNA, 31 bp, Artificial Sequence
  Description of Artificial Sequence: Synthetic oligonucleotide
cagagctgcagaagatagagagctctctgtg

SEQ ID NO: 129598 - DNA, 31 bp, Artificial Sequence
  Description of Artificial Sequence: Synthetic oligonucleotide
agagctgcagaagatagagagctctctgtgg

SEQ ID NO: 129599 - DNA, 30 bp, Artificial Sequence
  Description of Artificial Sequence: Synthetic oligonucleotide
gagctgcagaagatagagagctctctgtgg

SEQ ID NO: 129600 - DNA, 30 bp, Artificial Sequence
  Description of Artificial Sequence: Synthetic oligonucleotide
agctgcagaagatagagagctctctgtggg

SEQ ID NO: 129601 - DNA, 29 bp, Artificial Sequence
  Description of Artificial Sequence: Synthetic oligonucleotide
gctgcagaagatagagagctctctgtggg

SEQ ID NO: 129602 - DNA, 29 bp, Artificial Sequence
  Description of Artificial Sequence: Synthetic oligonucleotide
ctgcagaagatagagagctctctgtgggg

SEQ ID NO: 129603 - DNA, 29 bp, Artificial Sequence
  Description of Artificial Sequence: Synthetic oligonucleotide
tgcagaagatagagagctctctgtggggc

SEQ ID NO: 129604 - DNA, 28 bp, Artificial Sequence
  Description of Artificial Sequence: Synthetic oligonucleotide
gcagaagatagagagctctctgtggggc

SEQ ID NO: 129605 - DNA, 28 bp, Artificial Sequence
  Description of Artificial Sequence: Synthetic oligonucleotide
cagaagatagagagctctctgtggggcc

SEQ ID NO: 129606 - DNA, 29 bp, Artificial Sequence
  Description of Artificial Sequence: Synthetic oligonucleotide
agaagatagagagctctctgtggggccag

SEQ ID NO: 129607 - DNA, 28 bp, Artificial Sequence
  Description of Artificial Sequence: Synthetic oligonucleotide
gaagatagagagctctctgtggggccag

SEQ ID NO: 129608 - DNA, 28 bp, Artificial Sequence
  Description of Artificial Sequence: Synthetic oligonucleotide
aagatagagagctctctgtggggccagg

SEQ ID NO: 129609 - DNA, 27 bp, Artificial Sequence
  Description of Artificial Sequence: Synthetic oligonucleotide
agatagagagctctctgtggggccagg

SEQ ID NO: 129610 - DNA, 26 bp, Artificial Sequence
  Description of Artificial Sequence: Synthetic oligonucleotide
gatagagagctctctgtggggccagg

SEQ ID NO: 129611 - DNA, 26 bp, Artificial Sequence
  Description of Artificial Sequence: Synthetic oligonucleotide
atagagagctctctgtggggccaggg

SEQ ID NO: 129612 - DNA, 25 bp, Artificial Sequence
  Description of Artificial Sequence: Synthetic oligonucleotide
tagagagctctctgtggggccaggg

SEQ ID NO: 129613 - DNA, 24 bp, Artificial Sequence
  Description of Artificial Sequence: Synthetic oligonucleotide
agagagctctctgtggggccaggg

SEQ ID NO: 129614 - DNA, 23 bp, Artificial Sequence
  Description of Artificial Sequence: Synthetic oligonucleotide
gagagctctctgtggggccaggg

SEQ ID NO: 129615 - DNA, 24 bp, Artificial Sequence
  Description of Artificial Sequence: Synthetic oligonucleotide
agagctctctgtggggccagggga

SEQ ID NO: 129616 - DNA, 23 bp, Artificial Sequence
  Description of Artificial Sequence: Synthetic oligonucleotide
gagctctctgtggggccagggga

SEQ ID NO: 129617 - DNA, 23 bp, Artificial Sequence
  Description of Artificial Sequence: Synthetic oligonucleotide
agctctctgtggggccaggggag

SEQ ID NO: 129618 - DNA, 22 bp, Artificial Sequence
  Description of Artificial Sequence: Synthetic oligonucleotide
gctctctgtggggccaggggag

SEQ ID NO: 129619 - DNA, 23 bp, Artificial Sequence
  Description of Artificial Sequence: Synthetic oligonucleotide
ctctctgtggggccaggggaggt

SEQ ID NO: 129620 - DNA, 24 bp, Artificial Sequence
  Description of Artificial Sequence: Synthetic oligonucleotide
tctctgtggggccaggggaggtga

SEQ ID NO: 129621 - DNA, 23 bp, Artificial Sequence
  Description of Artificial Sequence: Synthetic oligonucleotide
ctctgtggggccaggggaggtga

SEQ ID NO: 129622 - DNA, 24 bp, Artificial Sequence
  Description of Artificial Sequence: Synthetic oligonucleotide
tctgtggggccaggggaggtgaca

SEQ ID NO: 129623 - DNA, 23 bp, Artificial Sequence
  Description of Artificial Sequence: Synthetic oligonucleotide
ctgtggggccaggggaggtgaca

SEQ ID NO: 129624 - DNA, 23 bp, Artificial Sequence
  Description of Artificial Sequence: Synthetic oligonucleotide
tgtggggccaggggaggtgacac

SEQ ID NO: 129625 - DNA, 22 bp, Artificial Sequence
  Description of Artificial Sequence: Synthetic oligonucleotide
gtggggccaggggaggtgacac

SEQ ID NO: 129626 - DNA, 23 bp, Artificial Sequence
  Description of Artificial Sequence: Synthetic oligonucleotide
tggggccaggggaggtgacacca

SEQ ID NO: 129627 - DNA, 22 bp, Artificial Sequence
  Description of Artificial Sequence: Synthetic oligonucleotide
ggggccaggggaggtgacacca

SEQ ID NO: 129628 - DNA, 22 bp, Artificial Sequence
  Description of Artificial Sequence: Synthetic oligonucleotide
gggccaggggaggtgacaccag

SEQ ID NO: 129629 - DNA, 23 bp, Artificial Sequence
  Description of Artificial Sequence: Synthetic oligonucleotide
ggccaggggaggtgacaccagga

SEQ ID NO: 129630 - DNA, 24 bp, Artificial Sequence
  Description of Artificial Sequence: Synthetic oligonucleotide
gccaggggaggtgacaccaggaga

SEQ ID NO: 129631 - DNA, 25 bp, Artificial Sequence
  Description of Artificial Sequence: Synthetic oligonucleotide
ccaggggaggtgacaccaggagact

SEQ ID NO: 129632 - DNA, 25 bp, Artificial Sequence
  Description of Artificial Sequence: Synthetic oligonucleotide
caggggaggtgacaccaggagactc

SEQ ID NO: 129633 - DNA, 26 bp, Artificial Sequence
  Description of Artificial Sequence: Synthetic oligonucleotide
aggggaggtgacaccaggagactcca

SEQ ID NO: 129634 - DNA, 25 bp, Artificial Sequence
  Description of Artificial Sequence: Synthetic oligonucleotide
ggggaggtgacaccaggagactcca

SEQ ID NO: 129635 - DNA, 25 bp, Artificial Sequence
  Description of Artificial Sequence: Synthetic oligonucleotide
gggaggtgacaccaggagactccag

SEQ ID NO: 129636 - DNA, 27 bp, Artificial Sequence
  Description of Artificial Sequence: Synthetic oligonucleotide
ggaggtgacaccaggagactccaggat

SEQ ID NO: 129637 - DNA, 27 bp, Artificial Sequence
  Description of Artificial Sequence: Synthetic oligonucleotide
gaggtgacaccaggagactccaggatg

SEQ ID NO: 129638 - DNA, 27 bp, Artificial Sequence
  Description of Artificial Sequence: Synthetic oligonucleotide
aggtgacaccaggagactccaggatgc

SEQ ID NO: 129639 - DNA, 26 bp, Artificial Sequence
  Description of Artificial Sequence: Synthetic oligonucleotide
ggtgacaccaggagactccaggatgc

SEQ ID NO: 129640 - DNA, 27 bp, Artificial Sequence
  Description of Artificial Sequence: Synthetic oligonucleotide
gtgacaccaggagactccaggatgcca

SEQ ID NO: 129641 - DNA, 27 bp, Artificial Sequence
  Description of Artificial Sequence: Synthetic oligonucleotide
tgacaccaggagactccaggatgccag

SEQ ID NO: 129642 - DNA, 26 bp, Artificial Sequence
  Description of Artificial Sequence: Synthetic oligonucleotide
gacaccaggagactccaggatgccag

SEQ ID NO: 129643 - DNA, 27 bp, Artificial Sequence
  Description of Artificial Sequence: Synthetic oligonucleotide
acaccaggagactccaggatgccagca

SEQ ID NO: 129644 - DNA, 26 bp, Artificial Sequence
  Description of Artificial Sequence: Synthetic oligonucleotide
caccaggagactccaggatgccagca

SEQ ID NO: 129645 - DNA, 26 bp, Artificial Sequence
  Description of Artificial Sequence: Synthetic oligonucleotide
accaggagactccaggatgccagcag

SEQ ID NO: 129646 - DNA, 25 bp, Artificial Sequence
  Description of Artificial Sequence: Synthetic oligonucleotide
ccaggagactccaggatgccagcag

SEQ ID NO: 129647 - DNA, 25 bp, Artificial Sequence
  Description of Artificial Sequence: Synthetic oligonucleotide
caggagactccaggatgccagcagg

SEQ ID NO: 129648 - DNA, 26 bp, Artificial Sequence
  Description of Artificial Sequence: Synthetic oligonucleotide
aggagactccaggatgccagcaggga

SEQ ID NO: 129649 - DNA, 25 bp, Artificial Sequence
  Description of Artificial Sequence: Synthetic oligonucleotide
ggagactccaggatgccagcaggga

SEQ ID NO: 129650 - DNA, 26 bp, Artificial Sequence
  Description of Artificial Sequence: Synthetic oligonucleotide
gagactccaggatgccagcagggact

SEQ ID NO: 129651 - DNA, 27 bp, Artificial Sequence
  Description of Artificial Sequence: Synthetic oligonucleotide
agactccaggatgccagcagggactga

SEQ ID NO: 129652 - DNA, 26 bp, Artificial Sequence
  Description of Artificial Sequence: Synthetic oligonucleotide
gactccaggatgccagcagggactga

SEQ ID NO: 129653 - DNA, 27 bp, Artificial Sequence
  Description of Artificial Sequence: Synthetic oligonucleotide
actccaggatgccagcagggactgaga

SEQ ID NO: 129654 - DNA, 26 bp, Artificial Sequence
  Description of Artificial Sequence: Synthetic oligonucleotide
ctccaggatgccagcagggactgaga

SEQ ID NO: 129655 - DNA, 26 bp, Artificial Sequence
  Description of Artificial Sequence: Synthetic oligonucleotide
tccaggatgccagcagggactgagac

SEQ ID NO: 129656 - DNA, 25 bp, Artificial Sequence
  Description of Artificial Sequence: Synthetic oligonucleotide
ccaggatgccagcagggactgagac

SEQ ID NO: 129657 - DNA, 25 bp, Artificial Sequence
  Description of Artificial Sequence: Synthetic oligonucleotide
caggatgccagcagggactgagacg

SEQ ID NO: 129658 - DNA, 26 bp, Artificial Sequence
  Description of Artificial Sequence: Synthetic oligonucleotide
aggatgccagcagggactgagacggt

SEQ ID NO: 129659 - DNA, 25 bp, Artificial Sequence
  Description of Artificial Sequence: Synthetic oligonucleotide
ggatgccagcagggactgagacggt

SEQ ID NO: 129660 - DNA, 26 bp, Artificial Sequence
  Description of Artificial Sequence: Synthetic oligonucleotide
gatgccagcagggactgagacggtgt

SEQ ID NO: 129661 - DNA, 27 bp, Artificial Sequence
  Description of Artificial Sequence: Synthetic oligonucleotide
atgccagcagggactgagacggtgtga

SEQ ID NO: 129662 - DNA, 31 bp, Artificial Sequence
  Description of Artificial Sequence: Synthetic oligonucleotide
atgggtcaaagtcagagtggtggtcatggtc

SEQ ID NO: 129663 - DNA, 30 bp, Artificial Sequence
  Description of Artificial Sequence: Synthetic oligonucleotide
tgggtcaaagtcagagtggtggtcatggtc

SEQ ID NO: 129664 - DNA, 29 bp, Artificial Sequence
  Description of Artificial Sequence: Synthetic oligonucleotide
gggtcaaagtcagagtggtggtcatggtc

SEQ ID NO: 129665 - DNA, 29 bp, Artificial Sequence
  Description of Artificial Sequence: Synthetic oligonucleotide
ggtcaaagtcagagtggtggtcatggtcc

SEQ ID NO: 129666 - DNA, 30 bp, Artificial Sequence
  Description of Artificial Sequence: Synthetic oligonucleotide
gtcaaagtcagagtggtggtcatggtcctg

SEQ ID NO: 129667 - DNA, 30 bp, Artificial Sequence
  Description of Artificial Sequence: Synthetic oligonucleotide
tcaaagtcagagtggtggtcatggtcctgg

SEQ ID NO: 129668 - DNA, 29 bp, Artificial Sequence
  Description of Artificial Sequence: Synthetic oligonucleotide
caaagtcagagtggtggtcatggtcctgg

SEQ ID NO: 129669 - DNA, 30 bp, Artificial Sequence
  Description of Artificial Sequence: Synthetic oligonucleotide
aaagtcagagtggtggtcatggtcctggag

SEQ ID NO: 129670 - DNA, 29 bp, Artificial Sequence
  Description of Artificial Sequence: Synthetic oligonucleotide
aagtcagagtggtggtcatggtcctggag

SEQ ID NO: 129671 - DNA, 28 bp, Artificial Sequence
  Description of Artificial Sequence: Synthetic oligonucleotide
agtcagagtggtggtcatggtcctggag

SEQ ID NO: 129672 - DNA, 27 bp, Artificial Sequence
  Description of Artificial Sequence: Synthetic oligonucleotide
gtcagagtggtggtcatggtcctggag

SEQ ID NO: 129673 - DNA, 27 bp, Artificial Sequence
  Description of Artificial Sequence: Synthetic oligonucleotide
tcagagtggtggtcatggtcctggagg

SEQ ID NO: 129674 - DNA, 27 bp, Artificial Sequence
  Description of Artificial Sequence: Synthetic oligonucleotide
cagagtggtggtcatggtcctggaggt

SEQ ID NO: 129675 - DNA, 27 bp, Artificial Sequence
  Description of Artificial Sequence: Synthetic oligonucleotide
agagtggtggtcatggtcctggaggtg

SEQ ID NO: 129676 - DNA, 26 bp, Artificial Sequence
  Description of Artificial Sequence: Synthetic oligonucleotide
gagtggtggtcatggtcctggaggtg

SEQ ID NO: 129677 - DNA, 26 bp, Artificial Sequence
  Description of Artificial Sequence: Synthetic oligonucleotide
agtggtggtcatggtcctggaggtgg

SEQ ID NO: 129678 - DNA, 25 bp, Artificial Sequence
  Description of Artificial Sequence: Synthetic oligonucleotide
gtggtggtcatggtcctggaggtgg

SEQ ID NO: 129679 - DNA, 27 bp, Artificial Sequence
  Description of Artificial Sequence: Synthetic oligonucleotide
tggtggtcatggtcctggaggtggcaa

SEQ ID NO: 129680 - DNA, 26 bp, Artificial Sequence
  Description of Artificial Sequence: Synthetic oligonucleotide
ggtggtcatggtcctggaggtggcaa

SEQ ID NO: 129681 - DNA, 27 bp, Artificial Sequence
  Description of Artificial Sequence: Synthetic oligonucleotide
gtggtcatggtcctggaggtggcaaga

SEQ ID NO: 129682 - DNA, 28 bp, Artificial Sequence
  Description of Artificial Sequence: Synthetic oligonucleotide
tggtcatggtcctggaggtggcaagaag

SEQ ID NO: 129683 - DNA, 27 bp, Artificial Sequence
  Description of Artificial Sequence: Synthetic oligonucleotide
ggtcatggtcctggaggtggcaagaag

SEQ ID NO: 129684 - DNA, 27 bp, Artificial Sequence
  Description of Artificial Sequence: Synthetic oligonucleotide
gtcatggtcctggaggtggcaagaagg

SEQ ID NO: 129685 - DNA, 29 bp, Artificial Sequence
  Description of Artificial Sequence: Synthetic oligonucleotide
tcatggtcctggaggtggcaagaaggatg

SEQ ID NO: 129686 - DNA, 28 bp, Artificial Sequence
  Description of Artificial Sequence: Synthetic oligonucleotide
catggtcctggaggtggcaagaaggatg

SEQ ID NO: 129687 - DNA, 29 bp, Artificial Sequence
  Description of Artificial Sequence: Synthetic oligonucleotide
atggtcctggaggtggcaagaaggatgac

SEQ ID NO: 129688 - DNA, 28 bp, Artificial Sequence
  Description of Artificial Sequence: Synthetic oligonucleotide
tggtcctggaggtggcaagaaggatgac

SEQ ID NO: 129689 - DNA, 27 bp, Artificial Sequence
  Description of Artificial Sequence: Synthetic oligonucleotide
ggtcctggaggtggcaagaaggatgac

SEQ ID NO: 129690 - DNA, 29 bp, Artificial Sequence
  Description of Artificial Sequence: Synthetic oligonucleotide
gtcctggaggtggcaagaaggatgacaag

SEQ ID NO: 129691 - DNA, 29 bp, Artificial Sequence
  Description of Artificial Sequence: Synthetic oligonucleotide
tcctggaggtggcaagaaggatgacaagg

SEQ ID NO: 129692 - DNA, 28 bp, Artificial Sequence
  Description of Artificial Sequence: Synthetic oligonucleotide
cctggaggtggcaagaaggatgacaagg

SEQ ID NO: 129693 - DNA, 29 bp, Artificial Sequence
  Description of Artificial Sequence: Synthetic oligonucleotide
ctggaggtggcaagaaggatgacaaggac

SEQ ID NO: 129694 - DNA, 31 bp, Artificial Sequence
  Description of Artificial Sequence: Synthetic oligonucleotide
tggaggtggcaagaaggatgacaaggacaag

SEQ ID NO: 129695 - DNA, 30 bp, Artificial Sequence
  Description of Artificial Sequence: Synthetic oligonucleotide
ggaggtggcaagaaggatgacaaggacaag

SEQ ID NO: 129696 - DNA, 35 bp, Artificial Sequence
  Description of Artificial Sequence: Synthetic oligonucleotide
gaggtggcaagaaggatgacaaggacaagaaaaag

SEQ ID NO: 129697 - DNA, 41 bp, Artificial Sequence
  Description of Artificial Sequence: Synthetic oligonucleotide
aggtggcaagaaggatgacaaggacaagaaaaagaaatatg

SEQ ID NO: 129698 - DNA, 40 bp, Artificial Sequence
  Description of Artificial Sequence: Synthetic oligonucleotide
ggtggcaagaaggatgacaaggacaagaaaaagaaatatg

SEQ ID NO: 129699 - DNA, 42 bp, Artificial Sequence
  Description of Artificial Sequence: Synthetic oligonucleotide
gtggcaagaaggatgacaaggacaagaaaaagaaatatgaac

SEQ ID NO: 129700 - DNA, 42 bp, Artificial Sequence
  Description of Artificial Sequence: Synthetic oligonucleotide
tggcaagaaggatgacaaggacaagaaaaagaaatatgaacc

SEQ ID NO: 129701 - DNA, 41 bp, Artificial Sequence
  Description of Artificial Sequence: Synthetic oligonucleotide
ggcaagaaggatgacaaggacaagaaaaagaaatatgaacc

SEQ ID NO: 129702 - DNA, 42 bp, Artificial Sequence
  Description of Artificial Sequence: Synthetic oligonucleotide
gcaagaaggatgacaaggacaagaaaaagaaatatgaacctc

SEQ ID NO: 129703 - DNA, 42 bp, Artificial Sequence
  Description of Artificial Sequence: Synthetic oligonucleotide
caagaaggatgacaaggacaagaaaaagaaatatgaacctcc

SEQ ID NO: 129704 - DNA, 43 bp, Artificial Sequence
  Description of Artificial Sequence: Synthetic oligonucleotide
aagaaggatgacaaggacaagaaaaagaaatatgaacctcctg

SEQ ID NO: 129705 - DNA, 42 bp, Artificial Sequence
  Description of Artificial Sequence: Synthetic oligonucleotide
agaaggatgacaaggacaagaaaaagaaatatgaacctcctg

SEQ ID NO: 129706 - DNA, 41 bp, Artificial Sequence
  Description of Artificial Sequence: Synthetic oligonucleotide
gaaggatgacaaggacaagaaaaagaaatatgaacctcctg

SEQ ID NO: 129707 - DNA, 43 bp, Artificial Sequence
  Description of Artificial Sequence: Synthetic oligonucleotide
aaggatgacaaggacaagaaaaagaaatatgaacctcctgtac

SEQ ID NO: 129708 - DNA, 42 bp, Artificial Sequence
  Description of Artificial Sequence: Synthetic oligonucleotide
aggatgacaaggacaagaaaaagaaatatgaacctcctgtac

SEQ ID NO: 129709 - DNA, 41 bp, Artificial Sequence
  Description of Artificial Sequence: Synthetic oligonucleotide
ggatgacaaggacaagaaaaagaaatatgaacctcctgtac

SEQ ID NO: 129710 - DNA, 41 bp, Artificial Sequence
  Description of Artificial Sequence: Synthetic oligonucleotide
gatgacaaggacaagaaaaagaaatatgaacctcctgtacc

SEQ ID NO: 129711 - DNA, 43 bp, Artificial Sequence
  Description of Artificial Sequence: Synthetic oligonucleotide
atgacaaggacaagaaaaagaaatatgaacctcctgtaccaac

SEQ ID NO: 129712 - DNA, 42 bp, Artificial Sequence
  Description of Artificial Sequence: Synthetic oligonucleotide
tgacaaggacaagaaaaagaaatatgaacctcctgtaccaac

SEQ ID NO: 129713 - DNA, 41 bp, Artificial Sequence
  Description of Artificial Sequence: Synthetic oligonucleotide
gacaaggacaagaaaaagaaatatgaacctcctgtaccaac

SEQ ID NO: 129714 - DNA, 43 bp, Artificial Sequence
  Description of Artificial Sequence: Synthetic oligonucleotide
acaaggacaagaaaaagaaatatgaacctcctgtaccaactag

SEQ ID NO: 129715 - DNA, 42 bp, Artificial Sequence
  Description of Artificial Sequence: Synthetic oligonucleotide
caaggacaagaaaaagaaatatgaacctcctgtaccaactag

SEQ ID NO: 129716 - DNA, 43 bp, Artificial Sequence
  Description of Artificial Sequence: Synthetic oligonucleotide
aaggacaagaaaaagaaatatgaacctcctgtaccaactagag

SEQ ID NO: 129717 - DNA, 42 bp, Artificial Sequence
  Description of Artificial Sequence: Synthetic oligonucleotide
aggacaagaaaaagaaatatgaacctcctgtaccaactagag

SEQ ID NO: 129718 - DNA, 41 bp, Artificial Sequence
  Description of Artificial Sequence: Synthetic oligonucleotide
ggacaagaaaaagaaatatgaacctcctgtaccaactagag

SEQ ID NO: 129719 - DNA, 42 bp, Artificial Sequence
  Description of Artificial Sequence: Synthetic oligonucleotide
gacaagaaaaagaaatatgaacctcctgtaccaactagagtg

SEQ ID NO: 129720 - DNA, 42 bp, Artificial Sequence
  Description of Artificial Sequence: Synthetic oligonucleotide
acaagaaaaagaaatatgaacctcctgtaccaactagagtgg

SEQ ID NO: 129721 - DNA, 41 bp, Artificial Sequence
  Description of Artificial Sequence: Synthetic oligonucleotide
caagaaaaagaaatatgaacctcctgtaccaactagagtgg

SEQ ID NO: 129722 - DNA, 41 bp, Artificial Sequence
  Description of Artificial Sequence: Synthetic oligonucleotide
aagaaaaagaaatatgaacctcctgtaccaactagagtggg

SEQ ID NO: 129723 - DNA, 40 bp, Artificial Sequence
  Description of Artificial Sequence: Synthetic oligonucleotide
agaaaaagaaatatgaacctcctgtaccaactagagtggg

SEQ ID NO: 129724 - DNA, 39 bp, Artificial Sequence
  Description of Artificial Sequence: Synthetic oligonucleotide
gaaaaagaaatatgaacctcctgtaccaactagagtggg

SEQ ID NO: 129725 - DNA, 39 bp, Artificial Sequence
  Description of Artificial Sequence: Synthetic oligonucleotide
aaaaagaaatatgaacctcctgtaccaactagagtgggg

SEQ ID NO: 129726 - DNA, 38 bp, Artificial Sequence
  Description of Artificial Sequence: Synthetic oligonucleotide
aaaagaaatatgaacctcctgtaccaactagagtgggg

SEQ ID NO: 129727 - DNA, 37 bp, Artificial Sequence
  Description of Artificial Sequence: Synthetic oligonucleotide
aaagaaatatgaacctcctgtaccaactagagtgggg

SEQ ID NO: 129728 - DNA, 36 bp, Artificial Sequence
  Description of Artificial Sequence: Synthetic oligonucleotide
aagaaatatgaacctcctgtaccaactagagtgggg

SEQ ID NO: 129729 - DNA, 35 bp, Artificial Sequence
  Description of Artificial Sequence: Synthetic oligonucleotide
agaaatatgaacctcctgtaccaactagagtgggg

SEQ ID NO: 129730 - DNA, 34 bp, Artificial Sequence
  Description of Artificial Sequence: Synthetic oligonucleotide
gaaatatgaacctcctgtaccaactagagtgggg

SEQ ID NO: 129731 - DNA, 39 bp, Artificial Sequence
  Description of Artificial Sequence: Synthetic oligonucleotide
aaatatgaacctcctgtaccaactagagtggggaaaaag

SEQ ID NO: 129732 - DNA, 38 bp, Artificial Sequence
  Description of Artificial Sequence: Synthetic oligonucleotide
aatatgaacctcctgtaccaactagagtggggaaaaag

SEQ ID NO: 129733 - DNA, 37 bp, Artificial Sequence
  Description of Artificial Sequence: Synthetic oligonucleotide
atatgaacctcctgtaccaactagagtggggaaaaag

SEQ ID NO: 129734 - DNA, 36 bp, Artificial Sequence
  Description of Artificial Sequence: Synthetic oligonucleotide
tatgaacctcctgtaccaactagagtggggaaaaag

SEQ ID NO: 129735 - DNA, 35 bp, Artificial Sequence
  Description of Artificial Sequence: Synthetic oligonucleotide
atgaacctcctgtaccaactagagtggggaaaaag

SEQ ID NO: 129736 - DNA, 34 bp, Artificial Sequence
  Description of Artificial Sequence: Synthetic oligonucleotide
tgaacctcctgtaccaactagagtggggaaaaag

SEQ ID NO: 129737 - DNA, 33 bp, Artificial Sequence
  Description of Artificial Sequence: Synthetic oligonucleotide
gaacctcctgtaccaactagagtggggaaaaag

SEQ ID NO: 129738 - DNA, 35 bp, Artificial Sequence
  Description of Artificial Sequence: Synthetic oligonucleotide
aacctcctgtaccaactagagtggggaaaaagaag

SEQ ID NO: 129739 - DNA, 34 bp, Artificial Sequence
  Description of Artificial Sequence: Synthetic oligonucleotide
acctcctgtaccaactagagtggggaaaaagaag

SEQ ID NO: 129740 - DNA, 33 bp, Artificial Sequence
  Description of Artificial Sequence: Synthetic oligonucleotide
cctcctgtaccaactagagtggggaaaaagaag

SEQ ID NO: 129741 - DNA, 35 bp, Artificial Sequence
  Description of Artificial Sequence: Synthetic oligonucleotide
ctcctgtaccaactagagtggggaaaaagaagaag

SEQ ID NO: 129742 - DNA, 39 bp, Artificial Sequence
  Description of Artificial Sequence: Synthetic oligonucleotide
tcctgtaccaactagagtggggaaaaagaagaagaaaac

SEQ ID NO: 129743 - DNA, 38 bp, Artificial Sequence
  Description of Artificial Sequence: Synthetic oligonucleotide
cctgtaccaactagagtggggaaaaagaagaagaaaac

SEQ ID NO: 129744 - DNA, 41 bp, Artificial Sequence
  Description of Artificial Sequence: Synthetic oligonucleotide
ctgtaccaactagagtggggaaaaagaagaagaaaacaaag

SEQ ID NO: 129745 - DNA, 41 bp, Artificial Sequence
  Description of Artificial Sequence: Synthetic oligonucleotide
tgtaccaactagagtggggaaaaagaagaagaaaacaaagg

SEQ ID NO: 129746 - DNA, 40 bp, Artificial Sequence
  Description of Artificial Sequence: Synthetic oligonucleotide
gtaccaactagagtggggaaaaagaagaagaaaacaaagg

SEQ ID NO: 129747 - DNA, 40 bp, Artificial Sequence
  Description of Artificial Sequence: Synthetic oligonucleotide
taccaactagagtggggaaaaagaagaagaaaacaaaggg

SEQ ID NO: 129748 - DNA, 39 bp, Artificial Sequence
  Description of Artificial Sequence: Synthetic oligonucleotide
accaactagagtggggaaaaagaagaagaaaacaaaggg

SEQ ID NO: 129749 - DNA, 38 bp, Artificial Sequence
  Description of Artificial Sequence: Synthetic oligonucleotide
ccaactagagtggggaaaaagaagaagaaaacaaaggg

SEQ ID NO: 129750 - DNA, 39 bp, Artificial Sequence
  Description of Artificial Sequence: Synthetic oligonucleotide
caactagagtggggaaaaagaagaagaaaacaaagggac

SEQ ID NO: 129751 - DNA, 39 bp, Artificial Sequence
  Description of Artificial Sequence: Synthetic oligonucleotide
aactagagtggggaaaaagaagaagaaaacaaagggacc

SEQ ID NO: 129752 - DNA, 38 bp, Artificial Sequence
  Description of Artificial Sequence: Synthetic oligonucleotide
actagagtggggaaaaagaagaagaaaacaaagggacc

SEQ ID NO: 129753 - DNA, 37 bp, Artificial Sequence
  Description of Artificial Sequence: Synthetic oligonucleotide
ctagagtggggaaaaagaagaagaaaacaaagggacc

SEQ ID NO: 129754 - DNA, 38 bp, Artificial Sequence
  Description of Artificial Sequence: Synthetic oligonucleotide
tagagtggggaaaaagaagaagaaaacaaagggaccag

SEQ ID NO: 129755 - DNA, 37 bp, Artificial Sequence
  Description of Artificial Sequence: Synthetic oligonucleotide
agagtggggaaaaagaagaagaaaacaaagggaccag

SEQ ID NO: 129756 - DNA, 36 bp, Artificial Sequence
  Description of Artificial Sequence: Synthetic oligonucleotide
gagtggggaaaaagaagaagaaaacaaagggaccag

SEQ ID NO: 129757 - DNA, 38 bp, Artificial Sequence
  Description of Artificial Sequence: Synthetic oligonucleotide
agtggggaaaaagaagaagaaaacaaagggaccagatg

SEQ ID NO: 129758 - DNA, 37 bp, Artificial Sequence
  Description of Artificial Sequence: Synthetic oligonucleotide
gtggggaaaaagaagaagaaaacaaagggaccagatg

SEQ ID NO: 129759 - DNA, 37 bp, Artificial Sequence
  Description of Artificial Sequence: Synthetic oligonucleotide
tggggaaaaagaagaagaaaacaaagggaccagatgc

SEQ ID NO: 129760 - DNA, 36 bp, Artificial Sequence
  Description of Artificial Sequence: Synthetic oligonucleotide
ggggaaaaagaagaagaaaacaaagggaccagatgc

SEQ ID NO: 129761 - DNA, 37 bp, Artificial Sequence
  Description of Artificial Sequence: Synthetic oligonucleotide
gggaaaaagaagaagaaaacaaagggaccagatgctg

SEQ ID NO: 129762 - DNA, 37 bp, Artificial Sequence
  Description of Artificial Sequence: Synthetic oligonucleotide
ggaaaaagaagaagaaaacaaagggaccagatgctgc

SEQ ID NO: 129763 - DNA, 37 bp, Artificial Sequence
  Description of Artificial Sequence: Synthetic oligonucleotide
gaaaaagaagaagaaaacaaagggaccagatgctgcc

SEQ ID NO: 129764 - DNA, 38 bp, Artificial Sequence
  Description of Artificial Sequence: Synthetic oligonucleotide
aaaaagaagaagaaaacaaagggaccagatgctgccag

SEQ ID NO: 129765 - DNA, 37 bp, Artificial Sequence
  Description of Artificial Sequence: Synthetic oligonucleotide
aaaagaagaagaaaacaaagggaccagatgctgccag

SEQ ID NO: 129766 - DNA, 36 bp, Artificial Sequence
  Description of Artificial Sequence: Synthetic oligonucleotide
aaagaagaagaaaacaaagggaccagatgctgccag

SEQ ID NO: 129767 - DNA, 35 bp, Artificial Sequence
  Description of Artificial Sequence: Synthetic oligonucleotide
aagaagaagaaaacaaagggaccagatgctgccag

SEQ ID NO: 129768 - DNA, 34 bp, Artificial Sequence
  Description of Artificial Sequence: Synthetic oligonucleotide
agaagaagaaaacaaagggaccagatgctgccag

SEQ ID NO: 129769 - DNA, 33 bp, Artificial Sequence
  Description of Artificial Sequence: Synthetic oligonucleotide
gaagaagaaaacaaagggaccagatgctgccag

SEQ ID NO: 129770 - DNA, 33 bp, Artificial Sequence
  Description of Artificial Sequence: Synthetic oligonucleotide
aagaagaaaacaaagggaccagatgctgccagc

SEQ ID NO: 129771 - DNA, 32 bp, Artificial Sequence
  Description of Artificial Sequence: Synthetic oligonucleotide
agaagaaaacaaagggaccagatgctgccagc

SEQ ID NO: 129772 - DNA, 31 bp, Artificial Sequence
  Description of Artificial Sequence: Synthetic oligonucleotide
gaagaaaacaaagggaccagatgctgccagc

SEQ ID NO: 129773 - DNA, 34 bp, Artificial Sequence
  Description of Artificial Sequence: Synthetic oligonucleotide
aagaaaacaaagggaccagatgctgccagcaaac

SEQ ID NO: 129774 - DNA, 33 bp, Artificial Sequence
  Description of Artificial Sequence: Synthetic oligonucleotide
agaaaacaaagggaccagatgctgccagcaaac

SEQ ID NO: 129775 - DNA, 32 bp, Artificial Sequence
  Description of Artificial Sequence: Synthetic oligonucleotide
gaaaacaaagggaccagatgctgccagcaaac

SEQ ID NO: 129776 - DNA, 33 bp, Artificial Sequence
  Description of Artificial Sequence: Synthetic oligonucleotide
aaaacaaagggaccagatgctgccagcaaactg

SEQ ID NO: 129777 - DNA, 32 bp, Artificial Sequence
  Description of Artificial Sequence: Synthetic oligonucleotide
aaacaaagggaccagatgctgccagcaaactg

SEQ ID NO: 129778 - DNA, 31 bp, Artificial Sequence
  Description of Artificial Sequence: Synthetic oligonucleotide
aacaaagggaccagatgctgccagcaaactg

SEQ ID NO: 129779 - DNA, 30 bp, Artificial Sequence
  Description of Artificial Sequence: Synthetic oligonucleotide
acaaagggaccagatgctgccagcaaactg

SEQ ID NO: 129780 - DNA, 29 bp, Artificial Sequence
  Description of Artificial Sequence: Synthetic oligonucleotide
caaagggaccagatgctgccagcaaactg

SEQ ID NO: 129781 - DNA, 29 bp, Artificial Sequence
  Description of Artificial Sequence: Synthetic oligonucleotide
aaagggaccagatgctgccagcaaactgc

SEQ ID NO: 129782 - DNA, 28 bp, Artificial Sequence
  Description of Artificial Sequence: Synthetic oligonucleotide
aagggaccagatgctgccagcaaactgc

SEQ ID NO: 129783 - DNA, 27 bp, Artificial Sequence
  Description of Artificial Sequence: Synthetic oligonucleotide
agggaccagatgctgccagcaaactgc

SEQ ID NO: 129784 - DNA, 26 bp, Artificial Sequence
  Description of Artificial Sequence: Synthetic oligonucleotide
gggaccagatgctgccagcaaactgc

SEQ ID NO: 129785 - DNA, 27 bp, Artificial Sequence
  Description of Artificial Sequence: Synthetic oligonucleotide
ggaccagatgctgccagcaaactgcca

SEQ ID NO: 129786 - DNA, 27 bp, Artificial Sequence
  Description of Artificial Sequence: Synthetic oligonucleotide
gaccagatgctgccagcaaactgccac

SEQ ID NO: 129787 - DNA, 28 bp, Artificial Sequence
  Description of Artificial Sequence: Synthetic oligonucleotide
accagatgctgccagcaaactgccactg

SEQ ID NO: 129788 - DNA, 27 bp, Artificial Sequence
  Description of Artificial Sequence: Synthetic oligonucleotide
ccagatgctgccagcaaactgccactg

SEQ ID NO: 129789 - DNA, 27 bp, Artificial Sequence
  Description of Artificial Sequence: Synthetic oligonucleotide
cagatgctgccagcaaactgccactgg

SEQ ID NO: 129790 - DNA, 28 bp, Artificial Sequence
  Description of Artificial Sequence: Synthetic oligonucleotide
agatgctgccagcaaactgccactggtg

SEQ ID NO: 129791 - DNA, 27 bp, Artificial Sequence
  Description of Artificial Sequence: Synthetic oligonucleotide
gatgctgccagcaaactgccactggtg

SEQ ID NO: 129792 - DNA, 28 bp, Artificial Sequence
  Description of Artificial Sequence: Synthetic oligonucleotide
atgctgccagcaaactgccactggtgac

SEQ ID NO: 129793 - DNA, 27 bp, Artificial Sequence
  Description of Artificial Sequence: Synthetic oligonucleotide
tgctgccagcaaactgccactggtgac

SEQ ID NO: 129794 - DNA, 27 bp, Artificial Sequence
  Description of Artificial Sequence: Synthetic oligonucleotide
gctgccagcaaactgccactggtgaca

SEQ ID NO: 129795 - DNA, 27 bp, Artificial Sequence
  Description of Artificial Sequence: Synthetic oligonucleotide
ctgccagcaaactgccactggtgacac

SEQ ID NO: 129796 - DNA, 27 bp, Artificial Sequence
  Description of Artificial Sequence: Synthetic oligonucleotide
tgccagcaaactgccactggtgacacc

SEQ ID NO: 129797 - DNA, 27 bp, Artificial Sequence
  Description of Artificial Sequence: Synthetic oligonucleotide
gccagcaaactgccactggtgacacct

SEQ ID NO: 129798 - DNA, 27 bp, Artificial Sequence
  Description of Artificial Sequence: Synthetic oligonucleotide
ccagcaaactgccactggtgacacctc

SEQ ID NO: 129799 - DNA, 28 bp, Artificial Sequence
  Description of Artificial Sequence: Synthetic oligonucleotide
cagcaaactgccactggtgacacctcac

SEQ ID NO: 129800 - DNA, 29 bp, Artificial Sequence
  Description of Artificial Sequence: Synthetic oligonucleotide
agcaaactgccactggtgacacctcacac

SEQ ID NO: 129801 - DNA, 28 bp, Artificial Sequence
  Description of Artificial Sequence: Synthetic oligonucleotide
gcaaactgccactggtgacacctcacac

SEQ ID NO: 129802 - DNA, 29 bp, Artificial Sequence
  Description of Artificial Sequence: Synthetic oligonucleotide
caaactgccactggtgacacctcacactc

SEQ ID NO: 129803 - DNA, 30 bp, Artificial Sequence
  Description of Artificial Sequence: Synthetic oligonucleotide
aaactgccactggtgacacctcacactcag

SEQ ID NO: 129804 - DNA, 29 bp, Artificial Sequence
  Description of Artificial Sequence: Synthetic oligonucleotide
aactgccactggtgacacctcacactcag

SEQ ID NO: 129805 - DNA, 28 bp, Artificial Sequence
  Description of Artificial Sequence: Synthetic oligonucleotide
actgccactggtgacacctcacactcag

SEQ ID NO: 129806 - DNA, 27 bp, Artificial Sequence
  Description of Artificial Sequence: Synthetic oligonucleotide
ctgccactggtgacacctcacactcag

SEQ ID NO: 129807 - DNA, 28 bp, Artificial Sequence
  Description of Artificial Sequence: Synthetic oligonucleotide
tgccactggtgacacctcacactcagtg

SEQ ID NO: 129808 - DNA, 27 bp, Artificial Sequence
  Description of Artificial Sequence: Synthetic oligonucleotide
gccactggtgacacctcacactcagtg

SEQ ID NO: 129809 - DNA, 27 bp, Artificial Sequence
  Description of Artificial Sequence: Synthetic oligonucleotide
ccactggtgacacctcacactcagtgc

SEQ ID NO: 129810 - DNA, 27 bp, Artificial Sequence
  Description of Artificial Sequence: Synthetic oligonucleotide
cactggtgacacctcacactcagtgcc

SEQ ID NO: 129811 - DNA, 27 bp, Artificial Sequence
  Description of Artificial Sequence: Synthetic oligonucleotide
actggtgacacctcacactcagtgccg

SEQ ID NO: 129812 - DNA, 26 bp, Artificial Sequence
  Description of Artificial Sequence: Synthetic oligonucleotide
ctggtgacacctcacactcagtgccg

SEQ ID NO: 129813 - DNA, 27 bp, Artificial Sequence
  Description of Artificial Sequence: Synthetic oligonucleotide
tggtgacacctcacactcagtgccggt

SEQ ID NO: 129814 - DNA, 27 bp, Artificial Sequence
  Description of Artificial Sequence: Synthetic oligonucleotide
ggtgacacctcacactcagtgccggtt

SEQ ID NO: 129815 - DNA, 34 bp, Artificial Sequence
  Description of Artificial Sequence: Synthetic oligonucleotide
gtgacacctcacactcagtgccggttaaaattac

SEQ ID NO: 129816 - DNA, 35 bp, Artificial Sequence
  Description of Artificial Sequence: Synthetic oligonucleotide
tgacacctcacactcagtgccggttaaaattactg

SEQ ID NO: 129817 - DNA, 34 bp, Artificial Sequence
  Description of Artificial Sequence: Synthetic oligonucleotide
gacacctcacactcagtgccggttaaaattactg

SEQ ID NO: 129818 - DNA, 36 bp, Artificial Sequence
  Description of Artificial Sequence: Synthetic oligonucleotide
acacctcacactcagtgccggttaaaattactgaag

SEQ ID NO: 129819 - DNA, 35 bp, Artificial Sequence
  Description of Artificial Sequence: Synthetic oligonucleotide
cacctcacactcagtgccggttaaaattactgaag

SEQ ID NO: 129820 - DNA, 38 bp, Artificial Sequence
  Description of Artificial Sequence: Synthetic oligonucleotide
acctcacactcagtgccggttaaaattactgaagttag

SEQ ID NO: 129821 - DNA, 37 bp, Artificial Sequence
  Description of Artificial Sequence: Synthetic oligonucleotide
cctcacactcagtgccggttaaaattactgaagttag

SEQ ID NO: 129822 - DNA, 38 bp, Artificial Sequence
  Description of Artificial Sequence: Synthetic oligonucleotide
ctcacactcagtgccggttaaaattactgaagttagag

SEQ ID NO: 129823 - DNA, 39 bp, Artificial Sequence
  Description of Artificial Sequence: Synthetic oligonucleotide
tcacactcagtgccggttaaaattactgaagttagagag

SEQ ID NO: 129824 - DNA, 38 bp, Artificial Sequence
  Description of Artificial Sequence: Synthetic oligonucleotide
cacactcagtgccggttaaaattactgaagttagagag

SEQ ID NO: 129825 - DNA, 45 bp, Artificial Sequence
  Description of Artificial Sequence: Synthetic oligonucleotide
acactcagtgccggttaaaattactgaagttagagagaattaaag

SEQ ID NO: 129826 - DNA, 44 bp, Artificial Sequence
  Description of Artificial Sequence: Synthetic oligonucleotide
cactcagtgccggttaaaattactgaagttagagagaattaaag

SEQ ID NO: 129827 - DNA, 45 bp, Artificial Sequence
  Description of Artificial Sequence: Synthetic oligonucleotide
actcagtgccggttaaaattactgaagttagagagaattaaagac

SEQ ID NO: 129828 - DNA, 44 bp, Artificial Sequence
  Description of Artificial Sequence: Synthetic oligonucleotide
ctcagtgccggttaaaattactgaagttagagagaattaaagac

SEQ ID NO: 129829 - DNA, 47 bp, Artificial Sequence
  Description of Artificial Sequence: Synthetic oligonucleotide
tcagtgccggttaaaattactgaagttagagagaattaaagactatc

SEQ ID NO: 129830 - DNA, 46 bp, Artificial Sequence
  Description of Artificial Sequence: Synthetic oligonucleotide
cagtgccggttaaaattactgaagttagagagaattaaagactatc

SEQ ID NO: 129831 - DNA, 48 bp, Artificial Sequence
  Description of Artificial Sequence: Synthetic oligonucleotide
agtgccggttaaaattactgaagttagagagaattaaagactatcttc

SEQ ID NO: 129832 - DNA, 47 bp, Artificial Sequence
  Description of Artificial Sequence: Synthetic oligonucleotide
gtgccggttaaaattactgaagttagagagaattaaagactatcttc

SEQ ID NO: 129833 - DNA, 48 bp, Artificial Sequence
  Description of Artificial Sequence: Synthetic oligonucleotide
tgccggttaaaattactgaagttagagagaattaaagactatcttctc

SEQ ID NO: 129834 - DNA, 47 bp, Artificial Sequence
  Description of Artificial Sequence: Synthetic oligonucleotide
gccggttaaaattactgaagttagagagaattaaagactatcttctc

SEQ ID NO: 129835 - DNA, 49 bp, Artificial Sequence
  Description of Artificial Sequence: Synthetic oligonucleotide
ccggttaaaattactgaagttagagagaattaaagactatcttctcatg

SEQ ID NO: 129836 - DNA, 49 bp, Artificial Sequence
  Description of Artificial Sequence: Synthetic oligonucleotide
cggttaaaattactgaagttagagagaattaaagactatcttctcatgg

SEQ ID NO: 129837 - DNA, 50 bp, Artificial Sequence
  Description of Artificial Sequence: Synthetic oligonucleotide
ggttaaaattactgaagttagagagaattaaagactatcttctcatggag

SEQ ID NO: 129838 - DNA, 50 bp, Artificial Sequence
  Description of Artificial Sequence: Synthetic oligonucleotide
gttaaaattactgaagttagagagaattaaagactatcttctcatggagg

SEQ ID NO: 129839 - DNA, 52 bp, Artificial Sequence
  Description of Artificial Sequence: Synthetic oligonucleotide
ttaaaattactgaagttagagagaattaaagactatcttctcatggaggaag

SEQ ID NO: 129840 - DNA, 51 bp, Artificial Sequence
  Description of Artificial Sequence: Synthetic oligonucleotide
taaaattactgaagttagagagaattaaagactatcttctcatggaggaag

SEQ ID NO: 129841 - DNA, 50 bp, Artificial Sequence
  Description of Artificial Sequence: Synthetic oligonucleotide
aaaattactgaagttagagagaattaaagactatcttctcatggaggaag

SEQ ID NO: 129842 - DNA, 49 bp, Artificial Sequence
  Description of Artificial Sequence: Synthetic oligonucleotide
aaattactgaagttagagagaattaaagactatcttctcatggaggaag

SEQ ID NO: 129843 - DNA, 48 bp, Artificial Sequence
  Description of Artificial Sequence: Synthetic oligonucleotide
aattactgaagttagagagaattaaagactatcttctcatggaggaag

SEQ ID NO: 129844 - DNA, 47 bp, Artificial Sequence
  Description of Artificial Sequence: Synthetic oligonucleotide
attactgaagttagagagaattaaagactatcttctcatggaggaag

SEQ ID NO: 129845 - DNA, 46 bp, Artificial Sequence
  Description of Artificial Sequence: Synthetic oligonucleotide
ttactgaagttagagagaattaaagactatcttctcatggaggaag

SEQ ID NO: 129846 - DNA, 45 bp, Artificial Sequence
  Description of Artificial Sequence: Synthetic oligonucleotide
tactgaagttagagagaattaaagactatcttctcatggaggaag

SEQ ID NO: 129847 - DNA, 44 bp, Artificial Sequence
  Description of Artificial Sequence: Synthetic oligonucleotide
actgaagttagagagaattaaagactatcttctcatggaggaag

SEQ ID NO: 129848 - DNA, 43 bp, Artificial Sequence
  Description of Artificial Sequence: Synthetic oligonucleotide
ctgaagttagagagaattaaagactatcttctcatggaggaag

SEQ ID NO: 129849 - DNA, 47 bp, Artificial Sequence
  Description of Artificial Sequence: Synthetic oligonucleotide
tgaagttagagagaattaaagactatcttctcatggaggaagaattc

SEQ ID NO: 129850 - DNA, 46 bp, Artificial Sequence
  Description of Artificial Sequence: Synthetic oligonucleotide
gaagttagagagaattaaagactatcttctcatggaggaagaattc

SEQ ID NO: 129851 - DNA, 50 bp, Artificial Sequence
  Description of Artificial Sequence: Synthetic oligonucleotide
aagttagagagaattaaagactatcttctcatggaggaagaattcattag

SEQ ID NO: 129852 - DNA, 49 bp, Artificial Sequence
  Description of Artificial Sequence: Synthetic oligonucleotide
agttagagagaattaaagactatcttctcatggaggaagaattcattag

SEQ ID NO: 129853 - DNA, 48 bp, Artificial Sequence
  Description of Artificial Sequence: Synthetic oligonucleotide
gttagagagaattaaagactatcttctcatggaggaagaattcattag

SEQ ID NO: 129854 - DNA, 52 bp, Artificial Sequence
  Description of Artificial Sequence: Synthetic oligonucleotide
ttagagagaattaaagactatcttctcatggaggaagaattcattagaaatc

SEQ ID NO: 129855 - DNA, 51 bp, Artificial Sequence
  Description of Artificial Sequence: Synthetic oligonucleotide
tagagagaattaaagactatcttctcatggaggaagaattcattagaaatc

SEQ ID NO: 129856 - DNA, 50 bp, Artificial Sequence
  Description of Artificial Sequence: Synthetic oligonucleotide
agagagaattaaagactatcttctcatggaggaagaattcattagaaatc

SEQ ID NO: 129857 - DNA, 49 bp, Artificial Sequence
  Description of Artificial Sequence: Synthetic oligonucleotide
gagagaattaaagactatcttctcatggaggaagaattcattagaaatc

SEQ ID NO: 129858 - DNA, 50 bp, Artificial Sequence
  Description of Artificial Sequence: Synthetic oligonucleotide
agagaattaaagactatcttctcatggaggaagaattcattagaaatcag

SEQ ID NO: 129859 - DNA, 49 bp, Artificial Sequence
  Description of Artificial Sequence: Synthetic oligonucleotide
gagaattaaagactatcttctcatggaggaagaattcattagaaatcag

SEQ ID NO: 129860 - DNA, 49 bp, Artificial Sequence
  Description of Artificial Sequence: Synthetic oligonucleotide
agaattaaagactatcttctcatggaggaagaattcattagaaatcagg

SEQ ID NO: 129861 - DNA, 48 bp, Artificial Sequence
  Description of Artificial Sequence: Synthetic oligonucleotide
gaattaaagactatcttctcatggaggaagaattcattagaaatcagg

SEQ ID NO: 129862 - DNA, 50 bp, Artificial Sequence
  Description of Artificial Sequence: Synthetic oligonucleotide
aattaaagactatcttctcatggaggaagaattcattagaaatcaggaac

SEQ ID NO: 129863 - DNA, 49 bp, Artificial Sequence
  Description of Artificial Sequence: Synthetic oligonucleotide
attaaagactatcttctcatggaggaagaattcattagaaatcaggaac

SEQ ID NO: 129864 - DNA, 48 bp, Artificial Sequence
  Description of Artificial Sequence: Synthetic oligonucleotide
ttaaagactatcttctcatggaggaagaattcattagaaatcaggaac

SEQ ID NO: 129865 - DNA, 47 bp, Artificial Sequence
  Description of Artificial Sequence: Synthetic oligonucleotide
taaagactatcttctcatggaggaagaattcattagaaatcaggaac

SEQ ID NO: 129866 - DNA, 46 bp, Artificial Sequence
  Description of Artificial Sequence: Synthetic oligonucleotide
aaagactatcttctcatggaggaagaattcattagaaatcaggaac

SEQ ID NO: 129867 - DNA, 45 bp, Artificial Sequence
  Description of Artificial Sequence: Synthetic oligonucleotide
aagactatcttctcatggaggaagaattcattagaaatcaggaac

SEQ ID NO: 129868 - DNA, 44 bp, Artificial Sequence
  Description of Artificial Sequence: Synthetic oligonucleotide
agactatcttctcatggaggaagaattcattagaaatcaggaac

SEQ ID NO: 129869 - DNA, 43 bp, Artificial Sequence
  Description of Artificial Sequence: Synthetic oligonucleotide
gactatcttctcatggaggaagaattcattagaaatcaggaac

SEQ ID NO: 129870 - DNA, 47 bp, Artificial Sequence
  Description of Artificial Sequence: Synthetic oligonucleotide
actatcttctcatggaggaagaattcattagaaatcaggaacaaatg

SEQ ID NO: 129871 - DNA, 46 bp, Artificial Sequence
  Description of Artificial Sequence: Synthetic oligonucleotide
ctatcttctcatggaggaagaattcattagaaatcaggaacaaatg

SEQ ID NO: 129872 - DNA, 49 bp, Artificial Sequence
  Description of Artificial Sequence: Synthetic oligonucleotide
tatcttctcatggaggaagaattcattagaaatcaggaacaaatgaaac

SEQ ID NO: 129873 - DNA, 48 bp, Artificial Sequence
  Description of Artificial Sequence: Synthetic oligonucleotide
atcttctcatggaggaagaattcattagaaatcaggaacaaatgaaac

SEQ ID NO: 129874 - DNA, 47 bp, Artificial Sequence
  Description of Artificial Sequence: Synthetic oligonucleotide
tcttctcatggaggaagaattcattagaaatcaggaacaaatgaaac

SEQ ID NO: 129875 - DNA, 46 bp, Artificial Sequence
  Description of Artificial Sequence: Synthetic oligonucleotide
cttctcatggaggaagaattcattagaaatcaggaacaaatgaaac

SEQ ID NO: 129876 - DNA, 46 bp, Artificial Sequence
  Description of Artificial Sequence: Synthetic oligonucleotide
ttctcatggaggaagaattcattagaaatcaggaacaaatgaaacc

SEQ ID NO: 129877 - DNA, 45 bp, Artificial Sequence
  Description of Artificial Sequence: Synthetic oligonucleotide
tctcatggaggaagaattcattagaaatcaggaacaaatgaaacc

SEQ ID NO: 129878 - DNA, 44 bp, Artificial Sequence
  Description of Artificial Sequence: Synthetic oligonucleotide
ctcatggaggaagaattcattagaaatcaggaacaaatgaaacc

SEQ ID NO: 129879 - DNA, 48 bp, Artificial Sequence
  Description of Artificial Sequence: Synthetic oligonucleotide
tcatggaggaagaattcattagaaatcaggaacaaatgaaaccattag

SEQ ID NO: 129880 - DNA, 47 bp, Artificial Sequence
  Description of Artificial Sequence: Synthetic oligonucleotide
catggaggaagaattcattagaaatcaggaacaaatgaaaccattag

SEQ ID NO: 129881 - DNA, 49 bp, Artificial Sequence
  Description of Artificial Sequence: Synthetic oligonucleotide
atggaggaagaattcattagaaatcaggaacaaatgaaaccattagaag

SEQ ID NO: 129882 - DNA, 48 bp, Artificial Sequence
  Description of Artificial Sequence: Synthetic oligonucleotide
tggaggaagaattcattagaaatcaggaacaaatgaaaccattagaag

SEQ ID NO: 129883 - DNA, 47 bp, Artificial Sequence
  Description of Artificial Sequence: Synthetic oligonucleotide
ggaggaagaattcattagaaatcaggaacaaatgaaaccattagaag

SEQ ID NO: 129884 - DNA, 51 bp, Artificial Sequence
  Description of Artificial Sequence: Synthetic oligonucleotide
gaggaagaattcattagaaatcaggaacaaatgaaaccattagaagaaaag

SEQ ID NO: 129885 - DNA, 51 bp, Artificial Sequence
  Description of Artificial Sequence: Synthetic oligonucleotide
aggaagaattcattagaaatcaggaacaaatgaaaccattagaagaaaagc

SEQ ID NO: 129886 - DNA, 50 bp, Artificial Sequence
  Description of Artificial Sequence: Synthetic oligonucleotide
ggaagaattcattagaaatcaggaacaaatgaaaccattagaagaaaagc

SEQ ID NO: 129887 - DNA, 52 bp, Artificial Sequence
  Description of Artificial Sequence: Synthetic oligonucleotide
gaagaattcattagaaatcaggaacaaatgaaaccattagaagaaaagcaag

SEQ ID NO: 129888 - DNA, 53 bp, Artificial Sequence
  Description of Artificial Sequence: Synthetic oligonucleotide
aagaattcattagaaatcaggaacaaatgaaaccattagaagaaaagcaagag

SEQ ID NO: 129889 - DNA, 52 bp, Artificial Sequence
  Description of Artificial Sequence: Synthetic oligonucleotide
agaattcattagaaatcaggaacaaatgaaaccattagaagaaaagcaagag

SEQ ID NO: 129890 - DNA, 51 bp, Artificial Sequence
  Description of Artificial Sequence: Synthetic oligonucleotide
gaattcattagaaatcaggaacaaatgaaaccattagaagaaaagcaagag

SEQ ID NO: 129891 - DNA, 51 bp, Artificial Sequence
  Description of Artificial Sequence: Synthetic oligonucleotide
aattcattagaaatcaggaacaaatgaaaccattagaagaaaagcaagagg

SEQ ID NO: 129892 - DNA, 50 bp, Artificial Sequence
  Description of Artificial Sequence: Synthetic oligonucleotide
attcattagaaatcaggaacaaatgaaaccattagaagaaaagcaagagg

SEQ ID NO: 129893 - DNA, 49 bp, Artificial Sequence
  Description of Artificial Sequence: Synthetic oligonucleotide
ttcattagaaatcaggaacaaatgaaaccattagaagaaaagcaagagg

SEQ ID NO: 129894 - DNA, 48 bp, Artificial Sequence
  Description of Artificial Sequence: Synthetic oligonucleotide
tcattagaaatcaggaacaaatgaaaccattagaagaaaagcaagagg

SEQ ID NO: 129895 - DNA, 47 bp, Artificial Sequence
  Description of Artificial Sequence: Synthetic oligonucleotide
cattagaaatcaggaacaaatgaaaccattagaagaaaagcaagagg

SEQ ID NO: 129896 - DNA, 48 bp, Artificial Sequence
  Description of Artificial Sequence: Synthetic oligonucleotide
attagaaatcaggaacaaatgaaaccattagaagaaaagcaagaggag

SEQ ID NO: 129897 - DNA, 47 bp, Artificial Sequence
  Description of Artificial Sequence: Synthetic oligonucleotide
ttagaaatcaggaacaaatgaaaccattagaagaaaagcaagaggag

SEQ ID NO: 129898 - DNA, 46 bp, Artificial Sequence
  Description of Artificial Sequence: Synthetic oligonucleotide
tagaaatcaggaacaaatgaaaccattagaagaaaagcaagaggag

SEQ ID NO: 129899 - DNA, 45 bp, Artificial Sequence
  Description of Artificial Sequence: Synthetic oligonucleotide
agaaatcaggaacaaatgaaaccattagaagaaaagcaagaggag

SEQ ID NO: 129900 - DNA, 44 bp, Artificial Sequence
  Description of Artificial Sequence: Synthetic oligonucleotide
gaaatcaggaacaaatgaaaccattagaagaaaagcaagaggag

SEQ ID NO: 129901 - DNA, 44 bp, Artificial Sequence
  Description of Artificial Sequence: Synthetic oligonucleotide
aaatcaggaacaaatgaaaccattagaagaaaagcaagaggagg

SEQ ID NO: 129902 - DNA, 43 bp, Artificial Sequence
  Description of Artificial Sequence: Synthetic oligonucleotide
aatcaggaacaaatgaaaccattagaagaaaagcaagaggagg

SEQ ID NO: 129903 - DNA, 42 bp, Artificial Sequence
  Description of Artificial Sequence: Synthetic oligonucleotide
atcaggaacaaatgaaaccattagaagaaaagcaagaggagg

SEQ ID NO: 129904 - DNA, 41 bp, Artificial Sequence
  Description of Artificial Sequence: Synthetic oligonucleotide
tcaggaacaaatgaaaccattagaagaaaagcaagaggagg

SEQ ID NO: 129905 - DNA, 40 bp, Artificial Sequence
  Description of Artificial Sequence: Synthetic oligonucleotide
caggaacaaatgaaaccattagaagaaaagcaagaggagg

SEQ ID NO: 129906 - DNA, 43 bp, Artificial Sequence
  Description of Artificial Sequence: Synthetic oligonucleotide
aggaacaaatgaaaccattagaagaaaagcaagaggaggaaag

SEQ ID NO: 129907 - DNA, 42 bp, Artificial Sequence
  Description of Artificial Sequence: Synthetic oligonucleotide
ggaacaaatgaaaccattagaagaaaagcaagaggaggaaag

SEQ ID NO: 129908 - DNA, 44 bp, Artificial Sequence
  Description of Artificial Sequence: Synthetic oligonucleotide
gaacaaatgaaaccattagaagaaaagcaagaggaggaaagatc

SEQ ID NO: 129909 - DNA, 48 bp, Artificial Sequence
  Description of Artificial Sequence: Synthetic oligonucleotide
aacaaatgaaaccattagaagaaaagcaagaggaggaaagatcaaaag

SEQ ID NO: 129910 - DNA, 47 bp, Artificial Sequence
  Description of Artificial Sequence: Synthetic oligonucleotide
acaaatgaaaccattagaagaaaagcaagaggaggaaagatcaaaag

SEQ ID NO: 129911 - DNA, 46 bp, Artificial Sequence
  Description of Artificial Sequence: Synthetic oligonucleotide
caaatgaaaccattagaagaaaagcaagaggaggaaagatcaaaag

SEQ ID NO: 129912 - DNA, 47 bp, Artificial Sequence
  Description of Artificial Sequence: Synthetic oligonucleotide
aaatgaaaccattagaagaaaagcaagaggaggaaagatcaaaagtg

SEQ ID NO: 129913 - DNA, 46 bp, Artificial Sequence
  Description of Artificial Sequence: Synthetic oligonucleotide
aatgaaaccattagaagaaaagcaagaggaggaaagatcaaaagtg

SEQ ID NO: 129914 - DNA, 45 bp, Artificial Sequence
  Description of Artificial Sequence: Synthetic oligonucleotide
atgaaaccattagaagaaaagcaagaggaggaaagatcaaaagtg

SEQ ID NO: 129915 - DNA, 44 bp, Artificial Sequence
  Description of Artificial Sequence: Synthetic oligonucleotide
tgaaaccattagaagaaaagcaagaggaggaaagatcaaaagtg

SEQ ID NO: 129916 - DNA, 43 bp, Artificial Sequence
  Description of Artificial Sequence: Synthetic oligonucleotide
gaaaccattagaagaaaagcaagaggaggaaagatcaaaagtg

SEQ ID NO: 129917 - DNA, 43 bp, Artificial Sequence
  Description of Artificial Sequence: Synthetic oligonucleotide
aaaccattagaagaaaagcaagaggaggaaagatcaaaagtgg

SEQ ID NO: 129918 - DNA, 42 bp, Artificial Sequence
  Description of Artificial Sequence: Synthetic oligonucleotide
aaccattagaagaaaagcaagaggaggaaagatcaaaagtgg

SEQ ID NO: 129919 - DNA, 41 bp, Artificial Sequence
  Description of Artificial Sequence: Synthetic oligonucleotide
accattagaagaaaagcaagaggaggaaagatcaaaagtgg

SEQ ID NO: 129920 - DNA, 40 bp, Artificial Sequence
  Description of Artificial Sequence: Synthetic oligonucleotide
ccattagaagaaaagcaagaggaggaaagatcaaaagtgg

SEQ ID NO: 129921 - DNA, 42 bp, Artificial Sequence
  Description of Artificial Sequence: Synthetic oligonucleotide
cattagaagaaaagcaagaggaggaaagatcaaaagtggatg

SEQ ID NO: 129922 - DNA, 44 bp, Artificial Sequence
  Description of Artificial Sequence: Synthetic oligonucleotide
attagaagaaaagcaagaggaggaaagatcaaaagtggatgatc

SEQ ID NO: 129923 - DNA, 43 bp, Artificial Sequence
  Description of Artificial Sequence: Synthetic oligonucleotide
ttagaagaaaagcaagaggaggaaagatcaaaagtggatgatc

SEQ ID NO: 129924 - DNA, 42 bp, Artificial Sequence
  Description of Artificial Sequence: Synthetic oligonucleotide
tagaagaaaagcaagaggaggaaagatcaaaagtggatgatc

SEQ ID NO: 129925 - DNA, 41 bp, Artificial Sequence
  Description of Artificial Sequence: Synthetic oligonucleotide
agaagaaaagcaagaggaggaaagatcaaaagtggatgatc

SEQ ID NO: 129926 - DNA, 40 bp, Artificial Sequence
  Description of Artificial Sequence: Synthetic oligonucleotide
gaagaaaagcaagaggaggaaagatcaaaagtggatgatc

SEQ ID NO: 129927 - DNA, 41 bp, Artificial Sequence
  Description of Artificial Sequence: Synthetic oligonucleotide
aagaaaagcaagaggaggaaagatcaaaagtggatgatctg

SEQ ID NO: 129928 - DNA, 40 bp, Artificial Sequence
  Description of Artificial Sequence: Synthetic oligonucleotide
agaaaagcaagaggaggaaagatcaaaagtggatgatctg

SEQ ID NO: 129929 - DNA, 39 bp, Artificial Sequence
  Description of Artificial Sequence: Synthetic oligonucleotide
gaaaagcaagaggaggaaagatcaaaagtggatgatctg

SEQ ID NO: 129930 - DNA, 40 bp, Artificial Sequence
  Description of Artificial Sequence: Synthetic oligonucleotide
aaaagcaagaggaggaaagatcaaaagtggatgatctgag

SEQ ID NO: 129931 - DNA, 39 bp, Artificial Sequence
  Description of Artificial Sequence: Synthetic oligonucleotide
aaagcaagaggaggaaagatcaaaagtggatgatctgag

SEQ ID NO: 129932 - DNA, 38 bp, Artificial Sequence
  Description of Artificial Sequence: Synthetic oligonucleotide
aagcaagaggaggaaagatcaaaagtggatgatctgag

SEQ ID NO: 129933 - DNA, 37 bp, Artificial Sequence
  Description of Artificial Sequence: Synthetic oligonucleotide
agcaagaggaggaaagatcaaaagtggatgatctgag

SEQ ID NO: 129934 - DNA, 36 bp, Artificial Sequence
  Description of Artificial Sequence: Synthetic oligonucleotide
gcaagaggaggaaagatcaaaagtggatgatctgag

SEQ ID NO: 129935 - DNA, 36 bp, Artificial Sequence
  Description of Artificial Sequence: Synthetic oligonucleotide
caagaggaggaaagatcaaaagtggatgatctgagg

SEQ ID NO: 129936 - DNA, 36 bp, Artificial Sequence
  Description of Artificial Sequence: Synthetic oligonucleotide
aagaggaggaaagatcaaaagtggatgatctgaggg

SEQ ID NO: 129937 - DNA, 35 bp, Artificial Sequence
  Description of Artificial Sequence: Synthetic oligonucleotide
agaggaggaaagatcaaaagtggatgatctgaggg

SEQ ID NO: 129938 - DNA, 34 bp, Artificial Sequence
  Description of Artificial Sequence: Synthetic oligonucleotide
gaggaggaaagatcaaaagtggatgatctgaggg

SEQ ID NO: 129939 - DNA, 34 bp, Artificial Sequence
  Description of Artificial Sequence: Synthetic oligonucleotide
aggaggaaagatcaaaagtggatgatctgagggg

SEQ ID NO: 129940 - DNA, 33 bp, Artificial Sequence
  Description of Artificial Sequence: Synthetic oligonucleotide
ggaggaaagatcaaaagtggatgatctgagggg

SEQ ID NO: 129941 - DNA, 33 bp, Artificial Sequence
  Description of Artificial Sequence: Synthetic oligonucleotide
gaggaaagatcaaaagtggatgatctgaggggg

SEQ ID NO: 129942 - DNA, 34 bp, Artificial Sequence
  Description of Artificial Sequence: Synthetic oligonucleotide
aggaaagatcaaaagtggatgatctgagggggac

SEQ ID NO: 129943 - DNA, 33 bp, Artificial Sequence
  Description of Artificial Sequence: Synthetic oligonucleotide
ggaaagatcaaaagtggatgatctgagggggac

SEQ ID NO: 129944 - DNA, 33 bp, Artificial Sequence
  Description of Artificial Sequence: Synthetic oligonucleotide
gaaagatcaaaagtggatgatctgagggggacc

SEQ ID NO: 129945 - DNA, 33 bp, Artificial Sequence
  Description of Artificial Sequence: Synthetic oligonucleotide
aaagatcaaaagtggatgatctgagggggaccc

SEQ ID NO: 129946 - DNA, 32 bp, Artificial Sequence
  Description of Artificial Sequence: Synthetic oligonucleotide
aagatcaaaagtggatgatctgagggggaccc

SEQ ID NO: 129947 - DNA, 31 bp, Artificial Sequence
  Description of Artificial Sequence: Synthetic oligonucleotide
agatcaaaagtggatgatctgagggggaccc

SEQ ID NO: 129948 - DNA, 30 bp, Artificial Sequence
  Description of Artificial Sequence: Synthetic oligonucleotide
gatcaaaagtggatgatctgagggggaccc

SEQ ID NO: 129949 - DNA, 30 bp, Artificial Sequence
  Description of Artificial Sequence: Synthetic oligonucleotide
atcaaaagtggatgatctgagggggacccc

SEQ ID NO: 129950 - DNA, 29 bp, Artificial Sequence
  Description of Artificial Sequence: Synthetic oligonucleotide
tcaaaagtggatgatctgagggggacccc

SEQ ID NO: 129951 - DNA, 28 bp, Artificial Sequence
  Description of Artificial Sequence: Synthetic oligonucleotide
caaaagtggatgatctgagggggacccc

SEQ ID NO: 129952 - DNA, 28 bp, Artificial Sequence
  Description of Artificial Sequence: Synthetic oligonucleotide
aaaagtggatgatctgagggggaccccg

SEQ ID NO: 129953 - DNA, 27 bp, Artificial Sequence
  Description of Artificial Sequence: Synthetic oligonucleotide
aaagtggatgatctgagggggaccccg

SEQ ID NO: 129954 - DNA, 27 bp, Artificial Sequence
  Description of Artificial Sequence: Synthetic oligonucleotide
aagtggatgatctgagggggaccccga

SEQ ID NO: 129955 - DNA, 27 bp, Artificial Sequence
  Description of Artificial Sequence: Synthetic oligonucleotide
agtggatgatctgagggggaccccgat

SEQ ID NO: 129956 - DNA, 26 bp, Artificial Sequence
  Description of Artificial Sequence: Synthetic oligonucleotide
gtggatgatctgagggggaccccgat

SEQ ID NO: 129957 - DNA, 27 bp, Artificial Sequence
  Description of Artificial Sequence: Synthetic oligonucleotide
tggatgatctgagggggaccccgatgt

SEQ ID NO: 129958 - DNA, 26 bp, Artificial Sequence
  Description of Artificial Sequence: Synthetic oligonucleotide
ggatgatctgagggggaccccgatgt

SEQ ID NO: 129959 - DNA, 27 bp, Artificial Sequence
  Description of Artificial Sequence: Synthetic oligonucleotide
gatgatctgagggggaccccgatgtca

SEQ ID NO: 129960 - DNA, 27 bp, Artificial Sequence
  Description of Artificial Sequence: Synthetic oligonucleotide
atgatctgagggggaccccgatgtcag

SEQ ID NO: 129961 - DNA, 27 bp, Artificial Sequence
  Description of Artificial Sequence: Synthetic oligonucleotide
tgatctgagggggaccccgatgtcagt

SEQ ID NO: 129962 - DNA, 27 bp, Artificial Sequence
  Description of Artificial Sequence: Synthetic oligonucleotide
gatctgagggggaccccgatgtcagta

SEQ ID NO: 129963 - DNA, 27 bp, Artificial Sequence
  Description of Artificial Sequence: Synthetic oligonucleotide
atctgagggggaccccgatgtcagtag

SEQ ID NO: 129964 - DNA, 26 bp, Artificial Sequence
  Description of Artificial Sequence: Synthetic oligonucleotide
tctgagggggaccccgatgtcagtag

SEQ ID NO: 129965 - DNA, 25 bp, Artificial Sequence
  Description of Artificial Sequence: Synthetic oligonucleotide
ctgagggggaccccgatgtcagtag

SEQ ID NO: 129966 - DNA, 27 bp, Artificial Sequence
  Description of Artificial Sequence: Synthetic oligonucleotide
tgagggggaccccgatgtcagtaggaa

SEQ ID NO: 129967 - DNA, 26 bp, Artificial Sequence
  Description of Artificial Sequence: Synthetic oligonucleotide
gagggggaccccgatgtcagtaggaa

SEQ ID NO: 129968 - DNA, 26 bp, Artificial Sequence
  Description of Artificial Sequence: Synthetic oligonucleotide
agggggaccccgatgtcagtaggaac

SEQ ID NO: 129969 - DNA, 25 bp, Artificial Sequence
  Description of Artificial Sequence: Synthetic oligonucleotide
gggggaccccgatgtcagtaggaac

SEQ ID NO: 129970 - DNA, 27 bp, Artificial Sequence
  Description of Artificial Sequence: Synthetic oligonucleotide
ggggaccccgatgtcagtaggaacctt

SEQ ID NO: 129971 - DNA, 27 bp, Artificial Sequence
  Description of Artificial Sequence: Synthetic oligonucleotide
gggaccccgatgtcagtaggaaccttg

SEQ ID NO: 129972 - DNA, 27 bp, Artificial Sequence
  Description of Artificial Sequence: Synthetic oligonucleotide
ggaccccgatgtcagtaggaaccttgg

SEQ ID NO: 129973 - DNA, 29 bp, Artificial Sequence
  Description of Artificial Sequence: Synthetic oligonucleotide
gaccccgatgtcagtaggaaccttggaag

SEQ ID NO: 129974 - DNA, 30 bp, Artificial Sequence
  Description of Artificial Sequence: Synthetic oligonucleotide
accccgatgtcagtaggaaccttggaagag

SEQ ID NO: 129975 - DNA, 29 bp, Artificial Sequence
  Description of Artificial Sequence: Synthetic oligonucleotide
ccccgatgtcagtaggaaccttggaagag

SEQ ID NO: 129976 - DNA, 31 bp, Artificial Sequence
  Description of Artificial Sequence: Synthetic oligonucleotide
cccgatgtcagtaggaaccttggaagagatc

SEQ ID NO: 129977 - DNA, 34 bp, Artificial Sequence
  Description of Artificial Sequence: Synthetic oligonucleotide
ccgatgtcagtaggaaccttggaagagatcattg

SEQ ID NO: 129978 - DNA, 36 bp, Artificial Sequence
  Description of Artificial Sequence: Synthetic oligonucleotide
cgatgtcagtaggaaccttggaagagatcattgatg

SEQ ID NO: 129979 - DNA, 37 bp, Artificial Sequence
  Description of Artificial Sequence: Synthetic oligonucleotide
gatgtcagtaggaaccttggaagagatcattgatgac

SEQ ID NO: 129980 - DNA, 40 bp, Artificial Sequence
  Description of Artificial Sequence: Synthetic oligonucleotide
atgtcagtaggaaccttggaagagatcattgatgacaatc

SEQ ID NO: 129981 - DNA, 39 bp, Artificial Sequence
  Description of Artificial Sequence: Synthetic oligonucleotide
tgtcagtaggaaccttggaagagatcattgatgacaatc

SEQ ID NO: 129982 - DNA, 38 bp, Artificial Sequence
  Description of Artificial Sequence: Synthetic oligonucleotide
gtcagtaggaaccttggaagagatcattgatgacaatc

SEQ ID NO: 129983 - DNA, 40 bp, Artificial Sequence
  Description of Artificial Sequence: Synthetic oligonucleotide
tcagtaggaaccttggaagagatcattgatgacaatcatg

SEQ ID NO: 129984 - DNA, 39 bp, Artificial Sequence
  Description of Artificial Sequence: Synthetic oligonucleotide
cagtaggaaccttggaagagatcattgatgacaatcatg

SEQ ID NO: 129985 - DNA, 39 bp, Artificial Sequence
  Description of Artificial Sequence: Synthetic oligonucleotide
agtaggaaccttggaagagatcattgatgacaatcatgc

SEQ ID NO: 129986 - DNA, 38 bp, Artificial Sequence
  Description of Artificial Sequence: Synthetic oligonucleotide
gtaggaaccttggaagagatcattgatgacaatcatgc

SEQ ID NO: 129987 - DNA, 38 bp, Artificial Sequence
  Description of Artificial Sequence: Synthetic oligonucleotide
taggaaccttggaagagatcattgatgacaatcatgcc

SEQ ID NO: 129988 - DNA, 37 bp, Artificial Sequence
  Description of Artificial Sequence: Synthetic oligonucleotide
aggaaccttggaagagatcattgatgacaatcatgcc

SEQ ID NO: 129989 - DNA, 36 bp, Artificial Sequence
  Description of Artificial Sequence: Synthetic oligonucleotide
ggaaccttggaagagatcattgatgacaatcatgcc

SEQ ID NO: 129990 - DNA, 38 bp, Artificial Sequence
  Description of Artificial Sequence: Synthetic oligonucleotide
gaaccttggaagagatcattgatgacaatcatgccatc

SEQ ID NO: 129991 - DNA, 38 bp, Artificial Sequence
  Description of Artificial Sequence: Synthetic oligonucleotide
aaccttggaagagatcattgatgacaatcatgccatcg

SEQ ID NO: 129992 - DNA, 37 bp, Artificial Sequence
  Description of Artificial Sequence: Synthetic oligonucleotide
accttggaagagatcattgatgacaatcatgccatcg

SEQ ID NO: 129993 - DNA, 36 bp, Artificial Sequence
  Description of Artificial Sequence: Synthetic oligonucleotide
ccttggaagagatcattgatgacaatcatgccatcg

SEQ ID NO: 129994 - DNA, 37 bp, Artificial Sequence
  Description of Artificial Sequence: Synthetic oligonucleotide
cttggaagagatcattgatgacaatcatgccatcgtg

SEQ ID NO: 129995 - DNA, 38 bp, Artificial Sequence
  Description of Artificial Sequence: Synthetic oligonucleotide
ttggaagagatcattgatgacaatcatgccatcgtgtc

SEQ ID NO: 129996 - DNA, 37 bp, Artificial Sequence
  Description of Artificial Sequence: Synthetic oligonucleotide
tggaagagatcattgatgacaatcatgccatcgtgtc

SEQ ID NO: 129997 - DNA, 36 bp, Artificial Sequence
  Description of Artificial Sequence: Synthetic oligonucleotide
ggaagagatcattgatgacaatcatgccatcgtgtc

SEQ ID NO: 129998 - DNA, 38 bp, Artificial Sequence
  Description of Artificial Sequence: Synthetic oligonucleotide
gaagagatcattgatgacaatcatgccatcgtgtctac

SEQ ID NO: 129999 - DNA, 40 bp, Artificial Sequence
  Description of Artificial Sequence: Synthetic oligonucleotide
aagagatcattgatgacaatcatgccatcgtgtctacatc

SEQ ID NO: 130000 - DNA, 39 bp, Artificial Sequence
  Description of Artificial Sequence: Synthetic oligonucleotide
agagatcattgatgacaatcatgccatcgtgtctacatc

SEQ ID NO: 130001 - DNA, 38 bp, Artificial Sequence
  Description of Artificial Sequence: Synthetic oligonucleotide
gagatcattgatgacaatcatgccatcgtgtctacatc

SEQ ID NO: 130002 - DNA, 39 bp, Artificial Sequence
  Description of Artificial Sequence: Synthetic oligonucleotide
agatcattgatgacaatcatgccatcgtgtctacatctg

SEQ ID NO: 130003 - DNA, 38 bp, Artificial Sequence
  Description of Artificial Sequence: Synthetic oligonucleotide
gatcattgatgacaatcatgccatcgtgtctacatctg

SEQ ID NO: 130004 - DNA, 39 bp, Artificial Sequence
  Description of Artificial Sequence: Synthetic oligonucleotide
atcattgatgacaatcatgccatcgtgtctacatctgtg

SEQ ID NO: 130005 - DNA, 38 bp, Artificial Sequence
  Description of Artificial Sequence: Synthetic oligonucleotide
tcattgatgacaatcatgccatcgtgtctacatctgtg

SEQ ID NO: 130006 - DNA, 37 bp, Artificial Sequence
  Description of Artificial Sequence: Synthetic oligonucleotide
cattgatgacaatcatgccatcgtgtctacatctgtg

SEQ ID NO: 130007 - DNA, 37 bp, Artificial Sequence
  Description of Artificial Sequence: Synthetic oligonucleotide
attgatgacaatcatgccatcgtgtctacatctgtgg

SEQ ID NO: 130008 - DNA, 36 bp, Artificial Sequence
  Description of Artificial Sequence: Synthetic oligonucleotide
ttgatgacaatcatgccatcgtgtctacatctgtgg

SEQ ID NO: 130009 - DNA, 35 bp, Artificial Sequence
  Description of Artificial Sequence: Synthetic oligonucleotide
tgatgacaatcatgccatcgtgtctacatctgtgg

SEQ ID NO: 130010 - DNA, 34 bp, Artificial Sequence
  Description of Artificial Sequence: Synthetic oligonucleotide
gatgacaatcatgccatcgtgtctacatctgtgg

SEQ ID NO: 130011 - DNA, 34 bp, Artificial Sequence
  Description of Artificial Sequence: Synthetic oligonucleotide
atgacaatcatgccatcgtgtctacatctgtggg

SEQ ID NO: 130012 - DNA, 33 bp, Artificial Sequence
  Description of Artificial Sequence: Synthetic oligonucleotide
tgacaatcatgccatcgtgtctacatctgtggg

SEQ ID NO: 130013 - DNA, 32 bp, Artificial Sequence
  Description of Artificial Sequence: Synthetic oligonucleotide
gacaatcatgccatcgtgtctacatctgtggg

SEQ ID NO: 130014 - DNA, 32 bp, Artificial Sequence
  Description of Artificial Sequence: Synthetic oligonucleotide
acaatcatgccatcgtgtctacatctgtgggc

SEQ ID NO: 130015 - DNA, 31 bp, Artificial Sequence
  Description of Artificial Sequence: Synthetic oligonucleotide
caatcatgccatcgtgtctacatctgtgggc

SEQ ID NO: 130016 - DNA, 32 bp, Artificial Sequence
  Description of Artificial Sequence: Synthetic oligonucleotide
aatcatgccatcgtgtctacatctgtgggctc

SEQ ID NO: 130017 - DNA, 31 bp, Artificial Sequence
  Description of Artificial Sequence: Synthetic oligonucleotide
atcatgccatcgtgtctacatctgtgggctc

SEQ ID NO: 130018 - DNA, 30 bp, Artificial Sequence
  Description of Artificial Sequence: Synthetic oligonucleotide
tcatgccatcgtgtctacatctgtgggctc

SEQ ID NO: 130019 - DNA, 29 bp, Artificial Sequence
  Description of Artificial Sequence: Synthetic oligonucleotide
catgccatcgtgtctacatctgtgggctc

SEQ ID NO: 130020 - DNA, 30 bp, Artificial Sequence
  Description of Artificial Sequence: Synthetic oligonucleotide
atgccatcgtgtctacatctgtgggctcag

SEQ ID NO: 130021 - DNA, 29 bp, Artificial Sequence
  Description of Artificial Sequence: Synthetic oligonucleotide
tgccatcgtgtctacatctgtgggctcag

SEQ ID NO: 130022 - DNA, 28 bp, Artificial Sequence
  Description of Artificial Sequence: Synthetic oligonucleotide
gccatcgtgtctacatctgtgggctcag

SEQ ID NO: 130023 - DNA, 30 bp, Artificial Sequence
  Description of Artificial Sequence: Synthetic oligonucleotide
ccatcgtgtctacatctgtgggctcagaac

SEQ ID NO: 130024 - DNA, 31 bp, Artificial Sequence
  Description of Artificial Sequence: Synthetic oligonucleotide
catcgtgtctacatctgtgggctcagaacac

SEQ ID NO: 130025 - DNA, 33 bp, Artificial Sequence
  Description of Artificial Sequence: Synthetic oligonucleotide
atcgtgtctacatctgtgggctcagaacactac

SEQ ID NO: 130026 - DNA, 32 bp, Artificial Sequence
  Description of Artificial Sequence: Synthetic oligonucleotide
tcgtgtctacatctgtgggctcagaacactac

SEQ ID NO: 130027 - DNA, 31 bp, Artificial Sequence
  Description of Artificial Sequence: Synthetic oligonucleotide
cgtgtctacatctgtgggctcagaacactac

SEQ ID NO: 130028 - DNA, 31 bp, Artificial Sequence
  Description of Artificial Sequence: Synthetic oligonucleotide
gtgtctacatctgtgggctcagaacactacg

SEQ ID NO: 130029 - DNA, 32 bp, Artificial Sequence
  Description of Artificial Sequence: Synthetic oligonucleotide
tgtctacatctgtgggctcagaacactacgtc

SEQ ID NO: 130030 - DNA, 31 bp, Artificial Sequence
  Description of Artificial Sequence: Synthetic oligonucleotide
gtctacatctgtgggctcagaacactacgtc

SEQ ID NO: 130031 - DNA, 32 bp, Artificial Sequence
  Description of Artificial Sequence: Synthetic oligonucleotide
tctacatctgtgggctcagaacactacgtcag

SEQ ID NO: 130032 - DNA, 31 bp, Artificial Sequence
  Description of Artificial Sequence: Synthetic oligonucleotide
ctacatctgtgggctcagaacactacgtcag

SEQ ID NO: 130033 - DNA, 31 bp, Artificial Sequence
  Description of Artificial Sequence: Synthetic oligonucleotide
tacatctgtgggctcagaacactacgtcagc

SEQ ID NO: 130034 - DNA, 30 bp, Artificial Sequence
  Description of Artificial Sequence: Synthetic oligonucleotide
acatctgtgggctcagaacactacgtcagc

SEQ ID NO: 130035 - DNA, 29 bp, Artificial Sequence
  Description of Artificial Sequence: Synthetic oligonucleotide
catctgtgggctcagaacactacgtcagc

SEQ ID NO: 130036 - DNA, 32 bp, Artificial Sequence
  Description of Artificial Sequence: Synthetic oligonucleotide
atctgtgggctcagaacactacgtcagcattc

SEQ ID NO: 130037 - DNA, 31 bp, Artificial Sequence
  Description of Artificial Sequence: Synthetic oligonucleotide
tctgtgggctcagaacactacgtcagcattc

SEQ ID NO: 130038 - DNA, 30 bp, Artificial Sequence
  Description of Artificial Sequence: Synthetic oligonucleotide
ctgtgggctcagaacactacgtcagcattc

SEQ ID NO: 130039 - DNA, 33 bp, Artificial Sequence
  Description of Artificial Sequence: Synthetic oligonucleotide
tgtgggctcagaacactacgtcagcattctttc

SEQ ID NO: 130040 - DNA, 32 bp, Artificial Sequence
  Description of Artificial Sequence: Synthetic oligonucleotide
gtgggctcagaacactacgtcagcattctttc

SEQ ID NO: 130041 - DNA, 36 bp, Artificial Sequence
  Description of Artificial Sequence: Synthetic oligonucleotide
tgggctcagaacactacgtcagcattctttcatttg

SEQ ID NO: 130042 - DNA, 35 bp, Artificial Sequence
  Description of Artificial Sequence: Synthetic oligonucleotide
gggctcagaacactacgtcagcattctttcatttg

SEQ ID NO: 130043 - DNA, 37 bp, Artificial Sequence
  Description of Artificial Sequence: Synthetic oligonucleotide
ggctcagaacactacgtcagcattctttcatttgtag

SEQ ID NO: 130044 - DNA, 38 bp, Artificial Sequence
  Description of Artificial Sequence: Synthetic oligonucleotide
gctcagaacactacgtcagcattctttcatttgtagac

SEQ ID NO: 130045 - DNA, 40 bp, Artificial Sequence
  Description of Artificial Sequence: Synthetic oligonucleotide
ctcagaacactacgtcagcattctttcatttgtagacaag

SEQ ID NO: 130046 - DNA, 40 bp, Artificial Sequence
  Description of Artificial Sequence: Synthetic oligonucleotide
tcagaacactacgtcagcattctttcatttgtagacaagg

SEQ ID NO: 130047 - DNA, 39 bp, Artificial Sequence
  Description of Artificial Sequence: Synthetic oligonucleotide
cagaacactacgtcagcattctttcatttgtagacaagg

SEQ ID NO: 130048 - DNA, 41 bp, Artificial Sequence
  Description of Artificial Sequence: Synthetic oligonucleotide
agaacactacgtcagcattctttcatttgtagacaaggatc

SEQ ID NO: 130049 - DNA, 40 bp, Artificial Sequence
  Description of Artificial Sequence: Synthetic oligonucleotide
gaacactacgtcagcattctttcatttgtagacaaggatc

SEQ ID NO: 130050 - DNA, 41 bp, Artificial Sequence
  Description of Artificial Sequence: Synthetic oligonucleotide
aacactacgtcagcattctttcatttgtagacaaggatctg

SEQ ID NO: 130051 - DNA, 40 bp, Artificial Sequence
  Description of Artificial Sequence: Synthetic oligonucleotide
acactacgtcagcattctttcatttgtagacaaggatctg

SEQ ID NO: 130052 - DNA, 39 bp, Artificial Sequence
  Description of Artificial Sequence: Synthetic oligonucleotide
cactacgtcagcattctttcatttgtagacaaggatctg

SEQ ID NO: 130053 - DNA, 39 bp, Artificial Sequence
  Description of Artificial Sequence: Synthetic oligonucleotide
actacgtcagcattctttcatttgtagacaaggatctgc

SEQ ID NO: 130054 - DNA, 38 bp, Artificial Sequence
  Description of Artificial Sequence: Synthetic oligonucleotide
ctacgtcagcattctttcatttgtagacaaggatctgc

SEQ ID NO: 130055 - DNA, 39 bp, Artificial Sequence
  Description of Artificial Sequence: Synthetic oligonucleotide
tacgtcagcattctttcatttgtagacaaggatctgctg

SEQ ID NO: 130056 - DNA, 38 bp, Artificial Sequence
  Description of Artificial Sequence: Synthetic oligonucleotide
acgtcagcattctttcatttgtagacaaggatctgctg

SEQ ID NO: 130057 - DNA, 37 bp, Artificial Sequence
  Description of Artificial Sequence: Synthetic oligonucleotide
cgtcagcattctttcatttgtagacaaggatctgctg

SEQ ID NO: 130058 - DNA, 37 bp, Artificial Sequence
  Description of Artificial Sequence: Synthetic oligonucleotide
gtcagcattctttcatttgtagacaaggatctgctgg

SEQ ID NO: 130059 - DNA, 39 bp, Artificial Sequence
  Description of Artificial Sequence: Synthetic oligonucleotide
tcagcattctttcatttgtagacaaggatctgctggaac

SEQ ID NO: 130060 - DNA, 38 bp, Artificial Sequence
  Description of Artificial Sequence: Synthetic oligonucleotide
cagcattctttcatttgtagacaaggatctgctggaac

SEQ ID NO: 130061 - DNA, 38 bp, Artificial Sequence
  Description of Artificial Sequence: Synthetic oligonucleotide
agcattctttcatttgtagacaaggatctgctggaacc

SEQ ID NO: 130062 - DNA, 37 bp, Artificial Sequence
  Description of Artificial Sequence: Synthetic oligonucleotide
gcattctttcatttgtagacaaggatctgctggaacc

SEQ ID NO: 130063 - DNA, 38 bp, Artificial Sequence
  Description of Artificial Sequence: Synthetic oligonucleotide
cattctttcatttgtagacaaggatctgctggaacctg

SEQ ID NO: 130064 - DNA, 38 bp, Artificial Sequence
  Description of Artificial Sequence: Synthetic oligonucleotide
attctttcatttgtagacaaggatctgctggaacctgg

SEQ ID NO: 130065 - DNA, 37 bp, Artificial Sequence
  Description of Artificial Sequence: Synthetic oligonucleotide
ttctttcatttgtagacaaggatctgctggaacctgg

SEQ ID NO: 130066 - DNA, 36 bp, Artificial Sequence
  Description of Artificial Sequence: Synthetic oligonucleotide
tctttcatttgtagacaaggatctgctggaacctgg

SEQ ID NO: 130067 - DNA, 35 bp, Artificial Sequence
  Description of Artificial Sequence: Synthetic oligonucleotide
ctttcatttgtagacaaggatctgctggaacctgg

SEQ ID NO: 130068 - DNA, 35 bp, Artificial Sequence
  Description of Artificial Sequence: Synthetic oligonucleotide
tttcatttgtagacaaggatctgctggaacctggc

SEQ ID NO: 130069 - DNA, 34 bp, Artificial Sequence
  Description of Artificial Sequence: Synthetic oligonucleotide
ttcatttgtagacaaggatctgctggaacctggc

SEQ ID NO: 130070 - DNA, 33 bp, Artificial Sequence
  Description of Artificial Sequence: Synthetic oligonucleotide
tcatttgtagacaaggatctgctggaacctggc

SEQ ID NO: 130071 - DNA, 32 bp, Artificial Sequence
  Description of Artificial Sequence: Synthetic oligonucleotide
catttgtagacaaggatctgctggaacctggc

SEQ ID NO: 130072 - DNA, 33 bp, Artificial Sequence
  Description of Artificial Sequence: Synthetic oligonucleotide
atttgtagacaaggatctgctggaacctggctg

SEQ ID NO: 130073 - DNA, 32 bp, Artificial Sequence
  Description of Artificial Sequence: Synthetic oligonucleotide
tttgtagacaaggatctgctggaacctggctg

SEQ ID NO: 130074 - DNA, 31 bp, Artificial Sequence
  Description of Artificial Sequence: Synthetic oligonucleotide
ttgtagacaaggatctgctggaacctggctg

SEQ ID NO: 130075 - DNA, 30 bp, Artificial Sequence
  Description of Artificial Sequence: Synthetic oligonucleotide
tgtagacaaggatctgctggaacctggctg

SEQ ID NO: 130076 - DNA, 29 bp, Artificial Sequence
  Description of Artificial Sequence: Synthetic oligonucleotide
gtagacaaggatctgctggaacctggctg

SEQ ID NO: 130077 - DNA, 29 bp, Artificial Sequence
  Description of Artificial Sequence: Synthetic oligonucleotide
tagacaaggatctgctggaacctggctgc

SEQ ID NO: 130078 - DNA, 28 bp, Artificial Sequence
  Description of Artificial Sequence: Synthetic oligonucleotide
agacaaggatctgctggaacctggctgc

SEQ ID NO: 130079 - DNA, 27 bp, Artificial Sequence
  Description of Artificial Sequence: Synthetic oligonucleotide
gacaaggatctgctggaacctggctgc

SEQ ID NO: 130080 - DNA, 28 bp, Artificial Sequence
  Description of Artificial Sequence: Synthetic oligonucleotide
acaaggatctgctggaacctggctgctc

SEQ ID NO: 130081 - DNA, 27 bp, Artificial Sequence
  Description of Artificial Sequence: Synthetic oligonucleotide
caaggatctgctggaacctggctgctc

SEQ ID NO: 130082 - DNA, 27 bp, Artificial Sequence
  Description of Artificial Sequence: Synthetic oligonucleotide
aaggatctgctggaacctggctgctcg

SEQ ID NO: 130083 - DNA, 26 bp, Artificial Sequence
  Description of Artificial Sequence: Synthetic oligonucleotide
aggatctgctggaacctggctgctcg

SEQ ID NO: 130084 - DNA, 25 bp, Artificial Sequence
  Description of Artificial Sequence: Synthetic oligonucleotide
ggatctgctggaacctggctgctcg

SEQ ID NO: 130085 - DNA, 26 bp, Artificial Sequence
  Description of Artificial Sequence: Synthetic oligonucleotide
gatctgctggaacctggctgctcggt

SEQ ID NO: 130086 - DNA, 26 bp, Artificial Sequence
  Description of Artificial Sequence: Synthetic oligonucleotide
atctgctggaacctggctgctcggtc

SEQ ID NO: 130087 - DNA, 25 bp, Artificial Sequence
  Description of Artificial Sequence: Synthetic oligonucleotide
tctgctggaacctggctgctcggtc

SEQ ID NO: 130088 - DNA, 24 bp, Artificial Sequence
  Description of Artificial Sequence: Synthetic oligonucleotide
ctgctggaacctggctgctcggtc

SEQ ID NO: 130089 - DNA, 25 bp, Artificial Sequence
  Description of Artificial Sequence: Synthetic oligonucleotide
tgctggaacctggctgctcggtcct

SEQ ID NO: 130090 - DNA, 24 bp, Artificial Sequence
  Description of Artificial Sequence: Synthetic oligonucleotide
gctggaacctggctgctcggtcct

SEQ ID NO: 130091 - DNA, 24 bp, Artificial Sequence
  Description of Artificial Sequence: Synthetic oligonucleotide
ctggaacctggctgctcggtcctg

SEQ ID NO: 130092 - DNA, 25 bp, Artificial Sequence
  Description of Artificial Sequence: Synthetic oligonucleotide
tggaacctggctgctcggtcctgct

SEQ ID NO: 130093 - DNA, 24 bp, Artificial Sequence
  Description of Artificial Sequence: Synthetic oligonucleotide
ggaacctggctgctcggtcctgct

SEQ ID NO: 130094 - DNA, 26 bp, Artificial Sequence
  Description of Artificial Sequence: Synthetic oligonucleotide
gaacctggctgctcggtcctgctcaa

SEQ ID NO: 130095 - DNA, 26 bp, Artificial Sequence
  Description of Artificial Sequence: Synthetic oligonucleotide
aacctggctgctcggtcctgctcaac

SEQ ID NO: 130096 - DNA, 25 bp, Artificial Sequence
  Description of Artificial Sequence: Synthetic oligonucleotide
acctggctgctcggtcctgctcaac

SEQ ID NO: 130097 - DNA, 24 bp, Artificial Sequence
  Description of Artificial Sequence: Synthetic oligonucleotide
cctggctgctcggtcctgctcaac

SEQ ID NO: 130098 - DNA, 25 bp, Artificial Sequence
  Description of Artificial Sequence: Synthetic oligonucleotide
ctggctgctcggtcctgctcaacca

SEQ ID NO: 130099 - DNA, 27 bp, Artificial Sequence
  Description of Artificial Sequence: Synthetic oligonucleotide
tggctgctcggtcctgctcaaccacaa

SEQ ID NO: 130100 - DNA, 26 bp, Artificial Sequence
  Description of Artificial Sequence: Synthetic oligonucleotide
ggctgctcggtcctgctcaaccacaa

SEQ ID NO: 130101 - DNA, 26 bp, Artificial Sequence
  Description of Artificial Sequence: Synthetic oligonucleotide
gctgctcggtcctgctcaaccacaag

SEQ ID NO: 130102 - DNA, 27 bp, Artificial Sequence
  Description of Artificial Sequence: Synthetic oligonucleotide
ctgctcggtcctgctcaaccacaaggt

SEQ ID NO: 130103 - DNA, 27 bp, Artificial Sequence
  Description of Artificial Sequence: Synthetic oligonucleotide
tgctcggtcctgctcaaccacaaggtg

SEQ ID NO: 130104 - DNA, 26 bp, Artificial Sequence
  Description of Artificial Sequence: Synthetic oligonucleotide
gctcggtcctgctcaaccacaaggtg

SEQ ID NO: 130105 - DNA, 27 bp, Artificial Sequence
  Description of Artificial Sequence: Synthetic oligonucleotide
ctcggtcctgctcaaccacaaggtgca

SEQ ID NO: 130106 - DNA, 28 bp, Artificial Sequence
  Description of Artificial Sequence: Synthetic oligonucleotide
tcggtcctgctcaaccacaaggtgcatg

SEQ ID NO: 130107 - DNA, 27 bp, Artificial Sequence
  Description of Artificial Sequence: Synthetic oligonucleotide
cggtcctgctcaaccacaaggtgcatg

SEQ ID NO: 130108 - DNA, 27 bp, Artificial Sequence
  Description of Artificial Sequence: Synthetic oligonucleotide
ggtcctgctcaaccacaaggtgcatgc

SEQ ID NO: 130109 - DNA, 27 bp, Artificial Sequence
  Description of Artificial Sequence: Synthetic oligonucleotide
gtcctgctcaaccacaaggtgcatgcc

SEQ ID NO: 130110 - DNA, 27 bp, Artificial Sequence
  Description of Artificial Sequence: Synthetic oligonucleotide
tcctgctcaaccacaaggtgcatgccg

SEQ ID NO: 130111 - DNA, 27 bp, Artificial Sequence
  Description of Artificial Sequence: Synthetic oligonucleotide
cctgctcaaccacaaggtgcatgccgt

SEQ ID NO: 130112 - DNA, 27 bp, Artificial Sequence
  Description of Artificial Sequence: Synthetic oligonucleotide
ctgctcaaccacaaggtgcatgccgtg

SEQ ID NO: 130113 - DNA, 30 bp, Artificial Sequence
  Description of Artificial Sequence: Synthetic oligonucleotide
tgctcaaccacaaggtgcatgccgtgatag

SEQ ID NO: 130114 - DNA, 29 bp, Artificial Sequence
  Description of Artificial Sequence: Synthetic oligonucleotide
gctcaaccacaaggtgcatgccgtgatag

SEQ ID NO: 130115 - DNA, 29 bp, Artificial Sequence
  Description of Artificial Sequence: Synthetic oligonucleotide
ctcaaccacaaggtgcatgccgtgatagg

SEQ ID NO: 130116 - DNA, 29 bp, Artificial Sequence
  Description of Artificial Sequence: Synthetic oligonucleotide
tcaaccacaaggtgcatgccgtgataggg

SEQ ID NO: 130117 - DNA, 28 bp, Artificial Sequence
  Description of Artificial Sequence: Synthetic oligonucleotide
caaccacaaggtgcatgccgtgataggg

SEQ ID NO: 130118 - DNA, 28 bp, Artificial Sequence
  Description of Artificial Sequence: Synthetic oligonucleotide
aaccacaaggtgcatgccgtgatagggg

SEQ ID NO: 130119 - DNA, 27 bp, Artificial Sequence
  Description of Artificial Sequence: Synthetic oligonucleotide
accacaaggtgcatgccgtgatagggg

SEQ ID NO: 130120 - DNA, 27 bp, Artificial Sequence
  Description of Artificial Sequence: Synthetic oligonucleotide
ccacaaggtgcatgccgtgataggggt

SEQ ID NO: 130121 - DNA, 27 bp, Artificial Sequence
  Description of Artificial Sequence: Synthetic oligonucleotide
cacaaggtgcatgccgtgataggggtg

SEQ ID NO: 130122 - DNA, 27 bp, Artificial Sequence
  Description of Artificial Sequence: Synthetic oligonucleotide
acaaggtgcatgccgtgataggggtgc

SEQ ID NO: 130123 - DNA, 27 bp, Artificial Sequence
  Description of Artificial Sequence: Synthetic oligonucleotide
caaggtgcatgccgtgataggggtgct

SEQ ID NO: 130124 - DNA, 27 bp, Artificial Sequence
  Description of Artificial Sequence: Synthetic oligonucleotide
aaggtgcatgccgtgataggggtgctg

SEQ ID NO: 130125 - DNA, 27 bp, Artificial Sequence
  Description of Artificial Sequence: Synthetic oligonucleotide
aggtgcatgccgtgataggggtgctga

SEQ ID NO: 130126 - DNA, 27 bp, Artificial Sequence
  Description of Artificial Sequence: Synthetic oligonucleotide
ggtgcatgccgtgataggggtgctgat

SEQ ID NO: 130127 - DNA, 27 bp, Artificial Sequence
  Description of Artificial Sequence: Synthetic oligonucleotide
gtgcatgccgtgataggggtgctgatg

SEQ ID NO: 130128 - DNA, 27 bp, Artificial Sequence
  Description of Artificial Sequence: Synthetic oligonucleotide
tgcatgccgtgataggggtgctgatgg

SEQ ID NO: 130129 - DNA, 27 bp, Artificial Sequence
  Description of Artificial Sequence: Synthetic oligonucleotide
gcatgccgtgataggggtgctgatgga

SEQ ID NO: 130130 - DNA, 28 bp, Artificial Sequence
  Description of Artificial Sequence: Synthetic oligonucleotide
catgccgtgataggggtgctgatggatg

SEQ ID NO: 130131 - DNA, 29 bp, Artificial Sequence
  Description of Artificial Sequence: Synthetic oligonucleotide
atgccgtgataggggtgctgatggatgac

SEQ ID NO: 130132 - DNA, 28 bp, Artificial Sequence
  Description of Artificial Sequence: Synthetic oligonucleotide
tgccgtgataggggtgctgatggatgac

SEQ ID NO: 130133 - DNA, 27 bp, Artificial Sequence
  Description of Artificial Sequence: Synthetic oligonucleotide
gccgtgataggggtgctgatggatgac

SEQ ID NO: 130134 - DNA, 28 bp, Artificial Sequence
  Description of Artificial Sequence: Synthetic oligonucleotide
ccgtgataggggtgctgatggatgacac

SEQ ID NO: 130135 - DNA, 28 bp, Artificial Sequence
  Description of Artificial Sequence: Synthetic oligonucleotide
cgtgataggggtgctgatggatgacacg

SEQ ID NO: 130136 - DNA, 28 bp, Artificial Sequence
  Description of Artificial Sequence: Synthetic oligonucleotide
gtgataggggtgctgatggatgacacgg

SEQ ID NO: 130137 - DNA, 30 bp, Artificial Sequence
  Description of Artificial Sequence: Synthetic oligonucleotide
tgataggggtgctgatggatgacacggatc

SEQ ID NO: 130138 - DNA, 29 bp, Artificial Sequence
  Description of Artificial Sequence: Synthetic oligonucleotide
gataggggtgctgatggatgacacggatc

SEQ ID NO: 130139 - DNA, 29 bp, Artificial Sequence
  Description of Artificial Sequence: Synthetic oligonucleotide
ataggggtgctgatggatgacacggatcc

SEQ ID NO: 130140 - DNA, 28 bp, Artificial Sequence
  Description of Artificial Sequence: Synthetic oligonucleotide
taggggtgctgatggatgacacggatcc

SEQ ID NO: 130141 - DNA, 27 bp, Artificial Sequence
  Description of Artificial Sequence: Synthetic oligonucleotide
aggggtgctgatggatgacacggatcc

SEQ ID NO: 130142 - DNA, 26 bp, Artificial Sequence
  Description of Artificial Sequence: Synthetic oligonucleotide
ggggtgctgatggatgacacggatcc

SEQ ID NO: 130143 - DNA, 26 bp, Artificial Sequence
  Description of Artificial Sequence: Synthetic oligonucleotide
gggtgctgatggatgacacggatccc

SEQ ID NO: 130144 - DNA, 27 bp, Artificial Sequence
  Description of Artificial Sequence: Synthetic oligonucleotide
ggtgctgatggatgacacggatcccct

SEQ ID NO: 130145 - DNA, 27 bp, Artificial Sequence
  Description of Artificial Sequence: Synthetic oligonucleotide
gtgctgatggatgacacggatcccctg

SEQ ID NO: 130146 - DNA, 27 bp, Artificial Sequence
  Description of Artificial Sequence: Synthetic oligonucleotide
tgctgatggatgacacggatcccctgg

SEQ ID NO: 130147 - DNA, 27 bp, Artificial Sequence
  Description of Artificial Sequence: Synthetic oligonucleotide
gctgatggatgacacggatcccctggt

SEQ ID NO: 130148 - DNA, 27 bp, Artificial Sequence
  Description of Artificial Sequence: Synthetic oligonucleotide
ctgatggatgacacggatcccctggtc

SEQ ID NO: 130149 - DNA, 28 bp, Artificial Sequence
  Description of Artificial Sequence: Synthetic oligonucleotide
tgatggatgacacggatcccctggtcac

SEQ ID NO: 130150 - DNA, 27 bp, Artificial Sequence
  Description of Artificial Sequence: Synthetic oligonucleotide
gatggatgacacggatcccctggtcac

SEQ ID NO: 130151 - DNA, 28 bp, Artificial Sequence
  Description of Artificial Sequence: Synthetic oligonucleotide
atggatgacacggatcccctggtcacag

SEQ ID NO: 130152 - DNA, 27 bp, Artificial Sequence
  Description of Artificial Sequence: Synthetic oligonucleotide
tggatgacacggatcccctggtcacag

SEQ ID NO: 130153 - DNA, 27 bp, Artificial Sequence
  Description of Artificial Sequence: Synthetic oligonucleotide
ggatgacacggatcccctggtcacagt

SEQ ID NO: 130154 - DNA, 27 bp, Artificial Sequence
  Description of Artificial Sequence: Synthetic oligonucleotide
gatgacacggatcccctggtcacagtg

SEQ ID NO: 130155 - DNA, 29 bp, Artificial Sequence
  Description of Artificial Sequence: Synthetic oligonucleotide
atgacacggatcccctggtcacagtgatg

SEQ ID NO: 130156 - DNA, 28 bp, Artificial Sequence
  Description of Artificial Sequence: Synthetic oligonucleotide
tgacacggatcccctggtcacagtgatg

SEQ ID NO: 130157 - DNA, 27 bp, Artificial Sequence
  Description of Artificial Sequence: Synthetic oligonucleotide
gacacggatcccctggtcacagtgatg

SEQ ID NO: 130158 - DNA, 29 bp, Artificial Sequence
  Description of Artificial Sequence: Synthetic oligonucleotide
acacggatcccctggtcacagtgatgaag

SEQ ID NO: 130159 - DNA, 28 bp, Artificial Sequence
  Description of Artificial Sequence: Synthetic oligonucleotide
cacggatcccctggtcacagtgatgaag

SEQ ID NO: 130160 - DNA, 28 bp, Artificial Sequence
  Description of Artificial Sequence: Synthetic oligonucleotide
acggatcccctggtcacagtgatgaagg

SEQ ID NO: 130161 - DNA, 27 bp, Artificial Sequence
  Description of Artificial Sequence: Synthetic oligonucleotide
cggatcccctggtcacagtgatgaagg

SEQ ID NO: 130162 - DNA, 29 bp, Artificial Sequence
  Description of Artificial Sequence: Synthetic oligonucleotide
ggatcccctggtcacagtgatgaaggtag

SEQ ID NO: 130163 - DNA, 33 bp, Artificial Sequence
  Description of Artificial Sequence: Synthetic oligonucleotide
gatcccctggtcacagtgatgaaggtagaaaag

SEQ ID NO: 130164 - DNA, 33 bp, Artificial Sequence
  Description of Artificial Sequence: Synthetic oligonucleotide
atcccctggtcacagtgatgaaggtagaaaagg

SEQ ID NO: 130165 - DNA, 32 bp, Artificial Sequence
  Description of Artificial Sequence: Synthetic oligonucleotide
tcccctggtcacagtgatgaaggtagaaaagg

SEQ ID NO: 130166 - DNA, 31 bp, Artificial Sequence
  Description of Artificial Sequence: Synthetic oligonucleotide
cccctggtcacagtgatgaaggtagaaaagg

SEQ ID NO: 130167 - DNA, 31 bp, Artificial Sequence
  Description of Artificial Sequence: Synthetic oligonucleotide
ccctggtcacagtgatgaaggtagaaaaggc

SEQ ID NO: 130168 - DNA, 31 bp, Artificial Sequence
  Description of Artificial Sequence: Synthetic oligonucleotide
cctggtcacagtgatgaaggtagaaaaggcc

SEQ ID NO: 130169 - DNA, 31 bp, Artificial Sequence
  Description of Artificial Sequence: Synthetic oligonucleotide
ctggtcacagtgatgaaggtagaaaaggccc

SEQ ID NO: 130170 - DNA, 31 bp, Artificial Sequence
  Description of Artificial Sequence: Synthetic oligonucleotide
tggtcacagtgatgaaggtagaaaaggcccc

SEQ ID NO: 130171 - DNA, 30 bp, Artificial Sequence
  Description of Artificial Sequence: Synthetic oligonucleotide
ggtcacagtgatgaaggtagaaaaggcccc

SEQ ID NO: 130172 - DNA, 30 bp, Artificial Sequence
  Description of Artificial Sequence: Synthetic oligonucleotide
gtcacagtgatgaaggtagaaaaggccccc

SEQ ID NO: 130173 - DNA, 30 bp, Artificial Sequence
  Description of Artificial Sequence: Synthetic oligonucleotide
tcacagtgatgaaggtagaaaaggcccccc

SEQ ID NO: 130174 - DNA, 29 bp, Artificial Sequence
  Description of Artificial Sequence: Synthetic oligonucleotide
cacagtgatgaaggtagaaaaggcccccc

SEQ ID NO: 130175 - DNA, 30 bp, Artificial Sequence
  Description of Artificial Sequence: Synthetic oligonucleotide
acagtgatgaaggtagaaaaggccccccag

SEQ ID NO: 130176 - DNA, 29 bp, Artificial Sequence
  Description of Artificial Sequence: Synthetic oligonucleotide
cagtgatgaaggtagaaaaggccccccag

SEQ ID NO: 130177 - DNA, 29 bp, Artificial Sequence
  Description of Artificial Sequence: Synthetic oligonucleotide
agtgatgaaggtagaaaaggccccccagg

SEQ ID NO: 130178 - DNA, 28 bp, Artificial Sequence
  Description of Artificial Sequence: Synthetic oligonucleotide
gtgatgaaggtagaaaaggccccccagg

SEQ ID NO: 130179 - DNA, 29 bp, Artificial Sequence
  Description of Artificial Sequence: Synthetic oligonucleotide
tgatgaaggtagaaaaggccccccaggag

SEQ ID NO: 130180 - DNA, 28 bp, Artificial Sequence
  Description of Artificial Sequence: Synthetic oligonucleotide
gatgaaggtagaaaaggccccccaggag

SEQ ID NO: 130181 - DNA, 29 bp, Artificial Sequence
  Description of Artificial Sequence: Synthetic oligonucleotide
atgaaggtagaaaaggccccccaggagac

SEQ ID NO: 130182 - DNA, 28 bp, Artificial Sequence
  Description of Artificial Sequence: Synthetic oligonucleotide
tgaaggtagaaaaggccccccaggagac

SEQ ID NO: 130183 - DNA, 27 bp, Artificial Sequence
  Description of Artificial Sequence: Synthetic oligonucleotide
gaaggtagaaaaggccccccaggagac

SEQ ID NO: 130184 - DNA, 27 bp, Artificial Sequence
  Description of Artificial Sequence: Synthetic oligonucleotide
aaggtagaaaaggccccccaggagacc

SEQ ID NO: 130185 - DNA, 27 bp, Artificial Sequence
  Description of Artificial Sequence: Synthetic oligonucleotide
aggtagaaaaggccccccaggagacct

SEQ ID NO: 130186 - DNA, 27 bp, Artificial Sequence
  Description of Artificial Sequence: Synthetic oligonucleotide
ggtagaaaaggccccccaggagaccta

SEQ ID NO: 130187 - DNA, 28 bp, Artificial Sequence
  Description of Artificial Sequence: Synthetic oligonucleotide
gtagaaaaggccccccaggagacctatg

SEQ ID NO: 130188 - DNA, 28 bp, Artificial Sequence
  Description of Artificial Sequence: Synthetic oligonucleotide
tagaaaaggccccccaggagacctatgc

SEQ ID NO: 130189 - DNA, 27 bp, Artificial Sequence
  Description of Artificial Sequence: Synthetic oligonucleotide
agaaaaggccccccaggagacctatgc

SEQ ID NO: 130190 - DNA, 27 bp, Artificial Sequence
  Description of Artificial Sequence: Synthetic oligonucleotide
gaaaaggccccccaggagacctatgca

SEQ ID NO: 130191 - DNA, 27 bp, Artificial Sequence
  Description of Artificial Sequence: Synthetic oligonucleotide
aaaaggccccccaggagacctatgcag

SEQ ID NO: 130192 - DNA, 27 bp, Artificial Sequence
  Description of Artificial Sequence: Synthetic oligonucleotide
aaaggccccccaggagacctatgcaga

SEQ ID NO: 130193 - DNA, 27 bp, Artificial Sequence
  Description of Artificial Sequence: Synthetic oligonucleotide
aaggccccccaggagacctatgcagat

SEQ ID NO: 130194 - DNA, 27 bp, Artificial Sequence
  Description of Artificial Sequence: Synthetic oligonucleotide
aggccccccaggagacctatgcagata

SEQ ID NO: 130195 - DNA, 27 bp, Artificial Sequence
  Description of Artificial Sequence: Synthetic oligonucleotide
ggccccccaggagacctatgcagatat

SEQ ID NO: 130196 - DNA, 28 bp, Artificial Sequence
  Description of Artificial Sequence: Synthetic oligonucleotide
gccccccaggagacctatgcagatattg

SEQ ID NO: 130197 - DNA, 28 bp, Artificial Sequence
  Description of Artificial Sequence: Synthetic oligonucleotide
ccccccaggagacctatgcagatattgg

SEQ ID NO: 130198 - DNA, 28 bp, Artificial Sequence
  Description of Artificial Sequence: Synthetic oligonucleotide
cccccaggagacctatgcagatattggg

SEQ ID NO: 130199 - DNA, 28 bp, Artificial Sequence
  Description of Artificial Sequence: Synthetic oligonucleotide
ccccaggagacctatgcagatattgggg

SEQ ID NO: 130200 - DNA, 28 bp, Artificial Sequence
  Description of Artificial Sequence: Synthetic oligonucleotide
cccaggagacctatgcagatattggggg

SEQ ID NO: 130201 - DNA, 28 bp, Artificial Sequence
  Description of Artificial Sequence: Synthetic oligonucleotide
ccaggagacctatgcagatattgggggg

SEQ ID NO: 130202 - DNA, 30 bp, Artificial Sequence
  Description of Artificial Sequence: Synthetic oligonucleotide
caggagacctatgcagatattggggggttg

SEQ ID NO: 130203 - DNA, 30 bp, Artificial Sequence
  Description of Artificial Sequence: Synthetic oligonucleotide
aggagacctatgcagatattggggggttgg

SEQ ID NO: 130204 - DNA, 29 bp, Artificial Sequence
  Description of Artificial Sequence: Synthetic oligonucleotide
ggagacctatgcagatattggggggttgg

SEQ ID NO: 130205 - DNA, 30 bp, Artificial Sequence
  Description of Artificial Sequence: Synthetic oligonucleotide
gagacctatgcagatattggggggttggac

SEQ ID NO: 130206 - DNA, 32 bp, Artificial Sequence
  Description of Artificial Sequence: Synthetic oligonucleotide
agacctatgcagatattggggggttggacaac

SEQ ID NO: 130207 - DNA, 31 bp, Artificial Sequence
  Description of Artificial Sequence: Synthetic oligonucleotide
gacctatgcagatattggggggttggacaac

SEQ ID NO: 130208 - DNA, 31 bp, Artificial Sequence
  Description of Artificial Sequence: Synthetic oligonucleotide
acctatgcagatattggggggttggacaacc

SEQ ID NO: 130209 - DNA, 30 bp, Artificial Sequence
  Description of Artificial Sequence: Synthetic oligonucleotide
cctatgcagatattggggggttggacaacc

SEQ ID NO: 130210 - DNA, 35 bp, Artificial Sequence
  Description of Artificial Sequence: Synthetic oligonucleotide
ctatgcagatattggggggttggacaaccaaattc

SEQ ID NO: 130211 - DNA, 36 bp, Artificial Sequence
  Description of Artificial Sequence: Synthetic oligonucleotide
tatgcagatattggggggttggacaaccaaattcag

SEQ ID NO: 130212 - DNA, 35 bp, Artificial Sequence
  Description of Artificial Sequence: Synthetic oligonucleotide
atgcagatattggggggttggacaaccaaattcag

SEQ ID NO: 130213 - DNA, 34 bp, Artificial Sequence
  Description of Artificial Sequence: Synthetic oligonucleotide
tgcagatattggggggttggacaaccaaattcag

SEQ ID NO: 130214 - DNA, 33 bp, Artificial Sequence
  Description of Artificial Sequence: Synthetic oligonucleotide
gcagatattggggggttggacaaccaaattcag

SEQ ID NO: 130215 - DNA, 33 bp, Artificial Sequence
  Description of Artificial Sequence: Synthetic oligonucleotide
cagatattggggggttggacaaccaaattcagg

SEQ ID NO: 130216 - DNA, 40 bp, Artificial Sequence
  Description of Artificial Sequence: Synthetic oligonucleotide
agatattggggggttggacaaccaaattcaggaaattaag

SEQ ID NO: 130217 - DNA, 39 bp, Artificial Sequence
  Description of Artificial Sequence: Synthetic oligonucleotide
gatattggggggttggacaaccaaattcaggaaattaag

SEQ ID NO: 130218 - DNA, 39 bp, Artificial Sequence
  Description of Artificial Sequence: Synthetic oligonucleotide
atattggggggttggacaaccaaattcaggaaattaagg

SEQ ID NO: 130219 - DNA, 38 bp, Artificial Sequence
  Description of Artificial Sequence: Synthetic oligonucleotide
tattggggggttggacaaccaaattcaggaaattaagg

SEQ ID NO: 130220 - DNA, 37 bp, Artificial Sequence
  Description of Artificial Sequence: Synthetic oligonucleotide
attggggggttggacaaccaaattcaggaaattaagg

SEQ ID NO: 130221 - DNA, 36 bp, Artificial Sequence
  Description of Artificial Sequence: Synthetic oligonucleotide
ttggggggttggacaaccaaattcaggaaattaagg

SEQ ID NO: 130222 - DNA, 35 bp, Artificial Sequence
  Description of Artificial Sequence: Synthetic oligonucleotide
tggggggttggacaaccaaattcaggaaattaagg

SEQ ID NO: 130223 - DNA, 34 bp, Artificial Sequence
  Description of Artificial Sequence: Synthetic oligonucleotide
ggggggttggacaaccaaattcaggaaattaagg

SEQ ID NO: 130224 - DNA, 37 bp, Artificial Sequence
  Description of Artificial Sequence: Synthetic oligonucleotide
gggggttggacaaccaaattcaggaaattaaggaatc

SEQ ID NO: 130225 - DNA, 38 bp, Artificial Sequence
  Description of Artificial Sequence: Synthetic oligonucleotide
ggggttggacaaccaaattcaggaaattaaggaatctg

SEQ ID NO: 130226 - DNA, 39 bp, Artificial Sequence
  Description of Artificial Sequence: Synthetic oligonucleotide
gggttggacaaccaaattcaggaaattaaggaatctgtg

SEQ ID NO: 130227 - DNA, 39 bp, Artificial Sequence
  Description of Artificial Sequence: Synthetic oligonucleotide
ggttggacaaccaaattcaggaaattaaggaatctgtgg

SEQ ID NO: 130228 - DNA, 40 bp, Artificial Sequence
  Description of Artificial Sequence: Synthetic oligonucleotide
gttggacaaccaaattcaggaaattaaggaatctgtggag

SEQ ID NO: 130229 - DNA, 40 bp, Artificial Sequence
  Description of Artificial Sequence: Synthetic oligonucleotide
ttggacaaccaaattcaggaaattaaggaatctgtggagc

SEQ ID NO: 130230 - DNA, 39 bp, Artificial Sequence
  Description of Artificial Sequence: Synthetic oligonucleotide
tggacaaccaaattcaggaaattaaggaatctgtggagc

SEQ ID NO: 130231 - DNA, 38 bp, Artificial Sequence
  Description of Artificial Sequence: Synthetic oligonucleotide
ggacaaccaaattcaggaaattaaggaatctgtggagc

SEQ ID NO: 130232 - DNA, 40 bp, Artificial Sequence
  Description of Artificial Sequence: Synthetic oligonucleotide
gacaaccaaattcaggaaattaaggaatctgtggagcttc

SEQ ID NO: 130233 - DNA, 40 bp, Artificial Sequence
  Description of Artificial Sequence: Synthetic oligonucleotide
acaaccaaattcaggaaattaaggaatctgtggagcttcc

SEQ ID NO: 130234 - DNA, 39 bp, Artificial Sequence
  Description of Artificial Sequence: Synthetic oligonucleotide
caaccaaattcaggaaattaaggaatctgtggagcttcc

SEQ ID NO: 130235 - DNA, 40 bp, Artificial Sequence
  Description of Artificial Sequence: Synthetic oligonucleotide
aaccaaattcaggaaattaaggaatctgtggagcttcctc

SEQ ID NO: 130236 - DNA, 39 bp, Artificial Sequence
  Description of Artificial Sequence: Synthetic oligonucleotide
accaaattcaggaaattaaggaatctgtggagcttcctc

SEQ ID NO: 130237 - DNA, 38 bp, Artificial Sequence
  Description of Artificial Sequence: Synthetic oligonucleotide
ccaaattcaggaaattaaggaatctgtggagcttcctc

SEQ ID NO: 130238 - DNA, 39 bp, Artificial Sequence
  Description of Artificial Sequence: Synthetic oligonucleotide
caaattcaggaaattaaggaatctgtggagcttcctctc

SEQ ID NO: 130239 - DNA, 40 bp, Artificial Sequence
  Description of Artificial Sequence: Synthetic oligonucleotide
aaattcaggaaattaaggaatctgtggagcttcctctcac

SEQ ID NO: 130240 - DNA, 39 bp, Artificial Sequence
  Description of Artificial Sequence: Synthetic oligonucleotide
aattcaggaaattaaggaatctgtggagcttcctctcac

SEQ ID NO: 130241 - DNA, 38 bp, Artificial Sequence
  Description of Artificial Sequence: Synthetic oligonucleotide
attcaggaaattaaggaatctgtggagcttcctctcac

SEQ ID NO: 130242 - DNA, 37 bp, Artificial Sequence
  Description of Artificial Sequence: Synthetic oligonucleotide
ttcaggaaattaaggaatctgtggagcttcctctcac

SEQ ID NO: 130243 - DNA, 36 bp, Artificial Sequence
  Description of Artificial Sequence: Synthetic oligonucleotide
tcaggaaattaaggaatctgtggagcttcctctcac

SEQ ID NO: 130244 - DNA, 35 bp, Artificial Sequence
  Description of Artificial Sequence: Synthetic oligonucleotide
caggaaattaaggaatctgtggagcttcctctcac

SEQ ID NO: 130245 - DNA, 35 bp, Artificial Sequence
  Description of Artificial Sequence: Synthetic oligonucleotide
aggaaattaaggaatctgtggagcttcctctcacc

SEQ ID NO: 130246 - DNA, 34 bp, Artificial Sequence
  Description of Artificial Sequence: Synthetic oligonucleotide
ggaaattaaggaatctgtggagcttcctctcacc

SEQ ID NO: 130247 - DNA, 34 bp, Artificial Sequence
  Description of Artificial Sequence: Synthetic oligonucleotide
gaaattaaggaatctgtggagcttcctctcaccc

SEQ ID NO: 130248 - DNA, 36 bp, Artificial Sequence
  Description of Artificial Sequence: Synthetic oligonucleotide
aaattaaggaatctgtggagcttcctctcacccatc

SEQ ID NO: 130249 - DNA, 35 bp, Artificial Sequence
  Description of Artificial Sequence: Synthetic oligonucleotide
aattaaggaatctgtggagcttcctctcacccatc

SEQ ID NO: 130250 - DNA, 34 bp, Artificial Sequence
  Description of Artificial Sequence: Synthetic oligonucleotide
attaaggaatctgtggagcttcctctcacccatc

SEQ ID NO: 130251 - DNA, 33 bp, Artificial Sequence
  Description of Artificial Sequence: Synthetic oligonucleotide
ttaaggaatctgtggagcttcctctcacccatc

SEQ ID NO: 130252 - DNA, 32 bp, Artificial Sequence
  Description of Artificial Sequence: Synthetic oligonucleotide
taaggaatctgtggagcttcctctcacccatc

SEQ ID NO: 130253 - DNA, 31 bp, Artificial Sequence
  Description of Artificial Sequence: Synthetic oligonucleotide
aaggaatctgtggagcttcctctcacccatc

SEQ ID NO: 130254 - DNA, 30 bp, Artificial Sequence
  Description of Artificial Sequence: Synthetic oligonucleotide
aggaatctgtggagcttcctctcacccatc

SEQ ID NO: 130255 - DNA, 29 bp, Artificial Sequence
  Description of Artificial Sequence: Synthetic oligonucleotide
ggaatctgtggagcttcctctcacccatc

SEQ ID NO: 130256 - DNA, 29 bp, Artificial Sequence
  Description of Artificial Sequence: Synthetic oligonucleotide
gaatctgtggagcttcctctcacccatcc

SEQ ID NO: 130257 - DNA, 30 bp, Artificial Sequence
  Description of Artificial Sequence: Synthetic oligonucleotide
aatctgtggagcttcctctcacccatcctg

SEQ ID NO: 130258 - DNA, 29 bp, Artificial Sequence
  Description of Artificial Sequence: Synthetic oligonucleotide
atctgtggagcttcctctcacccatcctg

SEQ ID NO: 130259 - DNA, 28 bp, Artificial Sequence
  Description of Artificial Sequence: Synthetic oligonucleotide
tctgtggagcttcctctcacccatcctg

SEQ ID NO: 130260 - DNA, 27 bp, Artificial Sequence
  Description of Artificial Sequence: Synthetic oligonucleotide
ctgtggagcttcctctcacccatcctg

SEQ ID NO: 130261 - DNA, 35 bp, Artificial Sequence
  Description of Artificial Sequence: Synthetic oligonucleotide
tgtggagcttcctctcacccatcctgaatattatg

SEQ ID NO: 130262 - DNA, 34 bp, Artificial Sequence
  Description of Artificial Sequence: Synthetic oligonucleotide
gtggagcttcctctcacccatcctgaatattatg

SEQ ID NO: 130263 - DNA, 36 bp, Artificial Sequence
  Description of Artificial Sequence: Synthetic oligonucleotide
tggagcttcctctcacccatcctgaatattatgaag

SEQ ID NO: 130264 - DNA, 35 bp, Artificial Sequence
  Description of Artificial Sequence: Synthetic oligonucleotide
ggagcttcctctcacccatcctgaatattatgaag

SEQ ID NO: 130265 - DNA, 36 bp, Artificial Sequence
  Description of Artificial Sequence: Synthetic oligonucleotide
gagcttcctctcacccatcctgaatattatgaagag

SEQ ID NO: 130266 - DNA, 38 bp, Artificial Sequence
  Description of Artificial Sequence: Synthetic oligonucleotide
agcttcctctcacccatcctgaatattatgaagagatg

SEQ ID NO: 130267 - DNA, 37 bp, Artificial Sequence
  Description of Artificial Sequence: Synthetic oligonucleotide
gcttcctctcacccatcctgaatattatgaagagatg

SEQ ID NO: 130268 - DNA, 37 bp, Artificial Sequence
  Description of Artificial Sequence: Synthetic oligonucleotide
cttcctctcacccatcctgaatattatgaagagatgg

SEQ ID NO: 130269 - DNA, 37 bp, Artificial Sequence
  Description of Artificial Sequence: Synthetic oligonucleotide
ttcctctcacccatcctgaatattatgaagagatggg

SEQ ID NO: 130270 - DNA, 36 bp, Artificial Sequence
  Description of Artificial Sequence: Synthetic oligonucleotide
tcctctcacccatcctgaatattatgaagagatggg

SEQ ID NO: 130271 - DNA, 35 bp, Artificial Sequence
  Description of Artificial Sequence: Synthetic oligonucleotide
cctctcacccatcctgaatattatgaagagatggg

SEQ ID NO: 130272 - DNA, 41 bp, Artificial Sequence
  Description of Artificial Sequence: Synthetic oligonucleotide
ctctcacccatcctgaatattatgaagagatgggtataaag

SEQ ID NO: 130273 - DNA, 41 bp, Artificial Sequence
  Description of Artificial Sequence: Synthetic oligonucleotide
tctcacccatcctgaatattatgaagagatgggtataaagc

SEQ ID NO: 130274 - DNA, 40 bp, Artificial Sequence
  Description of Artificial Sequence: Synthetic oligonucleotide
ctcacccatcctgaatattatgaagagatgggtataaagc

SEQ ID NO: 130275 - DNA, 40 bp, Artificial Sequence
  Description of Artificial Sequence: Synthetic oligonucleotide
tcacccatcctgaatattatgaagagatgggtataaagcc

SEQ ID NO: 130276 - DNA, 39 bp, Artificial Sequence
  Description of Artificial Sequence: Synthetic oligonucleotide
cacccatcctgaatattatgaagagatgggtataaagcc

SEQ ID NO: 130277 - DNA, 40 bp, Artificial Sequence
  Description of Artificial Sequence: Synthetic oligonucleotide
acccatcctgaatattatgaagagatgggtataaagcctc

SEQ ID NO: 130278 - DNA, 39 bp, Artificial Sequence
  Description of Artificial Sequence: Synthetic oligonucleotide
cccatcctgaatattatgaagagatgggtataaagcctc

SEQ ID NO: 130279 - DNA, 39 bp, Artificial Sequence
  Description of Artificial Sequence: Synthetic oligonucleotide
ccatcctgaatattatgaagagatgggtataaagcctcc

SEQ ID NO: 130280 - DNA, 42 bp, Artificial Sequence
  Description of Artificial Sequence: Synthetic oligonucleotide
catcctgaatattatgaagagatgggtataaagcctcctaag

SEQ ID NO: 130281 - DNA, 42 bp, Artificial Sequence
  Description of Artificial Sequence: Synthetic oligonucleotide
atcctgaatattatgaagagatgggtataaagcctcctaagg

SEQ ID NO: 130282 - DNA, 41 bp, Artificial Sequence
  Description of Artificial Sequence: Synthetic oligonucleotide
tcctgaatattatgaagagatgggtataaagcctcctaagg

SEQ ID NO: 130283 - DNA, 40 bp, Artificial Sequence
  Description of Artificial Sequence: Synthetic oligonucleotide
cctgaatattatgaagagatgggtataaagcctcctaagg

SEQ ID NO: 130284 - DNA, 40 bp, Artificial Sequence
  Description of Artificial Sequence: Synthetic oligonucleotide
ctgaatattatgaagagatgggtataaagcctcctaaggg

SEQ ID NO: 130285 - DNA, 40 bp, Artificial Sequence
  Description of Artificial Sequence: Synthetic oligonucleotide
tgaatattatgaagagatgggtataaagcctcctaagggg

SEQ ID NO: 130286 - DNA, 39 bp, Artificial Sequence
  Description of Artificial Sequence: Synthetic oligonucleotide
gaatattatgaagagatgggtataaagcctcctaagggg

SEQ ID NO: 130287 - DNA, 39 bp, Artificial Sequence
  Description of Artificial Sequence: Synthetic oligonucleotide
aatattatgaagagatgggtataaagcctcctaaggggg

SEQ ID NO: 130288 - DNA, 38 bp, Artificial Sequence
  Description of Artificial Sequence: Synthetic oligonucleotide
atattatgaagagatgggtataaagcctcctaaggggg

SEQ ID NO: 130289 - DNA, 37 bp, Artificial Sequence
  Description of Artificial Sequence: Synthetic oligonucleotide
tattatgaagagatgggtataaagcctcctaaggggg

SEQ ID NO: 130290 - DNA, 36 bp, Artificial Sequence
  Description of Artificial Sequence: Synthetic oligonucleotide
attatgaagagatgggtataaagcctcctaaggggg

SEQ ID NO: 130291 - DNA, 35 bp, Artificial Sequence
  Description of Artificial Sequence: Synthetic oligonucleotide
ttatgaagagatgggtataaagcctcctaaggggg

SEQ ID NO: 130292 - DNA, 34 bp, Artificial Sequence
  Description of Artificial Sequence: Synthetic oligonucleotide
tatgaagagatgggtataaagcctcctaaggggg

SEQ ID NO: 130293 - DNA, 33 bp, Artificial Sequence
  Description of Artificial Sequence: Synthetic oligonucleotide
atgaagagatgggtataaagcctcctaaggggg

SEQ ID NO: 130294 - DNA, 32 bp, Artificial Sequence
  Description of Artificial Sequence: Synthetic oligonucleotide
tgaagagatgggtataaagcctcctaaggggg

SEQ ID NO: 130295 - DNA, 31 bp, Artificial Sequence
  Description of Artificial Sequence: Synthetic oligonucleotide
gaagagatgggtataaagcctcctaaggggg

SEQ ID NO: 130296 - DNA, 32 bp, Artificial Sequence
  Description of Artificial Sequence: Synthetic oligonucleotide
aagagatgggtataaagcctcctaagggggtc

SEQ ID NO: 130297 - DNA, 31 bp, Artificial Sequence
  Description of Artificial Sequence: Synthetic oligonucleotide
agagatgggtataaagcctcctaagggggtc

SEQ ID NO: 130298 - DNA, 30 bp, Artificial Sequence
  Description of Artificial Sequence: Synthetic oligonucleotide
gagatgggtataaagcctcctaagggggtc

SEQ ID NO: 130299 - DNA, 33 bp, Artificial Sequence
  Description of Artificial Sequence: Synthetic oligonucleotide
agatgggtataaagcctcctaagggggtcattc

SEQ ID NO: 130300 - DNA, 32 bp, Artificial Sequence
  Description of Artificial Sequence: Synthetic oligonucleotide
gatgggtataaagcctcctaagggggtcattc

SEQ ID NO: 130301 - DNA, 33 bp, Artificial Sequence
  Description of Artificial Sequence: Synthetic oligonucleotide
atgggtataaagcctcctaagggggtcattctc

SEQ ID NO: 130302 - DNA, 32 bp, Artificial Sequence
  Description of Artificial Sequence: Synthetic oligonucleotide
tgggtataaagcctcctaagggggtcattctc

SEQ ID NO: 130303 - DNA, 31 bp, Artificial Sequence
  Description of Artificial Sequence: Synthetic oligonucleotide
gggtataaagcctcctaagggggtcattctc

SEQ ID NO: 130304 - DNA, 34 bp, Artificial Sequence
  Description of Artificial Sequence: Synthetic oligonucleotide
ggtataaagcctcctaagggggtcattctctatg

SEQ ID NO: 130305 - DNA, 34 bp, Artificial Sequence
  Description of Artificial Sequence: Synthetic oligonucleotide
gtataaagcctcctaagggggtcattctctatgg

SEQ ID NO: 130306 - DNA, 35 bp, Artificial Sequence
  Description of Artificial Sequence: Synthetic oligonucleotide
tataaagcctcctaagggggtcattctctatggtc

SEQ ID NO: 130307 - DNA, 34 bp, Artificial Sequence
  Description of Artificial Sequence: Synthetic oligonucleotide
ataaagcctcctaagggggtcattctctatggtc

SEQ ID NO: 130308 - DNA, 33 bp, Artificial Sequence
  Description of Artificial Sequence: Synthetic oligonucleotide
taaagcctcctaagggggtcattctctatggtc

SEQ ID NO: 130309 - DNA, 32 bp, Artificial Sequence
  Description of Artificial Sequence: Synthetic oligonucleotide
aaagcctcctaagggggtcattctctatggtc

SEQ ID NO: 130310 - DNA, 31 bp, Artificial Sequence
  Description of Artificial Sequence: Synthetic oligonucleotide
aagcctcctaagggggtcattctctatggtc

SEQ ID NO: 130311 - DNA, 30 bp, Artificial Sequence
  Description of Artificial Sequence: Synthetic oligonucleotide
agcctcctaagggggtcattctctatggtc

SEQ ID NO: 130312 - DNA, 29 bp, Artificial Sequence
  Description of Artificial Sequence: Synthetic oligonucleotide
gcctcctaagggggtcattctctatggtc

SEQ ID NO: 130313 - DNA, 29 bp, Artificial Sequence
  Description of Artificial Sequence: Synthetic oligonucleotide
cctcctaagggggtcattctctatggtcc

SEQ ID NO: 130314 - DNA, 30 bp, Artificial Sequence
  Description of Artificial Sequence: Synthetic oligonucleotide
ctcctaagggggtcattctctatggtccac

SEQ ID NO: 130315 - DNA, 30 bp, Artificial Sequence
  Description of Artificial Sequence: Synthetic oligonucleotide
tcctaagggggtcattctctatggtccacc

SEQ ID NO: 130316 - DNA, 29 bp, Artificial Sequence
  Description of Artificial Sequence: Synthetic oligonucleotide
cctaagggggtcattctctatggtccacc

SEQ ID NO: 130317 - DNA, 30 bp, Artificial Sequence
  Description of Artificial Sequence: Synthetic oligonucleotide
ctaagggggtcattctctatggtccacctg

SEQ ID NO: 130318 - DNA, 30 bp, Artificial Sequence
  Description of Artificial Sequence: Synthetic oligonucleotide
taagggggtcattctctatggtccacctgg

SEQ ID NO: 130319 - DNA, 29 bp, Artificial Sequence
  Description of Artificial Sequence: Synthetic oligonucleotide
aagggggtcattctctatggtccacctgg

SEQ ID NO: 130320 - DNA, 28 bp, Artificial Sequence
  Description of Artificial Sequence: Synthetic oligonucleotide
agggggtcattctctatggtccacctgg

SEQ ID NO: 130321 - DNA, 27 bp, Artificial Sequence
  Description of Artificial Sequence: Synthetic oligonucleotide
gggggtcattctctatggtccacctgg

SEQ ID NO: 130322 - DNA, 27 bp, Artificial Sequence
  Description of Artificial Sequence: Synthetic oligonucleotide
ggggtcattctctatggtccacctggc

SEQ ID NO: 130323 - DNA, 28 bp, Artificial Sequence
  Description of Artificial Sequence: Synthetic oligonucleotide
gggtcattctctatggtccacctggcac

SEQ ID NO: 130324 - DNA, 29 bp, Artificial Sequence
  Description of Artificial Sequence: Synthetic oligonucleotide
ggtcattctctatggtccacctggcacag

SEQ ID NO: 130325 - DNA, 29 bp, Artificial Sequence
  Description of Artificial Sequence: Synthetic oligonucleotide
gtcattctctatggtccacctggcacagg

SEQ ID NO: 130326 - DNA, 34 bp, Artificial Sequence
  Description of Artificial Sequence: Synthetic oligonucleotide
tcattctctatggtccacctggcacaggtaaaac

SEQ ID NO: 130327 - DNA, 33 bp, Artificial Sequence
  Description of Artificial Sequence: Synthetic oligonucleotide
cattctctatggtccacctggcacaggtaaaac

SEQ ID NO: 130328 - DNA, 33 bp, Artificial Sequence
  Description of Artificial Sequence: Synthetic oligonucleotide
attctctatggtccacctggcacaggtaaaacc

SEQ ID NO: 130329 - DNA, 32 bp, Artificial Sequence
  Description of Artificial Sequence: Synthetic oligonucleotide
ttctctatggtccacctggcacaggtaaaacc

SEQ ID NO: 130330 - DNA, 31 bp, Artificial Sequence
  Description of Artificial Sequence: Synthetic oligonucleotide
tctctatggtccacctggcacaggtaaaacc

SEQ ID NO: 130331 - DNA, 30 bp, Artificial Sequence
  Description of Artificial Sequence: Synthetic oligonucleotide
ctctatggtccacctggcacaggtaaaacc

SEQ ID NO: 130332 - DNA, 32 bp, Artificial Sequence
  Description of Artificial Sequence: Synthetic oligonucleotide
tctatggtccacctggcacaggtaaaaccttg

SEQ ID NO: 130333 - DNA, 31 bp, Artificial Sequence
  Description of Artificial Sequence: Synthetic oligonucleotide
ctatggtccacctggcacaggtaaaaccttg

SEQ ID NO: 130334 - DNA, 34 bp, Artificial Sequence
  Description of Artificial Sequence: Synthetic oligonucleotide
tatggtccacctggcacaggtaaaaccttgttag

SEQ ID NO: 130335 - DNA, 33 bp, Artificial Sequence
  Description of Artificial Sequence: Synthetic oligonucleotide
atggtccacctggcacaggtaaaaccttgttag

SEQ ID NO: 130336 - DNA, 32 bp, Artificial Sequence
  Description of Artificial Sequence: Synthetic oligonucleotide
tggtccacctggcacaggtaaaaccttgttag

SEQ ID NO: 130337 - DNA, 31 bp, Artificial Sequence
  Description of Artificial Sequence: Synthetic oligonucleotide
ggtccacctggcacaggtaaaaccttgttag

SEQ ID NO: 130338 - DNA, 31 bp, Artificial Sequence
  Description of Artificial Sequence: Synthetic oligonucleotide
gtccacctggcacaggtaaaaccttgttagc

SEQ ID NO: 130339 - DNA, 31 bp, Artificial Sequence
  Description of Artificial Sequence: Synthetic oligonucleotide
tccacctggcacaggtaaaaccttgttagcc

SEQ ID NO: 130340 - DNA, 30 bp, Artificial Sequence
  Description of Artificial Sequence: Synthetic oligonucleotide
ccacctggcacaggtaaaaccttgttagcc

SEQ ID NO: 130341 - DNA, 33 bp, Artificial Sequence
  Description of Artificial Sequence: Synthetic oligonucleotide
cacctggcacaggtaaaaccttgttagccaaag

SEQ ID NO: 130342 - DNA, 33 bp, Artificial Sequence
  Description of Artificial Sequence: Synthetic oligonucleotide
acctggcacaggtaaaaccttgttagccaaagc

SEQ ID NO: 130343 - DNA, 32 bp, Artificial Sequence
  Description of Artificial Sequence: Synthetic oligonucleotide
cctggcacaggtaaaaccttgttagccaaagc

SEQ ID NO: 130344 - DNA, 33 bp, Artificial Sequence
  Description of Artificial Sequence: Synthetic oligonucleotide
ctggcacaggtaaaaccttgttagccaaagcag

SEQ ID NO: 130345 - DNA, 35 bp, Artificial Sequence
  Description of Artificial Sequence: Synthetic oligonucleotide
tggcacaggtaaaaccttgttagccaaagcagtag

SEQ ID NO: 130346 - DNA, 34 bp, Artificial Sequence
  Description of Artificial Sequence: Synthetic oligonucleotide
ggcacaggtaaaaccttgttagccaaagcagtag

SEQ ID NO: 130347 - DNA, 34 bp, Artificial Sequence
  Description of Artificial Sequence: Synthetic oligonucleotide
gcacaggtaaaaccttgttagccaaagcagtagc

SEQ ID NO: 130348 - DNA, 37 bp, Artificial Sequence
  Description of Artificial Sequence: Synthetic oligonucleotide
cacaggtaaaaccttgttagccaaagcagtagcaaac

SEQ ID NO: 130349 - DNA, 37 bp, Artificial Sequence
  Description of Artificial Sequence: Synthetic oligonucleotide
acaggtaaaaccttgttagccaaagcagtagcaaacc

SEQ ID NO: 130350 - DNA, 36 bp, Artificial Sequence
  Description of Artificial Sequence: Synthetic oligonucleotide
caggtaaaaccttgttagccaaagcagtagcaaacc

SEQ ID NO: 130351 - DNA, 39 bp, Artificial Sequence
  Description of Artificial Sequence: Synthetic oligonucleotide
aggtaaaaccttgttagccaaagcagtagcaaaccaaac

SEQ ID NO: 130352 - DNA, 38 bp, Artificial Sequence
  Description of Artificial Sequence: Synthetic oligonucleotide
ggtaaaaccttgttagccaaagcagtagcaaaccaaac

SEQ ID NO: 130353 - DNA, 38 bp, Artificial Sequence
  Description of Artificial Sequence: Synthetic oligonucleotide
gtaaaaccttgttagccaaagcagtagcaaaccaaacc

SEQ ID NO: 130354 - DNA, 39 bp, Artificial Sequence
  Description of Artificial Sequence: Synthetic oligonucleotide
taaaaccttgttagccaaagcagtagcaaaccaaacctc

SEQ ID NO: 130355 - DNA, 38 bp, Artificial Sequence
  Description of Artificial Sequence: Synthetic oligonucleotide
aaaaccttgttagccaaagcagtagcaaaccaaacctc

SEQ ID NO: 130356 - DNA, 37 bp, Artificial Sequence
  Description of Artificial Sequence: Synthetic oligonucleotide
aaaccttgttagccaaagcagtagcaaaccaaacctc

SEQ ID NO: 130357 - DNA, 36 bp, Artificial Sequence
  Description of Artificial Sequence: Synthetic oligonucleotide
aaccttgttagccaaagcagtagcaaaccaaacctc

SEQ ID NO: 130358 - DNA, 35 bp, Artificial Sequence
  Description of Artificial Sequence: Synthetic oligonucleotide
accttgttagccaaagcagtagcaaaccaaacctc

SEQ ID NO: 130359 - DNA, 34 bp, Artificial Sequence
  Description of Artificial Sequence: Synthetic oligonucleotide
ccttgttagccaaagcagtagcaaaccaaacctc

SEQ ID NO: 130360 - DNA, 35 bp, Artificial Sequence
  Description of Artificial Sequence: Synthetic oligonucleotide
cttgttagccaaagcagtagcaaaccaaacctcag

SEQ ID NO: 130361 - DNA, 35 bp, Artificial Sequence
  Description of Artificial Sequence: Synthetic oligonucleotide
ttgttagccaaagcagtagcaaaccaaacctcagc

SEQ ID NO: 130362 - DNA, 34 bp, Artificial Sequence
  Description of Artificial Sequence: Synthetic oligonucleotide
tgttagccaaagcagtagcaaaccaaacctcagc

SEQ ID NO: 130363 - DNA, 33 bp, Artificial Sequence
  Description of Artificial Sequence: Synthetic oligonucleotide
gttagccaaagcagtagcaaaccaaacctcagc

SEQ ID NO: 130364 - DNA, 33 bp, Artificial Sequence
  Description of Artificial Sequence: Synthetic oligonucleotide
ttagccaaagcagtagcaaaccaaacctcagcc

SEQ ID NO: 130365 - DNA, 32 bp, Artificial Sequence
  Description of Artificial Sequence: Synthetic oligonucleotide
tagccaaagcagtagcaaaccaaacctcagcc

SEQ ID NO: 130366 - DNA, 31 bp, Artificial Sequence
  Description of Artificial Sequence: Synthetic oligonucleotide
agccaaagcagtagcaaaccaaacctcagcc

SEQ ID NO: 130367 - DNA, 30 bp, Artificial Sequence
  Description of Artificial Sequence: Synthetic oligonucleotide
gccaaagcagtagcaaaccaaacctcagcc

SEQ ID NO: 130368 - DNA, 31 bp, Artificial Sequence
  Description of Artificial Sequence: Synthetic oligonucleotide
ccaaagcagtagcaaaccaaacctcagccac

SEQ ID NO: 130369 - DNA, 34 bp, Artificial Sequence
  Description of Artificial Sequence: Synthetic oligonucleotide
caaagcagtagcaaaccaaacctcagccactttc

SEQ ID NO: 130370 - DNA, 36 bp, Artificial Sequence
  Description of Artificial Sequence: Synthetic oligonucleotide
aaagcagtagcaaaccaaacctcagccactttcttg

SEQ ID NO: 130371 - DNA, 35 bp, Artificial Sequence
  Description of Artificial Sequence: Synthetic oligonucleotide
aagcagtagcaaaccaaacctcagccactttcttg

SEQ ID NO: 130372 - DNA, 34 bp, Artificial Sequence
  Description of Artificial Sequence: Synthetic oligonucleotide
agcagtagcaaaccaaacctcagccactttcttg

SEQ ID NO: 130373 - DNA, 33 bp, Artificial Sequence
  Description of Artificial Sequence: Synthetic oligonucleotide
gcagtagcaaaccaaacctcagccactttcttg

SEQ ID NO: 130374 - DNA, 34 bp, Artificial Sequence
  Description of Artificial Sequence: Synthetic oligonucleotide
cagtagcaaaccaaacctcagccactttcttgag

SEQ ID NO: 130375 - DNA, 35 bp, Artificial Sequence
  Description of Artificial Sequence: Synthetic oligonucleotide
agtagcaaaccaaacctcagccactttcttgagag

SEQ ID NO: 130376 - DNA, 34 bp, Artificial Sequence
  Description of Artificial Sequence: Synthetic oligonucleotide
gtagcaaaccaaacctcagccactttcttgagag

SEQ ID NO: 130377 - DNA, 35 bp, Artificial Sequence
  Description of Artificial Sequence: Synthetic oligonucleotide
tagcaaaccaaacctcagccactttcttgagagtg

SEQ ID NO: 130378 - DNA, 34 bp, Artificial Sequence
  Description of Artificial Sequence: Synthetic oligonucleotide
agcaaaccaaacctcagccactttcttgagagtg

SEQ ID NO: 130379 - DNA, 33 bp, Artificial Sequence
  Description of Artificial Sequence: Synthetic oligonucleotide
gcaaaccaaacctcagccactttcttgagagtg

SEQ ID NO: 130380 - DNA, 33 bp, Artificial Sequence
  Description of Artificial Sequence: Synthetic oligonucleotide
caaaccaaacctcagccactttcttgagagtgg

SEQ ID NO: 130381 - DNA, 35 bp, Artificial Sequence
  Description of Artificial Sequence: Synthetic oligonucleotide
aaaccaaacctcagccactttcttgagagtggttg

SEQ ID NO: 130382 - DNA, 34 bp, Artificial Sequence
  Description of Artificial Sequence: Synthetic oligonucleotide
aaccaaacctcagccactttcttgagagtggttg

SEQ ID NO: 130383 - DNA, 33 bp, Artificial Sequence
  Description of Artificial Sequence: Synthetic oligonucleotide
accaaacctcagccactttcttgagagtggttg

SEQ ID NO: 130384 - DNA, 32 bp, Artificial Sequence
  Description of Artificial Sequence: Synthetic oligonucleotide
ccaaacctcagccactttcttgagagtggttg

SEQ ID NO: 130385 - DNA, 32 bp, Artificial Sequence
  Description of Artificial Sequence: Synthetic oligonucleotide
caaacctcagccactttcttgagagtggttgg

SEQ ID NO: 130386 - DNA, 32 bp, Artificial Sequence
  Description of Artificial Sequence: Synthetic oligonucleotide
aaacctcagccactttcttgagagtggttggc

SEQ ID NO: 130387 - DNA, 31 bp, Artificial Sequence
  Description of Artificial Sequence: Synthetic oligonucleotide
aacctcagccactttcttgagagtggttggc

SEQ ID NO: 130388 - DNA, 30 bp, Artificial Sequence
  Description of Artificial Sequence: Synthetic oligonucleotide
acctcagccactttcttgagagtggttggc

SEQ ID NO: 130389 - DNA, 29 bp, Artificial Sequence
  Description of Artificial Sequence: Synthetic oligonucleotide
cctcagccactttcttgagagtggttggc

SEQ ID NO: 130390 - DNA, 30 bp, Artificial Sequence
  Description of Artificial Sequence: Synthetic oligonucleotide
ctcagccactttcttgagagtggttggctc

SEQ ID NO: 130391 - DNA, 31 bp, Artificial Sequence
  Description of Artificial Sequence: Synthetic oligonucleotide
tcagccactttcttgagagtggttggctctg

SEQ ID NO: 130392 - DNA, 30 bp, Artificial Sequence
  Description of Artificial Sequence: Synthetic oligonucleotide
cagccactttcttgagagtggttggctctg

SEQ ID NO: 130393 - DNA, 32 bp, Artificial Sequence
  Description of Artificial Sequence: Synthetic oligonucleotide
agccactttcttgagagtggttggctctgaac

SEQ ID NO: 130394 - DNA, 31 bp, Artificial Sequence
  Description of Artificial Sequence: Synthetic oligonucleotide
gccactttcttgagagtggttggctctgaac

SEQ ID NO: 130395 - DNA, 36 bp, Artificial Sequence
  Description of Artificial Sequence: Synthetic oligonucleotide
ccactttcttgagagtggttggctctgaacttattc

SEQ ID NO: 130396 - DNA, 37 bp, Artificial Sequence
  Description of Artificial Sequence: Synthetic oligonucleotide
cactttcttgagagtggttggctctgaacttattcag

SEQ ID NO: 130397 - DNA, 39 bp, Artificial Sequence
  Description of Artificial Sequence: Synthetic oligonucleotide
actttcttgagagtggttggctctgaacttattcagaag

SEQ ID NO: 130398 - DNA, 38 bp, Artificial Sequence
  Description of Artificial Sequence: Synthetic oligonucleotide
ctttcttgagagtggttggctctgaacttattcagaag

SEQ ID NO: 130399 - DNA, 40 bp, Artificial Sequence
  Description of Artificial Sequence: Synthetic oligonucleotide
tttcttgagagtggttggctctgaacttattcagaagtac

SEQ ID NO: 130400 - DNA, 39 bp, Artificial Sequence
  Description of Artificial Sequence: Synthetic oligonucleotide
ttcttgagagtggttggctctgaacttattcagaagtac

SEQ ID NO: 130401 - DNA, 38 bp, Artificial Sequence
  Description of Artificial Sequence: Synthetic oligonucleotide
tcttgagagtggttggctctgaacttattcagaagtac

SEQ ID NO: 130402 - DNA, 37 bp, Artificial Sequence
  Description of Artificial Sequence: Synthetic oligonucleotide
cttgagagtggttggctctgaacttattcagaagtac

SEQ ID NO: 130403 - DNA, 37 bp, Artificial Sequence
  Description of Artificial Sequence: Synthetic oligonucleotide
ttgagagtggttggctctgaacttattcagaagtacc

SEQ ID NO: 130404 - DNA, 36 bp, Artificial Sequence
  Description of Artificial Sequence: Synthetic oligonucleotide
tgagagtggttggctctgaacttattcagaagtacc

SEQ ID NO: 130405 - DNA, 35 bp, Artificial Sequence
  Description of Artificial Sequence: Synthetic oligonucleotide
gagagtggttggctctgaacttattcagaagtacc

SEQ ID NO: 130406 - DNA, 37 bp, Artificial Sequence
  Description of Artificial Sequence: Synthetic oligonucleotide
agagtggttggctctgaacttattcagaagtacctag

SEQ ID NO: 130407 - DNA, 36 bp, Artificial Sequence
  Description of Artificial Sequence: Synthetic oligonucleotide
gagtggttggctctgaacttattcagaagtacctag

SEQ ID NO: 130408 - DNA, 36 bp, Artificial Sequence
  Description of Artificial Sequence: Synthetic oligonucleotide
agtggttggctctgaacttattcagaagtacctagg

SEQ ID NO: 130409 - DNA, 35 bp, Artificial Sequence
  Description of Artificial Sequence: Synthetic oligonucleotide
gtggttggctctgaacttattcagaagtacctagg

SEQ ID NO: 130410 - DNA, 36 bp, Artificial Sequence
  Description of Artificial Sequence: Synthetic oligonucleotide
tggttggctctgaacttattcagaagtacctaggtg

SEQ ID NO: 130411 - DNA, 35 bp, Artificial Sequence
  Description of Artificial Sequence: Synthetic oligonucleotide
ggttggctctgaacttattcagaagtacctaggtg

SEQ ID NO: 130412 - DNA, 37 bp, Artificial Sequence
  Description of Artificial Sequence: Synthetic oligonucleotide
gttggctctgaacttattcagaagtacctaggtgatg

SEQ ID NO: 130413 - DNA, 37 bp, Artificial Sequence
  Description of Artificial Sequence: Synthetic oligonucleotide
ttggctctgaacttattcagaagtacctaggtgatgg

SEQ ID NO: 130414 - DNA, 36 bp, Artificial Sequence
  Description of Artificial Sequence: Synthetic oligonucleotide
tggctctgaacttattcagaagtacctaggtgatgg

SEQ ID NO: 130415 - DNA, 35 bp, Artificial Sequence
  Description of Artificial Sequence: Synthetic oligonucleotide
ggctctgaacttattcagaagtacctaggtgatgg

SEQ ID NO: 130416 - DNA, 35 bp, Artificial Sequence
  Description of Artificial Sequence: Synthetic oligonucleotide
gctctgaacttattcagaagtacctaggtgatggg

SEQ ID NO: 130417 - DNA, 35 bp, Artificial Sequence
  Description of Artificial Sequence: Synthetic oligonucleotide
ctctgaacttattcagaagtacctaggtgatgggc

SEQ ID NO: 130418 - DNA, 35 bp, Artificial Sequence
  Description of Artificial Sequence: Synthetic oligonucleotide
tctgaacttattcagaagtacctaggtgatgggcc

SEQ ID NO: 130419 - DNA, 34 bp, Artificial Sequence
  Description of Artificial Sequence: Synthetic oligonucleotide
ctgaacttattcagaagtacctaggtgatgggcc

SEQ ID NO: 130420 - DNA, 34 bp, Artificial Sequence
  Description of Artificial Sequence: Synthetic oligonucleotide
tgaacttattcagaagtacctaggtgatgggccc

SEQ ID NO: 130421 - DNA, 33 bp, Artificial Sequence
  Description of Artificial Sequence: Synthetic oligonucleotide
gaacttattcagaagtacctaggtgatgggccc

SEQ ID NO: 130422 - DNA, 36 bp, Artificial Sequence
  Description of Artificial Sequence: Synthetic oligonucleotide
aacttattcagaagtacctaggtgatgggcccaaac

SEQ ID NO: 130423 - DNA, 35 bp, Artificial Sequence
  Description of Artificial Sequence: Synthetic oligonucleotide
acttattcagaagtacctaggtgatgggcccaaac

SEQ ID NO: 130424 - DNA, 34 bp, Artificial Sequence
  Description of Artificial Sequence: Synthetic oligonucleotide
cttattcagaagtacctaggtgatgggcccaaac

SEQ ID NO: 130425 - DNA, 35 bp, Artificial Sequence
  Description of Artificial Sequence: Synthetic oligonucleotide
ttattcagaagtacctaggtgatgggcccaaactc

SEQ ID NO: 130426 - DNA, 34 bp, Artificial Sequence
  Description of Artificial Sequence: Synthetic oligonucleotide
tattcagaagtacctaggtgatgggcccaaactc

SEQ ID NO: 130427 - DNA, 33 bp, Artificial Sequence
  Description of Artificial Sequence: Synthetic oligonucleotide
attcagaagtacctaggtgatgggcccaaactc

SEQ ID NO: 130428 - DNA, 32 bp, Artificial Sequence
  Description of Artificial Sequence: Synthetic oligonucleotide
ttcagaagtacctaggtgatgggcccaaactc

SEQ ID NO: 130429 - DNA, 31 bp, Artificial Sequence
  Description of Artificial Sequence: Synthetic oligonucleotide
tcagaagtacctaggtgatgggcccaaactc

SEQ ID NO: 130430 - DNA, 30 bp, Artificial Sequence
  Description of Artificial Sequence: Synthetic oligonucleotide
cagaagtacctaggtgatgggcccaaactc

SEQ ID NO: 130431 - DNA, 30 bp, Artificial Sequence
  Description of Artificial Sequence: Synthetic oligonucleotide
agaagtacctaggtgatgggcccaaactcg

SEQ ID NO: 130432 - DNA, 29 bp, Artificial Sequence
  Description of Artificial Sequence: Synthetic oligonucleotide
gaagtacctaggtgatgggcccaaactcg

SEQ ID NO: 130433 - DNA, 31 bp, Artificial Sequence
  Description of Artificial Sequence: Synthetic oligonucleotide
aagtacctaggtgatgggcccaaactcgtac

SEQ ID NO: 130434 - DNA, 30 bp, Artificial Sequence
  Description of Artificial Sequence: Synthetic oligonucleotide
agtacctaggtgatgggcccaaactcgtac

SEQ ID NO: 130435 - DNA, 29 bp, Artificial Sequence
  Description of Artificial Sequence: Synthetic oligonucleotide
gtacctaggtgatgggcccaaactcgtac

SEQ ID NO: 130436 - DNA, 29 bp, Artificial Sequence
  Description of Artificial Sequence: Synthetic oligonucleotide
tacctaggtgatgggcccaaactcgtacg

SEQ ID NO: 130437 - DNA, 28 bp, Artificial Sequence
  Description of Artificial Sequence: Synthetic oligonucleotide
acctaggtgatgggcccaaactcgtacg

SEQ ID NO: 130438 - DNA, 27 bp, Artificial Sequence
  Description of Artificial Sequence: Synthetic oligonucleotide
cctaggtgatgggcccaaactcgtacg

SEQ ID NO: 130439 - DNA, 27 bp, Artificial Sequence
  Description of Artificial Sequence: Synthetic oligonucleotide
ctaggtgatgggcccaaactcgtacgg

SEQ ID NO: 130440 - DNA, 27 bp, Artificial Sequence
  Description of Artificial Sequence: Synthetic oligonucleotide
taggtgatgggcccaaactcgtacggg

SEQ ID NO: 130441 - DNA, 27 bp, Artificial Sequence
  Description of Artificial Sequence: Synthetic oligonucleotide
aggtgatgggcccaaactcgtacggga

SEQ ID NO: 130442 - DNA, 27 bp, Artificial Sequence
  Description of Artificial Sequence: Synthetic oligonucleotide
ggtgatgggcccaaactcgtacgggaa

SEQ ID NO: 130443 - DNA, 29 bp, Artificial Sequence
  Description of Artificial Sequence: Synthetic oligonucleotide
gtgatgggcccaaactcgtacgggaattg

SEQ ID NO: 130444 - DNA, 31 bp, Artificial Sequence
  Description of Artificial Sequence: Synthetic oligonucleotide
tgatgggcccaaactcgtacgggaattgttc

SEQ ID NO: 130445 - DNA, 30 bp, Artificial Sequence
  Description of Artificial Sequence: Synthetic oligonucleotide
gatgggcccaaactcgtacgggaattgttc

SEQ ID NO: 130446 - DNA, 30 bp, Artificial Sequence
  Description of Artificial Sequence: Synthetic oligonucleotide
atgggcccaaactcgtacgggaattgttcc

SEQ ID NO: 130447 - DNA, 29 bp, Artificial Sequence
  Description of Artificial Sequence: Synthetic oligonucleotide
tgggcccaaactcgtacgggaattgttcc

SEQ ID NO: 130448 - DNA, 28 bp, Artificial Sequence
  Description of Artificial Sequence: Synthetic oligonucleotide
gggcccaaactcgtacgggaattgttcc

SEQ ID NO: 130449 - DNA, 28 bp, Artificial Sequence
  Description of Artificial Sequence: Synthetic oligonucleotide
ggcccaaactcgtacgggaattgttccg

SEQ ID NO: 130450 - DNA, 29 bp, Artificial Sequence
  Description of Artificial Sequence: Synthetic oligonucleotide
gcccaaactcgtacgggaattgttccgag

SEQ ID NO: 130451 - DNA, 31 bp, Artificial Sequence
  Description of Artificial Sequence: Synthetic oligonucleotide
cccaaactcgtacgggaattgttccgagttg

SEQ ID NO: 130452 - DNA, 31 bp, Artificial Sequence
  Description of Artificial Sequence: Synthetic oligonucleotide
ccaaactcgtacgggaattgttccgagttgc

SEQ ID NO: 130453 - DNA, 32 bp, Artificial Sequence
  Description of Artificial Sequence: Synthetic oligonucleotide
caaactcgtacgggaattgttccgagttgctg

SEQ ID NO: 130454 - DNA, 34 bp, Artificial Sequence
  Description of Artificial Sequence: Synthetic oligonucleotide
aaactcgtacgggaattgttccgagttgctgaag

SEQ ID NO: 130455 - DNA, 33 bp, Artificial Sequence
  Description of Artificial Sequence: Synthetic oligonucleotide
aactcgtacgggaattgttccgagttgctgaag

SEQ ID NO: 130456 - DNA, 32 bp, Artificial Sequence
  Description of Artificial Sequence: Synthetic oligonucleotide
actcgtacgggaattgttccgagttgctgaag

SEQ ID NO: 130457 - DNA, 31 bp, Artificial Sequence
  Description of Artificial Sequence: Synthetic oligonucleotide
ctcgtacgggaattgttccgagttgctgaag

SEQ ID NO: 130458 - DNA, 33 bp, Artificial Sequence
  Description of Artificial Sequence: Synthetic oligonucleotide
tcgtacgggaattgttccgagttgctgaagaac

SEQ ID NO: 130459 - DNA, 32 bp, Artificial Sequence
  Description of Artificial Sequence: Synthetic oligonucleotide
cgtacgggaattgttccgagttgctgaagaac

SEQ ID NO: 130460 - DNA, 34 bp, Artificial Sequence
  Description of Artificial Sequence: Synthetic oligonucleotide
gtacgggaattgttccgagttgctgaagaacatg

SEQ ID NO: 130461 - DNA, 34 bp, Artificial Sequence
  Description of Artificial Sequence: Synthetic oligonucleotide
tacgggaattgttccgagttgctgaagaacatgc

SEQ ID NO: 130462 - DNA, 33 bp, Artificial Sequence
  Description of Artificial Sequence: Synthetic oligonucleotide
acgggaattgttccgagttgctgaagaacatgc

SEQ ID NO: 130463 - DNA, 32 bp, Artificial Sequence
  Description of Artificial Sequence: Synthetic oligonucleotide
cgggaattgttccgagttgctgaagaacatgc

SEQ ID NO: 130464 - DNA, 33 bp, Artificial Sequence
  Description of Artificial Sequence: Synthetic oligonucleotide
gggaattgttccgagttgctgaagaacatgcac

SEQ ID NO: 130465 - DNA, 33 bp, Artificial Sequence
  Description of Artificial Sequence: Synthetic oligonucleotide
ggaattgttccgagttgctgaagaacatgcacc

SEQ ID NO: 130466 - DNA, 33 bp, Artificial Sequence
  Description of Artificial Sequence: Synthetic oligonucleotide
gaattgttccgagttgctgaagaacatgcaccg

SEQ ID NO: 130467 - DNA, 34 bp, Artificial Sequence
  Description of Artificial Sequence: Synthetic oligonucleotide
aattgttccgagttgctgaagaacatgcaccgtc

SEQ ID NO: 130468 - DNA, 33 bp, Artificial Sequence
  Description of Artificial Sequence: Synthetic oligonucleotide
attgttccgagttgctgaagaacatgcaccgtc

SEQ ID NO: 130469 - DNA, 32 bp, Artificial Sequence
  Description of Artificial Sequence: Synthetic oligonucleotide
ttgttccgagttgctgaagaacatgcaccgtc

SEQ ID NO: 130470 - DNA, 31 bp, Artificial Sequence
  Description of Artificial Sequence: Synthetic oligonucleotide
tgttccgagttgctgaagaacatgcaccgtc

SEQ ID NO: 130471 - DNA, 30 bp, Artificial Sequence
  Description of Artificial Sequence: Synthetic oligonucleotide
gttccgagttgctgaagaacatgcaccgtc

SEQ ID NO: 130472 - DNA, 30 bp, Artificial Sequence
  Description of Artificial Sequence: Synthetic oligonucleotide
ttccgagttgctgaagaacatgcaccgtcc

SEQ ID NO: 130473 - DNA, 29 bp, Artificial Sequence
  Description of Artificial Sequence: Synthetic oligonucleotide
tccgagttgctgaagaacatgcaccgtcc

SEQ ID NO: 130474 - DNA, 28 bp, Artificial Sequence
  Description of Artificial Sequence: Synthetic oligonucleotide
ccgagttgctgaagaacatgcaccgtcc

SEQ ID NO: 130475 - DNA, 30 bp, Artificial Sequence
  Description of Artificial Sequence: Synthetic oligonucleotide
cgagttgctgaagaacatgcaccgtccatc

SEQ ID NO: 130476 - DNA, 30 bp, Artificial Sequence
  Description of Artificial Sequence: Synthetic oligonucleotide
gagttgctgaagaacatgcaccgtccatcg

SEQ ID NO: 130477 - DNA, 31 bp, Artificial Sequence
  Description of Artificial Sequence: Synthetic oligonucleotide
agttgctgaagaacatgcaccgtccatcgtg

SEQ ID NO: 130478 - DNA, 30 bp, Artificial Sequence
  Description of Artificial Sequence: Synthetic oligonucleotide
gttgctgaagaacatgcaccgtccatcgtg

SEQ ID NO: 130479 - DNA, 36 bp, Artificial Sequence
  Description of Artificial Sequence: Synthetic oligonucleotide
ttgctgaagaacatgcaccgtccatcgtgtttattg

SEQ ID NO: 130480 - DNA, 35 bp, Artificial Sequence
  Description of Artificial Sequence: Synthetic oligonucleotide
tgctgaagaacatgcaccgtccatcgtgtttattg

SEQ ID NO: 130481 - DNA, 34 bp, Artificial Sequence
  Description of Artificial Sequence: Synthetic oligonucleotide
gctgaagaacatgcaccgtccatcgtgtttattg

SEQ ID NO: 130482 - DNA, 36 bp, Artificial Sequence
  Description of Artificial Sequence: Synthetic oligonucleotide
ctgaagaacatgcaccgtccatcgtgtttattgatg

SEQ ID NO: 130483 - DNA, 41 bp, Artificial Sequence
  Description of Artificial Sequence: Synthetic oligonucleotide
tgaagaacatgcaccgtccatcgtgtttattgatgaaattg

SEQ ID NO: 130484 - DNA, 40 bp, Artificial Sequence
  Description of Artificial Sequence: Synthetic oligonucleotide
gaagaacatgcaccgtccatcgtgtttattgatgaaattg

SEQ ID NO: 130485 - DNA, 41 bp, Artificial Sequence
  Description of Artificial Sequence: Synthetic oligonucleotide
aagaacatgcaccgtccatcgtgtttattgatgaaattgac

SEQ ID NO: 130486 - DNA, 40 bp, Artificial Sequence
  Description of Artificial Sequence: Synthetic oligonucleotide
agaacatgcaccgtccatcgtgtttattgatgaaattgac

SEQ ID NO: 130487 - DNA, 39 bp, Artificial Sequence
  Description of Artificial Sequence: Synthetic oligonucleotide
gaacatgcaccgtccatcgtgtttattgatgaaattgac

SEQ ID NO: 130488 - DNA, 39 bp, Artificial Sequence
  Description of Artificial Sequence: Synthetic oligonucleotide
aacatgcaccgtccatcgtgtttattgatgaaattgacg

SEQ ID NO: 130489 - DNA, 38 bp, Artificial Sequence
  Description of Artificial Sequence: Synthetic oligonucleotide
acatgcaccgtccatcgtgtttattgatgaaattgacg

SEQ ID NO: 130490 - DNA, 37 bp, Artificial Sequence
  Description of Artificial Sequence: Synthetic oligonucleotide
catgcaccgtccatcgtgtttattgatgaaattgacg

SEQ ID NO: 130491 - DNA, 37 bp, Artificial Sequence
  Description of Artificial Sequence: Synthetic oligonucleotide
atgcaccgtccatcgtgtttattgatgaaattgacgc

SEQ ID NO: 130492 - DNA, 36 bp, Artificial Sequence
  Description of Artificial Sequence: Synthetic oligonucleotide
tgcaccgtccatcgtgtttattgatgaaattgacgc

SEQ ID NO: 130493 - DNA, 35 bp, Artificial Sequence
  Description of Artificial Sequence: Synthetic oligonucleotide
gcaccgtccatcgtgtttattgatgaaattgacgc

SEQ ID NO: 130494 - DNA, 35 bp, Artificial Sequence
  Description of Artificial Sequence: Synthetic oligonucleotide
caccgtccatcgtgtttattgatgaaattgacgcc

SEQ ID NO: 130495 - DNA, 38 bp, Artificial Sequence
  Description of Artificial Sequence: Synthetic oligonucleotide
accgtccatcgtgtttattgatgaaattgacgccattg

SEQ ID NO: 130496 - DNA, 37 bp, Artificial Sequence
  Description of Artificial Sequence: Synthetic oligonucleotide
ccgtccatcgtgtttattgatgaaattgacgccattg

SEQ ID NO: 130497 - DNA, 37 bp, Artificial Sequence
  Description of Artificial Sequence: Synthetic oligonucleotide
cgtccatcgtgtttattgatgaaattgacgccattgg

SEQ ID NO: 130498 - DNA, 37 bp, Artificial Sequence
  Description of Artificial Sequence: Synthetic oligonucleotide
gtccatcgtgtttattgatgaaattgacgccattggg

SEQ ID NO: 130499 - DNA, 38 bp, Artificial Sequence
  Description of Artificial Sequence: Synthetic oligonucleotide
tccatcgtgtttattgatgaaattgacgccattgggac

SEQ ID NO: 130500 - DNA, 37 bp, Artificial Sequence
  Description of Artificial Sequence: Synthetic oligonucleotide
ccatcgtgtttattgatgaaattgacgccattgggac

SEQ ID NO: 130501 - DNA, 42 bp, Artificial Sequence
  Description of Artificial Sequence: Synthetic oligonucleotide
catcgtgtttattgatgaaattgacgccattgggacaaaaag

SEQ ID NO: 130502 - DNA, 46 bp, Artificial Sequence
  Description of Artificial Sequence: Synthetic oligonucleotide
atcgtgtttattgatgaaattgacgccattgggacaaaaagatatg

SEQ ID NO: 130503 - DNA, 45 bp, Artificial Sequence
  Description of Artificial Sequence: Synthetic oligonucleotide
tcgtgtttattgatgaaattgacgccattgggacaaaaagatatg

SEQ ID NO: 130504 - DNA, 44 bp, Artificial Sequence
  Description of Artificial Sequence: Synthetic oligonucleotide
cgtgtttattgatgaaattgacgccattgggacaaaaagatatg

SEQ ID NO: 130505 - DNA, 45 bp, Artificial Sequence
  Description of Artificial Sequence: Synthetic oligonucleotide
gtgtttattgatgaaattgacgccattgggacaaaaagatatgac

SEQ ID NO: 130506 - DNA, 46 bp, Artificial Sequence
  Description of Artificial Sequence: Synthetic oligonucleotide
tgtttattgatgaaattgacgccattgggacaaaaagatatgactc

SEQ ID NO: 130507 - DNA, 45 bp, Artificial Sequence
  Description of Artificial Sequence: Synthetic oligonucleotide
gtttattgatgaaattgacgccattgggacaaaaagatatgactc

SEQ ID NO: 130508 - DNA, 45 bp, Artificial Sequence
  Description of Artificial Sequence: Synthetic oligonucleotide
tttattgatgaaattgacgccattgggacaaaaagatatgactcc

SEQ ID NO: 130509 - DNA, 44 bp, Artificial Sequence
  Description of Artificial Sequence: Synthetic oligonucleotide
ttattgatgaaattgacgccattgggacaaaaagatatgactcc

SEQ ID NO: 130510 - DNA, 43 bp, Artificial Sequence
  Description of Artificial Sequence: Synthetic oligonucleotide
tattgatgaaattgacgccattgggacaaaaagatatgactcc

SEQ ID NO: 130511 - DNA, 42 bp, Artificial Sequence
  Description of Artificial Sequence: Synthetic oligonucleotide
attgatgaaattgacgccattgggacaaaaagatatgactcc

SEQ ID NO: 130512 - DNA, 41 bp, Artificial Sequence
  Description of Artificial Sequence: Synthetic oligonucleotide
ttgatgaaattgacgccattgggacaaaaagatatgactcc

SEQ ID NO: 130513 - DNA, 40 bp, Artificial Sequence
  Description of Artificial Sequence: Synthetic oligonucleotide
tgatgaaattgacgccattgggacaaaaagatatgactcc

SEQ ID NO: 130514 - DNA, 39 bp, Artificial Sequence
  Description of Artificial Sequence: Synthetic oligonucleotide
gatgaaattgacgccattgggacaaaaagatatgactcc

SEQ ID NO: 130515 - DNA, 43 bp, Artificial Sequence
  Description of Artificial Sequence: Synthetic oligonucleotide
atgaaattgacgccattgggacaaaaagatatgactccaattc

SEQ ID NO: 130516 - DNA, 42 bp, Artificial Sequence
  Description of Artificial Sequence: Synthetic oligonucleotide
tgaaattgacgccattgggacaaaaagatatgactccaattc

SEQ ID NO: 130517 - DNA, 41 bp, Artificial Sequence
  Description of Artificial Sequence: Synthetic oligonucleotide
gaaattgacgccattgggacaaaaagatatgactccaattc

SEQ ID NO: 130518 - DNA, 42 bp, Artificial Sequence
  Description of Artificial Sequence: Synthetic oligonucleotide
aaattgacgccattgggacaaaaagatatgactccaattctg

SEQ ID NO: 130519 - DNA, 41 bp, Artificial Sequence
  Description of Artificial Sequence: Synthetic oligonucleotide
aattgacgccattgggacaaaaagatatgactccaattctg

SEQ ID NO: 130520 - DNA, 40 bp, Artificial Sequence
  Description of Artificial Sequence: Synthetic oligonucleotide
attgacgccattgggacaaaaagatatgactccaattctg

SEQ ID NO: 130521 - DNA, 39 bp, Artificial Sequence
  Description of Artificial Sequence: Synthetic oligonucleotide
ttgacgccattgggacaaaaagatatgactccaattctg

SEQ ID NO: 130522 - DNA, 38 bp, Artificial Sequence
  Description of Artificial Sequence: Synthetic oligonucleotide
tgacgccattgggacaaaaagatatgactccaattctg

SEQ ID NO: 130523 - DNA, 37 bp, Artificial Sequence
  Description of Artificial Sequence: Synthetic oligonucleotide
gacgccattgggacaaaaagatatgactccaattctg

SEQ ID NO: 130524 - DNA, 37 bp, Artificial Sequence
  Description of Artificial Sequence: Synthetic oligonucleotide
acgccattgggacaaaaagatatgactccaattctgg

SEQ ID NO: 130525 - DNA, 36 bp, Artificial Sequence
  Description of Artificial Sequence: Synthetic oligonucleotide
cgccattgggacaaaaagatatgactccaattctgg

SEQ ID NO: 130526 - DNA, 37 bp, Artificial Sequence
  Description of Artificial Sequence: Synthetic oligonucleotide
gccattgggacaaaaagatatgactccaattctggtg

SEQ ID NO: 130527 - DNA, 37 bp, Artificial Sequence
  Description of Artificial Sequence: Synthetic oligonucleotide
ccattgggacaaaaagatatgactccaattctggtgg

SEQ ID NO: 130528 - DNA, 38 bp, Artificial Sequence
  Description of Artificial Sequence: Synthetic oligonucleotide
cattgggacaaaaagatatgactccaattctggtggtg

SEQ ID NO: 130529 - DNA, 39 bp, Artificial Sequence
  Description of Artificial Sequence: Synthetic oligonucleotide
attgggacaaaaagatatgactccaattctggtggtgag

SEQ ID NO: 130530 - DNA, 38 bp, Artificial Sequence
  Description of Artificial Sequence: Synthetic oligonucleotide
ttgggacaaaaagatatgactccaattctggtggtgag

SEQ ID NO: 130531 - DNA, 37 bp, Artificial Sequence
  Description of Artificial Sequence: Synthetic oligonucleotide
tgggacaaaaagatatgactccaattctggtggtgag

SEQ ID NO: 130532 - DNA, 36 bp, Artificial Sequence
  Description of Artificial Sequence: Synthetic oligonucleotide
gggacaaaaagatatgactccaattctggtggtgag

SEQ ID NO: 130533 - DNA, 37 bp, Artificial Sequence
  Description of Artificial Sequence: Synthetic oligonucleotide
ggacaaaaagatatgactccaattctggtggtgagag

SEQ ID NO: 130534 - DNA, 38 bp, Artificial Sequence
  Description of Artificial Sequence: Synthetic oligonucleotide
gacaaaaagatatgactccaattctggtggtgagagag

SEQ ID NO: 130535 - DNA, 43 bp, Artificial Sequence
  Description of Artificial Sequence: Synthetic oligonucleotide
acaaaaagatatgactccaattctggtggtgagagagaaattc

SEQ ID NO: 130536 - DNA, 42 bp, Artificial Sequence
  Description of Artificial Sequence: Synthetic oligonucleotide
caaaaagatatgactccaattctggtggtgagagagaaattc

SEQ ID NO: 130537 - DNA, 43 bp, Artificial Sequence
  Description of Artificial Sequence: Synthetic oligonucleotide
aaaaagatatgactccaattctggtggtgagagagaaattcag

SEQ ID NO: 130538 - DNA, 42 bp, Artificial Sequence
  Description of Artificial Sequence: Synthetic oligonucleotide
aaaagatatgactccaattctggtggtgagagagaaattcag

SEQ ID NO: 130539 - DNA, 41 bp, Artificial Sequence
  Description of Artificial Sequence: Synthetic oligonucleotide
aaagatatgactccaattctggtggtgagagagaaattcag

SEQ ID NO: 130540 - DNA, 40 bp, Artificial Sequence
  Description of Artificial Sequence: Synthetic oligonucleotide
aagatatgactccaattctggtggtgagagagaaattcag

SEQ ID NO: 130541 - DNA, 39 bp, Artificial Sequence
  Description of Artificial Sequence: Synthetic oligonucleotide
agatatgactccaattctggtggtgagagagaaattcag

SEQ ID NO: 130542 - DNA, 38 bp, Artificial Sequence
  Description of Artificial Sequence: Synthetic oligonucleotide
gatatgactccaattctggtggtgagagagaaattcag

SEQ ID NO: 130543 - DNA, 38 bp, Artificial Sequence
  Description of Artificial Sequence: Synthetic oligonucleotide
atatgactccaattctggtggtgagagagaaattcagc

SEQ ID NO: 130544 - DNA, 37 bp, Artificial Sequence
  Description of Artificial Sequence: Synthetic oligonucleotide
tatgactccaattctggtggtgagagagaaattcagc

SEQ ID NO: 130545 - DNA, 36 bp, Artificial Sequence
  Description of Artificial Sequence: Synthetic oligonucleotide
atgactccaattctggtggtgagagagaaattcagc

SEQ ID NO: 130546 - DNA, 35 bp, Artificial Sequence
  Description of Artificial Sequence: Synthetic oligonucleotide
tgactccaattctggtggtgagagagaaattcagc

SEQ ID NO: 130547 - DNA, 34 bp, Artificial Sequence
  Description of Artificial Sequence: Synthetic oligonucleotide
gactccaattctggtggtgagagagaaattcagc

SEQ ID NO: 130548 - DNA, 34 bp, Artificial Sequence
  Description of Artificial Sequence: Synthetic oligonucleotide
actccaattctggtggtgagagagaaattcagcg

SEQ ID NO: 130549 - DNA, 33 bp, Artificial Sequence
  Description of Artificial Sequence: Synthetic oligonucleotide
ctccaattctggtggtgagagagaaattcagcg

SEQ ID NO: 130550 - DNA, 35 bp, Artificial Sequence
  Description of Artificial Sequence: Synthetic oligonucleotide
tccaattctggtggtgagagagaaattcagcgaac

SEQ ID NO: 130551 - DNA, 34 bp, Artificial Sequence
  Description of Artificial Sequence: Synthetic oligonucleotide
ccaattctggtggtgagagagaaattcagcgaac

SEQ ID NO: 130552 - DNA, 37 bp, Artificial Sequence
  Description of Artificial Sequence: Synthetic oligonucleotide
caattctggtggtgagagagaaattcagcgaacaatg

SEQ ID NO: 130553 - DNA, 39 bp, Artificial Sequence
  Description of Artificial Sequence: Synthetic oligonucleotide
aattctggtggtgagagagaaattcagcgaacaatgttg

SEQ ID NO: 130554 - DNA, 38 bp, Artificial Sequence
  Description of Artificial Sequence: Synthetic oligonucleotide
attctggtggtgagagagaaattcagcgaacaatgttg

SEQ ID NO: 130555 - DNA, 37 bp, Artificial Sequence
  Description of Artificial Sequence: Synthetic oligonucleotide
ttctggtggtgagagagaaattcagcgaacaatgttg

SEQ ID NO: 130556 - DNA, 36 bp, Artificial Sequence
  Description of Artificial Sequence: Synthetic oligonucleotide
tctggtggtgagagagaaattcagcgaacaatgttg

SEQ ID NO: 130557 - DNA, 35 bp, Artificial Sequence
  Description of Artificial Sequence: Synthetic oligonucleotide
ctggtggtgagagagaaattcagcgaacaatgttg

SEQ ID NO: 130558 - DNA, 35 bp, Artificial Sequence
  Description of Artificial Sequence: Synthetic oligonucleotide
tggtggtgagagagaaattcagcgaacaatgttgg

SEQ ID NO: 130559 - DNA, 34 bp, Artificial Sequence
  Description of Artificial Sequence: Synthetic oligonucleotide
ggtggtgagagagaaattcagcgaacaatgttgg

SEQ ID NO: 130560 - DNA, 36 bp, Artificial Sequence
  Description of Artificial Sequence: Synthetic oligonucleotide
gtggtgagagagaaattcagcgaacaatgttggaac

SEQ ID NO: 130561 - DNA, 37 bp, Artificial Sequence
  Description of Artificial Sequence: Synthetic oligonucleotide
tggtgagagagaaattcagcgaacaatgttggaactg

SEQ ID NO: 130562 - DNA, 36 bp, Artificial Sequence
  Description of Artificial Sequence: Synthetic oligonucleotide
ggtgagagagaaattcagcgaacaatgttggaactg

SEQ ID NO: 130563 - DNA, 36 bp, Artificial Sequence
  Description of Artificial Sequence: Synthetic oligonucleotide
gtgagagagaaattcagcgaacaatgttggaactgc

SEQ ID NO: 130564 - DNA, 37 bp, Artificial Sequence
  Description of Artificial Sequence: Synthetic oligonucleotide
tgagagagaaattcagcgaacaatgttggaactgctg

SEQ ID NO: 130565 - DNA, 36 bp, Artificial Sequence
  Description of Artificial Sequence: Synthetic oligonucleotide
gagagagaaattcagcgaacaatgttggaactgctg

SEQ ID NO: 130566 - DNA, 38 bp, Artificial Sequence
  Description of Artificial Sequence: Synthetic oligonucleotide
agagagaaattcagcgaacaatgttggaactgctgaac

SEQ ID NO: 130567 - DNA, 37 bp, Artificial Sequence
  Description of Artificial Sequence: Synthetic oligonucleotide
gagagaaattcagcgaacaatgttggaactgctgaac

SEQ ID NO: 130568 - DNA, 37 bp, Artificial Sequence
  Description of Artificial Sequence: Synthetic oligonucleotide
agagaaattcagcgaacaatgttggaactgctgaacc

SEQ ID NO: 130569 - DNA, 36 bp, Artificial Sequence
  Description of Artificial Sequence: Synthetic oligonucleotide
gagaaattcagcgaacaatgttggaactgctgaacc

SEQ ID NO: 130570 - DNA, 37 bp, Artificial Sequence
  Description of Artificial Sequence: Synthetic oligonucleotide
agaaattcagcgaacaatgttggaactgctgaaccag

SEQ ID NO: 130571 - DNA, 36 bp, Artificial Sequence
  Description of Artificial Sequence: Synthetic oligonucleotide
gaaattcagcgaacaatgttggaactgctgaaccag

SEQ ID NO: 130572 - DNA, 38 bp, Artificial Sequence
  Description of Artificial Sequence: Synthetic oligonucleotide
aaattcagcgaacaatgttggaactgctgaaccagttg

SEQ ID NO: 130573 - DNA, 37 bp, Artificial Sequence
  Description of Artificial Sequence: Synthetic oligonucleotide
aattcagcgaacaatgttggaactgctgaaccagttg

SEQ ID NO: 130574 - DNA, 36 bp, Artificial Sequence
  Description of Artificial Sequence: Synthetic oligonucleotide
attcagcgaacaatgttggaactgctgaaccagttg

SEQ ID NO: 130575 - DNA, 35 bp, Artificial Sequence
  Description of Artificial Sequence: Synthetic oligonucleotide
ttcagcgaacaatgttggaactgctgaaccagttg

SEQ ID NO: 130576 - DNA, 34 bp, Artificial Sequence
  Description of Artificial Sequence: Synthetic oligonucleotide
tcagcgaacaatgttggaactgctgaaccagttg

SEQ ID NO: 130577 - DNA, 33 bp, Artificial Sequence
  Description of Artificial Sequence: Synthetic oligonucleotide
cagcgaacaatgttggaactgctgaaccagttg

SEQ ID NO: 130578 - DNA, 33 bp, Artificial Sequence
  Description of Artificial Sequence: Synthetic oligonucleotide
agcgaacaatgttggaactgctgaaccagttgg

SEQ ID NO: 130579 - DNA, 32 bp, Artificial Sequence
  Description of Artificial Sequence: Synthetic oligonucleotide
gcgaacaatgttggaactgctgaaccagttgg

SEQ ID NO: 130580 - DNA, 34 bp, Artificial Sequence
  Description of Artificial Sequence: Synthetic oligonucleotide
cgaacaatgttggaactgctgaaccagttggatg

SEQ ID NO: 130581 - DNA, 34 bp, Artificial Sequence
  Description of Artificial Sequence: Synthetic oligonucleotide
gaacaatgttggaactgctgaaccagttggatgg

SEQ ID NO: 130582 - DNA, 38 bp, Artificial Sequence
  Description of Artificial Sequence: Synthetic oligonucleotide
aacaatgttggaactgctgaaccagttggatggatttg

SEQ ID NO: 130583 - DNA, 37 bp, Artificial Sequence
  Description of Artificial Sequence: Synthetic oligonucleotide
acaatgttggaactgctgaaccagttggatggatttg

SEQ ID NO: 130584 - DNA, 36 bp, Artificial Sequence
  Description of Artificial Sequence: Synthetic oligonucleotide
caatgttggaactgctgaaccagttggatggatttg

SEQ ID NO: 130585 - DNA, 39 bp, Artificial Sequence
  Description of Artificial Sequence: Synthetic oligonucleotide
aatgttggaactgctgaaccagttggatggatttgattc

SEQ ID NO: 130586 - DNA, 38 bp, Artificial Sequence
  Description of Artificial Sequence: Synthetic oligonucleotide
atgttggaactgctgaaccagttggatggatttgattc

SEQ ID NO: 130587 - DNA, 37 bp, Artificial Sequence
  Description of Artificial Sequence: Synthetic oligonucleotide
tgttggaactgctgaaccagttggatggatttgattc

SEQ ID NO: 130588 - DNA, 36 bp, Artificial Sequence
  Description of Artificial Sequence: Synthetic oligonucleotide
gttggaactgctgaaccagttggatggatttgattc

SEQ ID NO: 130589 - DNA, 38 bp, Artificial Sequence
  Description of Artificial Sequence: Synthetic oligonucleotide
ttggaactgctgaaccagttggatggatttgattctag

SEQ ID NO: 130590 - DNA, 37 bp, Artificial Sequence
  Description of Artificial Sequence: Synthetic oligonucleotide
tggaactgctgaaccagttggatggatttgattctag

SEQ ID NO: 130591 - DNA, 36 bp, Artificial Sequence
  Description of Artificial Sequence: Synthetic oligonucleotide
ggaactgctgaaccagttggatggatttgattctag

SEQ ID NO: 130592 - DNA, 36 bp, Artificial Sequence
  Description of Artificial Sequence: Synthetic oligonucleotide
gaactgctgaaccagttggatggatttgattctagg

SEQ ID NO: 130593 - DNA, 36 bp, Artificial Sequence
  Description of Artificial Sequence: Synthetic oligonucleotide
aactgctgaaccagttggatggatttgattctaggg

SEQ ID NO: 130594 - DNA, 35 bp, Artificial Sequence
  Description of Artificial Sequence: Synthetic oligonucleotide
actgctgaaccagttggatggatttgattctaggg

SEQ ID NO: 130595 - DNA, 34 bp, Artificial Sequence
  Description of Artificial Sequence: Synthetic oligonucleotide
ctgctgaaccagttggatggatttgattctaggg

SEQ ID NO: 130596 - DNA, 34 bp, Artificial Sequence
  Description of Artificial Sequence: Synthetic oligonucleotide
tgctgaaccagttggatggatttgattctagggg

SEQ ID NO: 130597 - DNA, 33 bp, Artificial Sequence
  Description of Artificial Sequence: Synthetic oligonucleotide
gctgaaccagttggatggatttgattctagggg

SEQ ID NO: 130598 - DNA, 34 bp, Artificial Sequence
  Description of Artificial Sequence: Synthetic oligonucleotide
ctgaaccagttggatggatttgattctaggggag

SEQ ID NO: 130599 - DNA, 36 bp, Artificial Sequence
  Description of Artificial Sequence: Synthetic oligonucleotide
tgaaccagttggatggatttgattctaggggagatg

SEQ ID NO: 130600 - DNA, 35 bp, Artificial Sequence
  Description of Artificial Sequence: Synthetic oligonucleotide
gaaccagttggatggatttgattctaggggagatg

SEQ ID NO: 130601 - DNA, 36 bp, Artificial Sequence
  Description of Artificial Sequence: Synthetic oligonucleotide
aaccagttggatggatttgattctaggggagatgtg

SEQ ID NO: 130602 - DNA, 35 bp, Artificial Sequence
  Description of Artificial Sequence: Synthetic oligonucleotide
accagttggatggatttgattctaggggagatgtg

SEQ ID NO: 130603 - DNA, 34 bp, Artificial Sequence
  Description of Artificial Sequence: Synthetic oligonucleotide
ccagttggatggatttgattctaggggagatgtg

SEQ ID NO: 130604 - DNA, 37 bp, Artificial Sequence
  Description of Artificial Sequence: Synthetic oligonucleotide
cagttggatggatttgattctaggggagatgtgaaag

SEQ ID NO: 130605 - DNA, 41 bp, Artificial Sequence
  Description of Artificial Sequence: Synthetic oligonucleotide
agttggatggatttgattctaggggagatgtgaaagttatc

SEQ ID NO: 130606 - DNA, 40 bp, Artificial Sequence
  Description of Artificial Sequence: Synthetic oligonucleotide
gttggatggatttgattctaggggagatgtgaaagttatc

SEQ ID NO: 130607 - DNA, 42 bp, Artificial Sequence
  Description of Artificial Sequence: Synthetic oligonucleotide
ttggatggatttgattctaggggagatgtgaaagttatcatg

SEQ ID NO: 130608 - DNA, 41 bp, Artificial Sequence
  Description of Artificial Sequence: Synthetic oligonucleotide
tggatggatttgattctaggggagatgtgaaagttatcatg

SEQ ID NO: 130609 - DNA, 40 bp, Artificial Sequence
  Description of Artificial Sequence: Synthetic oligonucleotide
ggatggatttgattctaggggagatgtgaaagttatcatg

SEQ ID NO: 130610 - DNA, 40 bp, Artificial Sequence
  Description of Artificial Sequence: Synthetic oligonucleotide
gatggatttgattctaggggagatgtgaaagttatcatgg

SEQ ID NO: 130611 - DNA, 40 bp, Artificial Sequence
  Description of Artificial Sequence: Synthetic oligonucleotide
atggatttgattctaggggagatgtgaaagttatcatggc

SEQ ID NO: 130612 - DNA, 39 bp, Artificial Sequence
  Description of Artificial Sequence: Synthetic oligonucleotide
tggatttgattctaggggagatgtgaaagttatcatggc

SEQ ID NO: 130613 - DNA, 38 bp, Artificial Sequence
  Description of Artificial Sequence: Synthetic oligonucleotide
ggatttgattctaggggagatgtgaaagttatcatggc

SEQ ID NO: 130614 - DNA, 38 bp, Artificial Sequence
  Description of Artificial Sequence: Synthetic oligonucleotide
gatttgattctaggggagatgtgaaagttatcatggcc

SEQ ID NO: 130615 - DNA, 39 bp, Artificial Sequence
  Description of Artificial Sequence: Synthetic oligonucleotide
atttgattctaggggagatgtgaaagttatcatggccac

SEQ ID NO: 130616 - DNA, 38 bp, Artificial Sequence
  Description of Artificial Sequence: Synthetic oligonucleotide
tttgattctaggggagatgtgaaagttatcatggccac

SEQ ID NO: 130617 - DNA, 37 bp, Artificial Sequence
  Description of Artificial Sequence: Synthetic oligonucleotide
ttgattctaggggagatgtgaaagttatcatggccac

SEQ ID NO: 130618 - DNA, 36 bp, Artificial Sequence
  Description of Artificial Sequence: Synthetic oligonucleotide
tgattctaggggagatgtgaaagttatcatggccac

SEQ ID NO: 130619 - DNA, 35 bp, Artificial Sequence
  Description of Artificial Sequence: Synthetic oligonucleotide
gattctaggggagatgtgaaagttatcatggccac

SEQ ID NO: 130620 - DNA, 38 bp, Artificial Sequence
  Description of Artificial Sequence: Synthetic oligonucleotide
attctaggggagatgtgaaagttatcatggccacaaac

SEQ ID NO: 130621 - DNA, 37 bp, Artificial Sequence
  Description of Artificial Sequence: Synthetic oligonucleotide
ttctaggggagatgtgaaagttatcatggccacaaac

SEQ ID NO: 130622 - DNA, 36 bp, Artificial Sequence
  Description of Artificial Sequence: Synthetic oligonucleotide
tctaggggagatgtgaaagttatcatggccacaaac

SEQ ID NO: 130623 - DNA, 35 bp, Artificial Sequence
  Description of Artificial Sequence: Synthetic oligonucleotide
ctaggggagatgtgaaagttatcatggccacaaac

SEQ ID NO: 130624 - DNA, 35 bp, Artificial Sequence
  Description of Artificial Sequence: Synthetic oligonucleotide
taggggagatgtgaaagttatcatggccacaaacc

SEQ ID NO: 130625 - DNA, 34 bp, Artificial Sequence
  Description of Artificial Sequence: Synthetic oligonucleotide
aggggagatgtgaaagttatcatggccacaaacc

SEQ ID NO: 130626 - DNA, 33 bp, Artificial Sequence
  Description of Artificial Sequence: Synthetic oligonucleotide
ggggagatgtgaaagttatcatggccacaaacc

SEQ ID NO: 130627 - DNA, 33 bp, Artificial Sequence
  Description of Artificial Sequence: Synthetic oligonucleotide
gggagatgtgaaagttatcatggccacaaaccg

SEQ ID NO: 130628 - DNA, 37 bp, Artificial Sequence
  Description of Artificial Sequence: Synthetic oligonucleotide
ggagatgtgaaagttatcatggccacaaaccgaatag

SEQ ID NO: 130629 - DNA, 40 bp, Artificial Sequence
  Description of Artificial Sequence: Synthetic oligonucleotide
gagatgtgaaagttatcatggccacaaaccgaatagaaac

SEQ ID NO: 130630 - DNA, 43 bp, Artificial Sequence
  Description of Artificial Sequence: Synthetic oligonucleotide
agatgtgaaagttatcatggccacaaaccgaatagaaactttg

SEQ ID NO: 130631 - DNA, 42 bp, Artificial Sequence
  Description of Artificial Sequence: Synthetic oligonucleotide
gatgtgaaagttatcatggccacaaaccgaatagaaactttg

SEQ ID NO: 130632 - DNA, 42 bp, Artificial Sequence
  Description of Artificial Sequence: Synthetic oligonucleotide
atgtgaaagttatcatggccacaaaccgaatagaaactttgg

SEQ ID NO: 130633 - DNA, 41 bp, Artificial Sequence
  Description of Artificial Sequence: Synthetic oligonucleotide
tgtgaaagttatcatggccacaaaccgaatagaaactttgg

SEQ ID NO: 130634 - DNA, 40 bp, Artificial Sequence
  Description of Artificial Sequence: Synthetic oligonucleotide
gtgaaagttatcatggccacaaaccgaatagaaactttgg

SEQ ID NO: 130635 - DNA, 42 bp, Artificial Sequence
  Description of Artificial Sequence: Synthetic oligonucleotide
tgaaagttatcatggccacaaaccgaatagaaactttggatc

SEQ ID NO: 130636 - DNA, 41 bp, Artificial Sequence
  Description of Artificial Sequence: Synthetic oligonucleotide
gaaagttatcatggccacaaaccgaatagaaactttggatc

SEQ ID NO: 130637 - DNA, 41 bp, Artificial Sequence
  Description of Artificial Sequence: Synthetic oligonucleotide
aaagttatcatggccacaaaccgaatagaaactttggatcc

SEQ ID NO: 130638 - DNA, 40 bp, Artificial Sequence
  Description of Artificial Sequence: Synthetic oligonucleotide
aagttatcatggccacaaaccgaatagaaactttggatcc

SEQ ID NO: 130639 - DNA, 39 bp, Artificial Sequence
  Description of Artificial Sequence: Synthetic oligonucleotide
agttatcatggccacaaaccgaatagaaactttggatcc

SEQ ID NO: 130640 - DNA, 38 bp, Artificial Sequence
  Description of Artificial Sequence: Synthetic oligonucleotide
gttatcatggccacaaaccgaatagaaactttggatcc

SEQ ID NO: 130641 - DNA, 39 bp, Artificial Sequence
  Description of Artificial Sequence: Synthetic oligonucleotide
ttatcatggccacaaaccgaatagaaactttggatccag

SEQ ID NO: 130642 - DNA, 38 bp, Artificial Sequence
  Description of Artificial Sequence: Synthetic oligonucleotide
tatcatggccacaaaccgaatagaaactttggatccag

SEQ ID NO: 130643 - DNA, 37 bp, Artificial Sequence
  Description of Artificial Sequence: Synthetic oligonucleotide
atcatggccacaaaccgaatagaaactttggatccag

SEQ ID NO: 130644 - DNA, 36 bp, Artificial Sequence
  Description of Artificial Sequence: Synthetic oligonucleotide
tcatggccacaaaccgaatagaaactttggatccag

SEQ ID NO: 130645 - DNA, 35 bp, Artificial Sequence
  Description of Artificial Sequence: Synthetic oligonucleotide
catggccacaaaccgaatagaaactttggatccag

SEQ ID NO: 130646 - DNA, 35 bp, Artificial Sequence
  Description of Artificial Sequence: Synthetic oligonucleotide
atggccacaaaccgaatagaaactttggatccagc

SEQ ID NO: 130647 - DNA, 34 bp, Artificial Sequence
  Description of Artificial Sequence: Synthetic oligonucleotide
tggccacaaaccgaatagaaactttggatccagc

SEQ ID NO: 130648 - DNA, 33 bp, Artificial Sequence
  Description of Artificial Sequence: Synthetic oligonucleotide
ggccacaaaccgaatagaaactttggatccagc

SEQ ID NO: 130649 - DNA, 34 bp, Artificial Sequence
  Description of Artificial Sequence: Synthetic oligonucleotide
gccacaaaccgaatagaaactttggatccagcac

SEQ ID NO: 130650 - DNA, 38 bp, Artificial Sequence
  Description of Artificial Sequence: Synthetic oligonucleotide
ccacaaaccgaatagaaactttggatccagcacttatc

SEQ ID NO: 130651 - DNA, 39 bp, Artificial Sequence
  Description of Artificial Sequence: Synthetic oligonucleotide
cacaaaccgaatagaaactttggatccagcacttatcag

SEQ ID NO: 130652 - DNA, 40 bp, Artificial Sequence
  Description of Artificial Sequence: Synthetic oligonucleotide
acaaaccgaatagaaactttggatccagcacttatcagac

SEQ ID NO: 130653 - DNA, 39 bp, Artificial Sequence
  Description of Artificial Sequence: Synthetic oligonucleotide
caaaccgaatagaaactttggatccagcacttatcagac

SEQ ID NO: 130654 - DNA, 39 bp, Artificial Sequence
  Description of Artificial Sequence: Synthetic oligonucleotide
aaaccgaatagaaactttggatccagcacttatcagacc

SEQ ID NO: 130655 - DNA, 38 bp, Artificial Sequence
  Description of Artificial Sequence: Synthetic oligonucleotide
aaccgaatagaaactttggatccagcacttatcagacc

SEQ ID NO: 130656 - DNA, 37 bp, Artificial Sequence
  Description of Artificial Sequence: Synthetic oligonucleotide
accgaatagaaactttggatccagcacttatcagacc

SEQ ID NO: 130657 - DNA, 36 bp, Artificial Sequence
  Description of Artificial Sequence: Synthetic oligonucleotide
ccgaatagaaactttggatccagcacttatcagacc

SEQ ID NO: 130658 - DNA, 37 bp, Artificial Sequence
  Description of Artificial Sequence: Synthetic oligonucleotide
cgaatagaaactttggatccagcacttatcagaccag

SEQ ID NO: 130659 - DNA, 37 bp, Artificial Sequence
  Description of Artificial Sequence: Synthetic oligonucleotide
gaatagaaactttggatccagcacttatcagaccagg

SEQ ID NO: 130660 - DNA, 37 bp, Artificial Sequence
  Description of Artificial Sequence: Synthetic oligonucleotide
aatagaaactttggatccagcacttatcagaccaggc

SEQ ID NO: 130661 - DNA, 36 bp, Artificial Sequence
  Description of Artificial Sequence: Synthetic oligonucleotide
atagaaactttggatccagcacttatcagaccaggc

SEQ ID NO: 130662 - DNA, 35 bp, Artificial Sequence
  Description of Artificial Sequence: Synthetic oligonucleotide
tagaaactttggatccagcacttatcagaccaggc

SEQ ID NO: 130663 - DNA, 34 bp, Artificial Sequence
  Description of Artificial Sequence: Synthetic oligonucleotide
agaaactttggatccagcacttatcagaccaggc

SEQ ID NO: 130664 - DNA, 33 bp, Artificial Sequence
  Description of Artificial Sequence: Synthetic oligonucleotide
gaaactttggatccagcacttatcagaccaggc

SEQ ID NO: 130665 - DNA, 33 bp, Artificial Sequence
  Description of Artificial Sequence: Synthetic oligonucleotide
aaactttggatccagcacttatcagaccaggcc

SEQ ID NO: 130666 - DNA, 32 bp, Artificial Sequence
  Description of Artificial Sequence: Synthetic oligonucleotide
aactttggatccagcacttatcagaccaggcc

SEQ ID NO: 130667 - DNA, 31 bp, Artificial Sequence
  Description of Artificial Sequence: Synthetic oligonucleotide
actttggatccagcacttatcagaccaggcc

SEQ ID NO: 130668 - DNA, 30 bp, Artificial Sequence
  Description of Artificial Sequence: Synthetic oligonucleotide
ctttggatccagcacttatcagaccaggcc

SEQ ID NO: 130669 - DNA, 30 bp, Artificial Sequence
  Description of Artificial Sequence: Synthetic oligonucleotide
tttggatccagcacttatcagaccaggccg

SEQ ID NO: 130670 - DNA, 29 bp, Artificial Sequence
  Description of Artificial Sequence: Synthetic oligonucleotide
ttggatccagcacttatcagaccaggccg

SEQ ID NO: 130671 - DNA, 28 bp, Artificial Sequence
  Description of Artificial Sequence: Synthetic oligonucleotide
tggatccagcacttatcagaccaggccg

SEQ ID NO: 130672 - DNA, 27 bp, Artificial Sequence
  Description of Artificial Sequence: Synthetic oligonucleotide
ggatccagcacttatcagaccaggccg

SEQ ID NO: 130673 - DNA, 27 bp, Artificial Sequence
  Description of Artificial Sequence: Synthetic oligonucleotide
gatccagcacttatcagaccaggccgc

SEQ ID NO: 130674 - DNA, 30 bp, Artificial Sequence
  Description of Artificial Sequence: Synthetic oligonucleotide
atccagcacttatcagaccaggccgcattg

SEQ ID NO: 130675 - DNA, 29 bp, Artificial Sequence
  Description of Artificial Sequence: Synthetic oligonucleotide
tccagcacttatcagaccaggccgcattg

SEQ ID NO: 130676 - DNA, 28 bp, Artificial Sequence
  Description of Artificial Sequence: Synthetic oligonucleotide
ccagcacttatcagaccaggccgcattg

SEQ ID NO: 130677 - DNA, 29 bp, Artificial Sequence
  Description of Artificial Sequence: Synthetic oligonucleotide
cagcacttatcagaccaggccgcattgac

SEQ ID NO: 130678 - DNA, 30 bp, Artificial Sequence
  Description of Artificial Sequence: Synthetic oligonucleotide
agcacttatcagaccaggccgcattgacag

SEQ ID NO: 130679 - DNA, 29 bp, Artificial Sequence
  Description of Artificial Sequence: Synthetic oligonucleotide
gcacttatcagaccaggccgcattgacag

SEQ ID NO: 130680 - DNA, 29 bp, Artificial Sequence
  Description of Artificial Sequence: Synthetic oligonucleotide
cacttatcagaccaggccgcattgacagg

SEQ ID NO: 130681 - DNA, 31 bp, Artificial Sequence
  Description of Artificial Sequence: Synthetic oligonucleotide
acttatcagaccaggccgcattgacaggaag

SEQ ID NO: 130682 - DNA, 30 bp, Artificial Sequence
  Description of Artificial Sequence: Synthetic oligonucleotide
cttatcagaccaggccgcattgacaggaag

SEQ ID NO: 130683 - DNA, 33 bp, Artificial Sequence
  Description of Artificial Sequence: Synthetic oligonucleotide
ttatcagaccaggccgcattgacaggaagattg

SEQ ID NO: 130684 - DNA, 32 bp, Artificial Sequence
  Description of Artificial Sequence: Synthetic oligonucleotide
tatcagaccaggccgcattgacaggaagattg

SEQ ID NO: 130685 - DNA, 31 bp, Artificial Sequence
  Description of Artificial Sequence: Synthetic oligonucleotide
atcagaccaggccgcattgacaggaagattg

SEQ ID NO: 130686 - DNA, 30 bp, Artificial Sequence
  Description of Artificial Sequence: Synthetic oligonucleotide
tcagaccaggccgcattgacaggaagattg

SEQ ID NO: 130687 - DNA, 29 bp, Artificial Sequence
  Description of Artificial Sequence: Synthetic oligonucleotide
cagaccaggccgcattgacaggaagattg

SEQ ID NO: 130688 - DNA, 30 bp, Artificial Sequence
  Description of Artificial Sequence: Synthetic oligonucleotide
agaccaggccgcattgacaggaagattgag

SEQ ID NO: 130689 - DNA, 29 bp, Artificial Sequence
  Description of Artificial Sequence: Synthetic oligonucleotide
gaccaggccgcattgacaggaagattgag

SEQ ID NO: 130690 - DNA, 31 bp, Artificial Sequence
  Description of Artificial Sequence: Synthetic oligonucleotide
accaggccgcattgacaggaagattgagttc

SEQ ID NO: 130691 - DNA, 30 bp, Artificial Sequence
  Description of Artificial Sequence: Synthetic oligonucleotide
ccaggccgcattgacaggaagattgagttc

SEQ ID NO: 130692 - DNA, 30 bp, Artificial Sequence
  Description of Artificial Sequence: Synthetic oligonucleotide
caggccgcattgacaggaagattgagttcc

SEQ ID NO: 130693 - DNA, 30 bp, Artificial Sequence
  Description of Artificial Sequence: Synthetic oligonucleotide
aggccgcattgacaggaagattgagttccc

SEQ ID NO: 130694 - DNA, 29 bp, Artificial Sequence
  Description of Artificial Sequence: Synthetic oligonucleotide
ggccgcattgacaggaagattgagttccc

SEQ ID NO: 130695 - DNA, 29 bp, Artificial Sequence
  Description of Artificial Sequence: Synthetic oligonucleotide
gccgcattgacaggaagattgagttcccc

SEQ ID NO: 130696 - DNA, 29 bp, Artificial Sequence
  Description of Artificial Sequence: Synthetic oligonucleotide
ccgcattgacaggaagattgagttccccc

SEQ ID NO: 130697 - DNA, 30 bp, Artificial Sequence
  Description of Artificial Sequence: Synthetic oligonucleotide
cgcattgacaggaagattgagttccccctg

SEQ ID NO: 130698 - DNA, 30 bp, Artificial Sequence
  Description of Artificial Sequence: Synthetic oligonucleotide
gcattgacaggaagattgagttccccctgc

SEQ ID NO: 130699 - DNA, 30 bp, Artificial Sequence
  Description of Artificial Sequence: Synthetic oligonucleotide
cattgacaggaagattgagttccccctgcc

SEQ ID NO: 130700 - DNA, 31 bp, Artificial Sequence
  Description of Artificial Sequence: Synthetic oligonucleotide
attgacaggaagattgagttccccctgcctg

SEQ ID NO: 130701 - DNA, 30 bp, Artificial Sequence
  Description of Artificial Sequence: Synthetic oligonucleotide
ttgacaggaagattgagttccccctgcctg

SEQ ID NO: 130702 - DNA, 29 bp, Artificial Sequence
  Description of Artificial Sequence: Synthetic oligonucleotide
tgacaggaagattgagttccccctgcctg

SEQ ID NO: 130703 - DNA, 28 bp, Artificial Sequence
  Description of Artificial Sequence: Synthetic oligonucleotide
gacaggaagattgagttccccctgcctg

SEQ ID NO: 130704 - DNA, 30 bp, Artificial Sequence
  Description of Artificial Sequence: Synthetic oligonucleotide
acaggaagattgagttccccctgcctgatg

SEQ ID NO: 130705 - DNA, 29 bp, Artificial Sequence
  Description of Artificial Sequence: Synthetic oligonucleotide
caggaagattgagttccccctgcctgatg

SEQ ID NO: 130706 - DNA, 33 bp, Artificial Sequence
  Description of Artificial Sequence: Synthetic oligonucleotide
aggaagattgagttccccctgcctgatgaaaag

SEQ ID NO: 130707 - DNA, 32 bp, Artificial Sequence
  Description of Artificial Sequence: Synthetic oligonucleotide
ggaagattgagttccccctgcctgatgaaaag

SEQ ID NO: 130708 - DNA, 33 bp, Artificial Sequence
  Description of Artificial Sequence: Synthetic oligonucleotide
gaagattgagttccccctgcctgatgaaaagac

SEQ ID NO: 130709 - DNA, 33 bp, Artificial Sequence
  Description of Artificial Sequence: Synthetic oligonucleotide
aagattgagttccccctgcctgatgaaaagacg

SEQ ID NO: 130710 - DNA, 32 bp, Artificial Sequence
  Description of Artificial Sequence: Synthetic oligonucleotide
agattgagttccccctgcctgatgaaaagacg

SEQ ID NO: 130711 - DNA, 31 bp, Artificial Sequence
  Description of Artificial Sequence: Synthetic oligonucleotide
gattgagttccccctgcctgatgaaaagacg

SEQ ID NO: 130712 - DNA, 33 bp, Artificial Sequence
  Description of Artificial Sequence: Synthetic oligonucleotide
attgagttccccctgcctgatgaaaagacgaag

SEQ ID NO: 130713 - DNA, 32 bp, Artificial Sequence
  Description of Artificial Sequence: Synthetic oligonucleotide
ttgagttccccctgcctgatgaaaagacgaag

SEQ ID NO: 130714 - DNA, 31 bp, Artificial Sequence
  Description of Artificial Sequence: Synthetic oligonucleotide
tgagttccccctgcctgatgaaaagacgaag

SEQ ID NO: 130715 - DNA, 30 bp, Artificial Sequence
  Description of Artificial Sequence: Synthetic oligonucleotide
gagttccccctgcctgatgaaaagacgaag

SEQ ID NO: 130716 - DNA, 32 bp, Artificial Sequence
  Description of Artificial Sequence: Synthetic oligonucleotide
agttccccctgcctgatgaaaagacgaagaag

SEQ ID NO: 130717 - DNA, 31 bp, Artificial Sequence
  Description of Artificial Sequence: Synthetic oligonucleotide
gttccccctgcctgatgaaaagacgaagaag

SEQ ID NO: 130718 - DNA, 31 bp, Artificial Sequence
  Description of Artificial Sequence: Synthetic oligonucleotide
ttccccctgcctgatgaaaagacgaagaagc

SEQ ID NO: 130719 - DNA, 30 bp, Artificial Sequence
  Description of Artificial Sequence: Synthetic oligonucleotide
tccccctgcctgatgaaaagacgaagaagc

SEQ ID NO: 130720 - DNA, 29 bp, Artificial Sequence
  Description of Artificial Sequence: Synthetic oligonucleotide
ccccctgcctgatgaaaagacgaagaagc

SEQ ID NO: 130721 - DNA, 29 bp, Artificial Sequence
  Description of Artificial Sequence: Synthetic oligonucleotide
cccctgcctgatgaaaagacgaagaagcg

SEQ ID NO: 130722 - DNA, 29 bp, Artificial Sequence
  Description of Artificial Sequence: Synthetic oligonucleotide
ccctgcctgatgaaaagacgaagaagcgc

SEQ ID NO: 130723 - DNA, 31 bp, Artificial Sequence
  Description of Artificial Sequence: Synthetic oligonucleotide
cctgcctgatgaaaagacgaagaagcgcatc

SEQ ID NO: 130724 - DNA, 34 bp, Artificial Sequence
  Description of Artificial Sequence: Synthetic oligonucleotide
ctgcctgatgaaaagacgaagaagcgcatctttc

SEQ ID NO: 130725 - DNA, 35 bp, Artificial Sequence
  Description of Artificial Sequence: Synthetic oligonucleotide
tgcctgatgaaaagacgaagaagcgcatctttcag

SEQ ID NO: 130726 - DNA, 34 bp, Artificial Sequence
  Description of Artificial Sequence: Synthetic oligonucleotide
gcctgatgaaaagacgaagaagcgcatctttcag

SEQ ID NO: 130727 - DNA, 37 bp, Artificial Sequence
  Description of Artificial Sequence: Synthetic oligonucleotide
cctgatgaaaagacgaagaagcgcatctttcagattc

SEQ ID NO: 130728 - DNA, 38 bp, Artificial Sequence
  Description of Artificial Sequence: Synthetic oligonucleotide
ctgatgaaaagacgaagaagcgcatctttcagattcac

SEQ ID NO: 130729 - DNA, 39 bp, Artificial Sequence
  Description of Artificial Sequence: Synthetic oligonucleotide
tgatgaaaagacgaagaagcgcatctttcagattcacac

SEQ ID NO: 130730 - DNA, 38 bp, Artificial Sequence
  Description of Artificial Sequence: Synthetic oligonucleotide
gatgaaaagacgaagaagcgcatctttcagattcacac

SEQ ID NO: 130731 - DNA, 40 bp, Artificial Sequence
  Description of Artificial Sequence: Synthetic oligonucleotide
atgaaaagacgaagaagcgcatctttcagattcacacaag

SEQ ID NO: 130732 - DNA, 39 bp, Artificial Sequence
  Description of Artificial Sequence: Synthetic oligonucleotide
tgaaaagacgaagaagcgcatctttcagattcacacaag

SEQ ID NO: 130733 - DNA, 38 bp, Artificial Sequence
  Description of Artificial Sequence: Synthetic oligonucleotide
gaaaagacgaagaagcgcatctttcagattcacacaag

SEQ ID NO: 130734 - DNA, 38 bp, Artificial Sequence
  Description of Artificial Sequence: Synthetic oligonucleotide
aaaagacgaagaagcgcatctttcagattcacacaagc

SEQ ID NO: 130735 - DNA, 37 bp, Artificial Sequence
  Description of Artificial Sequence: Synthetic oligonucleotide
aaagacgaagaagcgcatctttcagattcacacaagc

SEQ ID NO: 130736 - DNA, 36 bp, Artificial Sequence
  Description of Artificial Sequence: Synthetic oligonucleotide
aagacgaagaagcgcatctttcagattcacacaagc

SEQ ID NO: 130737 - DNA, 35 bp, Artificial Sequence
  Description of Artificial Sequence: Synthetic oligonucleotide
agacgaagaagcgcatctttcagattcacacaagc

SEQ ID NO: 130738 - DNA, 34 bp, Artificial Sequence
  Description of Artificial Sequence: Synthetic oligonucleotide
gacgaagaagcgcatctttcagattcacacaagc

SEQ ID NO: 130739 - DNA, 35 bp, Artificial Sequence
  Description of Artificial Sequence: Synthetic oligonucleotide
acgaagaagcgcatctttcagattcacacaagcag

SEQ ID NO: 130740 - DNA, 34 bp, Artificial Sequence
  Description of Artificial Sequence: Synthetic oligonucleotide
cgaagaagcgcatctttcagattcacacaagcag

SEQ ID NO: 130741 - DNA, 34 bp, Artificial Sequence
  Description of Artificial Sequence: Synthetic oligonucleotide
gaagaagcgcatctttcagattcacacaagcagg

SEQ ID NO: 130742 - DNA, 36 bp, Artificial Sequence
  Description of Artificial Sequence: Synthetic oligonucleotide
aagaagcgcatctttcagattcacacaagcaggatg

SEQ ID NO: 130743 - DNA, 35 bp, Artificial Sequence
  Description of Artificial Sequence: Synthetic oligonucleotide
agaagcgcatctttcagattcacacaagcaggatg

SEQ ID NO: 130744 - DNA, 34 bp, Artificial Sequence
  Description of Artificial Sequence: Synthetic oligonucleotide
gaagcgcatctttcagattcacacaagcaggatg

SEQ ID NO: 130745 - DNA, 35 bp, Artificial Sequence
  Description of Artificial Sequence: Synthetic oligonucleotide
aagcgcatctttcagattcacacaagcaggatgac

SEQ ID NO: 130746 - DNA, 34 bp, Artificial Sequence
  Description of Artificial Sequence: Synthetic oligonucleotide
agcgcatctttcagattcacacaagcaggatgac

SEQ ID NO: 130747 - DNA, 33 bp, Artificial Sequence
  Description of Artificial Sequence: Synthetic oligonucleotide
gcgcatctttcagattcacacaagcaggatgac

SEQ ID NO: 130748 - DNA, 33 bp, Artificial Sequence
  Description of Artificial Sequence: Synthetic oligonucleotide
cgcatctttcagattcacacaagcaggatgacg

SEQ ID NO: 130749 - DNA, 33 bp, Artificial Sequence
  Description of Artificial Sequence: Synthetic oligonucleotide
gcatctttcagattcacacaagcaggatgacgc

SEQ ID NO: 130750 - DNA, 34 bp, Artificial Sequence
  Description of Artificial Sequence: Synthetic oligonucleotide
catctttcagattcacacaagcaggatgacgctg

SEQ ID NO: 130751 - DNA, 34 bp, Artificial Sequence
  Description of Artificial Sequence: Synthetic oligonucleotide
atctttcagattcacacaagcaggatgacgctgg

SEQ ID NO: 130752 - DNA, 33 bp, Artificial Sequence
  Description of Artificial Sequence: Synthetic oligonucleotide
tctttcagattcacacaagcaggatgacgctgg

SEQ ID NO: 130753 - DNA, 32 bp, Artificial Sequence
  Description of Artificial Sequence: Synthetic oligonucleotide
ctttcagattcacacaagcaggatgacgctgg

SEQ ID NO: 130754 - DNA, 32 bp, Artificial Sequence
  Description of Artificial Sequence: Synthetic oligonucleotide
tttcagattcacacaagcaggatgacgctggc

SEQ ID NO: 130755 - DNA, 31 bp, Artificial Sequence
  Description of Artificial Sequence: Synthetic oligonucleotide
ttcagattcacacaagcaggatgacgctggc

SEQ ID NO: 130756 - DNA, 30 bp, Artificial Sequence
  Description of Artificial Sequence: Synthetic oligonucleotide
tcagattcacacaagcaggatgacgctggc

SEQ ID NO: 130757 - DNA, 29 bp, Artificial Sequence
  Description of Artificial Sequence: Synthetic oligonucleotide
cagattcacacaagcaggatgacgctggc

SEQ ID NO: 130758 - DNA, 30 bp, Artificial Sequence
  Description of Artificial Sequence: Synthetic oligonucleotide
agattcacacaagcaggatgacgctggctg

SEQ ID NO: 130759 - DNA, 29 bp, Artificial Sequence
  Description of Artificial Sequence: Synthetic oligonucleotide
gattcacacaagcaggatgacgctggctg

SEQ ID NO: 130760 - DNA, 31 bp, Artificial Sequence
  Description of Artificial Sequence: Synthetic oligonucleotide
attcacacaagcaggatgacgctggctgatg

SEQ ID NO: 130761 - DNA, 30 bp, Artificial Sequence
  Description of Artificial Sequence: Synthetic oligonucleotide
ttcacacaagcaggatgacgctggctgatg

SEQ ID NO: 130762 - DNA, 29 bp, Artificial Sequence
  Description of Artificial Sequence: Synthetic oligonucleotide
tcacacaagcaggatgacgctggctgatg

SEQ ID NO: 130763 - DNA, 28 bp, Artificial Sequence
  Description of Artificial Sequence: Synthetic oligonucleotide
cacacaagcaggatgacgctggctgatg

SEQ ID NO: 130764 - DNA, 30 bp, Artificial Sequence
  Description of Artificial Sequence: Synthetic oligonucleotide
acacaagcaggatgacgctggctgatgatg

SEQ ID NO: 130765 - DNA, 29 bp, Artificial Sequence
  Description of Artificial Sequence: Synthetic oligonucleotide
cacaagcaggatgacgctggctgatgatg

SEQ ID NO: 130766 - DNA, 32 bp, Artificial Sequence
  Description of Artificial Sequence: Synthetic oligonucleotide
acaagcaggatgacgctggctgatgatgtaac

SEQ ID NO: 130767 - DNA, 31 bp, Artificial Sequence
  Description of Artificial Sequence: Synthetic oligonucleotide
caagcaggatgacgctggctgatgatgtaac

SEQ ID NO: 130768 - DNA, 31 bp, Artificial Sequence
  Description of Artificial Sequence: Synthetic oligonucleotide
aagcaggatgacgctggctgatgatgtaacc

SEQ ID NO: 130769 - DNA, 30 bp, Artificial Sequence
  Description of Artificial Sequence: Synthetic oligonucleotide
agcaggatgacgctggctgatgatgtaacc

SEQ ID NO: 130770 - DNA, 29 bp, Artificial Sequence
  Description of Artificial Sequence: Synthetic oligonucleotide
gcaggatgacgctggctgatgatgtaacc

SEQ ID NO: 130771 - DNA, 29 bp, Artificial Sequence
  Description of Artificial Sequence: Synthetic oligonucleotide
caggatgacgctggctgatgatgtaaccc

SEQ ID NO: 130772 - DNA, 30 bp, Artificial Sequence
  Description of Artificial Sequence: Synthetic oligonucleotide
aggatgacgctggctgatgatgtaaccctg

SEQ ID NO: 130773 - DNA, 29 bp, Artificial Sequence
  Description of Artificial Sequence: Synthetic oligonucleotide
ggatgacgctggctgatgatgtaaccctg

SEQ ID NO: 130774 - DNA, 29 bp, Artificial Sequence
  Description of Artificial Sequence: Synthetic oligonucleotide
gatgacgctggctgatgatgtaaccctgg

SEQ ID NO: 130775 - DNA, 30 bp, Artificial Sequence
  Description of Artificial Sequence: Synthetic oligonucleotide
atgacgctggctgatgatgtaaccctggac

SEQ ID NO: 130776 - DNA, 29 bp, Artificial Sequence
  Description of Artificial Sequence: Synthetic oligonucleotide
tgacgctggctgatgatgtaaccctggac

SEQ ID NO: 130777 - DNA, 28 bp, Artificial Sequence
  Description of Artificial Sequence: Synthetic oligonucleotide
gacgctggctgatgatgtaaccctggac

SEQ ID NO: 130778 - DNA, 28 bp, Artificial Sequence
  Description of Artificial Sequence: Synthetic oligonucleotide
acgctggctgatgatgtaaccctggacg

SEQ ID NO: 130779 - DNA, 27 bp, Artificial Sequence
  Description of Artificial Sequence: Synthetic oligonucleotide
cgctggctgatgatgtaaccctggacg

SEQ ID NO: 130780 - DNA, 28 bp, Artificial Sequence
  Description of Artificial Sequence: Synthetic oligonucleotide
gctggctgatgatgtaaccctggacgac

SEQ ID NO: 130781 - DNA, 28 bp, Artificial Sequence
  Description of Artificial Sequence: Synthetic oligonucleotide
ctggctgatgatgtaaccctggacgacc

SEQ ID NO: 130782 - DNA, 29 bp, Artificial Sequence
  Description of Artificial Sequence: Synthetic oligonucleotide
tggctgatgatgtaaccctggacgacctg

SEQ ID NO: 130783 - DNA, 28 bp, Artificial Sequence
  Description of Artificial Sequence: Synthetic oligonucleotide
ggctgatgatgtaaccctggacgacctg

SEQ ID NO: 130784 - DNA, 30 bp, Artificial Sequence
  Description of Artificial Sequence: Synthetic oligonucleotide
gctgatgatgtaaccctggacgacctgatc

SEQ ID NO: 130785 - DNA, 32 bp, Artificial Sequence
  Description of Artificial Sequence: Synthetic oligonucleotide
ctgatgatgtaaccctggacgacctgatcatg

SEQ ID NO: 130786 - DNA, 32 bp, Artificial Sequence
  Description of Artificial Sequence: Synthetic oligonucleotide
tgatgatgtaaccctggacgacctgatcatgg

SEQ ID NO: 130787 - DNA, 31 bp, Artificial Sequence
  Description of Artificial Sequence: Synthetic oligonucleotide
gatgatgtaaccctggacgacctgatcatgg

SEQ ID NO: 130788 - DNA, 31 bp, Artificial Sequence
  Description of Artificial Sequence: Synthetic oligonucleotide
atgatgtaaccctggacgacctgatcatggc

SEQ ID NO: 130789 - DNA, 30 bp, Artificial Sequence
  Description of Artificial Sequence: Synthetic oligonucleotide
tgatgtaaccctggacgacctgatcatggc

SEQ ID NO: 130790 - DNA, 29 bp, Artificial Sequence
  Description of Artificial Sequence: Synthetic oligonucleotide
gatgtaaccctggacgacctgatcatggc

SEQ ID NO: 130791 - DNA, 33 bp, Artificial Sequence
  Description of Artificial Sequence: Synthetic oligonucleotide
atgtaaccctggacgacctgatcatggctaaag

SEQ ID NO: 130792 - DNA, 32 bp, Artificial Sequence
  Description of Artificial Sequence: Synthetic oligonucleotide
tgtaaccctggacgacctgatcatggctaaag

SEQ ID NO: 130793 - DNA, 31 bp, Artificial Sequence
  Description of Artificial Sequence: Synthetic oligonucleotide
gtaaccctggacgacctgatcatggctaaag

SEQ ID NO: 130794 - DNA, 33 bp, Artificial Sequence
  Description of Artificial Sequence: Synthetic oligonucleotide
taaccctggacgacctgatcatggctaaagatg

SEQ ID NO: 130795 - DNA, 32 bp, Artificial Sequence
  Description of Artificial Sequence: Synthetic oligonucleotide
aaccctggacgacctgatcatggctaaagatg

SEQ ID NO: 130796 - DNA, 31 bp, Artificial Sequence
  Description of Artificial Sequence: Synthetic oligonucleotide
accctggacgacctgatcatggctaaagatg

SEQ ID NO: 130797 - DNA, 30 bp, Artificial Sequence
  Description of Artificial Sequence: Synthetic oligonucleotide
ccctggacgacctgatcatggctaaagatg

SEQ ID NO: 130798 - DNA, 31 bp, Artificial Sequence
  Description of Artificial Sequence: Synthetic oligonucleotide
cctggacgacctgatcatggctaaagatgac

SEQ ID NO: 130799 - DNA, 31 bp, Artificial Sequence
  Description of Artificial Sequence: Synthetic oligonucleotide
ctggacgacctgatcatggctaaagatgacc

SEQ ID NO: 130800 - DNA, 32 bp, Artificial Sequence
  Description of Artificial Sequence: Synthetic oligonucleotide
tggacgacctgatcatggctaaagatgacctc

SEQ ID NO: 130801 - DNA, 31 bp, Artificial Sequence
  Description of Artificial Sequence: Synthetic oligonucleotide
ggacgacctgatcatggctaaagatgacctc

SEQ ID NO: 130802 - DNA, 32 bp, Artificial Sequence
  Description of Artificial Sequence: Synthetic oligonucleotide
gacgacctgatcatggctaaagatgacctctc

SEQ ID NO: 130803 - DNA, 33 bp, Artificial Sequence
  Description of Artificial Sequence: Synthetic oligonucleotide
acgacctgatcatggctaaagatgacctctctg

SEQ ID NO: 130804 - DNA, 32 bp, Artificial Sequence
  Description of Artificial Sequence: Synthetic oligonucleotide
cgacctgatcatggctaaagatgacctctctg

SEQ ID NO: 130805 - DNA, 32 bp, Artificial Sequence
  Description of Artificial Sequence: Synthetic oligonucleotide
gacctgatcatggctaaagatgacctctctgg

SEQ ID NO: 130806 - DNA, 33 bp, Artificial Sequence
  Description of Artificial Sequence: Synthetic oligonucleotide
acctgatcatggctaaagatgacctctctggtg

SEQ ID NO: 130807 - DNA, 32 bp, Artificial Sequence
  Description of Artificial Sequence: Synthetic oligonucleotide
cctgatcatggctaaagatgacctctctggtg

SEQ ID NO: 130808 - DNA, 32 bp, Artificial Sequence
  Description of Artificial Sequence: Synthetic oligonucleotide
ctgatcatggctaaagatgacctctctggtgc

SEQ ID NO: 130809 - DNA, 33 bp, Artificial Sequence
  Description of Artificial Sequence: Synthetic oligonucleotide
tgatcatggctaaagatgacctctctggtgctg

SEQ ID NO: 130810 - DNA, 32 bp, Artificial Sequence
  Description of Artificial Sequence: Synthetic oligonucleotide
gatcatggctaaagatgacctctctggtgctg

SEQ ID NO: 130811 - DNA, 33 bp, Artificial Sequence
  Description of Artificial Sequence: Synthetic oligonucleotide
atcatggctaaagatgacctctctggtgctgac

SEQ ID NO: 130812 - DNA, 32 bp, Artificial Sequence
  Description of Artificial Sequence: Synthetic oligonucleotide
tcatggctaaagatgacctctctggtgctgac

SEQ ID NO: 130813 - DNA, 31 bp, Artificial Sequence
  Description of Artificial Sequence: Synthetic oligonucleotide
catggctaaagatgacctctctggtgctgac

SEQ ID NO: 130814 - DNA, 33 bp, Artificial Sequence
  Description of Artificial Sequence: Synthetic oligonucleotide
atggctaaagatgacctctctggtgctgacatc

SEQ ID NO: 130815 - DNA, 32 bp, Artificial Sequence
  Description of Artificial Sequence: Synthetic oligonucleotide
tggctaaagatgacctctctggtgctgacatc

SEQ ID NO: 130816 - DNA, 31 bp, Artificial Sequence
  Description of Artificial Sequence: Synthetic oligonucleotide
ggctaaagatgacctctctggtgctgacatc

SEQ ID NO: 130817 - DNA, 33 bp, Artificial Sequence
  Description of Artificial Sequence: Synthetic oligonucleotide
gctaaagatgacctctctggtgctgacatcaag

SEQ ID NO: 130818 - DNA, 33 bp, Artificial Sequence
  Description of Artificial Sequence: Synthetic oligonucleotide
ctaaagatgacctctctggtgctgacatcaagg

SEQ ID NO: 130819 - DNA, 33 bp, Artificial Sequence
  Description of Artificial Sequence: Synthetic oligonucleotide
taaagatgacctctctggtgctgacatcaaggc

SEQ ID NO: 130820 - DNA, 32 bp, Artificial Sequence
  Description of Artificial Sequence: Synthetic oligonucleotide
aaagatgacctctctggtgctgacatcaaggc

SEQ ID NO: 130821 - DNA, 31 bp, Artificial Sequence
  Description of Artificial Sequence: Synthetic oligonucleotide
aagatgacctctctggtgctgacatcaaggc

SEQ ID NO: 130822 - DNA, 30 bp, Artificial Sequence
  Description of Artificial Sequence: Synthetic oligonucleotide
agatgacctctctggtgctgacatcaaggc

SEQ ID NO: 130823 - DNA, 29 bp, Artificial Sequence
  Description of Artificial Sequence: Synthetic oligonucleotide
gatgacctctctggtgctgacatcaaggc

SEQ ID NO: 130824 - DNA, 32 bp, Artificial Sequence
  Description of Artificial Sequence: Synthetic oligonucleotide
atgacctctctggtgctgacatcaaggcaatc

SEQ ID NO: 130825 - DNA, 31 bp, Artificial Sequence
  Description of Artificial Sequence: Synthetic oligonucleotide
tgacctctctggtgctgacatcaaggcaatc

SEQ ID NO: 130826 - DNA, 30 bp, Artificial Sequence
  Description of Artificial Sequence: Synthetic oligonucleotide
gacctctctggtgctgacatcaaggcaatc

SEQ ID NO: 130827 - DNA, 31 bp, Artificial Sequence
  Description of Artificial Sequence: Synthetic oligonucleotide
acctctctggtgctgacatcaaggcaatctg

SEQ ID NO: 130828 - DNA, 30 bp, Artificial Sequence
  Description of Artificial Sequence: Synthetic oligonucleotide
cctctctggtgctgacatcaaggcaatctg

SEQ ID NO: 130829 - DNA, 32 bp, Artificial Sequence
  Description of Artificial Sequence: Synthetic oligonucleotide
ctctctggtgctgacatcaaggcaatctgtac

SEQ ID NO: 130830 - DNA, 33 bp, Artificial Sequence
  Description of Artificial Sequence: Synthetic oligonucleotide
tctctggtgctgacatcaaggcaatctgtacag

SEQ ID NO: 130831 - DNA, 32 bp, Artificial Sequence
  Description of Artificial Sequence: Synthetic oligonucleotide
ctctggtgctgacatcaaggcaatctgtacag

SEQ ID NO: 130832 - DNA, 34 bp, Artificial Sequence
  Description of Artificial Sequence: Synthetic oligonucleotide
tctggtgctgacatcaaggcaatctgtacagaag

SEQ ID NO: 130833 - DNA, 33 bp, Artificial Sequence
  Description of Artificial Sequence: Synthetic oligonucleotide
ctggtgctgacatcaaggcaatctgtacagaag

SEQ ID NO: 130834 - DNA, 33 bp, Artificial Sequence
  Description of Artificial Sequence: Synthetic oligonucleotide
tggtgctgacatcaaggcaatctgtacagaagc

SEQ ID NO: 130835 - DNA, 32 bp, Artificial Sequence
  Description of Artificial Sequence: Synthetic oligonucleotide
ggtgctgacatcaaggcaatctgtacagaagc

SEQ ID NO: 130836 - DNA, 33 bp, Artificial Sequence
  Description of Artificial Sequence: Synthetic oligonucleotide
gtgctgacatcaaggcaatctgtacagaagctg

SEQ ID NO: 130837 - DNA, 33 bp, Artificial Sequence
  Description of Artificial Sequence: Synthetic oligonucleotide
tgctgacatcaaggcaatctgtacagaagctgg

SEQ ID NO: 130838 - DNA, 32 bp, Artificial Sequence
  Description of Artificial Sequence: Synthetic oligonucleotide
gctgacatcaaggcaatctgtacagaagctgg

SEQ ID NO: 130839 - DNA, 33 bp, Artificial Sequence
  Description of Artificial Sequence: Synthetic oligonucleotide
ctgacatcaaggcaatctgtacagaagctggtc

SEQ ID NO: 130840 - DNA, 34 bp, Artificial Sequence
  Description of Artificial Sequence: Synthetic oligonucleotide
tgacatcaaggcaatctgtacagaagctggtctg

SEQ ID NO: 130841 - DNA, 33 bp, Artificial Sequence
  Description of Artificial Sequence: Synthetic oligonucleotide
gacatcaaggcaatctgtacagaagctggtctg

SEQ ID NO: 130842 - DNA, 35 bp, Artificial Sequence
  Description of Artificial Sequence: Synthetic oligonucleotide
acatcaaggcaatctgtacagaagctggtctgatg

SEQ ID NO: 130843 - DNA, 34 bp, Artificial Sequence
  Description of Artificial Sequence: Synthetic oligonucleotide
catcaaggcaatctgtacagaagctggtctgatg

SEQ ID NO: 130844 - DNA, 34 bp, Artificial Sequence
  Description of Artificial Sequence: Synthetic oligonucleotide
atcaaggcaatctgtacagaagctggtctgatgg

SEQ ID NO: 130845 - DNA, 33 bp, Artificial Sequence
  Description of Artificial Sequence: Synthetic oligonucleotide
tcaaggcaatctgtacagaagctggtctgatgg

SEQ ID NO: 130846 - DNA, 32 bp, Artificial Sequence
  Description of Artificial Sequence: Synthetic oligonucleotide
caaggcaatctgtacagaagctggtctgatgg

SEQ ID NO: 130847 - DNA, 32 bp, Artificial Sequence
  Description of Artificial Sequence: Synthetic oligonucleotide
aaggcaatctgtacagaagctggtctgatggc

SEQ ID NO: 130848 - DNA, 31 bp, Artificial Sequence
  Description of Artificial Sequence: Synthetic oligonucleotide
aggcaatctgtacagaagctggtctgatggc

SEQ ID NO: 130849 - DNA, 30 bp, Artificial Sequence
  Description of Artificial Sequence: Synthetic oligonucleotide
ggcaatctgtacagaagctggtctgatggc

SEQ ID NO: 130850 - DNA, 30 bp, Artificial Sequence
  Description of Artificial Sequence: Synthetic oligonucleotide
gcaatctgtacagaagctggtctgatggcc

SEQ ID NO: 130851 - DNA, 34 bp, Artificial Sequence
  Description of Artificial Sequence: Synthetic oligonucleotide
caatctgtacagaagctggtctgatggccttaag

SEQ ID NO: 130852 - DNA, 35 bp, Artificial Sequence
  Description of Artificial Sequence: Synthetic oligonucleotide
aatctgtacagaagctggtctgatggccttaagag

SEQ ID NO: 130853 - DNA, 34 bp, Artificial Sequence
  Description of Artificial Sequence: Synthetic oligonucleotide
atctgtacagaagctggtctgatggccttaagag

SEQ ID NO: 130854 - DNA, 33 bp, Artificial Sequence
  Description of Artificial Sequence: Synthetic oligonucleotide
tctgtacagaagctggtctgatggccttaagag

SEQ ID NO: 130855 - DNA, 32 bp, Artificial Sequence
  Description of Artificial Sequence: Synthetic oligonucleotide
ctgtacagaagctggtctgatggccttaagag

SEQ ID NO: 130856 - DNA, 34 bp, Artificial Sequence
  Description of Artificial Sequence: Synthetic oligonucleotide
tgtacagaagctggtctgatggccttaagagaac

SEQ ID NO: 130857 - DNA, 33 bp, Artificial Sequence
  Description of Artificial Sequence: Synthetic oligonucleotide
gtacagaagctggtctgatggccttaagagaac

SEQ ID NO: 130858 - DNA, 33 bp, Artificial Sequence
  Description of Artificial Sequence: Synthetic oligonucleotide
tacagaagctggtctgatggccttaagagaacg

SEQ ID NO: 130859 - DNA, 32 bp, Artificial Sequence
  Description of Artificial Sequence: Synthetic oligonucleotide
acagaagctggtctgatggccttaagagaacg

SEQ ID NO: 130860 - DNA, 31 bp, Artificial Sequence
  Description of Artificial Sequence: Synthetic oligonucleotide
cagaagctggtctgatggccttaagagaacg

SEQ ID NO: 130861 - DNA, 33 bp, Artificial Sequence
  Description of Artificial Sequence: Synthetic oligonucleotide
agaagctggtctgatggccttaagagaacgtag

SEQ ID NO: 130862 - DNA, 32 bp, Artificial Sequence
  Description of Artificial Sequence: Synthetic oligonucleotide
gaagctggtctgatggccttaagagaacgtag

SEQ ID NO: 130863 - DNA, 35 bp, Artificial Sequence
  Description of Artificial Sequence: Synthetic oligonucleotide
aagctggtctgatggccttaagagaacgtagaatg

SEQ ID NO: 130864 - DNA, 34 bp, Artificial Sequence
  Description of Artificial Sequence: Synthetic oligonucleotide
agctggtctgatggccttaagagaacgtagaatg

SEQ ID NO: 130865 - DNA, 33 bp, Artificial Sequence
  Description of Artificial Sequence: Synthetic oligonucleotide
gctggtctgatggccttaagagaacgtagaatg

SEQ ID NO: 130866 - DNA, 36 bp, Artificial Sequence
  Description of Artificial Sequence: Synthetic oligonucleotide
ctggtctgatggccttaagagaacgtagaatgaaag

SEQ ID NO: 130867 - DNA, 39 bp, Artificial Sequence
  Description of Artificial Sequence: Synthetic oligonucleotide
tggtctgatggccttaagagaacgtagaatgaaagtaac

SEQ ID NO: 130868 - DNA, 38 bp, Artificial Sequence
  Description of Artificial Sequence: Synthetic oligonucleotide
ggtctgatggccttaagagaacgtagaatgaaagtaac

SEQ ID NO: 130869 - DNA, 42 bp, Artificial Sequence
  Description of Artificial Sequence: Synthetic oligonucleotide
gtctgatggccttaagagaacgtagaatgaaagtaacaaatg

SEQ ID NO: 130870 - DNA, 44 bp, Artificial Sequence
  Description of Artificial Sequence: Synthetic oligonucleotide
tctgatggccttaagagaacgtagaatgaaagtaacaaatgaag

SEQ ID NO: 130871 - DNA, 43 bp, Artificial Sequence
  Description of Artificial Sequence: Synthetic oligonucleotide
ctgatggccttaagagaacgtagaatgaaagtaacaaatgaag

SEQ ID NO: 130872 - DNA, 44 bp, Artificial Sequence
  Description of Artificial Sequence: Synthetic oligonucleotide
tgatggccttaagagaacgtagaatgaaagtaacaaatgaagac

SEQ ID NO: 130873 - DNA, 43 bp, Artificial Sequence
  Description of Artificial Sequence: Synthetic oligonucleotide
gatggccttaagagaacgtagaatgaaagtaacaaatgaagac

SEQ ID NO: 130874 - DNA, 45 bp, Artificial Sequence
  Description of Artificial Sequence: Synthetic oligonucleotide
atggccttaagagaacgtagaatgaaagtaacaaatgaagacttc

SEQ ID NO: 130875 - DNA, 44 bp, Artificial Sequence
  Description of Artificial Sequence: Synthetic oligonucleotide
tggccttaagagaacgtagaatgaaagtaacaaatgaagacttc

SEQ ID NO: 130876 - DNA, 43 bp, Artificial Sequence
  Description of Artificial Sequence: Synthetic oligonucleotide
ggccttaagagaacgtagaatgaaagtaacaaatgaagacttc

SEQ ID NO: 130877 - DNA, 50 bp, Artificial Sequence
  Description of Artificial Sequence: Synthetic oligonucleotide
gccttaagagaacgtagaatgaaagtaacaaatgaagacttcaaaaaatc

SEQ ID NO: 130878 - DNA, 54 bp, Artificial Sequence
  Description of Artificial Sequence: Synthetic oligonucleotide
ccttaagagaacgtagaatgaaagtaacaaatgaagacttcaaaaaatctaaag

SEQ ID NO: 130879 - DNA, 59 bp, Artificial Sequence
  Description of Artificial Sequence: Synthetic oligonucleotide
cttaagagaacgtagaatgaaagtaacaaatgaagacttcaaaaaatctaaagaaaatg

SEQ ID NO: 130880 - DNA, 60 bp, Artificial Sequence
  Description of Artificial Sequence: Synthetic oligonucleotide
ttaagagaacgtagaatgaaagtaacaaatgaagacttcaaaaaatctaaagaaaatgtt

SEQ ID NO: 130881 - DNA, 60 bp, Artificial Sequence
  Description of Artificial Sequence: Synthetic oligonucleotide
taagagaacgtagaatgaaagtaacaaatgaagacttcaaaaaatctaaagaaaatgttc

SEQ ID NO: 130882 - DNA, 59 bp, Artificial Sequence
  Description of Artificial Sequence: Synthetic oligonucleotide
aagagaacgtagaatgaaagtaacaaatgaagacttcaaaaaatctaaagaaaatgttc

SEQ ID NO: 130883 - DNA, 58 bp, Artificial Sequence
  Description of Artificial Sequence: Synthetic oligonucleotide
agagaacgtagaatgaaagtaacaaatgaagacttcaaaaaatctaaagaaaatgttc

SEQ ID NO: 130884 - DNA, 57 bp, Artificial Sequence
  Description of Artificial Sequence: Synthetic oligonucleotide
gagaacgtagaatgaaagtaacaaatgaagacttcaaaaaatctaaagaaaatgttc

SEQ ID NO: 130885 - DNA, 60 bp, Artificial Sequence
  Description of Artificial Sequence: Synthetic oligonucleotide
agaacgtagaatgaaagtaacaaatgaagacttcaaaaaatctaaagaaaatgttcttta

SEQ ID NO: 130886 - DNA, 60 bp, Artificial Sequence
  Description of Artificial Sequence: Synthetic oligonucleotide
gaacgtagaatgaaagtaacaaatgaagacttcaaaaaatctaaagaaaatgttctttat

SEQ ID NO: 130887 - DNA, 60 bp, Artificial Sequence
  Description of Artificial Sequence: Synthetic oligonucleotide
aacgtagaatgaaagtaacaaatgaagacttcaaaaaatctaaagaaaatgttctttata

SEQ ID NO: 130888 - DNA, 60 bp, Artificial Sequence
  Description of Artificial Sequence: Synthetic oligonucleotide
acgtagaatgaaagtaacaaatgaagacttcaaaaaatctaaagaaaatgttctttataa

SEQ ID NO: 130889 - DNA, 60 bp, Artificial Sequence
  Description of Artificial Sequence: Synthetic oligonucleotide
cgtagaatgaaagtaacaaatgaagacttcaaaaaatctaaagaaaatgttctttataag

SEQ ID NO: 130890 - DNA, 60 bp, Artificial Sequence
  Description of Artificial Sequence: Synthetic oligonucleotide
gtagaatgaaagtaacaaatgaagacttcaaaaaatctaaagaaaatgttctttataaga

SEQ ID NO: 130891 - DNA, 60 bp, Artificial Sequence
  Description of Artificial Sequence: Synthetic oligonucleotide
tagaatgaaagtaacaaatgaagacttcaaaaaatctaaagaaaatgttctttataagaa

SEQ ID NO: 130892 - DNA, 60 bp, Artificial Sequence
  Description of Artificial Sequence: Synthetic oligonucleotide
agaatgaaagtaacaaatgaagacttcaaaaaatctaaagaaaatgttctttataagaaa

SEQ ID NO: 130893 - DNA, 60 bp, Artificial Sequence
  Description of Artificial Sequence: Synthetic oligonucleotide
gaatgaaagtaacaaatgaagacttcaaaaaatctaaagaaaatgttctttataagaaac

SEQ ID NO: 130894 - DNA, 60 bp, Artificial Sequence
  Description of Artificial Sequence: Synthetic oligonucleotide
aatgaaagtaacaaatgaagacttcaaaaaatctaaagaaaatgttctttataagaaaca

SEQ ID NO: 130895 - DNA, 60 bp, Artificial Sequence
  Description of Artificial Sequence: Synthetic oligonucleotide
atgaaagtaacaaatgaagacttcaaaaaatctaaagaaaatgttctttataagaaacag

SEQ ID NO: 130896 - DNA, 60 bp, Artificial Sequence
  Description of Artificial Sequence: Synthetic oligonucleotide
tgaaagtaacaaatgaagacttcaaaaaatctaaagaaaatgttctttataagaaacagg

SEQ ID NO: 130897 - DNA, 60 bp, Artificial Sequence
  Description of Artificial Sequence: Synthetic oligonucleotide
gaaagtaacaaatgaagacttcaaaaaatctaaagaaaatgttctttataagaaacagga

SEQ ID NO: 130898 - DNA, 60 bp, Artificial Sequence
  Description of Artificial Sequence: Synthetic oligonucleotide
aaagtaacaaatgaagacttcaaaaaatctaaagaaaatgttctttataagaaacaggaa

SEQ ID NO: 130899 - DNA, 60 bp, Artificial Sequence
  Description of Artificial Sequence: Synthetic oligonucleotide
aagtaacaaatgaagacttcaaaaaatctaaagaaaatgttctttataagaaacaggaag

SEQ ID NO: 130900 - DNA, 60 bp, Artificial Sequence
  Description of Artificial Sequence: Synthetic oligonucleotide
agtaacaaatgaagacttcaaaaaatctaaagaaaatgttctttataagaaacaggaagg

SEQ ID NO: 130901 - DNA, 59 bp, Artificial Sequence
  Description of Artificial Sequence: Synthetic oligonucleotide
gtaacaaatgaagacttcaaaaaatctaaagaaaatgttctttataagaaacaggaagg

SEQ ID NO: 130902 - DNA, 59 bp, Artificial Sequence
  Description of Artificial Sequence: Synthetic oligonucleotide
taacaaatgaagacttcaaaaaatctaaagaaaatgttctttataagaaacaggaaggc

SEQ ID NO: 130903 - DNA, 58 bp, Artificial Sequence
  Description of Artificial Sequence: Synthetic oligonucleotide
aacaaatgaagacttcaaaaaatctaaagaaaatgttctttataagaaacaggaaggc

SEQ ID NO: 130904 - DNA, 57 bp, Artificial Sequence
  Description of Artificial Sequence: Synthetic oligonucleotide
acaaatgaagacttcaaaaaatctaaagaaaatgttctttataagaaacaggaaggc

SEQ ID NO: 130905 - DNA, 56 bp, Artificial Sequence
  Description of Artificial Sequence: Synthetic oligonucleotide
caaatgaagacttcaaaaaatctaaagaaaatgttctttataagaaacaggaaggc

SEQ ID NO: 130906 - DNA, 57 bp, Artificial Sequence
  Description of Artificial Sequence: Synthetic oligonucleotide
aaatgaagacttcaaaaaatctaaagaaaatgttctttataagaaacaggaaggcac

SEQ ID NO: 130907 - DNA, 56 bp, Artificial Sequence
  Description of Artificial Sequence: Synthetic oligonucleotide
aatgaagacttcaaaaaatctaaagaaaatgttctttataagaaacaggaaggcac

SEQ ID NO: 130908 - DNA, 55 bp, Artificial Sequence
  Description of Artificial Sequence: Synthetic oligonucleotide
atgaagacttcaaaaaatctaaagaaaatgttctttataagaaacaggaaggcac

SEQ ID NO: 130909 - DNA, 54 bp, Artificial Sequence
  Description of Artificial Sequence: Synthetic oligonucleotide
tgaagacttcaaaaaatctaaagaaaatgttctttataagaaacaggaaggcac

SEQ ID NO: 130910 - DNA, 53 bp, Artificial Sequence
  Description of Artificial Sequence: Synthetic oligonucleotide
gaagacttcaaaaaatctaaagaaaatgttctttataagaaacaggaaggcac

SEQ ID NO: 130911 - DNA, 53 bp, Artificial Sequence
  Description of Artificial Sequence: Synthetic oligonucleotide
aagacttcaaaaaatctaaagaaaatgttctttataagaaacaggaaggcacc

SEQ ID NO: 130912 - DNA, 52 bp, Artificial Sequence
  Description of Artificial Sequence: Synthetic oligonucleotide
agacttcaaaaaatctaaagaaaatgttctttataagaaacaggaaggcacc

SEQ ID NO: 130913 - DNA, 51 bp, Artificial Sequence
  Description of Artificial Sequence: Synthetic oligonucleotide
gacttcaaaaaatctaaagaaaatgttctttataagaaacaggaaggcacc

SEQ ID NO: 130914 - DNA, 51 bp, Artificial Sequence
  Description of Artificial Sequence: Synthetic oligonucleotide
acttcaaaaaatctaaagaaaatgttctttataagaaacaggaaggcaccc

SEQ ID NO: 130915 - DNA, 50 bp, Artificial Sequence
  Description of Artificial Sequence: Synthetic oligonucleotide
cttcaaaaaatctaaagaaaatgttctttataagaaacaggaaggcaccc

SEQ ID NO: 130916 - DNA, 50 bp, Artificial Sequence
  Description of Artificial Sequence: Synthetic oligonucleotide
ttcaaaaaatctaaagaaaatgttctttataagaaacaggaaggcacccc

SEQ ID NO: 130917 - DNA, 49 bp, Artificial Sequence
  Description of Artificial Sequence: Synthetic oligonucleotide
tcaaaaaatctaaagaaaatgttctttataagaaacaggaaggcacccc

SEQ ID NO: 130918 - DNA, 48 bp, Artificial Sequence
  Description of Artificial Sequence: Synthetic oligonucleotide
caaaaaatctaaagaaaatgttctttataagaaacaggaaggcacccc

SEQ ID NO: 130919 - DNA, 49 bp, Artificial Sequence
  Description of Artificial Sequence: Synthetic oligonucleotide
aaaaaatctaaagaaaatgttctttataagaaacaggaaggcacccctg

SEQ ID NO: 130920 - DNA, 48 bp, Artificial Sequence
  Description of Artificial Sequence: Synthetic oligonucleotide
aaaaatctaaagaaaatgttctttataagaaacaggaaggcacccctg

SEQ ID NO: 130921 - DNA, 47 bp, Artificial Sequence
  Description of Artificial Sequence: Synthetic oligonucleotide
aaaatctaaagaaaatgttctttataagaaacaggaaggcacccctg

SEQ ID NO: 130922 - DNA, 46 bp, Artificial Sequence
  Description of Artificial Sequence: Synthetic oligonucleotide
aaatctaaagaaaatgttctttataagaaacaggaaggcacccctg

SEQ ID NO: 130923 - DNA, 45 bp, Artificial Sequence
  Description of Artificial Sequence: Synthetic oligonucleotide
aatctaaagaaaatgttctttataagaaacaggaaggcacccctg

SEQ ID NO: 130924 - DNA, 44 bp, Artificial Sequence
  Description of Artificial Sequence: Synthetic oligonucleotide
atctaaagaaaatgttctttataagaaacaggaaggcacccctg

SEQ ID NO: 130925 - DNA, 43 bp, Artificial Sequence
  Description of Artificial Sequence: Synthetic oligonucleotide
tctaaagaaaatgttctttataagaaacaggaaggcacccctg

SEQ ID NO: 130926 - DNA, 42 bp, Artificial Sequence
  Description of Artificial Sequence: Synthetic oligonucleotide
ctaaagaaaatgttctttataagaaacaggaaggcacccctg

SEQ ID NO: 130927 - DNA, 43 bp, Artificial Sequence
  Description of Artificial Sequence: Synthetic oligonucleotide
taaagaaaatgttctttataagaaacaggaaggcacccctgag

SEQ ID NO: 130928 - DNA, 42 bp, Artificial Sequence
  Description of Artificial Sequence: Synthetic oligonucleotide
aaagaaaatgttctttataagaaacaggaaggcacccctgag

SEQ ID NO: 130929 - DNA, 41 bp, Artificial Sequence
  Description of Artificial Sequence: Synthetic oligonucleotide
aagaaaatgttctttataagaaacaggaaggcacccctgag

SEQ ID NO: 130930 - DNA, 40 bp, Artificial Sequence
  Description of Artificial Sequence: Synthetic oligonucleotide
agaaaatgttctttataagaaacaggaaggcacccctgag

SEQ ID NO: 130931 - DNA, 39 bp, Artificial Sequence
  Description of Artificial Sequence: Synthetic oligonucleotide
gaaaatgttctttataagaaacaggaaggcacccctgag

SEQ ID NO: 130932 - DNA, 39 bp, Artificial Sequence
  Description of Artificial Sequence: Synthetic oligonucleotide
aaaatgttctttataagaaacaggaaggcacccctgagg

SEQ ID NO: 130933 - DNA, 38 bp, Artificial Sequence
  Description of Artificial Sequence: Synthetic oligonucleotide
aaatgttctttataagaaacaggaaggcacccctgagg

SEQ ID NO: 130934 - DNA, 37 bp, Artificial Sequence
  Description of Artificial Sequence: Synthetic oligonucleotide
aatgttctttataagaaacaggaaggcacccctgagg

SEQ ID NO: 130935 - DNA, 36 bp, Artificial Sequence
  Description of Artificial Sequence: Synthetic oligonucleotide
atgttctttataagaaacaggaaggcacccctgagg

SEQ ID NO: 130936 - DNA, 35 bp, Artificial Sequence
  Description of Artificial Sequence: Synthetic oligonucleotide
tgttctttataagaaacaggaaggcacccctgagg

SEQ ID NO: 130937 - DNA, 34 bp, Artificial Sequence
  Description of Artificial Sequence: Synthetic oligonucleotide
gttctttataagaaacaggaaggcacccctgagg

SEQ ID NO: 130938 - DNA, 34 bp, Artificial Sequence
  Description of Artificial Sequence: Synthetic oligonucleotide
ttctttataagaaacaggaaggcacccctgaggg

SEQ ID NO: 130939 - DNA, 33 bp, Artificial Sequence
  Description of Artificial Sequence: Synthetic oligonucleotide
tctttataagaaacaggaaggcacccctgaggg

SEQ ID NO: 130940 - DNA, 32 bp, Artificial Sequence
  Description of Artificial Sequence: Synthetic oligonucleotide
ctttataagaaacaggaaggcacccctgaggg

SEQ ID NO: 130941 - DNA, 32 bp, Artificial Sequence
  Description of Artificial Sequence: Synthetic oligonucleotide
tttataagaaacaggaaggcacccctgagggg

SEQ ID NO: 130942 - DNA, 31 bp, Artificial Sequence
  Description of Artificial Sequence: Synthetic oligonucleotide
ttataagaaacaggaaggcacccctgagggg

SEQ ID NO: 130943 - DNA, 30 bp, Artificial Sequence
  Description of Artificial Sequence: Synthetic oligonucleotide
tataagaaacaggaaggcacccctgagggg

SEQ ID NO: 130944 - DNA, 29 bp, Artificial Sequence
  Description of Artificial Sequence: Synthetic oligonucleotide
ataagaaacaggaaggcacccctgagggg

SEQ ID NO: 130945 - DNA, 28 bp, Artificial Sequence
  Description of Artificial Sequence: Synthetic oligonucleotide
taagaaacaggaaggcacccctgagggg

SEQ ID NO: 130946 - DNA, 27 bp, Artificial Sequence
  Description of Artificial Sequence: Synthetic oligonucleotide
aagaaacaggaaggcacccctgagggg

SEQ ID NO: 130947 - DNA, 26 bp, Artificial Sequence
  Description of Artificial Sequence: Synthetic oligonucleotide
agaaacaggaaggcacccctgagggg

SEQ ID NO: 130948 - DNA, 25 bp, Artificial Sequence
  Description of Artificial Sequence: Synthetic oligonucleotide
gaaacaggaaggcacccctgagggg

SEQ ID NO: 130949 - DNA, 26 bp, Artificial Sequence
  Description of Artificial Sequence: Synthetic oligonucleotide
aaacaggaaggcacccctgaggggct

SEQ ID NO: 130950 - DNA, 25 bp, Artificial Sequence
  Description of Artificial Sequence: Synthetic oligonucleotide
aacaggaaggcacccctgaggggct

SEQ ID NO: 130951 - DNA, 24 bp, Artificial Sequence
  Description of Artificial Sequence: Synthetic oligonucleotide
acaggaaggcacccctgaggggct

SEQ ID NO: 130952 - DNA, 23 bp, Artificial Sequence
  Description of Artificial Sequence: Synthetic oligonucleotide
caggaaggcacccctgaggggct

SEQ ID NO: 130953 - DNA, 26 bp, Artificial Sequence
  Description of Artificial Sequence: Synthetic oligonucleotide
aggaaggcacccctgaggggctgtat

SEQ ID NO: 130954 - DNA, 25 bp, Artificial Sequence
  Description of Artificial Sequence: Synthetic oligonucleotide
ggaaggcacccctgaggggctgtat

SEQ ID NO: 130955 - DNA, 26 bp, Artificial Sequence
  Description of Artificial Sequence: Synthetic oligonucleotide
gaaggcacccctgaggggctgtatct

SEQ ID NO: 130956 - DNA, 27 bp, Artificial Sequence
  Description of Artificial Sequence: Synthetic oligonucleotide
aaggcacccctgaggggctgtatctct

SEQ ID NO: 130957 - DNA, 27 bp, Artificial Sequence
  Description of Artificial Sequence: Synthetic oligonucleotide
aggcacccctgaggggctgtatctcta

SEQ ID NO: 130958 - DNA, 27 bp, Artificial Sequence
  Description of Artificial Sequence: Synthetic oligonucleotide
ggcacccctgaggggctgtatctctaa

SEQ ID NO: 130959 - DNA, 27 bp, Artificial Sequence
  Description of Artificial Sequence: Synthetic oligonucleotide
atgccggattacctcggtgccgatcag

SEQ ID NO: 130960 - DNA, 26 bp, Artificial Sequence
  Description of Artificial Sequence: Synthetic oligonucleotide
tgccggattacctcggtgccgatcag

SEQ ID NO: 130961 - DNA, 25 bp, Artificial Sequence
  Description of Artificial Sequence: Synthetic oligonucleotide
gccggattacctcggtgccgatcag

SEQ ID NO: 130962 - DNA, 25 bp, Artificial Sequence
  Description of Artificial Sequence: Synthetic oligonucleotide
ccggattacctcggtgccgatcagc

SEQ ID NO: 130963 - DNA, 25 bp, Artificial Sequence
  Description of Artificial Sequence: Synthetic oligonucleotide
cggattacctcggtgccgatcagcg

SEQ ID NO: 130964 - DNA, 27 bp, Artificial Sequence
  Description of Artificial Sequence: Synthetic oligonucleotide
ggattacctcggtgccgatcagcggaa

SEQ ID NO: 130965 - DNA, 27 bp, Artificial Sequence
  Description of Artificial Sequence: Synthetic oligonucleotide
gattacctcggtgccgatcagcggaag

SEQ ID NO: 130966 - DNA, 28 bp, Artificial Sequence
  Description of Artificial Sequence: Synthetic oligonucleotide
attacctcggtgccgatcagcggaagac

SEQ ID NO: 130967 - DNA, 27 bp, Artificial Sequence
  Description of Artificial Sequence: Synthetic oligonucleotide
ttacctcggtgccgatcagcggaagac

SEQ ID NO: 130968 - DNA, 26 bp, Artificial Sequence
  Description of Artificial Sequence: Synthetic oligonucleotide
tacctcggtgccgatcagcggaagac

SEQ ID NO: 130969 - DNA, 25 bp, Artificial Sequence
  Description of Artificial Sequence: Synthetic oligonucleotide
acctcggtgccgatcagcggaagac

SEQ ID NO: 130970 - DNA, 24 bp, Artificial Sequence
  Description of Artificial Sequence: Synthetic oligonucleotide
cctcggtgccgatcagcggaagac

SEQ ID NO: 130971 - DNA, 27 bp, Artificial Sequence
  Description of Artificial Sequence: Synthetic oligonucleotide
ctcggtgccgatcagcggaagaccaaa

SEQ ID NO: 130972 - DNA, 27 bp, Artificial Sequence
  Description of Artificial Sequence: Synthetic oligonucleotide
tcggtgccgatcagcggaagaccaaag

SEQ ID NO: 130973 - DNA, 27 bp, Artificial Sequence
  Description of Artificial Sequence: Synthetic oligonucleotide
cggtgccgatcagcggaagaccaaaga

SEQ ID NO: 130974 - DNA, 27 bp, Artificial Sequence
  Description of Artificial Sequence: Synthetic oligonucleotide
ggtgccgatcagcggaagaccaaagag

SEQ ID NO: 130975 - DNA, 27 bp, Artificial Sequence
  Description of Artificial Sequence: Synthetic oligonucleotide
gtgccgatcagcggaagaccaaagagg

SEQ ID NO: 130976 - DNA, 29 bp, Artificial Sequence
  Description of Artificial Sequence: Synthetic oligonucleotide
tgccgatcagcggaagaccaaagaggatg

SEQ ID NO: 130977 - DNA, 28 bp, Artificial Sequence
  Description of Artificial Sequence: Synthetic oligonucleotide
gccgatcagcggaagaccaaagaggatg

SEQ ID NO: 130978 - DNA, 29 bp, Artificial Sequence
  Description of Artificial Sequence: Synthetic oligonucleotide
ccgatcagcggaagaccaaagaggatgag

SEQ ID NO: 130979 - DNA, 31 bp, Artificial Sequence
  Description of Artificial Sequence: Synthetic oligonucleotide
cgatcagcggaagaccaaagaggatgagaag

SEQ ID NO: 130980 - DNA, 31 bp, Artificial Sequence
  Description of Artificial Sequence: Synthetic oligonucleotide
gatcagcggaagaccaaagaggatgagaagg

SEQ ID NO: 130981 - DNA, 32 bp, Artificial Sequence
  Description of Artificial Sequence: Synthetic oligonucleotide
atcagcggaagaccaaagaggatgagaaggac

SEQ ID NO: 130982 - DNA, 31 bp, Artificial Sequence
  Description of Artificial Sequence: Synthetic oligonucleotide
tcagcggaagaccaaagaggatgagaaggac

SEQ ID NO: 130983 - DNA, 30 bp, Artificial Sequence
  Description of Artificial Sequence: Synthetic oligonucleotide
cagcggaagaccaaagaggatgagaaggac

SEQ ID NO: 130984 - DNA, 30 bp, Artificial Sequence
  Description of Artificial Sequence: Synthetic oligonucleotide
agcggaagaccaaagaggatgagaaggacg

SEQ ID NO: 130985 - DNA, 29 bp, Artificial Sequence
  Description of Artificial Sequence: Synthetic oligonucleotide
gcggaagaccaaagaggatgagaaggacg

SEQ ID NO: 130986 - DNA, 30 bp, Artificial Sequence
  Description of Artificial Sequence: Synthetic oligonucleotide
cggaagaccaaagaggatgagaaggacgac

SEQ ID NO: 130987 - DNA, 32 bp, Artificial Sequence
  Description of Artificial Sequence: Synthetic oligonucleotide
ggaagaccaaagaggatgagaaggacgacaag

SEQ ID NO: 130988 - DNA, 32 bp, Artificial Sequence
  Description of Artificial Sequence: Synthetic oligonucleotide
gaagaccaaagaggatgagaaggacgacaagc

SEQ ID NO: 130989 - DNA, 32 bp, Artificial Sequence
  Description of Artificial Sequence: Synthetic oligonucleotide
aagaccaaagaggatgagaaggacgacaagcc

SEQ ID NO: 130990 - DNA, 31 bp, Artificial Sequence
  Description of Artificial Sequence: Synthetic oligonucleotide
agaccaaagaggatgagaaggacgacaagcc

SEQ ID NO: 130991 - DNA, 30 bp, Artificial Sequence
  Description of Artificial Sequence: Synthetic oligonucleotide
gaccaaagaggatgagaaggacgacaagcc

SEQ ID NO: 130992 - DNA, 30 bp, Artificial Sequence
  Description of Artificial Sequence: Synthetic oligonucleotide
accaaagaggatgagaaggacgacaagccc

SEQ ID NO: 130993 - DNA, 29 bp, Artificial Sequence
  Description of Artificial Sequence: Synthetic oligonucleotide
ccaaagaggatgagaaggacgacaagccc

SEQ ID NO: 130994 - DNA, 31 bp, Artificial Sequence
  Description of Artificial Sequence: Synthetic oligonucleotide
caaagaggatgagaaggacgacaagcccatc

SEQ ID NO: 130995 - DNA, 31 bp, Artificial Sequence
  Description of Artificial Sequence: Synthetic oligonucleotide
aaagaggatgagaaggacgacaagcccatcc

SEQ ID NO: 130996 - DNA, 30 bp, Artificial Sequence
  Description of Artificial Sequence: Synthetic oligonucleotide
aagaggatgagaaggacgacaagcccatcc

SEQ ID NO: 130997 - DNA, 29 bp, Artificial Sequence
  Description of Artificial Sequence: Synthetic oligonucleotide
agaggatgagaaggacgacaagcccatcc

SEQ ID NO: 130998 - DNA, 28 bp, Artificial Sequence
  Description of Artificial Sequence: Synthetic oligonucleotide
gaggatgagaaggacgacaagcccatcc

SEQ ID NO: 130999 - DNA, 28 bp, Artificial Sequence
  Description of Artificial Sequence: Synthetic oligonucleotide
aggatgagaaggacgacaagcccatccg

SEQ ID NO: 131000 - DNA, 27 bp, Artificial Sequence
  Description of Artificial Sequence: Synthetic oligonucleotide
ggatgagaaggacgacaagcccatccg

SEQ ID NO: 131001 - DNA, 28 bp, Artificial Sequence
  Description of Artificial Sequence: Synthetic oligonucleotide
gatgagaaggacgacaagcccatccgag

SEQ ID NO: 131002 - DNA, 28 bp, Artificial Sequence
  Description of Artificial Sequence: Synthetic oligonucleotide
atgagaaggacgacaagcccatccgagc

SEQ ID NO: 131003 - DNA, 27 bp, Artificial Sequence
  Description of Artificial Sequence: Synthetic oligonucleotide
tgagaaggacgacaagcccatccgagc

SEQ ID NO: 131004 - DNA, 27 bp, Artificial Sequence
  Description of Artificial Sequence: Synthetic oligonucleotide
gagaaggacgacaagcccatccgagct

SEQ ID NO: 131005 - DNA, 27 bp, Artificial Sequence
  Description of Artificial Sequence: Synthetic oligonucleotide
agaaggacgacaagcccatccgagctc

SEQ ID NO: 131006 - DNA, 27 bp, Artificial Sequence
  Description of Artificial Sequence: Synthetic oligonucleotide
gaaggacgacaagcccatccgagctct

SEQ ID NO: 131007 - DNA, 27 bp, Artificial Sequence
  Description of Artificial Sequence: Synthetic oligonucleotide
aaggacgacaagcccatccgagctctg

SEQ ID NO: 131008 - DNA, 26 bp, Artificial Sequence
  Description of Artificial Sequence: Synthetic oligonucleotide
aggacgacaagcccatccgagctctg

SEQ ID NO: 131009 - DNA, 25 bp, Artificial Sequence
  Description of Artificial Sequence: Synthetic oligonucleotide
ggacgacaagcccatccgagctctg

SEQ ID NO: 131010 - DNA, 27 bp, Artificial Sequence
  Description of Artificial Sequence: Synthetic oligonucleotide
gacgacaagcccatccgagctctggat

SEQ ID NO: 131011 - DNA, 27 bp, Artificial Sequence
  Description of Artificial Sequence: Synthetic oligonucleotide
acgacaagcccatccgagctctggatg

SEQ ID NO: 131012 - DNA, 27 bp, Artificial Sequence
  Description of Artificial Sequence: Synthetic oligonucleotide
cgacaagcccatccgagctctggatga

SEQ ID NO: 131013 - DNA, 27 bp, Artificial Sequence
  Description of Artificial Sequence: Synthetic oligonucleotide
gacaagcccatccgagctctggatgag

SEQ ID NO: 131014 - DNA, 27 bp, Artificial Sequence
  Description of Artificial Sequence: Synthetic oligonucleotide
acaagcccatccgagctctggatgagg

SEQ ID NO: 131015 - DNA, 26 bp, Artificial Sequence
  Description of Artificial Sequence: Synthetic oligonucleotide
caagcccatccgagctctggatgagg

SEQ ID NO: 131016 - DNA, 26 bp, Artificial Sequence
  Description of Artificial Sequence: Synthetic oligonucleotide
aagcccatccgagctctggatgaggg

SEQ ID NO: 131017 - DNA, 25 bp, Artificial Sequence
  Description of Artificial Sequence: Synthetic oligonucleotide
agcccatccgagctctggatgaggg

SEQ ID NO: 131018 - DNA, 24 bp, Artificial Sequence
  Description of Artificial Sequence: Synthetic oligonucleotide
gcccatccgagctctggatgaggg

SEQ ID NO: 131019 - DNA, 24 bp, Artificial Sequence
  Description of Artificial Sequence: Synthetic oligonucleotide
cccatccgagctctggatgagggg

SEQ ID NO: 131020 - DNA, 27 bp, Artificial Sequence
  Description of Artificial Sequence: Synthetic oligonucleotide
ccatccgagctctggatgagggggata

SEQ ID NO: 131021 - DNA, 29 bp, Artificial Sequence
  Description of Artificial Sequence: Synthetic oligonucleotide
catccgagctctggatgagggggatattg

SEQ ID NO: 131022 - DNA, 29 bp, Artificial Sequence
  Description of Artificial Sequence: Synthetic oligonucleotide
atccgagctctggatgagggggatattgc

SEQ ID NO: 131023 - DNA, 28 bp, Artificial Sequence
  Description of Artificial Sequence: Synthetic oligonucleotide
tccgagctctggatgagggggatattgc

SEQ ID NO: 131024 - DNA, 27 bp, Artificial Sequence
  Description of Artificial Sequence: Synthetic oligonucleotide
ccgagctctggatgagggggatattgc

SEQ ID NO: 131025 - DNA, 27 bp, Artificial Sequence
  Description of Artificial Sequence: Synthetic oligonucleotide
cgagctctggatgagggggatattgcc

SEQ ID NO: 131026 - DNA, 29 bp, Artificial Sequence
  Description of Artificial Sequence: Synthetic oligonucleotide
gagctctggatgagggggatattgccttg

SEQ ID NO: 131027 - DNA, 31 bp, Artificial Sequence
  Description of Artificial Sequence: Synthetic oligonucleotide
agctctggatgagggggatattgccttgttg

SEQ ID NO: 131028 - DNA, 30 bp, Artificial Sequence
  Description of Artificial Sequence: Synthetic oligonucleotide
gctctggatgagggggatattgccttgttg

SEQ ID NO: 131029 - DNA, 34 bp, Artificial Sequence
  Description of Artificial Sequence: Synthetic oligonucleotide
ctctggatgagggggatattgccttgttgaaaac

SEQ ID NO: 131030 - DNA, 38 bp, Artificial Sequence
  Description of Artificial Sequence: Synthetic oligonucleotide
tctggatgagggggatattgccttgttgaaaacttatg

SEQ ID NO: 131031 - DNA, 37 bp, Artificial Sequence
  Description of Artificial Sequence: Synthetic oligonucleotide
ctggatgagggggatattgccttgttgaaaacttatg

SEQ ID NO: 131032 - DNA, 37 bp, Artificial Sequence
  Description of Artificial Sequence: Synthetic oligonucleotide
tggatgagggggatattgccttgttgaaaacttatgg

SEQ ID NO: 131033 - DNA, 36 bp, Artificial Sequence
  Description of Artificial Sequence: Synthetic oligonucleotide
ggatgagggggatattgccttgttgaaaacttatgg

SEQ ID NO: 131034 - DNA, 37 bp, Artificial Sequence
  Description of Artificial Sequence: Synthetic oligonucleotide
gatgagggggatattgccttgttgaaaacttatggtc

SEQ ID NO: 131035 - DNA, 38 bp, Artificial Sequence
  Description of Artificial Sequence: Synthetic oligonucleotide
atgagggggatattgccttgttgaaaacttatggtcag

SEQ ID NO: 131036 - DNA, 37 bp, Artificial Sequence
  Description of Artificial Sequence: Synthetic oligonucleotide
tgagggggatattgccttgttgaaaacttatggtcag

SEQ ID NO: 131037 - DNA, 36 bp, Artificial Sequence
  Description of Artificial Sequence: Synthetic oligonucleotide
gagggggatattgccttgttgaaaacttatggtcag

SEQ ID NO: 131038 - DNA, 37 bp, Artificial Sequence
  Description of Artificial Sequence: Synthetic oligonucleotide
agggggatattgccttgttgaaaacttatggtcagag

SEQ ID NO: 131039 - DNA, 36 bp, Artificial Sequence
  Description of Artificial Sequence: Synthetic oligonucleotide
gggggatattgccttgttgaaaacttatggtcagag

SEQ ID NO: 131040 - DNA, 36 bp, Artificial Sequence
  Description of Artificial Sequence: Synthetic oligonucleotide
ggggatattgccttgttgaaaacttatggtcagagc

SEQ ID NO: 131041 - DNA, 37 bp, Artificial Sequence
  Description of Artificial Sequence: Synthetic oligonucleotide
gggatattgccttgttgaaaacttatggtcagagcac

SEQ ID NO: 131042 - DNA, 40 bp, Artificial Sequence
  Description of Artificial Sequence: Synthetic oligonucleotide
ggatattgccttgttgaaaacttatggtcagagcacttac

SEQ ID NO: 131043 - DNA, 41 bp, Artificial Sequence
  Description of Artificial Sequence: Synthetic oligonucleotide
gatattgccttgttgaaaacttatggtcagagcacttactc

SEQ ID NO: 131044 - DNA, 43 bp, Artificial Sequence
  Description of Artificial Sequence: Synthetic oligonucleotide
atattgccttgttgaaaacttatggtcagagcacttactctag

SEQ ID NO: 131045 - DNA, 42 bp, Artificial Sequence
  Description of Artificial Sequence: Synthetic oligonucleotide
tattgccttgttgaaaacttatggtcagagcacttactctag

SEQ ID NO: 131046 - DNA, 41 bp, Artificial Sequence
  Description of Artificial Sequence: Synthetic oligonucleotide
attgccttgttgaaaacttatggtcagagcacttactctag

SEQ ID NO: 131047 - DNA, 40 bp, Artificial Sequence
  Description of Artificial Sequence: Synthetic oligonucleotide
ttgccttgttgaaaacttatggtcagagcacttactctag

SEQ ID NO: 131048 - DNA, 39 bp, Artificial Sequence
  Description of Artificial Sequence: Synthetic oligonucleotide
tgccttgttgaaaacttatggtcagagcacttactctag

SEQ ID NO: 131049 - DNA, 38 bp, Artificial Sequence
  Description of Artificial Sequence: Synthetic oligonucleotide
gccttgttgaaaacttatggtcagagcacttactctag

SEQ ID NO: 131050 - DNA, 38 bp, Artificial Sequence
  Description of Artificial Sequence: Synthetic oligonucleotide
ccttgttgaaaacttatggtcagagcacttactctagg

SEQ ID NO: 131051 - DNA, 38 bp, Artificial Sequence
  Description of Artificial Sequence: Synthetic oligonucleotide
cttgttgaaaacttatggtcagagcacttactctaggc

SEQ ID NO: 131052 - DNA, 39 bp, Artificial Sequence
  Description of Artificial Sequence: Synthetic oligonucleotide
ttgttgaaaacttatggtcagagcacttactctaggcag

SEQ ID NO: 131053 - DNA, 38 bp, Artificial Sequence
  Description of Artificial Sequence: Synthetic oligonucleotide
tgttgaaaacttatggtcagagcacttactctaggcag

SEQ ID NO: 131054 - DNA, 37 bp, Artificial Sequence
  Description of Artificial Sequence: Synthetic oligonucleotide
gttgaaaacttatggtcagagcacttactctaggcag

SEQ ID NO: 131055 - DNA, 39 bp, Artificial Sequence
  Description of Artificial Sequence: Synthetic oligonucleotide
ttgaaaacttatggtcagagcacttactctaggcagatc

SEQ ID NO: 131056 - DNA, 38 bp, Artificial Sequence
  Description of Artificial Sequence: Synthetic oligonucleotide
tgaaaacttatggtcagagcacttactctaggcagatc

SEQ ID NO: 131057 - DNA, 37 bp, Artificial Sequence
  Description of Artificial Sequence: Synthetic oligonucleotide
gaaaacttatggtcagagcacttactctaggcagatc

SEQ ID NO: 131058 - DNA, 39 bp, Artificial Sequence
  Description of Artificial Sequence: Synthetic oligonucleotide
aaaacttatggtcagagcacttactctaggcagatcaag

SEQ ID NO: 131059 - DNA, 38 bp, Artificial Sequence
  Description of Artificial Sequence: Synthetic oligonucleotide
aaacttatggtcagagcacttactctaggcagatcaag

SEQ ID NO: 131060 - DNA, 37 bp, Artificial Sequence
  Description of Artificial Sequence: Synthetic oligonucleotide
aacttatggtcagagcacttactctaggcagatcaag

SEQ ID NO: 131061 - DNA, 36 bp, Artificial Sequence
  Description of Artificial Sequence: Synthetic oligonucleotide
acttatggtcagagcacttactctaggcagatcaag

SEQ ID NO: 131062 - DNA, 35 bp, Artificial Sequence
  Description of Artificial Sequence: Synthetic oligonucleotide
cttatggtcagagcacttactctaggcagatcaag

SEQ ID NO: 131063 - DNA, 35 bp, Artificial Sequence
  Description of Artificial Sequence: Synthetic oligonucleotide
ttatggtcagagcacttactctaggcagatcaagc

SEQ ID NO: 131064 - DNA, 34 bp, Artificial Sequence
  Description of Artificial Sequence: Synthetic oligonucleotide
tatggtcagagcacttactctaggcagatcaagc

SEQ ID NO: 131065 - DNA, 33 bp, Artificial Sequence
  Description of Artificial Sequence: Synthetic oligonucleotide
atggtcagagcacttactctaggcagatcaagc

SEQ ID NO: 131066 - DNA, 32 bp, Artificial Sequence
  Description of Artificial Sequence: Synthetic oligonucleotide
tggtcagagcacttactctaggcagatcaagc

SEQ ID NO: 131067 - DNA, 31 bp, Artificial Sequence
  Description of Artificial Sequence: Synthetic oligonucleotide
ggtcagagcacttactctaggcagatcaagc

SEQ ID NO: 131068 - DNA, 33 bp, Artificial Sequence
  Description of Artificial Sequence: Synthetic oligonucleotide
gtcagagcacttactctaggcagatcaagcaag

SEQ ID NO: 131069 - DNA, 35 bp, Artificial Sequence
  Description of Artificial Sequence: Synthetic oligonucleotide
tcagagcacttactctaggcagatcaagcaagttg

SEQ ID NO: 131070 - DNA, 34 bp, Artificial Sequence
  Description of Artificial Sequence: Synthetic oligonucleotide
cagagcacttactctaggcagatcaagcaagttg

SEQ ID NO: 131071 - DNA, 36 bp, Artificial Sequence
  Description of Artificial Sequence: Synthetic oligonucleotide
agagcacttactctaggcagatcaagcaagttgaag

SEQ ID NO: 131072 - DNA, 35 bp, Artificial Sequence
  Description of Artificial Sequence: Synthetic oligonucleotide
gagcacttactctaggcagatcaagcaagttgaag

SEQ ID NO: 131073 - DNA, 37 bp, Artificial Sequence
  Description of Artificial Sequence: Synthetic oligonucleotide
agcacttactctaggcagatcaagcaagttgaagatg

SEQ ID NO: 131074 - DNA, 36 bp, Artificial Sequence
  Description of Artificial Sequence: Synthetic oligonucleotide
gcacttactctaggcagatcaagcaagttgaagatg

SEQ ID NO: 131075 - DNA, 37 bp, Artificial Sequence
  Description of Artificial Sequence: Synthetic oligonucleotide
cacttactctaggcagatcaagcaagttgaagatgac

SEQ ID NO: 131076 - DNA, 40 bp, Artificial Sequence
  Description of Artificial Sequence: Synthetic oligonucleotide
acttactctaggcagatcaagcaagttgaagatgacattc

SEQ ID NO: 131077 - DNA, 39 bp, Artificial Sequence
  Description of Artificial Sequence: Synthetic oligonucleotide
cttactctaggcagatcaagcaagttgaagatgacattc

SEQ ID NO: 131078 - DNA, 40 bp, Artificial Sequence
  Description of Artificial Sequence: Synthetic oligonucleotide
ttactctaggcagatcaagcaagttgaagatgacattcag

SEQ ID NO: 131079 - DNA, 39 bp, Artificial Sequence
  Description of Artificial Sequence: Synthetic oligonucleotide
tactctaggcagatcaagcaagttgaagatgacattcag

SEQ ID NO: 131080 - DNA, 38 bp, Artificial Sequence
  Description of Artificial Sequence: Synthetic oligonucleotide
actctaggcagatcaagcaagttgaagatgacattcag

SEQ ID NO: 131081 - DNA, 37 bp, Artificial Sequence
  Description of Artificial Sequence: Synthetic oligonucleotide
ctctaggcagatcaagcaagttgaagatgacattcag

SEQ ID NO: 131082 - DNA, 37 bp, Artificial Sequence
  Description of Artificial Sequence: Synthetic oligonucleotide
tctaggcagatcaagcaagttgaagatgacattcagc

SEQ ID NO: 131083 - DNA, 36 bp, Artificial Sequence
  Description of Artificial Sequence: Synthetic oligonucleotide
ctaggcagatcaagcaagttgaagatgacattcagc

SEQ ID NO: 131084 - DNA, 38 bp, Artificial Sequence
  Description of Artificial Sequence: Synthetic oligonucleotide
taggcagatcaagcaagttgaagatgacattcagcaac

SEQ ID NO: 131085 - DNA, 37 bp, Artificial Sequence
  Description of Artificial Sequence: Synthetic oligonucleotide
aggcagatcaagcaagttgaagatgacattcagcaac

SEQ ID NO: 131086 - DNA, 36 bp, Artificial Sequence
  Description of Artificial Sequence: Synthetic oligonucleotide
ggcagatcaagcaagttgaagatgacattcagcaac

SEQ ID NO: 131087 - DNA, 38 bp, Artificial Sequence
  Description of Artificial Sequence: Synthetic oligonucleotide
gcagatcaagcaagttgaagatgacattcagcaacttc

SEQ ID NO: 131088 - DNA, 39 bp, Artificial Sequence
  Description of Artificial Sequence: Synthetic oligonucleotide
cagatcaagcaagttgaagatgacattcagcaacttctc

SEQ ID NO: 131089 - DNA, 41 bp, Artificial Sequence
  Description of Artificial Sequence: Synthetic oligonucleotide
agatcaagcaagttgaagatgacattcagcaacttctcaag

SEQ ID NO: 131090 - DNA, 40 bp, Artificial Sequence
  Description of Artificial Sequence: Synthetic oligonucleotide
gatcaagcaagttgaagatgacattcagcaacttctcaag

SEQ ID NO: 131091 - DNA, 49 bp, Artificial Sequence
  Description of Artificial Sequence: Synthetic oligonucleotide
atcaagcaagttgaagatgacattcagcaacttctcaagaaaattaatg

SEQ ID NO: 131092 - DNA, 48 bp, Artificial Sequence
  Description of Artificial Sequence: Synthetic oligonucleotide
tcaagcaagttgaagatgacattcagcaacttctcaagaaaattaatg

SEQ ID NO: 131093 - DNA, 47 bp, Artificial Sequence
  Description of Artificial Sequence: Synthetic oligonucleotide
caagcaagttgaagatgacattcagcaacttctcaagaaaattaatg

SEQ ID NO: 131094 - DNA, 48 bp, Artificial Sequence
  Description of Artificial Sequence: Synthetic oligonucleotide
aagcaagttgaagatgacattcagcaacttctcaagaaaattaatgag

SEQ ID NO: 131095 - DNA, 47 bp, Artificial Sequence
  Description of Artificial Sequence: Synthetic oligonucleotide
agcaagttgaagatgacattcagcaacttctcaagaaaattaatgag

SEQ ID NO: 131096 - DNA, 46 bp, Artificial Sequence
  Description of Artificial Sequence: Synthetic oligonucleotide
gcaagttgaagatgacattcagcaacttctcaagaaaattaatgag

SEQ ID NO: 131097 - DNA, 46 bp, Artificial Sequence
  Description of Artificial Sequence: Synthetic oligonucleotide
caagttgaagatgacattcagcaacttctcaagaaaattaatgagc

SEQ ID NO: 131098 - DNA, 47 bp, Artificial Sequence
  Description of Artificial Sequence: Synthetic oligonucleotide
aagttgaagatgacattcagcaacttctcaagaaaattaatgagctc

SEQ ID NO: 131099 - DNA, 46 bp, Artificial Sequence
  Description of Artificial Sequence: Synthetic oligonucleotide
agttgaagatgacattcagcaacttctcaagaaaattaatgagctc

SEQ ID NO: 131100 - DNA, 45 bp, Artificial Sequence
  Description of Artificial Sequence: Synthetic oligonucleotide
gttgaagatgacattcagcaacttctcaagaaaattaatgagctc

SEQ ID NO: 131101 - DNA, 46 bp, Artificial Sequence
  Description of Artificial Sequence: Synthetic oligonucleotide
ttgaagatgacattcagcaacttctcaagaaaattaatgagctcac

SEQ ID NO: 131102 - DNA, 45 bp, Artificial Sequence
  Description of Artificial Sequence: Synthetic oligonucleotide
tgaagatgacattcagcaacttctcaagaaaattaatgagctcac

SEQ ID NO: 131103 - DNA, 44 bp, Artificial Sequence
  Description of Artificial Sequence: Synthetic oligonucleotide
gaagatgacattcagcaacttctcaagaaaattaatgagctcac

SEQ ID NO: 131104 - DNA, 45 bp, Artificial Sequence
  Description of Artificial Sequence: Synthetic oligonucleotide
aagatgacattcagcaacttctcaagaaaattaatgagctcactg

SEQ ID NO: 131105 - DNA, 44 bp, Artificial Sequence
  Description of Artificial Sequence: Synthetic oligonucleotide
agatgacattcagcaacttctcaagaaaattaatgagctcactg

SEQ ID NO: 131106 - DNA, 43 bp, Artificial Sequence
  Description of Artificial Sequence: Synthetic oligonucleotide
gatgacattcagcaacttctcaagaaaattaatgagctcactg

SEQ ID NO: 131107 - DNA, 43 bp, Artificial Sequence
  Description of Artificial Sequence: Synthetic oligonucleotide
atgacattcagcaacttctcaagaaaattaatgagctcactgg

SEQ ID NO: 131108 - DNA, 42 bp, Artificial Sequence
  Description of Artificial Sequence: Synthetic oligonucleotide
tgacattcagcaacttctcaagaaaattaatgagctcactgg

SEQ ID NO: 131109 - DNA, 41 bp, Artificial Sequence
  Description of Artificial Sequence: Synthetic oligonucleotide
gacattcagcaacttctcaagaaaattaatgagctcactgg

SEQ ID NO: 131110 - DNA, 48 bp, Artificial Sequence
  Description of Artificial Sequence: Synthetic oligonucleotide
acattcagcaacttctcaagaaaattaatgagctcactggtattaaag

SEQ ID NO: 131111 - DNA, 47 bp, Artificial Sequence
  Description of Artificial Sequence: Synthetic oligonucleotide
cattcagcaacttctcaagaaaattaatgagctcactggtattaaag

SEQ ID NO: 131112 - DNA, 50 bp, Artificial Sequence
  Description of Artificial Sequence: Synthetic oligonucleotide
attcagcaacttctcaagaaaattaatgagctcactggtattaaagaatc

SEQ ID NO: 131113 - DNA, 49 bp, Artificial Sequence
  Description of Artificial Sequence: Synthetic oligonucleotide
ttcagcaacttctcaagaaaattaatgagctcactggtattaaagaatc

SEQ ID NO: 131114 - DNA, 48 bp, Artificial Sequence
  Description of Artificial Sequence: Synthetic oligonucleotide
tcagcaacttctcaagaaaattaatgagctcactggtattaaagaatc

SEQ ID NO: 131115 - DNA, 47 bp, Artificial Sequence
  Description of Artificial Sequence: Synthetic oligonucleotide
cagcaacttctcaagaaaattaatgagctcactggtattaaagaatc

SEQ ID NO: 131116 - DNA, 48 bp, Artificial Sequence
  Description of Artificial Sequence: Synthetic oligonucleotide
agcaacttctcaagaaaattaatgagctcactggtattaaagaatctg

SEQ ID NO: 131117 - DNA, 47 bp, Artificial Sequence
  Description of Artificial Sequence: Synthetic oligonucleotide
gcaacttctcaagaaaattaatgagctcactggtattaaagaatctg

SEQ ID NO: 131118 - DNA, 48 bp, Artificial Sequence
  Description of Artificial Sequence: Synthetic oligonucleotide
caacttctcaagaaaattaatgagctcactggtattaaagaatctgac

SEQ ID NO: 131119 - DNA, 49 bp, Artificial Sequence
  Description of Artificial Sequence: Synthetic oligonucleotide
aacttctcaagaaaattaatgagctcactggtattaaagaatctgacac

SEQ ID NO: 131120 - DNA, 48 bp, Artificial Sequence
  Description of Artificial Sequence: Synthetic oligonucleotide
acttctcaagaaaattaatgagctcactggtattaaagaatctgacac

SEQ ID NO: 131121 - DNA, 47 bp, Artificial Sequence
  Description of Artificial Sequence: Synthetic oligonucleotide
cttctcaagaaaattaatgagctcactggtattaaagaatctgacac

SEQ ID NO: 131122 - DNA, 48 bp, Artificial Sequence
  Description of Artificial Sequence: Synthetic oligonucleotide
ttctcaagaaaattaatgagctcactggtattaaagaatctgacactg

SEQ ID NO: 131123 - DNA, 47 bp, Artificial Sequence
  Description of Artificial Sequence: Synthetic oligonucleotide
tctcaagaaaattaatgagctcactggtattaaagaatctgacactg

SEQ ID NO: 131124 - DNA, 46 bp, Artificial Sequence
  Description of Artificial Sequence: Synthetic oligonucleotide
ctcaagaaaattaatgagctcactggtattaaagaatctgacactg

SEQ ID NO: 131125 - DNA, 46 bp, Artificial Sequence
  Description of Artificial Sequence: Synthetic oligonucleotide
tcaagaaaattaatgagctcactggtattaaagaatctgacactgg

SEQ ID NO: 131126 - DNA, 45 bp, Artificial Sequence
  Description of Artificial Sequence: Synthetic oligonucleotide
caagaaaattaatgagctcactggtattaaagaatctgacactgg

SEQ ID NO: 131127 - DNA, 45 bp, Artificial Sequence
  Description of Artificial Sequence: Synthetic oligonucleotide
aagaaaattaatgagctcactggtattaaagaatctgacactggc

SEQ ID NO: 131128 - DNA, 44 bp, Artificial Sequence
  Description of Artificial Sequence: Synthetic oligonucleotide
agaaaattaatgagctcactggtattaaagaatctgacactggc

SEQ ID NO: 131129 - DNA, 43 bp, Artificial Sequence
  Description of Artificial Sequence: Synthetic oligonucleotide
gaaaattaatgagctcactggtattaaagaatctgacactggc

SEQ ID NO: 131130 - DNA, 43 bp, Artificial Sequence
  Description of Artificial Sequence: Synthetic oligonucleotide
aaaattaatgagctcactggtattaaagaatctgacactggcc

SEQ ID NO: 131131 - DNA, 42 bp, Artificial Sequence
  Description of Artificial Sequence: Synthetic oligonucleotide
aaattaatgagctcactggtattaaagaatctgacactggcc

SEQ ID NO: 131132 - DNA, 41 bp, Artificial Sequence
  Description of Artificial Sequence: Synthetic oligonucleotide
aattaatgagctcactggtattaaagaatctgacactggcc

SEQ ID NO: 131133 - DNA, 40 bp, Artificial Sequence
  Description of Artificial Sequence: Synthetic oligonucleotide
attaatgagctcactggtattaaagaatctgacactggcc

SEQ ID NO: 131134 - DNA, 39 bp, Artificial Sequence
  Description of Artificial Sequence: Synthetic oligonucleotide
ttaatgagctcactggtattaaagaatctgacactggcc

SEQ ID NO: 131135 - DNA, 38 bp, Artificial Sequence
  Description of Artificial Sequence: Synthetic oligonucleotide
taatgagctcactggtattaaagaatctgacactggcc

SEQ ID NO: 131136 - DNA, 37 bp, Artificial Sequence
  Description of Artificial Sequence: Synthetic oligonucleotide
aatgagctcactggtattaaagaatctgacactggcc

SEQ ID NO: 131137 - DNA, 36 bp, Artificial Sequence
  Description of Artificial Sequence: Synthetic oligonucleotide
atgagctcactggtattaaagaatctgacactggcc

SEQ ID NO: 131138 - DNA, 35 bp, Artificial Sequence
  Description of Artificial Sequence: Synthetic oligonucleotide
tgagctcactggtattaaagaatctgacactggcc

SEQ ID NO: 131139 - DNA, 34 bp, Artificial Sequence
  Description of Artificial Sequence: Synthetic oligonucleotide
gagctcactggtattaaagaatctgacactggcc

SEQ ID NO: 131140 - DNA, 35 bp, Artificial Sequence
  Description of Artificial Sequence: Synthetic oligonucleotide
agctcactggtattaaagaatctgacactggcctg

SEQ ID NO: 131141 - DNA, 34 bp, Artificial Sequence
  Description of Artificial Sequence: Synthetic oligonucleotide
gctcactggtattaaagaatctgacactggcctg

SEQ ID NO: 131142 - DNA, 34 bp, Artificial Sequence
  Description of Artificial Sequence: Synthetic oligonucleotide
ctcactggtattaaagaatctgacactggcctgg

SEQ ID NO: 131143 - DNA, 34 bp, Artificial Sequence
  Description of Artificial Sequence: Synthetic oligonucleotide
tcactggtattaaagaatctgacactggcctggc

SEQ ID NO: 131144 - DNA, 33 bp, Artificial Sequence
  Description of Artificial Sequence: Synthetic oligonucleotide
cactggtattaaagaatctgacactggcctggc

SEQ ID NO: 131145 - DNA, 33 bp, Artificial Sequence
  Description of Artificial Sequence: Synthetic oligonucleotide
actggtattaaagaatctgacactggcctggcc

SEQ ID NO: 131146 - DNA, 32 bp, Artificial Sequence
  Description of Artificial Sequence: Synthetic oligonucleotide
ctggtattaaagaatctgacactggcctggcc

SEQ ID NO: 131147 - DNA, 32 bp, Artificial Sequence
  Description of Artificial Sequence: Synthetic oligonucleotide
tggtattaaagaatctgacactggcctggccc

SEQ ID NO: 131148 - DNA, 31 bp, Artificial Sequence
  Description of Artificial Sequence: Synthetic oligonucleotide
ggtattaaagaatctgacactggcctggccc

SEQ ID NO: 131149 - DNA, 31 bp, Artificial Sequence
  Description of Artificial Sequence: Synthetic oligonucleotide
gtattaaagaatctgacactggcctggcccc

SEQ ID NO: 131150 - DNA, 32 bp, Artificial Sequence
  Description of Artificial Sequence: Synthetic oligonucleotide
tattaaagaatctgacactggcctggccccac

SEQ ID NO: 131151 - DNA, 31 bp, Artificial Sequence
  Description of Artificial Sequence: Synthetic oligonucleotide
attaaagaatctgacactggcctggccccac

SEQ ID NO: 131152 - DNA, 30 bp, Artificial Sequence
  Description of Artificial Sequence: Synthetic oligonucleotide
ttaaagaatctgacactggcctggccccac

SEQ ID NO: 131153 - DNA, 29 bp, Artificial Sequence
  Description of Artificial Sequence: Synthetic oligonucleotide
taaagaatctgacactggcctggccccac

SEQ ID NO: 131154 - DNA, 28 bp, Artificial Sequence
  Description of Artificial Sequence: Synthetic oligonucleotide
aaagaatctgacactggcctggccccac

SEQ ID NO: 131155 - DNA, 27 bp, Artificial Sequence
  Description of Artificial Sequence: Synthetic oligonucleotide
aagaatctgacactggcctggccccac

SEQ ID NO: 131156 - DNA, 26 bp, Artificial Sequence
  Description of Artificial Sequence: Synthetic oligonucleotide
agaatctgacactggcctggccccac

SEQ ID NO: 131157 - DNA, 25 bp, Artificial Sequence
  Description of Artificial Sequence: Synthetic oligonucleotide
gaatctgacactggcctggccccac

SEQ ID NO: 131158 - DNA, 26 bp, Artificial Sequence
  Description of Artificial Sequence: Synthetic oligonucleotide
aatctgacactggcctggccccacca

SEQ ID NO: 131159 - DNA, 25 bp, Artificial Sequence
  Description of Artificial Sequence: Synthetic oligonucleotide
atctgacactggcctggccccacca

SEQ ID NO: 131160 - DNA, 24 bp, Artificial Sequence
  Description of Artificial Sequence: Synthetic oligonucleotide
tctgacactggcctggccccacca

SEQ ID NO: 131161 - DNA, 23 bp, Artificial Sequence
  Description of Artificial Sequence: Synthetic oligonucleotide
ctgacactggcctggccccacca

SEQ ID NO: 131162 - DNA, 23 bp, Artificial Sequence
  Description of Artificial Sequence: Synthetic oligonucleotide
tgacactggcctggccccaccag

SEQ ID NO: 131163 - DNA, 22 bp, Artificial Sequence
  Description of Artificial Sequence: Synthetic oligonucleotide
gacactggcctggccccaccag

SEQ ID NO: 131164 - DNA, 23 bp, Artificial Sequence
  Description of Artificial Sequence: Synthetic oligonucleotide
acactggcctggccccaccagca

SEQ ID NO: 131165 - DNA, 22 bp, Artificial Sequence
  Description of Artificial Sequence: Synthetic oligonucleotide
cactggcctggccccaccagca

SEQ ID NO: 131166 - DNA, 23 bp, Artificial Sequence
  Description of Artificial Sequence: Synthetic oligonucleotide
actggcctggccccaccagcact

SEQ ID NO: 131167 - DNA, 22 bp, Artificial Sequence
  Description of Artificial Sequence: Synthetic oligonucleotide
ctggcctggccccaccagcact

SEQ ID NO: 131168 - DNA, 23 bp, Artificial Sequence
  Description of Artificial Sequence: Synthetic oligonucleotide
tggcctggccccaccagcactct

SEQ ID NO: 131169 - DNA, 22 bp, Artificial Sequence
  Description of Artificial Sequence: Synthetic oligonucleotide
ggcctggccccaccagcactct

SEQ ID NO: 131170 - DNA, 22 bp, Artificial Sequence
  Description of Artificial Sequence: Synthetic oligonucleotide
gcctggccccaccagcactctg

SEQ ID NO: 131171 - DNA, 22 bp, Artificial Sequence
  Description of Artificial Sequence: Synthetic oligonucleotide
cctggccccaccagcactctgg

SEQ ID NO: 131172 - DNA, 26 bp, Artificial Sequence
  Description of Artificial Sequence: Synthetic oligonucleotide
ctggccccaccagcactctgggattt

SEQ ID NO: 131173 - DNA, 26 bp, Artificial Sequence
  Description of Artificial Sequence: Synthetic oligonucleotide
tggccccaccagcactctgggatttg

SEQ ID NO: 131174 - DNA, 25 bp, Artificial Sequence
  Description of Artificial Sequence: Synthetic oligonucleotide
ggccccaccagcactctgggatttg

SEQ ID NO: 131175 - DNA, 25 bp, Artificial Sequence
  Description of Artificial Sequence: Synthetic oligonucleotide
gccccaccagcactctgggatttgg

SEQ ID NO: 131176 - DNA, 26 bp, Artificial Sequence
  Description of Artificial Sequence: Synthetic oligonucleotide
ccccaccagcactctgggatttggct

SEQ ID NO: 131177 - DNA, 26 bp, Artificial Sequence
  Description of Artificial Sequence: Synthetic oligonucleotide
cccaccagcactctgggatttggctg

SEQ ID NO: 131178 - DNA, 27 bp, Artificial Sequence
  Description of Artificial Sequence: Synthetic oligonucleotide
ccaccagcactctgggatttggctgca

SEQ ID NO: 131179 - DNA, 27 bp, Artificial Sequence
  Description of Artificial Sequence: Synthetic oligonucleotide
caccagcactctgggatttggctgcag

SEQ ID NO: 131180 - DNA, 31 bp, Artificial Sequence
  Description of Artificial Sequence: Synthetic oligonucleotide
accagcactctgggatttggctgcagataag

SEQ ID NO: 131181 - DNA, 30 bp, Artificial Sequence
  Description of Artificial Sequence: Synthetic oligonucleotide
ccagcactctgggatttggctgcagataag

SEQ ID NO: 131182 - DNA, 30 bp, Artificial Sequence
  Description of Artificial Sequence: Synthetic oligonucleotide
cagcactctgggatttggctgcagataagc

SEQ ID NO: 131183 - DNA, 31 bp, Artificial Sequence
  Description of Artificial Sequence: Synthetic oligonucleotide
agcactctgggatttggctgcagataagcag

SEQ ID NO: 131184 - DNA, 30 bp, Artificial Sequence
  Description of Artificial Sequence: Synthetic oligonucleotide
gcactctgggatttggctgcagataagcag

SEQ ID NO: 131185 - DNA, 31 bp, Artificial Sequence
  Description of Artificial Sequence: Synthetic oligonucleotide
cactctgggatttggctgcagataagcagac

SEQ ID NO: 131186 - DNA, 32 bp, Artificial Sequence
  Description of Artificial Sequence: Synthetic oligonucleotide
actctgggatttggctgcagataagcagacac

SEQ ID NO: 131187 - DNA, 31 bp, Artificial Sequence
  Description of Artificial Sequence: Synthetic oligonucleotide
ctctgggatttggctgcagataagcagacac

SEQ ID NO: 131188 - DNA, 32 bp, Artificial Sequence
  Description of Artificial Sequence: Synthetic oligonucleotide
tctgggatttggctgcagataagcagacactc

SEQ ID NO: 131189 - DNA, 31 bp, Artificial Sequence
  Description of Artificial Sequence: Synthetic oligonucleotide
ctgggatttggctgcagataagcagacactc

SEQ ID NO: 131190 - DNA, 31 bp, Artificial Sequence
  Description of Artificial Sequence: Synthetic oligonucleotide
tgggatttggctgcagataagcagacactcc

SEQ ID NO: 131191 - DNA, 30 bp, Artificial Sequence
  Description of Artificial Sequence: Synthetic oligonucleotide
gggatttggctgcagataagcagacactcc

SEQ ID NO: 131192 - DNA, 31 bp, Artificial Sequence
  Description of Artificial Sequence: Synthetic oligonucleotide
ggatttggctgcagataagcagacactccag

SEQ ID NO: 131193 - DNA, 32 bp, Artificial Sequence
  Description of Artificial Sequence: Synthetic oligonucleotide
gatttggctgcagataagcagacactccagag

SEQ ID NO: 131194 - DNA, 33 bp, Artificial Sequence
  Description of Artificial Sequence: Synthetic oligonucleotide
atttggctgcagataagcagacactccagagtg

SEQ ID NO: 131195 - DNA, 32 bp, Artificial Sequence
  Description of Artificial Sequence: Synthetic oligonucleotide
tttggctgcagataagcagacactccagagtg

SEQ ID NO: 131196 - DNA, 31 bp, Artificial Sequence
  Description of Artificial Sequence: Synthetic oligonucleotide
ttggctgcagataagcagacactccagagtg

SEQ ID NO: 131197 - DNA, 30 bp, Artificial Sequence
  Description of Artificial Sequence: Synthetic oligonucleotide
tggctgcagataagcagacactccagagtg

SEQ ID NO: 131198 - DNA, 29 bp, Artificial Sequence
  Description of Artificial Sequence: Synthetic oligonucleotide
ggctgcagataagcagacactccagagtg

SEQ ID NO: 131199 - DNA, 31 bp, Artificial Sequence
  Description of Artificial Sequence: Synthetic oligonucleotide
gctgcagataagcagacactccagagtgaac

SEQ ID NO: 131200 - DNA, 32 bp, Artificial Sequence
  Description of Artificial Sequence: Synthetic oligonucleotide
ctgcagataagcagacactccagagtgaacag

SEQ ID NO: 131201 - DNA, 32 bp, Artificial Sequence
  Description of Artificial Sequence: Synthetic oligonucleotide
tgcagataagcagacactccagagtgaacagc

SEQ ID NO: 131202 - DNA, 31 bp, Artificial Sequence
  Description of Artificial Sequence: Synthetic oligonucleotide
gcagataagcagacactccagagtgaacagc

SEQ ID NO: 131203 - DNA, 31 bp, Artificial Sequence
  Description of Artificial Sequence: Synthetic oligonucleotide
cagataagcagacactccagagtgaacagcc

SEQ ID NO: 131204 - DNA, 35 bp, Artificial Sequence
  Description of Artificial Sequence: Synthetic oligonucleotide
agataagcagacactccagagtgaacagcctttac

SEQ ID NO: 131205 - DNA, 34 bp, Artificial Sequence
  Description of Artificial Sequence: Synthetic oligonucleotide
gataagcagacactccagagtgaacagcctttac

SEQ ID NO: 131206 - DNA, 35 bp, Artificial Sequence
  Description of Artificial Sequence: Synthetic oligonucleotide
ataagcagacactccagagtgaacagcctttacag

SEQ ID NO: 131207 - DNA, 34 bp, Artificial Sequence
  Description of Artificial Sequence: Synthetic oligonucleotide
taagcagacactccagagtgaacagcctttacag

SEQ ID NO: 131208 - DNA, 33 bp, Artificial Sequence
  Description of Artificial Sequence: Synthetic oligonucleotide
aagcagacactccagagtgaacagcctttacag

SEQ ID NO: 131209 - DNA, 32 bp, Artificial Sequence
  Description of Artificial Sequence: Synthetic oligonucleotide
agcagacactccagagtgaacagcctttacag

SEQ ID NO: 131210 - DNA, 31 bp, Artificial Sequence
  Description of Artificial Sequence: Synthetic oligonucleotide
gcagacactccagagtgaacagcctttacag

SEQ ID NO: 131211 - DNA, 31 bp, Artificial Sequence
  Description of Artificial Sequence: Synthetic oligonucleotide
cagacactccagagtgaacagcctttacagg

SEQ ID NO: 131212 - DNA, 33 bp, Artificial Sequence
  Description of Artificial Sequence: Synthetic oligonucleotide
agacactccagagtgaacagcctttacaggttg

SEQ ID NO: 131213 - DNA, 32 bp, Artificial Sequence
  Description of Artificial Sequence: Synthetic oligonucleotide
gacactccagagtgaacagcctttacaggttg

SEQ ID NO: 131214 - DNA, 32 bp, Artificial Sequence
  Description of Artificial Sequence: Synthetic oligonucleotide
acactccagagtgaacagcctttacaggttgc

SEQ ID NO: 131215 - DNA, 31 bp, Artificial Sequence
  Description of Artificial Sequence: Synthetic oligonucleotide
cactccagagtgaacagcctttacaggttgc

SEQ ID NO: 131216 - DNA, 31 bp, Artificial Sequence
  Description of Artificial Sequence: Synthetic oligonucleotide
actccagagtgaacagcctttacaggttgcc

SEQ ID NO: 131217 - DNA, 30 bp, Artificial Sequence
  Description of Artificial Sequence: Synthetic oligonucleotide
ctccagagtgaacagcctttacaggttgcc

SEQ ID NO: 131218 - DNA, 31 bp, Artificial Sequence
  Description of Artificial Sequence: Synthetic oligonucleotide
tccagagtgaacagcctttacaggttgccag

SEQ ID NO: 131219 - DNA, 30 bp, Artificial Sequence
  Description of Artificial Sequence: Synthetic oligonucleotide
ccagagtgaacagcctttacaggttgccag

SEQ ID NO: 131220 - DNA, 30 bp, Artificial Sequence
  Description of Artificial Sequence: Synthetic oligonucleotide
cagagtgaacagcctttacaggttgccagg

SEQ ID NO: 131221 - DNA, 31 bp, Artificial Sequence
  Description of Artificial Sequence: Synthetic oligonucleotide
agagtgaacagcctttacaggttgccaggtg

SEQ ID NO: 131222 - DNA, 30 bp, Artificial Sequence
  Description of Artificial Sequence: Synthetic oligonucleotide
gagtgaacagcctttacaggttgccaggtg

SEQ ID NO: 131223 - DNA, 32 bp, Artificial Sequence
  Description of Artificial Sequence: Synthetic oligonucleotide
agtgaacagcctttacaggttgccaggtgtac

SEQ ID NO: 131224 - DNA, 31 bp, Artificial Sequence
  Description of Artificial Sequence: Synthetic oligonucleotide
gtgaacagcctttacaggttgccaggtgtac

SEQ ID NO: 131225 - DNA, 34 bp, Artificial Sequence
  Description of Artificial Sequence: Synthetic oligonucleotide
tgaacagcctttacaggttgccaggtgtacaaag

SEQ ID NO: 131226 - DNA, 33 bp, Artificial Sequence
  Description of Artificial Sequence: Synthetic oligonucleotide
gaacagcctttacaggttgccaggtgtacaaag

SEQ ID NO: 131227 - DNA, 38 bp, Artificial Sequence
  Description of Artificial Sequence: Synthetic oligonucleotide
aacagcctttacaggttgccaggtgtacaaagataatc

SEQ ID NO: 131228 - DNA, 37 bp, Artificial Sequence
  Description of Artificial Sequence: Synthetic oligonucleotide
acagcctttacaggttgccaggtgtacaaagataatc

SEQ ID NO: 131229 - DNA, 36 bp, Artificial Sequence
  Description of Artificial Sequence: Synthetic oligonucleotide
cagcctttacaggttgccaggtgtacaaagataatc

SEQ ID NO: 131230 - DNA, 39 bp, Artificial Sequence
  Description of Artificial Sequence: Synthetic oligonucleotide
agcctttacaggttgccaggtgtacaaagataatcaatg

SEQ ID NO: 131231 - DNA, 38 bp, Artificial Sequence
  Description of Artificial Sequence: Synthetic oligonucleotide
gcctttacaggttgccaggtgtacaaagataatcaatg

SEQ ID NO: 131232 - DNA, 38 bp, Artificial Sequence
  Description of Artificial Sequence: Synthetic oligonucleotide
cctttacaggttgccaggtgtacaaagataatcaatgc

SEQ ID NO: 131233 - DNA, 39 bp, Artificial Sequence
  Description of Artificial Sequence: Synthetic oligonucleotide
ctttacaggttgccaggtgtacaaagataatcaatgctg

SEQ ID NO: 131234 - DNA, 42 bp, Artificial Sequence
  Description of Artificial Sequence: Synthetic oligonucleotide
tttacaggttgccaggtgtacaaagataatcaatgctgattc

SEQ ID NO: 131235 - DNA, 41 bp, Artificial Sequence
  Description of Artificial Sequence: Synthetic oligonucleotide
ttacaggttgccaggtgtacaaagataatcaatgctgattc

SEQ ID NO: 131236 - DNA, 40 bp, Artificial Sequence
  Description of Artificial Sequence: Synthetic oligonucleotide
tacaggttgccaggtgtacaaagataatcaatgctgattc

SEQ ID NO: 131237 - DNA, 39 bp, Artificial Sequence
  Description of Artificial Sequence: Synthetic oligonucleotide
acaggttgccaggtgtacaaagataatcaatgctgattc

SEQ ID NO: 131238 - DNA, 38 bp, Artificial Sequence
  Description of Artificial Sequence: Synthetic oligonucleotide
caggttgccaggtgtacaaagataatcaatgctgattc

SEQ ID NO: 131239 - DNA, 38 bp, Artificial Sequence
  Description of Artificial Sequence: Synthetic oligonucleotide
aggttgccaggtgtacaaagataatcaatgctgattcg

SEQ ID NO: 131240 - DNA, 37 bp, Artificial Sequence
  Description of Artificial Sequence: Synthetic oligonucleotide
ggttgccaggtgtacaaagataatcaatgctgattcg

SEQ ID NO: 131241 - DNA, 37 bp, Artificial Sequence
  Description of Artificial Sequence: Synthetic oligonucleotide
gttgccaggtgtacaaagataatcaatgctgattcgg

SEQ ID NO: 131242 - DNA, 38 bp, Artificial Sequence
  Description of Artificial Sequence: Synthetic oligonucleotide
ttgccaggtgtacaaagataatcaatgctgattcggag

SEQ ID NO: 131243 - DNA, 37 bp, Artificial Sequence
  Description of Artificial Sequence: Synthetic oligonucleotide
tgccaggtgtacaaagataatcaatgctgattcggag

SEQ ID NO: 131244 - DNA, 36 bp, Artificial Sequence
  Description of Artificial Sequence: Synthetic oligonucleotide
gccaggtgtacaaagataatcaatgctgattcggag

SEQ ID NO: 131245 - DNA, 36 bp, Artificial Sequence
  Description of Artificial Sequence: Synthetic oligonucleotide
ccaggtgtacaaagataatcaatgctgattcggagg

SEQ ID NO: 131246 - DNA, 37 bp, Artificial Sequence
  Description of Artificial Sequence: Synthetic oligonucleotide
caggtgtacaaagataatcaatgctgattcggaggac

SEQ ID NO: 131247 - DNA, 37 bp, Artificial Sequence
  Description of Artificial Sequence: Synthetic oligonucleotide
aggtgtacaaagataatcaatgctgattcggaggacc

SEQ ID NO: 131248 - DNA, 36 bp, Artificial Sequence
  Description of Artificial Sequence: Synthetic oligonucleotide
ggtgtacaaagataatcaatgctgattcggaggacc

SEQ ID NO: 131249 - DNA, 36 bp, Artificial Sequence
  Description of Artificial Sequence: Synthetic oligonucleotide
gtgtacaaagataatcaatgctgattcggaggaccc

SEQ ID NO: 131250 - DNA, 42 bp, Artificial Sequence
  Description of Artificial Sequence: Synthetic oligonucleotide
tgtacaaagataatcaatgctgattcggaggacccaaaatac

SEQ ID NO: 131251 - DNA, 41 bp, Artificial Sequence
  Description of Artificial Sequence: Synthetic oligonucleotide
gtacaaagataatcaatgctgattcggaggacccaaaatac

SEQ ID NO: 131252 - DNA, 46 bp, Artificial Sequence
  Description of Artificial Sequence: Synthetic oligonucleotide
tacaaagataatcaatgctgattcggaggacccaaaatacattatc

SEQ ID NO: 131253 - DNA, 45 bp, Artificial Sequence
  Description of Artificial Sequence: Synthetic oligonucleotide
acaaagataatcaatgctgattcggaggacccaaaatacattatc

SEQ ID NO: 131254 - DNA, 44 bp, Artificial Sequence
  Description of Artificial Sequence: Synthetic oligonucleotide
caaagataatcaatgctgattcggaggacccaaaatacattatc

SEQ ID NO: 131255 - DNA, 46 bp, Artificial Sequence
  Description of Artificial Sequence: Synthetic oligonucleotide
aaagataatcaatgctgattcggaggacccaaaatacattatcaac

SEQ ID NO: 131256 - DNA, 45 bp, Artificial Sequence
  Description of Artificial Sequence: Synthetic oligonucleotide
aagataatcaatgctgattcggaggacccaaaatacattatcaac

SEQ ID NO: 131257 - DNA, 44 bp, Artificial Sequence
  Description of Artificial Sequence: Synthetic oligonucleotide
agataatcaatgctgattcggaggacccaaaatacattatcaac

SEQ ID NO: 131258 - DNA, 43 bp, Artificial Sequence
  Description of Artificial Sequence: Synthetic oligonucleotide
gataatcaatgctgattcggaggacccaaaatacattatcaac

SEQ ID NO: 131259 - DNA, 43 bp, Artificial Sequence
  Description of Artificial Sequence: Synthetic oligonucleotide
ataatcaatgctgattcggaggacccaaaatacattatcaacg

SEQ ID NO: 131260 - DNA, 42 bp, Artificial Sequence
  Description of Artificial Sequence: Synthetic oligonucleotide
taatcaatgctgattcggaggacccaaaatacattatcaacg

SEQ ID NO: 131261 - DNA, 41 bp, Artificial Sequence
  Description of Artificial Sequence: Synthetic oligonucleotide
aatcaatgctgattcggaggacccaaaatacattatcaacg

SEQ ID NO: 131262 - DNA, 40 bp, Artificial Sequence
  Description of Artificial Sequence: Synthetic oligonucleotide
atcaatgctgattcggaggacccaaaatacattatcaacg

SEQ ID NO: 131263 - DNA, 39 bp, Artificial Sequence
  Description of Artificial Sequence: Synthetic oligonucleotide
tcaatgctgattcggaggacccaaaatacattatcaacg

SEQ ID NO: 131264 - DNA, 38 bp, Artificial Sequence
  Description of Artificial Sequence: Synthetic oligonucleotide
caatgctgattcggaggacccaaaatacattatcaacg

SEQ ID NO: 131265 - DNA, 42 bp, Artificial Sequence
  Description of Artificial Sequence: Synthetic oligonucleotide
aatgctgattcggaggacccaaaatacattatcaacgtaaag

SEQ ID NO: 131266 - DNA, 41 bp, Artificial Sequence
  Description of Artificial Sequence: Synthetic oligonucleotide
atgctgattcggaggacccaaaatacattatcaacgtaaag

SEQ ID NO: 131267 - DNA, 40 bp, Artificial Sequence
  Description of Artificial Sequence: Synthetic oligonucleotide
tgctgattcggaggacccaaaatacattatcaacgtaaag

SEQ ID NO: 131268 - DNA, 39 bp, Artificial Sequence
  Description of Artificial Sequence: Synthetic oligonucleotide
gctgattcggaggacccaaaatacattatcaacgtaaag

SEQ ID NO: 131269 - DNA, 39 bp, Artificial Sequence
  Description of Artificial Sequence: Synthetic oligonucleotide
ctgattcggaggacccaaaatacattatcaacgtaaagc

SEQ ID NO: 131270 - DNA, 40 bp, Artificial Sequence
  Description of Artificial Sequence: Synthetic oligonucleotide
tgattcggaggacccaaaatacattatcaacgtaaagcag

SEQ ID NO: 131271 - DNA, 39 bp, Artificial Sequence
  Description of Artificial Sequence: Synthetic oligonucleotide
gattcggaggacccaaaatacattatcaacgtaaagcag

SEQ ID NO: 131272 - DNA, 42 bp, Artificial Sequence
  Description of Artificial Sequence: Synthetic oligonucleotide
attcggaggacccaaaatacattatcaacgtaaagcagtttg

SEQ ID NO: 131273 - DNA, 41 bp, Artificial Sequence
  Description of Artificial Sequence: Synthetic oligonucleotide
ttcggaggacccaaaatacattatcaacgtaaagcagtttg

SEQ ID NO: 131274 - DNA, 40 bp, Artificial Sequence
  Description of Artificial Sequence: Synthetic oligonucleotide
tcggaggacccaaaatacattatcaacgtaaagcagtttg

SEQ ID NO: 131275 - DNA, 39 bp, Artificial Sequence
  Description of Artificial Sequence: Synthetic oligonucleotide
cggaggacccaaaatacattatcaacgtaaagcagtttg

SEQ ID NO: 131276 - DNA, 39 bp, Artificial Sequence
  Description of Artificial Sequence: Synthetic oligonucleotide
ggaggacccaaaatacattatcaacgtaaagcagtttgc

SEQ ID NO: 131277 - DNA, 39 bp, Artificial Sequence
  Description of Artificial Sequence: Synthetic oligonucleotide
gaggacccaaaatacattatcaacgtaaagcagtttgcc

SEQ ID NO: 131278 - DNA, 41 bp, Artificial Sequence
  Description of Artificial Sequence: Synthetic oligonucleotide
aggacccaaaatacattatcaacgtaaagcagtttgccaag

SEQ ID NO: 131279 - DNA, 40 bp, Artificial Sequence
  Description of Artificial Sequence: Synthetic oligonucleotide
ggacccaaaatacattatcaacgtaaagcagtttgccaag

SEQ ID NO: 131280 - DNA, 43 bp, Artificial Sequence
  Description of Artificial Sequence: Synthetic oligonucleotide
gacccaaaatacattatcaacgtaaagcagtttgccaagtttg

SEQ ID NO: 131281 - DNA, 44 bp, Artificial Sequence
  Description of Artificial Sequence: Synthetic oligonucleotide
acccaaaatacattatcaacgtaaagcagtttgccaagtttgtg

SEQ ID NO: 131282 - DNA, 43 bp, Artificial Sequence
  Description of Artificial Sequence: Synthetic oligonucleotide
cccaaaatacattatcaacgtaaagcagtttgccaagtttgtg

SEQ ID NO: 131283 - DNA, 43 bp, Artificial Sequence
  Description of Artificial Sequence: Synthetic oligonucleotide
ccaaaatacattatcaacgtaaagcagtttgccaagtttgtgg

SEQ ID NO: 131284 - DNA, 44 bp, Artificial Sequence
  Description of Artificial Sequence: Synthetic oligonucleotide
caaaatacattatcaacgtaaagcagtttgccaagtttgtggtg

SEQ ID NO: 131285 - DNA, 44 bp, Artificial Sequence
  Description of Artificial Sequence: Synthetic oligonucleotide
aaaatacattatcaacgtaaagcagtttgccaagtttgtggtgg

SEQ ID NO: 131286 - DNA, 43 bp, Artificial Sequence
  Description of Artificial Sequence: Synthetic oligonucleotide
aaatacattatcaacgtaaagcagtttgccaagtttgtggtgg

SEQ ID NO: 131287 - DNA, 42 bp, Artificial Sequence
  Description of Artificial Sequence: Synthetic oligonucleotide
aatacattatcaacgtaaagcagtttgccaagtttgtggtgg

SEQ ID NO: 131288 - DNA, 41 bp, Artificial Sequence
  Description of Artificial Sequence: Synthetic oligonucleotide
atacattatcaacgtaaagcagtttgccaagtttgtggtgg

SEQ ID NO: 131289 - DNA, 40 bp, Artificial Sequence
  Description of Artificial Sequence: Synthetic oligonucleotide
tacattatcaacgtaaagcagtttgccaagtttgtggtgg

SEQ ID NO: 131290 - DNA, 39 bp, Artificial Sequence
  Description of Artificial Sequence: Synthetic oligonucleotide
acattatcaacgtaaagcagtttgccaagtttgtggtgg

SEQ ID NO: 131291 - DNA, 38 bp, Artificial Sequence
  Description of Artificial Sequence: Synthetic oligonucleotide
cattatcaacgtaaagcagtttgccaagtttgtggtgg

SEQ ID NO: 131292 - DNA, 39 bp, Artificial Sequence
  Description of Artificial Sequence: Synthetic oligonucleotide
attatcaacgtaaagcagtttgccaagtttgtggtggac

SEQ ID NO: 131293 - DNA, 38 bp, Artificial Sequence
  Description of Artificial Sequence: Synthetic oligonucleotide
ttatcaacgtaaagcagtttgccaagtttgtggtggac

SEQ ID NO: 131294 - DNA, 37 bp, Artificial Sequence
  Description of Artificial Sequence: Synthetic oligonucleotide
tatcaacgtaaagcagtttgccaagtttgtggtggac

SEQ ID NO: 131295 - DNA, 36 bp, Artificial Sequence
  Description of Artificial Sequence: Synthetic oligonucleotide
atcaacgtaaagcagtttgccaagtttgtggtggac

SEQ ID NO: 131296 - DNA, 35 bp, Artificial Sequence
  Description of Artificial Sequence: Synthetic oligonucleotide
tcaacgtaaagcagtttgccaagtttgtggtggac

SEQ ID NO: 131297 - DNA, 34 bp, Artificial Sequence
  Description of Artificial Sequence: Synthetic oligonucleotide
caacgtaaagcagtttgccaagtttgtggtggac

SEQ ID NO: 131298 - DNA, 34 bp, Artificial Sequence
  Description of Artificial Sequence: Synthetic oligonucleotide
aacgtaaagcagtttgccaagtttgtggtggacc

SEQ ID NO: 131299 - DNA, 33 bp, Artificial Sequence
  Description of Artificial Sequence: Synthetic oligonucleotide
acgtaaagcagtttgccaagtttgtggtggacc

SEQ ID NO: 131300 - DNA, 32 bp, Artificial Sequence
  Description of Artificial Sequence: Synthetic oligonucleotide
cgtaaagcagtttgccaagtttgtggtggacc

SEQ ID NO: 131301 - DNA, 35 bp, Artificial Sequence
  Description of Artificial Sequence: Synthetic oligonucleotide
gtaaagcagtttgccaagtttgtggtggaccttag

SEQ ID NO: 131302 - DNA, 36 bp, Artificial Sequence
  Description of Artificial Sequence: Synthetic oligonucleotide
taaagcagtttgccaagtttgtggtggaccttagtg

SEQ ID NO: 131303 - DNA, 35 bp, Artificial Sequence
  Description of Artificial Sequence: Synthetic oligonucleotide
aaagcagtttgccaagtttgtggtggaccttagtg

SEQ ID NO: 131304 - DNA, 34 bp, Artificial Sequence
  Description of Artificial Sequence: Synthetic oligonucleotide
aagcagtttgccaagtttgtggtggaccttagtg

SEQ ID NO: 131305 - DNA, 33 bp, Artificial Sequence
  Description of Artificial Sequence: Synthetic oligonucleotide
agcagtttgccaagtttgtggtggaccttagtg

SEQ ID NO: 131306 - DNA, 32 bp, Artificial Sequence
  Description of Artificial Sequence: Synthetic oligonucleotide
gcagtttgccaagtttgtggtggaccttagtg

SEQ ID NO: 131307 - DNA, 34 bp, Artificial Sequence
  Description of Artificial Sequence: Synthetic oligonucleotide
cagtttgccaagtttgtggtggaccttagtgatc

SEQ ID NO: 131308 - DNA, 35 bp, Artificial Sequence
  Description of Artificial Sequence: Synthetic oligonucleotide
agtttgccaagtttgtggtggaccttagtgatcag

SEQ ID NO: 131309 - DNA, 34 bp, Artificial Sequence
  Description of Artificial Sequence: Synthetic oligonucleotide
gtttgccaagtttgtggtggaccttagtgatcag

SEQ ID NO: 131310 - DNA, 34 bp, Artificial Sequence
  Description of Artificial Sequence: Synthetic oligonucleotide
tttgccaagtttgtggtggaccttagtgatcagg

SEQ ID NO: 131311 - DNA, 33 bp, Artificial Sequence
  Description of Artificial Sequence: Synthetic oligonucleotide
ttgccaagtttgtggtggaccttagtgatcagg

SEQ ID NO: 131312 - DNA, 32 bp, Artificial Sequence
  Description of Artificial Sequence: Synthetic oligonucleotide
tgccaagtttgtggtggaccttagtgatcagg

SEQ ID NO: 131313 - DNA, 31 bp, Artificial Sequence
  Description of Artificial Sequence: Synthetic oligonucleotide
gccaagtttgtggtggaccttagtgatcagg

SEQ ID NO: 131314 - DNA, 32 bp, Artificial Sequence
  Description of Artificial Sequence: Synthetic oligonucleotide
ccaagtttgtggtggaccttagtgatcaggtg

SEQ ID NO: 131315 - DNA, 32 bp, Artificial Sequence
  Description of Artificial Sequence: Synthetic oligonucleotide
caagtttgtggtggaccttagtgatcaggtgg

SEQ ID NO: 131316 - DNA, 32 bp, Artificial Sequence
  Description of Artificial Sequence: Synthetic oligonucleotide
aagtttgtggtggaccttagtgatcaggtggc

SEQ ID NO: 131317 - DNA, 31 bp, Artificial Sequence
  Description of Artificial Sequence: Synthetic oligonucleotide
agtttgtggtggaccttagtgatcaggtggc

SEQ ID NO: 131318 - DNA, 30 bp, Artificial Sequence
  Description of Artificial Sequence: Synthetic oligonucleotide
gtttgtggtggaccttagtgatcaggtggc

SEQ ID NO: 131319 - DNA, 31 bp, Artificial Sequence
  Description of Artificial Sequence: Synthetic oligonucleotide
tttgtggtggaccttagtgatcaggtggcac

SEQ ID NO: 131320 - DNA, 30 bp, Artificial Sequence
  Description of Artificial Sequence: Synthetic oligonucleotide
ttgtggtggaccttagtgatcaggtggcac

SEQ ID NO: 131321 - DNA, 29 bp, Artificial Sequence
  Description of Artificial Sequence: Synthetic oligonucleotide
tgtggtggaccttagtgatcaggtggcac

SEQ ID NO: 131322 - DNA, 28 bp, Artificial Sequence
  Description of Artificial Sequence: Synthetic oligonucleotide
gtggtggaccttagtgatcaggtggcac

SEQ ID NO: 131323 - DNA, 28 bp, Artificial Sequence
  Description of Artificial Sequence: Synthetic oligonucleotide
tggtggaccttagtgatcaggtggcacc

SEQ ID NO: 131324 - DNA, 27 bp, Artificial Sequence
  Description of Artificial Sequence: Synthetic oligonucleotide
ggtggaccttagtgatcaggtggcacc

SEQ ID NO: 131325 - DNA, 29 bp, Artificial Sequence
  Description of Artificial Sequence: Synthetic oligonucleotide
gtggaccttagtgatcaggtggcacctac

SEQ ID NO: 131326 - DNA, 30 bp, Artificial Sequence
  Description of Artificial Sequence: Synthetic oligonucleotide
tggaccttagtgatcaggtggcacctactg

SEQ ID NO: 131327 - DNA, 29 bp, Artificial Sequence
  Description of Artificial Sequence: Synthetic oligonucleotide
ggaccttagtgatcaggtggcacctactg

SEQ ID NO: 131328 - DNA, 30 bp, Artificial Sequence
  Description of Artificial Sequence: Synthetic oligonucleotide
gaccttagtgatcaggtggcacctactgac

SEQ ID NO: 131329 - DNA, 33 bp, Artificial Sequence
  Description of Artificial Sequence: Synthetic oligonucleotide
accttagtgatcaggtggcacctactgacattg

SEQ ID NO: 131330 - DNA, 32 bp, Artificial Sequence
  Description of Artificial Sequence: Synthetic oligonucleotide
ccttagtgatcaggtggcacctactgacattg

SEQ ID NO: 131331 - DNA, 34 bp, Artificial Sequence
  Description of Artificial Sequence: Synthetic oligonucleotide
cttagtgatcaggtggcacctactgacattgaag

SEQ ID NO: 131332 - DNA, 36 bp, Artificial Sequence
  Description of Artificial Sequence: Synthetic oligonucleotide
ttagtgatcaggtggcacctactgacattgaagaag

SEQ ID NO: 131333 - DNA, 35 bp, Artificial Sequence
  Description of Artificial Sequence: Synthetic oligonucleotide
tagtgatcaggtggcacctactgacattgaagaag

SEQ ID NO: 131334 - DNA, 34 bp, Artificial Sequence
  Description of Artificial Sequence: Synthetic oligonucleotide
agtgatcaggtggcacctactgacattgaagaag

SEQ ID NO: 131335 - DNA, 33 bp, Artificial Sequence
  Description of Artificial Sequence: Synthetic oligonucleotide
gtgatcaggtggcacctactgacattgaagaag

SEQ ID NO: 131336 - DNA, 33 bp, Artificial Sequence
  Description of Artificial Sequence: Synthetic oligonucleotide
tgatcaggtggcacctactgacattgaagaagg

SEQ ID NO: 131337 - DNA, 32 bp, Artificial Sequence
  Description of Artificial Sequence: Synthetic oligonucleotide
gatcaggtggcacctactgacattgaagaagg

SEQ ID NO: 131338 - DNA, 32 bp, Artificial Sequence
  Description of Artificial Sequence: Synthetic oligonucleotide
atcaggtggcacctactgacattgaagaaggg

SEQ ID NO: 131339 - DNA, 31 bp, Artificial Sequence
  Description of Artificial Sequence: Synthetic oligonucleotide
tcaggtggcacctactgacattgaagaaggg

SEQ ID NO: 131340 - DNA, 30 bp, Artificial Sequence
  Description of Artificial Sequence: Synthetic oligonucleotide
caggtggcacctactgacattgaagaaggg

SEQ ID NO: 131341 - DNA, 32 bp, Artificial Sequence
  Description of Artificial Sequence: Synthetic oligonucleotide
aggtggcacctactgacattgaagaagggatg

SEQ ID NO: 131342 - DNA, 31 bp, Artificial Sequence
  Description of Artificial Sequence: Synthetic oligonucleotide
ggtggcacctactgacattgaagaagggatg

SEQ ID NO: 131343 - DNA, 32 bp, Artificial Sequence
  Description of Artificial Sequence: Synthetic oligonucleotide
gtggcacctactgacattgaagaagggatgag

SEQ ID NO: 131344 - DNA, 33 bp, Artificial Sequence
  Description of Artificial Sequence: Synthetic oligonucleotide
tggcacctactgacattgaagaagggatgagag

SEQ ID NO: 131345 - DNA, 32 bp, Artificial Sequence
  Description of Artificial Sequence: Synthetic oligonucleotide
ggcacctactgacattgaagaagggatgagag

SEQ ID NO: 131346 - DNA, 33 bp, Artificial Sequence
  Description of Artificial Sequence: Synthetic oligonucleotide
gcacctactgacattgaagaagggatgagagtg

SEQ ID NO: 131347 - DNA, 33 bp, Artificial Sequence
  Description of Artificial Sequence: Synthetic oligonucleotide
cacctactgacattgaagaagggatgagagtgg

SEQ ID NO: 131348 - DNA, 33 bp, Artificial Sequence
  Description of Artificial Sequence: Synthetic oligonucleotide
acctactgacattgaagaagggatgagagtggg

SEQ ID NO: 131349 - DNA, 32 bp, Artificial Sequence
  Description of Artificial Sequence: Synthetic oligonucleotide
cctactgacattgaagaagggatgagagtggg

SEQ ID NO: 131350 - DNA, 32 bp, Artificial Sequence
  Description of Artificial Sequence: Synthetic oligonucleotide
ctactgacattgaagaagggatgagagtgggc

SEQ ID NO: 131351 - DNA, 32 bp, Artificial Sequence
  Description of Artificial Sequence: Synthetic oligonucleotide
tactgacattgaagaagggatgagagtgggcg

SEQ ID NO: 131352 - DNA, 31 bp, Artificial Sequence
  Description of Artificial Sequence: Synthetic oligonucleotide
actgacattgaagaagggatgagagtgggcg

SEQ ID NO: 131353 - DNA, 30 bp, Artificial Sequence
  Description of Artificial Sequence: Synthetic oligonucleotide
ctgacattgaagaagggatgagagtgggcg

SEQ ID NO: 131354 - DNA, 31 bp, Artificial Sequence
  Description of Artificial Sequence: Synthetic oligonucleotide
tgacattgaagaagggatgagagtgggcgtg

SEQ ID NO: 131355 - DNA, 30 bp, Artificial Sequence
  Description of Artificial Sequence: Synthetic oligonucleotide
gacattgaagaagggatgagagtgggcgtg

SEQ ID NO: 131356 - DNA, 30 bp, Artificial Sequence
  Description of Artificial Sequence: Synthetic oligonucleotide
acattgaagaagggatgagagtgggcgtgg

SEQ ID NO: 131357 - DNA, 29 bp, Artificial Sequence
  Description of Artificial Sequence: Synthetic oligonucleotide
cattgaagaagggatgagagtgggcgtgg

SEQ ID NO: 131358 - DNA, 32 bp, Artificial Sequence
  Description of Artificial Sequence: Synthetic oligonucleotide
attgaagaagggatgagagtgggcgtggatag

SEQ ID NO: 131359 - DNA, 31 bp, Artificial Sequence
  Description of Artificial Sequence: Synthetic oligonucleotide
ttgaagaagggatgagagtgggcgtggatag

SEQ ID NO: 131360 - DNA, 30 bp, Artificial Sequence
  Description of Artificial Sequence: Synthetic oligonucleotide
tgaagaagggatgagagtgggcgtggatag

SEQ ID NO: 131361 - DNA, 29 bp, Artificial Sequence
  Description of Artificial Sequence: Synthetic oligonucleotide
gaagaagggatgagagtgggcgtggatag

SEQ ID NO: 131362 - DNA, 39 bp, Artificial Sequence
  Description of Artificial Sequence: Synthetic oligonucleotide
aagaagggatgagagtgggcgtggatagaaataaatatc

SEQ ID NO: 131363 - DNA, 38 bp, Artificial Sequence
  Description of Artificial Sequence: Synthetic oligonucleotide
agaagggatgagagtgggcgtggatagaaataaatatc

SEQ ID NO: 131364 - DNA, 37 bp, Artificial Sequence
  Description of Artificial Sequence: Synthetic oligonucleotide
gaagggatgagagtgggcgtggatagaaataaatatc

SEQ ID NO: 131365 - DNA, 42 bp, Artificial Sequence
  Description of Artificial Sequence: Synthetic oligonucleotide
aagggatgagagtgggcgtggatagaaataaatatcaaattc

SEQ ID NO: 131366 - DNA, 41 bp, Artificial Sequence
  Description of Artificial Sequence: Synthetic oligonucleotide
agggatgagagtgggcgtggatagaaataaatatcaaattc

SEQ ID NO: 131367 - DNA, 40 bp, Artificial Sequence
  Description of Artificial Sequence: Synthetic oligonucleotide
gggatgagagtgggcgtggatagaaataaatatcaaattc

SEQ ID NO: 131368 - DNA, 41 bp, Artificial Sequence
  Description of Artificial Sequence: Synthetic oligonucleotide
ggatgagagtgggcgtggatagaaataaatatcaaattcac

SEQ ID NO: 131369 - DNA, 44 bp, Artificial Sequence
  Description of Artificial Sequence: Synthetic oligonucleotide
gatgagagtgggcgtggatagaaataaatatcaaattcacattc

SEQ ID NO: 131370 - DNA, 44 bp, Artificial Sequence
  Description of Artificial Sequence: Synthetic oligonucleotide
atgagagtgggcgtggatagaaataaatatcaaattcacattcc

SEQ ID NO: 131371 - DNA, 43 bp, Artificial Sequence
  Description of Artificial Sequence: Synthetic oligonucleotide
tgagagtgggcgtggatagaaataaatatcaaattcacattcc

SEQ ID NO: 131372 - DNA, 42 bp, Artificial Sequence
  Description of Artificial Sequence: Synthetic oligonucleotide
gagagtgggcgtggatagaaataaatatcaaattcacattcc

SEQ ID NO: 131373 - DNA, 45 bp, Artificial Sequence
  Description of Artificial Sequence: Synthetic oligonucleotide
agagtgggcgtggatagaaataaatatcaaattcacattccattg

SEQ ID NO: 131374 - DNA, 44 bp, Artificial Sequence
  Description of Artificial Sequence: Synthetic oligonucleotide
gagtgggcgtggatagaaataaatatcaaattcacattccattg

SEQ ID NO: 131375 - DNA, 44 bp, Artificial Sequence
  Description of Artificial Sequence: Synthetic oligonucleotide
agtgggcgtggatagaaataaatatcaaattcacattccattgc

SEQ ID NO: 131376 - DNA, 43 bp, Artificial Sequence
  Description of Artificial Sequence: Synthetic oligonucleotide
gtgggcgtggatagaaataaatatcaaattcacattccattgc

SEQ ID NO: 131377 - DNA, 43 bp, Artificial Sequence
  Description of Artificial Sequence: Synthetic oligonucleotide
tgggcgtggatagaaataaatatcaaattcacattccattgcc

SEQ ID NO: 131378 - DNA, 42 bp, Artificial Sequence
  Description of Artificial Sequence: Synthetic oligonucleotide
gggcgtggatagaaataaatatcaaattcacattccattgcc

SEQ ID NO: 131379 - DNA, 43 bp, Artificial Sequence
  Description of Artificial Sequence: Synthetic oligonucleotide
ggcgtggatagaaataaatatcaaattcacattccattgcctc

SEQ ID NO: 131380 - DNA, 43 bp, Artificial Sequence
  Description of Artificial Sequence: Synthetic oligonucleotide
gcgtggatagaaataaatatcaaattcacattccattgcctcc

SEQ ID NO: 131381 - DNA, 46 bp, Artificial Sequence
  Description of Artificial Sequence: Synthetic oligonucleotide
cgtggatagaaataaatatcaaattcacattccattgcctcctaag

SEQ ID NO: 131382 - DNA, 49 bp, Artificial Sequence
  Description of Artificial Sequence: Synthetic oligonucleotide
gtggatagaaataaatatcaaattcacattccattgcctcctaagattg

SEQ ID NO: 131383 - DNA, 50 bp, Artificial Sequence
  Description of Artificial Sequence: Synthetic oligonucleotide
tggatagaaataaatatcaaattcacattccattgcctcctaagattgac

SEQ ID NO: 131384 - DNA, 49 bp, Artificial Sequence
  Description of Artificial Sequence: Synthetic oligonucleotide
ggatagaaataaatatcaaattcacattccattgcctcctaagattgac

SEQ ID NO: 131385 - DNA, 49 bp, Artificial Sequence
  Description of Artificial Sequence: Synthetic oligonucleotide
gatagaaataaatatcaaattcacattccattgcctcctaagattgacc

SEQ ID NO: 131386 - DNA, 49 bp, Artificial Sequence
  Description of Artificial Sequence: Synthetic oligonucleotide
atagaaataaatatcaaattcacattccattgcctcctaagattgaccc

SEQ ID NO: 131387 - DNA, 48 bp, Artificial Sequence
  Description of Artificial Sequence: Synthetic oligonucleotide
tagaaataaatatcaaattcacattccattgcctcctaagattgaccc

SEQ ID NO: 131388 - DNA, 47 bp, Artificial Sequence
  Description of Artificial Sequence: Synthetic oligonucleotide
agaaataaatatcaaattcacattccattgcctcctaagattgaccc

SEQ ID NO: 131389 - DNA, 46 bp, Artificial Sequence
  Description of Artificial Sequence: Synthetic oligonucleotide
gaaataaatatcaaattcacattccattgcctcctaagattgaccc

SEQ ID NO: 131390 - DNA, 48 bp, Artificial Sequence
  Description of Artificial Sequence: Synthetic oligonucleotide
aaataaatatcaaattcacattccattgcctcctaagattgacccaac

SEQ ID NO: 131391 - DNA, 47 bp, Artificial Sequence
  Description of Artificial Sequence: Synthetic oligonucleotide
aataaatatcaaattcacattccattgcctcctaagattgacccaac

SEQ ID NO: 131392 - DNA, 46 bp, Artificial Sequence
  Description of Artificial Sequence: Synthetic oligonucleotide
ataaatatcaaattcacattccattgcctcctaagattgacccaac

SEQ ID NO: 131393 - DNA, 45 bp, Artificial Sequence
  Description of Artificial Sequence: Synthetic oligonucleotide
taaatatcaaattcacattccattgcctcctaagattgacccaac

SEQ ID NO: 131394 - DNA, 44 bp, Artificial Sequence
  Description of Artificial Sequence: Synthetic oligonucleotide
aaatatcaaattcacattccattgcctcctaagattgacccaac

SEQ ID NO: 131395 - DNA, 43 bp, Artificial Sequence
  Description of Artificial Sequence: Synthetic oligonucleotide
aatatcaaattcacattccattgcctcctaagattgacccaac

SEQ ID NO: 131396 - DNA, 42 bp, Artificial Sequence
  Description of Artificial Sequence: Synthetic oligonucleotide
atatcaaattcacattccattgcctcctaagattgacccaac

SEQ ID NO: 131397 - DNA, 41 bp, Artificial Sequence
  Description of Artificial Sequence: Synthetic oligonucleotide
tatcaaattcacattccattgcctcctaagattgacccaac

SEQ ID NO: 131398 - DNA, 40 bp, Artificial Sequence
  Description of Artificial Sequence: Synthetic oligonucleotide
atcaaattcacattccattgcctcctaagattgacccaac

SEQ ID NO: 131399 - DNA, 39 bp, Artificial Sequence
  Description of Artificial Sequence: Synthetic oligonucleotide
tcaaattcacattccattgcctcctaagattgacccaac

SEQ ID NO: 131400 - DNA, 38 bp, Artificial Sequence
  Description of Artificial Sequence: Synthetic oligonucleotide
caaattcacattccattgcctcctaagattgacccaac

SEQ ID NO: 131401 - DNA, 39 bp, Artificial Sequence
  Description of Artificial Sequence: Synthetic oligonucleotide
aaattcacattccattgcctcctaagattgacccaacag

SEQ ID NO: 131402 - DNA, 38 bp, Artificial Sequence
  Description of Artificial Sequence: Synthetic oligonucleotide
aattcacattccattgcctcctaagattgacccaacag

SEQ ID NO: 131403 - DNA, 37 bp, Artificial Sequence
  Description of Artificial Sequence: Synthetic oligonucleotide
attcacattccattgcctcctaagattgacccaacag

SEQ ID NO: 131404 - DNA, 36 bp, Artificial Sequence
  Description of Artificial Sequence: Synthetic oligonucleotide
ttcacattccattgcctcctaagattgacccaacag

SEQ ID NO: 131405 - DNA, 35 bp, Artificial Sequence
  Description of Artificial Sequence: Synthetic oligonucleotide
tcacattccattgcctcctaagattgacccaacag

SEQ ID NO: 131406 - DNA, 34 bp, Artificial Sequence
  Description of Artificial Sequence: Synthetic oligonucleotide
cacattccattgcctcctaagattgacccaacag

SEQ ID NO: 131407 - DNA, 37 bp, Artificial Sequence
  Description of Artificial Sequence: Synthetic oligonucleotide
acattccattgcctcctaagattgacccaacagttac

SEQ ID NO: 131408 - DNA, 36 bp, Artificial Sequence
  Description of Artificial Sequence: Synthetic oligonucleotide
cattccattgcctcctaagattgacccaacagttac

SEQ ID NO: 131409 - DNA, 36 bp, Artificial Sequence
  Description of Artificial Sequence: Synthetic oligonucleotide
attccattgcctcctaagattgacccaacagttacc

SEQ ID NO: 131410 - DNA, 35 bp, Artificial Sequence
  Description of Artificial Sequence: Synthetic oligonucleotide
ttccattgcctcctaagattgacccaacagttacc

SEQ ID NO: 131411 - DNA, 34 bp, Artificial Sequence
  Description of Artificial Sequence: Synthetic oligonucleotide
tccattgcctcctaagattgacccaacagttacc

SEQ ID NO: 131412 - DNA, 33 bp, Artificial Sequence
  Description of Artificial Sequence: Synthetic oligonucleotide
ccattgcctcctaagattgacccaacagttacc

SEQ ID NO: 131413 - DNA, 35 bp, Artificial Sequence
  Description of Artificial Sequence: Synthetic oligonucleotide
cattgcctcctaagattgacccaacagttaccatg

SEQ ID NO: 131414 - DNA, 37 bp, Artificial Sequence
  Description of Artificial Sequence: Synthetic oligonucleotide
attgcctcctaagattgacccaacagttaccatgatg

SEQ ID NO: 131415 - DNA, 36 bp, Artificial Sequence
  Description of Artificial Sequence: Synthetic oligonucleotide
ttgcctcctaagattgacccaacagttaccatgatg

SEQ ID NO: 131416 - DNA, 35 bp, Artificial Sequence
  Description of Artificial Sequence: Synthetic oligonucleotide
tgcctcctaagattgacccaacagttaccatgatg

SEQ ID NO: 131417 - DNA, 34 bp, Artificial Sequence
  Description of Artificial Sequence: Synthetic oligonucleotide
gcctcctaagattgacccaacagttaccatgatg

SEQ ID NO: 131418 - DNA, 34 bp, Artificial Sequence
  Description of Artificial Sequence: Synthetic oligonucleotide
cctcctaagattgacccaacagttaccatgatgc

SEQ ID NO: 131419 - DNA, 35 bp, Artificial Sequence
  Description of Artificial Sequence: Synthetic oligonucleotide
ctcctaagattgacccaacagttaccatgatgcag

SEQ ID NO: 131420 - DNA, 35 bp, Artificial Sequence
  Description of Artificial Sequence: Synthetic oligonucleotide
tcctaagattgacccaacagttaccatgatgcagg

SEQ ID NO: 131421 - DNA, 34 bp, Artificial Sequence
  Description of Artificial Sequence: Synthetic oligonucleotide
cctaagattgacccaacagttaccatgatgcagg

SEQ ID NO: 131422 - DNA, 35 bp, Artificial Sequence
  Description of Artificial Sequence: Synthetic oligonucleotide
ctaagattgacccaacagttaccatgatgcaggtg

SEQ ID NO: 131423 - DNA, 35 bp, Artificial Sequence
  Description of Artificial Sequence: Synthetic oligonucleotide
taagattgacccaacagttaccatgatgcaggtgg

SEQ ID NO: 131424 - DNA, 34 bp, Artificial Sequence
  Description of Artificial Sequence: Synthetic oligonucleotide
aagattgacccaacagttaccatgatgcaggtgg

SEQ ID NO: 131425 - DNA, 33 bp, Artificial Sequence
  Description of Artificial Sequence: Synthetic oligonucleotide
agattgacccaacagttaccatgatgcaggtgg

SEQ ID NO: 131426 - DNA, 32 bp, Artificial Sequence
  Description of Artificial Sequence: Synthetic oligonucleotide
gattgacccaacagttaccatgatgcaggtgg

SEQ ID NO: 131427 - DNA, 34 bp, Artificial Sequence
  Description of Artificial Sequence: Synthetic oligonucleotide
attgacccaacagttaccatgatgcaggtggaag

SEQ ID NO: 131428 - DNA, 33 bp, Artificial Sequence
  Description of Artificial Sequence: Synthetic oligonucleotide
ttgacccaacagttaccatgatgcaggtggaag

SEQ ID NO: 131429 - DNA, 32 bp, Artificial Sequence
  Description of Artificial Sequence: Synthetic oligonucleotide
tgacccaacagttaccatgatgcaggtggaag

SEQ ID NO: 131430 - DNA, 31 bp, Artificial Sequence
  Description of Artificial Sequence: Synthetic oligonucleotide
gacccaacagttaccatgatgcaggtggaag

SEQ ID NO: 131431 - DNA, 32 bp, Artificial Sequence
  Description of Artificial Sequence: Synthetic oligonucleotide
acccaacagttaccatgatgcaggtggaagag

SEQ ID NO: 131432 - DNA, 31 bp, Artificial Sequence
  Description of Artificial Sequence: Synthetic oligonucleotide
cccaacagttaccatgatgcaggtggaagag

SEQ ID NO: 131433 - DNA, 34 bp, Artificial Sequence
  Description of Artificial Sequence: Synthetic oligonucleotide
ccaacagttaccatgatgcaggtggaagagaaac

SEQ ID NO: 131434 - DNA, 34 bp, Artificial Sequence
  Description of Artificial Sequence: Synthetic oligonucleotide
caacagttaccatgatgcaggtggaagagaaacc

SEQ ID NO: 131435 - DNA, 35 bp, Artificial Sequence
  Description of Artificial Sequence: Synthetic oligonucleotide
aacagttaccatgatgcaggtggaagagaaacctg

SEQ ID NO: 131436 - DNA, 34 bp, Artificial Sequence
  Description of Artificial Sequence: Synthetic oligonucleotide
acagttaccatgatgcaggtggaagagaaacctg

SEQ ID NO: 131437 - DNA, 33 bp, Artificial Sequence
  Description of Artificial Sequence: Synthetic oligonucleotide
cagttaccatgatgcaggtggaagagaaacctg

SEQ ID NO: 131438 - DNA, 35 bp, Artificial Sequence
  Description of Artificial Sequence: Synthetic oligonucleotide
agttaccatgatgcaggtggaagagaaacctgatg

SEQ ID NO: 131439 - DNA, 34 bp, Artificial Sequence
  Description of Artificial Sequence: Synthetic oligonucleotide
gttaccatgatgcaggtggaagagaaacctgatg

SEQ ID NO: 131440 - DNA, 35 bp, Artificial Sequence
  Description of Artificial Sequence: Synthetic oligonucleotide
ttaccatgatgcaggtggaagagaaacctgatgtc

SEQ ID NO: 131441 - DNA, 34 bp, Artificial Sequence
  Description of Artificial Sequence: Synthetic oligonucleotide
taccatgatgcaggtggaagagaaacctgatgtc

SEQ ID NO: 131442 - DNA, 33 bp, Artificial Sequence
  Description of Artificial Sequence: Synthetic oligonucleotide
accatgatgcaggtggaagagaaacctgatgtc

SEQ ID NO: 131443 - DNA, 32 bp, Artificial Sequence
  Description of Artificial Sequence: Synthetic oligonucleotide
ccatgatgcaggtggaagagaaacctgatgtc

SEQ ID NO: 131444 - DNA, 33 bp, Artificial Sequence
  Description of Artificial Sequence: Synthetic oligonucleotide
catgatgcaggtggaagagaaacctgatgtcac

SEQ ID NO: 131445 - DNA, 36 bp, Artificial Sequence
  Description of Artificial Sequence: Synthetic oligonucleotide
atgatgcaggtggaagagaaacctgatgtcacatac

SEQ ID NO: 131446 - DNA, 35 bp, Artificial Sequence
  Description of Artificial Sequence: Synthetic oligonucleotide
tgatgcaggtggaagagaaacctgatgtcacatac

SEQ ID NO: 131447 - DNA, 34 bp, Artificial Sequence
  Description of Artificial Sequence: Synthetic oligonucleotide
gatgcaggtggaagagaaacctgatgtcacatac

SEQ ID NO: 131448 - DNA, 35 bp, Artificial Sequence
  Description of Artificial Sequence: Synthetic oligonucleotide
atgcaggtggaagagaaacctgatgtcacatacag

SEQ ID NO: 131449 - DNA, 34 bp, Artificial Sequence
  Description of Artificial Sequence: Synthetic oligonucleotide
tgcaggtggaagagaaacctgatgtcacatacag

SEQ ID NO: 131450 - DNA, 33 bp, Artificial Sequence
  Description of Artificial Sequence: Synthetic oligonucleotide
gcaggtggaagagaaacctgatgtcacatacag

SEQ ID NO: 131451 - DNA, 34 bp, Artificial Sequence
  Description of Artificial Sequence: Synthetic oligonucleotide
caggtggaagagaaacctgatgtcacatacagtg

SEQ ID NO: 131452 - DNA, 36 bp, Artificial Sequence
  Description of Artificial Sequence: Synthetic oligonucleotide
aggtggaagagaaacctgatgtcacatacagtgatg

SEQ ID NO: 131453 - DNA, 35 bp, Artificial Sequence
  Description of Artificial Sequence: Synthetic oligonucleotide
ggtggaagagaaacctgatgtcacatacagtgatg

SEQ ID NO: 131454 - DNA, 37 bp, Artificial Sequence
  Description of Artificial Sequence: Synthetic oligonucleotide
gtggaagagaaacctgatgtcacatacagtgatgttg

SEQ ID NO: 131455 - DNA, 37 bp, Artificial Sequence
  Description of Artificial Sequence: Synthetic oligonucleotide
tggaagagaaacctgatgtcacatacagtgatgttgg

SEQ ID NO: 131456 - DNA, 36 bp, Artificial Sequence
  Description of Artificial Sequence: Synthetic oligonucleotide
ggaagagaaacctgatgtcacatacagtgatgttgg

SEQ ID NO: 131457 - DNA, 37 bp, Artificial Sequence
  Description of Artificial Sequence: Synthetic oligonucleotide
gaagagaaacctgatgtcacatacagtgatgttggtg

SEQ ID NO: 131458 - DNA, 37 bp, Artificial Sequence
  Description of Artificial Sequence: Synthetic oligonucleotide
aagagaaacctgatgtcacatacagtgatgttggtgg

SEQ ID NO: 131459 - DNA, 36 bp, Artificial Sequence
  Description of Artificial Sequence: Synthetic oligonucleotide
agagaaacctgatgtcacatacagtgatgttggtgg

SEQ ID NO: 131460 - DNA, 35 bp, Artificial Sequence
  Description of Artificial Sequence: Synthetic oligonucleotide
gagaaacctgatgtcacatacagtgatgttggtgg

SEQ ID NO: 131461 - DNA, 35 bp, Artificial Sequence
  Description of Artificial Sequence: Synthetic oligonucleotide
agaaacctgatgtcacatacagtgatgttggtggc

SEQ ID NO: 131462 - DNA, 34 bp, Artificial Sequence
  Description of Artificial Sequence: Synthetic oligonucleotide
gaaacctgatgtcacatacagtgatgttggtggc

SEQ ID NO: 131463 - DNA, 35 bp, Artificial Sequence
  Description of Artificial Sequence: Synthetic oligonucleotide
aaacctgatgtcacatacagtgatgttggtggctg

SEQ ID NO: 131464 - DNA, 34 bp, Artificial Sequence
  Description of Artificial Sequence: Synthetic oligonucleotide
aacctgatgtcacatacagtgatgttggtggctg

SEQ ID NO: 131465 - DNA, 33 bp, Artificial Sequence
  Description of Artificial Sequence: Synthetic oligonucleotide
acctgatgtcacatacagtgatgttggtggctg

SEQ ID NO: 131466 - DNA, 32 bp, Artificial Sequence
  Description of Artificial Sequence: Synthetic oligonucleotide
cctgatgtcacatacagtgatgttggtggctg

SEQ ID NO: 131467 - DNA, 35 bp, Artificial Sequence
  Description of Artificial Sequence: Synthetic oligonucleotide
ctgatgtcacatacagtgatgttggtggctgtaag

SEQ ID NO: 131468 - DNA, 35 bp, Artificial Sequence
  Description of Artificial Sequence: Synthetic oligonucleotide
tgatgtcacatacagtgatgttggtggctgtaagg

SEQ ID NO: 131469 - DNA, 34 bp, Artificial Sequence
  Description of Artificial Sequence: Synthetic oligonucleotide
gatgtcacatacagtgatgttggtggctgtaagg

SEQ ID NO: 131470 - DNA, 36 bp, Artificial Sequence
  Description of Artificial Sequence: Synthetic oligonucleotide
atgtcacatacagtgatgttggtggctgtaaggaac

SEQ ID NO: 131471 - DNA, 35 bp, Artificial Sequence
  Description of Artificial Sequence: Synthetic oligonucleotide
tgtcacatacagtgatgttggtggctgtaaggaac

SEQ ID NO: 131472 - DNA, 34 bp, Artificial Sequence
  Description of Artificial Sequence: Synthetic oligonucleotide
gtcacatacagtgatgttggtggctgtaaggaac

SEQ ID NO: 131473 - DNA, 35 bp, Artificial Sequence
  Description of Artificial Sequence: Synthetic oligonucleotide
tcacatacagtgatgttggtggctgtaaggaacag

SEQ ID NO: 131474 - DNA, 34 bp, Artificial Sequence
  Description of Artificial Sequence: Synthetic oligonucleotide
cacatacagtgatgttggtggctgtaaggaacag

SEQ ID NO: 131475 - DNA, 37 bp, Artificial Sequence
  Description of Artificial Sequence: Synthetic oligonucleotide
acatacagtgatgttggtggctgtaaggaacagattg

SEQ ID NO: 131476 - DNA, 36 bp, Artificial Sequence
  Description of Artificial Sequence: Synthetic oligonucleotide
catacagtgatgttggtggctgtaaggaacagattg

SEQ ID NO: 131477 - DNA, 37 bp, Artificial Sequence
  Description of Artificial Sequence: Synthetic oligonucleotide
atacagtgatgttggtggctgtaaggaacagattgag

SEQ ID NO: 131478 - DNA, 36 bp, Artificial Sequence
  Description of Artificial Sequence: Synthetic oligonucleotide
tacagtgatgttggtggctgtaaggaacagattgag

SEQ ID NO: 131479 - DNA, 35 bp, Artificial Sequence
  Description of Artificial Sequence: Synthetic oligonucleotide
acagtgatgttggtggctgtaaggaacagattgag

SEQ ID NO: 131480 - DNA, 34 bp, Artificial Sequence
  Description of Artificial Sequence: Synthetic oligonucleotide
cagtgatgttggtggctgtaaggaacagattgag

SEQ ID NO: 131481 - DNA, 37 bp, Artificial Sequence
  Description of Artificial Sequence: Synthetic oligonucleotide
agtgatgttggtggctgtaaggaacagattgagaaac

SEQ ID NO: 131482 - DNA, 36 bp, Artificial Sequence
  Description of Artificial Sequence: Synthetic oligonucleotide
gtgatgttggtggctgtaaggaacagattgagaaac

SEQ ID NO: 131483 - DNA, 37 bp, Artificial Sequence
  Description of Artificial Sequence: Synthetic oligonucleotide
tgatgttggtggctgtaaggaacagattgagaaactg

SEQ ID NO: 131484 - DNA, 36 bp, Artificial Sequence
  Description of Artificial Sequence: Synthetic oligonucleotide
gatgttggtggctgtaaggaacagattgagaaactg

SEQ ID NO: 131485 - DNA, 36 bp, Artificial Sequence
  Description of Artificial Sequence: Synthetic oligonucleotide
atgttggtggctgtaaggaacagattgagaaactgc

SEQ ID NO: 131486 - DNA, 35 bp, Artificial Sequence
  Description of Artificial Sequence: Synthetic oligonucleotide
tgttggtggctgtaaggaacagattgagaaactgc

SEQ ID NO: 131487 - DNA, 34 bp, Artificial Sequence
  Description of Artificial Sequence: Synthetic oligonucleotide
gttggtggctgtaaggaacagattgagaaactgc

SEQ ID NO: 131488 - DNA, 34 bp, Artificial Sequence
  Description of Artificial Sequence: Synthetic oligonucleotide
ttggtggctgtaaggaacagattgagaaactgcg

SEQ ID NO: 131489 - DNA, 33 bp, Artificial Sequence
  Description of Artificial Sequence: Synthetic oligonucleotide
tggtggctgtaaggaacagattgagaaactgcg

SEQ ID NO: 131490 - DNA, 32 bp, Artificial Sequence
  Description of Artificial Sequence: Synthetic oligonucleotide
ggtggctgtaaggaacagattgagaaactgcg

SEQ ID NO: 131491 - DNA, 33 bp, Artificial Sequence
  Description of Artificial Sequence: Synthetic oligonucleotide
gtggctgtaaggaacagattgagaaactgcgag

SEQ ID NO: 131492 - DNA, 35 bp, Artificial Sequence
  Description of Artificial Sequence: Synthetic oligonucleotide
tggctgtaaggaacagattgagaaactgcgagaag

SEQ ID NO: 131493 - DNA, 34 bp, Artificial Sequence
  Description of Artificial Sequence: Synthetic oligonucleotide
ggctgtaaggaacagattgagaaactgcgagaag

SEQ ID NO: 131494 - DNA, 36 bp, Artificial Sequence
  Description of Artificial Sequence: Synthetic oligonucleotide
gctgtaaggaacagattgagaaactgcgagaagtag

SEQ ID NO: 131495 - DNA, 38 bp, Artificial Sequence
  Description of Artificial Sequence: Synthetic oligonucleotide
ctgtaaggaacagattgagaaactgcgagaagtagttg

SEQ ID NO: 131496 - DNA, 41 bp, Artificial Sequence
  Description of Artificial Sequence: Synthetic oligonucleotide
tgtaaggaacagattgagaaactgcgagaagtagttgaaac

SEQ ID NO: 131497 - DNA, 40 bp, Artificial Sequence
  Description of Artificial Sequence: Synthetic oligonucleotide
gtaaggaacagattgagaaactgcgagaagtagttgaaac

SEQ ID NO: 131498 - DNA, 40 bp, Artificial Sequence
  Description of Artificial Sequence: Synthetic oligonucleotide
taaggaacagattgagaaactgcgagaagtagttgaaacc

SEQ ID NO: 131499 - DNA, 39 bp, Artificial Sequence
  Description of Artificial Sequence: Synthetic oligonucleotide
aaggaacagattgagaaactgcgagaagtagttgaaacc

SEQ ID NO: 131500 - DNA, 38 bp, Artificial Sequence
  Description of Artificial Sequence: Synthetic oligonucleotide
aggaacagattgagaaactgcgagaagtagttgaaacc

SEQ ID NO: 131501 - DNA, 37 bp, Artificial Sequence
  Description of Artificial Sequence: Synthetic oligonucleotide
ggaacagattgagaaactgcgagaagtagttgaaacc

SEQ ID NO: 131502 - DNA, 37 bp, Artificial Sequence
  Description of Artificial Sequence: Synthetic oligonucleotide
gaacagattgagaaactgcgagaagtagttgaaaccc

SEQ ID NO: 131503 - DNA, 37 bp, Artificial Sequence
  Description of Artificial Sequence: Synthetic oligonucleotide
aacagattgagaaactgcgagaagtagttgaaacccc

SEQ ID NO: 131504 - DNA, 36 bp, Artificial Sequence
  Description of Artificial Sequence: Synthetic oligonucleotide
acagattgagaaactgcgagaagtagttgaaacccc

SEQ ID NO: 131505 - DNA, 35 bp, Artificial Sequence
  Description of Artificial Sequence: Synthetic oligonucleotide
cagattgagaaactgcgagaagtagttgaaacccc

SEQ ID NO: 131506 - DNA, 39 bp, Artificial Sequence
  Description of Artificial Sequence: Synthetic oligonucleotide
agattgagaaactgcgagaagtagttgaaaccccattac

SEQ ID NO: 131507 - DNA, 38 bp, Artificial Sequence
  Description of Artificial Sequence: Synthetic oligonucleotide
gattgagaaactgcgagaagtagttgaaaccccattac

SEQ ID NO: 131508 - DNA, 40 bp, Artificial Sequence
  Description of Artificial Sequence: Synthetic oligonucleotide
attgagaaactgcgagaagtagttgaaaccccattacttc

SEQ ID NO: 131509 - DNA, 39 bp, Artificial Sequence
  Description of Artificial Sequence: Synthetic oligonucleotide
ttgagaaactgcgagaagtagttgaaaccccattacttc

SEQ ID NO: 131510 - DNA, 38 bp, Artificial Sequence
  Description of Artificial Sequence: Synthetic oligonucleotide
tgagaaactgcgagaagtagttgaaaccccattacttc

SEQ ID NO: 131511 - DNA, 37 bp, Artificial Sequence
  Description of Artificial Sequence: Synthetic oligonucleotide
gagaaactgcgagaagtagttgaaaccccattacttc

SEQ ID NO: 131512 - DNA, 39 bp, Artificial Sequence
  Description of Artificial Sequence: Synthetic oligonucleotide
agaaactgcgagaagtagttgaaaccccattacttcatc

SEQ ID NO: 131513 - DNA, 38 bp, Artificial Sequence
  Description of Artificial Sequence: Synthetic oligonucleotide
gaaactgcgagaagtagttgaaaccccattacttcatc

SEQ ID NO: 131514 - DNA, 38 bp, Artificial Sequence
  Description of Artificial Sequence: Synthetic oligonucleotide
aaactgcgagaagtagttgaaaccccattacttcatcc

SEQ ID NO: 131515 - DNA, 37 bp, Artificial Sequence
  Description of Artificial Sequence: Synthetic oligonucleotide
aactgcgagaagtagttgaaaccccattacttcatcc

SEQ ID NO: 131516 - DNA, 36 bp, Artificial Sequence
  Description of Artificial Sequence: Synthetic oligonucleotide
actgcgagaagtagttgaaaccccattacttcatcc

SEQ ID NO: 131517 - DNA, 35 bp, Artificial Sequence
  Description of Artificial Sequence: Synthetic oligonucleotide
ctgcgagaagtagttgaaaccccattacttcatcc

SEQ ID NO: 131518 - DNA, 36 bp, Artificial Sequence
  Description of Artificial Sequence: Synthetic oligonucleotide
tgcgagaagtagttgaaaccccattacttcatccag

SEQ ID NO: 131519 - DNA, 35 bp, Artificial Sequence
  Description of Artificial Sequence: Synthetic oligonucleotide
gcgagaagtagttgaaaccccattacttcatccag

SEQ ID NO: 131520 - DNA, 36 bp, Artificial Sequence
  Description of Artificial Sequence: Synthetic oligonucleotide
cgagaagtagttgaaaccccattacttcatccagag

SEQ ID NO: 131521 - DNA, 37 bp, Artificial Sequence
  Description of Artificial Sequence: Synthetic oligonucleotide
gagaagtagttgaaaccccattacttcatccagagag

SEQ ID NO: 131522 - DNA, 37 bp, Artificial Sequence
  Description of Artificial Sequence: Synthetic oligonucleotide
agaagtagttgaaaccccattacttcatccagagagg

SEQ ID NO: 131523 - DNA, 36 bp, Artificial Sequence
  Description of Artificial Sequence: Synthetic oligonucleotide
gaagtagttgaaaccccattacttcatccagagagg

SEQ ID NO: 131524 - DNA, 39 bp, Artificial Sequence
  Description of Artificial Sequence: Synthetic oligonucleotide
aagtagttgaaaccccattacttcatccagagaggtttg

SEQ ID NO: 131525 - DNA, 38 bp, Artificial Sequence
  Description of Artificial Sequence: Synthetic oligonucleotide
agtagttgaaaccccattacttcatccagagaggtttg

SEQ ID NO: 131526 - DNA, 37 bp, Artificial Sequence
  Description of Artificial Sequence: Synthetic oligonucleotide
gtagttgaaaccccattacttcatccagagaggtttg

SEQ ID NO: 131527 - DNA, 38 bp, Artificial Sequence
  Description of Artificial Sequence: Synthetic oligonucleotide
tagttgaaaccccattacttcatccagagaggtttgtg

SEQ ID NO: 131528 - DNA, 37 bp, Artificial Sequence
  Description of Artificial Sequence: Synthetic oligonucleotide
agttgaaaccccattacttcatccagagaggtttgtg

SEQ ID NO: 131529 - DNA, 36 bp, Artificial Sequence
  Description of Artificial Sequence: Synthetic oligonucleotide
gttgaaaccccattacttcatccagagaggtttgtg

SEQ ID NO: 131530 - DNA, 38 bp, Artificial Sequence
  Description of Artificial Sequence: Synthetic oligonucleotide
ttgaaaccccattacttcatccagagaggtttgtgaac

SEQ ID NO: 131531 - DNA, 37 bp, Artificial Sequence
  Description of Artificial Sequence: Synthetic oligonucleotide
tgaaaccccattacttcatccagagaggtttgtgaac

SEQ ID NO: 131532 - DNA, 36 bp, Artificial Sequence
  Description of Artificial Sequence: Synthetic oligonucleotide
gaaaccccattacttcatccagagaggtttgtgaac

SEQ ID NO: 131533 - DNA, 36 bp, Artificial Sequence
  Description of Artificial Sequence: Synthetic oligonucleotide
aaaccccattacttcatccagagaggtttgtgaacc

SEQ ID NO: 131534 - DNA, 35 bp, Artificial Sequence
  Description of Artificial Sequence: Synthetic oligonucleotide
aaccccattacttcatccagagaggtttgtgaacc

SEQ ID NO: 131535 - DNA, 34 bp, Artificial Sequence
  Description of Artificial Sequence: Synthetic oligonucleotide
accccattacttcatccagagaggtttgtgaacc

SEQ ID NO: 131536 - DNA, 33 bp, Artificial Sequence
  Description of Artificial Sequence: Synthetic oligonucleotide
ccccattacttcatccagagaggtttgtgaacc

SEQ ID NO: 131537 - DNA, 35 bp, Artificial Sequence
  Description of Artificial Sequence: Synthetic oligonucleotide
cccattacttcatccagagaggtttgtgaaccttg

SEQ ID NO: 131538 - DNA, 35 bp, Artificial Sequence
  Description of Artificial Sequence: Synthetic oligonucleotide
ccattacttcatccagagaggtttgtgaaccttgg

SEQ ID NO: 131539 - DNA, 35 bp, Artificial Sequence
  Description of Artificial Sequence: Synthetic oligonucleotide
cattacttcatccagagaggtttgtgaaccttggc

SEQ ID NO: 131540 - DNA, 38 bp, Artificial Sequence
  Description of Artificial Sequence: Synthetic oligonucleotide
attacttcatccagagaggtttgtgaaccttggcattg

SEQ ID NO: 131541 - DNA, 37 bp, Artificial Sequence
  Description of Artificial Sequence: Synthetic oligonucleotide
ttacttcatccagagaggtttgtgaaccttggcattg

SEQ ID NO: 131542 - DNA, 36 bp, Artificial Sequence
  Description of Artificial Sequence: Synthetic oligonucleotide
tacttcatccagagaggtttgtgaaccttggcattg

SEQ ID NO: 131543 - DNA, 35 bp, Artificial Sequence
  Description of Artificial Sequence: Synthetic oligonucleotide
acttcatccagagaggtttgtgaaccttggcattg

SEQ ID NO: 131544 - DNA, 34 bp, Artificial Sequence
  Description of Artificial Sequence: Synthetic oligonucleotide
cttcatccagagaggtttgtgaaccttggcattg

SEQ ID NO: 131545 - DNA, 35 bp, Artificial Sequence
  Description of Artificial Sequence: Synthetic oligonucleotide
ttcatccagagaggtttgtgaaccttggcattgag

SEQ ID NO: 131546 - DNA, 34 bp, Artificial Sequence
  Description of Artificial Sequence: Synthetic oligonucleotide
tcatccagagaggtttgtgaaccttggcattgag

SEQ ID NO: 131547 - DNA, 33 bp, Artificial Sequence
  Description of Artificial Sequence: Synthetic oligonucleotide
catccagagaggtttgtgaaccttggcattgag

SEQ ID NO: 131548 - DNA, 33 bp, Artificial Sequence
  Description of Artificial Sequence: Synthetic oligonucleotide
atccagagaggtttgtgaaccttggcattgagc

SEQ ID NO: 131549 - DNA, 32 bp, Artificial Sequence
  Description of Artificial Sequence: Synthetic oligonucleotide
tccagagaggtttgtgaaccttggcattgagc

SEQ ID NO: 131550 - DNA, 31 bp, Artificial Sequence
  Description of Artificial Sequence: Synthetic oligonucleotide
ccagagaggtttgtgaaccttggcattgagc

SEQ ID NO: 131551 - DNA, 31 bp, Artificial Sequence
  Description of Artificial Sequence: Synthetic oligonucleotide
cagagaggtttgtgaaccttggcattgagcc

SEQ ID NO: 131552 - DNA, 32 bp, Artificial Sequence
  Description of Artificial Sequence: Synthetic oligonucleotide
agagaggtttgtgaaccttggcattgagcctc

SEQ ID NO: 131553 - DNA, 31 bp, Artificial Sequence
  Description of Artificial Sequence: Synthetic oligonucleotide
gagaggtttgtgaaccttggcattgagcctc

SEQ ID NO: 131554 - DNA, 31 bp, Artificial Sequence
  Description of Artificial Sequence: Synthetic oligonucleotide
agaggtttgtgaaccttggcattgagcctcc

SEQ ID NO: 131555 - DNA, 30 bp, Artificial Sequence
  Description of Artificial Sequence: Synthetic oligonucleotide
gaggtttgtgaaccttggcattgagcctcc

SEQ ID NO: 131556 - DNA, 30 bp, Artificial Sequence
  Description of Artificial Sequence: Synthetic oligonucleotide
aggtttgtgaaccttggcattgagcctccc

SEQ ID NO: 131557 - DNA, 29 bp, Artificial Sequence
  Description of Artificial Sequence: Synthetic oligonucleotide
ggtttgtgaaccttggcattgagcctccc

SEQ ID NO: 131558 - DNA, 31 bp, Artificial Sequence
  Description of Artificial Sequence: Synthetic oligonucleotide
gtttgtgaaccttggcattgagcctcccaag

SEQ ID NO: 131559 - DNA, 31 bp, Artificial Sequence
  Description of Artificial Sequence: Synthetic oligonucleotide
tttgtgaaccttggcattgagcctcccaagg

SEQ ID NO: 131560 - DNA, 30 bp, Artificial Sequence
  Description of Artificial Sequence: Synthetic oligonucleotide
ttgtgaaccttggcattgagcctcccaagg

SEQ ID NO: 131561 - DNA, 29 bp, Artificial Sequence
  Description of Artificial Sequence: Synthetic oligonucleotide
tgtgaaccttggcattgagcctcccaagg

SEQ ID NO: 131562 - DNA, 28 bp, Artificial Sequence
  Description of Artificial Sequence: Synthetic oligonucleotide
gtgaaccttggcattgagcctcccaagg

SEQ ID NO: 131563 - DNA, 28 bp, Artificial Sequence
  Description of Artificial Sequence: Synthetic oligonucleotide
tgaaccttggcattgagcctcccaaggg

SEQ ID NO: 131564 - DNA, 27 bp, Artificial Sequence
  Description of Artificial Sequence: Synthetic oligonucleotide
gaaccttggcattgagcctcccaaggg

SEQ ID NO: 131565 - DNA, 27 bp, Artificial Sequence
  Description of Artificial Sequence: Synthetic oligonucleotide
aaccttggcattgagcctcccaagggc

SEQ ID NO: 131566 - DNA, 26 bp, Artificial Sequence
  Description of Artificial Sequence: Synthetic oligonucleotide
accttggcattgagcctcccaagggc

SEQ ID NO: 131567 - DNA, 25 bp, Artificial Sequence
  Description of Artificial Sequence: Synthetic oligonucleotide
ccttggcattgagcctcccaagggc

SEQ ID NO: 131568 - DNA, 26 bp, Artificial Sequence
  Description of Artificial Sequence: Synthetic oligonucleotide
cttggcattgagcctcccaagggcgt

SEQ ID NO: 131569 - DNA, 26 bp, Artificial Sequence
  Description of Artificial Sequence: Synthetic oligonucleotide
ttggcattgagcctcccaagggcgtg

SEQ ID NO: 131570 - DNA, 25 bp, Artificial Sequence
  Description of Artificial Sequence: Synthetic oligonucleotide
tggcattgagcctcccaagggcgtg

SEQ ID NO: 131571 - DNA, 24 bp, Artificial Sequence
  Description of Artificial Sequence: Synthetic oligonucleotide
ggcattgagcctcccaagggcgtg

SEQ ID NO: 131572 - DNA, 25 bp, Artificial Sequence
  Description of Artificial Sequence: Synthetic oligonucleotide
gcattgagcctcccaagggcgtgct

SEQ ID NO: 131573 - DNA, 25 bp, Artificial Sequence
  Description of Artificial Sequence: Synthetic oligonucleotide
cattgagcctcccaagggcgtgctg

SEQ ID NO: 131574 - DNA, 26 bp, Artificial Sequence
  Description of Artificial Sequence: Synthetic oligonucleotide
attgagcctcccaagggcgtgctgct

SEQ ID NO: 131575 - DNA, 25 bp, Artificial Sequence
  Description of Artificial Sequence: Synthetic oligonucleotide
ttgagcctcccaagggcgtgctgct

SEQ ID NO: 131576 - DNA, 24 bp, Artificial Sequence
  Description of Artificial Sequence: Synthetic oligonucleotide
tgagcctcccaagggcgtgctgct

SEQ ID NO: 131577 - DNA, 23 bp, Artificial Sequence
  Description of Artificial Sequence: Synthetic oligonucleotide
gagcctcccaagggcgtgctgct

SEQ ID NO: 131578 - DNA, 26 bp, Artificial Sequence
  Description of Artificial Sequence: Synthetic oligonucleotide
agcctcccaagggcgtgctgctcttt

SEQ ID NO: 131579 - DNA, 25 bp, Artificial Sequence
  Description of Artificial Sequence: Synthetic oligonucleotide
gcctcccaagggcgtgctgctcttt

SEQ ID NO: 131580 - DNA, 25 bp, Artificial Sequence
  Description of Artificial Sequence: Synthetic oligonucleotide
cctcccaagggcgtgctgctctttg

SEQ ID NO: 131581 - DNA, 26 bp, Artificial Sequence
  Description of Artificial Sequence: Synthetic oligonucleotide
ctcccaagggcgtgctgctctttggt

SEQ ID NO: 131582 - DNA, 26 bp, Artificial Sequence
  Description of Artificial Sequence: Synthetic oligonucleotide
tcccaagggcgtgctgctctttggtc

SEQ ID NO: 131583 - DNA, 25 bp, Artificial Sequence
  Description of Artificial Sequence: Synthetic oligonucleotide
cccaagggcgtgctgctctttggtc

SEQ ID NO: 131584 - DNA, 26 bp, Artificial Sequence
  Description of Artificial Sequence: Synthetic oligonucleotide
ccaagggcgtgctgctctttggtcca

SEQ ID NO: 131585 - DNA, 26 bp, Artificial Sequence
  Description of Artificial Sequence: Synthetic oligonucleotide
caagggcgtgctgctctttggtccac

SEQ ID NO: 131586 - DNA, 26 bp, Artificial Sequence
  Description of Artificial Sequence: Synthetic oligonucleotide
aagggcgtgctgctctttggtccacc

SEQ ID NO: 131587 - DNA, 25 bp, Artificial Sequence
  Description of Artificial Sequence: Synthetic oligonucleotide
agggcgtgctgctctttggtccacc

SEQ ID NO: 131588 - DNA, 24 bp, Artificial Sequence
  Description of Artificial Sequence: Synthetic oligonucleotide
gggcgtgctgctctttggtccacc

SEQ ID NO: 131589 - DNA, 24 bp, Artificial Sequence
  Description of Artificial Sequence: Synthetic oligonucleotide
ggcgtgctgctctttggtccaccc

SEQ ID NO: 131590 - DNA, 24 bp, Artificial Sequence
  Description of Artificial Sequence: Synthetic oligonucleotide
gcgtgctgctctttggtccacccg

SEQ ID NO: 131591 - DNA, 26 bp, Artificial Sequence
  Description of Artificial Sequence: Synthetic oligonucleotide
cgtgctgctctttggtccacccggta

SEQ ID NO: 131592 - DNA, 27 bp, Artificial Sequence
  Description of Artificial Sequence: Synthetic oligonucleotide
gtgctgctctttggtccacccggtaca

SEQ ID NO: 131593 - DNA, 27 bp, Artificial Sequence
  Description of Artificial Sequence: Synthetic oligonucleotide
tgctgctctttggtccacccggtacag

SEQ ID NO: 131594 - DNA, 26 bp, Artificial Sequence
  Description of Artificial Sequence: Synthetic oligonucleotide
gctgctctttggtccacccggtacag

SEQ ID NO: 131595 - DNA, 26 bp, Artificial Sequence
  Description of Artificial Sequence: Synthetic oligonucleotide
ctgctctttggtccacccggtacagg

SEQ ID NO: 131596 - DNA, 27 bp, Artificial Sequence
  Description of Artificial Sequence: Synthetic oligonucleotide
tgctctttggtccacccggtacaggca

SEQ ID NO: 131597 - DNA, 27 bp, Artificial Sequence
  Description of Artificial Sequence: Synthetic oligonucleotide
gctctttggtccacccggtacaggcaa

SEQ ID NO: 131598 - DNA, 27 bp, Artificial Sequence
  Description of Artificial Sequence: Synthetic oligonucleotide
ctctttggtccacccggtacaggcaag

SEQ ID NO: 131599 - DNA, 28 bp, Artificial Sequence
  Description of Artificial Sequence: Synthetic oligonucleotide
tctttggtccacccggtacaggcaagac

SEQ ID NO: 131600 - DNA, 27 bp, Artificial Sequence
  Description of Artificial Sequence: Synthetic oligonucleotide
ctttggtccacccggtacaggcaagac

SEQ ID NO: 131601 - DNA, 28 bp, Artificial Sequence
  Description of Artificial Sequence: Synthetic oligonucleotide
tttggtccacccggtacaggcaagacac

SEQ ID NO: 131602 - DNA, 27 bp, Artificial Sequence
  Description of Artificial Sequence: Synthetic oligonucleotide
ttggtccacccggtacaggcaagacac

SEQ ID NO: 131603 - DNA, 27 bp, Artificial Sequence
  Description of Artificial Sequence: Synthetic oligonucleotide
tggtccacccggtacaggcaagacact

SEQ ID NO: 131604 - DNA, 26 bp, Artificial Sequence
  Description of Artificial Sequence: Synthetic oligonucleotide
ggtccacccggtacaggcaagacact

SEQ ID NO: 131605 - DNA, 27 bp, Artificial Sequence
  Description of Artificial Sequence: Synthetic oligonucleotide
gtccacccggtacaggcaagacactct

SEQ ID NO: 131606 - DNA, 27 bp, Artificial Sequence
  Description of Artificial Sequence: Synthetic oligonucleotide
tccacccggtacaggcaagacactctg

SEQ ID NO: 131607 - DNA, 27 bp, Artificial Sequence
  Description of Artificial Sequence: Synthetic oligonucleotide
ccacccggtacaggcaagacactctgt

SEQ ID NO: 131608 - DNA, 27 bp, Artificial Sequence
  Description of Artificial Sequence: Synthetic oligonucleotide
cacccggtacaggcaagacactctgtg

SEQ ID NO: 131609 - DNA, 27 bp, Artificial Sequence
  Description of Artificial Sequence: Synthetic oligonucleotide
acccggtacaggcaagacactctgtgc

SEQ ID NO: 131610 - DNA, 26 bp, Artificial Sequence
  Description of Artificial Sequence: Synthetic oligonucleotide
cccggtacaggcaagacactctgtgc

SEQ ID NO: 131611 - DNA, 26 bp, Artificial Sequence
  Description of Artificial Sequence: Synthetic oligonucleotide
ccggtacaggcaagacactctgtgcg

SEQ ID NO: 131612 - DNA, 26 bp, Artificial Sequence
  Description of Artificial Sequence: Synthetic oligonucleotide
cggtacaggcaagacactctgtgcgc

SEQ ID NO: 131613 - DNA, 26 bp, Artificial Sequence
  Description of Artificial Sequence: Synthetic oligonucleotide
ggtacaggcaagacactctgtgcgcg

SEQ ID NO: 131614 - DNA, 26 bp, Artificial Sequence
  Description of Artificial Sequence: Synthetic oligonucleotide
gtacaggcaagacactctgtgcgcgg

SEQ ID NO: 131615 - DNA, 26 bp, Artificial Sequence
  Description of Artificial Sequence: Synthetic oligonucleotide
tacaggcaagacactctgtgcgcggg

SEQ ID NO: 131616 - DNA, 25 bp, Artificial Sequence
  Description of Artificial Sequence: Synthetic oligonucleotide
acaggcaagacactctgtgcgcggg

SEQ ID NO: 131617 - DNA, 24 bp, Artificial Sequence
  Description of Artificial Sequence: Synthetic oligonucleotide
caggcaagacactctgtgcgcggg

SEQ ID NO: 131618 - DNA, 25 bp, Artificial Sequence
  Description of Artificial Sequence: Synthetic oligonucleotide
aggcaagacactctgtgcgcgggca

SEQ ID NO: 131619 - DNA, 24 bp, Artificial Sequence
  Description of Artificial Sequence: Synthetic oligonucleotide
ggcaagacactctgtgcgcgggca

SEQ ID NO: 131620 - DNA, 26 bp, Artificial Sequence
  Description of Artificial Sequence: Synthetic oligonucleotide
gcaagacactctgtgcgcgggcagtt

SEQ ID NO: 131621 - DNA, 26 bp, Artificial Sequence
  Description of Artificial Sequence: Synthetic oligonucleotide
caagacactctgtgcgcgggcagttg

SEQ ID NO: 131622 - DNA, 27 bp, Artificial Sequence
  Description of Artificial Sequence: Synthetic oligonucleotide
aagacactctgtgcgcgggcagttgct

SEQ ID NO: 131623 - DNA, 27 bp, Artificial Sequence
  Description of Artificial Sequence: Synthetic oligonucleotide
agacactctgtgcgcgggcagttgcta

SEQ ID NO: 131624 - DNA, 27 bp, Artificial Sequence
  Description of Artificial Sequence: Synthetic oligonucleotide
gacactctgtgcgcgggcagttgctaa

SEQ ID NO: 131625 - DNA, 28 bp, Artificial Sequence
  Description of Artificial Sequence: Synthetic oligonucleotide
acactctgtgcgcgggcagttgctaatc

SEQ ID NO: 131626 - DNA, 27 bp, Artificial Sequence
  Description of Artificial Sequence: Synthetic oligonucleotide
cactctgtgcgcgggcagttgctaatc

SEQ ID NO: 131627 - DNA, 27 bp, Artificial Sequence
  Description of Artificial Sequence: Synthetic oligonucleotide
actctgtgcgcgggcagttgctaatcg

SEQ ID NO: 131628 - DNA, 26 bp, Artificial Sequence
  Description of Artificial Sequence: Synthetic oligonucleotide
ctctgtgcgcgggcagttgctaatcg

SEQ ID NO: 131629 - DNA, 27 bp, Artificial Sequence
  Description of Artificial Sequence: Synthetic oligonucleotide
tctgtgcgcgggcagttgctaatcgga

SEQ ID NO: 131630 - DNA, 26 bp, Artificial Sequence
  Description of Artificial Sequence: Synthetic oligonucleotide
ctgtgcgcgggcagttgctaatcgga

SEQ ID NO: 131631 - DNA, 27 bp, Artificial Sequence
  Description of Artificial Sequence: Synthetic oligonucleotide
tgtgcgcgggcagttgctaatcggact

SEQ ID NO: 131632 - DNA, 26 bp, Artificial Sequence
  Description of Artificial Sequence: Synthetic oligonucleotide
gtgcgcgggcagttgctaatcggact

SEQ ID NO: 131633 - DNA, 27 bp, Artificial Sequence
  Description of Artificial Sequence: Synthetic oligonucleotide
tgcgcgggcagttgctaatcggactga

SEQ ID NO: 131634 - DNA, 27 bp, Artificial Sequence
  Description of Artificial Sequence: Synthetic oligonucleotide
gcgcgggcagttgctaatcggactgat

SEQ ID NO: 131635 - DNA, 27 bp, Artificial Sequence
  Description of Artificial Sequence: Synthetic oligonucleotide
cgcgggcagttgctaatcggactgatg

SEQ ID NO: 131636 - DNA, 27 bp, Artificial Sequence
  Description of Artificial Sequence: Synthetic oligonucleotide
gcgggcagttgctaatcggactgatgc

SEQ ID NO: 131637 - DNA, 27 bp, Artificial Sequence
  Description of Artificial Sequence: Synthetic oligonucleotide
cgggcagttgctaatcggactgatgcg

SEQ ID NO: 131638 - DNA, 28 bp, Artificial Sequence
  Description of Artificial Sequence: Synthetic oligonucleotide
gggcagttgctaatcggactgatgcgtg

SEQ ID NO: 131639 - DNA, 28 bp, Artificial Sequence
  Description of Artificial Sequence: Synthetic oligonucleotide
ggcagttgctaatcggactgatgcgtgc

SEQ ID NO: 131640 - DNA, 30 bp, Artificial Sequence
  Description of Artificial Sequence: Synthetic oligonucleotide
gcagttgctaatcggactgatgcgtgcttc

SEQ ID NO: 131641 - DNA, 33 bp, Artificial Sequence
  Description of Artificial Sequence: Synthetic oligonucleotide
cagttgctaatcggactgatgcgtgcttcattc

SEQ ID NO: 131642 - DNA, 33 bp, Artificial Sequence
  Description of Artificial Sequence: Synthetic oligonucleotide
agttgctaatcggactgatgcgtgcttcattcg

SEQ ID NO: 131643 - DNA, 32 bp, Artificial Sequence
  Description of Artificial Sequence: Synthetic oligonucleotide
gttgctaatcggactgatgcgtgcttcattcg

SEQ ID NO: 131644 - DNA, 33 bp, Artificial Sequence
  Description of Artificial Sequence: Synthetic oligonucleotide
ttgctaatcggactgatgcgtgcttcattcgag

SEQ ID NO: 131645 - DNA, 32 bp, Artificial Sequence
  Description of Artificial Sequence: Synthetic oligonucleotide
tgctaatcggactgatgcgtgcttcattcgag

SEQ ID NO: 131646 - DNA, 31 bp, Artificial Sequence
  Description of Artificial Sequence: Synthetic oligonucleotide
gctaatcggactgatgcgtgcttcattcgag

SEQ ID NO: 131647 - DNA, 36 bp, Artificial Sequence
  Description of Artificial Sequence: Synthetic oligonucleotide
ctaatcggactgatgcgtgcttcattcgagttattg

SEQ ID NO: 131648 - DNA, 36 bp, Artificial Sequence
  Description of Artificial Sequence: Synthetic oligonucleotide
taatcggactgatgcgtgcttcattcgagttattgg

SEQ ID NO: 131649 - DNA, 35 bp, Artificial Sequence
  Description of Artificial Sequence: Synthetic oligonucleotide
aatcggactgatgcgtgcttcattcgagttattgg

SEQ ID NO: 131650 - DNA, 34 bp, Artificial Sequence
  Description of Artificial Sequence: Synthetic oligonucleotide
atcggactgatgcgtgcttcattcgagttattgg

SEQ ID NO: 131651 - DNA, 33 bp, Artificial Sequence
  Description of Artificial Sequence: Synthetic oligonucleotide
tcggactgatgcgtgcttcattcgagttattgg

SEQ ID NO: 131652 - DNA, 32 bp, Artificial Sequence
  Description of Artificial Sequence: Synthetic oligonucleotide
cggactgatgcgtgcttcattcgagttattgg

SEQ ID NO: 131653 - DNA, 34 bp, Artificial Sequence
  Description of Artificial Sequence: Synthetic oligonucleotide
ggactgatgcgtgcttcattcgagttattggatc

SEQ ID NO: 131654 - DNA, 35 bp, Artificial Sequence
  Description of Artificial Sequence: Synthetic oligonucleotide
gactgatgcgtgcttcattcgagttattggatctg

SEQ ID NO: 131655 - DNA, 36 bp, Artificial Sequence
  Description of Artificial Sequence: Synthetic oligonucleotide
actgatgcgtgcttcattcgagttattggatctgag

SEQ ID NO: 131656 - DNA, 35 bp, Artificial Sequence
  Description of Artificial Sequence: Synthetic oligonucleotide
ctgatgcgtgcttcattcgagttattggatctgag

SEQ ID NO: 131657 - DNA, 35 bp, Artificial Sequence
  Description of Artificial Sequence: Synthetic oligonucleotide
tgatgcgtgcttcattcgagttattggatctgagc

SEQ ID NO: 131658 - DNA, 34 bp, Artificial Sequence
  Description of Artificial Sequence: Synthetic oligonucleotide
gatgcgtgcttcattcgagttattggatctgagc

SEQ ID NO: 131659 - DNA, 36 bp, Artificial Sequence
  Description of Artificial Sequence: Synthetic oligonucleotide
atgcgtgcttcattcgagttattggatctgagcttg

SEQ ID NO: 131660 - DNA, 35 bp, Artificial Sequence
  Description of Artificial Sequence: Synthetic oligonucleotide
tgcgtgcttcattcgagttattggatctgagcttg

SEQ ID NO: 131661 - DNA, 34 bp, Artificial Sequence
  Description of Artificial Sequence: Synthetic oligonucleotide
gcgtgcttcattcgagttattggatctgagcttg

SEQ ID NO: 131662 - DNA, 36 bp, Artificial Sequence
  Description of Artificial Sequence: Synthetic oligonucleotide
cgtgcttcattcgagttattggatctgagcttgtac

SEQ ID NO: 131663 - DNA, 37 bp, Artificial Sequence
  Description of Artificial Sequence: Synthetic oligonucleotide
gtgcttcattcgagttattggatctgagcttgtacag

SEQ ID NO: 131664 - DNA, 42 bp, Artificial Sequence
  Description of Artificial Sequence: Synthetic oligonucleotide
tgcttcattcgagttattggatctgagcttgtacagaaatac

SEQ ID NO: 131665 - DNA, 41 bp, Artificial Sequence
  Description of Artificial Sequence: Synthetic oligonucleotide
gcttcattcgagttattggatctgagcttgtacagaaatac

SEQ ID NO: 131666 - DNA, 41 bp, Artificial Sequence
  Description of Artificial Sequence: Synthetic oligonucleotide
cttcattcgagttattggatctgagcttgtacagaaatacg

SEQ ID NO: 131667 - DNA, 42 bp, Artificial Sequence
  Description of Artificial Sequence: Synthetic oligonucleotide
ttcattcgagttattggatctgagcttgtacagaaatacgtc

SEQ ID NO: 131668 - DNA, 41 bp, Artificial Sequence
  Description of Artificial Sequence: Synthetic oligonucleotide
tcattcgagttattggatctgagcttgtacagaaatacgtc

SEQ ID NO: 131669 - DNA, 40 bp, Artificial Sequence
  Description of Artificial Sequence: Synthetic oligonucleotide
cattcgagttattggatctgagcttgtacagaaatacgtc

SEQ ID NO: 131670 - DNA, 40 bp, Artificial Sequence
  Description of Artificial Sequence: Synthetic oligonucleotide
attcgagttattggatctgagcttgtacagaaatacgtcg

SEQ ID NO: 131671 - DNA, 39 bp, Artificial Sequence
  Description of Artificial Sequence: Synthetic oligonucleotide
ttcgagttattggatctgagcttgtacagaaatacgtcg

SEQ ID NO: 131672 - DNA, 38 bp, Artificial Sequence
  Description of Artificial Sequence: Synthetic oligonucleotide
tcgagttattggatctgagcttgtacagaaatacgtcg

SEQ ID NO: 131673 - DNA, 37 bp, Artificial Sequence
  Description of Artificial Sequence: Synthetic oligonucleotide
cgagttattggatctgagcttgtacagaaatacgtcg

SEQ ID NO: 131674 - DNA, 37 bp, Artificial Sequence
  Description of Artificial Sequence: Synthetic oligonucleotide
gagttattggatctgagcttgtacagaaatacgtcgg

SEQ ID NO: 131675 - DNA, 38 bp, Artificial Sequence
  Description of Artificial Sequence: Synthetic oligonucleotide
agttattggatctgagcttgtacagaaatacgtcggtg

SEQ ID NO: 131676 - DNA, 37 bp, Artificial Sequence
  Description of Artificial Sequence: Synthetic oligonucleotide
gttattggatctgagcttgtacagaaatacgtcggtg

SEQ ID NO: 131677 - DNA, 38 bp, Artificial Sequence
  Description of Artificial Sequence: Synthetic oligonucleotide
ttattggatctgagcttgtacagaaatacgtcggtgag

SEQ ID NO: 131678 - DNA, 37 bp, Artificial Sequence
  Description of Artificial Sequence: Synthetic oligonucleotide
tattggatctgagcttgtacagaaatacgtcggtgag

SEQ ID NO: 131679 - DNA, 36 bp, Artificial Sequence
  Description of Artificial Sequence: Synthetic oligonucleotide
attggatctgagcttgtacagaaatacgtcggtgag

SEQ ID NO: 131680 - DNA, 35 bp, Artificial Sequence
  Description of Artificial Sequence: Synthetic oligonucleotide
ttggatctgagcttgtacagaaatacgtcggtgag

SEQ ID NO: 131681 - DNA, 34 bp, Artificial Sequence
  Description of Artificial Sequence: Synthetic oligonucleotide
tggatctgagcttgtacagaaatacgtcggtgag

SEQ ID NO: 131682 - DNA, 33 bp, Artificial Sequence
  Description of Artificial Sequence: Synthetic oligonucleotide
ggatctgagcttgtacagaaatacgtcggtgag

SEQ ID NO: 131683 - DNA, 33 bp, Artificial Sequence
  Description of Artificial Sequence: Synthetic oligonucleotide
gatctgagcttgtacagaaatacgtcggtgagg

SEQ ID NO: 131684 - DNA, 33 bp, Artificial Sequence
  Description of Artificial Sequence: Synthetic oligonucleotide
atctgagcttgtacagaaatacgtcggtgaggg

SEQ ID NO: 131685 - DNA, 32 bp, Artificial Sequence
  Description of Artificial Sequence: Synthetic oligonucleotide
tctgagcttgtacagaaatacgtcggtgaggg

SEQ ID NO: 131686 - DNA, 31 bp, Artificial Sequence
  Description of Artificial Sequence: Synthetic oligonucleotide
ctgagcttgtacagaaatacgtcggtgaggg

SEQ ID NO: 131687 - DNA, 31 bp, Artificial Sequence
  Description of Artificial Sequence: Synthetic oligonucleotide
tgagcttgtacagaaatacgtcggtgagggg

SEQ ID NO: 131688 - DNA, 30 bp, Artificial Sequence
  Description of Artificial Sequence: Synthetic oligonucleotide
gagcttgtacagaaatacgtcggtgagggg

SEQ ID NO: 131689 - DNA, 30 bp, Artificial Sequence
  Description of Artificial Sequence: Synthetic oligonucleotide
agcttgtacagaaatacgtcggtgaggggg

SEQ ID NO: 131690 - DNA, 29 bp, Artificial Sequence
  Description of Artificial Sequence: Synthetic oligonucleotide
gcttgtacagaaatacgtcggtgaggggg

SEQ ID NO: 131691 - DNA, 29 bp, Artificial Sequence
  Description of Artificial Sequence: Synthetic oligonucleotide
cttgtacagaaatacgtcggtgagggggc

SEQ ID NO: 131692 - DNA, 30 bp, Artificial Sequence
  Description of Artificial Sequence: Synthetic oligonucleotide
ttgtacagaaatacgtcggtgagggggctc

SEQ ID NO: 131693 - DNA, 29 bp, Artificial Sequence
  Description of Artificial Sequence: Synthetic oligonucleotide
tgtacagaaatacgtcggtgagggggctc

SEQ ID NO: 131694 - DNA, 28 bp, Artificial Sequence
  Description of Artificial Sequence: Synthetic oligonucleotide
gtacagaaatacgtcggtgagggggctc

SEQ ID NO: 131695 - DNA, 28 bp, Artificial Sequence
  Description of Artificial Sequence: Synthetic oligonucleotide
tacagaaatacgtcggtgagggggctcg

SEQ ID NO: 131696 - DNA, 27 bp, Artificial Sequence
  Description of Artificial Sequence: Synthetic oligonucleotide
acagaaatacgtcggtgagggggctcg

SEQ ID NO: 131697 - DNA, 27 bp, Artificial Sequence
  Description of Artificial Sequence: Synthetic oligonucleotide
cagaaatacgtcggtgagggggctcga

SEQ ID NO: 131698 - DNA, 29 bp, Artificial Sequence
  Description of Artificial Sequence: Synthetic oligonucleotide
agaaatacgtcggtgagggggctcgaatg

SEQ ID NO: 131699 - DNA, 28 bp, Artificial Sequence
  Description of Artificial Sequence: Synthetic oligonucleotide
gaaatacgtcggtgagggggctcgaatg

SEQ ID NO: 131700 - DNA, 28 bp, Artificial Sequence
  Description of Artificial Sequence: Synthetic oligonucleotide
aaatacgtcggtgagggggctcgaatgg

SEQ ID NO: 131701 - DNA, 27 bp, Artificial Sequence
  Description of Artificial Sequence: Synthetic oligonucleotide
aatacgtcggtgagggggctcgaatgg

SEQ ID NO: 131702 - DNA, 27 bp, Artificial Sequence
  Description of Artificial Sequence: Synthetic oligonucleotide
atacgtcggtgagggggctcgaatggt

SEQ ID NO: 131703 - DNA, 27 bp, Artificial Sequence
  Description of Artificial Sequence: Synthetic oligonucleotide
tacgtcggtgagggggctcgaatggtt

SEQ ID NO: 131704 - DNA, 26 bp, Artificial Sequence
  Description of Artificial Sequence: Synthetic oligonucleotide
acgtcggtgagggggctcgaatggtt

SEQ ID NO: 131705 - DNA, 25 bp, Artificial Sequence
  Description of Artificial Sequence: Synthetic oligonucleotide
cgtcggtgagggggctcgaatggtt

SEQ ID NO: 131706 - DNA, 25 bp, Artificial Sequence
  Description of Artificial Sequence: Synthetic oligonucleotide
gtcggtgagggggctcgaatggttc

SEQ ID NO: 131707 - DNA, 26 bp, Artificial Sequence
  Description of Artificial Sequence: Synthetic oligonucleotide
tcggtgagggggctcgaatggttcgt

SEQ ID NO: 131708 - DNA, 25 bp, Artificial Sequence
  Description of Artificial Sequence: Synthetic oligonucleotide
cggtgagggggctcgaatggttcgt

SEQ ID NO: 131709 - DNA, 27 bp, Artificial Sequence
  Description of Artificial Sequence: Synthetic oligonucleotide
ggtgagggggctcgaatggttcgtgaa

SEQ ID NO: 131710 - DNA, 27 bp, Artificial Sequence
  Description of Artificial Sequence: Synthetic oligonucleotide
gtgagggggctcgaatggttcgtgaac

SEQ ID NO: 131711 - DNA, 28 bp, Artificial Sequence
  Description of Artificial Sequence: Synthetic oligonucleotide
tgagggggctcgaatggttcgtgaactc

SEQ ID NO: 131712 - DNA, 27 bp, Artificial Sequence
  Description of Artificial Sequence: Synthetic oligonucleotide
gagggggctcgaatggttcgtgaactc

SEQ ID NO: 131713 - DNA, 30 bp, Artificial Sequence
  Description of Artificial Sequence: Synthetic oligonucleotide
agggggctcgaatggttcgtgaactctttg

SEQ ID NO: 131714 - DNA, 29 bp, Artificial Sequence
  Description of Artificial Sequence: Synthetic oligonucleotide
gggggctcgaatggttcgtgaactctttg

SEQ ID NO: 131715 - DNA, 33 bp, Artificial Sequence
  Description of Artificial Sequence: Synthetic oligonucleotide
ggggctcgaatggttcgtgaactctttgaaatg

SEQ ID NO: 131716 - DNA, 33 bp, Artificial Sequence
  Description of Artificial Sequence: Synthetic oligonucleotide
gggctcgaatggttcgtgaactctttgaaatgg

SEQ ID NO: 131717 - DNA, 33 bp, Artificial Sequence
  Description of Artificial Sequence: Synthetic oligonucleotide
ggctcgaatggttcgtgaactctttgaaatggc

SEQ ID NO: 131718 - DNA, 33 bp, Artificial Sequence
  Description of Artificial Sequence: Synthetic oligonucleotide
gctcgaatggttcgtgaactctttgaaatggcc

SEQ ID NO: 131719 - DNA, 34 bp, Artificial Sequence
  Description of Artificial Sequence: Synthetic oligonucleotide
ctcgaatggttcgtgaactctttgaaatggccag

SEQ ID NO: 131720 - DNA, 36 bp, Artificial Sequence
  Description of Artificial Sequence: Synthetic oligonucleotide
tcgaatggttcgtgaactctttgaaatggccagaac

SEQ ID NO: 131721 - DNA, 35 bp, Artificial Sequence
  Description of Artificial Sequence: Synthetic oligonucleotide
cgaatggttcgtgaactctttgaaatggccagaac

SEQ ID NO: 131722 - DNA, 42 bp, Artificial Sequence
  Description of Artificial Sequence: Synthetic oligonucleotide
gaatggttcgtgaactctttgaaatggccagaacaaaaaaag

SEQ ID NO: 131723 - DNA, 42 bp, Artificial Sequence
  Description of Artificial Sequence: Synthetic oligonucleotide
aatggttcgtgaactctttgaaatggccagaacaaaaaaagc

SEQ ID NO: 131724 - DNA, 41 bp, Artificial Sequence
  Description of Artificial Sequence: Synthetic oligonucleotide
atggttcgtgaactctttgaaatggccagaacaaaaaaagc

SEQ ID NO: 131725 - DNA, 40 bp, Artificial Sequence
  Description of Artificial Sequence: Synthetic oligonucleotide
tggttcgtgaactctttgaaatggccagaacaaaaaaagc

SEQ ID NO: 131726 - DNA, 39 bp, Artificial Sequence
  Description of Artificial Sequence: Synthetic oligonucleotide
ggttcgtgaactctttgaaatggccagaacaaaaaaagc

SEQ ID NO: 131727 - DNA, 39 bp, Artificial Sequence
  Description of Artificial Sequence: Synthetic oligonucleotide
gttcgtgaactctttgaaatggccagaacaaaaaaagcc

SEQ ID NO: 131728 - DNA, 40 bp, Artificial Sequence
  Description of Artificial Sequence: Synthetic oligonucleotide
ttcgtgaactctttgaaatggccagaacaaaaaaagcctg

SEQ ID NO: 131729 - DNA, 39 bp, Artificial Sequence
  Description of Artificial Sequence: Synthetic oligonucleotide
tcgtgaactctttgaaatggccagaacaaaaaaagcctg

SEQ ID NO: 131730 - DNA, 38 bp, Artificial Sequence
  Description of Artificial Sequence: Synthetic oligonucleotide
cgtgaactctttgaaatggccagaacaaaaaaagcctg

SEQ ID NO: 131731 - DNA, 38 bp, Artificial Sequence
  Description of Artificial Sequence: Synthetic oligonucleotide
gtgaactctttgaaatggccagaacaaaaaaagcctgc

SEQ ID NO: 131732 - DNA, 38 bp, Artificial Sequence
  Description of Artificial Sequence: Synthetic oligonucleotide
tgaactctttgaaatggccagaacaaaaaaagcctgcc

SEQ ID NO: 131733 - DNA, 37 bp, Artificial Sequence
  Description of Artificial Sequence: Synthetic oligonucleotide
gaactctttgaaatggccagaacaaaaaaagcctgcc

SEQ ID NO: 131734 - DNA, 41 bp, Artificial Sequence
  Description of Artificial Sequence: Synthetic oligonucleotide
aactctttgaaatggccagaacaaaaaaagcctgccttatc

SEQ ID NO: 131735 - DNA, 40 bp, Artificial Sequence
  Description of Artificial Sequence: Synthetic oligonucleotide
actctttgaaatggccagaacaaaaaaagcctgccttatc

SEQ ID NO: 131736 - DNA, 39 bp, Artificial Sequence
  Description of Artificial Sequence: Synthetic oligonucleotide
ctctttgaaatggccagaacaaaaaaagcctgccttatc

SEQ ID NO: 131737 - DNA, 41 bp, Artificial Sequence
  Description of Artificial Sequence: Synthetic oligonucleotide
tctttgaaatggccagaacaaaaaaagcctgccttatcttc

SEQ ID NO: 131738 - DNA, 40 bp, Artificial Sequence
  Description of Artificial Sequence: Synthetic oligonucleotide
ctttgaaatggccagaacaaaaaaagcctgccttatcttc

SEQ ID NO: 131739 - DNA, 43 bp, Artificial Sequence
  Description of Artificial Sequence: Synthetic oligonucleotide
tttgaaatggccagaacaaaaaaagcctgccttatcttctttg

SEQ ID NO: 131740 - DNA, 42 bp, Artificial Sequence
  Description of Artificial Sequence: Synthetic oligonucleotide
ttgaaatggccagaacaaaaaaagcctgccttatcttctttg

SEQ ID NO: 131741 - DNA, 41 bp, Artificial Sequence
  Description of Artificial Sequence: Synthetic oligonucleotide
tgaaatggccagaacaaaaaaagcctgccttatcttctttg

SEQ ID NO: 131742 - DNA, 40 bp, Artificial Sequence
  Description of Artificial Sequence: Synthetic oligonucleotide
gaaatggccagaacaaaaaaagcctgccttatcttctttg

SEQ ID NO: 131743 - DNA, 42 bp, Artificial Sequence
  Description of Artificial Sequence: Synthetic oligonucleotide
aaatggccagaacaaaaaaagcctgccttatcttctttgatg

SEQ ID NO: 131744 - DNA, 41 bp, Artificial Sequence
  Description of Artificial Sequence: Synthetic oligonucleotide
aatggccagaacaaaaaaagcctgccttatcttctttgatg

SEQ ID NO: 131745 - DNA, 40 bp, Artificial Sequence
  Description of Artificial Sequence: Synthetic oligonucleotide
atggccagaacaaaaaaagcctgccttatcttctttgatg

SEQ ID NO: 131746 - DNA, 39 bp, Artificial Sequence
  Description of Artificial Sequence: Synthetic oligonucleotide
tggccagaacaaaaaaagcctgccttatcttctttgatg

SEQ ID NO: 131747 - DNA, 38 bp, Artificial Sequence
  Description of Artificial Sequence: Synthetic oligonucleotide
ggccagaacaaaaaaagcctgccttatcttctttgatg

SEQ ID NO: 131748 - DNA, 43 bp, Artificial Sequence
  Description of Artificial Sequence: Synthetic oligonucleotide
gccagaacaaaaaaagcctgccttatcttctttgatgaaattg

SEQ ID NO: 131749 - DNA, 45 bp, Artificial Sequence
  Description of Artificial Sequence: Synthetic oligonucleotide
ccagaacaaaaaaagcctgccttatcttctttgatgaaattgatg

SEQ ID NO: 131750 - DNA, 45 bp, Artificial Sequence
  Description of Artificial Sequence: Synthetic oligonucleotide
cagaacaaaaaaagcctgccttatcttctttgatgaaattgatgc

SEQ ID NO: 131751 - DNA, 49 bp, Artificial Sequence
  Description of Artificial Sequence: Synthetic oligonucleotide
agaacaaaaaaagcctgccttatcttctttgatgaaattgatgctattg

SEQ ID NO: 131752 - DNA, 48 bp, Artificial Sequence
  Description of Artificial Sequence: Synthetic oligonucleotide
gaacaaaaaaagcctgccttatcttctttgatgaaattgatgctattg

SEQ ID NO: 131753 - DNA, 48 bp, Artificial Sequence
  Description of Artificial Sequence: Synthetic oligonucleotide
aacaaaaaaagcctgccttatcttctttgatgaaattgatgctattgg

SEQ ID NO: 131754 - DNA, 47 bp, Artificial Sequence
  Description of Artificial Sequence: Synthetic oligonucleotide
acaaaaaaagcctgccttatcttctttgatgaaattgatgctattgg

SEQ ID NO: 131755 - DNA, 46 bp, Artificial Sequence
  Description of Artificial Sequence: Synthetic oligonucleotide
caaaaaaagcctgccttatcttctttgatgaaattgatgctattgg

SEQ ID NO: 131756 - DNA, 47 bp, Artificial Sequence
  Description of Artificial Sequence: Synthetic oligonucleotide
aaaaaaagcctgccttatcttctttgatgaaattgatgctattggag

SEQ ID NO: 131757 - DNA, 46 bp, Artificial Sequence
  Description of Artificial Sequence: Synthetic oligonucleotide
aaaaaagcctgccttatcttctttgatgaaattgatgctattggag

SEQ ID NO: 131758 - DNA, 45 bp, Artificial Sequence
  Description of Artificial Sequence: Synthetic oligonucleotide
aaaaagcctgccttatcttctttgatgaaattgatgctattggag

SEQ ID NO: 131759 - DNA, 44 bp, Artificial Sequence
  Description of Artificial Sequence: Synthetic oligonucleotide
aaaagcctgccttatcttctttgatgaaattgatgctattggag

SEQ ID NO: 131760 - DNA, 43 bp, Artificial Sequence
  Description of Artificial Sequence: Synthetic oligonucleotide
aaagcctgccttatcttctttgatgaaattgatgctattggag

SEQ ID NO: 131761 - DNA, 42 bp, Artificial Sequence
  Description of Artificial Sequence: Synthetic oligonucleotide
aagcctgccttatcttctttgatgaaattgatgctattggag

SEQ ID NO: 131762 - DNA, 41 bp, Artificial Sequence
  Description of Artificial Sequence: Synthetic oligonucleotide
agcctgccttatcttctttgatgaaattgatgctattggag

SEQ ID NO: 131763 - DNA, 40 bp, Artificial Sequence
  Description of Artificial Sequence: Synthetic oligonucleotide
gcctgccttatcttctttgatgaaattgatgctattggag

SEQ ID NO: 131764 - DNA, 40 bp, Artificial Sequence
  Description of Artificial Sequence: Synthetic oligonucleotide
cctgccttatcttctttgatgaaattgatgctattggagg

SEQ ID NO: 131765 - DNA, 40 bp, Artificial Sequence
  Description of Artificial Sequence: Synthetic oligonucleotide
ctgccttatcttctttgatgaaattgatgctattggaggg

SEQ ID NO: 131766 - DNA, 40 bp, Artificial Sequence
  Description of Artificial Sequence: Synthetic oligonucleotide
tgccttatcttctttgatgaaattgatgctattggagggg

SEQ ID NO: 131767 - DNA, 39 bp, Artificial Sequence
  Description of Artificial Sequence: Synthetic oligonucleotide
gccttatcttctttgatgaaattgatgctattggagggg

SEQ ID NO: 131768 - DNA, 39 bp, Artificial Sequence
  Description of Artificial Sequence: Synthetic oligonucleotide
ccttatcttctttgatgaaattgatgctattggaggggc

SEQ ID NO: 131769 - DNA, 40 bp, Artificial Sequence
  Description of Artificial Sequence: Synthetic oligonucleotide
cttatcttctttgatgaaattgatgctattggaggggctc

SEQ ID NO: 131770 - DNA, 40 bp, Artificial Sequence
  Description of Artificial Sequence: Synthetic oligonucleotide
ttatcttctttgatgaaattgatgctattggaggggctcg

SEQ ID NO: 131771 - DNA, 39 bp, Artificial Sequence
  Description of Artificial Sequence: Synthetic oligonucleotide
tatcttctttgatgaaattgatgctattggaggggctcg

SEQ ID NO: 131772 - DNA, 38 bp, Artificial Sequence
  Description of Artificial Sequence: Synthetic oligonucleotide
atcttctttgatgaaattgatgctattggaggggctcg

SEQ ID NO: 131773 - DNA, 37 bp, Artificial Sequence
  Description of Artificial Sequence: Synthetic oligonucleotide
tcttctttgatgaaattgatgctattggaggggctcg

SEQ ID NO: 131774 - DNA, 36 bp, Artificial Sequence
  Description of Artificial Sequence: Synthetic oligonucleotide
cttctttgatgaaattgatgctattggaggggctcg

SEQ ID NO: 131775 - DNA, 40 bp, Artificial Sequence
  Description of Artificial Sequence: Synthetic oligonucleotide
ttctttgatgaaattgatgctattggaggggctcgttttg

SEQ ID NO: 131776 - DNA, 39 bp, Artificial Sequence
  Description of Artificial Sequence: Synthetic oligonucleotide
tctttgatgaaattgatgctattggaggggctcgttttg

SEQ ID NO: 131777 - DNA, 38 bp, Artificial Sequence
  Description of Artificial Sequence: Synthetic oligonucleotide
ctttgatgaaattgatgctattggaggggctcgttttg

SEQ ID NO: 131778 - DNA, 40 bp, Artificial Sequence
  Description of Artificial Sequence: Synthetic oligonucleotide
tttgatgaaattgatgctattggaggggctcgttttgatg

SEQ ID NO: 131779 - DNA, 39 bp, Artificial Sequence
  Description of Artificial Sequence: Synthetic oligonucleotide
ttgatgaaattgatgctattggaggggctcgttttgatg

SEQ ID NO: 131780 - DNA, 38 bp, Artificial Sequence
  Description of Artificial Sequence: Synthetic oligonucleotide
tgatgaaattgatgctattggaggggctcgttttgatg

SEQ ID NO: 131781 - DNA, 37 bp, Artificial Sequence
  Description of Artificial Sequence: Synthetic oligonucleotide
gatgaaattgatgctattggaggggctcgttttgatg

SEQ ID NO: 131782 - DNA, 39 bp, Artificial Sequence
  Description of Artificial Sequence: Synthetic oligonucleotide
atgaaattgatgctattggaggggctcgttttgatgatg

SEQ ID NO: 131783 - DNA, 38 bp, Artificial Sequence
  Description of Artificial Sequence: Synthetic oligonucleotide
tgaaattgatgctattggaggggctcgttttgatgatg

SEQ ID NO: 131784 - DNA, 37 bp, Artificial Sequence
  Description of Artificial Sequence: Synthetic oligonucleotide
gaaattgatgctattggaggggctcgttttgatgatg

SEQ ID NO: 131785 - DNA, 37 bp, Artificial Sequence
  Description of Artificial Sequence: Synthetic oligonucleotide
aaattgatgctattggaggggctcgttttgatgatgg

SEQ ID NO: 131786 - DNA, 36 bp, Artificial Sequence
  Description of Artificial Sequence: Synthetic oligonucleotide
aattgatgctattggaggggctcgttttgatgatgg

SEQ ID NO: 131787 - DNA, 35 bp, Artificial Sequence
  Description of Artificial Sequence: Synthetic oligonucleotide
attgatgctattggaggggctcgttttgatgatgg

SEQ ID NO: 131788 - DNA, 34 bp, Artificial Sequence
  Description of Artificial Sequence: Synthetic oligonucleotide
ttgatgctattggaggggctcgttttgatgatgg

SEQ ID NO: 131789 - DNA, 33 bp, Artificial Sequence
  Description of Artificial Sequence: Synthetic oligonucleotide
tgatgctattggaggggctcgttttgatgatgg

SEQ ID NO: 131790 - DNA, 32 bp, Artificial Sequence
  Description of Artificial Sequence: Synthetic oligonucleotide
gatgctattggaggggctcgttttgatgatgg

SEQ ID NO: 131791 - DNA, 33 bp, Artificial Sequence
  Description of Artificial Sequence: Synthetic oligonucleotide
atgctattggaggggctcgttttgatgatggtg

SEQ ID NO: 131792 - DNA, 32 bp, Artificial Sequence
  Description of Artificial Sequence: Synthetic oligonucleotide
tgctattggaggggctcgttttgatgatggtg

SEQ ID NO: 131793 - DNA, 31 bp, Artificial Sequence
  Description of Artificial Sequence: Synthetic oligonucleotide
gctattggaggggctcgttttgatgatggtg

SEQ ID NO: 131794 - DNA, 31 bp, Artificial Sequence
  Description of Artificial Sequence: Synthetic oligonucleotide
ctattggaggggctcgttttgatgatggtgc

SEQ ID NO: 131795 - DNA, 32 bp, Artificial Sequence
  Description of Artificial Sequence: Synthetic oligonucleotide
tattggaggggctcgttttgatgatggtgctg

SEQ ID NO: 131796 - DNA, 31 bp, Artificial Sequence
  Description of Artificial Sequence: Synthetic oligonucleotide
attggaggggctcgttttgatgatggtgctg

SEQ ID NO: 131797 - DNA, 30 bp, Artificial Sequence
  Description of Artificial Sequence: Synthetic oligonucleotide
ttggaggggctcgttttgatgatggtgctg

SEQ ID NO: 131798 - DNA, 29 bp, Artificial Sequence
  Description of Artificial Sequence: Synthetic oligonucleotide
tggaggggctcgttttgatgatggtgctg

SEQ ID NO: 131799 - DNA, 28 bp, Artificial Sequence
  Description of Artificial Sequence: Synthetic oligonucleotide
ggaggggctcgttttgatgatggtgctg

SEQ ID NO: 131800 - DNA, 28 bp, Artificial Sequence
  Description of Artificial Sequence: Synthetic oligonucleotide
gaggggctcgttttgatgatggtgctgg

SEQ ID NO: 131801 - DNA, 29 bp, Artificial Sequence
  Description of Artificial Sequence: Synthetic oligonucleotide
aggggctcgttttgatgatggtgctggag

SEQ ID NO: 131802 - DNA, 28 bp, Artificial Sequence
  Description of Artificial Sequence: Synthetic oligonucleotide
ggggctcgttttgatgatggtgctggag

SEQ ID NO: 131803 - DNA, 28 bp, Artificial Sequence
  Description of Artificial Sequence: Synthetic oligonucleotide
gggctcgttttgatgatggtgctggagg

SEQ ID NO: 131804 - DNA, 29 bp, Artificial Sequence
  Description of Artificial Sequence: Synthetic oligonucleotide
ggctcgttttgatgatggtgctggaggtg

SEQ ID NO: 131805 - DNA, 30 bp, Artificial Sequence
  Description of Artificial Sequence: Synthetic oligonucleotide
gctcgttttgatgatggtgctggaggtgac

SEQ ID NO: 131806 - DNA, 33 bp, Artificial Sequence
  Description of Artificial Sequence: Synthetic oligonucleotide
ctcgttttgatgatggtgctggaggtgacaatg

SEQ ID NO: 131807 - DNA, 35 bp, Artificial Sequence
  Description of Artificial Sequence: Synthetic oligonucleotide
tcgttttgatgatggtgctggaggtgacaatgaag

SEQ ID NO: 131808 - DNA, 34 bp, Artificial Sequence
  Description of Artificial Sequence: Synthetic oligonucleotide
cgttttgatgatggtgctggaggtgacaatgaag

SEQ ID NO: 131809 - DNA, 35 bp, Artificial Sequence
  Description of Artificial Sequence: Synthetic oligonucleotide
gttttgatgatggtgctggaggtgacaatgaagtg

SEQ ID NO: 131810 - DNA, 35 bp, Artificial Sequence
  Description of Artificial Sequence: Synthetic oligonucleotide
ttttgatgatggtgctggaggtgacaatgaagtgc

SEQ ID NO: 131811 - DNA, 34 bp, Artificial Sequence
  Description of Artificial Sequence: Synthetic oligonucleotide
tttgatgatggtgctggaggtgacaatgaagtgc

SEQ ID NO: 131812 - DNA, 33 bp, Artificial Sequence
  Description of Artificial Sequence: Synthetic oligonucleotide
ttgatgatggtgctggaggtgacaatgaagtgc

SEQ ID NO: 131813 - DNA, 32 bp, Artificial Sequence
  Description of Artificial Sequence: Synthetic oligonucleotide
tgatgatggtgctggaggtgacaatgaagtgc

SEQ ID NO: 131814 - DNA, 31 bp, Artificial Sequence
  Description of Artificial Sequence: Synthetic oligonucleotide
gatgatggtgctggaggtgacaatgaagtgc

SEQ ID NO: 131815 - DNA, 32 bp, Artificial Sequence
  Description of Artificial Sequence: Synthetic oligonucleotide
atgatggtgctggaggtgacaatgaagtgcag

SEQ ID NO: 131816 - DNA, 31 bp, Artificial Sequence
  Description of Artificial Sequence: Synthetic oligonucleotide
tgatggtgctggaggtgacaatgaagtgcag

SEQ ID NO: 131817 - DNA, 30 bp, Artificial Sequence
  Description of Artificial Sequence: Synthetic oligonucleotide
gatggtgctggaggtgacaatgaagtgcag

SEQ ID NO: 131818 - DNA, 31 bp, Artificial Sequence
  Description of Artificial Sequence: Synthetic oligonucleotide
atggtgctggaggtgacaatgaagtgcagag

SEQ ID NO: 131819 - DNA, 30 bp, Artificial Sequence
  Description of Artificial Sequence: Synthetic oligonucleotide
tggtgctggaggtgacaatgaagtgcagag

SEQ ID NO: 131820 - DNA, 29 bp, Artificial Sequence
  Description of Artificial Sequence: Synthetic oligonucleotide
ggtgctggaggtgacaatgaagtgcagag

SEQ ID NO: 131821 - DNA, 31 bp, Artificial Sequence
  Description of Artificial Sequence: Synthetic oligonucleotide
gtgctggaggtgacaatgaagtgcagagaac

SEQ ID NO: 131822 - DNA, 34 bp, Artificial Sequence
  Description of Artificial Sequence: Synthetic oligonucleotide
tgctggaggtgacaatgaagtgcagagaacaatg

SEQ ID NO: 131823 - DNA, 33 bp, Artificial Sequence
  Description of Artificial Sequence: Synthetic oligonucleotide
gctggaggtgacaatgaagtgcagagaacaatg

SEQ ID NO: 131824 - DNA, 35 bp, Artificial Sequence
  Description of Artificial Sequence: Synthetic oligonucleotide
ctggaggtgacaatgaagtgcagagaacaatgttg

SEQ ID NO: 131825 - DNA, 35 bp, Artificial Sequence
  Description of Artificial Sequence: Synthetic oligonucleotide
tggaggtgacaatgaagtgcagagaacaatgttgg

SEQ ID NO: 131826 - DNA, 34 bp, Artificial Sequence
  Description of Artificial Sequence: Synthetic oligonucleotide
ggaggtgacaatgaagtgcagagaacaatgttgg

SEQ ID NO: 131827 - DNA, 36 bp, Artificial Sequence
  Description of Artificial Sequence: Synthetic oligonucleotide
gaggtgacaatgaagtgcagagaacaatgttggaac

SEQ ID NO: 131828 - DNA, 37 bp, Artificial Sequence
  Description of Artificial Sequence: Synthetic oligonucleotide
aggtgacaatgaagtgcagagaacaatgttggaactg

SEQ ID NO: 131829 - DNA, 36 bp, Artificial Sequence
  Description of Artificial Sequence: Synthetic oligonucleotide
ggtgacaatgaagtgcagagaacaatgttggaactg

SEQ ID NO: 131830 - DNA, 38 bp, Artificial Sequence
  Description of Artificial Sequence: Synthetic oligonucleotide
gtgacaatgaagtgcagagaacaatgttggaactgatc

SEQ ID NO: 131831 - DNA, 41 bp, Artificial Sequence
  Description of Artificial Sequence: Synthetic oligonucleotide
tgacaatgaagtgcagagaacaatgttggaactgatcaatc

SEQ ID NO: 131832 - DNA, 40 bp, Artificial Sequence
  Description of Artificial Sequence: Synthetic oligonucleotide
gacaatgaagtgcagagaacaatgttggaactgatcaatc

SEQ ID NO: 131833 - DNA, 41 bp, Artificial Sequence
  Description of Artificial Sequence: Synthetic oligonucleotide
acaatgaagtgcagagaacaatgttggaactgatcaatcag

SEQ ID NO: 131834 - DNA, 40 bp, Artificial Sequence
  Description of Artificial Sequence: Synthetic oligonucleotide
caatgaagtgcagagaacaatgttggaactgatcaatcag

SEQ ID NO: 131835 - DNA, 40 bp, Artificial Sequence
  Description of Artificial Sequence: Synthetic oligonucleotide
aatgaagtgcagagaacaatgttggaactgatcaatcagc

SEQ ID NO: 131836 - DNA, 39 bp, Artificial Sequence
  Description of Artificial Sequence: Synthetic oligonucleotide
atgaagtgcagagaacaatgttggaactgatcaatcagc

SEQ ID NO: 131837 - DNA, 38 bp, Artificial Sequence
  Description of Artificial Sequence: Synthetic oligonucleotide
tgaagtgcagagaacaatgttggaactgatcaatcagc

SEQ ID NO: 131838 - DNA, 37 bp, Artificial Sequence
  Description of Artificial Sequence: Synthetic oligonucleotide
gaagtgcagagaacaatgttggaactgatcaatcagc

SEQ ID NO: 131839 - DNA, 39 bp, Artificial Sequence
  Description of Artificial Sequence: Synthetic oligonucleotide
aagtgcagagaacaatgttggaactgatcaatcagcttg

SEQ ID NO: 131840 - DNA, 38 bp, Artificial Sequence
  Description of Artificial Sequence: Synthetic oligonucleotide
agtgcagagaacaatgttggaactgatcaatcagcttg

SEQ ID NO: 131841 - DNA, 37 bp, Artificial Sequence
  Description of Artificial Sequence: Synthetic oligonucleotide
gtgcagagaacaatgttggaactgatcaatcagcttg

SEQ ID NO: 131842 - DNA, 39 bp, Artificial Sequence
  Description of Artificial Sequence: Synthetic oligonucleotide
tgcagagaacaatgttggaactgatcaatcagcttgatg

SEQ ID NO: 131843 - DNA, 38 bp, Artificial Sequence
  Description of Artificial Sequence: Synthetic oligonucleotide
gcagagaacaatgttggaactgatcaatcagcttgatg

SEQ ID NO: 131844 - DNA, 38 bp, Artificial Sequence
  Description of Artificial Sequence: Synthetic oligonucleotide
cagagaacaatgttggaactgatcaatcagcttgatgg

SEQ ID NO: 131845 - DNA, 42 bp, Artificial Sequence
  Description of Artificial Sequence: Synthetic oligonucleotide
agagaacaatgttggaactgatcaatcagcttgatggttttg

SEQ ID NO: 131846 - DNA, 41 bp, Artificial Sequence
  Description of Artificial Sequence: Synthetic oligonucleotide
gagaacaatgttggaactgatcaatcagcttgatggttttg

SEQ ID NO: 131847 - DNA, 43 bp, Artificial Sequence
  Description of Artificial Sequence: Synthetic oligonucleotide
agaacaatgttggaactgatcaatcagcttgatggttttgatc

SEQ ID NO: 131848 - DNA, 42 bp, Artificial Sequence
  Description of Artificial Sequence: Synthetic oligonucleotide
gaacaatgttggaactgatcaatcagcttgatggttttgatc

SEQ ID NO: 131849 - DNA, 42 bp, Artificial Sequence
  Description of Artificial Sequence: Synthetic oligonucleotide
aacaatgttggaactgatcaatcagcttgatggttttgatcc

SEQ ID NO: 131850 - DNA, 41 bp, Artificial Sequence
  Description of Artificial Sequence: Synthetic oligonucleotide
acaatgttggaactgatcaatcagcttgatggttttgatcc

SEQ ID NO: 131851 - DNA, 40 bp, Artificial Sequence
  Description of Artificial Sequence: Synthetic oligonucleotide
caatgttggaactgatcaatcagcttgatggttttgatcc

SEQ ID NO: 131852 - DNA, 41 bp, Artificial Sequence
  Description of Artificial Sequence: Synthetic oligonucleotide
aatgttggaactgatcaatcagcttgatggttttgatcctc

SEQ ID NO: 131853 - DNA, 40 bp, Artificial Sequence
  Description of Artificial Sequence: Synthetic oligonucleotide
atgttggaactgatcaatcagcttgatggttttgatcctc

SEQ ID NO: 131854 - DNA, 39 bp, Artificial Sequence
  Description of Artificial Sequence: Synthetic oligonucleotide
tgttggaactgatcaatcagcttgatggttttgatcctc

SEQ ID NO: 131855 - DNA, 38 bp, Artificial Sequence
  Description of Artificial Sequence: Synthetic oligonucleotide
gttggaactgatcaatcagcttgatggttttgatcctc

SEQ ID NO: 131856 - DNA, 38 bp, Artificial Sequence
  Description of Artificial Sequence: Synthetic oligonucleotide
ttggaactgatcaatcagcttgatggttttgatcctcg

SEQ ID NO: 131857 - DNA, 37 bp, Artificial Sequence
  Description of Artificial Sequence: Synthetic oligonucleotide
tggaactgatcaatcagcttgatggttttgatcctcg

SEQ ID NO: 131858 - DNA, 36 bp, Artificial Sequence
  Description of Artificial Sequence: Synthetic oligonucleotide
ggaactgatcaatcagcttgatggttttgatcctcg

SEQ ID NO: 131859 - DNA, 37 bp, Artificial Sequence
  Description of Artificial Sequence: Synthetic oligonucleotide
gaactgatcaatcagcttgatggttttgatcctcgag

SEQ ID NO: 131860 - DNA, 37 bp, Artificial Sequence
  Description of Artificial Sequence: Synthetic oligonucleotide
aactgatcaatcagcttgatggttttgatcctcgagg

SEQ ID NO: 131861 - DNA, 36 bp, Artificial Sequence
  Description of Artificial Sequence: Synthetic oligonucleotide
actgatcaatcagcttgatggttttgatcctcgagg

SEQ ID NO: 131862 - DNA, 35 bp, Artificial Sequence
  Description of Artificial Sequence: Synthetic oligonucleotide
ctgatcaatcagcttgatggttttgatcctcgagg

SEQ ID NO: 131863 - DNA, 35 bp, Artificial Sequence
  Description of Artificial Sequence: Synthetic oligonucleotide
tgatcaatcagcttgatggttttgatcctcgaggc

SEQ ID NO: 131864 - DNA, 34 bp, Artificial Sequence
  Description of Artificial Sequence: Synthetic oligonucleotide
gatcaatcagcttgatggttttgatcctcgaggc

SEQ ID NO: 131865 - DNA, 43 bp, Artificial Sequence
  Description of Artificial Sequence: Synthetic oligonucleotide
atcaatcagcttgatggttttgatcctcgaggcaatattaaag

SEQ ID NO: 131866 - DNA, 42 bp, Artificial Sequence
  Description of Artificial Sequence: Synthetic oligonucleotide
tcaatcagcttgatggttttgatcctcgaggcaatattaaag

SEQ ID NO: 131867 - DNA, 41 bp, Artificial Sequence
  Description of Artificial Sequence: Synthetic oligonucleotide
caatcagcttgatggttttgatcctcgaggcaatattaaag

SEQ ID NO: 131868 - DNA, 42 bp, Artificial Sequence
  Description of Artificial Sequence: Synthetic oligonucleotide
aatcagcttgatggttttgatcctcgaggcaatattaaagtg

SEQ ID NO: 131869 - DNA, 41 bp, Artificial Sequence
  Description of Artificial Sequence: Synthetic oligonucleotide
atcagcttgatggttttgatcctcgaggcaatattaaagtg

SEQ ID NO: 131870 - DNA, 40 bp, Artificial Sequence
  Description of Artificial Sequence: Synthetic oligonucleotide
tcagcttgatggttttgatcctcgaggcaatattaaagtg

SEQ ID NO: 131871 - DNA, 39 bp, Artificial Sequence
  Description of Artificial Sequence: Synthetic oligonucleotide
cagcttgatggttttgatcctcgaggcaatattaaagtg

SEQ ID NO: 131872 - DNA, 39 bp, Artificial Sequence
  Description of Artificial Sequence: Synthetic oligonucleotide
agcttgatggttttgatcctcgaggcaatattaaagtgc

SEQ ID NO: 131873 - DNA, 38 bp, Artificial Sequence
  Description of Artificial Sequence: Synthetic oligonucleotide
gcttgatggttttgatcctcgaggcaatattaaagtgc

SEQ ID NO: 131874 - DNA, 39 bp, Artificial Sequence
  Description of Artificial Sequence: Synthetic oligonucleotide
cttgatggttttgatcctcgaggcaatattaaagtgctg

SEQ ID NO: 131875 - DNA, 41 bp, Artificial Sequence
  Description of Artificial Sequence: Synthetic oligonucleotide
ttgatggttttgatcctcgaggcaatattaaagtgctgatg

SEQ ID NO: 131876 - DNA, 40 bp, Artificial Sequence
  Description of Artificial Sequence: Synthetic oligonucleotide
tgatggttttgatcctcgaggcaatattaaagtgctgatg

SEQ ID NO: 131877 - DNA, 39 bp, Artificial Sequence
  Description of Artificial Sequence: Synthetic oligonucleotide
gatggttttgatcctcgaggcaatattaaagtgctgatg

SEQ ID NO: 131878 - DNA, 39 bp, Artificial Sequence
  Description of Artificial Sequence: Synthetic oligonucleotide
atggttttgatcctcgaggcaatattaaagtgctgatgg

SEQ ID NO: 131879 - DNA, 38 bp, Artificial Sequence
  Description of Artificial Sequence: Synthetic oligonucleotide
tggttttgatcctcgaggcaatattaaagtgctgatgg

SEQ ID NO: 131880 - DNA, 37 bp, Artificial Sequence
  Description of Artificial Sequence: Synthetic oligonucleotide
ggttttgatcctcgaggcaatattaaagtgctgatgg

SEQ ID NO: 131881 - DNA, 37 bp, Artificial Sequence
  Description of Artificial Sequence: Synthetic oligonucleotide
gttttgatcctcgaggcaatattaaagtgctgatggc

SEQ ID NO: 131882 - DNA, 37 bp, Artificial Sequence
  Description of Artificial Sequence: Synthetic oligonucleotide
ttttgatcctcgaggcaatattaaagtgctgatggcc

SEQ ID NO: 131883 - DNA, 36 bp, Artificial Sequence
  Description of Artificial Sequence: Synthetic oligonucleotide
tttgatcctcgaggcaatattaaagtgctgatggcc

SEQ ID NO: 131884 - DNA, 35 bp, Artificial Sequence
  Description of Artificial Sequence: Synthetic oligonucleotide
ttgatcctcgaggcaatattaaagtgctgatggcc

SEQ ID NO: 131885 - DNA, 34 bp, Artificial Sequence
  Description of Artificial Sequence: Synthetic oligonucleotide
tgatcctcgaggcaatattaaagtgctgatggcc

SEQ ID NO: 131886 - DNA, 33 bp, Artificial Sequence
  Description of Artificial Sequence: Synthetic oligonucleotide
gatcctcgaggcaatattaaagtgctgatggcc

SEQ ID NO: 131887 - DNA, 34 bp, Artificial Sequence
  Description of Artificial Sequence: Synthetic oligonucleotide
atcctcgaggcaatattaaagtgctgatggccac

SEQ ID NO: 131888 - DNA, 33 bp, Artificial Sequence
  Description of Artificial Sequence: Synthetic oligonucleotide
tcctcgaggcaatattaaagtgctgatggccac

SEQ ID NO: 131889 - DNA, 32 bp, Artificial Sequence
  Description of Artificial Sequence: Synthetic oligonucleotide
cctcgaggcaatattaaagtgctgatggccac

SEQ ID NO: 131890 - DNA, 35 bp, Artificial Sequence
  Description of Artificial Sequence: Synthetic oligonucleotide
ctcgaggcaatattaaagtgctgatggccactaac

SEQ ID NO: 131891 - DNA, 36 bp, Artificial Sequence
  Description of Artificial Sequence: Synthetic oligonucleotide
tcgaggcaatattaaagtgctgatggccactaacag

SEQ ID NO: 131892 - DNA, 35 bp, Artificial Sequence
  Description of Artificial Sequence: Synthetic oligonucleotide
cgaggcaatattaaagtgctgatggccactaacag

SEQ ID NO: 131893 - DNA, 36 bp, Artificial Sequence
  Description of Artificial Sequence: Synthetic oligonucleotide
gaggcaatattaaagtgctgatggccactaacagac

SEQ ID NO: 131894 - DNA, 36 bp, Artificial Sequence
  Description of Artificial Sequence: Synthetic oligonucleotide
aggcaatattaaagtgctgatggccactaacagacc

SEQ ID NO: 131895 - DNA, 35 bp, Artificial Sequence
  Description of Artificial Sequence: Synthetic oligonucleotide
ggcaatattaaagtgctgatggccactaacagacc

SEQ ID NO: 131896 - DNA, 36 bp, Artificial Sequence
  Description of Artificial Sequence: Synthetic oligonucleotide
gcaatattaaagtgctgatggccactaacagacctg

SEQ ID NO: 131897 - DNA, 39 bp, Artificial Sequence
  Description of Artificial Sequence: Synthetic oligonucleotide
caatattaaagtgctgatggccactaacagacctgatac

SEQ ID NO: 131898 - DNA, 42 bp, Artificial Sequence
  Description of Artificial Sequence: Synthetic oligonucleotide
aatattaaagtgctgatggccactaacagacctgatactttg

SEQ ID NO: 131899 - DNA, 41 bp, Artificial Sequence
  Description of Artificial Sequence: Synthetic oligonucleotide
atattaaagtgctgatggccactaacagacctgatactttg

SEQ ID NO: 131900 - DNA, 40 bp, Artificial Sequence
  Description of Artificial Sequence: Synthetic oligonucleotide
tattaaagtgctgatggccactaacagacctgatactttg

SEQ ID NO: 131901 - DNA, 39 bp, Artificial Sequence
  Description of Artificial Sequence: Synthetic oligonucleotide
attaaagtgctgatggccactaacagacctgatactttg

SEQ ID NO: 131902 - DNA, 38 bp, Artificial Sequence
  Description of Artificial Sequence: Synthetic oligonucleotide
ttaaagtgctgatggccactaacagacctgatactttg

SEQ ID NO: 131903 - DNA, 37 bp, Artificial Sequence
  Description of Artificial Sequence: Synthetic oligonucleotide
taaagtgctgatggccactaacagacctgatactttg

SEQ ID NO: 131904 - DNA, 36 bp, Artificial Sequence
  Description of Artificial Sequence: Synthetic oligonucleotide
aaagtgctgatggccactaacagacctgatactttg

SEQ ID NO: 131905 - DNA, 35 bp, Artificial Sequence
  Description of Artificial Sequence: Synthetic oligonucleotide
aagtgctgatggccactaacagacctgatactttg

SEQ ID NO: 131906 - DNA, 34 bp, Artificial Sequence
  Description of Artificial Sequence: Synthetic oligonucleotide
agtgctgatggccactaacagacctgatactttg

SEQ ID NO: 131907 - DNA, 33 bp, Artificial Sequence
  Description of Artificial Sequence: Synthetic oligonucleotide
gtgctgatggccactaacagacctgatactttg

SEQ ID NO: 131908 - DNA, 33 bp, Artificial Sequence
  Description of Artificial Sequence: Synthetic oligonucleotide
tgctgatggccactaacagacctgatactttgg

SEQ ID NO: 131909 - DNA, 32 bp, Artificial Sequence
  Description of Artificial Sequence: Synthetic oligonucleotide
gctgatggccactaacagacctgatactttgg

SEQ ID NO: 131910 - DNA, 34 bp, Artificial Sequence
  Description of Artificial Sequence: Synthetic oligonucleotide
ctgatggccactaacagacctgatactttggatc

SEQ ID NO: 131911 - DNA, 34 bp, Artificial Sequence
  Description of Artificial Sequence: Synthetic oligonucleotide
tgatggccactaacagacctgatactttggatcc

SEQ ID NO: 131912 - DNA, 33 bp, Artificial Sequence
  Description of Artificial Sequence: Synthetic oligonucleotide
gatggccactaacagacctgatactttggatcc

SEQ ID NO: 131913 - DNA, 34 bp, Artificial Sequence
  Description of Artificial Sequence: Synthetic oligonucleotide
atggccactaacagacctgatactttggatccag

SEQ ID NO: 131914 - DNA, 33 bp, Artificial Sequence
  Description of Artificial Sequence: Synthetic oligonucleotide
tggccactaacagacctgatactttggatccag

SEQ ID NO: 131915 - DNA, 32 bp, Artificial Sequence
  Description of Artificial Sequence: Synthetic oligonucleotide
ggccactaacagacctgatactttggatccag

SEQ ID NO: 131916 - DNA, 32 bp, Artificial Sequence
  Description of Artificial Sequence: Synthetic oligonucleotide
gccactaacagacctgatactttggatccagc

SEQ ID NO: 131917 - DNA, 33 bp, Artificial Sequence
  Description of Artificial Sequence: Synthetic oligonucleotide
ccactaacagacctgatactttggatccagcac

SEQ ID NO: 131918 - DNA, 34 bp, Artificial Sequence
  Description of Artificial Sequence: Synthetic oligonucleotide
cactaacagacctgatactttggatccagcactg

SEQ ID NO: 131919 - DNA, 36 bp, Artificial Sequence
  Description of Artificial Sequence: Synthetic oligonucleotide
actaacagacctgatactttggatccagcactgatg

SEQ ID NO: 131920 - DNA, 35 bp, Artificial Sequence
  Description of Artificial Sequence: Synthetic oligonucleotide
ctaacagacctgatactttggatccagcactgatg

SEQ ID NO: 131921 - DNA, 36 bp, Artificial Sequence
  Description of Artificial Sequence: Synthetic oligonucleotide
taacagacctgatactttggatccagcactgatgag

SEQ ID NO: 131922 - DNA, 35 bp, Artificial Sequence
  Description of Artificial Sequence: Synthetic oligonucleotide
aacagacctgatactttggatccagcactgatgag

SEQ ID NO: 131923 - DNA, 34 bp, Artificial Sequence
  Description of Artificial Sequence: Synthetic oligonucleotide
acagacctgatactttggatccagcactgatgag

SEQ ID NO: 131924 - DNA, 33 bp, Artificial Sequence
  Description of Artificial Sequence: Synthetic oligonucleotide
cagacctgatactttggatccagcactgatgag

SEQ ID NO: 131925 - DNA, 33 bp, Artificial Sequence
  Description of Artificial Sequence: Synthetic oligonucleotide
agacctgatactttggatccagcactgatgagg

SEQ ID NO: 131926 - DNA, 32 bp, Artificial Sequence
  Description of Artificial Sequence: Synthetic oligonucleotide
gacctgatactttggatccagcactgatgagg

SEQ ID NO: 131927 - DNA, 32 bp, Artificial Sequence
  Description of Artificial Sequence: Synthetic oligonucleotide
acctgatactttggatccagcactgatgaggc

SEQ ID NO: 131928 - DNA, 31 bp, Artificial Sequence
  Description of Artificial Sequence: Synthetic oligonucleotide
cctgatactttggatccagcactgatgaggc

SEQ ID NO: 131929 - DNA, 31 bp, Artificial Sequence
  Description of Artificial Sequence: Synthetic oligonucleotide
ctgatactttggatccagcactgatgaggcc

SEQ ID NO: 131930 - DNA, 32 bp, Artificial Sequence
  Description of Artificial Sequence: Synthetic oligonucleotide
tgatactttggatccagcactgatgaggccag

SEQ ID NO: 131931 - DNA, 31 bp, Artificial Sequence
  Description of Artificial Sequence: Synthetic oligonucleotide
gatactttggatccagcactgatgaggccag

SEQ ID NO: 131932 - DNA, 31 bp, Artificial Sequence
  Description of Artificial Sequence: Synthetic oligonucleotide
atactttggatccagcactgatgaggccagg

SEQ ID NO: 131933 - DNA, 30 bp, Artificial Sequence
  Description of Artificial Sequence: Synthetic oligonucleotide
tactttggatccagcactgatgaggccagg

SEQ ID NO: 131934 - DNA, 29 bp, Artificial Sequence
  Description of Artificial Sequence: Synthetic oligonucleotide
actttggatccagcactgatgaggccagg

SEQ ID NO: 131935 - DNA, 28 bp, Artificial Sequence
  Description of Artificial Sequence: Synthetic oligonucleotide
ctttggatccagcactgatgaggccagg

SEQ ID NO: 131936 - DNA, 28 bp, Artificial Sequence
  Description of Artificial Sequence: Synthetic oligonucleotide
tttggatccagcactgatgaggccaggg

SEQ ID NO: 131937 - DNA, 27 bp, Artificial Sequence
  Description of Artificial Sequence: Synthetic oligonucleotide
ttggatccagcactgatgaggccaggg

SEQ ID NO: 131938 - DNA, 27 bp, Artificial Sequence
  Description of Artificial Sequence: Synthetic oligonucleotide
tggatccagcactgatgaggccaggga

SEQ ID NO: 131939 - DNA, 26 bp, Artificial Sequence
  Description of Artificial Sequence: Synthetic oligonucleotide
ggatccagcactgatgaggccaggga

SEQ ID NO: 131940 - DNA, 27 bp, Artificial Sequence
  Description of Artificial Sequence: Synthetic oligonucleotide
gatccagcactgatgaggccagggaga

SEQ ID NO: 131941 - DNA, 29 bp, Artificial Sequence
  Description of Artificial Sequence: Synthetic oligonucleotide
atccagcactgatgaggccagggagattg

SEQ ID NO: 131942 - DNA, 28 bp, Artificial Sequence
  Description of Artificial Sequence: Synthetic oligonucleotide
tccagcactgatgaggccagggagattg

SEQ ID NO: 131943 - DNA, 27 bp, Artificial Sequence
  Description of Artificial Sequence: Synthetic oligonucleotide
ccagcactgatgaggccagggagattg

SEQ ID NO: 131944 - DNA, 27 bp, Artificial Sequence
  Description of Artificial Sequence: Synthetic oligonucleotide
cagcactgatgaggccagggagattgg

SEQ ID NO: 131945 - DNA, 30 bp, Artificial Sequence
  Description of Artificial Sequence: Synthetic oligonucleotide
agcactgatgaggccagggagattggatag

SEQ ID NO: 131946 - DNA, 29 bp, Artificial Sequence
  Description of Artificial Sequence: Synthetic oligonucleotide
gcactgatgaggccagggagattggatag

SEQ ID NO: 131947 - DNA, 36 bp, Artificial Sequence
  Description of Artificial Sequence: Synthetic oligonucleotide
cactgatgaggccagggagattggatagaaaaattg

SEQ ID NO: 131948 - DNA, 42 bp, Artificial Sequence
  Description of Artificial Sequence: Synthetic oligonucleotide
actgatgaggccagggagattggatagaaaaattgaatttag

SEQ ID NO: 131949 - DNA, 41 bp, Artificial Sequence
  Description of Artificial Sequence: Synthetic oligonucleotide
ctgatgaggccagggagattggatagaaaaattgaatttag

SEQ ID NO: 131950 - DNA, 41 bp, Artificial Sequence
  Description of Artificial Sequence: Synthetic oligonucleotide
tgatgaggccagggagattggatagaaaaattgaatttagc

SEQ ID NO: 131951 - DNA, 40 bp, Artificial Sequence
  Description of Artificial Sequence: Synthetic oligonucleotide
gatgaggccagggagattggatagaaaaattgaatttagc

SEQ ID NO: 131952 - DNA, 42 bp, Artificial Sequence
  Description of Artificial Sequence: Synthetic oligonucleotide
atgaggccagggagattggatagaaaaattgaatttagcttg

SEQ ID NO: 131953 - DNA, 41 bp, Artificial Sequence
  Description of Artificial Sequence: Synthetic oligonucleotide
tgaggccagggagattggatagaaaaattgaatttagcttg

SEQ ID NO: 131954 - DNA, 40 bp, Artificial Sequence
  Description of Artificial Sequence: Synthetic oligonucleotide
gaggccagggagattggatagaaaaattgaatttagcttg

SEQ ID NO: 131955 - DNA, 40 bp, Artificial Sequence
  Description of Artificial Sequence: Synthetic oligonucleotide
aggccagggagattggatagaaaaattgaatttagcttgc

SEQ ID NO: 131956 - DNA, 39 bp, Artificial Sequence
  Description of Artificial Sequence: Synthetic oligonucleotide
ggccagggagattggatagaaaaattgaatttagcttgc

SEQ ID NO: 131957 - DNA, 39 bp, Artificial Sequence
  Description of Artificial Sequence: Synthetic oligonucleotide
gccagggagattggatagaaaaattgaatttagcttgcc

SEQ ID NO: 131958 - DNA, 39 bp, Artificial Sequence
  Description of Artificial Sequence: Synthetic oligonucleotide
ccagggagattggatagaaaaattgaatttagcttgccc

SEQ ID NO: 131959 - DNA, 39 bp, Artificial Sequence
  Description of Artificial Sequence: Synthetic oligonucleotide
cagggagattggatagaaaaattgaatttagcttgcccg

SEQ ID NO: 131960 - DNA, 41 bp, Artificial Sequence
  Description of Artificial Sequence: Synthetic oligonucleotide
agggagattggatagaaaaattgaatttagcttgcccgatc

SEQ ID NO: 131961 - DNA, 40 bp, Artificial Sequence
  Description of Artificial Sequence: Synthetic oligonucleotide
gggagattggatagaaaaattgaatttagcttgcccgatc

SEQ ID NO: 131962 - DNA, 42 bp, Artificial Sequence
  Description of Artificial Sequence: Synthetic oligonucleotide
ggagattggatagaaaaattgaatttagcttgcccgatctag

SEQ ID NO: 131963 - DNA, 43 bp, Artificial Sequence
  Description of Artificial Sequence: Synthetic oligonucleotide
gagattggatagaaaaattgaatttagcttgcccgatctagag

SEQ ID NO: 131964 - DNA, 43 bp, Artificial Sequence
  Description of Artificial Sequence: Synthetic oligonucleotide
agattggatagaaaaattgaatttagcttgcccgatctagagg

SEQ ID NO: 131965 - DNA, 42 bp, Artificial Sequence
  Description of Artificial Sequence: Synthetic oligonucleotide
gattggatagaaaaattgaatttagcttgcccgatctagagg

SEQ ID NO: 131966 - DNA, 42 bp, Artificial Sequence
  Description of Artificial Sequence: Synthetic oligonucleotide
attggatagaaaaattgaatttagcttgcccgatctagaggg

SEQ ID NO: 131967 - DNA, 41 bp, Artificial Sequence
  Description of Artificial Sequence: Synthetic oligonucleotide
ttggatagaaaaattgaatttagcttgcccgatctagaggg

SEQ ID NO: 131968 - DNA, 40 bp, Artificial Sequence
  Description of Artificial Sequence: Synthetic oligonucleotide
tggatagaaaaattgaatttagcttgcccgatctagaggg

SEQ ID NO: 131969 - DNA, 39 bp, Artificial Sequence
  Description of Artificial Sequence: Synthetic oligonucleotide
ggatagaaaaattgaatttagcttgcccgatctagaggg

SEQ ID NO: 131970 - DNA, 40 bp, Artificial Sequence
  Description of Artificial Sequence: Synthetic oligonucleotide
gatagaaaaattgaatttagcttgcccgatctagagggtc

SEQ ID NO: 131971 - DNA, 40 bp, Artificial Sequence
  Description of Artificial Sequence: Synthetic oligonucleotide
atagaaaaattgaatttagcttgcccgatctagagggtcg

SEQ ID NO: 131972 - DNA, 39 bp, Artificial Sequence
  Description of Artificial Sequence: Synthetic oligonucleotide
tagaaaaattgaatttagcttgcccgatctagagggtcg

SEQ ID NO: 131973 - DNA, 38 bp, Artificial Sequence
  Description of Artificial Sequence: Synthetic oligonucleotide
agaaaaattgaatttagcttgcccgatctagagggtcg

SEQ ID NO: 131974 - DNA, 37 bp, Artificial Sequence
  Description of Artificial Sequence: Synthetic oligonucleotide
gaaaaattgaatttagcttgcccgatctagagggtcg

SEQ ID NO: 131975 - DNA, 37 bp, Artificial Sequence
  Description of Artificial Sequence: Synthetic oligonucleotide
aaaaattgaatttagcttgcccgatctagagggtcgg

SEQ ID NO: 131976 - DNA, 36 bp, Artificial Sequence
  Description of Artificial Sequence: Synthetic oligonucleotide
aaaattgaatttagcttgcccgatctagagggtcgg

SEQ ID NO: 131977 - DNA, 35 bp, Artificial Sequence
  Description of Artificial Sequence: Synthetic oligonucleotide
aaattgaatttagcttgcccgatctagagggtcgg

SEQ ID NO: 131978 - DNA, 34 bp, Artificial Sequence
  Description of Artificial Sequence: Synthetic oligonucleotide
aattgaatttagcttgcccgatctagagggtcgg

SEQ ID NO: 131979 - DNA, 33 bp, Artificial Sequence
  Description of Artificial Sequence: Synthetic oligonucleotide
attgaatttagcttgcccgatctagagggtcgg

SEQ ID NO: 131980 - DNA, 32 bp, Artificial Sequence
  Description of Artificial Sequence: Synthetic oligonucleotide
ttgaatttagcttgcccgatctagagggtcgg

SEQ ID NO: 131981 - DNA, 31 bp, Artificial Sequence
  Description of Artificial Sequence: Synthetic oligonucleotide
tgaatttagcttgcccgatctagagggtcgg

SEQ ID NO: 131982 - DNA, 30 bp, Artificial Sequence
  Description of Artificial Sequence: Synthetic oligonucleotide
gaatttagcttgcccgatctagagggtcgg

SEQ ID NO: 131983 - DNA, 31 bp, Artificial Sequence
  Description of Artificial Sequence: Synthetic oligonucleotide
aatttagcttgcccgatctagagggtcggac

SEQ ID NO: 131984 - DNA, 30 bp, Artificial Sequence
  Description of Artificial Sequence: Synthetic oligonucleotide
atttagcttgcccgatctagagggtcggac

SEQ ID NO: 131985 - DNA, 29 bp, Artificial Sequence
  Description of Artificial Sequence: Synthetic oligonucleotide
tttagcttgcccgatctagagggtcggac

SEQ ID NO: 131986 - DNA, 28 bp, Artificial Sequence
  Description of Artificial Sequence: Synthetic oligonucleotide
ttagcttgcccgatctagagggtcggac

SEQ ID NO: 131987 - DNA, 27 bp, Artificial Sequence
  Description of Artificial Sequence: Synthetic oligonucleotide
tagcttgcccgatctagagggtcggac

SEQ ID NO: 131988 - DNA, 26 bp, Artificial Sequence
  Description of Artificial Sequence: Synthetic oligonucleotide
agcttgcccgatctagagggtcggac

SEQ ID NO: 131989 - DNA, 25 bp, Artificial Sequence
  Description of Artificial Sequence: Synthetic oligonucleotide
gcttgcccgatctagagggtcggac

SEQ ID NO: 131990 - DNA, 25 bp, Artificial Sequence
  Description of Artificial Sequence: Synthetic oligonucleotide
cttgcccgatctagagggtcggacc

SEQ ID NO: 131991 - DNA, 26 bp, Artificial Sequence
  Description of Artificial Sequence: Synthetic oligonucleotide
ttgcccgatctagagggtcggaccca

SEQ ID NO: 131992 - DNA, 25 bp, Artificial Sequence
  Description of Artificial Sequence: Synthetic oligonucleotide
tgcccgatctagagggtcggaccca

SEQ ID NO: 131993 - DNA, 24 bp, Artificial Sequence
  Description of Artificial Sequence: Synthetic oligonucleotide
gcccgatctagagggtcggaccca

SEQ ID NO: 131994 - DNA, 27 bp, Artificial Sequence
  Description of Artificial Sequence: Synthetic oligonucleotide
cccgatctagagggtcggacccacata

SEQ ID NO: 131995 - DNA, 32 bp, Artificial Sequence
  Description of Artificial Sequence: Synthetic oligonucleotide
ccgatctagagggtcggacccacatatttaag

SEQ ID NO: 131996 - DNA, 35 bp, Artificial Sequence
  Description of Artificial Sequence: Synthetic oligonucleotide
cgatctagagggtcggacccacatatttaagattc

SEQ ID NO: 131997 - DNA, 36 bp, Artificial Sequence
  Description of Artificial Sequence: Synthetic oligonucleotide
gatctagagggtcggacccacatatttaagattcac

SEQ ID NO: 131998 - DNA, 36 bp, Artificial Sequence
  Description of Artificial Sequence: Synthetic oligonucleotide
atctagagggtcggacccacatatttaagattcacg

SEQ ID NO: 131999 - DNA, 35 bp, Artificial Sequence
  Description of Artificial Sequence: Synthetic oligonucleotide
tctagagggtcggacccacatatttaagattcacg

SEQ ID NO: 132000 - DNA, 34 bp, Artificial Sequence
  Description of Artificial Sequence: Synthetic oligonucleotide
ctagagggtcggacccacatatttaagattcacg

SEQ ID NO: 132001 - DNA, 34 bp, Artificial Sequence
  Description of Artificial Sequence: Synthetic oligonucleotide
tagagggtcggacccacatatttaagattcacgc

SEQ ID NO: 132002 - DNA, 33 bp, Artificial Sequence
  Description of Artificial Sequence: Synthetic oligonucleotide
agagggtcggacccacatatttaagattcacgc

SEQ ID NO: 132003 - DNA, 32 bp, Artificial Sequence
  Description of Artificial Sequence: Synthetic oligonucleotide
gagggtcggacccacatatttaagattcacgc

SEQ ID NO: 132004 - DNA, 33 bp, Artificial Sequence
  Description of Artificial Sequence: Synthetic oligonucleotide
agggtcggacccacatatttaagattcacgctc

SEQ ID NO: 132005 - DNA, 32 bp, Artificial Sequence
  Description of Artificial Sequence: Synthetic oligonucleotide
gggtcggacccacatatttaagattcacgctc

SEQ ID NO: 132006 - DNA, 32 bp, Artificial Sequence
  Description of Artificial Sequence: Synthetic oligonucleotide
ggtcggacccacatatttaagattcacgctcg

SEQ ID NO: 132007 - DNA, 34 bp, Artificial Sequence
  Description of Artificial Sequence: Synthetic oligonucleotide
gtcggacccacatatttaagattcacgctcgttc

SEQ ID NO: 132008 - DNA, 37 bp, Artificial Sequence
  Description of Artificial Sequence: Synthetic oligonucleotide
tcggacccacatatttaagattcacgctcgttcaatg

SEQ ID NO: 132009 - DNA, 36 bp, Artificial Sequence
  Description of Artificial Sequence: Synthetic oligonucleotide
cggacccacatatttaagattcacgctcgttcaatg

SEQ ID NO: 132010 - DNA, 37 bp, Artificial Sequence
  Description of Artificial Sequence: Synthetic oligonucleotide
ggacccacatatttaagattcacgctcgttcaatgag

SEQ ID NO: 132011 - DNA, 38 bp, Artificial Sequence
  Description of Artificial Sequence: Synthetic oligonucleotide
gacccacatatttaagattcacgctcgttcaatgagtg

SEQ ID NO: 132012 - DNA, 40 bp, Artificial Sequence
  Description of Artificial Sequence: Synthetic oligonucleotide
acccacatatttaagattcacgctcgttcaatgagtgttg

SEQ ID NO: 132013 - DNA, 39 bp, Artificial Sequence
  Description of Artificial Sequence: Synthetic oligonucleotide
cccacatatttaagattcacgctcgttcaatgagtgttg

SEQ ID NO: 132014 - DNA, 42 bp, Artificial Sequence
  Description of Artificial Sequence: Synthetic oligonucleotide
ccacatatttaagattcacgctcgttcaatgagtgttgaaag

SEQ ID NO: 132015 - DNA, 43 bp, Artificial Sequence
  Description of Artificial Sequence: Synthetic oligonucleotide
cacatatttaagattcacgctcgttcaatgagtgttgaaagag

SEQ ID NO: 132016 - DNA, 47 bp, Artificial Sequence
  Description of Artificial Sequence: Synthetic oligonucleotide
acatatttaagattcacgctcgttcaatgagtgttgaaagagatatc

SEQ ID NO: 132017 - DNA, 46 bp, Artificial Sequence
  Description of Artificial Sequence: Synthetic oligonucleotide
catatttaagattcacgctcgttcaatgagtgttgaaagagatatc

SEQ ID NO: 132018 - DNA, 47 bp, Artificial Sequence
  Description of Artificial Sequence: Synthetic oligonucleotide
atatttaagattcacgctcgttcaatgagtgttgaaagagatatcag

SEQ ID NO: 132019 - DNA, 46 bp, Artificial Sequence
  Description of Artificial Sequence: Synthetic oligonucleotide
tatttaagattcacgctcgttcaatgagtgttgaaagagatatcag

SEQ ID NO: 132020 - DNA, 45 bp, Artificial Sequence
  Description of Artificial Sequence: Synthetic oligonucleotide
atttaagattcacgctcgttcaatgagtgttgaaagagatatcag

SEQ ID NO: 132021 - DNA, 44 bp, Artificial Sequence
  Description of Artificial Sequence: Synthetic oligonucleotide
tttaagattcacgctcgttcaatgagtgttgaaagagatatcag

SEQ ID NO: 132022 - DNA, 43 bp, Artificial Sequence
  Description of Artificial Sequence: Synthetic oligonucleotide
ttaagattcacgctcgttcaatgagtgttgaaagagatatcag

SEQ ID NO: 132023 - DNA, 42 bp, Artificial Sequence
  Description of Artificial Sequence: Synthetic oligonucleotide
taagattcacgctcgttcaatgagtgttgaaagagatatcag

SEQ ID NO: 132024 - DNA, 41 bp, Artificial Sequence
  Description of Artificial Sequence: Synthetic oligonucleotide
aagattcacgctcgttcaatgagtgttgaaagagatatcag

SEQ ID NO: 132025 - DNA, 40 bp, Artificial Sequence
  Description of Artificial Sequence: Synthetic oligonucleotide
agattcacgctcgttcaatgagtgttgaaagagatatcag

SEQ ID NO: 132026 - DNA, 39 bp, Artificial Sequence
  Description of Artificial Sequence: Synthetic oligonucleotide
gattcacgctcgttcaatgagtgttgaaagagatatcag

SEQ ID NO: 132027 - DNA, 43 bp, Artificial Sequence
  Description of Artificial Sequence: Synthetic oligonucleotide
attcacgctcgttcaatgagtgttgaaagagatatcagatttg

SEQ ID NO: 132028 - DNA, 42 bp, Artificial Sequence
  Description of Artificial Sequence: Synthetic oligonucleotide
ttcacgctcgttcaatgagtgttgaaagagatatcagatttg

SEQ ID NO: 132029 - DNA, 41 bp, Artificial Sequence
  Description of Artificial Sequence: Synthetic oligonucleotide
tcacgctcgttcaatgagtgttgaaagagatatcagatttg

SEQ ID NO: 132030 - DNA, 40 bp, Artificial Sequence
  Description of Artificial Sequence: Synthetic oligonucleotide
cacgctcgttcaatgagtgttgaaagagatatcagatttg

SEQ ID NO: 132031 - DNA, 42 bp, Artificial Sequence
  Description of Artificial Sequence: Synthetic oligonucleotide
acgctcgttcaatgagtgttgaaagagatatcagatttgaac

SEQ ID NO: 132032 - DNA, 41 bp, Artificial Sequence
  Description of Artificial Sequence: Synthetic oligonucleotide
cgctcgttcaatgagtgttgaaagagatatcagatttgaac

SEQ ID NO: 132033 - DNA, 42 bp, Artificial Sequence
  Description of Artificial Sequence: Synthetic oligonucleotide
gctcgttcaatgagtgttgaaagagatatcagatttgaactg

SEQ ID NO: 132034 - DNA, 45 bp, Artificial Sequence
  Description of Artificial Sequence: Synthetic oligonucleotide
ctcgttcaatgagtgttgaaagagatatcagatttgaactgttag

SEQ ID NO: 132035 - DNA, 45 bp, Artificial Sequence
  Description of Artificial Sequence: Synthetic oligonucleotide
tcgttcaatgagtgttgaaagagatatcagatttgaactgttagc

SEQ ID NO: 132036 - DNA, 44 bp, Artificial Sequence
  Description of Artificial Sequence: Synthetic oligonucleotide
cgttcaatgagtgttgaaagagatatcagatttgaactgttagc

SEQ ID NO: 132037 - DNA, 45 bp, Artificial Sequence
  Description of Artificial Sequence: Synthetic oligonucleotide
gttcaatgagtgttgaaagagatatcagatttgaactgttagcac

SEQ ID NO: 132038 - DNA, 45 bp, Artificial Sequence
  Description of Artificial Sequence: Synthetic oligonucleotide
ttcaatgagtgttgaaagagatatcagatttgaactgttagcacg

SEQ ID NO: 132039 - DNA, 44 bp, Artificial Sequence
  Description of Artificial Sequence: Synthetic oligonucleotide
tcaatgagtgttgaaagagatatcagatttgaactgttagcacg

SEQ ID NO: 132040 - DNA, 43 bp, Artificial Sequence
  Description of Artificial Sequence: Synthetic oligonucleotide
caatgagtgttgaaagagatatcagatttgaactgttagcacg

SEQ ID NO: 132041 - DNA, 44 bp, Artificial Sequence
  Description of Artificial Sequence: Synthetic oligonucleotide
aatgagtgttgaaagagatatcagatttgaactgttagcacgac

SEQ ID NO: 132042 - DNA, 43 bp, Artificial Sequence
  Description of Artificial Sequence: Synthetic oligonucleotide
atgagtgttgaaagagatatcagatttgaactgttagcacgac

SEQ ID NO: 132043 - DNA, 42 bp, Artificial Sequence
  Description of Artificial Sequence: Synthetic oligonucleotide
tgagtgttgaaagagatatcagatttgaactgttagcacgac

SEQ ID NO: 132044 - DNA, 41 bp, Artificial Sequence
  Description of Artificial Sequence: Synthetic oligonucleotide
gagtgttgaaagagatatcagatttgaactgttagcacgac

SEQ ID NO: 132045 - DNA, 42 bp, Artificial Sequence
  Description of Artificial Sequence: Synthetic oligonucleotide
agtgttgaaagagatatcagatttgaactgttagcacgactg

SEQ ID NO: 132046 - DNA, 41 bp, Artificial Sequence
  Description of Artificial Sequence: Synthetic oligonucleotide
gtgttgaaagagatatcagatttgaactgttagcacgactg

SEQ ID NO: 132047 - DNA, 42 bp, Artificial Sequence
  Description of Artificial Sequence: Synthetic oligonucleotide
tgttgaaagagatatcagatttgaactgttagcacgactgtg

SEQ ID NO: 132048 - DNA, 41 bp, Artificial Sequence
  Description of Artificial Sequence: Synthetic oligonucleotide
gttgaaagagatatcagatttgaactgttagcacgactgtg

SEQ ID NO: 132049 - DNA, 42 bp, Artificial Sequence
  Description of Artificial Sequence: Synthetic oligonucleotide
ttgaaagagatatcagatttgaactgttagcacgactgtgtc

SEQ ID NO: 132050 - DNA, 41 bp, Artificial Sequence
  Description of Artificial Sequence: Synthetic oligonucleotide
tgaaagagatatcagatttgaactgttagcacgactgtgtc

SEQ ID NO: 132051 - DNA, 40 bp, Artificial Sequence
  Description of Artificial Sequence: Synthetic oligonucleotide
gaaagagatatcagatttgaactgttagcacgactgtgtc

SEQ ID NO: 132052 - DNA, 40 bp, Artificial Sequence
  Description of Artificial Sequence: Synthetic oligonucleotide
aaagagatatcagatttgaactgttagcacgactgtgtcc

SEQ ID NO: 132053 - DNA, 39 bp, Artificial Sequence
  Description of Artificial Sequence: Synthetic oligonucleotide
aagagatatcagatttgaactgttagcacgactgtgtcc

SEQ ID NO: 132054 - DNA, 38 bp, Artificial Sequence
  Description of Artificial Sequence: Synthetic oligonucleotide
agagatatcagatttgaactgttagcacgactgtgtcc

SEQ ID NO: 132055 - DNA, 37 bp, Artificial Sequence
  Description of Artificial Sequence: Synthetic oligonucleotide
gagatatcagatttgaactgttagcacgactgtgtcc

SEQ ID NO: 132056 - DNA, 42 bp, Artificial Sequence
  Description of Artificial Sequence: Synthetic oligonucleotide
agatatcagatttgaactgttagcacgactgtgtccaaatag

SEQ ID NO: 132057 - DNA, 41 bp, Artificial Sequence
  Description of Artificial Sequence: Synthetic oligonucleotide
gatatcagatttgaactgttagcacgactgtgtccaaatag

SEQ ID NO: 132058 - DNA, 41 bp, Artificial Sequence
  Description of Artificial Sequence: Synthetic oligonucleotide
atatcagatttgaactgttagcacgactgtgtccaaatagc

SEQ ID NO: 132059 - DNA, 40 bp, Artificial Sequence
  Description of Artificial Sequence: Synthetic oligonucleotide
tatcagatttgaactgttagcacgactgtgtccaaatagc

SEQ ID NO: 132060 - DNA, 39 bp, Artificial Sequence
  Description of Artificial Sequence: Synthetic oligonucleotide
atcagatttgaactgttagcacgactgtgtccaaatagc

SEQ ID NO: 132061 - DNA, 38 bp, Artificial Sequence
  Description of Artificial Sequence: Synthetic oligonucleotide
tcagatttgaactgttagcacgactgtgtccaaatagc

SEQ ID NO: 132062 - DNA, 37 bp, Artificial Sequence
  Description of Artificial Sequence: Synthetic oligonucleotide
cagatttgaactgttagcacgactgtgtccaaatagc

SEQ ID NO: 132063 - DNA, 38 bp, Artificial Sequence
  Description of Artificial Sequence: Synthetic oligonucleotide
agatttgaactgttagcacgactgtgtccaaatagcac

SEQ ID NO: 132064 - DNA, 37 bp, Artificial Sequence
  Description of Artificial Sequence: Synthetic oligonucleotide
gatttgaactgttagcacgactgtgtccaaatagcac

SEQ ID NO: 132065 - DNA, 38 bp, Artificial Sequence
  Description of Artificial Sequence: Synthetic oligonucleotide
atttgaactgttagcacgactgtgtccaaatagcactg

SEQ ID NO: 132066 - DNA, 37 bp, Artificial Sequence
  Description of Artificial Sequence: Synthetic oligonucleotide
tttgaactgttagcacgactgtgtccaaatagcactg

SEQ ID NO: 132067 - DNA, 36 bp, Artificial Sequence
  Description of Artificial Sequence: Synthetic oligonucleotide
ttgaactgttagcacgactgtgtccaaatagcactg

SEQ ID NO: 132068 - DNA, 35 bp, Artificial Sequence
  Description of Artificial Sequence: Synthetic oligonucleotide
tgaactgttagcacgactgtgtccaaatagcactg

SEQ ID NO: 132069 - DNA, 34 bp, Artificial Sequence
  Description of Artificial Sequence: Synthetic oligonucleotide
gaactgttagcacgactgtgtccaaatagcactg

SEQ ID NO: 132070 - DNA, 34 bp, Artificial Sequence
  Description of Artificial Sequence: Synthetic oligonucleotide
aactgttagcacgactgtgtccaaatagcactgg

SEQ ID NO: 132071 - DNA, 33 bp, Artificial Sequence
  Description of Artificial Sequence: Synthetic oligonucleotide
actgttagcacgactgtgtccaaatagcactgg

SEQ ID NO: 132072 - DNA, 32 bp, Artificial Sequence
  Description of Artificial Sequence: Synthetic oligonucleotide
ctgttagcacgactgtgtccaaatagcactgg

SEQ ID NO: 132073 - DNA, 33 bp, Artificial Sequence
  Description of Artificial Sequence: Synthetic oligonucleotide
tgttagcacgactgtgtccaaatagcactggtg

SEQ ID NO: 132074 - DNA, 32 bp, Artificial Sequence
  Description of Artificial Sequence: Synthetic oligonucleotide
gttagcacgactgtgtccaaatagcactggtg

SEQ ID NO: 132075 - DNA, 32 bp, Artificial Sequence
  Description of Artificial Sequence: Synthetic oligonucleotide
ttagcacgactgtgtccaaatagcactggtgc

SEQ ID NO: 132076 - DNA, 31 bp, Artificial Sequence
  Description of Artificial Sequence: Synthetic oligonucleotide
tagcacgactgtgtccaaatagcactggtgc

SEQ ID NO: 132077 - DNA, 30 bp, Artificial Sequence
  Description of Artificial Sequence: Synthetic oligonucleotide
agcacgactgtgtccaaatagcactggtgc

SEQ ID NO: 132078 - DNA, 29 bp, Artificial Sequence
  Description of Artificial Sequence: Synthetic oligonucleotide
gcacgactgtgtccaaatagcactggtgc

SEQ ID NO: 132079 - DNA, 30 bp, Artificial Sequence
  Description of Artificial Sequence: Synthetic oligonucleotide
cacgactgtgtccaaatagcactggtgctg

SEQ ID NO: 132080 - DNA, 31 bp, Artificial Sequence
  Description of Artificial Sequence: Synthetic oligonucleotide
acgactgtgtccaaatagcactggtgctgag

SEQ ID NO: 132081 - DNA, 30 bp, Artificial Sequence
  Description of Artificial Sequence: Synthetic oligonucleotide
cgactgtgtccaaatagcactggtgctgag

SEQ ID NO: 132082 - DNA, 34 bp, Artificial Sequence
  Description of Artificial Sequence: Synthetic oligonucleotide
gactgtgtccaaatagcactggtgctgagattag

SEQ ID NO: 132083 - DNA, 36 bp, Artificial Sequence
  Description of Artificial Sequence: Synthetic oligonucleotide
actgtgtccaaatagcactggtgctgagattagaag

SEQ ID NO: 132084 - DNA, 35 bp, Artificial Sequence
  Description of Artificial Sequence: Synthetic oligonucleotide
ctgtgtccaaatagcactggtgctgagattagaag

SEQ ID NO: 132085 - DNA, 35 bp, Artificial Sequence
  Description of Artificial Sequence: Synthetic oligonucleotide
tgtgtccaaatagcactggtgctgagattagaagc

SEQ ID NO: 132086 - DNA, 34 bp, Artificial Sequence
  Description of Artificial Sequence: Synthetic oligonucleotide
gtgtccaaatagcactggtgctgagattagaagc

SEQ ID NO: 132087 - DNA, 34 bp, Artificial Sequence
  Description of Artificial Sequence: Synthetic oligonucleotide
tgtccaaatagcactggtgctgagattagaagcg

SEQ ID NO: 132088 - DNA, 33 bp, Artificial Sequence
  Description of Artificial Sequence: Synthetic oligonucleotide
gtccaaatagcactggtgctgagattagaagcg

SEQ ID NO: 132089 - DNA, 34 bp, Artificial Sequence
  Description of Artificial Sequence: Synthetic oligonucleotide
tccaaatagcactggtgctgagattagaagcgtc

SEQ ID NO: 132090 - DNA, 33 bp, Artificial Sequence
  Description of Artificial Sequence: Synthetic oligonucleotide
ccaaatagcactggtgctgagattagaagcgtc

SEQ ID NO: 132091 - DNA, 34 bp, Artificial Sequence
  Description of Artificial Sequence: Synthetic oligonucleotide
caaatagcactggtgctgagattagaagcgtctg

SEQ ID NO: 132092 - DNA, 34 bp, Artificial Sequence
  Description of Artificial Sequence: Synthetic oligonucleotide
aaatagcactggtgctgagattagaagcgtctgc

SEQ ID NO: 132093 - DNA, 33 bp, Artificial Sequence
  Description of Artificial Sequence: Synthetic oligonucleotide
aatagcactggtgctgagattagaagcgtctgc

SEQ ID NO: 132094 - DNA, 32 bp, Artificial Sequence
  Description of Artificial Sequence: Synthetic oligonucleotide
atagcactggtgctgagattagaagcgtctgc

SEQ ID NO: 132095 - DNA, 31 bp, Artificial Sequence
  Description of Artificial Sequence: Synthetic oligonucleotide
tagcactggtgctgagattagaagcgtctgc

SEQ ID NO: 132096 - DNA, 30 bp, Artificial Sequence
  Description of Artificial Sequence: Synthetic oligonucleotide
agcactggtgctgagattagaagcgtctgc

SEQ ID NO: 132097 - DNA, 29 bp, Artificial Sequence
  Description of Artificial Sequence: Synthetic oligonucleotide
gcactggtgctgagattagaagcgtctgc

SEQ ID NO: 132098 - DNA, 30 bp, Artificial Sequence
  Description of Artificial Sequence: Synthetic oligonucleotide
cactggtgctgagattagaagcgtctgcac

SEQ ID NO: 132099 - DNA, 31 bp, Artificial Sequence
  Description of Artificial Sequence: Synthetic oligonucleotide
actggtgctgagattagaagcgtctgcacag

SEQ ID NO: 132100 - DNA, 30 bp, Artificial Sequence
  Description of Artificial Sequence: Synthetic oligonucleotide
ctggtgctgagattagaagcgtctgcacag

SEQ ID NO: 132101 - DNA, 31 bp, Artificial Sequence
  Description of Artificial Sequence: Synthetic oligonucleotide
tggtgctgagattagaagcgtctgcacagag

SEQ ID NO: 132102 - DNA, 30 bp, Artificial Sequence
  Description of Artificial Sequence: Synthetic oligonucleotide
ggtgctgagattagaagcgtctgcacagag

SEQ ID NO: 132103 - DNA, 30 bp, Artificial Sequence
  Description of Artificial Sequence: Synthetic oligonucleotide
gtgctgagattagaagcgtctgcacagagg

SEQ ID NO: 132104 - DNA, 30 bp, Artificial Sequence
  Description of Artificial Sequence: Synthetic oligonucleotide
tgctgagattagaagcgtctgcacagaggc

SEQ ID NO: 132105 - DNA, 29 bp, Artificial Sequence
  Description of Artificial Sequence: Synthetic oligonucleotide
gctgagattagaagcgtctgcacagaggc

SEQ ID NO: 132106 - DNA, 30 bp, Artificial Sequence
  Description of Artificial Sequence: Synthetic oligonucleotide
ctgagattagaagcgtctgcacagaggctg

SEQ ID NO: 132107 - DNA, 30 bp, Artificial Sequence
  Description of Artificial Sequence: Synthetic oligonucleotide
tgagattagaagcgtctgcacagaggctgg

SEQ ID NO: 132108 - DNA, 29 bp, Artificial Sequence
  Description of Artificial Sequence: Synthetic oligonucleotide
gagattagaagcgtctgcacagaggctgg

SEQ ID NO: 132109 - DNA, 32 bp, Artificial Sequence
  Description of Artificial Sequence: Synthetic oligonucleotide
agattagaagcgtctgcacagaggctggtatg

SEQ ID NO: 132110 - DNA, 31 bp, Artificial Sequence
  Description of Artificial Sequence: Synthetic oligonucleotide
gattagaagcgtctgcacagaggctggtatg

SEQ ID NO: 132111 - DNA, 34 bp, Artificial Sequence
  Description of Artificial Sequence: Synthetic oligonucleotide
attagaagcgtctgcacagaggctggtatgtttg

SEQ ID NO: 132112 - DNA, 33 bp, Artificial Sequence
  Description of Artificial Sequence: Synthetic oligonucleotide
ttagaagcgtctgcacagaggctggtatgtttg

SEQ ID NO: 132113 - DNA, 32 bp, Artificial Sequence
  Description of Artificial Sequence: Synthetic oligonucleotide
tagaagcgtctgcacagaggctggtatgtttg

SEQ ID NO: 132114 - DNA, 31 bp, Artificial Sequence
  Description of Artificial Sequence: Synthetic oligonucleotide
agaagcgtctgcacagaggctggtatgtttg

SEQ ID NO: 132115 - DNA, 30 bp, Artificial Sequence
  Description of Artificial Sequence: Synthetic oligonucleotide
gaagcgtctgcacagaggctggtatgtttg

SEQ ID NO: 132116 - DNA, 30 bp, Artificial Sequence
  Description of Artificial Sequence: Synthetic oligonucleotide
aagcgtctgcacagaggctggtatgtttgc

SEQ ID NO: 132117 - DNA, 29 bp, Artificial Sequence
  Description of Artificial Sequence: Synthetic oligonucleotide
agcgtctgcacagaggctggtatgtttgc

SEQ ID NO: 132118 - DNA, 28 bp, Artificial Sequence
  Description of Artificial Sequence: Synthetic oligonucleotide
gcgtctgcacagaggctggtatgtttgc

SEQ ID NO: 132119 - DNA, 28 bp, Artificial Sequence
  Description of Artificial Sequence: Synthetic oligonucleotide
cgtctgcacagaggctggtatgtttgcc

SEQ ID NO: 132120 - DNA, 30 bp, Artificial Sequence
  Description of Artificial Sequence: Synthetic oligonucleotide
gtctgcacagaggctggtatgtttgccatc

SEQ ID NO: 132121 - DNA, 31 bp, Artificial Sequence
  Description of Artificial Sequence: Synthetic oligonucleotide
tctgcacagaggctggtatgtttgccatcag

SEQ ID NO: 132122 - DNA, 30 bp, Artificial Sequence
  Description of Artificial Sequence: Synthetic oligonucleotide
ctgcacagaggctggtatgtttgccatcag

SEQ ID NO: 132123 - DNA, 31 bp, Artificial Sequence
  Description of Artificial Sequence: Synthetic oligonucleotide
tgcacagaggctggtatgtttgccatcagag

SEQ ID NO: 132124 - DNA, 30 bp, Artificial Sequence
  Description of Artificial Sequence: Synthetic oligonucleotide
gcacagaggctggtatgtttgccatcagag

SEQ ID NO: 132125 - DNA, 30 bp, Artificial Sequence
  Description of Artificial Sequence: Synthetic oligonucleotide
cacagaggctggtatgtttgccatcagagc

SEQ ID NO: 132126 - DNA, 31 bp, Artificial Sequence
  Description of Artificial Sequence: Synthetic oligonucleotide
acagaggctggtatgtttgccatcagagcac

SEQ ID NO: 132127 - DNA, 30 bp, Artificial Sequence
  Description of Artificial Sequence: Synthetic oligonucleotide
cagaggctggtatgtttgccatcagagcac

SEQ ID NO: 132128 - DNA, 30 bp, Artificial Sequence
  Description of Artificial Sequence: Synthetic oligonucleotide
agaggctggtatgtttgccatcagagcacg

SEQ ID NO: 132129 - DNA, 29 bp, Artificial Sequence
  Description of Artificial Sequence: Synthetic oligonucleotide
gaggctggtatgtttgccatcagagcacg

SEQ ID NO: 132130 - DNA, 29 bp, Artificial Sequence
  Description of Artificial Sequence: Synthetic oligonucleotide
aggctggtatgtttgccatcagagcacgg

SEQ ID NO: 132131 - DNA, 28 bp, Artificial Sequence
  Description of Artificial Sequence: Synthetic oligonucleotide
ggctggtatgtttgccatcagagcacgg

SEQ ID NO: 132132 - DNA, 28 bp, Artificial Sequence
  Description of Artificial Sequence: Synthetic oligonucleotide
gctggtatgtttgccatcagagcacggc

SEQ ID NO: 132133 - DNA, 28 bp, Artificial Sequence
  Description of Artificial Sequence: Synthetic oligonucleotide
ctggtatgtttgccatcagagcacggcg

SEQ ID NO: 132134 - DNA, 35 bp, Artificial Sequence
  Description of Artificial Sequence: Synthetic oligonucleotide
tggtatgtttgccatcagagcacggcgaaaaattg

SEQ ID NO: 132135 - DNA, 34 bp, Artificial Sequence
  Description of Artificial Sequence: Synthetic oligonucleotide
ggtatgtttgccatcagagcacggcgaaaaattg

SEQ ID NO: 132136 - DNA, 34 bp, Artificial Sequence
  Description of Artificial Sequence: Synthetic oligonucleotide
gtatgtttgccatcagagcacggcgaaaaattgc

SEQ ID NO: 132137 - DNA, 36 bp, Artificial Sequence
  Description of Artificial Sequence: Synthetic oligonucleotide
tatgtttgccatcagagcacggcgaaaaattgctac

SEQ ID NO: 132138 - DNA, 35 bp, Artificial Sequence
  Description of Artificial Sequence: Synthetic oligonucleotide
atgtttgccatcagagcacggcgaaaaattgctac

SEQ ID NO: 132139 - DNA, 34 bp, Artificial Sequence
  Description of Artificial Sequence: Synthetic oligonucleotide
tgtttgccatcagagcacggcgaaaaattgctac

SEQ ID NO: 132140 - DNA, 33 bp, Artificial Sequence
  Description of Artificial Sequence: Synthetic oligonucleotide
gtttgccatcagagcacggcgaaaaattgctac

SEQ ID NO: 132141 - DNA, 33 bp, Artificial Sequence
  Description of Artificial Sequence: Synthetic oligonucleotide
tttgccatcagagcacggcgaaaaattgctacc

SEQ ID NO: 132142 - DNA, 32 bp, Artificial Sequence
  Description of Artificial Sequence: Synthetic oligonucleotide
ttgccatcagagcacggcgaaaaattgctacc

SEQ ID NO: 132143 - DNA, 31 bp, Artificial Sequence
  Description of Artificial Sequence: Synthetic oligonucleotide
tgccatcagagcacggcgaaaaattgctacc

SEQ ID NO: 132144 - DNA, 30 bp, Artificial Sequence
  Description of Artificial Sequence: Synthetic oligonucleotide
gccatcagagcacggcgaaaaattgctacc

SEQ ID NO: 132145 - DNA, 30 bp, Artificial Sequence
  Description of Artificial Sequence: Synthetic oligonucleotide
ccatcagagcacggcgaaaaattgctaccg

SEQ ID NO: 132146 - DNA, 31 bp, Artificial Sequence
  Description of Artificial Sequence: Synthetic oligonucleotide
catcagagcacggcgaaaaattgctaccgag

SEQ ID NO: 132147 - DNA, 33 bp, Artificial Sequence
  Description of Artificial Sequence: Synthetic oligonucleotide
atcagagcacggcgaaaaattgctaccgagaag

SEQ ID NO: 132148 - DNA, 32 bp, Artificial Sequence
  Description of Artificial Sequence: Synthetic oligonucleotide
tcagagcacggcgaaaaattgctaccgagaag

SEQ ID NO: 132149 - DNA, 31 bp, Artificial Sequence
  Description of Artificial Sequence: Synthetic oligonucleotide
cagagcacggcgaaaaattgctaccgagaag

SEQ ID NO: 132150 - DNA, 31 bp, Artificial Sequence
  Description of Artificial Sequence: Synthetic oligonucleotide
agagcacggcgaaaaattgctaccgagaagg

SEQ ID NO: 132151 - DNA, 30 bp, Artificial Sequence
  Description of Artificial Sequence: Synthetic oligonucleotide
gagcacggcgaaaaattgctaccgagaagg

SEQ ID NO: 132152 - DNA, 34 bp, Artificial Sequence
  Description of Artificial Sequence: Synthetic oligonucleotide
agcacggcgaaaaattgctaccgagaaggatttc

SEQ ID NO: 132153 - DNA, 33 bp, Artificial Sequence
  Description of Artificial Sequence: Synthetic oligonucleotide
gcacggcgaaaaattgctaccgagaaggatttc

SEQ ID NO: 132154 - DNA, 35 bp, Artificial Sequence
  Description of Artificial Sequence: Synthetic oligonucleotide
cacggcgaaaaattgctaccgagaaggatttcttg

SEQ ID NO: 132155 - DNA, 35 bp, Artificial Sequence
  Description of Artificial Sequence: Synthetic oligonucleotide
acggcgaaaaattgctaccgagaaggatttcttgg

SEQ ID NO: 132156 - DNA, 34 bp, Artificial Sequence
  Description of Artificial Sequence: Synthetic oligonucleotide
cggcgaaaaattgctaccgagaaggatttcttgg

SEQ ID NO: 132157 - DNA, 36 bp, Artificial Sequence
  Description of Artificial Sequence: Synthetic oligonucleotide
ggcgaaaaattgctaccgagaaggatttcttggaag

SEQ ID NO: 132158 - DNA, 36 bp, Artificial Sequence
  Description of Artificial Sequence: Synthetic oligonucleotide
gcgaaaaattgctaccgagaaggatttcttggaagc

SEQ ID NO: 132159 - DNA, 37 bp, Artificial Sequence
  Description of Artificial Sequence: Synthetic oligonucleotide
cgaaaaattgctaccgagaaggatttcttggaagctg

SEQ ID NO: 132160 - DNA, 44 bp, Artificial Sequence
  Description of Artificial Sequence: Synthetic oligonucleotide
gaaaaattgctaccgagaaggatttcttggaagctgtaaataag

SEQ ID NO: 132161 - DNA, 44 bp, Artificial Sequence
  Description of Artificial Sequence: Synthetic oligonucleotide
aaaaattgctaccgagaaggatttcttggaagctgtaaataagg

SEQ ID NO: 132162 - DNA, 43 bp, Artificial Sequence
  Description of Artificial Sequence: Synthetic oligonucleotide
aaaattgctaccgagaaggatttcttggaagctgtaaataagg

SEQ ID NO: 132163 - DNA, 42 bp, Artificial Sequence
  Description of Artificial Sequence: Synthetic oligonucleotide
aaattgctaccgagaaggatttcttggaagctgtaaataagg

SEQ ID NO: 132164 - DNA, 41 bp, Artificial Sequence
  Description of Artificial Sequence: Synthetic oligonucleotide
aattgctaccgagaaggatttcttggaagctgtaaataagg

SEQ ID NO: 132165 - DNA, 40 bp, Artificial Sequence
  Description of Artificial Sequence: Synthetic oligonucleotide
attgctaccgagaaggatttcttggaagctgtaaataagg

SEQ ID NO: 132166 - DNA, 39 bp, Artificial Sequence
  Description of Artificial Sequence: Synthetic oligonucleotide
ttgctaccgagaaggatttcttggaagctgtaaataagg

SEQ ID NO: 132167 - DNA, 38 bp, Artificial Sequence
  Description of Artificial Sequence: Synthetic oligonucleotide
tgctaccgagaaggatttcttggaagctgtaaataagg

SEQ ID NO: 132168 - DNA, 37 bp, Artificial Sequence
  Description of Artificial Sequence: Synthetic oligonucleotide
gctaccgagaaggatttcttggaagctgtaaataagg

SEQ ID NO: 132169 - DNA, 38 bp, Artificial Sequence
  Description of Artificial Sequence: Synthetic oligonucleotide
ctaccgagaaggatttcttggaagctgtaaataaggtc

SEQ ID NO: 132170 - DNA, 43 bp, Artificial Sequence
  Description of Artificial Sequence: Synthetic oligonucleotide
taccgagaaggatttcttggaagctgtaaataaggtcattaag

SEQ ID NO: 132171 - DNA, 42 bp, Artificial Sequence
  Description of Artificial Sequence: Synthetic oligonucleotide
accgagaaggatttcttggaagctgtaaataaggtcattaag

SEQ ID NO: 132172 - DNA, 41 bp, Artificial Sequence
  Description of Artificial Sequence: Synthetic oligonucleotide
ccgagaaggatttcttggaagctgtaaataaggtcattaag

SEQ ID NO: 132173 - DNA, 42 bp, Artificial Sequence
  Description of Artificial Sequence: Synthetic oligonucleotide
cgagaaggatttcttggaagctgtaaataaggtcattaagtc

SEQ ID NO: 132174 - DNA, 46 bp, Artificial Sequence
  Description of Artificial Sequence: Synthetic oligonucleotide
gagaaggatttcttggaagctgtaaataaggtcattaagtcttatg

SEQ ID NO: 132175 - DNA, 46 bp, Artificial Sequence
  Description of Artificial Sequence: Synthetic oligonucleotide
agaaggatttcttggaagctgtaaataaggtcattaagtcttatgc

SEQ ID NO: 132176 - DNA, 45 bp, Artificial Sequence
  Description of Artificial Sequence: Synthetic oligonucleotide
gaaggatttcttggaagctgtaaataaggtcattaagtcttatgc

SEQ ID NO: 132177 - DNA, 45 bp, Artificial Sequence
  Description of Artificial Sequence: Synthetic oligonucleotide
aaggatttcttggaagctgtaaataaggtcattaagtcttatgcc

SEQ ID NO: 132178 - DNA, 44 bp, Artificial Sequence
  Description of Artificial Sequence: Synthetic oligonucleotide
aggatttcttggaagctgtaaataaggtcattaagtcttatgcc

SEQ ID NO: 132179 - DNA, 43 bp, Artificial Sequence
  Description of Artificial Sequence: Synthetic oligonucleotide
ggatttcttggaagctgtaaataaggtcattaagtcttatgcc

SEQ ID NO: 132180 - DNA, 48 bp, Artificial Sequence
  Description of Artificial Sequence: Synthetic oligonucleotide
gatttcttggaagctgtaaataaggtcattaagtcttatgccaaattc

SEQ ID NO: 132181 - DNA, 49 bp, Artificial Sequence
  Description of Artificial Sequence: Synthetic oligonucleotide
atttcttggaagctgtaaataaggtcattaagtcttatgccaaattcag

SEQ ID NO: 132182 - DNA, 48 bp, Artificial Sequence
  Description of Artificial Sequence: Synthetic oligonucleotide
tttcttggaagctgtaaataaggtcattaagtcttatgccaaattcag

SEQ ID NO: 132183 - DNA, 47 bp, Artificial Sequence
  Description of Artificial Sequence: Synthetic oligonucleotide
ttcttggaagctgtaaataaggtcattaagtcttatgccaaattcag

SEQ ID NO: 132184 - DNA, 46 bp, Artificial Sequence
  Description of Artificial Sequence: Synthetic oligonucleotide
tcttggaagctgtaaataaggtcattaagtcttatgccaaattcag

SEQ ID NO: 132185 - DNA, 45 bp, Artificial Sequence
  Description of Artificial Sequence: Synthetic oligonucleotide
cttggaagctgtaaataaggtcattaagtcttatgccaaattcag

SEQ ID NO: 132186 - DNA, 46 bp, Artificial Sequence
  Description of Artificial Sequence: Synthetic oligonucleotide
ttggaagctgtaaataaggtcattaagtcttatgccaaattcagtg

SEQ ID NO: 132187 - DNA, 45 bp, Artificial Sequence
  Description of Artificial Sequence: Synthetic oligonucleotide
tggaagctgtaaataaggtcattaagtcttatgccaaattcagtg

SEQ ID NO: 132188 - DNA, 44 bp, Artificial Sequence
  Description of Artificial Sequence: Synthetic oligonucleotide
ggaagctgtaaataaggtcattaagtcttatgccaaattcagtg

SEQ ID NO: 132189 - DNA, 44 bp, Artificial Sequence
  Description of Artificial Sequence: Synthetic oligonucleotide
gaagctgtaaataaggtcattaagtcttatgccaaattcagtgc

SEQ ID NO: 132190 - DNA, 46 bp, Artificial Sequence
  Description of Artificial Sequence: Synthetic oligonucleotide
aagctgtaaataaggtcattaagtcttatgccaaattcagtgctac

SEQ ID NO: 132191 - DNA, 45 bp, Artificial Sequence
  Description of Artificial Sequence: Synthetic oligonucleotide
agctgtaaataaggtcattaagtcttatgccaaattcagtgctac

SEQ ID NO: 132192 - DNA, 44 bp, Artificial Sequence
  Description of Artificial Sequence: Synthetic oligonucleotide
gctgtaaataaggtcattaagtcttatgccaaattcagtgctac

SEQ ID NO: 132193 - DNA, 45 bp, Artificial Sequence
  Description of Artificial Sequence: Synthetic oligonucleotide
ctgtaaataaggtcattaagtcttatgccaaattcagtgctactc

SEQ ID NO: 132194 - DNA, 45 bp, Artificial Sequence
  Description of Artificial Sequence: Synthetic oligonucleotide
tgtaaataaggtcattaagtcttatgccaaattcagtgctactcc

SEQ ID NO: 132195 - DNA, 44 bp, Artificial Sequence
  Description of Artificial Sequence: Synthetic oligonucleotide
gtaaataaggtcattaagtcttatgccaaattcagtgctactcc

SEQ ID NO: 132196 - DNA, 45 bp, Artificial Sequence
  Description of Artificial Sequence: Synthetic oligonucleotide
taaataaggtcattaagtcttatgccaaattcagtgctactcctc

SEQ ID NO: 132197 - DNA, 44 bp, Artificial Sequence
  Description of Artificial Sequence: Synthetic oligonucleotide
aaataaggtcattaagtcttatgccaaattcagtgctactcctc

SEQ ID NO: 132198 - DNA, 43 bp, Artificial Sequence
  Description of Artificial Sequence: Synthetic oligonucleotide
aataaggtcattaagtcttatgccaaattcagtgctactcctc

SEQ ID NO: 132199 - DNA, 42 bp, Artificial Sequence
  Description of Artificial Sequence: Synthetic oligonucleotide
ataaggtcattaagtcttatgccaaattcagtgctactcctc

SEQ ID NO: 132200 - DNA, 41 bp, Artificial Sequence
  Description of Artificial Sequence: Synthetic oligonucleotide
taaggtcattaagtcttatgccaaattcagtgctactcctc

SEQ ID NO: 132201 - DNA, 40 bp, Artificial Sequence
  Description of Artificial Sequence: Synthetic oligonucleotide
aaggtcattaagtcttatgccaaattcagtgctactcctc

SEQ ID NO: 132202 - DNA, 39 bp, Artificial Sequence
  Description of Artificial Sequence: Synthetic oligonucleotide
aggtcattaagtcttatgccaaattcagtgctactcctc

SEQ ID NO: 132203 - DNA, 38 bp, Artificial Sequence
  Description of Artificial Sequence: Synthetic oligonucleotide
ggtcattaagtcttatgccaaattcagtgctactcctc

SEQ ID NO: 132204 - DNA, 38 bp, Artificial Sequence
  Description of Artificial Sequence: Synthetic oligonucleotide
gtcattaagtcttatgccaaattcagtgctactcctcg

SEQ ID NO: 132205 - DNA, 41 bp, Artificial Sequence
  Description of Artificial Sequence: Synthetic oligonucleotide
tcattaagtcttatgccaaattcagtgctactcctcgttac

SEQ ID NO: 132206 - DNA, 40 bp, Artificial Sequence
  Description of Artificial Sequence: Synthetic oligonucleotide
cattaagtcttatgccaaattcagtgctactcctcgttac

SEQ ID NO: 132207 - DNA, 42 bp, Artificial Sequence
  Description of Artificial Sequence: Synthetic oligonucleotide
attaagtcttatgccaaattcagtgctactcctcgttacatg

SEQ ID NO: 132208 - DNA, 41 bp, Artificial Sequence
  Description of Artificial Sequence: Synthetic oligonucleotide
ttaagtcttatgccaaattcagtgctactcctcgttacatg

SEQ ID NO: 132209 - DNA, 40 bp, Artificial Sequence
  Description of Artificial Sequence: Synthetic oligonucleotide
taagtcttatgccaaattcagtgctactcctcgttacatg

SEQ ID NO: 132210 - DNA, 39 bp, Artificial Sequence
  Description of Artificial Sequence: Synthetic oligonucleotide
aagtcttatgccaaattcagtgctactcctcgttacatg

SEQ ID NO: 132211 - DNA, 38 bp, Artificial Sequence
  Description of Artificial Sequence: Synthetic oligonucleotide
agtcttatgccaaattcagtgctactcctcgttacatg

SEQ ID NO: 132212 - DNA, 37 bp, Artificial Sequence
  Description of Artificial Sequence: Synthetic oligonucleotide
gtcttatgccaaattcagtgctactcctcgttacatg

SEQ ID NO: 132213 - DNA, 38 bp, Artificial Sequence
  Description of Artificial Sequence: Synthetic oligonucleotide
tcttatgccaaattcagtgctactcctcgttacatgac

SEQ ID NO: 132214 - DNA, 37 bp, Artificial Sequence
  Description of Artificial Sequence: Synthetic oligonucleotide
cttatgccaaattcagtgctactcctcgttacatgac

SEQ ID NO: 132215 - DNA, 40 bp, Artificial Sequence
  Description of Artificial Sequence: Synthetic oligonucleotide
ttatgccaaattcagtgctactcctcgttacatgacatac

SEQ ID NO: 132216 - DNA, 39 bp, Artificial Sequence
  Description of Artificial Sequence: Synthetic oligonucleotide
tatgccaaattcagtgctactcctcgttacatgacatac

SEQ ID NO: 132217 - DNA, 38 bp, Artificial Sequence
  Description of Artificial Sequence: Synthetic oligonucleotide
atgccaaattcagtgctactcctcgttacatgacatac

SEQ ID NO: 132218 - DNA, 37 bp, Artificial Sequence
  Description of Artificial Sequence: Synthetic oligonucleotide
tgccaaattcagtgctactcctcgttacatgacatac

SEQ ID NO: 132219 - DNA, 36 bp, Artificial Sequence
  Description of Artificial Sequence: Synthetic oligonucleotide
gccaaattcagtgctactcctcgttacatgacatac

SEQ ID NO: 132220 - DNA, 38 bp, Artificial Sequence
  Description of Artificial Sequence: Synthetic oligonucleotide
ccaaattcagtgctactcctcgttacatgacatacaac

SEQ ID NO: 132221 - DNA, 39 bp, Artificial Sequence
  Description of Artificial Sequence: Synthetic oligonucleotide
caaattcagtgctactcctcgttacatgacatacaactg

SEQ ID NO: 132222 - DNA, 35 bp, Artificial Sequence
  Description of Artificial Sequence: Synthetic oligonucleotide
atgaatctgctgccgaatattgagagtccagtgac

SEQ ID NO: 132223 - DNA, 34 bp, Artificial Sequence
  Description of Artificial Sequence: Synthetic oligonucleotide
tgaatctgctgccgaatattgagagtccagtgac

SEQ ID NO: 132224 - DNA, 33 bp, Artificial Sequence
  Description of Artificial Sequence: Synthetic oligonucleotide
gaatctgctgccgaatattgagagtccagtgac

SEQ ID NO: 132225 - DNA, 34 bp, Artificial Sequence
  Description of Artificial Sequence: Synthetic oligonucleotide
aatctgctgccgaatattgagagtccagtgactc

SEQ ID NO: 132226 - DNA, 33 bp, Artificial Sequence
  Description of Artificial Sequence: Synthetic oligonucleotide
atctgctgccgaatattgagagtccagtgactc

SEQ ID NO: 132227 - DNA, 32 bp, Artificial Sequence
  Description of Artificial Sequence: Synthetic oligonucleotide
tctgctgccgaatattgagagtccagtgactc

SEQ ID NO: 132228 - DNA, 31 bp, Artificial Sequence
  Description of Artificial Sequence: Synthetic oligonucleotide
ctgctgccgaatattgagagtccagtgactc

SEQ ID NO: 132229 - DNA, 31 bp, Artificial Sequence
  Description of Artificial Sequence: Synthetic oligonucleotide
tgctgccgaatattgagagtccagtgactcg

SEQ ID NO: 132230 - DNA, 30 bp, Artificial Sequence
  Description of Artificial Sequence: Synthetic oligonucleotide
gctgccgaatattgagagtccagtgactcg

SEQ ID NO: 132231 - DNA, 30 bp, Artificial Sequence
  Description of Artificial Sequence: Synthetic oligonucleotide
ctgccgaatattgagagtccagtgactcgg

SEQ ID NO: 132232 - DNA, 30 bp, Artificial Sequence
  Description of Artificial Sequence: Synthetic oligonucleotide
tgccgaatattgagagtccagtgactcggc

SEQ ID NO: 132233 - DNA, 29 bp, Artificial Sequence
  Description of Artificial Sequence: Synthetic oligonucleotide
gccgaatattgagagtccagtgactcggc

SEQ ID NO: 132234 - DNA, 30 bp, Artificial Sequence
  Description of Artificial Sequence: Synthetic oligonucleotide
ccgaatattgagagtccagtgactcggcag

SEQ ID NO: 132235 - DNA, 30 bp, Artificial Sequence
  Description of Artificial Sequence: Synthetic oligonucleotide
cgaatattgagagtccagtgactcggcagg

SEQ ID NO: 132236 - DNA, 31 bp, Artificial Sequence
  Description of Artificial Sequence: Synthetic oligonucleotide
gaatattgagagtccagtgactcggcaggag

SEQ ID NO: 132237 - DNA, 33 bp, Artificial Sequence
  Description of Artificial Sequence: Synthetic oligonucleotide
aatattgagagtccagtgactcggcaggagaag

SEQ ID NO: 132238 - DNA, 32 bp, Artificial Sequence
  Description of Artificial Sequence: Synthetic oligonucleotide
atattgagagtccagtgactcggcaggagaag

SEQ ID NO: 132239 - DNA, 31 bp, Artificial Sequence
  Description of Artificial Sequence: Synthetic oligonucleotide
tattgagagtccagtgactcggcaggagaag

SEQ ID NO: 132240 - DNA, 30 bp, Artificial Sequence
  Description of Artificial Sequence: Synthetic oligonucleotide
attgagagtccagtgactcggcaggagaag

SEQ ID NO: 132241 - DNA, 29 bp, Artificial Sequence
  Description of Artificial Sequence: Synthetic oligonucleotide
ttgagagtccagtgactcggcaggagaag

SEQ ID NO: 132242 - DNA, 28 bp, Artificial Sequence
  Description of Artificial Sequence: Synthetic oligonucleotide
tgagagtccagtgactcggcaggagaag

SEQ ID NO: 132243 - DNA, 27 bp, Artificial Sequence
  Description of Artificial Sequence: Synthetic oligonucleotide
gagagtccagtgactcggcaggagaag

SEQ ID NO: 132244 - DNA, 29 bp, Artificial Sequence
  Description of Artificial Sequence: Synthetic oligonucleotide
agagtccagtgactcggcaggagaagatg

SEQ ID NO: 132245 - DNA, 28 bp, Artificial Sequence
  Description of Artificial Sequence: Synthetic oligonucleotide
gagtccagtgactcggcaggagaagatg

SEQ ID NO: 132246 - DNA, 28 bp, Artificial Sequence
  Description of Artificial Sequence: Synthetic oligonucleotide
agtccagtgactcggcaggagaagatgg

SEQ ID NO: 132247 - DNA, 27 bp, Artificial Sequence
  Description of Artificial Sequence: Synthetic oligonucleotide
gtccagtgactcggcaggagaagatgg

SEQ ID NO: 132248 - DNA, 27 bp, Artificial Sequence
  Description of Artificial Sequence: Synthetic oligonucleotide
tccagtgactcggcaggagaagatggc

SEQ ID NO: 132249 - DNA, 26 bp, Artificial Sequence
  Description of Artificial Sequence: Synthetic oligonucleotide
ccagtgactcggcaggagaagatggc

SEQ ID NO: 132250 - DNA, 27 bp, Artificial Sequence
  Description of Artificial Sequence: Synthetic oligonucleotide
cagtgactcggcaggagaagatggcga

SEQ ID NO: 132251 - DNA, 27 bp, Artificial Sequence
  Description of Artificial Sequence: Synthetic oligonucleotide
agtgactcggcaggagaagatggcgac

SEQ ID NO: 132252 - DNA, 26 bp, Artificial Sequence
  Description of Artificial Sequence: Synthetic oligonucleotide
gtgactcggcaggagaagatggcgac

SEQ ID NO: 132253 - DNA, 26 bp, Artificial Sequence
  Description of Artificial Sequence: Synthetic oligonucleotide
tgactcggcaggagaagatggcgacc

SEQ ID NO: 132254 - DNA, 25 bp, Artificial Sequence
  Description of Artificial Sequence: Synthetic oligonucleotide
gactcggcaggagaagatggcgacc

SEQ ID NO: 132255 - DNA, 26 bp, Artificial Sequence
  Description of Artificial Sequence: Synthetic oligonucleotide
actcggcaggagaagatggcgaccgt

SEQ ID NO: 132256 - DNA, 25 bp, Artificial Sequence
  Description of Artificial Sequence: Synthetic oligonucleotide
ctcggcaggagaagatggcgaccgt

SEQ ID NO: 132257 - DNA, 26 bp, Artificial Sequence
  Description of Artificial Sequence: Synthetic oligonucleotide
tcggcaggagaagatggcgaccgtgt

SEQ ID NO: 132258 - DNA, 25 bp, Artificial Sequence
  Description of Artificial Sequence: Synthetic oligonucleotide
cggcaggagaagatggcgaccgtgt

SEQ ID NO: 132259 - DNA, 25 bp, Artificial Sequence
  Description of Artificial Sequence: Synthetic oligonucleotide
ggcaggagaagatggcgaccgtgtg

SEQ ID NO: 132260 - DNA, 25 bp, Artificial Sequence
  Description of Artificial Sequence: Synthetic oligonucleotide
gcaggagaagatggcgaccgtgtgg

SEQ ID NO: 132261 - DNA, 27 bp, Artificial Sequence
  Description of Artificial Sequence: Synthetic oligonucleotide
caggagaagatggcgaccgtgtgggat

SEQ ID NO: 132262 - DNA, 27 bp, Artificial Sequence
  Description of Artificial Sequence: Synthetic oligonucleotide
aggagaagatggcgaccgtgtgggatg

SEQ ID NO: 132263 - DNA, 27 bp, Artificial Sequence
  Description of Artificial Sequence: Synthetic oligonucleotide
ggagaagatggcgaccgtgtgggatga

SEQ ID NO: 132264 - DNA, 27 bp, Artificial Sequence
  Description of Artificial Sequence: Synthetic oligonucleotide
gagaagatggcgaccgtgtgggatgag

SEQ ID NO: 132265 - DNA, 27 bp, Artificial Sequence
  Description of Artificial Sequence: Synthetic oligonucleotide
agaagatggcgaccgtgtgggatgagg

SEQ ID NO: 132266 - DNA, 26 bp, Artificial Sequence
  Description of Artificial Sequence: Synthetic oligonucleotide
gaagatggcgaccgtgtgggatgagg

SEQ ID NO: 132267 - DNA, 26 bp, Artificial Sequence
  Description of Artificial Sequence: Synthetic oligonucleotide
aagatggcgaccgtgtgggatgaggc

SEQ ID NO: 132268 - DNA, 25 bp, Artificial Sequence
  Description of Artificial Sequence: Synthetic oligonucleotide
agatggcgaccgtgtgggatgaggc

SEQ ID NO: 132269 - DNA, 24 bp, Artificial Sequence
  Description of Artificial Sequence: Synthetic oligonucleotide
gatggcgaccgtgtgggatgaggc

SEQ ID NO: 132270 - DNA, 24 bp, Artificial Sequence
  Description of Artificial Sequence: Synthetic oligonucleotide
atggcgaccgtgtgggatgaggcc

SEQ ID NO: 132271 - DNA, 23 bp, Artificial Sequence
  Description of Artificial Sequence: Synthetic oligonucleotide
tggcgaccgtgtgggatgaggcc

SEQ ID NO: 132272 - DNA, 22 bp, Artificial Sequence
  Description of Artificial Sequence: Synthetic oligonucleotide
ggcgaccgtgtgggatgaggcc

SEQ ID NO: 132273 - DNA, 23 bp, Artificial Sequence
  Description of Artificial Sequence: Synthetic oligonucleotide
gcgaccgtgtgggatgaggccga

SEQ ID NO: 132274 - DNA, 23 bp, Artificial Sequence
  Description of Artificial Sequence: Synthetic oligonucleotide
cgaccgtgtgggatgaggccgag

SEQ ID NO: 132275 - DNA, 25 bp, Artificial Sequence
  Description of Artificial Sequence: Synthetic oligonucleotide
gaccgtgtgggatgaggccgagcaa

SEQ ID NO: 132276 - DNA, 27 bp, Artificial Sequence
  Description of Artificial Sequence: Synthetic oligonucleotide
accgtgtgggatgaggccgagcaagat

SEQ ID NO: 132277 - DNA, 26 bp, Artificial Sequence
  Description of Artificial Sequence: Synthetic oligonucleotide
ccgtgtgggatgaggccgagcaagat

SEQ ID NO: 132278 - DNA, 26 bp, Artificial Sequence
  Description of Artificial Sequence: Synthetic oligonucleotide
cgtgtgggatgaggccgagcaagatg

SEQ ID NO: 132279 - DNA, 27 bp, Artificial Sequence
  Description of Artificial Sequence: Synthetic oligonucleotide
gtgtgggatgaggccgagcaagatgga

SEQ ID NO: 132280 - DNA, 30 bp, Artificial Sequence
  Description of Artificial Sequence: Synthetic oligonucleotide
tgtgggatgaggccgagcaagatggaattg

SEQ ID NO: 132281 - DNA, 29 bp, Artificial Sequence
  Description of Artificial Sequence: Synthetic oligonucleotide
gtgggatgaggccgagcaagatggaattg

SEQ ID NO: 132282 - DNA, 29 bp, Artificial Sequence
  Description of Artificial Sequence: Synthetic oligonucleotide
tgggatgaggccgagcaagatggaattgg

SEQ ID NO: 132283 - DNA, 28 bp, Artificial Sequence
  Description of Artificial Sequence: Synthetic oligonucleotide
gggatgaggccgagcaagatggaattgg

SEQ ID NO: 132284 - DNA, 28 bp, Artificial Sequence
  Description of Artificial Sequence: Synthetic oligonucleotide
ggatgaggccgagcaagatggaattggg

SEQ ID NO: 132285 - DNA, 28 bp, Artificial Sequence
  Description of Artificial Sequence: Synthetic oligonucleotide
gatgaggccgagcaagatggaattgggg

SEQ ID NO: 132286 - DNA, 29 bp, Artificial Sequence
  Description of Artificial Sequence: Synthetic oligonucleotide
atgaggccgagcaagatggaattggggag

SEQ ID NO: 132287 - DNA, 28 bp, Artificial Sequence
  Description of Artificial Sequence: Synthetic oligonucleotide
tgaggccgagcaagatggaattggggag

SEQ ID NO: 132288 - DNA, 27 bp, Artificial Sequence
  Description of Artificial Sequence: Synthetic oligonucleotide
gaggccgagcaagatggaattggggag

SEQ ID NO: 132289 - DNA, 27 bp, Artificial Sequence
  Description of Artificial Sequence: Synthetic oligonucleotide
aggccgagcaagatggaattggggagg

SEQ ID NO: 132290 - DNA, 27 bp, Artificial Sequence
  Description of Artificial Sequence: Synthetic oligonucleotide
ggccgagcaagatggaattggggagga

SEQ ID NO: 132291 - DNA, 27 bp, Artificial Sequence
  Description of Artificial Sequence: Synthetic oligonucleotide
gccgagcaagatggaattggggaggag

SEQ ID NO: 132292 - DNA, 27 bp, Artificial Sequence
  Description of Artificial Sequence: Synthetic oligonucleotide
ccgagcaagatggaattggggaggagg

SEQ ID NO: 132293 - DNA, 28 bp, Artificial Sequence
  Description of Artificial Sequence: Synthetic oligonucleotide
cgagcaagatggaattggggaggaggtg

SEQ ID NO: 132294 - DNA, 28 bp, Artificial Sequence
  Description of Artificial Sequence: Synthetic oligonucleotide
gagcaagatggaattggggaggaggtgc

SEQ ID NO: 132295 - DNA, 29 bp, Artificial Sequence
  Description of Artificial Sequence: Synthetic oligonucleotide
agcaagatggaattggggaggaggtgctc

SEQ ID NO: 132296 - DNA, 28 bp, Artificial Sequence
  Description of Artificial Sequence: Synthetic oligonucleotide
gcaagatggaattggggaggaggtgctc

SEQ ID NO: 132297 - DNA, 30 bp, Artificial Sequence
  Description of Artificial Sequence: Synthetic oligonucleotide
caagatggaattggggaggaggtgctcaag

SEQ ID NO: 132298 - DNA, 32 bp, Artificial Sequence
  Description of Artificial Sequence: Synthetic oligonucleotide
aagatggaattggggaggaggtgctcaagatg

SEQ ID NO: 132299 - DNA, 31 bp, Artificial Sequence
  Description of Artificial Sequence: Synthetic oligonucleotide
agatggaattggggaggaggtgctcaagatg

SEQ ID NO: 132300 - DNA, 30 bp, Artificial Sequence
  Description of Artificial Sequence: Synthetic oligonucleotide
gatggaattggggaggaggtgctcaagatg

SEQ ID NO: 132301 - DNA, 31 bp, Artificial Sequence
  Description of Artificial Sequence: Synthetic oligonucleotide
atggaattggggaggaggtgctcaagatgtc

SEQ ID NO: 132302 - DNA, 30 bp, Artificial Sequence
  Description of Artificial Sequence: Synthetic oligonucleotide
tggaattggggaggaggtgctcaagatgtc

SEQ ID NO: 132303 - DNA, 29 bp, Artificial Sequence
  Description of Artificial Sequence: Synthetic oligonucleotide
ggaattggggaggaggtgctcaagatgtc

SEQ ID NO: 132304 - DNA, 29 bp, Artificial Sequence
  Description of Artificial Sequence: Synthetic oligonucleotide
gaattggggaggaggtgctcaagatgtcc

SEQ ID NO: 132305 - DNA, 30 bp, Artificial Sequence
  Description of Artificial Sequence: Synthetic oligonucleotide
aattggggaggaggtgctcaagatgtccac

SEQ ID NO: 132306 - DNA, 29 bp, Artificial Sequence
  Description of Artificial Sequence: Synthetic oligonucleotide
attggggaggaggtgctcaagatgtccac

SEQ ID NO: 132307 - DNA, 28 bp, Artificial Sequence
  Description of Artificial Sequence: Synthetic oligonucleotide
ttggggaggaggtgctcaagatgtccac

SEQ ID NO: 132308 - DNA, 27 bp, Artificial Sequence
  Description of Artificial Sequence: Synthetic oligonucleotide
tggggaggaggtgctcaagatgtccac

SEQ ID NO: 132309 - DNA, 26 bp, Artificial Sequence
  Description of Artificial Sequence: Synthetic oligonucleotide
ggggaggaggtgctcaagatgtccac

SEQ ID NO: 132310 - DNA, 26 bp, Artificial Sequence
  Description of Artificial Sequence: Synthetic oligonucleotide
gggaggaggtgctcaagatgtccacg

SEQ ID NO: 132311 - DNA, 27 bp, Artificial Sequence
  Description of Artificial Sequence: Synthetic oligonucleotide
ggaggaggtgctcaagatgtccacgga

SEQ ID NO: 132312 - DNA, 27 bp, Artificial Sequence
  Description of Artificial Sequence: Synthetic oligonucleotide
gaggaggtgctcaagatgtccacggag

SEQ ID NO: 132313 - DNA, 27 bp, Artificial Sequence
  Description of Artificial Sequence: Synthetic oligonucleotide
aggaggtgctcaagatgtccacggagg

SEQ ID NO: 132314 - DNA, 27 bp, Artificial Sequence
  Description of Artificial Sequence: Synthetic oligonucleotide
ggaggtgctcaagatgtccacggagga

SEQ ID NO: 132315 - DNA, 27 bp, Artificial Sequence
  Description of Artificial Sequence: Synthetic oligonucleotide
gaggtgctcaagatgtccacggaggag

SEQ ID NO: 132316 - DNA, 29 bp, Artificial Sequence
  Description of Artificial Sequence: Synthetic oligonucleotide
aggtgctcaagatgtccacggaggagatc

SEQ ID NO: 132317 - DNA, 28 bp, Artificial Sequence
  Description of Artificial Sequence: Synthetic oligonucleotide
ggtgctcaagatgtccacggaggagatc

SEQ ID NO: 132318 - DNA, 30 bp, Artificial Sequence
  Description of Artificial Sequence: Synthetic oligonucleotide
gtgctcaagatgtccacggaggagatcatc

SEQ ID NO: 132319 - DNA, 30 bp, Artificial Sequence
  Description of Artificial Sequence: Synthetic oligonucleotide
tgctcaagatgtccacggaggagatcatcc

SEQ ID NO: 132320 - DNA, 29 bp, Artificial Sequence
  Description of Artificial Sequence: Synthetic oligonucleotide
gctcaagatgtccacggaggagatcatcc

SEQ ID NO: 132321 - DNA, 30 bp, Artificial Sequence
  Description of Artificial Sequence: Synthetic oligonucleotide
ctcaagatgtccacggaggagatcatccag

SEQ ID NO: 132322 - DNA, 30 bp, Artificial Sequence
  Description of Artificial Sequence: Synthetic oligonucleotide
tcaagatgtccacggaggagatcatccagc

SEQ ID NO: 132323 - DNA, 29 bp, Artificial Sequence
  Description of Artificial Sequence: Synthetic oligonucleotide
caagatgtccacggaggagatcatccagc

SEQ ID NO: 132324 - DNA, 29 bp, Artificial Sequence
  Description of Artificial Sequence: Synthetic oligonucleotide
aagatgtccacggaggagatcatccagcg

SEQ ID NO: 132325 - DNA, 28 bp, Artificial Sequence
  Description of Artificial Sequence: Synthetic oligonucleotide
agatgtccacggaggagatcatccagcg

SEQ ID NO: 132326 - DNA, 27 bp, Artificial Sequence
  Description of Artificial Sequence: Synthetic oligonucleotide
gatgtccacggaggagatcatccagcg

SEQ ID NO: 132327 - DNA, 27 bp, Artificial Sequence
  Description of Artificial Sequence: Synthetic oligonucleotide
atgtccacggaggagatcatccagcgc

SEQ ID NO: 132328 - DNA, 27 bp, Artificial Sequence
  Description of Artificial Sequence: Synthetic oligonucleotide
tgtccacggaggagatcatccagcgca

SEQ ID NO: 132329 - DNA, 26 bp, Artificial Sequence
  Description of Artificial Sequence: Synthetic oligonucleotide
gtccacggaggagatcatccagcgca

SEQ ID NO: 132330 - DNA, 27 bp, Artificial Sequence
  Description of Artificial Sequence: Synthetic oligonucleotide
tccacggaggagatcatccagcgcaca

SEQ ID NO: 132331 - DNA, 26 bp, Artificial Sequence
  Description of Artificial Sequence: Synthetic oligonucleotide
ccacggaggagatcatccagcgcaca

SEQ ID NO: 132332 - DNA, 26 bp, Artificial Sequence
  Description of Artificial Sequence: Synthetic oligonucleotide
cacggaggagatcatccagcgcacac

SEQ ID NO: 132333 - DNA, 26 bp, Artificial Sequence
  Description of Artificial Sequence: Synthetic oligonucleotide
acggaggagatcatccagcgcacacg

SEQ ID NO: 132334 - DNA, 25 bp, Artificial Sequence
  Description of Artificial Sequence: Synthetic oligonucleotide
cggaggagatcatccagcgcacacg

SEQ ID NO: 132335 - DNA, 25 bp, Artificial Sequence
  Description of Artificial Sequence: Synthetic oligonucleotide
ggaggagatcatccagcgcacacgg

SEQ ID NO: 132336 - DNA, 26 bp, Artificial Sequence
  Description of Artificial Sequence: Synthetic oligonucleotide
gaggagatcatccagcgcacacggct

SEQ ID NO: 132337 - DNA, 26 bp, Artificial Sequence
  Description of Artificial Sequence: Synthetic oligonucleotide
aggagatcatccagcgcacacggctg

SEQ ID NO: 132338 - DNA, 25 bp, Artificial Sequence
  Description of Artificial Sequence: Synthetic oligonucleotide
ggagatcatccagcgcacacggctg

SEQ ID NO: 132339 - DNA, 26 bp, Artificial Sequence
  Description of Artificial Sequence: Synthetic oligonucleotide
gagatcatccagcgcacacggctgct

SEQ ID NO: 132340 - DNA, 26 bp, Artificial Sequence
  Description of Artificial Sequence: Synthetic oligonucleotide
agatcatccagcgcacacggctgctg

SEQ ID NO: 132341 - DNA, 25 bp, Artificial Sequence
  Description of Artificial Sequence: Synthetic oligonucleotide
gatcatccagcgcacacggctgctg

SEQ ID NO: 132342 - DNA, 26 bp, Artificial Sequence
  Description of Artificial Sequence: Synthetic oligonucleotide
atcatccagcgcacacggctgctgga

SEQ ID NO: 132343 - DNA, 25 bp, Artificial Sequence
  Description of Artificial Sequence: Synthetic oligonucleotide
tcatccagcgcacacggctgctgga

SEQ ID NO: 132344 - DNA, 24 bp, Artificial Sequence
  Description of Artificial Sequence: Synthetic oligonucleotide
catccagcgcacacggctgctgga

SEQ ID NO: 132345 - DNA, 25 bp, Artificial Sequence
  Description of Artificial Sequence: Synthetic oligonucleotide
atccagcgcacacggctgctggaca

SEQ ID NO: 132346 - DNA, 24 bp, Artificial Sequence
  Description of Artificial Sequence: Synthetic oligonucleotide
tccagcgcacacggctgctggaca

SEQ ID NO: 132347 - DNA, 23 bp, Artificial Sequence
  Description of Artificial Sequence: Synthetic oligonucleotide
ccagcgcacacggctgctggaca

SEQ ID NO: 132348 - DNA, 24 bp, Artificial Sequence
  Description of Artificial Sequence: Synthetic oligonucleotide
cagcgcacacggctgctggacagt

SEQ ID NO: 132349 - DNA, 25 bp, Artificial Sequence
  Description of Artificial Sequence: Synthetic oligonucleotide
agcgcacacggctgctggacagtga

SEQ ID NO: 132350 - DNA, 24 bp, Artificial Sequence
  Description of Artificial Sequence: Synthetic oligonucleotide
gcgcacacggctgctggacagtga

SEQ ID NO: 132351 - DNA, 26 bp, Artificial Sequence
  Description of Artificial Sequence: Synthetic oligonucleotide
cgcacacggctgctggacagtgagat

SEQ ID NO: 132352 - DNA, 27 bp, Artificial Sequence
  Description of Artificial Sequence: Synthetic oligonucleotide
gcacacggctgctggacagtgagatca

SEQ ID NO: 132353 - DNA, 28 bp, Artificial Sequence
  Description of Artificial Sequence: Synthetic oligonucleotide
cacacggctgctggacagtgagatcaag

SEQ ID NO: 132354 - DNA, 30 bp, Artificial Sequence
  Description of Artificial Sequence: Synthetic oligonucleotide
acacggctgctggacagtgagatcaagatc

SEQ ID NO: 132355 - DNA, 29 bp, Artificial Sequence
  Description of Artificial Sequence: Synthetic oligonucleotide
cacggctgctggacagtgagatcaagatc

SEQ ID NO: 132356 - DNA, 31 bp, Artificial Sequence
  Description of Artificial Sequence: Synthetic oligonucleotide
acggctgctggacagtgagatcaagatcatg

SEQ ID NO: 132357 - DNA, 30 bp, Artificial Sequence
  Description of Artificial Sequence: Synthetic oligonucleotide
cggctgctggacagtgagatcaagatcatg

SEQ ID NO: 132358 - DNA, 32 bp, Artificial Sequence
  Description of Artificial Sequence: Synthetic oligonucleotide
ggctgctggacagtgagatcaagatcatgaag

SEQ ID NO: 132359 - DNA, 33 bp, Artificial Sequence
  Description of Artificial Sequence: Synthetic oligonucleotide
gctgctggacagtgagatcaagatcatgaagag

SEQ ID NO: 132360 - DNA, 34 bp, Artificial Sequence
  Description of Artificial Sequence: Synthetic oligonucleotide
ctgctggacagtgagatcaagatcatgaagagtg

SEQ ID NO: 132361 - DNA, 36 bp, Artificial Sequence
  Description of Artificial Sequence: Synthetic oligonucleotide
tgctggacagtgagatcaagatcatgaagagtgaag

SEQ ID NO: 132362 - DNA, 35 bp, Artificial Sequence
  Description of Artificial Sequence: Synthetic oligonucleotide
gctggacagtgagatcaagatcatgaagagtgaag

SEQ ID NO: 132363 - DNA, 36 bp, Artificial Sequence
  Description of Artificial Sequence: Synthetic oligonucleotide
ctggacagtgagatcaagatcatgaagagtgaagtg

SEQ ID NO: 132364 - DNA, 38 bp, Artificial Sequence
  Description of Artificial Sequence: Synthetic oligonucleotide
tggacagtgagatcaagatcatgaagagtgaagtgttg

SEQ ID NO: 132365 - DNA, 37 bp, Artificial Sequence
  Description of Artificial Sequence: Synthetic oligonucleotide
ggacagtgagatcaagatcatgaagagtgaagtgttg

SEQ ID NO: 132366 - DNA, 38 bp, Artificial Sequence
  Description of Artificial Sequence: Synthetic oligonucleotide
gacagtgagatcaagatcatgaagagtgaagtgttgag

SEQ ID NO: 132367 - DNA, 39 bp, Artificial Sequence
  Description of Artificial Sequence: Synthetic oligonucleotide
acagtgagatcaagatcatgaagagtgaagtgttgagag

SEQ ID NO: 132368 - DNA, 38 bp, Artificial Sequence
  Description of Artificial Sequence: Synthetic oligonucleotide
cagtgagatcaagatcatgaagagtgaagtgttgagag

SEQ ID NO: 132369 - DNA, 39 bp, Artificial Sequence
  Description of Artificial Sequence: Synthetic oligonucleotide
agtgagatcaagatcatgaagagtgaagtgttgagagtc

SEQ ID NO: 132370 - DNA, 38 bp, Artificial Sequence
  Description of Artificial Sequence: Synthetic oligonucleotide
gtgagatcaagatcatgaagagtgaagtgttgagagtc

SEQ ID NO: 132371 - DNA, 39 bp, Artificial Sequence
  Description of Artificial Sequence: Synthetic oligonucleotide
tgagatcaagatcatgaagagtgaagtgttgagagtcac

SEQ ID NO: 132372 - DNA, 38 bp, Artificial Sequence
  Description of Artificial Sequence: Synthetic oligonucleotide
gagatcaagatcatgaagagtgaagtgttgagagtcac

SEQ ID NO: 132373 - DNA, 38 bp, Artificial Sequence
  Description of Artificial Sequence: Synthetic oligonucleotide
agatcaagatcatgaagagtgaagtgttgagagtcacc

SEQ ID NO: 132374 - DNA, 37 bp, Artificial Sequence
  Description of Artificial Sequence: Synthetic oligonucleotide
gatcaagatcatgaagagtgaagtgttgagagtcacc

SEQ ID NO: 132375 - DNA, 37 bp, Artificial Sequence
  Description of Artificial Sequence: Synthetic oligonucleotide
atcaagatcatgaagagtgaagtgttgagagtcaccc

SEQ ID NO: 132376 - DNA, 36 bp, Artificial Sequence
  Description of Artificial Sequence: Synthetic oligonucleotide
tcaagatcatgaagagtgaagtgttgagagtcaccc

SEQ ID NO: 132377 - DNA, 35 bp, Artificial Sequence
  Description of Artificial Sequence: Synthetic oligonucleotide
caagatcatgaagagtgaagtgttgagagtcaccc

SEQ ID NO: 132378 - DNA, 37 bp, Artificial Sequence
  Description of Artificial Sequence: Synthetic oligonucleotide
aagatcatgaagagtgaagtgttgagagtcacccatg

SEQ ID NO: 132379 - DNA, 36 bp, Artificial Sequence
  Description of Artificial Sequence: Synthetic oligonucleotide
agatcatgaagagtgaagtgttgagagtcacccatg

SEQ ID NO: 132380 - DNA, 35 bp, Artificial Sequence
  Description of Artificial Sequence: Synthetic oligonucleotide
gatcatgaagagtgaagtgttgagagtcacccatg

SEQ ID NO: 132381 - DNA, 36 bp, Artificial Sequence
  Description of Artificial Sequence: Synthetic oligonucleotide
atcatgaagagtgaagtgttgagagtcacccatgag

SEQ ID NO: 132382 - DNA, 35 bp, Artificial Sequence
  Description of Artificial Sequence: Synthetic oligonucleotide
tcatgaagagtgaagtgttgagagtcacccatgag

SEQ ID NO: 132383 - DNA, 34 bp, Artificial Sequence
  Description of Artificial Sequence: Synthetic oligonucleotide
catgaagagtgaagtgttgagagtcacccatgag

SEQ ID NO: 132384 - DNA, 34 bp, Artificial Sequence
  Description of Artificial Sequence: Synthetic oligonucleotide
atgaagagtgaagtgttgagagtcacccatgagc

SEQ ID NO: 132385 - DNA, 33 bp, Artificial Sequence
  Description of Artificial Sequence: Synthetic oligonucleotide
tgaagagtgaagtgttgagagtcacccatgagc

SEQ ID NO: 132386 - DNA, 32 bp, Artificial Sequence
  Description of Artificial Sequence: Synthetic oligonucleotide
gaagagtgaagtgttgagagtcacccatgagc

SEQ ID NO: 132387 - DNA, 33 bp, Artificial Sequence
  Description of Artificial Sequence: Synthetic oligonucleotide
aagagtgaagtgttgagagtcacccatgagctc

SEQ ID NO: 132388 - DNA, 32 bp, Artificial Sequence
  Description of Artificial Sequence: Synthetic oligonucleotide
agagtgaagtgttgagagtcacccatgagctc

SEQ ID NO: 132389 - DNA, 31 bp, Artificial Sequence
  Description of Artificial Sequence: Synthetic oligonucleotide
gagtgaagtgttgagagtcacccatgagctc

SEQ ID NO: 132390 - DNA, 31 bp, Artificial Sequence
  Description of Artificial Sequence: Synthetic oligonucleotide
agtgaagtgttgagagtcacccatgagctcc

SEQ ID NO: 132391 - DNA, 30 bp, Artificial Sequence
  Description of Artificial Sequence: Synthetic oligonucleotide
gtgaagtgttgagagtcacccatgagctcc

SEQ ID NO: 132392 - DNA, 32 bp, Artificial Sequence
  Description of Artificial Sequence: Synthetic oligonucleotide
tgaagtgttgagagtcacccatgagctccaag

SEQ ID NO: 132393 - DNA, 31 bp, Artificial Sequence
  Description of Artificial Sequence: Synthetic oligonucleotide
gaagtgttgagagtcacccatgagctccaag

SEQ ID NO: 132394 - DNA, 31 bp, Artificial Sequence
  Description of Artificial Sequence: Synthetic oligonucleotide
aagtgttgagagtcacccatgagctccaagc

SEQ ID NO: 132395 - DNA, 30 bp, Artificial Sequence
  Description of Artificial Sequence: Synthetic oligonucleotide
agtgttgagagtcacccatgagctccaagc

SEQ ID NO: 132396 - DNA, 29 bp, Artificial Sequence
  Description of Artificial Sequence: Synthetic oligonucleotide
gtgttgagagtcacccatgagctccaagc

SEQ ID NO: 132397 - DNA, 29 bp, Artificial Sequence
  Description of Artificial Sequence: Synthetic oligonucleotide
tgttgagagtcacccatgagctccaagcc

SEQ ID NO: 132398 - DNA, 28 bp, Artificial Sequence
  Description of Artificial Sequence: Synthetic oligonucleotide
gttgagagtcacccatgagctccaagcc

SEQ ID NO: 132399 - DNA, 30 bp, Artificial Sequence
  Description of Artificial Sequence: Synthetic oligonucleotide
ttgagagtcacccatgagctccaagccatg

SEQ ID NO: 132400 - DNA, 29 bp, Artificial Sequence
  Description of Artificial Sequence: Synthetic oligonucleotide
tgagagtcacccatgagctccaagccatg

SEQ ID NO: 132401 - DNA, 28 bp, Artificial Sequence
  Description of Artificial Sequence: Synthetic oligonucleotide
gagagtcacccatgagctccaagccatg

SEQ ID NO: 132402 - DNA, 30 bp, Artificial Sequence
  Description of Artificial Sequence: Synthetic oligonucleotide
agagtcacccatgagctccaagccatgaag

SEQ ID NO: 132403 - DNA, 29 bp, Artificial Sequence
  Description of Artificial Sequence: Synthetic oligonucleotide
gagtcacccatgagctccaagccatgaag

SEQ ID NO: 132404 - DNA, 29 bp, Artificial Sequence
  Description of Artificial Sequence: Synthetic oligonucleotide
agtcacccatgagctccaagccatgaagg

SEQ ID NO: 132405 - DNA, 28 bp, Artificial Sequence
  Description of Artificial Sequence: Synthetic oligonucleotide
gtcacccatgagctccaagccatgaagg

SEQ ID NO: 132406 - DNA, 29 bp, Artificial Sequence
  Description of Artificial Sequence: Synthetic oligonucleotide
tcacccatgagctccaagccatgaaggac

SEQ ID NO: 132407 - DNA, 28 bp, Artificial Sequence
  Description of Artificial Sequence: Synthetic oligonucleotide
cacccatgagctccaagccatgaaggac

SEQ ID NO: 132408 - DNA, 30 bp, Artificial Sequence
  Description of Artificial Sequence: Synthetic oligonucleotide
acccatgagctccaagccatgaaggacaag

SEQ ID NO: 132409 - DNA, 29 bp, Artificial Sequence
  Description of Artificial Sequence: Synthetic oligonucleotide
cccatgagctccaagccatgaaggacaag

SEQ ID NO: 132410 - DNA, 35 bp, Artificial Sequence
  Description of Artificial Sequence: Synthetic oligonucleotide
ccatgagctccaagccatgaaggacaagataaaag

SEQ ID NO: 132411 - DNA, 36 bp, Artificial Sequence
  Description of Artificial Sequence: Synthetic oligonucleotide
catgagctccaagccatgaaggacaagataaaagag

SEQ ID NO: 132412 - DNA, 38 bp, Artificial Sequence
  Description of Artificial Sequence: Synthetic oligonucleotide
atgagctccaagccatgaaggacaagataaaagagaac

SEQ ID NO: 132413 - DNA, 37 bp, Artificial Sequence
  Description of Artificial Sequence: Synthetic oligonucleotide
tgagctccaagccatgaaggacaagataaaagagaac

SEQ ID NO: 132414 - DNA, 36 bp, Artificial Sequence
  Description of Artificial Sequence: Synthetic oligonucleotide
gagctccaagccatgaaggacaagataaaagagaac

SEQ ID NO: 132415 - DNA, 37 bp, Artificial Sequence
  Description of Artificial Sequence: Synthetic oligonucleotide
agctccaagccatgaaggacaagataaaagagaacag

SEQ ID NO: 132416 - DNA, 36 bp, Artificial Sequence
  Description of Artificial Sequence: Synthetic oligonucleotide
gctccaagccatgaaggacaagataaaagagaacag

SEQ ID NO: 132417 - DNA, 37 bp, Artificial Sequence
  Description of Artificial Sequence: Synthetic oligonucleotide
ctccaagccatgaaggacaagataaaagagaacagtg

SEQ ID NO: 132418 - DNA, 38 bp, Artificial Sequence
  Description of Artificial Sequence: Synthetic oligonucleotide
tccaagccatgaaggacaagataaaagagaacagtgag

SEQ ID NO: 132419 - DNA, 37 bp, Artificial Sequence
  Description of Artificial Sequence: Synthetic oligonucleotide
ccaagccatgaaggacaagataaaagagaacagtgag

SEQ ID NO: 132420 - DNA, 42 bp, Artificial Sequence
  Description of Artificial Sequence: Synthetic oligonucleotide
caagccatgaaggacaagataaaagagaacagtgagaaaatc

SEQ ID NO: 132421 - DNA, 45 bp, Artificial Sequence
  Description of Artificial Sequence: Synthetic oligonucleotide
aagccatgaaggacaagataaaagagaacagtgagaaaatcaaag

SEQ ID NO: 132422 - DNA, 44 bp, Artificial Sequence
  Description of Artificial Sequence: Synthetic oligonucleotide
agccatgaaggacaagataaaagagaacagtgagaaaatcaaag

SEQ ID NO: 132423 - DNA, 43 bp, Artificial Sequence
  Description of Artificial Sequence: Synthetic oligonucleotide
gccatgaaggacaagataaaagagaacagtgagaaaatcaaag

SEQ ID NO: 132424 - DNA, 44 bp, Artificial Sequence
  Description of Artificial Sequence: Synthetic oligonucleotide
ccatgaaggacaagataaaagagaacagtgagaaaatcaaagtg

SEQ ID NO: 132425 - DNA, 46 bp, Artificial Sequence
  Description of Artificial Sequence: Synthetic oligonucleotide
catgaaggacaagataaaagagaacagtgagaaaatcaaagtgaac

SEQ ID NO: 132426 - DNA, 48 bp, Artificial Sequence
  Description of Artificial Sequence: Synthetic oligonucleotide
atgaaggacaagataaaagagaacagtgagaaaatcaaagtgaacaag

SEQ ID NO: 132427 - DNA, 47 bp, Artificial Sequence
  Description of Artificial Sequence: Synthetic oligonucleotide
tgaaggacaagataaaagagaacagtgagaaaatcaaagtgaacaag

SEQ ID NO: 132428 - DNA, 46 bp, Artificial Sequence
  Description of Artificial Sequence: Synthetic oligonucleotide
gaaggacaagataaaagagaacagtgagaaaatcaaagtgaacaag

SEQ ID NO: 132429 - DNA, 47 bp, Artificial Sequence
  Description of Artificial Sequence: Synthetic oligonucleotide
aaggacaagataaaagagaacagtgagaaaatcaaagtgaacaagac

SEQ ID NO: 132430 - DNA, 46 bp, Artificial Sequence
  Description of Artificial Sequence: Synthetic oligonucleotide
aggacaagataaaagagaacagtgagaaaatcaaagtgaacaagac

SEQ ID NO: 132431 - DNA, 45 bp, Artificial Sequence
  Description of Artificial Sequence: Synthetic oligonucleotide
ggacaagataaaagagaacagtgagaaaatcaaagtgaacaagac

SEQ ID NO: 132432 - DNA, 45 bp, Artificial Sequence
  Description of Artificial Sequence: Synthetic oligonucleotide
gacaagataaaagagaacagtgagaaaatcaaagtgaacaagacc

SEQ ID NO: 132433 - DNA, 45 bp, Artificial Sequence
  Description of Artificial Sequence: Synthetic oligonucleotide
acaagataaaagagaacagtgagaaaatcaaagtgaacaagaccc

SEQ ID NO: 132434 - DNA, 44 bp, Artificial Sequence
  Description of Artificial Sequence: Synthetic oligonucleotide
caagataaaagagaacagtgagaaaatcaaagtgaacaagaccc

SEQ ID NO: 132435 - DNA, 45 bp, Artificial Sequence
  Description of Artificial Sequence: Synthetic oligonucleotide
aagataaaagagaacagtgagaaaatcaaagtgaacaagaccctg

SEQ ID NO: 132436 - DNA, 44 bp, Artificial Sequence
  Description of Artificial Sequence: Synthetic oligonucleotide
agataaaagagaacagtgagaaaatcaaagtgaacaagaccctg

SEQ ID NO: 132437 - DNA, 43 bp, Artificial Sequence
  Description of Artificial Sequence: Synthetic oligonucleotide
gataaaagagaacagtgagaaaatcaaagtgaacaagaccctg

SEQ ID NO: 132438 - DNA, 43 bp, Artificial Sequence
  Description of Artificial Sequence: Synthetic oligonucleotide
ataaaagagaacagtgagaaaatcaaagtgaacaagaccctgc

SEQ ID NO: 132439 - DNA, 42 bp, Artificial Sequence
  Description of Artificial Sequence: Synthetic oligonucleotide
taaaagagaacagtgagaaaatcaaagtgaacaagaccctgc

SEQ ID NO: 132440 - DNA, 41 bp, Artificial Sequence
  Description of Artificial Sequence: Synthetic oligonucleotide
aaaagagaacagtgagaaaatcaaagtgaacaagaccctgc

SEQ ID NO: 132441 - DNA, 40 bp, Artificial Sequence
  Description of Artificial Sequence: Synthetic oligonucleotide
aaagagaacagtgagaaaatcaaagtgaacaagaccctgc

SEQ ID NO: 132442 - DNA, 39 bp, Artificial Sequence
  Description of Artificial Sequence: Synthetic oligonucleotide
aagagaacagtgagaaaatcaaagtgaacaagaccctgc

SEQ ID NO: 132443 - DNA, 38 bp, Artificial Sequence
  Description of Artificial Sequence: Synthetic oligonucleotide
agagaacagtgagaaaatcaaagtgaacaagaccctgc

SEQ ID NO: 132444 - DNA, 37 bp, Artificial Sequence
  Description of Artificial Sequence: Synthetic oligonucleotide
gagaacagtgagaaaatcaaagtgaacaagaccctgc

SEQ ID NO: 132445 - DNA, 37 bp, Artificial Sequence
  Description of Artificial Sequence: Synthetic oligonucleotide
agaacagtgagaaaatcaaagtgaacaagaccctgcc

SEQ ID NO: 132446 - DNA, 36 bp, Artificial Sequence
  Description of Artificial Sequence: Synthetic oligonucleotide
gaacagtgagaaaatcaaagtgaacaagaccctgcc

SEQ ID NO: 132447 - DNA, 36 bp, Artificial Sequence
  Description of Artificial Sequence: Synthetic oligonucleotide
aacagtgagaaaatcaaagtgaacaagaccctgccg

SEQ ID NO: 132448 - DNA, 35 bp, Artificial Sequence
  Description of Artificial Sequence: Synthetic oligonucleotide
acagtgagaaaatcaaagtgaacaagaccctgccg

SEQ ID NO: 132449 - DNA, 34 bp, Artificial Sequence
  Description of Artificial Sequence: Synthetic oligonucleotide
cagtgagaaaatcaaagtgaacaagaccctgccg

SEQ ID NO: 132450 - DNA, 36 bp, Artificial Sequence
  Description of Artificial Sequence: Synthetic oligonucleotide
agtgagaaaatcaaagtgaacaagaccctgccgtac

SEQ ID NO: 132451 - DNA, 35 bp, Artificial Sequence
  Description of Artificial Sequence: Synthetic oligonucleotide
gtgagaaaatcaaagtgaacaagaccctgccgtac

SEQ ID NO: 132452 - DNA, 35 bp, Artificial Sequence
  Description of Artificial Sequence: Synthetic oligonucleotide
tgagaaaatcaaagtgaacaagaccctgccgtacc

SEQ ID NO: 132453 - DNA, 34 bp, Artificial Sequence
  Description of Artificial Sequence: Synthetic oligonucleotide
gagaaaatcaaagtgaacaagaccctgccgtacc

SEQ ID NO: 132454 - DNA, 36 bp, Artificial Sequence
  Description of Artificial Sequence: Synthetic oligonucleotide
agaaaatcaaagtgaacaagaccctgccgtaccttg

SEQ ID NO: 132455 - DNA, 35 bp, Artificial Sequence
  Description of Artificial Sequence: Synthetic oligonucleotide
gaaaatcaaagtgaacaagaccctgccgtaccttg

SEQ ID NO: 132456 - DNA, 36 bp, Artificial Sequence
  Description of Artificial Sequence: Synthetic oligonucleotide
aaaatcaaagtgaacaagaccctgccgtaccttgtc

SEQ ID NO: 132457 - DNA, 35 bp, Artificial Sequence
  Description of Artificial Sequence: Synthetic oligonucleotide
aaatcaaagtgaacaagaccctgccgtaccttgtc

SEQ ID NO: 132458 - DNA, 34 bp, Artificial Sequence
  Description of Artificial Sequence: Synthetic oligonucleotide
aatcaaagtgaacaagaccctgccgtaccttgtc

SEQ ID NO: 132459 - DNA, 33 bp, Artificial Sequence
  Description of Artificial Sequence: Synthetic oligonucleotide
atcaaagtgaacaagaccctgccgtaccttgtc

SEQ ID NO: 132460 - DNA, 32 bp, Artificial Sequence
  Description of Artificial Sequence: Synthetic oligonucleotide
tcaaagtgaacaagaccctgccgtaccttgtc

SEQ ID NO: 132461 - DNA, 31 bp, Artificial Sequence
  Description of Artificial Sequence: Synthetic oligonucleotide
caaagtgaacaagaccctgccgtaccttgtc

SEQ ID NO: 132462 - DNA, 32 bp, Artificial Sequence
  Description of Artificial Sequence: Synthetic oligonucleotide
aaagtgaacaagaccctgccgtaccttgtctc

SEQ ID NO: 132463 - DNA, 31 bp, Artificial Sequence
  Description of Artificial Sequence: Synthetic oligonucleotide
aagtgaacaagaccctgccgtaccttgtctc

SEQ ID NO: 132464 - DNA, 30 bp, Artificial Sequence
  Description of Artificial Sequence: Synthetic oligonucleotide
agtgaacaagaccctgccgtaccttgtctc

SEQ ID NO: 132465 - DNA, 29 bp, Artificial Sequence
  Description of Artificial Sequence: Synthetic oligonucleotide
gtgaacaagaccctgccgtaccttgtctc

SEQ ID NO: 132466 - DNA, 29 bp, Artificial Sequence
  Description of Artificial Sequence: Synthetic oligonucleotide
tgaacaagaccctgccgtaccttgtctcc

SEQ ID NO: 132467 - DNA, 28 bp, Artificial Sequence
  Description of Artificial Sequence: Synthetic oligonucleotide
gaacaagaccctgccgtaccttgtctcc

SEQ ID NO: 132468 - DNA, 30 bp, Artificial Sequence
  Description of Artificial Sequence: Synthetic oligonucleotide
aacaagaccctgccgtaccttgtctccaac

SEQ ID NO: 132469 - DNA, 29 bp, Artificial Sequence
  Description of Artificial Sequence: Synthetic oligonucleotide
acaagaccctgccgtaccttgtctccaac

SEQ ID NO: 132470 - DNA, 28 bp, Artificial Sequence
  Description of Artificial Sequence: Synthetic oligonucleotide
caagaccctgccgtaccttgtctccaac

SEQ ID NO: 132471 - DNA, 28 bp, Artificial Sequence
  Description of Artificial Sequence: Synthetic oligonucleotide
aagaccctgccgtaccttgtctccaacg

SEQ ID NO: 132472 - DNA, 27 bp, Artificial Sequence
  Description of Artificial Sequence: Synthetic oligonucleotide
agaccctgccgtaccttgtctccaacg

SEQ ID NO: 132473 - DNA, 27 bp, Artificial Sequence
  Description of Artificial Sequence: Synthetic oligonucleotide
gaccctgccgtaccttgtctccaacgt

SEQ ID NO: 132474 - DNA, 27 bp, Artificial Sequence
  Description of Artificial Sequence: Synthetic oligonucleotide
accctgccgtaccttgtctccaacgtc

SEQ ID NO: 132475 - DNA, 27 bp, Artificial Sequence
  Description of Artificial Sequence: Synthetic oligonucleotide
ccctgccgtaccttgtctccaacgtca

SEQ ID NO: 132476 - DNA, 28 bp, Artificial Sequence
  Description of Artificial Sequence: Synthetic oligonucleotide
cctgccgtaccttgtctccaacgtcatc

SEQ ID NO: 132477 - DNA, 28 bp, Artificial Sequence
  Description of Artificial Sequence: Synthetic oligonucleotide
ctgccgtaccttgtctccaacgtcatcg

SEQ ID NO: 132478 - DNA, 29 bp, Artificial Sequence
  Description of Artificial Sequence: Synthetic oligonucleotide
tgccgtaccttgtctccaacgtcatcgag

SEQ ID NO: 132479 - DNA, 28 bp, Artificial Sequence
  Description of Artificial Sequence: Synthetic oligonucleotide
gccgtaccttgtctccaacgtcatcgag

SEQ ID NO: 132480 - DNA, 28 bp, Artificial Sequence
  Description of Artificial Sequence: Synthetic oligonucleotide
ccgtaccttgtctccaacgtcatcgagc

SEQ ID NO: 132481 - DNA, 29 bp, Artificial Sequence
  Description of Artificial Sequence: Synthetic oligonucleotide
cgtaccttgtctccaacgtcatcgagctc

SEQ ID NO: 132482 - DNA, 29 bp, Artificial Sequence
  Description of Artificial Sequence: Synthetic oligonucleotide
gtaccttgtctccaacgtcatcgagctcc

SEQ ID NO: 132483 - DNA, 30 bp, Artificial Sequence
  Description of Artificial Sequence: Synthetic oligonucleotide
taccttgtctccaacgtcatcgagctcctg

SEQ ID NO: 132484 - DNA, 29 bp, Artificial Sequence
  Description of Artificial Sequence: Synthetic oligonucleotide
accttgtctccaacgtcatcgagctcctg

SEQ ID NO: 132485 - DNA, 28 bp, Artificial Sequence
  Description of Artificial Sequence: Synthetic oligonucleotide
ccttgtctccaacgtcatcgagctcctg

SEQ ID NO: 132486 - DNA, 28 bp, Artificial Sequence
  Description of Artificial Sequence: Synthetic oligonucleotide
cttgtctccaacgtcatcgagctcctgg

SEQ ID NO: 132487 - DNA, 30 bp, Artificial Sequence
  Description of Artificial Sequence: Synthetic oligonucleotide
ttgtctccaacgtcatcgagctcctggatg

SEQ ID NO: 132488 - DNA, 29 bp, Artificial Sequence
  Description of Artificial Sequence: Synthetic oligonucleotide
tgtctccaacgtcatcgagctcctggatg

SEQ ID NO: 132489 - DNA, 28 bp, Artificial Sequence
  Description of Artificial Sequence: Synthetic oligonucleotide
gtctccaacgtcatcgagctcctggatg

SEQ ID NO: 132490 - DNA, 30 bp, Artificial Sequence
  Description of Artificial Sequence: Synthetic oligonucleotide
tctccaacgtcatcgagctcctggatgttg

SEQ ID NO: 132491 - DNA, 29 bp, Artificial Sequence
  Description of Artificial Sequence: Synthetic oligonucleotide
ctccaacgtcatcgagctcctggatgttg

SEQ ID NO: 132492 - DNA, 31 bp, Artificial Sequence
  Description of Artificial Sequence: Synthetic oligonucleotide
tccaacgtcatcgagctcctggatgttgatc

SEQ ID NO: 132493 - DNA, 30 bp, Artificial Sequence
  Description of Artificial Sequence: Synthetic oligonucleotide
ccaacgtcatcgagctcctggatgttgatc

SEQ ID NO: 132494 - DNA, 30 bp, Artificial Sequence
  Description of Artificial Sequence: Synthetic oligonucleotide
caacgtcatcgagctcctggatgttgatcc

SEQ ID NO: 132495 - DNA, 34 bp, Artificial Sequence
  Description of Artificial Sequence: Synthetic oligonucleotide
aacgtcatcgagctcctggatgttgatcctaatg

SEQ ID NO: 132496 - DNA, 33 bp, Artificial Sequence
  Description of Artificial Sequence: Synthetic oligonucleotide
acgtcatcgagctcctggatgttgatcctaatg

SEQ ID NO: 132497 - DNA, 32 bp, Artificial Sequence
  Description of Artificial Sequence: Synthetic oligonucleotide
cgtcatcgagctcctggatgttgatcctaatg

SEQ ID NO: 132498 - DNA, 33 bp, Artificial Sequence
  Description of Artificial Sequence: Synthetic oligonucleotide
gtcatcgagctcctggatgttgatcctaatgac

SEQ ID NO: 132499 - DNA, 33 bp, Artificial Sequence
  Description of Artificial Sequence: Synthetic oligonucleotide
tcatcgagctcctggatgttgatcctaatgacc

SEQ ID NO: 132500 - DNA, 32 bp, Artificial Sequence
  Description of Artificial Sequence: Synthetic oligonucleotide
catcgagctcctggatgttgatcctaatgacc

SEQ ID NO: 132501 - DNA, 34 bp, Artificial Sequence
  Description of Artificial Sequence: Synthetic oligonucleotide
atcgagctcctggatgttgatcctaatgaccaag

SEQ ID NO: 132502 - DNA, 33 bp, Artificial Sequence
  Description of Artificial Sequence: Synthetic oligonucleotide
tcgagctcctggatgttgatcctaatgaccaag

SEQ ID NO: 132503 - DNA, 32 bp, Artificial Sequence
  Description of Artificial Sequence: Synthetic oligonucleotide
cgagctcctggatgttgatcctaatgaccaag

SEQ ID NO: 132504 - DNA, 33 bp, Artificial Sequence
  Description of Artificial Sequence: Synthetic oligonucleotide
gagctcctggatgttgatcctaatgaccaagag

SEQ ID NO: 132505 - DNA, 33 bp, Artificial Sequence
  Description of Artificial Sequence: Synthetic oligonucleotide
agctcctggatgttgatcctaatgaccaagagg

SEQ ID NO: 132506 - DNA, 32 bp, Artificial Sequence
  Description of Artificial Sequence: Synthetic oligonucleotide
gctcctggatgttgatcctaatgaccaagagg

SEQ ID NO: 132507 - DNA, 33 bp, Artificial Sequence
  Description of Artificial Sequence: Synthetic oligonucleotide
ctcctggatgttgatcctaatgaccaagaggag

SEQ ID NO: 132508 - DNA, 33 bp, Artificial Sequence
  Description of Artificial Sequence: Synthetic oligonucleotide
tcctggatgttgatcctaatgaccaagaggagg

SEQ ID NO: 132509 - DNA, 32 bp, Artificial Sequence
  Description of Artificial Sequence: Synthetic oligonucleotide
cctggatgttgatcctaatgaccaagaggagg

SEQ ID NO: 132510 - DNA, 34 bp, Artificial Sequence
  Description of Artificial Sequence: Synthetic oligonucleotide
ctggatgttgatcctaatgaccaagaggaggatg

SEQ ID NO: 132511 - DNA, 34 bp, Artificial Sequence
  Description of Artificial Sequence: Synthetic oligonucleotide
tggatgttgatcctaatgaccaagaggaggatgg

SEQ ID NO: 132512 - DNA, 33 bp, Artificial Sequence
  Description of Artificial Sequence: Synthetic oligonucleotide
ggatgttgatcctaatgaccaagaggaggatgg

SEQ ID NO: 132513 - DNA, 34 bp, Artificial Sequence
  Description of Artificial Sequence: Synthetic oligonucleotide
gatgttgatcctaatgaccaagaggaggatggtg

SEQ ID NO: 132514 - DNA, 34 bp, Artificial Sequence
  Description of Artificial Sequence: Synthetic oligonucleotide
atgttgatcctaatgaccaagaggaggatggtgc

SEQ ID NO: 132515 - DNA, 33 bp, Artificial Sequence
  Description of Artificial Sequence: Synthetic oligonucleotide
tgttgatcctaatgaccaagaggaggatggtgc

SEQ ID NO: 132516 - DNA, 32 bp, Artificial Sequence
  Description of Artificial Sequence: Synthetic oligonucleotide
gttgatcctaatgaccaagaggaggatggtgc

SEQ ID NO: 132517 - DNA, 32 bp, Artificial Sequence
  Description of Artificial Sequence: Synthetic oligonucleotide
ttgatcctaatgaccaagaggaggatggtgcc

SEQ ID NO: 132518 - DNA, 31 bp, Artificial Sequence
  Description of Artificial Sequence: Synthetic oligonucleotide
tgatcctaatgaccaagaggaggatggtgcc

SEQ ID NO: 132519 - DNA, 30 bp, Artificial Sequence
  Description of Artificial Sequence: Synthetic oligonucleotide
gatcctaatgaccaagaggaggatggtgcc

SEQ ID NO: 132520 - DNA, 36 bp, Artificial Sequence
  Description of Artificial Sequence: Synthetic oligonucleotide
atcctaatgaccaagaggaggatggtgccaatattg

SEQ ID NO: 132521 - DNA, 35 bp, Artificial Sequence
  Description of Artificial Sequence: Synthetic oligonucleotide
tcctaatgaccaagaggaggatggtgccaatattg

SEQ ID NO: 132522 - DNA, 34 bp, Artificial Sequence
  Description of Artificial Sequence: Synthetic oligonucleotide
cctaatgaccaagaggaggatggtgccaatattg

SEQ ID NO: 132523 - DNA, 35 bp, Artificial Sequence
  Description of Artificial Sequence: Synthetic oligonucleotide
ctaatgaccaagaggaggatggtgccaatattgac

SEQ ID NO: 132524 - DNA, 35 bp, Artificial Sequence
  Description of Artificial Sequence: Synthetic oligonucleotide
taatgaccaagaggaggatggtgccaatattgacc

SEQ ID NO: 132525 - DNA, 34 bp, Artificial Sequence
  Description of Artificial Sequence: Synthetic oligonucleotide
aatgaccaagaggaggatggtgccaatattgacc

SEQ ID NO: 132526 - DNA, 33 bp, Artificial Sequence
  Description of Artificial Sequence: Synthetic oligonucleotide
atgaccaagaggaggatggtgccaatattgacc

SEQ ID NO: 132527 - DNA, 32 bp, Artificial Sequence
  Description of Artificial Sequence: Synthetic oligonucleotide
tgaccaagaggaggatggtgccaatattgacc

SEQ ID NO: 132528 - DNA, 31 bp, Artificial Sequence
  Description of Artificial Sequence: Synthetic oligonucleotide
gaccaagaggaggatggtgccaatattgacc

SEQ ID NO: 132529 - DNA, 32 bp, Artificial Sequence
  Description of Artificial Sequence: Synthetic oligonucleotide
accaagaggaggatggtgccaatattgacctg

SEQ ID NO: 132530 - DNA, 31 bp, Artificial Sequence
  Description of Artificial Sequence: Synthetic oligonucleotide
ccaagaggaggatggtgccaatattgacctg

SEQ ID NO: 132531 - DNA, 31 bp, Artificial Sequence
  Description of Artificial Sequence: Synthetic oligonucleotide
caagaggaggatggtgccaatattgacctgg

SEQ ID NO: 132532 - DNA, 32 bp, Artificial Sequence
  Description of Artificial Sequence: Synthetic oligonucleotide
aagaggaggatggtgccaatattgacctggac

SEQ ID NO: 132533 - DNA, 31 bp, Artificial Sequence
  Description of Artificial Sequence: Synthetic oligonucleotide
agaggaggatggtgccaatattgacctggac

SEQ ID NO: 132534 - DNA, 30 bp, Artificial Sequence
  Description of Artificial Sequence: Synthetic oligonucleotide
gaggaggatggtgccaatattgacctggac

SEQ ID NO: 132535 - DNA, 31 bp, Artificial Sequence
  Description of Artificial Sequence: Synthetic oligonucleotide
aggaggatggtgccaatattgacctggactc

SEQ ID NO: 132536 - DNA, 30 bp, Artificial Sequence
  Description of Artificial Sequence: Synthetic oligonucleotide
ggaggatggtgccaatattgacctggactc

SEQ ID NO: 132537 - DNA, 30 bp, Artificial Sequence
  Description of Artificial Sequence: Synthetic oligonucleotide
gaggatggtgccaatattgacctggactcc

SEQ ID NO: 132538 - DNA, 30 bp, Artificial Sequence
  Description of Artificial Sequence: Synthetic oligonucleotide
aggatggtgccaatattgacctggactccc

SEQ ID NO: 132539 - DNA, 29 bp, Artificial Sequence
  Description of Artificial Sequence: Synthetic oligonucleotide
ggatggtgccaatattgacctggactccc

SEQ ID NO: 132540 - DNA, 30 bp, Artificial Sequence
  Description of Artificial Sequence: Synthetic oligonucleotide
gatggtgccaatattgacctggactcccag

SEQ ID NO: 132541 - DNA, 31 bp, Artificial Sequence
  Description of Artificial Sequence: Synthetic oligonucleotide
atggtgccaatattgacctggactcccagag

SEQ ID NO: 132542 - DNA, 30 bp, Artificial Sequence
  Description of Artificial Sequence: Synthetic oligonucleotide
tggtgccaatattgacctggactcccagag

SEQ ID NO: 132543 - DNA, 29 bp, Artificial Sequence
  Description of Artificial Sequence: Synthetic oligonucleotide
ggtgccaatattgacctggactcccagag

SEQ ID NO: 132544 - DNA, 29 bp, Artificial Sequence
  Description of Artificial Sequence: Synthetic oligonucleotide
gtgccaatattgacctggactcccagagg

SEQ ID NO: 132545 - DNA, 31 bp, Artificial Sequence
  Description of Artificial Sequence: Synthetic oligonucleotide
tgccaatattgacctggactcccagaggaag

SEQ ID NO: 132546 - DNA, 30 bp, Artificial Sequence
  Description of Artificial Sequence: Synthetic oligonucleotide
gccaatattgacctggactcccagaggaag

SEQ ID NO: 132547 - DNA, 30 bp, Artificial Sequence
  Description of Artificial Sequence: Synthetic oligonucleotide
ccaatattgacctggactcccagaggaagg

SEQ ID NO: 132548 - DNA, 30 bp, Artificial Sequence
  Description of Artificial Sequence: Synthetic oligonucleotide
caatattgacctggactcccagaggaaggg

SEQ ID NO: 132549 - DNA, 30 bp, Artificial Sequence
  Description of Artificial Sequence: Synthetic oligonucleotide
aatattgacctggactcccagaggaagggc

SEQ ID NO: 132550 - DNA, 29 bp, Artificial Sequence
  Description of Artificial Sequence: Synthetic oligonucleotide
atattgacctggactcccagaggaagggc

SEQ ID NO: 132551 - DNA, 28 bp, Artificial Sequence
  Description of Artificial Sequence: Synthetic oligonucleotide
tattgacctggactcccagaggaagggc

SEQ ID NO: 132552 - DNA, 27 bp, Artificial Sequence
  Description of Artificial Sequence: Synthetic oligonucleotide
attgacctggactcccagaggaagggc

SEQ ID NO: 132553 - DNA, 27 bp, Artificial Sequence
  Description of Artificial Sequence: Synthetic oligonucleotide
ttgacctggactcccagaggaagggca

SEQ ID NO: 132554 - DNA, 27 bp, Artificial Sequence
  Description of Artificial Sequence: Synthetic oligonucleotide
tgacctggactcccagaggaagggcaa

SEQ ID NO: 132555 - DNA, 26 bp, Artificial Sequence
  Description of Artificial Sequence: Synthetic oligonucleotide
gacctggactcccagaggaagggcaa

SEQ ID NO: 132556 - DNA, 27 bp, Artificial Sequence
  Description of Artificial Sequence: Synthetic oligonucleotide
acctggactcccagaggaagggcaagt

SEQ ID NO: 132557 - DNA, 26 bp, Artificial Sequence
  Description of Artificial Sequence: Synthetic oligonucleotide
cctggactcccagaggaagggcaagt

SEQ ID NO: 132558 - DNA, 27 bp, Artificial Sequence
  Description of Artificial Sequence: Synthetic oligonucleotide
ctggactcccagaggaagggcaagtgt

SEQ ID NO: 132559 - DNA, 27 bp, Artificial Sequence
  Description of Artificial Sequence: Synthetic oligonucleotide
tggactcccagaggaagggcaagtgtg

SEQ ID NO: 132560 - DNA, 26 bp, Artificial Sequence
  Description of Artificial Sequence: Synthetic oligonucleotide
ggactcccagaggaagggcaagtgtg

SEQ ID NO: 132561 - DNA, 27 bp, Artificial Sequence
  Description of Artificial Sequence: Synthetic oligonucleotide
gactcccagaggaagggcaagtgtgct

SEQ ID NO: 132562 - DNA, 27 bp, Artificial Sequence
  Description of Artificial Sequence: Synthetic oligonucleotide
actcccagaggaagggcaagtgtgctg

SEQ ID NO: 132563 - DNA, 27 bp, Artificial Sequence
  Description of Artificial Sequence: Synthetic oligonucleotide
ctcccagaggaagggcaagtgtgctgt

SEQ ID NO: 132564 - DNA, 27 bp, Artificial Sequence
  Description of Artificial Sequence: Synthetic oligonucleotide
tcccagaggaagggcaagtgtgctgtg

SEQ ID NO: 132565 - DNA, 27 bp, Artificial Sequence
  Description of Artificial Sequence: Synthetic oligonucleotide
cccagaggaagggcaagtgtgctgtga

SEQ ID NO: 132566 - DNA, 28 bp, Artificial Sequence
  Description of Artificial Sequence: Synthetic oligonucleotide
ccagaggaagggcaagtgtgctgtgatc

SEQ ID NO: 132567 - DNA, 32 bp, Artificial Sequence
  Description of Artificial Sequence: Synthetic oligonucleotide
cagaggaagggcaagtgtgctgtgatcaaaac

SEQ ID NO: 132568 - DNA, 32 bp, Artificial Sequence
  Description of Artificial Sequence: Synthetic oligonucleotide
agaggaagggcaagtgtgctgtgatcaaaacc

SEQ ID NO: 132569 - DNA, 31 bp, Artificial Sequence
  Description of Artificial Sequence: Synthetic oligonucleotide
gaggaagggcaagtgtgctgtgatcaaaacc

SEQ ID NO: 132570 - DNA, 32 bp, Artificial Sequence
  Description of Artificial Sequence: Synthetic oligonucleotide
aggaagggcaagtgtgctgtgatcaaaacctc

SEQ ID NO: 132571 - DNA, 31 bp, Artificial Sequence
  Description of Artificial Sequence: Synthetic oligonucleotide
ggaagggcaagtgtgctgtgatcaaaacctc

SEQ ID NO: 132572 - DNA, 33 bp, Artificial Sequence
  Description of Artificial Sequence: Synthetic oligonucleotide
gaagggcaagtgtgctgtgatcaaaacctctac

SEQ ID NO: 132573 - DNA, 34 bp, Artificial Sequence
  Description of Artificial Sequence: Synthetic oligonucleotide
aagggcaagtgtgctgtgatcaaaacctctacac

SEQ ID NO: 132574 - DNA, 33 bp, Artificial Sequence
  Description of Artificial Sequence: Synthetic oligonucleotide
agggcaagtgtgctgtgatcaaaacctctacac

SEQ ID NO: 132575 - DNA, 32 bp, Artificial Sequence
  Description of Artificial Sequence: Synthetic oligonucleotide
gggcaagtgtgctgtgatcaaaacctctacac

SEQ ID NO: 132576 - DNA, 32 bp, Artificial Sequence
  Description of Artificial Sequence: Synthetic oligonucleotide
ggcaagtgtgctgtgatcaaaacctctacacg

SEQ ID NO: 132577 - DNA, 33 bp, Artificial Sequence
  Description of Artificial Sequence: Synthetic oligonucleotide
gcaagtgtgctgtgatcaaaacctctacacgac

SEQ ID NO: 132578 - DNA, 34 bp, Artificial Sequence
  Description of Artificial Sequence: Synthetic oligonucleotide
caagtgtgctgtgatcaaaacctctacacgacag

SEQ ID NO: 132579 - DNA, 35 bp, Artificial Sequence
  Description of Artificial Sequence: Synthetic oligonucleotide
aagtgtgctgtgatcaaaacctctacacgacagac

SEQ ID NO: 132580 - DNA, 34 bp, Artificial Sequence
  Description of Artificial Sequence: Synthetic oligonucleotide
agtgtgctgtgatcaaaacctctacacgacagac

SEQ ID NO: 132581 - DNA, 33 bp, Artificial Sequence
  Description of Artificial Sequence: Synthetic oligonucleotide
gtgtgctgtgatcaaaacctctacacgacagac

SEQ ID NO: 132582 - DNA, 33 bp, Artificial Sequence
  Description of Artificial Sequence: Synthetic oligonucleotide
tgtgctgtgatcaaaacctctacacgacagacg

SEQ ID NO: 132583 - DNA, 32 bp, Artificial Sequence
  Description of Artificial Sequence: Synthetic oligonucleotide
gtgctgtgatcaaaacctctacacgacagacg

SEQ ID NO: 132584 - DNA, 34 bp, Artificial Sequence
  Description of Artificial Sequence: Synthetic oligonucleotide
tgctgtgatcaaaacctctacacgacagacgtac

SEQ ID NO: 132585 - DNA, 33 bp, Artificial Sequence
  Description of Artificial Sequence: Synthetic oligonucleotide
gctgtgatcaaaacctctacacgacagacgtac

SEQ ID NO: 132586 - DNA, 35 bp, Artificial Sequence
  Description of Artificial Sequence: Synthetic oligonucleotide
ctgtgatcaaaacctctacacgacagacgtacttc

SEQ ID NO: 132587 - DNA, 35 bp, Artificial Sequence
  Description of Artificial Sequence: Synthetic oligonucleotide
tgtgatcaaaacctctacacgacagacgtacttcc

SEQ ID NO: 132588 - DNA, 34 bp, Artificial Sequence
  Description of Artificial Sequence: Synthetic oligonucleotide
gtgatcaaaacctctacacgacagacgtacttcc

SEQ ID NO: 132589 - DNA, 36 bp, Artificial Sequence
  Description of Artificial Sequence: Synthetic oligonucleotide
tgatcaaaacctctacacgacagacgtacttccttc

SEQ ID NO: 132590 - DNA, 35 bp, Artificial Sequence
  Description of Artificial Sequence: Synthetic oligonucleotide
gatcaaaacctctacacgacagacgtacttccttc

SEQ ID NO: 132591 - DNA, 35 bp, Artificial Sequence
  Description of Artificial Sequence: Synthetic oligonucleotide
atcaaaacctctacacgacagacgtacttccttcc

SEQ ID NO: 132592 - DNA, 34 bp, Artificial Sequence
  Description of Artificial Sequence: Synthetic oligonucleotide
tcaaaacctctacacgacagacgtacttccttcc

SEQ ID NO: 132593 - DNA, 33 bp, Artificial Sequence
  Description of Artificial Sequence: Synthetic oligonucleotide
caaaacctctacacgacagacgtacttccttcc

SEQ ID NO: 132594 - DNA, 34 bp, Artificial Sequence
  Description of Artificial Sequence: Synthetic oligonucleotide
aaaacctctacacgacagacgtacttccttcctg

SEQ ID NO: 132595 - DNA, 33 bp, Artificial Sequence
  Description of Artificial Sequence: Synthetic oligonucleotide
aaacctctacacgacagacgtacttccttcctg

SEQ ID NO: 132596 - DNA, 32 bp, Artificial Sequence
  Description of Artificial Sequence: Synthetic oligonucleotide
aacctctacacgacagacgtacttccttcctg

SEQ ID NO: 132597 - DNA, 31 bp, Artificial Sequence
  Description of Artificial Sequence: Synthetic oligonucleotide
acctctacacgacagacgtacttccttcctg

SEQ ID NO: 132598 - DNA, 30 bp, Artificial Sequence
  Description of Artificial Sequence: Synthetic oligonucleotide
cctctacacgacagacgtacttccttcctg

SEQ ID NO: 132599 - DNA, 31 bp, Artificial Sequence
  Description of Artificial Sequence: Synthetic oligonucleotide
ctctacacgacagacgtacttccttcctgtg

SEQ ID NO: 132600 - DNA, 34 bp, Artificial Sequence
  Description of Artificial Sequence: Synthetic oligonucleotide
tctacacgacagacgtacttccttcctgtgattg

SEQ ID NO: 132601 - DNA, 33 bp, Artificial Sequence
  Description of Artificial Sequence: Synthetic oligonucleotide
ctacacgacagacgtacttccttcctgtgattg

SEQ ID NO: 132602 - DNA, 33 bp, Artificial Sequence
  Description of Artificial Sequence: Synthetic oligonucleotide
tacacgacagacgtacttccttcctgtgattgg

SEQ ID NO: 132603 - DNA, 32 bp, Artificial Sequence
  Description of Artificial Sequence: Synthetic oligonucleotide
acacgacagacgtacttccttcctgtgattgg

SEQ ID NO: 132604 - DNA, 31 bp, Artificial Sequence
  Description of Artificial Sequence: Synthetic oligonucleotide
cacgacagacgtacttccttcctgtgattgg

SEQ ID NO: 132605 - DNA, 31 bp, Artificial Sequence
  Description of Artificial Sequence: Synthetic oligonucleotide
acgacagacgtacttccttcctgtgattggg

SEQ ID NO: 132606 - DNA, 30 bp, Artificial Sequence
  Description of Artificial Sequence: Synthetic oligonucleotide
cgacagacgtacttccttcctgtgattggg

SEQ ID NO: 132607 - DNA, 32 bp, Artificial Sequence
  Description of Artificial Sequence: Synthetic oligonucleotide
gacagacgtacttccttcctgtgattgggttg

SEQ ID NO: 132608 - DNA, 32 bp, Artificial Sequence
  Description of Artificial Sequence: Synthetic oligonucleotide
acagacgtacttccttcctgtgattgggttgg

SEQ ID NO: 132609 - DNA, 31 bp, Artificial Sequence
  Description of Artificial Sequence: Synthetic oligonucleotide
cagacgtacttccttcctgtgattgggttgg

SEQ ID NO: 132610 - DNA, 32 bp, Artificial Sequence
  Description of Artificial Sequence: Synthetic oligonucleotide
agacgtacttccttcctgtgattgggttggtg

SEQ ID NO: 132611 - DNA, 31 bp, Artificial Sequence
  Description of Artificial Sequence: Synthetic oligonucleotide
gacgtacttccttcctgtgattgggttggtg

SEQ ID NO: 132612 - DNA, 31 bp, Artificial Sequence
  Description of Artificial Sequence: Synthetic oligonucleotide
acgtacttccttcctgtgattgggttggtgg

SEQ ID NO: 132613 - DNA, 30 bp, Artificial Sequence
  Description of Artificial Sequence: Synthetic oligonucleotide
cgtacttccttcctgtgattgggttggtgg

SEQ ID NO: 132614 - DNA, 32 bp, Artificial Sequence
  Description of Artificial Sequence: Synthetic oligonucleotide
gtacttccttcctgtgattgggttggtggatg

SEQ ID NO: 132615 - DNA, 32 bp, Artificial Sequence
  Description of Artificial Sequence: Synthetic oligonucleotide
tacttccttcctgtgattgggttggtggatgc

SEQ ID NO: 132616 - DNA, 31 bp, Artificial Sequence
  Description of Artificial Sequence: Synthetic oligonucleotide
acttccttcctgtgattgggttggtggatgc

SEQ ID NO: 132617 - DNA, 30 bp, Artificial Sequence
  Description of Artificial Sequence: Synthetic oligonucleotide
cttccttcctgtgattgggttggtggatgc

SEQ ID NO: 132618 - DNA, 31 bp, Artificial Sequence
  Description of Artificial Sequence: Synthetic oligonucleotide
ttccttcctgtgattgggttggtggatgctg

SEQ ID NO: 132619 - DNA, 30 bp, Artificial Sequence
  Description of Artificial Sequence: Synthetic oligonucleotide
tccttcctgtgattgggttggtggatgctg

SEQ ID NO: 132620 - DNA, 29 bp, Artificial Sequence
  Description of Artificial Sequence: Synthetic oligonucleotide
ccttcctgtgattgggttggtggatgctg

SEQ ID NO: 132621 - DNA, 33 bp, Artificial Sequence
  Description of Artificial Sequence: Synthetic oligonucleotide
cttcctgtgattgggttggtggatgctgaaaag

SEQ ID NO: 132622 - DNA, 33 bp, Artificial Sequence
  Description of Artificial Sequence: Synthetic oligonucleotide
ttcctgtgattgggttggtggatgctgaaaagc

SEQ ID NO: 132623 - DNA, 32 bp, Artificial Sequence
  Description of Artificial Sequence: Synthetic oligonucleotide
tcctgtgattgggttggtggatgctgaaaagc

SEQ ID NO: 132624 - DNA, 31 bp, Artificial Sequence
  Description of Artificial Sequence: Synthetic oligonucleotide
cctgtgattgggttggtggatgctgaaaagc

SEQ ID NO: 132625 - DNA, 35 bp, Artificial Sequence
  Description of Artificial Sequence: Synthetic oligonucleotide
ctgtgattgggttggtggatgctgaaaagctaaag

SEQ ID NO: 132626 - DNA, 35 bp, Artificial Sequence
  Description of Artificial Sequence: Synthetic oligonucleotide
tgtgattgggttggtggatgctgaaaagctaaagc

SEQ ID NO: 132627 - DNA, 34 bp, Artificial Sequence
  Description of Artificial Sequence: Synthetic oligonucleotide
gtgattgggttggtggatgctgaaaagctaaagc

SEQ ID NO: 132628 - DNA, 34 bp, Artificial Sequence
  Description of Artificial Sequence: Synthetic oligonucleotide
tgattgggttggtggatgctgaaaagctaaagcc

SEQ ID NO: 132629 - DNA, 33 bp, Artificial Sequence
  Description of Artificial Sequence: Synthetic oligonucleotide
gattgggttggtggatgctgaaaagctaaagcc

SEQ ID NO: 132630 - DNA, 34 bp, Artificial Sequence
  Description of Artificial Sequence: Synthetic oligonucleotide
attgggttggtggatgctgaaaagctaaagccag

SEQ ID NO: 132631 - DNA, 33 bp, Artificial Sequence
  Description of Artificial Sequence: Synthetic oligonucleotide
ttgggttggtggatgctgaaaagctaaagccag

SEQ ID NO: 132632 - DNA, 32 bp, Artificial Sequence
  Description of Artificial Sequence: Synthetic oligonucleotide
tgggttggtggatgctgaaaagctaaagccag

SEQ ID NO: 132633 - DNA, 31 bp, Artificial Sequence
  Description of Artificial Sequence: Synthetic oligonucleotide
gggttggtggatgctgaaaagctaaagccag

SEQ ID NO: 132634 - DNA, 31 bp, Artificial Sequence
  Description of Artificial Sequence: Synthetic oligonucleotide
ggttggtggatgctgaaaagctaaagccagg

SEQ ID NO: 132635 - DNA, 32 bp, Artificial Sequence
  Description of Artificial Sequence: Synthetic oligonucleotide
gttggtggatgctgaaaagctaaagccaggag

SEQ ID NO: 132636 - DNA, 33 bp, Artificial Sequence
  Description of Artificial Sequence: Synthetic oligonucleotide
ttggtggatgctgaaaagctaaagccaggagac

SEQ ID NO: 132637 - DNA, 32 bp, Artificial Sequence
  Description of Artificial Sequence: Synthetic oligonucleotide
tggtggatgctgaaaagctaaagccaggagac

SEQ ID NO: 132638 - DNA, 31 bp, Artificial Sequence
  Description of Artificial Sequence: Synthetic oligonucleotide
ggtggatgctgaaaagctaaagccaggagac

SEQ ID NO: 132639 - DNA, 31 bp, Artificial Sequence
  Description of Artificial Sequence: Synthetic oligonucleotide
gtggatgctgaaaagctaaagccaggagacc

SEQ ID NO: 132640 - DNA, 32 bp, Artificial Sequence
  Description of Artificial Sequence: Synthetic oligonucleotide
tggatgctgaaaagctaaagccaggagacctg

SEQ ID NO: 132641 - DNA, 31 bp, Artificial Sequence
  Description of Artificial Sequence: Synthetic oligonucleotide
ggatgctgaaaagctaaagccaggagacctg

SEQ ID NO: 132642 - DNA, 31 bp, Artificial Sequence
  Description of Artificial Sequence: Synthetic oligonucleotide
gatgctgaaaagctaaagccaggagacctgg

SEQ ID NO: 132643 - DNA, 32 bp, Artificial Sequence
  Description of Artificial Sequence: Synthetic oligonucleotide
atgctgaaaagctaaagccaggagacctggtg

SEQ ID NO: 132644 - DNA, 31 bp, Artificial Sequence
  Description of Artificial Sequence: Synthetic oligonucleotide
tgctgaaaagctaaagccaggagacctggtg

SEQ ID NO: 132645 - DNA, 30 bp, Artificial Sequence
  Description of Artificial Sequence: Synthetic oligonucleotide
gctgaaaagctaaagccaggagacctggtg

SEQ ID NO: 132646 - DNA, 30 bp, Artificial Sequence
  Description of Artificial Sequence: Synthetic oligonucleotide
ctgaaaagctaaagccaggagacctggtgg

SEQ ID NO: 132647 - DNA, 30 bp, Artificial Sequence
  Description of Artificial Sequence: Synthetic oligonucleotide
tgaaaagctaaagccaggagacctggtggg

SEQ ID NO: 132648 - DNA, 29 bp, Artificial Sequence
  Description of Artificial Sequence: Synthetic oligonucleotide
gaaaagctaaagccaggagacctggtggg

SEQ ID NO: 132649 - DNA, 30 bp, Artificial Sequence
  Description of Artificial Sequence: Synthetic oligonucleotide
aaaagctaaagccaggagacctggtgggtg

SEQ ID NO: 132650 - DNA, 29 bp, Artificial Sequence
  Description of Artificial Sequence: Synthetic oligonucleotide
aaagctaaagccaggagacctggtgggtg

SEQ ID NO: 132651 - DNA, 28 bp, Artificial Sequence
  Description of Artificial Sequence: Synthetic oligonucleotide
aagctaaagccaggagacctggtgggtg

SEQ ID NO: 132652 - DNA, 27 bp, Artificial Sequence
  Description of Artificial Sequence: Synthetic oligonucleotide
agctaaagccaggagacctggtgggtg

SEQ ID NO: 132653 - DNA, 27 bp, Artificial Sequence
  Description of Artificial Sequence: Synthetic oligonucleotide
gctaaagccaggagacctggtgggtgt

SEQ ID NO: 132654 - DNA, 27 bp, Artificial Sequence
  Description of Artificial Sequence: Synthetic oligonucleotide
ctaaagccaggagacctggtgggtgtg

SEQ ID NO: 132655 - DNA, 29 bp, Artificial Sequence
  Description of Artificial Sequence: Synthetic oligonucleotide
taaagccaggagacctggtgggtgtgaac

SEQ ID NO: 132656 - DNA, 28 bp, Artificial Sequence
  Description of Artificial Sequence: Synthetic oligonucleotide
aaagccaggagacctggtgggtgtgaac

SEQ ID NO: 132657 - DNA, 27 bp, Artificial Sequence
  Description of Artificial Sequence: Synthetic oligonucleotide
aagccaggagacctggtgggtgtgaac

SEQ ID NO: 132658 - DNA, 27 bp, Artificial Sequence
  Description of Artificial Sequence: Synthetic oligonucleotide
agccaggagacctggtgggtgtgaaca

SEQ ID NO: 132659 - DNA, 27 bp, Artificial Sequence
  Description of Artificial Sequence: Synthetic oligonucleotide
gccaggagacctggtgggtgtgaacaa

SEQ ID NO: 132660 - DNA, 28 bp, Artificial Sequence
  Description of Artificial Sequence: Synthetic oligonucleotide
ccaggagacctggtgggtgtgaacaaag

SEQ ID NO: 132661 - DNA, 29 bp, Artificial Sequence
  Description of Artificial Sequence: Synthetic oligonucleotide
caggagacctggtgggtgtgaacaaagac

SEQ ID NO: 132662 - DNA, 30 bp, Artificial Sequence
  Description of Artificial Sequence: Synthetic oligonucleotide
aggagacctggtgggtgtgaacaaagactc

SEQ ID NO: 132663 - DNA, 29 bp, Artificial Sequence
  Description of Artificial Sequence: Synthetic oligonucleotide
ggagacctggtgggtgtgaacaaagactc

SEQ ID NO: 132664 - DNA, 29 bp, Artificial Sequence
  Description of Artificial Sequence: Synthetic oligonucleotide
gagacctggtgggtgtgaacaaagactcc

SEQ ID NO: 132665 - DNA, 32 bp, Artificial Sequence
  Description of Artificial Sequence: Synthetic oligonucleotide
agacctggtgggtgtgaacaaagactcctatc

SEQ ID NO: 132666 - DNA, 31 bp, Artificial Sequence
  Description of Artificial Sequence: Synthetic oligonucleotide
gacctggtgggtgtgaacaaagactcctatc

SEQ ID NO: 132667 - DNA, 32 bp, Artificial Sequence
  Description of Artificial Sequence: Synthetic oligonucleotide
acctggtgggtgtgaacaaagactcctatctg

SEQ ID NO: 132668 - DNA, 31 bp, Artificial Sequence
  Description of Artificial Sequence: Synthetic oligonucleotide
cctggtgggtgtgaacaaagactcctatctg

SEQ ID NO: 132669 - DNA, 33 bp, Artificial Sequence
  Description of Artificial Sequence: Synthetic oligonucleotide
ctggtgggtgtgaacaaagactcctatctgatc

SEQ ID NO: 132670 - DNA, 33 bp, Artificial Sequence
  Description of Artificial Sequence: Synthetic oligonucleotide
tggtgggtgtgaacaaagactcctatctgatcc

SEQ ID NO: 132671 - DNA, 32 bp, Artificial Sequence
  Description of Artificial Sequence: Synthetic oligonucleotide
ggtgggtgtgaacaaagactcctatctgatcc

SEQ ID NO: 132672 - DNA, 33 bp, Artificial Sequence
  Description of Artificial Sequence: Synthetic oligonucleotide
gtgggtgtgaacaaagactcctatctgatcctg

SEQ ID NO: 132673 - DNA, 33 bp, Artificial Sequence
  Description of Artificial Sequence: Synthetic oligonucleotide
tgggtgtgaacaaagactcctatctgatcctgg

SEQ ID NO: 132674 - DNA, 32 bp, Artificial Sequence
  Description of Artificial Sequence: Synthetic oligonucleotide
gggtgtgaacaaagactcctatctgatcctgg

SEQ ID NO: 132675 - DNA, 33 bp, Artificial Sequence
  Description of Artificial Sequence: Synthetic oligonucleotide
ggtgtgaacaaagactcctatctgatcctggag

SEQ ID NO: 132676 - DNA, 34 bp, Artificial Sequence
  Description of Artificial Sequence: Synthetic oligonucleotide
gtgtgaacaaagactcctatctgatcctggagac

SEQ ID NO: 132677 - DNA, 34 bp, Artificial Sequence
  Description of Artificial Sequence: Synthetic oligonucleotide
tgtgaacaaagactcctatctgatcctggagacg

SEQ ID NO: 132678 - DNA, 33 bp, Artificial Sequence
  Description of Artificial Sequence: Synthetic oligonucleotide
gtgaacaaagactcctatctgatcctggagacg

SEQ ID NO: 132679 - DNA, 33 bp, Artificial Sequence
  Description of Artificial Sequence: Synthetic oligonucleotide
tgaacaaagactcctatctgatcctggagacgc

SEQ ID NO: 132680 - DNA, 32 bp, Artificial Sequence
  Description of Artificial Sequence: Synthetic oligonucleotide
gaacaaagactcctatctgatcctggagacgc

SEQ ID NO: 132681 - DNA, 33 bp, Artificial Sequence
  Description of Artificial Sequence: Synthetic oligonucleotide
aacaaagactcctatctgatcctggagacgctg

SEQ ID NO: 132682 - DNA, 32 bp, Artificial Sequence
  Description of Artificial Sequence: Synthetic oligonucleotide
acaaagactcctatctgatcctggagacgctg

SEQ ID NO: 132683 - DNA, 31 bp, Artificial Sequence
  Description of Artificial Sequence: Synthetic oligonucleotide
caaagactcctatctgatcctggagacgctg

SEQ ID NO: 132684 - DNA, 31 bp, Artificial Sequence
  Description of Artificial Sequence: Synthetic oligonucleotide
aaagactcctatctgatcctggagacgctgc

SEQ ID NO: 132685 - DNA, 30 bp, Artificial Sequence
  Description of Artificial Sequence: Synthetic oligonucleotide
aagactcctatctgatcctggagacgctgc

SEQ ID NO: 132686 - DNA, 29 bp, Artificial Sequence
  Description of Artificial Sequence: Synthetic oligonucleotide
agactcctatctgatcctggagacgctgc

SEQ ID NO: 132687 - DNA, 28 bp, Artificial Sequence
  Description of Artificial Sequence: Synthetic oligonucleotide
gactcctatctgatcctggagacgctgc

SEQ ID NO: 132688 - DNA, 28 bp, Artificial Sequence
  Description of Artificial Sequence: Synthetic oligonucleotide
actcctatctgatcctggagacgctgcc

SEQ ID NO: 132689 - DNA, 27 bp, Artificial Sequence
  Description of Artificial Sequence: Synthetic oligonucleotide
ctcctatctgatcctggagacgctgcc

SEQ ID NO: 132690 - DNA, 27 bp, Artificial Sequence
  Description of Artificial Sequence: Synthetic oligonucleotide
tcctatctgatcctggagacgctgccc

SEQ ID NO: 132691 - DNA, 27 bp, Artificial Sequence
  Description of Artificial Sequence: Synthetic oligonucleotide
cctatctgatcctggagacgctgccca

SEQ ID NO: 132692 - DNA, 27 bp, Artificial Sequence
  Description of Artificial Sequence: Synthetic oligonucleotide
ctatctgatcctggagacgctgcccac

SEQ ID NO: 132693 - DNA, 28 bp, Artificial Sequence
  Description of Artificial Sequence: Synthetic oligonucleotide
tatctgatcctggagacgctgcccacag

SEQ ID NO: 132694 - DNA, 27 bp, Artificial Sequence
  Description of Artificial Sequence: Synthetic oligonucleotide
atctgatcctggagacgctgcccacag

SEQ ID NO: 132695 - DNA, 27 bp, Artificial Sequence
  Description of Artificial Sequence: Synthetic oligonucleotide
tctgatcctggagacgctgcccacaga

SEQ ID NO: 132696 - DNA, 26 bp, Artificial Sequence
  Description of Artificial Sequence: Synthetic oligonucleotide
ctgatcctggagacgctgcccacaga

SEQ ID NO: 132697 - DNA, 27 bp, Artificial Sequence
  Description of Artificial Sequence: Synthetic oligonucleotide
tgatcctggagacgctgcccacagagt

SEQ ID NO: 132698 - DNA, 27 bp, Artificial Sequence
  Description of Artificial Sequence: Synthetic oligonucleotide
gatcctggagacgctgcccacagagta

SEQ ID NO: 132699 - DNA, 28 bp, Artificial Sequence
  Description of Artificial Sequence: Synthetic oligonucleotide
atcctggagacgctgcccacagagtatg

SEQ ID NO: 132700 - DNA, 27 bp, Artificial Sequence
  Description of Artificial Sequence: Synthetic oligonucleotide
tcctggagacgctgcccacagagtatg

SEQ ID NO: 132701 - DNA, 27 bp, Artificial Sequence
  Description of Artificial Sequence: Synthetic oligonucleotide
cctggagacgctgcccacagagtatga

SEQ ID NO: 132702 - DNA, 27 bp, Artificial Sequence
  Description of Artificial Sequence: Synthetic oligonucleotide
ctggagacgctgcccacagagtatgac

SEQ ID NO: 132703 - DNA, 28 bp, Artificial Sequence
  Description of Artificial Sequence: Synthetic oligonucleotide
tggagacgctgcccacagagtatgactc

SEQ ID NO: 132704 - DNA, 27 bp, Artificial Sequence
  Description of Artificial Sequence: Synthetic oligonucleotide
ggagacgctgcccacagagtatgactc

SEQ ID NO: 132705 - DNA, 27 bp, Artificial Sequence
  Description of Artificial Sequence: Synthetic oligonucleotide
gagacgctgcccacagagtatgactcg

SEQ ID NO: 132706 - DNA, 27 bp, Artificial Sequence
  Description of Artificial Sequence: Synthetic oligonucleotide
agacgctgcccacagagtatgactcgc

SEQ ID NO: 132707 - DNA, 26 bp, Artificial Sequence
  Description of Artificial Sequence: Synthetic oligonucleotide
gacgctgcccacagagtatgactcgc

SEQ ID NO: 132708 - DNA, 26 bp, Artificial Sequence
  Description of Artificial Sequence: Synthetic oligonucleotide
acgctgcccacagagtatgactcgcg

SEQ ID NO: 132709 - DNA, 25 bp, Artificial Sequence
  Description of Artificial Sequence: Synthetic oligonucleotide
cgctgcccacagagtatgactcgcg

SEQ ID NO: 132710 - DNA, 25 bp, Artificial Sequence
  Description of Artificial Sequence: Synthetic oligonucleotide
gctgcccacagagtatgactcgcgg

SEQ ID NO: 132711 - DNA, 26 bp, Artificial Sequence
  Description of Artificial Sequence: Synthetic oligonucleotide
ctgcccacagagtatgactcgcgggt

SEQ ID NO: 132712 - DNA, 27 bp, Artificial Sequence
  Description of Artificial Sequence: Synthetic oligonucleotide
tgcccacagagtatgactcgcgggtga

SEQ ID NO: 132713 - DNA, 27 bp, Artificial Sequence
  Description of Artificial Sequence: Synthetic oligonucleotide
gcccacagagtatgactcgcgggtgaa

SEQ ID NO: 132714 - DNA, 27 bp, Artificial Sequence
  Description of Artificial Sequence: Synthetic oligonucleotide
cccacagagtatgactcgcgggtgaag

SEQ ID NO: 132715 - DNA, 27 bp, Artificial Sequence
  Description of Artificial Sequence: Synthetic oligonucleotide
ccacagagtatgactcgcgggtgaagg

SEQ ID NO: 132716 - DNA, 27 bp, Artificial Sequence
  Description of Artificial Sequence: Synthetic oligonucleotide
cacagagtatgactcgcgggtgaaggc

SEQ ID NO: 132717 - DNA, 27 bp, Artificial Sequence
  Description of Artificial Sequence: Synthetic oligonucleotide
acagagtatgactcgcgggtgaaggcc

SEQ ID NO: 132718 - DNA, 27 bp, Artificial Sequence
  Description of Artificial Sequence: Synthetic oligonucleotide
cagagtatgactcgcgggtgaaggcca

SEQ ID NO: 132719 - DNA, 28 bp, Artificial Sequence
  Description of Artificial Sequence: Synthetic oligonucleotide
agagtatgactcgcgggtgaaggccatg

SEQ ID NO: 132720 - DNA, 27 bp, Artificial Sequence
  Description of Artificial Sequence: Synthetic oligonucleotide
gagtatgactcgcgggtgaaggccatg

SEQ ID NO: 132721 - DNA, 27 bp, Artificial Sequence
  Description of Artificial Sequence: Synthetic oligonucleotide
agtatgactcgcgggtgaaggccatgg

SEQ ID NO: 132722 - DNA, 27 bp, Artificial Sequence
  Description of Artificial Sequence: Synthetic oligonucleotide
gtatgactcgcgggtgaaggccatgga

SEQ ID NO: 132723 - DNA, 27 bp, Artificial Sequence
  Description of Artificial Sequence: Synthetic oligonucleotide
tatgactcgcgggtgaaggccatggag

SEQ ID NO: 132724 - DNA, 26 bp, Artificial Sequence
  Description of Artificial Sequence: Synthetic oligonucleotide
atgactcgcgggtgaaggccatggag

SEQ ID NO: 132725 - DNA, 25 bp, Artificial Sequence
  Description of Artificial Sequence: Synthetic oligonucleotide
tgactcgcgggtgaaggccatggag

SEQ ID NO: 132726 - DNA, 24 bp, Artificial Sequence
  Description of Artificial Sequence: Synthetic oligonucleotide
gactcgcgggtgaaggccatggag

SEQ ID NO: 132727 - DNA, 26 bp, Artificial Sequence
  Description of Artificial Sequence: Synthetic oligonucleotide
actcgcgggtgaaggccatggaggta

SEQ ID NO: 132728 - DNA, 25 bp, Artificial Sequence
  Description of Artificial Sequence: Synthetic oligonucleotide
ctcgcgggtgaaggccatggaggta

SEQ ID NO: 132729 - DNA, 26 bp, Artificial Sequence
  Description of Artificial Sequence: Synthetic oligonucleotide
tcgcgggtgaaggccatggaggtaga

SEQ ID NO: 132730 - DNA, 25 bp, Artificial Sequence
  Description of Artificial Sequence: Synthetic oligonucleotide
cgcgggtgaaggccatggaggtaga

SEQ ID NO: 132731 - DNA, 25 bp, Artificial Sequence
  Description of Artificial Sequence: Synthetic oligonucleotide
gcgggtgaaggccatggaggtagac

SEQ ID NO: 132732 - DNA, 26 bp, Artificial Sequence
  Description of Artificial Sequence: Synthetic oligonucleotide
cgggtgaaggccatggaggtagacga

SEQ ID NO: 132733 - DNA, 27 bp, Artificial Sequence
  Description of Artificial Sequence: Synthetic oligonucleotide
gggtgaaggccatggaggtagacgaga

SEQ ID NO: 132734 - DNA, 27 bp, Artificial Sequence
  Description of Artificial Sequence: Synthetic oligonucleotide
ggtgaaggccatggaggtagacgagag

SEQ ID NO: 132735 - DNA, 27 bp, Artificial Sequence
  Description of Artificial Sequence: Synthetic oligonucleotide
gtgaaggccatggaggtagacgagagg

SEQ ID NO: 132736 - DNA, 27 bp, Artificial Sequence
  Description of Artificial Sequence: Synthetic oligonucleotide
tgaaggccatggaggtagacgagaggc

SEQ ID NO: 132737 - DNA, 26 bp, Artificial Sequence
  Description of Artificial Sequence: Synthetic oligonucleotide
gaaggccatggaggtagacgagaggc

SEQ ID NO: 132738 - DNA, 26 bp, Artificial Sequence
  Description of Artificial Sequence: Synthetic oligonucleotide
aaggccatggaggtagacgagaggcc

SEQ ID NO: 132739 - DNA, 25 bp, Artificial Sequence
  Description of Artificial Sequence: Synthetic oligonucleotide
aggccatggaggtagacgagaggcc

SEQ ID NO: 132740 - DNA, 24 bp, Artificial Sequence
  Description of Artificial Sequence: Synthetic oligonucleotide
ggccatggaggtagacgagaggcc

SEQ ID NO: 132741 - DNA, 25 bp, Artificial Sequence
  Description of Artificial Sequence: Synthetic oligonucleotide
gccatggaggtagacgagaggccca

SEQ ID NO: 132742 - DNA, 25 bp, Artificial Sequence
  Description of Artificial Sequence: Synthetic oligonucleotide
ccatggaggtagacgagaggcccac

SEQ ID NO: 132743 - DNA, 25 bp, Artificial Sequence
  Description of Artificial Sequence: Synthetic oligonucleotide
catggaggtagacgagaggcccacg

SEQ ID NO: 132744 - DNA, 26 bp, Artificial Sequence
  Description of Artificial Sequence: Synthetic oligonucleotide
atggaggtagacgagaggcccacgga

SEQ ID NO: 132745 - DNA, 25 bp, Artificial Sequence
  Description of Artificial Sequence: Synthetic oligonucleotide
tggaggtagacgagaggcccacgga

SEQ ID NO: 132746 - DNA, 24 bp, Artificial Sequence
  Description of Artificial Sequence: Synthetic oligonucleotide
ggaggtagacgagaggcccacgga

SEQ ID NO: 132747 - DNA, 24 bp, Artificial Sequence
  Description of Artificial Sequence: Synthetic oligonucleotide
gaggtagacgagaggcccacggag

SEQ ID NO: 132748 - DNA, 27 bp, Artificial Sequence
  Description of Artificial Sequence: Synthetic oligonucleotide
aggtagacgagaggcccacggagcaat

SEQ ID NO: 132749 - DNA, 27 bp, Artificial Sequence
  Description of Artificial Sequence: Synthetic oligonucleotide
ggtagacgagaggcccacggagcaata

SEQ ID NO: 132750 - DNA, 27 bp, Artificial Sequence
  Description of Artificial Sequence: Synthetic oligonucleotide
gtagacgagaggcccacggagcaatac

SEQ ID NO: 132751 - DNA, 28 bp, Artificial Sequence
  Description of Artificial Sequence: Synthetic oligonucleotide
tagacgagaggcccacggagcaatacag

SEQ ID NO: 132752 - DNA, 27 bp, Artificial Sequence
  Description of Artificial Sequence: Synthetic oligonucleotide
agacgagaggcccacggagcaatacag

SEQ ID NO: 132753 - DNA, 27 bp, Artificial Sequence
  Description of Artificial Sequence: Synthetic oligonucleotide
gacgagaggcccacggagcaatacagt

SEQ ID NO: 132754 - DNA, 27 bp, Artificial Sequence
  Description of Artificial Sequence: Synthetic oligonucleotide
acgagaggcccacggagcaatacagtg

SEQ ID NO: 132755 - DNA, 27 bp, Artificial Sequence
  Description of Artificial Sequence: Synthetic oligonucleotide
cgagaggcccacggagcaatacagtga

SEQ ID NO: 132756 - DNA, 27 bp, Artificial Sequence
  Description of Artificial Sequence: Synthetic oligonucleotide
gagaggcccacggagcaatacagtgac

SEQ ID NO: 132757 - DNA, 30 bp, Artificial Sequence
  Description of Artificial Sequence: Synthetic oligonucleotide
agaggcccacggagcaatacagtgacattg

SEQ ID NO: 132758 - DNA, 29 bp, Artificial Sequence
  Description of Artificial Sequence: Synthetic oligonucleotide
gaggcccacggagcaatacagtgacattg

SEQ ID NO: 132759 - DNA, 29 bp, Artificial Sequence
  Description of Artificial Sequence: Synthetic oligonucleotide
aggcccacggagcaatacagtgacattgg

SEQ ID NO: 132760 - DNA, 28 bp, Artificial Sequence
  Description of Artificial Sequence: Synthetic oligonucleotide
ggcccacggagcaatacagtgacattgg

SEQ ID NO: 132761 - DNA, 28 bp, Artificial Sequence
  Description of Artificial Sequence: Synthetic oligonucleotide
gcccacggagcaatacagtgacattggg

SEQ ID NO: 132762 - DNA, 28 bp, Artificial Sequence
  Description of Artificial Sequence: Synthetic oligonucleotide
cccacggagcaatacagtgacattgggg

SEQ ID NO: 132763 - DNA, 28 bp, Artificial Sequence
  Description of Artificial Sequence: Synthetic oligonucleotide
ccacggagcaatacagtgacattggggg

SEQ ID NO: 132764 - DNA, 31 bp, Artificial Sequence
  Description of Artificial Sequence: Synthetic oligonucleotide
cacggagcaatacagtgacattgggggtttg

SEQ ID NO: 132765 - DNA, 31 bp, Artificial Sequence
  Description of Artificial Sequence: Synthetic oligonucleotide
acggagcaatacagtgacattgggggtttgg

SEQ ID NO: 132766 - DNA, 30 bp, Artificial Sequence
  Description of Artificial Sequence: Synthetic oligonucleotide
cggagcaatacagtgacattgggggtttgg

SEQ ID NO: 132767 - DNA, 31 bp, Artificial Sequence
  Description of Artificial Sequence: Synthetic oligonucleotide
ggagcaatacagtgacattgggggtttggac

SEQ ID NO: 132768 - DNA, 33 bp, Artificial Sequence
  Description of Artificial Sequence: Synthetic oligonucleotide
gagcaatacagtgacattgggggtttggacaag

SEQ ID NO: 132769 - DNA, 33 bp, Artificial Sequence
  Description of Artificial Sequence: Synthetic oligonucleotide
agcaatacagtgacattgggggtttggacaagc

SEQ ID NO: 132770 - DNA, 32 bp, Artificial Sequence
  Description of Artificial Sequence: Synthetic oligonucleotide
gcaatacagtgacattgggggtttggacaagc

SEQ ID NO: 132771 - DNA, 33 bp, Artificial Sequence
  Description of Artificial Sequence: Synthetic oligonucleotide
caatacagtgacattgggggtttggacaagcag

SEQ ID NO: 132772 - DNA, 35 bp, Artificial Sequence
  Description of Artificial Sequence: Synthetic oligonucleotide
aatacagtgacattgggggtttggacaagcagatc

SEQ ID NO: 132773 - DNA, 34 bp, Artificial Sequence
  Description of Artificial Sequence: Synthetic oligonucleotide
atacagtgacattgggggtttggacaagcagatc

SEQ ID NO: 132774 - DNA, 33 bp, Artificial Sequence
  Description of Artificial Sequence: Synthetic oligonucleotide
tacagtgacattgggggtttggacaagcagatc

SEQ ID NO: 132775 - DNA, 32 bp, Artificial Sequence
  Description of Artificial Sequence: Synthetic oligonucleotide
acagtgacattgggggtttggacaagcagatc

SEQ ID NO: 132776 - DNA, 31 bp, Artificial Sequence
  Description of Artificial Sequence: Synthetic oligonucleotide
cagtgacattgggggtttggacaagcagatc

SEQ ID NO: 132777 - DNA, 31 bp, Artificial Sequence
  Description of Artificial Sequence: Synthetic oligonucleotide
agtgacattgggggtttggacaagcagatcc

SEQ ID NO: 132778 - DNA, 30 bp, Artificial Sequence
  Description of Artificial Sequence: Synthetic oligonucleotide
gtgacattgggggtttggacaagcagatcc

SEQ ID NO: 132779 - DNA, 31 bp, Artificial Sequence
  Description of Artificial Sequence: Synthetic oligonucleotide
tgacattgggggtttggacaagcagatccag

SEQ ID NO: 132780 - DNA, 30 bp, Artificial Sequence
  Description of Artificial Sequence: Synthetic oligonucleotide
gacattgggggtttggacaagcagatccag

SEQ ID NO: 132781 - DNA, 30 bp, Artificial Sequence
  Description of Artificial Sequence: Synthetic oligonucleotide
acattgggggtttggacaagcagatccagg

SEQ ID NO: 132782 - DNA, 29 bp, Artificial Sequence
  Description of Artificial Sequence: Synthetic oligonucleotide
cattgggggtttggacaagcagatccagg

SEQ ID NO: 132783 - DNA, 30 bp, Artificial Sequence
  Description of Artificial Sequence: Synthetic oligonucleotide
attgggggtttggacaagcagatccaggag

SEQ ID NO: 132784 - DNA, 29 bp, Artificial Sequence
  Description of Artificial Sequence: Synthetic oligonucleotide
ttgggggtttggacaagcagatccaggag

SEQ ID NO: 132785 - DNA, 28 bp, Artificial Sequence
  Description of Artificial Sequence: Synthetic oligonucleotide
tgggggtttggacaagcagatccaggag

SEQ ID NO: 132786 - DNA, 27 bp, Artificial Sequence
  Description of Artificial Sequence: Synthetic oligonucleotide
gggggtttggacaagcagatccaggag

SEQ ID NO: 132787 - DNA, 27 bp, Artificial Sequence
  Description of Artificial Sequence: Synthetic oligonucleotide
ggggtttggacaagcagatccaggagc

SEQ ID NO: 132788 - DNA, 28 bp, Artificial Sequence
  Description of Artificial Sequence: Synthetic oligonucleotide
gggtttggacaagcagatccaggagctg

SEQ ID NO: 132789 - DNA, 28 bp, Artificial Sequence
  Description of Artificial Sequence: Synthetic oligonucleotide
ggtttggacaagcagatccaggagctgg

SEQ ID NO: 132790 - DNA, 29 bp, Artificial Sequence
  Description of Artificial Sequence: Synthetic oligonucleotide
gtttggacaagcagatccaggagctggtg

SEQ ID NO: 132791 - DNA, 29 bp, Artificial Sequence
  Description of Artificial Sequence: Synthetic oligonucleotide
tttggacaagcagatccaggagctggtgg

SEQ ID NO: 132792 - DNA, 28 bp, Artificial Sequence
  Description of Artificial Sequence: Synthetic oligonucleotide
ttggacaagcagatccaggagctggtgg

SEQ ID NO: 132793 - DNA, 27 bp, Artificial Sequence
  Description of Artificial Sequence: Synthetic oligonucleotide
tggacaagcagatccaggagctggtgg

SEQ ID NO: 132794 - DNA, 27 bp, Artificial Sequence
  Description of Artificial Sequence: Synthetic oligonucleotide
ggacaagcagatccaggagctggtgga

SEQ ID NO: 132795 - DNA, 27 bp, Artificial Sequence
  Description of Artificial Sequence: Synthetic oligonucleotide
gacaagcagatccaggagctggtggag

SEQ ID NO: 132796 - DNA, 27 bp, Artificial Sequence
  Description of Artificial Sequence: Synthetic oligonucleotide
acaagcagatccaggagctggtggagg

SEQ ID NO: 132797 - DNA, 26 bp, Artificial Sequence
  Description of Artificial Sequence: Synthetic oligonucleotide
caagcagatccaggagctggtggagg

SEQ ID NO: 132798 - DNA, 26 bp, Artificial Sequence
  Description of Artificial Sequence: Synthetic oligonucleotide
aagcagatccaggagctggtggaggc

SEQ ID NO: 132799 - DNA, 25 bp, Artificial Sequence
  Description of Artificial Sequence: Synthetic oligonucleotide
agcagatccaggagctggtggaggc

SEQ ID NO: 132800 - DNA, 24 bp, Artificial Sequence
  Description of Artificial Sequence: Synthetic oligonucleotide
gcagatccaggagctggtggaggc

SEQ ID NO: 132801 - DNA, 27 bp, Artificial Sequence
  Description of Artificial Sequence: Synthetic oligonucleotide
cagatccaggagctggtggaggccatt

SEQ ID NO: 132802 - DNA, 27 bp, Artificial Sequence
  Description of Artificial Sequence: Synthetic oligonucleotide
agatccaggagctggtggaggccattg

SEQ ID NO: 132803 - DNA, 27 bp, Artificial Sequence
  Description of Artificial Sequence: Synthetic oligonucleotide
gatccaggagctggtggaggccattgt

SEQ ID NO: 132804 - DNA, 27 bp, Artificial Sequence
  Description of Artificial Sequence: Synthetic oligonucleotide
atccaggagctggtggaggccattgtc

SEQ ID NO: 132805 - DNA, 27 bp, Artificial Sequence
  Description of Artificial Sequence: Synthetic oligonucleotide
tccaggagctggtggaggccattgtct

SEQ ID NO: 132806 - DNA, 27 bp, Artificial Sequence
  Description of Artificial Sequence: Synthetic oligonucleotide
ccaggagctggtggaggccattgtctt

SEQ ID NO: 132807 - DNA, 27 bp, Artificial Sequence
  Description of Artificial Sequence: Synthetic oligonucleotide
caggagctggtggaggccattgtcttg

SEQ ID NO: 132808 - DNA, 27 bp, Artificial Sequence
  Description of Artificial Sequence: Synthetic oligonucleotide
aggagctggtggaggccattgtcttgc

SEQ ID NO: 132809 - DNA, 26 bp, Artificial Sequence
  Description of Artificial Sequence: Synthetic oligonucleotide
ggagctggtggaggccattgtcttgc

SEQ ID NO: 132810 - DNA, 27 bp, Artificial Sequence
  Description of Artificial Sequence: Synthetic oligonucleotide
gagctggtggaggccattgtcttgcca

SEQ ID NO: 132811 - DNA, 29 bp, Artificial Sequence
  Description of Artificial Sequence: Synthetic oligonucleotide
agctggtggaggccattgtcttgccaatg

SEQ ID NO: 132812 - DNA, 28 bp, Artificial Sequence
  Description of Artificial Sequence: Synthetic oligonucleotide
gctggtggaggccattgtcttgccaatg

SEQ ID NO: 132813 - DNA, 30 bp, Artificial Sequence
  Description of Artificial Sequence: Synthetic oligonucleotide
ctggtggaggccattgtcttgccaatgaac

SEQ ID NO: 132814 - DNA, 30 bp, Artificial Sequence
  Description of Artificial Sequence: Synthetic oligonucleotide
tggtggaggccattgtcttgccaatgaacc

SEQ ID NO: 132815 - DNA, 29 bp, Artificial Sequence
  Description of Artificial Sequence: Synthetic oligonucleotide
ggtggaggccattgtcttgccaatgaacc

SEQ ID NO: 132816 - DNA, 30 bp, Artificial Sequence
  Description of Artificial Sequence: Synthetic oligonucleotide
gtggaggccattgtcttgccaatgaaccac

SEQ ID NO: 132817 - DNA, 32 bp, Artificial Sequence
  Description of Artificial Sequence: Synthetic oligonucleotide
tggaggccattgtcttgccaatgaaccacaag

SEQ ID NO: 132818 - DNA, 31 bp, Artificial Sequence
  Description of Artificial Sequence: Synthetic oligonucleotide
ggaggccattgtcttgccaatgaaccacaag

SEQ ID NO: 132819 - DNA, 31 bp, Artificial Sequence
  Description of Artificial Sequence: Synthetic oligonucleotide
gaggccattgtcttgccaatgaaccacaagg

SEQ ID NO: 132820 - DNA, 32 bp, Artificial Sequence
  Description of Artificial Sequence: Synthetic oligonucleotide
aggccattgtcttgccaatgaaccacaaggag

SEQ ID NO: 132821 - DNA, 31 bp, Artificial Sequence
  Description of Artificial Sequence: Synthetic oligonucleotide
ggccattgtcttgccaatgaaccacaaggag

SEQ ID NO: 132822 - DNA, 33 bp, Artificial Sequence
  Description of Artificial Sequence: Synthetic oligonucleotide
gccattgtcttgccaatgaaccacaaggagaag

SEQ ID NO: 132823 - DNA, 36 bp, Artificial Sequence
  Description of Artificial Sequence: Synthetic oligonucleotide
ccattgtcttgccaatgaaccacaaggagaagtttg

SEQ ID NO: 132824 - DNA, 37 bp, Artificial Sequence
  Description of Artificial Sequence: Synthetic oligonucleotide
cattgtcttgccaatgaaccacaaggagaagtttgag

SEQ ID NO: 132825 - DNA, 39 bp, Artificial Sequence
  Description of Artificial Sequence: Synthetic oligonucleotide
attgtcttgccaatgaaccacaaggagaagtttgagaac

SEQ ID NO: 132826 - DNA, 38 bp, Artificial Sequence
  Description of Artificial Sequence: Synthetic oligonucleotide
ttgtcttgccaatgaaccacaaggagaagtttgagaac

SEQ ID NO: 132827 - DNA, 37 bp, Artificial Sequence
  Description of Artificial Sequence: Synthetic oligonucleotide
tgtcttgccaatgaaccacaaggagaagtttgagaac

SEQ ID NO: 132828 - DNA, 36 bp, Artificial Sequence
  Description of Artificial Sequence: Synthetic oligonucleotide
gtcttgccaatgaaccacaaggagaagtttgagaac

SEQ ID NO: 132829 - DNA, 38 bp, Artificial Sequence
  Description of Artificial Sequence: Synthetic oligonucleotide
tcttgccaatgaaccacaaggagaagtttgagaacttg

SEQ ID NO: 132830 - DNA, 37 bp, Artificial Sequence
  Description of Artificial Sequence: Synthetic oligonucleotide
cttgccaatgaaccacaaggagaagtttgagaacttg

SEQ ID NO: 132831 - DNA, 37 bp, Artificial Sequence
  Description of Artificial Sequence: Synthetic oligonucleotide
ttgccaatgaaccacaaggagaagtttgagaacttgg

SEQ ID NO: 132832 - DNA, 36 bp, Artificial Sequence
  Description of Artificial Sequence: Synthetic oligonucleotide
tgccaatgaaccacaaggagaagtttgagaacttgg

SEQ ID NO: 132833 - DNA, 35 bp, Artificial Sequence
  Description of Artificial Sequence: Synthetic oligonucleotide
gccaatgaaccacaaggagaagtttgagaacttgg

SEQ ID NO: 132834 - DNA, 35 bp, Artificial Sequence
  Description of Artificial Sequence: Synthetic oligonucleotide
ccaatgaaccacaaggagaagtttgagaacttggg

SEQ ID NO: 132835 - DNA, 35 bp, Artificial Sequence
  Description of Artificial Sequence: Synthetic oligonucleotide
caatgaaccacaaggagaagtttgagaacttgggg

SEQ ID NO: 132836 - DNA, 37 bp, Artificial Sequence
  Description of Artificial Sequence: Synthetic oligonucleotide
aatgaaccacaaggagaagtttgagaacttggggatc

SEQ ID NO: 132837 - DNA, 36 bp, Artificial Sequence
  Description of Artificial Sequence: Synthetic oligonucleotide
atgaaccacaaggagaagtttgagaacttggggatc

SEQ ID NO: 132838 - DNA, 35 bp, Artificial Sequence
  Description of Artificial Sequence: Synthetic oligonucleotide
tgaaccacaaggagaagtttgagaacttggggatc

SEQ ID NO: 132839 - DNA, 34 bp, Artificial Sequence
  Description of Artificial Sequence: Synthetic oligonucleotide
gaaccacaaggagaagtttgagaacttggggatc

SEQ ID NO: 132840 - DNA, 34 bp, Artificial Sequence
  Description of Artificial Sequence: Synthetic oligonucleotide
aaccacaaggagaagtttgagaacttggggatcc

SEQ ID NO: 132841 - DNA, 33 bp, Artificial Sequence
  Description of Artificial Sequence: Synthetic oligonucleotide
accacaaggagaagtttgagaacttggggatcc

SEQ ID NO: 132842 - DNA, 32 bp, Artificial Sequence
  Description of Artificial Sequence: Synthetic oligonucleotide
ccacaaggagaagtttgagaacttggggatcc

SEQ ID NO: 132843 - DNA, 34 bp, Artificial Sequence
  Description of Artificial Sequence: Synthetic oligonucleotide
cacaaggagaagtttgagaacttggggatccaac

SEQ ID NO: 132844 - DNA, 34 bp, Artificial Sequence
  Description of Artificial Sequence: Synthetic oligonucleotide
acaaggagaagtttgagaacttggggatccaacc

SEQ ID NO: 132845 - DNA, 33 bp, Artificial Sequence
  Description of Artificial Sequence: Synthetic oligonucleotide
caaggagaagtttgagaacttggggatccaacc

SEQ ID NO: 132846 - DNA, 34 bp, Artificial Sequence
  Description of Artificial Sequence: Synthetic oligonucleotide
aaggagaagtttgagaacttggggatccaacctc

SEQ ID NO: 132847 - DNA, 33 bp, Artificial Sequence
  Description of Artificial Sequence: Synthetic oligonucleotide
aggagaagtttgagaacttggggatccaacctc

SEQ ID NO: 132848 - DNA, 32 bp, Artificial Sequence
  Description of Artificial Sequence: Synthetic oligonucleotide
ggagaagtttgagaacttggggatccaacctc

SEQ ID NO: 132849 - DNA, 32 bp, Artificial Sequence
  Description of Artificial Sequence: Synthetic oligonucleotide
gagaagtttgagaacttggggatccaacctcc

SEQ ID NO: 132850 - DNA, 36 bp, Artificial Sequence
  Description of Artificial Sequence: Synthetic oligonucleotide
agaagtttgagaacttggggatccaacctccaaaag

SEQ ID NO: 132851 - DNA, 35 bp, Artificial Sequence
  Description of Artificial Sequence: Synthetic oligonucleotide
gaagtttgagaacttggggatccaacctccaaaag

SEQ ID NO: 132852 - DNA, 35 bp, Artificial Sequence
  Description of Artificial Sequence: Synthetic oligonucleotide
aagtttgagaacttggggatccaacctccaaaagg

SEQ ID NO: 132853 - DNA, 34 bp, Artificial Sequence
  Description of Artificial Sequence: Synthetic oligonucleotide
agtttgagaacttggggatccaacctccaaaagg

SEQ ID NO: 132854 - DNA, 33 bp, Artificial Sequence
  Description of Artificial Sequence: Synthetic oligonucleotide
gtttgagaacttggggatccaacctccaaaagg

SEQ ID NO: 132855 - DNA, 33 bp, Artificial Sequence
  Description of Artificial Sequence: Synthetic oligonucleotide
tttgagaacttggggatccaacctccaaaaggg

SEQ ID NO: 132856 - DNA, 32 bp, Artificial Sequence
  Description of Artificial Sequence: Synthetic oligonucleotide
ttgagaacttggggatccaacctccaaaaggg

SEQ ID NO: 132857 - DNA, 31 bp, Artificial Sequence
  Description of Artificial Sequence: Synthetic oligonucleotide
tgagaacttggggatccaacctccaaaaggg

SEQ ID NO: 132858 - DNA, 30 bp, Artificial Sequence
  Description of Artificial Sequence: Synthetic oligonucleotide
gagaacttggggatccaacctccaaaaggg

SEQ ID NO: 132859 - DNA, 30 bp, Artificial Sequence
  Description of Artificial Sequence: Synthetic oligonucleotide
agaacttggggatccaacctccaaaagggg

SEQ ID NO: 132860 - DNA, 29 bp, Artificial Sequence
  Description of Artificial Sequence: Synthetic oligonucleotide
gaacttggggatccaacctccaaaagggg

SEQ ID NO: 132861 - DNA, 30 bp, Artificial Sequence
  Description of Artificial Sequence: Synthetic oligonucleotide
aacttggggatccaacctccaaaaggggtg

SEQ ID NO: 132862 - DNA, 29 bp, Artificial Sequence
  Description of Artificial Sequence: Synthetic oligonucleotide
acttggggatccaacctccaaaaggggtg

SEQ ID NO: 132863 - DNA, 28 bp, Artificial Sequence
  Description of Artificial Sequence: Synthetic oligonucleotide
cttggggatccaacctccaaaaggggtg

SEQ ID NO: 132864 - DNA, 28 bp, Artificial Sequence
  Description of Artificial Sequence: Synthetic oligonucleotide
ttggggatccaacctccaaaaggggtgc

SEQ ID NO: 132865 - DNA, 27 bp, Artificial Sequence
  Description of Artificial Sequence: Synthetic oligonucleotide
tggggatccaacctccaaaaggggtgc

SEQ ID NO: 132866 - DNA, 27 bp, Artificial Sequence
  Description of Artificial Sequence: Synthetic oligonucleotide
ggggatccaacctccaaaaggggtgct

SEQ ID NO: 132867 - DNA, 27 bp, Artificial Sequence
  Description of Artificial Sequence: Synthetic oligonucleotide
gggatccaacctccaaaaggggtgctg

SEQ ID NO: 132868 - DNA, 29 bp, Artificial Sequence
  Description of Artificial Sequence: Synthetic oligonucleotide
ggatccaacctccaaaaggggtgctgatg

SEQ ID NO: 132869 - DNA, 32 bp, Artificial Sequence
  Description of Artificial Sequence: Synthetic oligonucleotide
gatccaacctccaaaaggggtgctgatgtatg

SEQ ID NO: 132870 - DNA, 32 bp, Artificial Sequence
  Description of Artificial Sequence: Synthetic oligonucleotide
atccaacctccaaaaggggtgctgatgtatgg

SEQ ID NO: 132871 - DNA, 31 bp, Artificial Sequence
  Description of Artificial Sequence: Synthetic oligonucleotide
tccaacctccaaaaggggtgctgatgtatgg

SEQ ID NO: 132872 - DNA, 30 bp, Artificial Sequence
  Description of Artificial Sequence: Synthetic oligonucleotide
ccaacctccaaaaggggtgctgatgtatgg

SEQ ID NO: 132873 - DNA, 30 bp, Artificial Sequence
  Description of Artificial Sequence: Synthetic oligonucleotide
caacctccaaaaggggtgctgatgtatggg

SEQ ID NO: 132874 - DNA, 30 bp, Artificial Sequence
  Description of Artificial Sequence: Synthetic oligonucleotide
aacctccaaaaggggtgctgatgtatgggc

SEQ ID NO: 132875 - DNA, 29 bp, Artificial Sequence
  Description of Artificial Sequence: Synthetic oligonucleotide
acctccaaaaggggtgctgatgtatgggc

SEQ ID NO: 132876 - DNA, 28 bp, Artificial Sequence
  Description of Artificial Sequence: Synthetic oligonucleotide
cctccaaaaggggtgctgatgtatgggc

SEQ ID NO: 132877 - DNA, 28 bp, Artificial Sequence
  Description of Artificial Sequence: Synthetic oligonucleotide
ctccaaaaggggtgctgatgtatgggcc

SEQ ID NO: 132878 - DNA, 28 bp, Artificial Sequence
  Description of Artificial Sequence: Synthetic oligonucleotide
tccaaaaggggtgctgatgtatgggccc

SEQ ID NO: 132879 - DNA, 27 bp, Artificial Sequence
  Description of Artificial Sequence: Synthetic oligonucleotide
ccaaaaggggtgctgatgtatgggccc

SEQ ID NO: 132880 - DNA, 27 bp, Artificial Sequence
  Description of Artificial Sequence: Synthetic oligonucleotide
caaaaggggtgctgatgtatgggcccc

SEQ ID NO: 132881 - DNA, 27 bp, Artificial Sequence
  Description of Artificial Sequence: Synthetic oligonucleotide
aaaaggggtgctgatgtatgggccccc

SEQ ID NO: 132882 - DNA, 27 bp, Artificial Sequence
  Description of Artificial Sequence: Synthetic oligonucleotide
aaaggggtgctgatgtatgggccccca

SEQ ID NO: 132883 - DNA, 26 bp, Artificial Sequence
  Description of Artificial Sequence: Synthetic oligonucleotide
aaggggtgctgatgtatgggccccca

SEQ ID NO: 132884 - DNA, 25 bp, Artificial Sequence
  Description of Artificial Sequence: Synthetic oligonucleotide
aggggtgctgatgtatgggccccca

SEQ ID NO: 132885 - DNA, 24 bp, Artificial Sequence
  Description of Artificial Sequence: Synthetic oligonucleotide
ggggtgctgatgtatgggccccca

SEQ ID NO: 132886 - DNA, 24 bp, Artificial Sequence
  Description of Artificial Sequence: Synthetic oligonucleotide
gggtgctgatgtatgggcccccag

SEQ ID NO: 132887 - DNA, 24 bp, Artificial Sequence
  Description of Artificial Sequence: Synthetic oligonucleotide
ggtgctgatgtatgggcccccagg

SEQ ID NO: 132888 - DNA, 25 bp, Artificial Sequence
  Description of Artificial Sequence: Synthetic oligonucleotide
gtgctgatgtatgggcccccaggga

SEQ ID NO: 132889 - DNA, 25 bp, Artificial Sequence
  Description of Artificial Sequence: Synthetic oligonucleotide
tgctgatgtatgggcccccagggac

SEQ ID NO: 132890 - DNA, 24 bp, Artificial Sequence
  Description of Artificial Sequence: Synthetic oligonucleotide
gctgatgtatgggcccccagggac

SEQ ID NO: 132891 - DNA, 24 bp, Artificial Sequence
  Description of Artificial Sequence: Synthetic oligonucleotide
ctgatgtatgggcccccagggacg

SEQ ID NO: 132892 - DNA, 24 bp, Artificial Sequence
  Description of Artificial Sequence: Synthetic oligonucleotide
tgatgtatgggcccccagggacgg

SEQ ID NO: 132893 - DNA, 23 bp, Artificial Sequence
  Description of Artificial Sequence: Synthetic oligonucleotide
gatgtatgggcccccagggacgg

SEQ ID NO: 132894 - DNA, 23 bp, Artificial Sequence
  Description of Artificial Sequence: Synthetic oligonucleotide
atgtatgggcccccagggacggg

SEQ ID NO: 132895 - DNA, 22 bp, Artificial Sequence
  Description of Artificial Sequence: Synthetic oligonucleotide
tgtatgggcccccagggacggg

SEQ ID NO: 132896 - DNA, 21 bp, Artificial Sequence
  Description of Artificial Sequence: Synthetic oligonucleotide
gtatgggcccccagggacggg

SEQ ID NO: 132897 - DNA, 23 bp, Artificial Sequence
  Description of Artificial Sequence: Synthetic oligonucleotide
tatgggcccccagggacggggaa

SEQ ID NO: 132898 - DNA, 22 bp, Artificial Sequence
  Description of Artificial Sequence: Synthetic oligonucleotide
atgggcccccagggacggggaa

SEQ ID NO: 132899 - DNA, 21 bp, Artificial Sequence
  Description of Artificial Sequence: Synthetic oligonucleotide
tgggcccccagggacggggaa

SEQ ID NO: 132900 - DNA, 20 bp, Artificial Sequence
  Description of Artificial Sequence: Synthetic oligonucleotide
gggcccccagggacggggaa

SEQ ID NO: 132901 - DNA, 21 bp, Artificial Sequence
  Description of Artificial Sequence: Synthetic oligonucleotide
ggcccccagggacggggaaga

SEQ ID NO: 132902 - DNA, 21 bp, Artificial Sequence
  Description of Artificial Sequence: Synthetic oligonucleotide
gcccccagggacggggaagac

SEQ ID NO: 132903 - DNA, 21 bp, Artificial Sequence
  Description of Artificial Sequence: Synthetic oligonucleotide
cccccagggacggggaagacc

SEQ ID NO: 132904 - DNA, 22 bp, Artificial Sequence
  Description of Artificial Sequence: Synthetic oligonucleotide
ccccagggacggggaagaccct

SEQ ID NO: 132905 - DNA, 22 bp, Artificial Sequence
  Description of Artificial Sequence: Synthetic oligonucleotide
cccagggacggggaagaccctc

SEQ ID NO: 132906 - DNA, 23 bp, Artificial Sequence
  Description of Artificial Sequence: Synthetic oligonucleotide
ccagggacggggaagaccctcct

SEQ ID NO: 132907 - DNA, 23 bp, Artificial Sequence
  Description of Artificial Sequence: Synthetic oligonucleotide
cagggacggggaagaccctcctg

SEQ ID NO: 132908 - DNA, 23 bp, Artificial Sequence
  Description of Artificial Sequence: Synthetic oligonucleotide
agggacggggaagaccctcctgg

SEQ ID NO: 132909 - DNA, 22 bp, Artificial Sequence
  Description of Artificial Sequence: Synthetic oligonucleotide
gggacggggaagaccctcctgg

SEQ ID NO: 132910 - DNA, 22 bp, Artificial Sequence
  Description of Artificial Sequence: Synthetic oligonucleotide
ggacggggaagaccctcctggc

SEQ ID NO: 132911 - DNA, 22 bp, Artificial Sequence
  Description of Artificial Sequence: Synthetic oligonucleotide
gacggggaagaccctcctggcc

SEQ ID NO: 132912 - DNA, 22 bp, Artificial Sequence
  Description of Artificial Sequence: Synthetic oligonucleotide
acggggaagaccctcctggccc

SEQ ID NO: 132913 - DNA, 21 bp, Artificial Sequence
  Description of Artificial Sequence: Synthetic oligonucleotide
cggggaagaccctcctggccc

SEQ ID NO: 132914 - DNA, 21 bp, Artificial Sequence
  Description of Artificial Sequence: Synthetic oligonucleotide
ggggaagaccctcctggcccg

SEQ ID NO: 132915 - DNA, 21 bp, Artificial Sequence
  Description of Artificial Sequence: Synthetic oligonucleotide
gggaagaccctcctggcccgg

SEQ ID NO: 132916 - DNA, 21 bp, Artificial Sequence
  Description of Artificial Sequence: Synthetic oligonucleotide
ggaagaccctcctggcccggg

SEQ ID NO: 132917 - DNA, 21 bp, Artificial Sequence
  Description of Artificial Sequence: Synthetic oligonucleotide
gaagaccctcctggcccgggc

SEQ ID NO: 132918 - DNA, 22 bp, Artificial Sequence
  Description of Artificial Sequence: Synthetic oligonucleotide
aagaccctcctggcccgggcct

SEQ ID NO: 132919 - DNA, 21 bp, Artificial Sequence
  Description of Artificial Sequence: Synthetic oligonucleotide
agaccctcctggcccgggcct

SEQ ID NO: 132920 - DNA, 20 bp, Artificial Sequence
  Description of Artificial Sequence: Synthetic oligonucleotide
gaccctcctggcccgggcct

SEQ ID NO: 132921 - DNA, 21 bp, Artificial Sequence
  Description of Artificial Sequence: Synthetic oligonucleotide
accctcctggcccgggcctgt

SEQ ID NO: 132922 - DNA, 20 bp, Artificial Sequence
  Description of Artificial Sequence: Synthetic oligonucleotide
ccctcctggcccgggcctgt

SEQ ID NO: 132923 - DNA, 20 bp, Artificial Sequence
  Description of Artificial Sequence: Synthetic oligonucleotide
cctcctggcccgggcctgtg

SEQ ID NO: 132924 - DNA, 20 bp, Artificial Sequence
  Description of Artificial Sequence: Synthetic oligonucleotide
ctcctggcccgggcctgtgc

SEQ ID NO: 132925 - DNA, 20 bp, Artificial Sequence
  Description of Artificial Sequence: Synthetic oligonucleotide
tcctggcccgggcctgtgcc

SEQ ID NO: 132926 - DNA, 20 bp, Artificial Sequence
  Description of Artificial Sequence: Synthetic oligonucleotide
cctggcccgggcctgtgcct

SEQ ID NO: 132927 - DNA, 20 bp, Artificial Sequence
  Description of Artificial Sequence: Synthetic oligonucleotide
ctggcccgggcctgtgccgt

SEQ ID NO: 132928 - DNA, 20 bp, Artificial Sequence
  Description of Artificial Sequence: Synthetic oligonucleotide
tggcccgggcctgtgccgca

SEQ ID NO: 132929 - DNA, 20 bp, Artificial Sequence
  Description of Artificial Sequence: Synthetic oligonucleotide
ggcccgggcctgtgccgcat

SEQ ID NO: 132930 - DNA, 20 bp, Artificial Sequence
  Description of Artificial Sequence: Synthetic oligonucleotide
gcccgggcctgtgccgcaca

SEQ ID NO: 132931 - DNA, 21 bp, Artificial Sequence
  Description of Artificial Sequence: Synthetic oligonucleotide
cccgggcctgtgccgcacaga

SEQ ID NO: 132932 - DNA, 24 bp, Artificial Sequence
  Description of Artificial Sequence: Synthetic oligonucleotide
ccgggcctgtgccgcacagactaa

SEQ ID NO: 132933 - DNA, 24 bp, Artificial Sequence
  Description of Artificial Sequence: Synthetic oligonucleotide
cgggcctgtgccgcacagactaag

SEQ ID NO: 132934 - DNA, 24 bp, Artificial Sequence
  Description of Artificial Sequence: Synthetic oligonucleotide
gggcctgtgccgcacagactaagg

SEQ ID NO: 132935 - DNA, 24 bp, Artificial Sequence
  Description of Artificial Sequence: Synthetic oligonucleotide
ggcctgtgccgcacagactaaggc

SEQ ID NO: 132936 - DNA, 25 bp, Artificial Sequence
  Description of Artificial Sequence: Synthetic oligonucleotide
gcctgtgccgcacagactaaggcca

SEQ ID NO: 132937 - DNA, 25 bp, Artificial Sequence
  Description of Artificial Sequence: Synthetic oligonucleotide
cctgtgccgcacagactaaggccac

SEQ ID NO: 132938 - DNA, 27 bp, Artificial Sequence
  Description of Artificial Sequence: Synthetic oligonucleotide
ctgtgccgcacagactaaggccacctt

SEQ ID NO: 132939 - DNA, 27 bp, Artificial Sequence
  Description of Artificial Sequence: Synthetic oligonucleotide
tgtgccgcacagactaaggccaccttc

SEQ ID NO: 132940 - DNA, 26 bp, Artificial Sequence
  Description of Artificial Sequence: Synthetic oligonucleotide
gtgccgcacagactaaggccaccttc

SEQ ID NO: 132941 - DNA, 27 bp, Artificial Sequence
  Description of Artificial Sequence: Synthetic oligonucleotide
tgccgcacagactaaggccaccttcct

SEQ ID NO: 132942 - DNA, 27 bp, Artificial Sequence
  Description of Artificial Sequence: Synthetic oligonucleotide
gccgcacagactaaggccaccttccta

SEQ ID NO: 132943 - DNA, 29 bp, Artificial Sequence
  Description of Artificial Sequence: Synthetic oligonucleotide
ccgcacagactaaggccaccttcctaaag

SEQ ID NO: 132944 - DNA, 29 bp, Artificial Sequence
  Description of Artificial Sequence: Synthetic oligonucleotide
cgcacagactaaggccaccttcctaaagc

SEQ ID NO: 132945 - DNA, 30 bp, Artificial Sequence
  Description of Artificial Sequence: Synthetic oligonucleotide
gcacagactaaggccaccttcctaaagctg

SEQ ID NO: 132946 - DNA, 30 bp, Artificial Sequence
  Description of Artificial Sequence: Synthetic oligonucleotide
cacagactaaggccaccttcctaaagctgg

SEQ ID NO: 132947 - DNA, 30 bp, Artificial Sequence
  Description of Artificial Sequence: Synthetic oligonucleotide
acagactaaggccaccttcctaaagctggc

SEQ ID NO: 132948 - DNA, 29 bp, Artificial Sequence
  Description of Artificial Sequence: Synthetic oligonucleotide
cagactaaggccaccttcctaaagctggc

SEQ ID NO: 132949 - DNA, 30 bp, Artificial Sequence
  Description of Artificial Sequence: Synthetic oligonucleotide
agactaaggccaccttcctaaagctggctg

SEQ ID NO: 132950 - DNA, 29 bp, Artificial Sequence
  Description of Artificial Sequence: Synthetic oligonucleotide
gactaaggccaccttcctaaagctggctg

SEQ ID NO: 132951 - DNA, 29 bp, Artificial Sequence
  Description of Artificial Sequence: Synthetic oligonucleotide
actaaggccaccttcctaaagctggctgg

SEQ ID NO: 132952 - DNA, 28 bp, Artificial Sequence
  Description of Artificial Sequence: Synthetic oligonucleotide
ctaaggccaccttcctaaagctggctgg

SEQ ID NO: 132953 - DNA, 28 bp, Artificial Sequence
  Description of Artificial Sequence: Synthetic oligonucleotide
taaggccaccttcctaaagctggctggc

SEQ ID NO: 132954 - DNA, 27 bp, Artificial Sequence
  Description of Artificial Sequence: Synthetic oligonucleotide
aaggccaccttcctaaagctggctggc

SEQ ID NO: 132955 - DNA, 26 bp, Artificial Sequence
  Description of Artificial Sequence: Synthetic oligonucleotide
aggccaccttcctaaagctggctggc

SEQ ID NO: 132956 - DNA, 25 bp, Artificial Sequence
  Description of Artificial Sequence: Synthetic oligonucleotide
ggccaccttcctaaagctggctggc

SEQ ID NO: 132957 - DNA, 25 bp, Artificial Sequence
  Description of Artificial Sequence: Synthetic oligonucleotide
gccaccttcctaaagctggctggcc

SEQ ID NO: 132958 - DNA, 25 bp, Artificial Sequence
  Description of Artificial Sequence: Synthetic oligonucleotide
ccaccttcctaaagctggctggccc

SEQ ID NO: 132959 - DNA, 25 bp, Artificial Sequence
  Description of Artificial Sequence: Synthetic oligonucleotide
caccttcctaaagctggctggcccc

SEQ ID NO: 132960 - DNA, 26 bp, Artificial Sequence
  Description of Artificial Sequence: Synthetic oligonucleotide
accttcctaaagctggctggccccca

SEQ ID NO: 132961 - DNA, 25 bp, Artificial Sequence
  Description of Artificial Sequence: Synthetic oligonucleotide
ccttcctaaagctggctggccccca

SEQ ID NO: 132962 - DNA, 25 bp, Artificial Sequence
  Description of Artificial Sequence: Synthetic oligonucleotide
cttcctaaagctggctggcccccag

SEQ ID NO: 132963 - DNA, 26 bp, Artificial Sequence
  Description of Artificial Sequence: Synthetic oligonucleotide
ttcctaaagctggctggcccccagct

SEQ ID NO: 132964 - DNA, 25 bp, Artificial Sequence
  Description of Artificial Sequence: Synthetic oligonucleotide
tcctaaagctggctggcccccagct

SEQ ID NO: 132965 - DNA, 24 bp, Artificial Sequence
  Description of Artificial Sequence: Synthetic oligonucleotide
cctaaagctggctggcccccagct

SEQ ID NO: 132966 - DNA, 24 bp, Artificial Sequence
  Description of Artificial Sequence: Synthetic oligonucleotide
ctaaagctggctggcccccagctg

SEQ ID NO: 132967 - DNA, 25 bp, Artificial Sequence
  Description of Artificial Sequence: Synthetic oligonucleotide
taaagctggctggcccccagctggt

SEQ ID NO: 132968 - DNA, 24 bp, Artificial Sequence
  Description of Artificial Sequence: Synthetic oligonucleotide
aaagctggctggcccccagctggt

SEQ ID NO: 132969 - DNA, 23 bp, Artificial Sequence
  Description of Artificial Sequence: Synthetic oligonucleotide
aagctggctggcccccagctggt

SEQ ID NO: 132970 - DNA, 22 bp, Artificial Sequence
  Description of Artificial Sequence: Synthetic oligonucleotide
agctggctggcccccagctggt

SEQ ID NO: 132971 - DNA, 21 bp, Artificial Sequence
  Description of Artificial Sequence: Synthetic oligonucleotide
gctggctggcccccagctggt

SEQ ID NO: 132972 - DNA, 21 bp, Artificial Sequence
  Description of Artificial Sequence: Synthetic oligonucleotide
ctggctggcccccagctggtg

SEQ ID NO: 132973 - DNA, 22 bp, Artificial Sequence
  Description of Artificial Sequence: Synthetic oligonucleotide
tggctggcccccagctggtgca

SEQ ID NO: 132974 - DNA, 21 bp, Artificial Sequence
  Description of Artificial Sequence: Synthetic oligonucleotide
ggctggcccccagctggtgca

SEQ ID NO: 132975 - DNA, 23 bp, Artificial Sequence
  Description of Artificial Sequence: Synthetic oligonucleotide
gctggcccccagctggtgcagat

SEQ ID NO: 132976 - DNA, 25 bp, Artificial Sequence
  Description of Artificial Sequence: Synthetic oligonucleotide
ctggcccccagctggtgcagatgtt

SEQ ID NO: 132977 - DNA, 27 bp, Artificial Sequence
  Description of Artificial Sequence: Synthetic oligonucleotide
tggcccccagctggtgcagatgttcat

SEQ ID NO: 132978 - DNA, 27 bp, Artificial Sequence
  Description of Artificial Sequence: Synthetic oligonucleotide
ggcccccagctggtgcagatgttcatt

SEQ ID NO: 132979 - DNA, 27 bp, Artificial Sequence
  Description of Artificial Sequence: Synthetic oligonucleotide
gcccccagctggtgcagatgttcattg

SEQ ID NO: 132980 - DNA, 27 bp, Artificial Sequence
  Description of Artificial Sequence: Synthetic oligonucleotide
cccccagctggtgcagatgttcattgg

SEQ ID NO: 132981 - DNA, 28 bp, Artificial Sequence
  Description of Artificial Sequence: Synthetic oligonucleotide
ccccagctggtgcagatgttcattggag

SEQ ID NO: 132982 - DNA, 30 bp, Artificial Sequence
  Description of Artificial Sequence: Synthetic oligonucleotide
cccagctggtgcagatgttcattggagatg

SEQ ID NO: 132983 - DNA, 30 bp, Artificial Sequence
  Description of Artificial Sequence: Synthetic oligonucleotide
ccagctggtgcagatgttcattggagatgg

SEQ ID NO: 132984 - DNA, 31 bp, Artificial Sequence
  Description of Artificial Sequence: Synthetic oligonucleotide
cagctggtgcagatgttcattggagatggtg

SEQ ID NO: 132985 - DNA, 31 bp, Artificial Sequence
  Description of Artificial Sequence: Synthetic oligonucleotide
agctggtgcagatgttcattggagatggtgc

SEQ ID NO: 132986 - DNA, 30 bp, Artificial Sequence
  Description of Artificial Sequence: Synthetic oligonucleotide
gctggtgcagatgttcattggagatggtgc

SEQ ID NO: 132987 - DNA, 30 bp, Artificial Sequence
  Description of Artificial Sequence: Synthetic oligonucleotide
ctggtgcagatgttcattggagatggtgcc

SEQ ID NO: 132988 - DNA, 32 bp, Artificial Sequence
  Description of Artificial Sequence: Synthetic oligonucleotide
tggtgcagatgttcattggagatggtgccaag

SEQ ID NO: 132989 - DNA, 31 bp, Artificial Sequence
  Description of Artificial Sequence: Synthetic oligonucleotide
ggtgcagatgttcattggagatggtgccaag

SEQ ID NO: 132990 - DNA, 31 bp, Artificial Sequence
  Description of Artificial Sequence: Synthetic oligonucleotide
gtgcagatgttcattggagatggtgccaagc

SEQ ID NO: 132991 - DNA, 33 bp, Artificial Sequence
  Description of Artificial Sequence: Synthetic oligonucleotide
tgcagatgttcattggagatggtgccaagctag

SEQ ID NO: 132992 - DNA, 32 bp, Artificial Sequence
  Description of Artificial Sequence: Synthetic oligonucleotide
gcagatgttcattggagatggtgccaagctag

SEQ ID NO: 132993 - DNA, 33 bp, Artificial Sequence
  Description of Artificial Sequence: Synthetic oligonucleotide
cagatgttcattggagatggtgccaagctagtc

SEQ ID NO: 132994 - DNA, 33 bp, Artificial Sequence
  Description of Artificial Sequence: Synthetic oligonucleotide
agatgttcattggagatggtgccaagctagtcc

SEQ ID NO: 132995 - DNA, 32 bp, Artificial Sequence
  Description of Artificial Sequence: Synthetic oligonucleotide
gatgttcattggagatggtgccaagctagtcc

SEQ ID NO: 132996 - DNA, 32 bp, Artificial Sequence
  Description of Artificial Sequence: Synthetic oligonucleotide
atgttcattggagatggtgccaagctagtccg

SEQ ID NO: 132997 - DNA, 31 bp, Artificial Sequence
  Description of Artificial Sequence: Synthetic oligonucleotide
tgttcattggagatggtgccaagctagtccg

SEQ ID NO: 132998 - DNA, 30 bp, Artificial Sequence
  Description of Artificial Sequence: Synthetic oligonucleotide
gttcattggagatggtgccaagctagtccg

SEQ ID NO: 132999 - DNA, 30 bp, Artificial Sequence
  Description of Artificial Sequence: Synthetic oligonucleotide
ttcattggagatggtgccaagctagtccgg

SEQ ID NO: 133000 - DNA, 29 bp, Artificial Sequence
  Description of Artificial Sequence: Synthetic oligonucleotide
tcattggagatggtgccaagctagtccgg

SEQ ID NO: 133001 - DNA, 28 bp, Artificial Sequence
  Description of Artificial Sequence: Synthetic oligonucleotide
cattggagatggtgccaagctagtccgg

SEQ ID NO: 133002 - DNA, 28 bp, Artificial Sequence
  Description of Artificial Sequence: Synthetic oligonucleotide
attggagatggtgccaagctagtccggg

SEQ ID NO: 133003 - DNA, 27 bp, Artificial Sequence
  Description of Artificial Sequence: Synthetic oligonucleotide
ttggagatggtgccaagctagtccggg

SEQ ID NO: 133004 - DNA, 27 bp, Artificial Sequence
  Description of Artificial Sequence: Synthetic oligonucleotide
tggagatggtgccaagctagtccggga

SEQ ID NO: 133005 - DNA, 27 bp, Artificial Sequence
  Description of Artificial Sequence: Synthetic oligonucleotide
ggagatggtgccaagctagtccgggat

SEQ ID NO: 133006 - DNA, 27 bp, Artificial Sequence
  Description of Artificial Sequence: Synthetic oligonucleotide
gagatggtgccaagctagtccgggatg

SEQ ID NO: 133007 - DNA, 27 bp, Artificial Sequence
  Description of Artificial Sequence: Synthetic oligonucleotide
agatggtgccaagctagtccgggatgc

SEQ ID NO: 133008 - DNA, 26 bp, Artificial Sequence
  Description of Artificial Sequence: Synthetic oligonucleotide
gatggtgccaagctagtccgggatgc

SEQ ID NO: 133009 - DNA, 27 bp, Artificial Sequence
  Description of Artificial Sequence: Synthetic oligonucleotide
atggtgccaagctagtccgggatgcct

SEQ ID NO: 133010 - DNA, 27 bp, Artificial Sequence
  Description of Artificial Sequence: Synthetic oligonucleotide
tggtgccaagctagtccgggatgcctt

SEQ ID NO: 133011 - DNA, 27 bp, Artificial Sequence
  Description of Artificial Sequence: Synthetic oligonucleotide
ggtgccaagctagtccgggatgccttt

SEQ ID NO: 133012 - DNA, 27 bp, Artificial Sequence
  Description of Artificial Sequence: Synthetic oligonucleotide
gtgccaagctagtccgggatgcctttg

SEQ ID NO: 133013 - DNA, 27 bp, Artificial Sequence
  Description of Artificial Sequence: Synthetic oligonucleotide
tgccaagctagtccgggatgcctttgc

SEQ ID NO: 133014 - DNA, 26 bp, Artificial Sequence
  Description of Artificial Sequence: Synthetic oligonucleotide
gccaagctagtccgggatgcctttgc

SEQ ID NO: 133015 - DNA, 26 bp, Artificial Sequence
  Description of Artificial Sequence: Synthetic oligonucleotide
ccaagctagtccgggatgcctttgcc

SEQ ID NO: 133016 - DNA, 27 bp, Artificial Sequence
  Description of Artificial Sequence: Synthetic oligonucleotide
caagctagtccgggatgcctttgccct

SEQ ID NO: 133017 - DNA, 27 bp, Artificial Sequence
  Description of Artificial Sequence: Synthetic oligonucleotide
aagctagtccgggatgcctttgccctg

SEQ ID NO: 133018 - DNA, 26 bp, Artificial Sequence
  Description of Artificial Sequence: Synthetic oligonucleotide
agctagtccgggatgcctttgccctg

SEQ ID NO: 133019 - DNA, 25 bp, Artificial Sequence
  Description of Artificial Sequence: Synthetic oligonucleotide
gctagtccgggatgcctttgccctg

SEQ ID NO: 133020 - DNA, 25 bp, Artificial Sequence
  Description of Artificial Sequence: Synthetic oligonucleotide
ctagtccgggatgcctttgccctgg

SEQ ID NO: 133021 - DNA, 25 bp, Artificial Sequence
  Description of Artificial Sequence: Synthetic oligonucleotide
tagtccgggatgcctttgccctggc

SEQ ID NO: 133022 - DNA, 24 bp, Artificial Sequence
  Description of Artificial Sequence: Synthetic oligonucleotide
agtccgggatgcctttgccctggc

SEQ ID NO: 133023 - DNA, 23 bp, Artificial Sequence
  Description of Artificial Sequence: Synthetic oligonucleotide
gtccgggatgcctttgccctggc

SEQ ID NO: 133024 - DNA, 25 bp, Artificial Sequence
  Description of Artificial Sequence: Synthetic oligonucleotide
tccgggatgcctttgccctggccaa

SEQ ID NO: 133025 - DNA, 24 bp, Artificial Sequence
  Description of Artificial Sequence: Synthetic oligonucleotide
ccgggatgcctttgccctggccaa

SEQ ID NO: 133026 - DNA, 24 bp, Artificial Sequence
  Description of Artificial Sequence: Synthetic oligonucleotide
cgggatgcctttgccctggccaag

SEQ ID NO: 133027 - DNA, 25 bp, Artificial Sequence
  Description of Artificial Sequence: Synthetic oligonucleotide
gggatgcctttgccctggccaagga

SEQ ID NO: 133028 - DNA, 27 bp, Artificial Sequence
  Description of Artificial Sequence: Synthetic oligonucleotide
ggatgcctttgccctggccaaggagaa

SEQ ID NO: 133029 - DNA, 28 bp, Artificial Sequence
  Description of Artificial Sequence: Synthetic oligonucleotide
gatgcctttgccctggccaaggagaaag

SEQ ID NO: 133030 - DNA, 28 bp, Artificial Sequence
  Description of Artificial Sequence: Synthetic oligonucleotide
atgcctttgccctggccaaggagaaagc

SEQ ID NO: 133031 - DNA, 27 bp, Artificial Sequence
  Description of Artificial Sequence: Synthetic oligonucleotide
tgcctttgccctggccaaggagaaagc

SEQ ID NO: 133032 - DNA, 26 bp, Artificial Sequence
  Description of Artificial Sequence: Synthetic oligonucleotide
gcctttgccctggccaaggagaaagc

SEQ ID NO: 133033 - DNA, 26 bp, Artificial Sequence
  Description of Artificial Sequence: Synthetic oligonucleotide
cctttgccctggccaaggagaaagcg

SEQ ID NO: 133034 - DNA, 26 bp, Artificial Sequence
  Description of Artificial Sequence: Synthetic oligonucleotide
ctttgccctggccaaggagaaagcgc

SEQ ID NO: 133035 - DNA, 26 bp, Artificial Sequence
  Description of Artificial Sequence: Synthetic oligonucleotide
tttgccctggccaaggagaaagcgcc

SEQ ID NO: 133036 - DNA, 25 bp, Artificial Sequence
  Description of Artificial Sequence: Synthetic oligonucleotide
ttgccctggccaaggagaaagcgcc

SEQ ID NO: 133037 - DNA, 24 bp, Artificial Sequence
  Description of Artificial Sequence: Synthetic oligonucleotide
tgccctggccaaggagaaagcgcc

SEQ ID NO: 133038 - DNA, 23 bp, Artificial Sequence
  Description of Artificial Sequence: Synthetic oligonucleotide
gccctggccaaggagaaagcgcc

SEQ ID NO: 133039 - DNA, 24 bp, Artificial Sequence
  Description of Artificial Sequence: Synthetic oligonucleotide
ccctggccaaggagaaagcgccct

SEQ ID NO: 133040 - DNA, 27 bp, Artificial Sequence
  Description of Artificial Sequence: Synthetic oligonucleotide
cctggccaaggagaaagcgccctctat

SEQ ID NO: 133041 - DNA, 27 bp, Artificial Sequence
  Description of Artificial Sequence: Synthetic oligonucleotide
ctggccaaggagaaagcgccctctatc

SEQ ID NO: 133042 - DNA, 29 bp, Artificial Sequence
  Description of Artificial Sequence: Synthetic oligonucleotide
tggccaaggagaaagcgccctctatcatc

SEQ ID NO: 133043 - DNA, 28 bp, Artificial Sequence
  Description of Artificial Sequence: Synthetic oligonucleotide
ggccaaggagaaagcgccctctatcatc

SEQ ID NO: 133044 - DNA, 30 bp, Artificial Sequence
  Description of Artificial Sequence: Synthetic oligonucleotide
gccaaggagaaagcgccctctatcatcttc

SEQ ID NO: 133045 - DNA, 33 bp, Artificial Sequence
  Description of Artificial Sequence: Synthetic oligonucleotide
ccaaggagaaagcgccctctatcatcttcattg

SEQ ID NO: 133046 - DNA, 35 bp, Artificial Sequence
  Description of Artificial Sequence: Synthetic oligonucleotide
caaggagaaagcgccctctatcatcttcattgatg

SEQ ID NO: 133047 - DNA, 36 bp, Artificial Sequence
  Description of Artificial Sequence: Synthetic oligonucleotide
aaggagaaagcgccctctatcatcttcattgatgag

SEQ ID NO: 133048 - DNA, 35 bp, Artificial Sequence
  Description of Artificial Sequence: Synthetic oligonucleotide
aggagaaagcgccctctatcatcttcattgatgag

SEQ ID NO: 133049 - DNA, 34 bp, Artificial Sequence
  Description of Artificial Sequence: Synthetic oligonucleotide
ggagaaagcgccctctatcatcttcattgatgag

SEQ ID NO: 133050 - DNA, 36 bp, Artificial Sequence
  Description of Artificial Sequence: Synthetic oligonucleotide
gagaaagcgccctctatcatcttcattgatgagttg

SEQ ID NO: 133051 - DNA, 36 bp, Artificial Sequence
  Description of Artificial Sequence: Synthetic oligonucleotide
agaaagcgccctctatcatcttcattgatgagttgg

SEQ ID NO: 133052 - DNA, 35 bp, Artificial Sequence
  Description of Artificial Sequence: Synthetic oligonucleotide
gaaagcgccctctatcatcttcattgatgagttgg

SEQ ID NO: 133053 - DNA, 37 bp, Artificial Sequence
  Description of Artificial Sequence: Synthetic oligonucleotide
aaagcgccctctatcatcttcattgatgagttggatg

SEQ ID NO: 133054 - DNA, 36 bp, Artificial Sequence
  Description of Artificial Sequence: Synthetic oligonucleotide
aagcgccctctatcatcttcattgatgagttggatg

SEQ ID NO: 133055 - DNA, 35 bp, Artificial Sequence
  Description of Artificial Sequence: Synthetic oligonucleotide
agcgccctctatcatcttcattgatgagttggatg

SEQ ID NO: 133056 - DNA, 34 bp, Artificial Sequence
  Description of Artificial Sequence: Synthetic oligonucleotide
gcgccctctatcatcttcattgatgagttggatg

SEQ ID NO: 133057 - DNA, 34 bp, Artificial Sequence
  Description of Artificial Sequence: Synthetic oligonucleotide
cgccctctatcatcttcattgatgagttggatgc

SEQ ID NO: 133058 - DNA, 34 bp, Artificial Sequence
  Description of Artificial Sequence: Synthetic oligonucleotide
gccctctatcatcttcattgatgagttggatgcc

SEQ ID NO: 133059 - DNA, 36 bp, Artificial Sequence
  Description of Artificial Sequence: Synthetic oligonucleotide
ccctctatcatcttcattgatgagttggatgccatc

SEQ ID NO: 133060 - DNA, 36 bp, Artificial Sequence
  Description of Artificial Sequence: Synthetic oligonucleotide
cctctatcatcttcattgatgagttggatgccatcg

SEQ ID NO: 133061 - DNA, 36 bp, Artificial Sequence
  Description of Artificial Sequence: Synthetic oligonucleotide
ctctatcatcttcattgatgagttggatgccatcgg

SEQ ID NO: 133062 - DNA, 36 bp, Artificial Sequence
  Description of Artificial Sequence: Synthetic oligonucleotide
tctatcatcttcattgatgagttggatgccatcggc

SEQ ID NO: 133063 - DNA, 35 bp, Artificial Sequence
  Description of Artificial Sequence: Synthetic oligonucleotide
ctatcatcttcattgatgagttggatgccatcggc

SEQ ID NO: 133064 - DNA, 36 bp, Artificial Sequence
  Description of Artificial Sequence: Synthetic oligonucleotide
tatcatcttcattgatgagttggatgccatcggcac

SEQ ID NO: 133065 - DNA, 35 bp, Artificial Sequence
  Description of Artificial Sequence: Synthetic oligonucleotide
atcatcttcattgatgagttggatgccatcggcac

SEQ ID NO: 133066 - DNA, 34 bp, Artificial Sequence
  Description of Artificial Sequence: Synthetic oligonucleotide
tcatcttcattgatgagttggatgccatcggcac

SEQ ID NO: 133067 - DNA, 33 bp, Artificial Sequence
  Description of Artificial Sequence: Synthetic oligonucleotide
catcttcattgatgagttggatgccatcggcac

SEQ ID NO: 133068 - DNA, 33 bp, Artificial Sequence
  Description of Artificial Sequence: Synthetic oligonucleotide
atcttcattgatgagttggatgccatcggcacc

SEQ ID NO: 133069 - DNA, 32 bp, Artificial Sequence
  Description of Artificial Sequence: Synthetic oligonucleotide
tcttcattgatgagttggatgccatcggcacc

SEQ ID NO: 133070 - DNA, 31 bp, Artificial Sequence
  Description of Artificial Sequence: Synthetic oligonucleotide
cttcattgatgagttggatgccatcggcacc

SEQ ID NO: 133071 - DNA, 33 bp, Artificial Sequence
  Description of Artificial Sequence: Synthetic oligonucleotide
ttcattgatgagttggatgccatcggcaccaag

SEQ ID NO: 133072 - DNA, 32 bp, Artificial Sequence
  Description of Artificial Sequence: Synthetic oligonucleotide
tcattgatgagttggatgccatcggcaccaag

SEQ ID NO: 133073 - DNA, 31 bp, Artificial Sequence
  Description of Artificial Sequence: Synthetic oligonucleotide
cattgatgagttggatgccatcggcaccaag

SEQ ID NO: 133074 - DNA, 31 bp, Artificial Sequence
  Description of Artificial Sequence: Synthetic oligonucleotide
attgatgagttggatgccatcggcaccaagc

SEQ ID NO: 133075 - DNA, 30 bp, Artificial Sequence
  Description of Artificial Sequence: Synthetic oligonucleotide
ttgatgagttggatgccatcggcaccaagc

SEQ ID NO: 133076 - DNA, 29 bp, Artificial Sequence
  Description of Artificial Sequence: Synthetic oligonucleotide
tgatgagttggatgccatcggcaccaagc

SEQ ID NO: 133077 - DNA, 28 bp, Artificial Sequence
  Description of Artificial Sequence: Synthetic oligonucleotide
gatgagttggatgccatcggcaccaagc

SEQ ID NO: 133078 - DNA, 28 bp, Artificial Sequence
  Description of Artificial Sequence: Synthetic oligonucleotide
atgagttggatgccatcggcaccaagcg

SEQ ID NO: 133079 - DNA, 27 bp, Artificial Sequence
  Description of Artificial Sequence: Synthetic oligonucleotide
tgagttggatgccatcggcaccaagcg

SEQ ID NO: 133080 - DNA, 26 bp, Artificial Sequence
  Description of Artificial Sequence: Synthetic oligonucleotide
gagttggatgccatcggcaccaagcg

SEQ ID NO: 133081 - DNA, 27 bp, Artificial Sequence
  Description of Artificial Sequence: Synthetic oligonucleotide
agttggatgccatcggcaccaagcgct

SEQ ID NO: 133082 - DNA, 27 bp, Artificial Sequence
  Description of Artificial Sequence: Synthetic oligonucleotide
gttggatgccatcggcaccaagcgctt

SEQ ID NO: 133083 - DNA, 28 bp, Artificial Sequence
  Description of Artificial Sequence: Synthetic oligonucleotide
ttggatgccatcggcaccaagcgctttg

SEQ ID NO: 133084 - DNA, 27 bp, Artificial Sequence
  Description of Artificial Sequence: Synthetic oligonucleotide
tggatgccatcggcaccaagcgctttg

SEQ ID NO: 133085 - DNA, 27 bp, Artificial Sequence
  Description of Artificial Sequence: Synthetic oligonucleotide
ggatgccatcggcaccaagcgctttga

SEQ ID NO: 133086 - DNA, 27 bp, Artificial Sequence
  Description of Artificial Sequence: Synthetic oligonucleotide
gatgccatcggcaccaagcgctttgac

SEQ ID NO: 133087 - DNA, 28 bp, Artificial Sequence
  Description of Artificial Sequence: Synthetic oligonucleotide
atgccatcggcaccaagcgctttgacag

SEQ ID NO: 133088 - DNA, 27 bp, Artificial Sequence
  Description of Artificial Sequence: Synthetic oligonucleotide
tgccatcggcaccaagcgctttgacag

SEQ ID NO: 133089 - DNA, 27 bp, Artificial Sequence
  Description of Artificial Sequence: Synthetic oligonucleotide
gccatcggcaccaagcgctttgacagt

SEQ ID NO: 133090 - DNA, 27 bp, Artificial Sequence
  Description of Artificial Sequence: Synthetic oligonucleotide
ccatcggcaccaagcgctttgacagtg

SEQ ID NO: 133091 - DNA, 28 bp, Artificial Sequence
  Description of Artificial Sequence: Synthetic oligonucleotide
catcggcaccaagcgctttgacagtgag

SEQ ID NO: 133092 - DNA, 30 bp, Artificial Sequence
  Description of Artificial Sequence: Synthetic oligonucleotide
atcggcaccaagcgctttgacagtgagaag

SEQ ID NO: 133093 - DNA, 29 bp, Artificial Sequence
  Description of Artificial Sequence: Synthetic oligonucleotide
tcggcaccaagcgctttgacagtgagaag

SEQ ID NO: 133094 - DNA, 28 bp, Artificial Sequence
  Description of Artificial Sequence: Synthetic oligonucleotide
cggcaccaagcgctttgacagtgagaag

SEQ ID NO: 133095 - DNA, 28 bp, Artificial Sequence
  Description of Artificial Sequence: Synthetic oligonucleotide
ggcaccaagcgctttgacagtgagaagg

SEQ ID NO: 133096 - DNA, 28 bp, Artificial Sequence
  Description of Artificial Sequence: Synthetic oligonucleotide
gcaccaagcgctttgacagtgagaaggc

SEQ ID NO: 133097 - DNA, 29 bp, Artificial Sequence
  Description of Artificial Sequence: Synthetic oligonucleotide
caccaagcgctttgacagtgagaaggctg

SEQ ID NO: 133098 - DNA, 29 bp, Artificial Sequence
  Description of Artificial Sequence: Synthetic oligonucleotide
accaagcgctttgacagtgagaaggctgg

SEQ ID NO: 133099 - DNA, 28 bp, Artificial Sequence
  Description of Artificial Sequence: Synthetic oligonucleotide
ccaagcgctttgacagtgagaaggctgg

SEQ ID NO: 133100 - DNA, 28 bp, Artificial Sequence
  Description of Artificial Sequence: Synthetic oligonucleotide
caagcgctttgacagtgagaaggctggg

SEQ ID NO: 133101 - DNA, 28 bp, Artificial Sequence
  Description of Artificial Sequence: Synthetic oligonucleotide
aagcgctttgacagtgagaaggctgggg

SEQ ID NO: 133102 - DNA, 27 bp, Artificial Sequence
  Description of Artificial Sequence: Synthetic oligonucleotide
agcgctttgacagtgagaaggctgggg

SEQ ID NO: 133103 - DNA, 27 bp, Artificial Sequence
  Description of Artificial Sequence: Synthetic oligonucleotide
gcgctttgacagtgagaaggctgggga

SEQ ID NO: 133104 - DNA, 27 bp, Artificial Sequence
  Description of Artificial Sequence: Synthetic oligonucleotide
cgctttgacagtgagaaggctggggac

SEQ ID NO: 133105 - DNA, 27 bp, Artificial Sequence
  Description of Artificial Sequence: Synthetic oligonucleotide
gctttgacagtgagaaggctggggacc

SEQ ID NO: 133106 - DNA, 27 bp, Artificial Sequence
  Description of Artificial Sequence: Synthetic oligonucleotide
ctttgacagtgagaaggctggggaccg

SEQ ID NO: 133107 - DNA, 27 bp, Artificial Sequence
  Description of Artificial Sequence: Synthetic oligonucleotide
tttgacagtgagaaggctggggaccgg

SEQ ID NO: 133108 - DNA, 26 bp, Artificial Sequence
  Description of Artificial Sequence: Synthetic oligonucleotide
ttgacagtgagaaggctggggaccgg

SEQ ID NO: 133109 - DNA, 25 bp, Artificial Sequence
  Description of Artificial Sequence: Synthetic oligonucleotide
tgacagtgagaaggctggggaccgg

SEQ ID NO: 133110 - DNA, 24 bp, Artificial Sequence
  Description of Artificial Sequence: Synthetic oligonucleotide
gacagtgagaaggctggggaccgg

SEQ ID NO: 133111 - DNA, 25 bp, Artificial Sequence
  Description of Artificial Sequence: Synthetic oligonucleotide
acagtgagaaggctggggaccggga

SEQ ID NO: 133112 - DNA, 24 bp, Artificial Sequence
  Description of Artificial Sequence: Synthetic oligonucleotide
cagtgagaaggctggggaccggga

SEQ ID NO: 133113 - DNA, 24 bp, Artificial Sequence
  Description of Artificial Sequence: Synthetic oligonucleotide
agtgagaaggctggggaccgggag

SEQ ID NO: 133114 - DNA, 23 bp, Artificial Sequence
  Description of Artificial Sequence: Synthetic oligonucleotide
gtgagaaggctggggaccgggag

SEQ ID NO: 133115 - DNA, 24 bp, Artificial Sequence
  Description of Artificial Sequence: Synthetic oligonucleotide
tgagaaggctggggaccgggaggt

SEQ ID NO: 133116 - DNA, 23 bp, Artificial Sequence
  Description of Artificial Sequence: Synthetic oligonucleotide
gagaaggctggggaccgggaggt

SEQ ID NO: 133117 - DNA, 23 bp, Artificial Sequence
  Description of Artificial Sequence: Synthetic oligonucleotide
agaaggctggggaccgggaggtg

SEQ ID NO: 133118 - DNA, 22 bp, Artificial Sequence
  Description of Artificial Sequence: Synthetic oligonucleotide
gaaggctggggaccgggaggtg

SEQ ID NO: 133119 - DNA, 23 bp, Artificial Sequence
  Description of Artificial Sequence: Synthetic oligonucleotide
aaggctggggaccgggaggtgca

SEQ ID NO: 133120 - DNA, 22 bp, Artificial Sequence
  Description of Artificial Sequence: Synthetic oligonucleotide
aggctggggaccgggaggtgca

SEQ ID NO: 133121 - DNA, 21 bp, Artificial Sequence
  Description of Artificial Sequence: Synthetic oligonucleotide
ggctggggaccgggaggtgca

SEQ ID NO: 133122 - DNA, 22 bp, Artificial Sequence
  Description of Artificial Sequence: Synthetic oligonucleotide
gctggggaccgggaggtgcaga

SEQ ID NO: 133123 - DNA, 22 bp, Artificial Sequence
  Description of Artificial Sequence: Synthetic oligonucleotide
ctggggaccgggaggtgcagag

SEQ ID NO: 133124 - DNA, 23 bp, Artificial Sequence
  Description of Artificial Sequence: Synthetic oligonucleotide
tggggaccgggaggtgcagagga

SEQ ID NO: 133125 - DNA, 22 bp, Artificial Sequence
  Description of Artificial Sequence: Synthetic oligonucleotide
ggggaccgggaggtgcagagga

SEQ ID NO: 133126 - DNA, 25 bp, Artificial Sequence
  Description of Artificial Sequence: Synthetic oligonucleotide
gggaccgggaggtgcagaggacaat

SEQ ID NO: 133127 - DNA, 25 bp, Artificial Sequence
  Description of Artificial Sequence: Synthetic oligonucleotide
ggaccgggaggtgcagaggacaatg

SEQ ID NO: 133128 - DNA, 26 bp, Artificial Sequence
  Description of Artificial Sequence: Synthetic oligonucleotide
gaccgggaggtgcagaggacaatgct

SEQ ID NO: 133129 - DNA, 26 bp, Artificial Sequence
  Description of Artificial Sequence: Synthetic oligonucleotide
accgggaggtgcagaggacaatgctg

SEQ ID NO: 133130 - DNA, 25 bp, Artificial Sequence
  Description of Artificial Sequence: Synthetic oligonucleotide
ccgggaggtgcagaggacaatgctg

SEQ ID NO: 133131 - DNA, 26 bp, Artificial Sequence
  Description of Artificial Sequence: Synthetic oligonucleotide
cgggaggtgcagaggacaatgctgga

SEQ ID NO: 133132 - DNA, 26 bp, Artificial Sequence
  Description of Artificial Sequence: Synthetic oligonucleotide
gggaggtgcagaggacaatgctggag

SEQ ID NO: 133133 - DNA, 27 bp, Artificial Sequence
  Description of Artificial Sequence: Synthetic oligonucleotide
ggaggtgcagaggacaatgctggagct

SEQ ID NO: 133134 - DNA, 28 bp, Artificial Sequence
  Description of Artificial Sequence: Synthetic oligonucleotide
gaggtgcagaggacaatgctggagcttc

SEQ ID NO: 133135 - DNA, 29 bp, Artificial Sequence
  Description of Artificial Sequence: Synthetic oligonucleotide
aggtgcagaggacaatgctggagcttctg

SEQ ID NO: 133136 - DNA, 28 bp, Artificial Sequence
  Description of Artificial Sequence: Synthetic oligonucleotide
ggtgcagaggacaatgctggagcttctg

SEQ ID NO: 133137 - DNA, 30 bp, Artificial Sequence
  Description of Artificial Sequence: Synthetic oligonucleotide
gtgcagaggacaatgctggagcttctgaac

SEQ ID NO: 133138 - DNA, 30 bp, Artificial Sequence
  Description of Artificial Sequence: Synthetic oligonucleotide
tgcagaggacaatgctggagcttctgaacc

SEQ ID NO: 133139 - DNA, 29 bp, Artificial Sequence
  Description of Artificial Sequence: Synthetic oligonucleotide
gcagaggacaatgctggagcttctgaacc

SEQ ID NO: 133140 - DNA, 30 bp, Artificial Sequence
  Description of Artificial Sequence: Synthetic oligonucleotide
cagaggacaatgctggagcttctgaaccag

SEQ ID NO: 133141 - DNA, 30 bp, Artificial Sequence
  Description of Artificial Sequence: Synthetic oligonucleotide
agaggacaatgctggagcttctgaaccagc

SEQ ID NO: 133142 - DNA, 29 bp, Artificial Sequence
  Description of Artificial Sequence: Synthetic oligonucleotide
gaggacaatgctggagcttctgaaccagc

SEQ ID NO: 133143 - DNA, 30 bp, Artificial Sequence
  Description of Artificial Sequence: Synthetic oligonucleotide
aggacaatgctggagcttctgaaccagctg

SEQ ID NO: 133144 - DNA, 29 bp, Artificial Sequence
  Description of Artificial Sequence: Synthetic oligonucleotide
ggacaatgctggagcttctgaaccagctg

SEQ ID NO: 133145 - DNA, 29 bp, Artificial Sequence
  Description of Artificial Sequence: Synthetic oligonucleotide
gacaatgctggagcttctgaaccagctgg

SEQ ID NO: 133146 - DNA, 31 bp, Artificial Sequence
  Description of Artificial Sequence: Synthetic oligonucleotide
acaatgctggagcttctgaaccagctggatg

SEQ ID NO: 133147 - DNA, 30 bp, Artificial Sequence
  Description of Artificial Sequence: Synthetic oligonucleotide
caatgctggagcttctgaaccagctggatg

SEQ ID NO: 133148 - DNA, 30 bp, Artificial Sequence
  Description of Artificial Sequence: Synthetic oligonucleotide
aatgctggagcttctgaaccagctggatgg

SEQ ID NO: 133149 - DNA, 29 bp, Artificial Sequence
  Description of Artificial Sequence: Synthetic oligonucleotide
atgctggagcttctgaaccagctggatgg

SEQ ID NO: 133150 - DNA, 28 bp, Artificial Sequence
  Description of Artificial Sequence: Synthetic oligonucleotide
tgctggagcttctgaaccagctggatgg

SEQ ID NO: 133151 - DNA, 27 bp, Artificial Sequence
  Description of Artificial Sequence: Synthetic oligonucleotide
gctggagcttctgaaccagctggatgg

SEQ ID NO: 133152 - DNA, 27 bp, Artificial Sequence
  Description of Artificial Sequence: Synthetic oligonucleotide
ctggagcttctgaaccagctggatggc

SEQ ID NO: 133153 - DNA, 29 bp, Artificial Sequence
  Description of Artificial Sequence: Synthetic oligonucleotide
tggagcttctgaaccagctggatggcttc

SEQ ID NO: 133154 - DNA, 28 bp, Artificial Sequence
  Description of Artificial Sequence: Synthetic oligonucleotide
ggagcttctgaaccagctggatggcttc

SEQ ID NO: 133155 - DNA, 28 bp, Artificial Sequence
  Description of Artificial Sequence: Synthetic oligonucleotide
gagcttctgaaccagctggatggcttcc

SEQ ID NO: 133156 - DNA, 29 bp, Artificial Sequence
  Description of Artificial Sequence: Synthetic oligonucleotide
agcttctgaaccagctggatggcttccag

SEQ ID NO: 133157 - DNA, 28 bp, Artificial Sequence
  Description of Artificial Sequence: Synthetic oligonucleotide
gcttctgaaccagctggatggcttccag

SEQ ID NO: 133158 - DNA, 28 bp, Artificial Sequence
  Description of Artificial Sequence: Synthetic oligonucleotide
cttctgaaccagctggatggcttccagc

SEQ ID NO: 133159 - DNA, 28 bp, Artificial Sequence
  Description of Artificial Sequence: Synthetic oligonucleotide
ttctgaaccagctggatggcttccagcc

SEQ ID NO: 133160 - DNA, 27 bp, Artificial Sequence
  Description of Artificial Sequence: Synthetic oligonucleotide
tctgaaccagctggatggcttccagcc

SEQ ID NO: 133161 - DNA, 26 bp, Artificial Sequence
  Description of Artificial Sequence: Synthetic oligonucleotide
ctgaaccagctggatggcttccagcc

SEQ ID NO: 133162 - DNA, 27 bp, Artificial Sequence
  Description of Artificial Sequence: Synthetic oligonucleotide
tgaaccagctggatggcttccagccca

SEQ ID NO: 133163 - DNA, 27 bp, Artificial Sequence
  Description of Artificial Sequence: Synthetic oligonucleotide
gaaccagctggatggcttccagcccaa

SEQ ID NO: 133164 - DNA, 27 bp, Artificial Sequence
  Description of Artificial Sequence: Synthetic oligonucleotide
aaccagctggatggcttccagcccaac

SEQ ID NO: 133165 - DNA, 27 bp, Artificial Sequence
  Description of Artificial Sequence: Synthetic oligonucleotide
accagctggatggcttccagcccaaca

SEQ ID NO: 133166 - DNA, 26 bp, Artificial Sequence
  Description of Artificial Sequence: Synthetic oligonucleotide
ccagctggatggcttccagcccaaca

SEQ ID NO: 133167 - DNA, 26 bp, Artificial Sequence
  Description of Artificial Sequence: Synthetic oligonucleotide
cagctggatggcttccagcccaacac

SEQ ID NO: 133168 - DNA, 26 bp, Artificial Sequence
  Description of Artificial Sequence: Synthetic oligonucleotide
agctggatggcttccagcccaacacc

SEQ ID NO: 133169 - DNA, 25 bp, Artificial Sequence
  Description of Artificial Sequence: Synthetic oligonucleotide
gctggatggcttccagcccaacacc

SEQ ID NO: 133170 - DNA, 27 bp, Artificial Sequence
  Description of Artificial Sequence: Synthetic oligonucleotide
ctggatggcttccagcccaacacccaa

SEQ ID NO: 133171 - DNA, 27 bp, Artificial Sequence
  Description of Artificial Sequence: Synthetic oligonucleotide
tggatggcttccagcccaacacccaag

SEQ ID NO: 133172 - DNA, 27 bp, Artificial Sequence
  Description of Artificial Sequence: Synthetic oligonucleotide
ggatggcttccagcccaacacccaagt

SEQ ID NO: 133173 - DNA, 30 bp, Artificial Sequence
  Description of Artificial Sequence: Synthetic oligonucleotide
gatggcttccagcccaacacccaagttaag

SEQ ID NO: 133174 - DNA, 30 bp, Artificial Sequence
  Description of Artificial Sequence: Synthetic oligonucleotide
atggcttccagcccaacacccaagttaagg

SEQ ID NO: 133175 - DNA, 29 bp, Artificial Sequence
  Description of Artificial Sequence: Synthetic oligonucleotide
tggcttccagcccaacacccaagttaagg

SEQ ID NO: 133176 - DNA, 28 bp, Artificial Sequence
  Description of Artificial Sequence: Synthetic oligonucleotide
ggcttccagcccaacacccaagttaagg

SEQ ID NO: 133177 - DNA, 33 bp, Artificial Sequence
  Description of Artificial Sequence: Synthetic oligonucleotide
gcttccagcccaacacccaagttaaggtaattg

SEQ ID NO: 133178 - DNA, 33 bp, Artificial Sequence
  Description of Artificial Sequence: Synthetic oligonucleotide
cttccagcccaacacccaagttaaggtaattgc

SEQ ID NO: 133179 - DNA, 34 bp, Artificial Sequence
  Description of Artificial Sequence: Synthetic oligonucleotide
ttccagcccaacacccaagttaaggtaattgcag

SEQ ID NO: 133180 - DNA, 33 bp, Artificial Sequence
  Description of Artificial Sequence: Synthetic oligonucleotide
tccagcccaacacccaagttaaggtaattgcag

SEQ ID NO: 133181 - DNA, 32 bp, Artificial Sequence
  Description of Artificial Sequence: Synthetic oligonucleotide
ccagcccaacacccaagttaaggtaattgcag

SEQ ID NO: 133182 - DNA, 32 bp, Artificial Sequence
  Description of Artificial Sequence: Synthetic oligonucleotide
cagcccaacacccaagttaaggtaattgcagc

SEQ ID NO: 133183 - DNA, 32 bp, Artificial Sequence
  Description of Artificial Sequence: Synthetic oligonucleotide
agcccaacacccaagttaaggtaattgcagcc

SEQ ID NO: 133184 - DNA, 31 bp, Artificial Sequence
  Description of Artificial Sequence: Synthetic oligonucleotide
gcccaacacccaagttaaggtaattgcagcc

SEQ ID NO: 133185 - DNA, 32 bp, Artificial Sequence
  Description of Artificial Sequence: Synthetic oligonucleotide
cccaacacccaagttaaggtaattgcagccac

SEQ ID NO: 133186 - DNA, 35 bp, Artificial Sequence
  Description of Artificial Sequence: Synthetic oligonucleotide
ccaacacccaagttaaggtaattgcagccacaaac

SEQ ID NO: 133187 - DNA, 36 bp, Artificial Sequence
  Description of Artificial Sequence: Synthetic oligonucleotide
caacacccaagttaaggtaattgcagccacaaacag

SEQ ID NO: 133188 - DNA, 36 bp, Artificial Sequence
  Description of Artificial Sequence: Synthetic oligonucleotide
aacacccaagttaaggtaattgcagccacaaacagg

SEQ ID NO: 133189 - DNA, 35 bp, Artificial Sequence
  Description of Artificial Sequence: Synthetic oligonucleotide
acacccaagttaaggtaattgcagccacaaacagg

SEQ ID NO: 133190 - DNA, 34 bp, Artificial Sequence
  Description of Artificial Sequence: Synthetic oligonucleotide
cacccaagttaaggtaattgcagccacaaacagg

SEQ ID NO: 133191 - DNA, 34 bp, Artificial Sequence
  Description of Artificial Sequence: Synthetic oligonucleotide
acccaagttaaggtaattgcagccacaaacaggg

SEQ ID NO: 133192 - DNA, 33 bp, Artificial Sequence
  Description of Artificial Sequence: Synthetic oligonucleotide
cccaagttaaggtaattgcagccacaaacaggg

SEQ ID NO: 133193 - DNA, 34 bp, Artificial Sequence
  Description of Artificial Sequence: Synthetic oligonucleotide
ccaagttaaggtaattgcagccacaaacagggtg

SEQ ID NO: 133194 - DNA, 34 bp, Artificial Sequence
  Description of Artificial Sequence: Synthetic oligonucleotide
caagttaaggtaattgcagccacaaacagggtgg

SEQ ID NO: 133195 - DNA, 35 bp, Artificial Sequence
  Description of Artificial Sequence: Synthetic oligonucleotide
aagttaaggtaattgcagccacaaacagggtggac

SEQ ID NO: 133196 - DNA, 34 bp, Artificial Sequence
  Description of Artificial Sequence: Synthetic oligonucleotide
agttaaggtaattgcagccacaaacagggtggac

SEQ ID NO: 133197 - DNA, 33 bp, Artificial Sequence
  Description of Artificial Sequence: Synthetic oligonucleotide
gttaaggtaattgcagccacaaacagggtggac

SEQ ID NO: 133198 - DNA, 35 bp, Artificial Sequence
  Description of Artificial Sequence: Synthetic oligonucleotide
ttaaggtaattgcagccacaaacagggtggacatc

SEQ ID NO: 133199 - DNA, 34 bp, Artificial Sequence
  Description of Artificial Sequence: Synthetic oligonucleotide
taaggtaattgcagccacaaacagggtggacatc

SEQ ID NO: 133200 - DNA, 33 bp, Artificial Sequence
  Description of Artificial Sequence: Synthetic oligonucleotide
aaggtaattgcagccacaaacagggtggacatc

SEQ ID NO: 133201 - DNA, 32 bp, Artificial Sequence
  Description of Artificial Sequence: Synthetic oligonucleotide
aggtaattgcagccacaaacagggtggacatc

SEQ ID NO: 133202 - DNA, 31 bp, Artificial Sequence
  Description of Artificial Sequence: Synthetic oligonucleotide
ggtaattgcagccacaaacagggtggacatc

SEQ ID NO: 133203 - DNA, 31 bp, Artificial Sequence
  Description of Artificial Sequence: Synthetic oligonucleotide
gtaattgcagccacaaacagggtggacatcc

SEQ ID NO: 133204 - DNA, 32 bp, Artificial Sequence
  Description of Artificial Sequence: Synthetic oligonucleotide
taattgcagccacaaacagggtggacatcctg

SEQ ID NO: 133205 - DNA, 31 bp, Artificial Sequence
  Description of Artificial Sequence: Synthetic oligonucleotide
aattgcagccacaaacagggtggacatcctg

SEQ ID NO: 133206 - DNA, 30 bp, Artificial Sequence
  Description of Artificial Sequence: Synthetic oligonucleotide
attgcagccacaaacagggtggacatcctg

SEQ ID NO: 133207 - DNA, 29 bp, Artificial Sequence
  Description of Artificial Sequence: Synthetic oligonucleotide
ttgcagccacaaacagggtggacatcctg

SEQ ID NO: 133208 - DNA, 28 bp, Artificial Sequence
  Description of Artificial Sequence: Synthetic oligonucleotide
tgcagccacaaacagggtggacatcctg

SEQ ID NO: 133209 - DNA, 27 bp, Artificial Sequence
  Description of Artificial Sequence: Synthetic oligonucleotide
gcagccacaaacagggtggacatcctg

SEQ ID NO: 133210 - DNA, 27 bp, Artificial Sequence
  Description of Artificial Sequence: Synthetic oligonucleotide
cagccacaaacagggtggacatcctgg

SEQ ID NO: 133211 - DNA, 28 bp, Artificial Sequence
  Description of Artificial Sequence: Synthetic oligonucleotide
agccacaaacagggtggacatcctggac

SEQ ID NO: 133212 - DNA, 27 bp, Artificial Sequence
  Description of Artificial Sequence: Synthetic oligonucleotide
gccacaaacagggtggacatcctggac

SEQ ID NO: 133213 - DNA, 27 bp, Artificial Sequence
  Description of Artificial Sequence: Synthetic oligonucleotide
ccacaaacagggtggacatcctggacc

SEQ ID NO: 133214 - DNA, 27 bp, Artificial Sequence
  Description of Artificial Sequence: Synthetic oligonucleotide
cacaaacagggtggacatcctggaccc

SEQ ID NO: 133215 - DNA, 27 bp, Artificial Sequence
  Description of Artificial Sequence: Synthetic oligonucleotide
acaaacagggtggacatcctggacccc

SEQ ID NO: 133216 - DNA, 26 bp, Artificial Sequence
  Description of Artificial Sequence: Synthetic oligonucleotide
caaacagggtggacatcctggacccc

SEQ ID NO: 133217 - DNA, 26 bp, Artificial Sequence
  Description of Artificial Sequence: Synthetic oligonucleotide
aaacagggtggacatcctggaccccg

SEQ ID NO: 133218 - DNA, 25 bp, Artificial Sequence
  Description of Artificial Sequence: Synthetic oligonucleotide
aacagggtggacatcctggaccccg

SEQ ID NO: 133219 - DNA, 24 bp, Artificial Sequence
  Description of Artificial Sequence: Synthetic oligonucleotide
acagggtggacatcctggaccccg

SEQ ID NO: 133220 - DNA, 23 bp, Artificial Sequence
  Description of Artificial Sequence: Synthetic oligonucleotide
cagggtggacatcctggaccccg

SEQ ID NO: 133221 - DNA, 23 bp, Artificial Sequence
  Description of Artificial Sequence: Synthetic oligonucleotide
agggtggacatcctggaccccgc

SEQ ID NO: 133222 - DNA, 22 bp, Artificial Sequence
  Description of Artificial Sequence: Synthetic oligonucleotide
gggtggacatcctggaccccgc

SEQ ID NO: 133223 - DNA, 22 bp, Artificial Sequence
  Description of Artificial Sequence: Synthetic oligonucleotide
ggtggacatcctggaccccgcc

SEQ ID NO: 133224 - DNA, 23 bp, Artificial Sequence
  Description of Artificial Sequence: Synthetic oligonucleotide
gtggacatcctggaccccgccct

SEQ ID NO: 133225 - DNA, 23 bp, Artificial Sequence
  Description of Artificial Sequence: Synthetic oligonucleotide
tggacatcctggaccccgccctc

SEQ ID NO: 133226 - DNA, 22 bp, Artificial Sequence
  Description of Artificial Sequence: Synthetic oligonucleotide
ggacatcctggaccccgccctc

SEQ ID NO: 133227 - DNA, 23 bp, Artificial Sequence
  Description of Artificial Sequence: Synthetic oligonucleotide
gacatcctggaccccgccctcct

SEQ ID NO: 133228 - DNA, 23 bp, Artificial Sequence
  Description of Artificial Sequence: Synthetic oligonucleotide
acatcctggaccccgccctcctc

SEQ ID NO: 133229 - DNA, 22 bp, Artificial Sequence
  Description of Artificial Sequence: Synthetic oligonucleotide
catcctggaccccgccctcctc

SEQ ID NO: 133230 - DNA, 22 bp, Artificial Sequence
  Description of Artificial Sequence: Synthetic oligonucleotide
atcctggaccccgccctcctcc

SEQ ID NO: 133231 - DNA, 21 bp, Artificial Sequence
  Description of Artificial Sequence: Synthetic oligonucleotide
tcctggaccccgccctcctcc

SEQ ID NO: 133232 - DNA, 20 bp, Artificial Sequence
  Description of Artificial Sequence: Synthetic oligonucleotide
cctggaccccgccctcctcc

SEQ ID NO: 133233 - DNA, 20 bp, Artificial Sequence
  Description of Artificial Sequence: Synthetic oligonucleotide
ctggaccccgccctcctccg

SEQ ID NO: 133234 - DNA, 21 bp, Artificial Sequence
  Description of Artificial Sequence: Synthetic oligonucleotide
tggaccccgccctcctccgct

SEQ ID NO: 133235 - DNA, 20 bp, Artificial Sequence
  Description of Artificial Sequence: Synthetic oligonucleotide
ggaccccgccctcctccgct

SEQ ID NO: 133236 - DNA, 20 bp, Artificial Sequence
  Description of Artificial Sequence: Synthetic oligonucleotide
gaccccgccctcctccgctc

SEQ ID NO: 133237 - DNA, 20 bp, Artificial Sequence
  Description of Artificial Sequence: Synthetic oligonucleotide
accccgccctcctccgctcg

SEQ ID NO: 133238 - DNA, 20 bp, Artificial Sequence
  Description of Artificial Sequence: Synthetic oligonucleotide
ccccgccctcctccgctcgt

SEQ ID NO: 133239 - DNA, 20 bp, Artificial Sequence
  Description of Artificial Sequence: Synthetic oligonucleotide
cccgccctcctccgctcggt

SEQ ID NO: 133240 - DNA, 20 bp, Artificial Sequence
  Description of Artificial Sequence: Synthetic oligonucleotide
ccgccctcctccgctcgggt

SEQ ID NO: 133241 - DNA, 20 bp, Artificial Sequence
  Description of Artificial Sequence: Synthetic oligonucleotide
cgccctcctccgctcgggct

SEQ ID NO: 133242 - DNA, 20 bp, Artificial Sequence
  Description of Artificial Sequence: Synthetic oligonucleotide
gccctcctccgctcgggcct

SEQ ID NO: 133243 - DNA, 20 bp, Artificial Sequence
  Description of Artificial Sequence: Synthetic oligonucleotide
ccctcctccgctcgggccgt

SEQ ID NO: 133244 - DNA, 20 bp, Artificial Sequence
  Description of Artificial Sequence: Synthetic oligonucleotide
cctcctccgctcgggccgct

SEQ ID NO: 133245 - DNA, 21 bp, Artificial Sequence
  Description of Artificial Sequence: Synthetic oligonucleotide
ctcctccgctcgggccgcctt

SEQ ID NO: 133246 - DNA, 22 bp, Artificial Sequence
  Description of Artificial Sequence: Synthetic oligonucleotide
tcctccgctcgggccgccttga

SEQ ID NO: 133247 - DNA, 21 bp, Artificial Sequence
  Description of Artificial Sequence: Synthetic oligonucleotide
cctccgctcgggccgccttga

SEQ ID NO: 133248 - DNA, 21 bp, Artificial Sequence
  Description of Artificial Sequence: Synthetic oligonucleotide
ctccgctcgggccgccttgac

SEQ ID NO: 133249 - DNA, 21 bp, Artificial Sequence
  Description of Artificial Sequence: Synthetic oligonucleotide
tccgctcgggccgccttgacc

SEQ ID NO: 133250 - DNA, 20 bp, Artificial Sequence
  Description of Artificial Sequence: Synthetic oligonucleotide
ccgctcgggccgccttgacc

SEQ ID NO: 133251 - DNA, 20 bp, Artificial Sequence
  Description of Artificial Sequence: Synthetic oligonucleotide
cgctcgggccgccttgaccg

SEQ ID NO: 133252 - DNA, 22 bp, Artificial Sequence
  Description of Artificial Sequence: Synthetic oligonucleotide
gctcgggccgccttgaccgcaa

SEQ ID NO: 133253 - DNA, 25 bp, Artificial Sequence
  Description of Artificial Sequence: Synthetic oligonucleotide
ctcgggccgccttgaccgcaagata

SEQ ID NO: 133254 - DNA, 26 bp, Artificial Sequence
  Description of Artificial Sequence: Synthetic oligonucleotide
tcgggccgccttgaccgcaagataga

SEQ ID NO: 133255 - DNA, 25 bp, Artificial Sequence
  Description of Artificial Sequence: Synthetic oligonucleotide
cgggccgccttgaccgcaagataga

SEQ ID NO: 133256 - DNA, 27 bp, Artificial Sequence
  Description of Artificial Sequence: Synthetic oligonucleotide
gggccgccttgaccgcaagatagagtt

SEQ ID NO: 133257 - DNA, 27 bp, Artificial Sequence
  Description of Artificial Sequence: Synthetic oligonucleotide
ggccgccttgaccgcaagatagagttc

SEQ ID NO: 133258 - DNA, 27 bp, Artificial Sequence
  Description of Artificial Sequence: Synthetic oligonucleotide
gccgccttgaccgcaagatagagttcc

SEQ ID NO: 133259 - DNA, 27 bp, Artificial Sequence
  Description of Artificial Sequence: Synthetic oligonucleotide
ccgccttgaccgcaagatagagttccc

SEQ ID NO: 133260 - DNA, 27 bp, Artificial Sequence
  Description of Artificial Sequence: Synthetic oligonucleotide
cgccttgaccgcaagatagagttcccg

SEQ ID NO: 133261 - DNA, 29 bp, Artificial Sequence
  Description of Artificial Sequence: Synthetic oligonucleotide
gccttgaccgcaagatagagttcccgatg

SEQ ID NO: 133262 - DNA, 29 bp, Artificial Sequence
  Description of Artificial Sequence: Synthetic oligonucleotide
ccttgaccgcaagatagagttcccgatgc

SEQ ID NO: 133263 - DNA, 29 bp, Artificial Sequence
  Description of Artificial Sequence: Synthetic oligonucleotide
cttgaccgcaagatagagttcccgatgcc

SEQ ID NO: 133264 - DNA, 29 bp, Artificial Sequence
  Description of Artificial Sequence: Synthetic oligonucleotide
ttgaccgcaagatagagttcccgatgccc

SEQ ID NO: 133265 - DNA, 28 bp, Artificial Sequence
  Description of Artificial Sequence: Synthetic oligonucleotide
tgaccgcaagatagagttcccgatgccc

SEQ ID NO: 133266 - DNA, 27 bp, Artificial Sequence
  Description of Artificial Sequence: Synthetic oligonucleotide
gaccgcaagatagagttcccgatgccc

SEQ ID NO: 133267 - DNA, 30 bp, Artificial Sequence
  Description of Artificial Sequence: Synthetic oligonucleotide
accgcaagatagagttcccgatgcccaatg

SEQ ID NO: 133268 - DNA, 29 bp, Artificial Sequence
  Description of Artificial Sequence: Synthetic oligonucleotide
ccgcaagatagagttcccgatgcccaatg

SEQ ID NO: 133269 - DNA, 30 bp, Artificial Sequence
  Description of Artificial Sequence: Synthetic oligonucleotide
cgcaagatagagttcccgatgcccaatgag

SEQ ID NO: 133270 - DNA, 30 bp, Artificial Sequence
  Description of Artificial Sequence: Synthetic oligonucleotide
gcaagatagagttcccgatgcccaatgagg

SEQ ID NO: 133271 - DNA, 31 bp, Artificial Sequence
  Description of Artificial Sequence: Synthetic oligonucleotide
caagatagagttcccgatgcccaatgaggag

SEQ ID NO: 133272 - DNA, 31 bp, Artificial Sequence
  Description of Artificial Sequence: Synthetic oligonucleotide
aagatagagttcccgatgcccaatgaggagg

SEQ ID NO: 133273 - DNA, 30 bp, Artificial Sequence
  Description of Artificial Sequence: Synthetic oligonucleotide
agatagagttcccgatgcccaatgaggagg

SEQ ID NO: 133274 - DNA, 29 bp, Artificial Sequence
  Description of Artificial Sequence: Synthetic oligonucleotide
gatagagttcccgatgcccaatgaggagg

SEQ ID NO: 133275 - DNA, 29 bp, Artificial Sequence
  Description of Artificial Sequence: Synthetic oligonucleotide
atagagttcccgatgcccaatgaggaggc

SEQ ID NO: 133276 - DNA, 28 bp, Artificial Sequence
  Description of Artificial Sequence: Synthetic oligonucleotide
tagagttcccgatgcccaatgaggaggc

SEQ ID NO: 133277 - DNA, 27 bp, Artificial Sequence
  Description of Artificial Sequence: Synthetic oligonucleotide
agagttcccgatgcccaatgaggaggc

SEQ ID NO: 133278 - DNA, 26 bp, Artificial Sequence
  Description of Artificial Sequence: Synthetic oligonucleotide
gagttcccgatgcccaatgaggaggc

SEQ ID NO: 133279 - DNA, 26 bp, Artificial Sequence
  Description of Artificial Sequence: Synthetic oligonucleotide
agttcccgatgcccaatgaggaggcc

SEQ ID NO: 133280 - DNA, 25 bp, Artificial Sequence
  Description of Artificial Sequence: Synthetic oligonucleotide
gttcccgatgcccaatgaggaggcc

SEQ ID NO: 133281 - DNA, 25 bp, Artificial Sequence
  Description of Artificial Sequence: Synthetic oligonucleotide
ttcccgatgcccaatgaggaggccc

SEQ ID NO: 133282 - DNA, 24 bp, Artificial Sequence
  Description of Artificial Sequence: Synthetic oligonucleotide
tcccgatgcccaatgaggaggccc

SEQ ID NO: 133283 - DNA, 23 bp, Artificial Sequence
  Description of Artificial Sequence: Synthetic oligonucleotide
cccgatgcccaatgaggaggccc

SEQ ID NO: 133284 - DNA, 23 bp, Artificial Sequence
  Description of Artificial Sequence: Synthetic oligonucleotide
ccgatgcccaatgaggaggcccg

SEQ ID NO: 133285 - DNA, 23 bp, Artificial Sequence
  Description of Artificial Sequence: Synthetic oligonucleotide
cgatgcccaatgaggaggcccgg

SEQ ID NO: 133286 - DNA, 23 bp, Artificial Sequence
  Description of Artificial Sequence: Synthetic oligonucleotide
gatgcccaatgaggaggcccggg

SEQ ID NO: 133287 - DNA, 23 bp, Artificial Sequence
  Description of Artificial Sequence: Synthetic oligonucleotide
atgcccaatgaggaggcccgggc

SEQ ID NO: 133288 - DNA, 22 bp, Artificial Sequence
  Description of Artificial Sequence: Synthetic oligonucleotide
tgcccaatgaggaggcccgggc

SEQ ID NO: 133289 - DNA, 21 bp, Artificial Sequence
  Description of Artificial Sequence: Synthetic oligonucleotide
gcccaatgaggaggcccgggc

SEQ ID NO: 133290 - DNA, 22 bp, Artificial Sequence
  Description of Artificial Sequence: Synthetic oligonucleotide
cccaatgaggaggcccgggcca

SEQ ID NO: 133291 - DNA, 25 bp, Artificial Sequence
  Description of Artificial Sequence: Synthetic oligonucleotide
ccaatgaggaggcccgggccagaat

SEQ ID NO: 133292 - DNA, 27 bp, Artificial Sequence
  Description of Artificial Sequence: Synthetic oligonucleotide
caatgaggaggcccgggccagaatcat

SEQ ID NO: 133293 - DNA, 27 bp, Artificial Sequence
  Description of Artificial Sequence: Synthetic oligonucleotide
aatgaggaggcccgggccagaatcatg

SEQ ID NO: 133294 - DNA, 26 bp, Artificial Sequence
  Description of Artificial Sequence: Synthetic oligonucleotide
atgaggaggcccgggccagaatcatg

SEQ ID NO: 133295 - DNA, 25 bp, Artificial Sequence
  Description of Artificial Sequence: Synthetic oligonucleotide
tgaggaggcccgggccagaatcatg

SEQ ID NO: 133296 - DNA, 24 bp, Artificial Sequence
  Description of Artificial Sequence: Synthetic oligonucleotide
gaggaggcccgggccagaatcatg

SEQ ID NO: 133297 - DNA, 25 bp, Artificial Sequence
  Description of Artificial Sequence: Synthetic oligonucleotide
aggaggcccgggccagaatcatgca

SEQ ID NO: 133298 - DNA, 24 bp, Artificial Sequence
  Description of Artificial Sequence: Synthetic oligonucleotide
ggaggcccgggccagaatcatgca

SEQ ID NO: 133299 - DNA, 26 bp, Artificial Sequence
  Description of Artificial Sequence: Synthetic oligonucleotide
gaggcccgggccagaatcatgcagat

SEQ ID NO: 133300 - DNA, 26 bp, Artificial Sequence
  Description of Artificial Sequence: Synthetic oligonucleotide
aggcccgggccagaatcatgcagatc

SEQ ID NO: 133301 - DNA, 25 bp, Artificial Sequence
  Description of Artificial Sequence: Synthetic oligonucleotide
ggcccgggccagaatcatgcagatc

SEQ ID NO: 133302 - DNA, 26 bp, Artificial Sequence
  Description of Artificial Sequence: Synthetic oligonucleotide
gcccgggccagaatcatgcagatcca

SEQ ID NO: 133303 - DNA, 27 bp, Artificial Sequence
  Description of Artificial Sequence: Synthetic oligonucleotide
cccgggccagaatcatgcagatccact

SEQ ID NO: 133304 - DNA, 27 bp, Artificial Sequence
  Description of Artificial Sequence: Synthetic oligonucleotide
ccgggccagaatcatgcagatccactc

SEQ ID NO: 133305 - DNA, 27 bp, Artificial Sequence
  Description of Artificial Sequence: Synthetic oligonucleotide
cgggccagaatcatgcagatccactcc

SEQ ID NO: 133306 - DNA, 27 bp, Artificial Sequence
  Description of Artificial Sequence: Synthetic oligonucleotide
gggccagaatcatgcagatccactccc

SEQ ID NO: 133307 - DNA, 27 bp, Artificial Sequence
  Description of Artificial Sequence: Synthetic oligonucleotide
ggccagaatcatgcagatccactcccg

SEQ ID NO: 133308 - DNA, 30 bp, Artificial Sequence
  Description of Artificial Sequence: Synthetic oligonucleotide
gccagaatcatgcagatccactcccgaaag

SEQ ID NO: 133309 - DNA, 32 bp, Artificial Sequence
  Description of Artificial Sequence: Synthetic oligonucleotide
ccagaatcatgcagatccactcccgaaagatg

SEQ ID NO: 133310 - DNA, 35 bp, Artificial Sequence
  Description of Artificial Sequence: Synthetic oligonucleotide
cagaatcatgcagatccactcccgaaagatgaatg

SEQ ID NO: 133311 - DNA, 36 bp, Artificial Sequence
  Description of Artificial Sequence: Synthetic oligonucleotide
agaatcatgcagatccactcccgaaagatgaatgtc

SEQ ID NO: 133312 - DNA, 35 bp, Artificial Sequence
  Description of Artificial Sequence: Synthetic oligonucleotide
gaatcatgcagatccactcccgaaagatgaatgtc

SEQ ID NO: 133313 - DNA, 36 bp, Artificial Sequence
  Description of Artificial Sequence: Synthetic oligonucleotide
aatcatgcagatccactcccgaaagatgaatgtcag

SEQ ID NO: 133314 - DNA, 35 bp, Artificial Sequence
  Description of Artificial Sequence: Synthetic oligonucleotide
atcatgcagatccactcccgaaagatgaatgtcag

SEQ ID NO: 133315 - DNA, 34 bp, Artificial Sequence
  Description of Artificial Sequence: Synthetic oligonucleotide
tcatgcagatccactcccgaaagatgaatgtcag

SEQ ID NO: 133316 - DNA, 33 bp, Artificial Sequence
  Description of Artificial Sequence: Synthetic oligonucleotide
catgcagatccactcccgaaagatgaatgtcag

SEQ ID NO: 133317 - DNA, 34 bp, Artificial Sequence
  Description of Artificial Sequence: Synthetic oligonucleotide
atgcagatccactcccgaaagatgaatgtcagtc

SEQ ID NO: 133318 - DNA, 33 bp, Artificial Sequence
  Description of Artificial Sequence: Synthetic oligonucleotide
tgcagatccactcccgaaagatgaatgtcagtc

SEQ ID NO: 133319 - DNA, 32 bp, Artificial Sequence
  Description of Artificial Sequence: Synthetic oligonucleotide
gcagatccactcccgaaagatgaatgtcagtc

SEQ ID NO: 133320 - DNA, 32 bp, Artificial Sequence
  Description of Artificial Sequence: Synthetic oligonucleotide
cagatccactcccgaaagatgaatgtcagtcc

SEQ ID NO: 133321 - DNA, 33 bp, Artificial Sequence
  Description of Artificial Sequence: Synthetic oligonucleotide
agatccactcccgaaagatgaatgtcagtcctg

SEQ ID NO: 133322 - DNA, 32 bp, Artificial Sequence
  Description of Artificial Sequence: Synthetic oligonucleotide
gatccactcccgaaagatgaatgtcagtcctg

SEQ ID NO: 133323 - DNA, 33 bp, Artificial Sequence
  Description of Artificial Sequence: Synthetic oligonucleotide
atccactcccgaaagatgaatgtcagtcctgac

SEQ ID NO: 133324 - DNA, 32 bp, Artificial Sequence
  Description of Artificial Sequence: Synthetic oligonucleotide
tccactcccgaaagatgaatgtcagtcctgac

SEQ ID NO: 133325 - DNA, 31 bp, Artificial Sequence
  Description of Artificial Sequence: Synthetic oligonucleotide
ccactcccgaaagatgaatgtcagtcctgac

SEQ ID NO: 133326 - DNA, 31 bp, Artificial Sequence
  Description of Artificial Sequence: Synthetic oligonucleotide
cactcccgaaagatgaatgtcagtcctgacg

SEQ ID NO: 133327 - DNA, 32 bp, Artificial Sequence
  Description of Artificial Sequence: Synthetic oligonucleotide
actcccgaaagatgaatgtcagtcctgacgtg

SEQ ID NO: 133328 - DNA, 31 bp, Artificial Sequence
  Description of Artificial Sequence: Synthetic oligonucleotide
ctcccgaaagatgaatgtcagtcctgacgtg

SEQ ID NO: 133329 - DNA, 33 bp, Artificial Sequence
  Description of Artificial Sequence: Synthetic oligonucleotide
tcccgaaagatgaatgtcagtcctgacgtgaac

SEQ ID NO: 133330 - DNA, 32 bp, Artificial Sequence
  Description of Artificial Sequence: Synthetic oligonucleotide
cccgaaagatgaatgtcagtcctgacgtgaac

SEQ ID NO: 133331 - DNA, 34 bp, Artificial Sequence
  Description of Artificial Sequence: Synthetic oligonucleotide
ccgaaagatgaatgtcagtcctgacgtgaactac

SEQ ID NO: 133332 - DNA, 34 bp, Artificial Sequence
  Description of Artificial Sequence: Synthetic oligonucleotide
cgaaagatgaatgtcagtcctgacgtgaactacg

SEQ ID NO: 133333 - DNA, 35 bp, Artificial Sequence
  Description of Artificial Sequence: Synthetic oligonucleotide
gaaagatgaatgtcagtcctgacgtgaactacgag

SEQ ID NO: 133334 - DNA, 35 bp, Artificial Sequence
  Description of Artificial Sequence: Synthetic oligonucleotide
aaagatgaatgtcagtcctgacgtgaactacgagg

SEQ ID NO: 133335 - DNA, 34 bp, Artificial Sequence
  Description of Artificial Sequence: Synthetic oligonucleotide
aagatgaatgtcagtcctgacgtgaactacgagg

SEQ ID NO: 133336 - DNA, 33 bp, Artificial Sequence
  Description of Artificial Sequence: Synthetic oligonucleotide
agatgaatgtcagtcctgacgtgaactacgagg

SEQ ID NO: 133337 - DNA, 32 bp, Artificial Sequence
  Description of Artificial Sequence: Synthetic oligonucleotide
gatgaatgtcagtcctgacgtgaactacgagg

SEQ ID NO: 133338 - DNA, 33 bp, Artificial Sequence
  Description of Artificial Sequence: Synthetic oligonucleotide
atgaatgtcagtcctgacgtgaactacgaggag

SEQ ID NO: 133339 - DNA, 32 bp, Artificial Sequence
  Description of Artificial Sequence: Synthetic oligonucleotide
tgaatgtcagtcctgacgtgaactacgaggag

SEQ ID NO: 133340 - DNA, 31 bp, Artificial Sequence
  Description of Artificial Sequence: Synthetic oligonucleotide
gaatgtcagtcctgacgtgaactacgaggag

SEQ ID NO: 133341 - DNA, 31 bp, Artificial Sequence
  Description of Artificial Sequence: Synthetic oligonucleotide
aatgtcagtcctgacgtgaactacgaggagc

SEQ ID NO: 133342 - DNA, 30 bp, Artificial Sequence
  Description of Artificial Sequence: Synthetic oligonucleotide
atgtcagtcctgacgtgaactacgaggagc

SEQ ID NO: 133343 - DNA, 29 bp, Artificial Sequence
  Description of Artificial Sequence: Synthetic oligonucleotide
tgtcagtcctgacgtgaactacgaggagc

SEQ ID NO: 133344 - DNA, 28 bp, Artificial Sequence
  Description of Artificial Sequence: Synthetic oligonucleotide
gtcagtcctgacgtgaactacgaggagc

SEQ ID NO: 133345 - DNA, 29 bp, Artificial Sequence
  Description of Artificial Sequence: Synthetic oligonucleotide
tcagtcctgacgtgaactacgaggagctg

SEQ ID NO: 133346 - DNA, 28 bp, Artificial Sequence
  Description of Artificial Sequence: Synthetic oligonucleotide
cagtcctgacgtgaactacgaggagctg

SEQ ID NO: 133347 - DNA, 28 bp, Artificial Sequence
  Description of Artificial Sequence: Synthetic oligonucleotide
agtcctgacgtgaactacgaggagctgg

SEQ ID NO: 133348 - DNA, 27 bp, Artificial Sequence
  Description of Artificial Sequence: Synthetic oligonucleotide
gtcctgacgtgaactacgaggagctgg

SEQ ID NO: 133349 - DNA, 27 bp, Artificial Sequence
  Description of Artificial Sequence: Synthetic oligonucleotide
tcctgacgtgaactacgaggagctggc

SEQ ID NO: 133350 - DNA, 26 bp, Artificial Sequence
  Description of Artificial Sequence: Synthetic oligonucleotide
cctgacgtgaactacgaggagctggc

SEQ ID NO: 133351 - DNA, 26 bp, Artificial Sequence
  Description of Artificial Sequence: Synthetic oligonucleotide
ctgacgtgaactacgaggagctggcc

SEQ ID NO: 133352 - DNA, 26 bp, Artificial Sequence
  Description of Artificial Sequence: Synthetic oligonucleotide
tgacgtgaactacgaggagctggccc

SEQ ID NO: 133353 - DNA, 25 bp, Artificial Sequence
  Description of Artificial Sequence: Synthetic oligonucleotide
gacgtgaactacgaggagctggccc

SEQ ID NO: 133354 - DNA, 25 bp, Artificial Sequence
  Description of Artificial Sequence: Synthetic oligonucleotide
acgtgaactacgaggagctggcccg

SEQ ID NO: 133355 - DNA, 24 bp, Artificial Sequence
  Description of Artificial Sequence: Synthetic oligonucleotide
cgtgaactacgaggagctggcccg

SEQ ID NO: 133356 - DNA, 25 bp, Artificial Sequence
  Description of Artificial Sequence: Synthetic oligonucleotide
gtgaactacgaggagctggcccgct

SEQ ID NO: 133357 - DNA, 25 bp, Artificial Sequence
  Description of Artificial Sequence: Synthetic oligonucleotide
tgaactacgaggagctggcccgctg

SEQ ID NO: 133358 - DNA, 24 bp, Artificial Sequence
  Description of Artificial Sequence: Synthetic oligonucleotide
gaactacgaggagctggcccgctg

SEQ ID NO: 133359 - DNA, 25 bp, Artificial Sequence
  Description of Artificial Sequence: Synthetic oligonucleotide
aactacgaggagctggcccgctgca

SEQ ID NO: 133360 - DNA, 24 bp, Artificial Sequence
  Description of Artificial Sequence: Synthetic oligonucleotide
actacgaggagctggcccgctgca

SEQ ID NO: 133361 - DNA, 23 bp, Artificial Sequence
  Description of Artificial Sequence: Synthetic oligonucleotide
ctacgaggagctggcccgctgca

SEQ ID NO: 133362 - DNA, 24 bp, Artificial Sequence
  Description of Artificial Sequence: Synthetic oligonucleotide
tacgaggagctggcccgctgcaca

SEQ ID NO: 133363 - DNA, 23 bp, Artificial Sequence
  Description of Artificial Sequence: Synthetic oligonucleotide
acgaggagctggcccgctgcaca

SEQ ID NO: 133364 - DNA, 22 bp, Artificial Sequence
  Description of Artificial Sequence: Synthetic oligonucleotide
cgaggagctggcccgctgcaca

SEQ ID NO: 133365 - DNA, 24 bp, Artificial Sequence
  Description of Artificial Sequence: Synthetic oligonucleotide
gaggagctggcccgctgcacagat

SEQ ID NO: 133366 - DNA, 25 bp, Artificial Sequence
  Description of Artificial Sequence: Synthetic oligonucleotide
aggagctggcccgctgcacagatga

SEQ ID NO: 133367 - DNA, 24 bp, Artificial Sequence
  Description of Artificial Sequence: Synthetic oligonucleotide
ggagctggcccgctgcacagatga

SEQ ID NO: 133368 - DNA, 26 bp, Artificial Sequence
  Description of Artificial Sequence: Synthetic oligonucleotide
gagctggcccgctgcacagatgactt

SEQ ID NO: 133369 - DNA, 27 bp, Artificial Sequence
  Description of Artificial Sequence: Synthetic oligonucleotide
agctggcccgctgcacagatgacttca

SEQ ID NO: 133370 - DNA, 27 bp, Artificial Sequence
  Description of Artificial Sequence: Synthetic oligonucleotide
gctggcccgctgcacagatgacttcaa

SEQ ID NO: 133371 - DNA, 28 bp, Artificial Sequence
  Description of Artificial Sequence: Synthetic oligonucleotide
ctggcccgctgcacagatgacttcaatg

SEQ ID NO: 133372 - DNA, 28 bp, Artificial Sequence
  Description of Artificial Sequence: Synthetic oligonucleotide
tggcccgctgcacagatgacttcaatgg

SEQ ID NO: 133373 - DNA, 27 bp, Artificial Sequence
  Description of Artificial Sequence: Synthetic oligonucleotide
ggcccgctgcacagatgacttcaatgg

SEQ ID NO: 133374 - DNA, 27 bp, Artificial Sequence
  Description of Artificial Sequence: Synthetic oligonucleotide
gcccgctgcacagatgacttcaatggg

SEQ ID NO: 133375 - DNA, 27 bp, Artificial Sequence
  Description of Artificial Sequence: Synthetic oligonucleotide
cccgctgcacagatgacttcaatgggg

SEQ ID NO: 133376 - DNA, 27 bp, Artificial Sequence
  Description of Artificial Sequence: Synthetic oligonucleotide
ccgctgcacagatgacttcaatggggc

SEQ ID NO: 133377 - DNA, 27 bp, Artificial Sequence
  Description of Artificial Sequence: Synthetic oligonucleotide
cgctgcacagatgacttcaatggggcc

SEQ ID NO: 133378 - DNA, 27 bp, Artificial Sequence
  Description of Artificial Sequence: Synthetic oligonucleotide
gctgcacagatgacttcaatggggccc

SEQ ID NO: 133379 - DNA, 28 bp, Artificial Sequence
  Description of Artificial Sequence: Synthetic oligonucleotide
ctgcacagatgacttcaatggggcccag

SEQ ID NO: 133380 - DNA, 29 bp, Artificial Sequence
  Description of Artificial Sequence: Synthetic oligonucleotide
tgcacagatgacttcaatggggcccagtg

SEQ ID NO: 133381 - DNA, 28 bp, Artificial Sequence
  Description of Artificial Sequence: Synthetic oligonucleotide
gcacagatgacttcaatggggcccagtg

SEQ ID NO: 133382 - DNA, 28 bp, Artificial Sequence
  Description of Artificial Sequence: Synthetic oligonucleotide
cacagatgacttcaatggggcccagtgc

SEQ ID NO: 133383 - DNA, 30 bp, Artificial Sequence
  Description of Artificial Sequence: Synthetic oligonucleotide
acagatgacttcaatggggcccagtgcaag

SEQ ID NO: 133384 - DNA, 29 bp, Artificial Sequence
  Description of Artificial Sequence: Synthetic oligonucleotide
cagatgacttcaatggggcccagtgcaag

SEQ ID NO: 133385 - DNA, 29 bp, Artificial Sequence
  Description of Artificial Sequence: Synthetic oligonucleotide
agatgacttcaatggggcccagtgcaagg

SEQ ID NO: 133386 - DNA, 28 bp, Artificial Sequence
  Description of Artificial Sequence: Synthetic oligonucleotide
gatgacttcaatggggcccagtgcaagg

SEQ ID NO: 133387 - DNA, 28 bp, Artificial Sequence
  Description of Artificial Sequence: Synthetic oligonucleotide
atgacttcaatggggcccagtgcaaggc

SEQ ID NO: 133388 - DNA, 27 bp, Artificial Sequence
  Description of Artificial Sequence: Synthetic oligonucleotide
tgacttcaatggggcccagtgcaaggc

SEQ ID NO: 133389 - DNA, 27 bp, Artificial Sequence
  Description of Artificial Sequence: Synthetic oligonucleotide
gacttcaatggggcccagtgcaaggct

SEQ ID NO: 133390 - DNA, 27 bp, Artificial Sequence
  Description of Artificial Sequence: Synthetic oligonucleotide
acttcaatggggcccagtgcaaggctg

SEQ ID NO: 133391 - DNA, 27 bp, Artificial Sequence
  Description of Artificial Sequence: Synthetic oligonucleotide
cttcaatggggcccagtgcaaggctgt

SEQ ID NO: 133392 - DNA, 27 bp, Artificial Sequence
  Description of Artificial Sequence: Synthetic oligonucleotide
ttcaatggggcccagtgcaaggctgtg

SEQ ID NO: 133393 - DNA, 27 bp, Artificial Sequence
  Description of Artificial Sequence: Synthetic oligonucleotide
tcaatggggcccagtgcaaggctgtgt

SEQ ID NO: 133394 - DNA, 26 bp, Artificial Sequence
  Description of Artificial Sequence: Synthetic oligonucleotide
caatggggcccagtgcaaggctgtgt

SEQ ID NO: 133395 - DNA, 27 bp, Artificial Sequence
  Description of Artificial Sequence: Synthetic oligonucleotide
aatggggcccagtgcaaggctgtgtgt

SEQ ID NO: 133396 - DNA, 26 bp, Artificial Sequence
  Description of Artificial Sequence: Synthetic oligonucleotide
atggggcccagtgcaaggctgtgtgt

SEQ ID NO: 133397 - DNA, 25 bp, Artificial Sequence
  Description of Artificial Sequence: Synthetic oligonucleotide
tggggcccagtgcaaggctgtgtgt

SEQ ID NO: 133398 - DNA, 24 bp, Artificial Sequence
  Description of Artificial Sequence: Synthetic oligonucleotide
ggggcccagtgcaaggctgtgtgt

SEQ ID NO: 133399 - DNA, 25 bp, Artificial Sequence
  Description of Artificial Sequence: Synthetic oligonucleotide
gggcccagtgcaaggctgtgtgtgt

SEQ ID NO: 133400 - DNA, 25 bp, Artificial Sequence
  Description of Artificial Sequence: Synthetic oligonucleotide
ggcccagtgcaaggctgtgtgtgtg

SEQ ID NO: 133401 - DNA, 26 bp, Artificial Sequence
  Description of Artificial Sequence: Synthetic oligonucleotide
gcccagtgcaaggctgtgtgtgtgga

SEQ ID NO: 133402 - DNA, 26 bp, Artificial Sequence
  Description of Artificial Sequence: Synthetic oligonucleotide
cccagtgcaaggctgtgtgtgtggag

SEQ ID NO: 133403 - DNA, 26 bp, Artificial Sequence
  Description of Artificial Sequence: Synthetic oligonucleotide
ccagtgcaaggctgtgtgtgtggagg

SEQ ID NO: 133404 - DNA, 26 bp, Artificial Sequence
  Description of Artificial Sequence: Synthetic oligonucleotide
cagtgcaaggctgtgtgtgtggaggc

SEQ ID NO: 133405 - DNA, 26 bp, Artificial Sequence
  Description of Artificial Sequence: Synthetic oligonucleotide
agtgcaaggctgtgtgtgtggaggcg

SEQ ID NO: 133406 - DNA, 25 bp, Artificial Sequence
  Description of Artificial Sequence: Synthetic oligonucleotide
gtgcaaggctgtgtgtgtggaggcg

SEQ ID NO: 133407 - DNA, 25 bp, Artificial Sequence
  Description of Artificial Sequence: Synthetic oligonucleotide
tgcaaggctgtgtgtgtggaggcgg

SEQ ID NO: 133408 - DNA, 24 bp, Artificial Sequence
  Description of Artificial Sequence: Synthetic oligonucleotide
gcaaggctgtgtgtgtggaggcgg

SEQ ID NO: 133409 - DNA, 24 bp, Artificial Sequence
  Description of Artificial Sequence: Synthetic oligonucleotide
caaggctgtgtgtgtggaggcggg

SEQ ID NO: 133410 - DNA, 26 bp, Artificial Sequence
  Description of Artificial Sequence: Synthetic oligonucleotide
aaggctgtgtgtgtggaggcgggcat

SEQ ID NO: 133411 - DNA, 25 bp, Artificial Sequence
  Description of Artificial Sequence: Synthetic oligonucleotide
aggctgtgtgtgtggaggcgggcat

SEQ ID NO: 133412 - DNA, 24 bp, Artificial Sequence
  Description of Artificial Sequence: Synthetic oligonucleotide
ggctgtgtgtgtggaggcgggcat

SEQ ID NO: 133413 - DNA, 26 bp, Artificial Sequence
  Description of Artificial Sequence: Synthetic oligonucleotide
gctgtgtgtgtggaggcgggcatgat

SEQ ID NO: 133414 - DNA, 26 bp, Artificial Sequence
  Description of Artificial Sequence: Synthetic oligonucleotide
ctgtgtgtgtggaggcgggcatgatc

SEQ ID NO: 133415 - DNA, 26 bp, Artificial Sequence
  Description of Artificial Sequence: Synthetic oligonucleotide
tgtgtgtgtggaggcgggcatgatcg

SEQ ID NO: 133416 - DNA, 25 bp, Artificial Sequence
  Description of Artificial Sequence: Synthetic oligonucleotide
gtgtgtgtggaggcgggcatgatcg

SEQ ID NO: 133417 - DNA, 26 bp, Artificial Sequence
  Description of Artificial Sequence: Synthetic oligonucleotide
tgtgtgtggaggcgggcatgatcgca

SEQ ID NO: 133418 - DNA, 25 bp, Artificial Sequence
  Description of Artificial Sequence: Synthetic oligonucleotide
gtgtgtggaggcgggcatgatcgca

SEQ ID NO: 133419 - DNA, 26 bp, Artificial Sequence
  Description of Artificial Sequence: Synthetic oligonucleotide
tgtgtggaggcgggcatgatcgcact

SEQ ID NO: 133420 - DNA, 25 bp, Artificial Sequence
  Description of Artificial Sequence: Synthetic oligonucleotide
gtgtggaggcgggcatgatcgcact

SEQ ID NO: 133421 - DNA, 25 bp, Artificial Sequence
  Description of Artificial Sequence: Synthetic oligonucleotide
tgtggaggcgggcatgatcgcactg

SEQ ID NO: 133422 - DNA, 24 bp, Artificial Sequence
  Description of Artificial Sequence: Synthetic oligonucleotide
gtggaggcgggcatgatcgcactg

SEQ ID NO: 133423 - DNA, 24 bp, Artificial Sequence
  Description of Artificial Sequence: Synthetic oligonucleotide
tggaggcgggcatgatcgcactgc

SEQ ID NO: 133424 - DNA, 23 bp, Artificial Sequence
  Description of Artificial Sequence: Synthetic oligonucleotide
ggaggcgggcatgatcgcactgc

SEQ ID NO: 133425 - DNA, 23 bp, Artificial Sequence
  Description of Artificial Sequence: Synthetic oligonucleotide
gaggcgggcatgatcgcactgcg

SEQ ID NO: 133426 - DNA, 24 bp, Artificial Sequence
  Description of Artificial Sequence: Synthetic oligonucleotide
aggcgggcatgatcgcactgcgca

SEQ ID NO: 133427 - DNA, 23 bp, Artificial Sequence
  Description of Artificial Sequence: Synthetic oligonucleotide
ggcgggcatgatcgcactgcgca

SEQ ID NO: 133428 - DNA, 23 bp, Artificial Sequence
  Description of Artificial Sequence: Synthetic oligonucleotide
gcgggcatgatcgcactgcgcag

SEQ ID NO: 133429 - DNA, 23 bp, Artificial Sequence
  Description of Artificial Sequence: Synthetic oligonucleotide
cgggcatgatcgcactgcgcagg

SEQ ID NO: 133430 - DNA, 23 bp, Artificial Sequence
  Description of Artificial Sequence: Synthetic oligonucleotide
gggcatgatcgcactgcgcaggg

SEQ ID NO: 133431 - DNA, 24 bp, Artificial Sequence
  Description of Artificial Sequence: Synthetic oligonucleotide
ggcatgatcgcactgcgcaggggt

SEQ ID NO: 133432 - DNA, 24 bp, Artificial Sequence
  Description of Artificial Sequence: Synthetic oligonucleotide
gcatgatcgcactgcgcaggggtg

SEQ ID NO: 133433 - DNA, 24 bp, Artificial Sequence
  Description of Artificial Sequence: Synthetic oligonucleotide
catgatcgcactgcgcaggggtgc

SEQ ID NO: 133434 - DNA, 25 bp, Artificial Sequence
  Description of Artificial Sequence: Synthetic oligonucleotide
atgatcgcactgcgcaggggtgcca

SEQ ID NO: 133435 - DNA, 24 bp, Artificial Sequence
  Description of Artificial Sequence: Synthetic oligonucleotide
tgatcgcactgcgcaggggtgcca

SEQ ID NO: 133436 - DNA, 23 bp, Artificial Sequence
  Description of Artificial Sequence: Synthetic oligonucleotide
gatcgcactgcgcaggggtgcca

SEQ ID NO: 133437 - DNA, 23 bp, Artificial Sequence
  Description of Artificial Sequence: Synthetic oligonucleotide
atcgcactgcgcaggggtgccac

SEQ ID NO: 133438 - DNA, 22 bp, Artificial Sequence
  Description of Artificial Sequence: Synthetic oligonucleotide
tcgcactgcgcaggggtgccac

SEQ ID NO: 133439 - DNA, 21 bp, Artificial Sequence
  Description of Artificial Sequence: Synthetic oligonucleotide
cgcactgcgcaggggtgccac

SEQ ID NO: 133440 - DNA, 21 bp, Artificial Sequence
  Description of Artificial Sequence: Synthetic oligonucleotide
gcactgcgcaggggtgccacg

SEQ ID NO: 133441 - DNA, 22 bp, Artificial Sequence
  Description of Artificial Sequence: Synthetic oligonucleotide
cactgcgcaggggtgccacgga

SEQ ID NO: 133442 - DNA, 22 bp, Artificial Sequence
  Description of Artificial Sequence: Synthetic oligonucleotide
actgcgcaggggtgccacggag

SEQ ID NO: 133443 - DNA, 21 bp, Artificial Sequence
  Description of Artificial Sequence: Synthetic oligonucleotide
ctgcgcaggggtgccacggag

SEQ ID NO: 133444 - DNA, 22 bp, Artificial Sequence
  Description of Artificial Sequence: Synthetic oligonucleotide
tgcgcaggggtgccacggagct

SEQ ID NO: 133445 - DNA, 21 bp, Artificial Sequence
  Description of Artificial Sequence: Synthetic oligonucleotide
gcgcaggggtgccacggagct

SEQ ID NO: 133446 - DNA, 22 bp, Artificial Sequence
  Description of Artificial Sequence: Synthetic oligonucleotide
cgcaggggtgccacggagctca

SEQ ID NO: 133447 - DNA, 22 bp, Artificial Sequence
  Description of Artificial Sequence: Synthetic oligonucleotide
gcaggggtgccacggagctcac

SEQ ID NO: 133448 - DNA, 22 bp, Artificial Sequence
  Description of Artificial Sequence: Synthetic oligonucleotide
caggggtgccacggagctcacc

SEQ ID NO: 133449 - DNA, 23 bp, Artificial Sequence
  Description of Artificial Sequence: Synthetic oligonucleotide
aggggtgccacggagctcaccca

SEQ ID NO: 133450 - DNA, 22 bp, Artificial Sequence
  Description of Artificial Sequence: Synthetic oligonucleotide
ggggtgccacggagctcaccca

SEQ ID NO: 133451 - DNA, 22 bp, Artificial Sequence
  Description of Artificial Sequence: Synthetic oligonucleotide
gggtgccacggagctcacccac

SEQ ID NO: 133452 - DNA, 23 bp, Artificial Sequence
  Description of Artificial Sequence: Synthetic oligonucleotide
ggtgccacggagctcacccacga

SEQ ID NO: 133453 - DNA, 23 bp, Artificial Sequence
  Description of Artificial Sequence: Synthetic oligonucleotide
gtgccacggagctcacccacgag

SEQ ID NO: 133454 - DNA, 24 bp, Artificial Sequence
  Description of Artificial Sequence: Synthetic oligonucleotide
tgccacggagctcacccacgagga

SEQ ID NO: 133455 - DNA, 23 bp, Artificial Sequence
  Description of Artificial Sequence: Synthetic oligonucleotide
gccacggagctcacccacgagga

SEQ ID NO: 133456 - DNA, 25 bp, Artificial Sequence
  Description of Artificial Sequence: Synthetic oligonucleotide
ccacggagctcacccacgaggacta

SEQ ID NO: 133457 - DNA, 27 bp, Artificial Sequence
  Description of Artificial Sequence: Synthetic oligonucleotide
cacggagctcacccacgaggactacat

SEQ ID NO: 133458 - DNA, 27 bp, Artificial Sequence
  Description of Artificial Sequence: Synthetic oligonucleotide
acggagctcacccacgaggactacatg

SEQ ID NO: 133459 - DNA, 26 bp, Artificial Sequence
  Description of Artificial Sequence: Synthetic oligonucleotide
cggagctcacccacgaggactacatg

SEQ ID NO: 133460 - DNA, 27 bp, Artificial Sequence
  Description of Artificial Sequence: Synthetic oligonucleotide
ggagctcacccacgaggactacatgga

SEQ ID NO: 133461 - DNA, 28 bp, Artificial Sequence
  Description of Artificial Sequence: Synthetic oligonucleotide
gagctcacccacgaggactacatggaag

SEQ ID NO: 133462 - DNA, 28 bp, Artificial Sequence
  Description of Artificial Sequence: Synthetic oligonucleotide
agctcacccacgaggactacatggaagg

SEQ ID NO: 133463 - DNA, 27 bp, Artificial Sequence
  Description of Artificial Sequence: Synthetic oligonucleotide
gctcacccacgaggactacatggaagg

SEQ ID NO: 133464 - DNA, 27 bp, Artificial Sequence
  Description of Artificial Sequence: Synthetic oligonucleotide
ctcacccacgaggactacatggaaggc

SEQ ID NO: 133465 - DNA, 29 bp, Artificial Sequence
  Description of Artificial Sequence: Synthetic oligonucleotide
tcacccacgaggactacatggaaggcatc

SEQ ID NO: 133466 - DNA, 28 bp, Artificial Sequence
  Description of Artificial Sequence: Synthetic oligonucleotide
cacccacgaggactacatggaaggcatc

SEQ ID NO: 133467 - DNA, 28 bp, Artificial Sequence
  Description of Artificial Sequence: Synthetic oligonucleotide
acccacgaggactacatggaaggcatcc

SEQ ID NO: 133468 - DNA, 27 bp, Artificial Sequence
  Description of Artificial Sequence: Synthetic oligonucleotide
cccacgaggactacatggaaggcatcc

SEQ ID NO: 133469 - DNA, 28 bp, Artificial Sequence
  Description of Artificial Sequence: Synthetic oligonucleotide
ccacgaggactacatggaaggcatcctg

SEQ ID NO: 133470 - DNA, 28 bp, Artificial Sequence
  Description of Artificial Sequence: Synthetic oligonucleotide
cacgaggactacatggaaggcatcctgg

SEQ ID NO: 133471 - DNA, 29 bp, Artificial Sequence
  Description of Artificial Sequence: Synthetic oligonucleotide
acgaggactacatggaaggcatcctggag

SEQ ID NO: 133472 - DNA, 28 bp, Artificial Sequence
  Description of Artificial Sequence: Synthetic oligonucleotide
cgaggactacatggaaggcatcctggag

SEQ ID NO: 133473 - DNA, 28 bp, Artificial Sequence
  Description of Artificial Sequence: Synthetic oligonucleotide
gaggactacatggaaggcatcctggagg

SEQ ID NO: 133474 - DNA, 29 bp, Artificial Sequence
  Description of Artificial Sequence: Synthetic oligonucleotide
aggactacatggaaggcatcctggaggtg

SEQ ID NO: 133475 - DNA, 28 bp, Artificial Sequence
  Description of Artificial Sequence: Synthetic oligonucleotide
ggactacatggaaggcatcctggaggtg

SEQ ID NO: 133476 - DNA, 28 bp, Artificial Sequence
  Description of Artificial Sequence: Synthetic oligonucleotide
gactacatggaaggcatcctggaggtgc

SEQ ID NO: 133477 - DNA, 29 bp, Artificial Sequence
  Description of Artificial Sequence: Synthetic oligonucleotide
actacatggaaggcatcctggaggtgcag

SEQ ID NO: 133478 - DNA, 28 bp, Artificial Sequence
  Description of Artificial Sequence: Synthetic oligonucleotide
ctacatggaaggcatcctggaggtgcag

SEQ ID NO: 133479 - DNA, 28 bp, Artificial Sequence
  Description of Artificial Sequence: Synthetic oligonucleotide
tacatggaaggcatcctggaggtgcagg

SEQ ID NO: 133480 - DNA, 27 bp, Artificial Sequence
  Description of Artificial Sequence: Synthetic oligonucleotide
acatggaaggcatcctggaggtgcagg

SEQ ID NO: 133481 - DNA, 26 bp, Artificial Sequence
  Description of Artificial Sequence: Synthetic oligonucleotide
catggaaggcatcctggaggtgcagg

SEQ ID NO: 133482 - DNA, 26 bp, Artificial Sequence
  Description of Artificial Sequence: Synthetic oligonucleotide
atggaaggcatcctggaggtgcaggc

SEQ ID NO: 133483 - DNA, 25 bp, Artificial Sequence
  Description of Artificial Sequence: Synthetic oligonucleotide
tggaaggcatcctggaggtgcaggc

SEQ ID NO: 133484 - DNA, 24 bp, Artificial Sequence
  Description of Artificial Sequence: Synthetic oligonucleotide
ggaaggcatcctggaggtgcaggc

SEQ ID NO: 133485 - DNA, 26 bp, Artificial Sequence
  Description of Artificial Sequence: Synthetic oligonucleotide
gaaggcatcctggaggtgcaggccaa

SEQ ID NO: 133486 - DNA, 27 bp, Artificial Sequence
  Description of Artificial Sequence: Synthetic oligonucleotide
aaggcatcctggaggtgcaggccaaga

SEQ ID NO: 133487 - DNA, 27 bp, Artificial Sequence
  Description of Artificial Sequence: Synthetic oligonucleotide
aggcatcctggaggtgcaggccaagaa

SEQ ID NO: 133488 - DNA, 26 bp, Artificial Sequence
  Description of Artificial Sequence: Synthetic oligonucleotide
ggcatcctggaggtgcaggccaagaa

SEQ ID NO: 133489 - DNA, 27 bp, Artificial Sequence
  Description of Artificial Sequence: Synthetic oligonucleotide
gcatcctggaggtgcaggccaagaaga

SEQ ID NO: 133490 - DNA, 29 bp, Artificial Sequence
  Description of Artificial Sequence: Synthetic oligonucleotide
catcctggaggtgcaggccaagaagaaag

SEQ ID NO: 133491 - DNA, 29 bp, Artificial Sequence
  Description of Artificial Sequence: Synthetic oligonucleotide
atcctggaggtgcaggccaagaagaaagc

SEQ ID NO: 133492 - DNA, 28 bp, Artificial Sequence
  Description of Artificial Sequence: Synthetic oligonucleotide
tcctggaggtgcaggccaagaagaaagc

SEQ ID NO: 133493 - DNA, 27 bp, Artificial Sequence
  Description of Artificial Sequence: Synthetic oligonucleotide
cctggaggtgcaggccaagaagaaagc

SEQ ID NO: 133494 - DNA, 27 bp, Artificial Sequence
  Description of Artificial Sequence: Synthetic oligonucleotide
ctggaggtgcaggccaagaagaaagcc

SEQ ID NO: 133495 - DNA, 29 bp, Artificial Sequence
  Description of Artificial Sequence: Synthetic oligonucleotide
tggaggtgcaggccaagaagaaagccaac

SEQ ID NO: 133496 - DNA, 28 bp, Artificial Sequence
  Description of Artificial Sequence: Synthetic oligonucleotide
ggaggtgcaggccaagaagaaagccaac

SEQ ID NO: 133497 - DNA, 28 bp, Artificial Sequence
  Description of Artificial Sequence: Synthetic oligonucleotide
gaggtgcaggccaagaagaaagccaacc

SEQ ID NO: 133498 - DNA, 30 bp, Artificial Sequence
  Description of Artificial Sequence: Synthetic oligonucleotide
aggtgcaggccaagaagaaagccaacctac

SEQ ID NO: 133499 - DNA, 29 bp, Artificial Sequence
  Description of Artificial Sequence: Synthetic oligonucleotide
ggtgcaggccaagaagaaagccaacctac

SEQ ID NO: 133500 - DNA, 33 bp, Artificial Sequence
  Description of Artificial Sequence: Synthetic oligonucleotide
gtgcaggccaagaagaaagccaacctacaatac

SEQ ID NO: 133501 - DNA, 35 bp, Artificial Sequence
  Description of Artificial Sequence: Synthetic oligonucleotide
tgcaggccaagaagaaagccaacctacaatactac

SEQ ID NO: 133502 - DNA, 34 bp, Artificial Sequence
  Description of Artificial Sequence: Synthetic oligonucleotide
gcaggccaagaagaaagccaacctacaatactac

SEQ ID NO: 133503 - DNA, 34 bp, Artificial Sequence
  Description of Artificial Sequence: Synthetic oligonucleotide
caggccaagaagaaagccaacctacaatactacg

SEQ ID NO: 133504 - DNA, 34 bp, Artificial Sequence
  Description of Artificial Sequence: Synthetic oligonucleotide
aggccaagaagaaagccaacctacaatactacgc

SEQ ID NO: 133505 - DNA, 33 bp, Artificial Sequence
  Description of Artificial Sequence: Synthetic oligonucleotide
ggccaagaagaaagccaacctacaatactacgc

SEQ ID NO: 133506 - DNA, 33 bp, Artificial Sequence
  Description of Artificial Sequence: Synthetic oligonucleotide
gccaagaagaaagccaacctacaatactacgcc

SEQ ID NO: 133507 - DNA, 35 bp, Artificial Sequence
  Description of Artificial Sequence: Synthetic oligonucleotide
ccaagaagaaagccaacctacaatactacgcctag

SEQ ID NO: 133508 - DNA, 27 bp, Artificial Sequence
  Description of Artificial Sequence: Synthetic oligonucleotide
atggcgcttgacggaccagagcagatg

SEQ ID NO: 133509 - DNA, 26 bp, Artificial Sequence
  Description of Artificial Sequence: Synthetic oligonucleotide
tggcgcttgacggaccagagcagatg

SEQ ID NO: 133510 - DNA, 25 bp, Artificial Sequence
  Description of Artificial Sequence: Synthetic oligonucleotide
ggcgcttgacggaccagagcagatg

SEQ ID NO: 133511 - DNA, 26 bp, Artificial Sequence
  Description of Artificial Sequence: Synthetic oligonucleotide
gcgcttgacggaccagagcagatgga

SEQ ID NO: 133512 - DNA, 26 bp, Artificial Sequence
  Description of Artificial Sequence: Synthetic oligonucleotide
cgcttgacggaccagagcagatggag

SEQ ID NO: 133513 - DNA, 27 bp, Artificial Sequence
  Description of Artificial Sequence: Synthetic oligonucleotide
gcttgacggaccagagcagatggagct

SEQ ID NO: 133514 - DNA, 27 bp, Artificial Sequence
  Description of Artificial Sequence: Synthetic oligonucleotide
cttgacggaccagagcagatggagctg

SEQ ID NO: 133515 - DNA, 27 bp, Artificial Sequence
  Description of Artificial Sequence: Synthetic oligonucleotide
ttgacggaccagagcagatggagctgg

SEQ ID NO: 133516 - DNA, 27 bp, Artificial Sequence
  Description of Artificial Sequence: Synthetic oligonucleotide
tgacggaccagagcagatggagctgga

SEQ ID NO: 133517 - DNA, 26 bp, Artificial Sequence
  Description of Artificial Sequence: Synthetic oligonucleotide
gacggaccagagcagatggagctgga

SEQ ID NO: 133518 - DNA, 26 bp, Artificial Sequence
  Description of Artificial Sequence: Synthetic oligonucleotide
acggaccagagcagatggagctggag

SEQ ID NO: 133519 - DNA, 25 bp, Artificial Sequence
  Description of Artificial Sequence: Synthetic oligonucleotide
cggaccagagcagatggagctggag

SEQ ID NO: 133520 - DNA, 26 bp, Artificial Sequence
  Description of Artificial Sequence: Synthetic oligonucleotide
ggaccagagcagatggagctggagga

SEQ ID NO: 133521 - DNA, 26 bp, Artificial Sequence
  Description of Artificial Sequence: Synthetic oligonucleotide
gaccagagcagatggagctggaggag

SEQ ID NO: 133522 - DNA, 26 bp, Artificial Sequence
  Description of Artificial Sequence: Synthetic oligonucleotide
accagagcagatggagctggaggagg

SEQ ID NO: 133523 - DNA, 25 bp, Artificial Sequence
  Description of Artificial Sequence: Synthetic oligonucleotide
ccagagcagatggagctggaggagg

SEQ ID NO: 133524 - DNA, 25 bp, Artificial Sequence
  Description of Artificial Sequence: Synthetic oligonucleotide
cagagcagatggagctggaggaggg

SEQ ID NO: 133525 - DNA, 27 bp, Artificial Sequence
  Description of Artificial Sequence: Synthetic oligonucleotide
agagcagatggagctggaggaggggaa

SEQ ID NO: 133526 - DNA, 26 bp, Artificial Sequence
  Description of Artificial Sequence: Synthetic oligonucleotide
gagcagatggagctggaggaggggaa

SEQ ID NO: 133527 - DNA, 26 bp, Artificial Sequence
  Description of Artificial Sequence: Synthetic oligonucleotide
agcagatggagctggaggaggggaag

SEQ ID NO: 133528 - DNA, 25 bp, Artificial Sequence
  Description of Artificial Sequence: Synthetic oligonucleotide
gcagatggagctggaggaggggaag

SEQ ID NO: 133529 - DNA, 25 bp, Artificial Sequence
  Description of Artificial Sequence: Synthetic oligonucleotide
cagatggagctggaggaggggaagg

SEQ ID NO: 133530 - DNA, 26 bp, Artificial Sequence
  Description of Artificial Sequence: Synthetic oligonucleotide
agatggagctggaggaggggaaggca

SEQ ID NO: 133531 - DNA, 25 bp, Artificial Sequence
  Description of Artificial Sequence: Synthetic oligonucleotide
gatggagctggaggaggggaaggca

SEQ ID NO: 133532 - DNA, 25 bp, Artificial Sequence
  Description of Artificial Sequence: Synthetic oligonucleotide
atggagctggaggaggggaaggcag

SEQ ID NO: 133533 - DNA, 24 bp, Artificial Sequence
  Description of Artificial Sequence: Synthetic oligonucleotide
tggagctggaggaggggaaggcag

SEQ ID NO: 133534 - DNA, 23 bp, Artificial Sequence
  Description of Artificial Sequence: Synthetic oligonucleotide
ggagctggaggaggggaaggcag

SEQ ID NO: 133535 - DNA, 23 bp, Artificial Sequence
  Description of Artificial Sequence: Synthetic oligonucleotide
gagctggaggaggggaaggcagg

SEQ ID NO: 133536 - DNA, 24 bp, Artificial Sequence
  Description of Artificial Sequence: Synthetic oligonucleotide
agctggaggaggggaaggcaggca

SEQ ID NO: 133537 - DNA, 23 bp, Artificial Sequence
  Description of Artificial Sequence: Synthetic oligonucleotide
gctggaggaggggaaggcaggca

SEQ ID NO: 133538 - DNA, 23 bp, Artificial Sequence
  Description of Artificial Sequence: Synthetic oligonucleotide
ctggaggaggggaaggcaggcag

SEQ ID NO: 133539 - DNA, 23 bp, Artificial Sequence
  Description of Artificial Sequence: Synthetic oligonucleotide
tggaggaggggaaggcaggcagc

SEQ ID NO: 133540 - DNA, 22 bp, Artificial Sequence
  Description of Artificial Sequence: Synthetic oligonucleotide
ggaggaggggaaggcaggcagc

SEQ ID NO: 133541 - DNA, 22 bp, Artificial Sequence
  Description of Artificial Sequence: Synthetic oligonucleotide
gaggaggggaaggcaggcagcg

SEQ ID NO: 133542 - DNA, 23 bp, Artificial Sequence
  Description of Artificial Sequence: Synthetic oligonucleotide
aggaggggaaggcaggcagcgga

SEQ ID NO: 133543 - DNA, 22 bp, Artificial Sequence
  Description of Artificial Sequence: Synthetic oligonucleotide
ggaggggaaggcaggcagcgga

SEQ ID NO: 133544 - DNA, 23 bp, Artificial Sequence
  Description of Artificial Sequence: Synthetic oligonucleotide
gaggggaaggcaggcagcggact

SEQ ID NO: 133545 - DNA, 23 bp, Artificial Sequence
  Description of Artificial Sequence: Synthetic oligonucleotide
aggggaaggcaggcagcggactc

SEQ ID NO: 133546 - DNA, 22 bp, Artificial Sequence
  Description of Artificial Sequence: Synthetic oligonucleotide
ggggaaggcaggcagcggactc

SEQ ID NO: 133547 - DNA, 22 bp, Artificial Sequence
  Description of Artificial Sequence: Synthetic oligonucleotide
gggaaggcaggcagcggactcc

SEQ ID NO: 133548 - DNA, 22 bp, Artificial Sequence
  Description of Artificial Sequence: Synthetic oligonucleotide
ggaaggcaggcagcggactccg

SEQ ID NO: 133549 - DNA, 22 bp, Artificial Sequence
  Description of Artificial Sequence: Synthetic oligonucleotide
gaaggcaggcagcggactccgc

SEQ ID NO: 133550 - DNA, 27 bp, Artificial Sequence
  Description of Artificial Sequence: Synthetic oligonucleotide
aaggcaggcagcggactccgccaatat

SEQ ID NO: 133551 - DNA, 27 bp, Artificial Sequence
  Description of Artificial Sequence: Synthetic oligonucleotide
aggcaggcagcggactccgccaatatt

SEQ ID NO: 133552 - DNA, 27 bp, Artificial Sequence
  Description of Artificial Sequence: Synthetic oligonucleotide
ggcaggcagcggactccgccaatatta

SEQ ID NO: 133553 - DNA, 28 bp, Artificial Sequence
  Description of Artificial Sequence: Synthetic oligonucleotide
gcaggcagcggactccgccaatattatc

SEQ ID NO: 133554 - DNA, 29 bp, Artificial Sequence
  Description of Artificial Sequence: Synthetic oligonucleotide
caggcagcggactccgccaatattatctg

SEQ ID NO: 133555 - DNA, 30 bp, Artificial Sequence
  Description of Artificial Sequence: Synthetic oligonucleotide
aggcagcggactccgccaatattatctgtc

SEQ ID NO: 133556 - DNA, 29 bp, Artificial Sequence
  Description of Artificial Sequence: Synthetic oligonucleotide
ggcagcggactccgccaatattatctgtc

SEQ ID NO: 133557 - DNA, 29 bp, Artificial Sequence
  Description of Artificial Sequence: Synthetic oligonucleotide
gcagcggactccgccaatattatctgtcc

SEQ ID NO: 133558 - DNA, 31 bp, Artificial Sequence
  Description of Artificial Sequence: Synthetic oligonucleotide
cagcggactccgccaatattatctgtccaag

SEQ ID NO: 133559 - DNA, 34 bp, Artificial Sequence
  Description of Artificial Sequence: Synthetic oligonucleotide
agcggactccgccaatattatctgtccaagattg

SEQ ID NO: 133560 - DNA, 33 bp, Artificial Sequence
  Description of Artificial Sequence: Synthetic oligonucleotide
gcggactccgccaatattatctgtccaagattg

SEQ ID NO: 133561 - DNA, 35 bp, Artificial Sequence
  Description of Artificial Sequence: Synthetic oligonucleotide
cggactccgccaatattatctgtccaagattgaag

SEQ ID NO: 133562 - DNA, 37 bp, Artificial Sequence
  Description of Artificial Sequence: Synthetic oligonucleotide
ggactccgccaatattatctgtccaagattgaagaac

SEQ ID NO: 133563 - DNA, 38 bp, Artificial Sequence
  Description of Artificial Sequence: Synthetic oligonucleotide
gactccgccaatattatctgtccaagattgaagaactc

SEQ ID NO: 133564 - DNA, 38 bp, Artificial Sequence
  Description of Artificial Sequence: Synthetic oligonucleotide
actccgccaatattatctgtccaagattgaagaactcc

SEQ ID NO: 133565 - DNA, 37 bp, Artificial Sequence
  Description of Artificial Sequence: Synthetic oligonucleotide
ctccgccaatattatctgtccaagattgaagaactcc

SEQ ID NO: 133566 - DNA, 38 bp, Artificial Sequence
  Description of Artificial Sequence: Synthetic oligonucleotide
tccgccaatattatctgtccaagattgaagaactccag

SEQ ID NO: 133567 - DNA, 37 bp, Artificial Sequence
  Description of Artificial Sequence: Synthetic oligonucleotide
ccgccaatattatctgtccaagattgaagaactccag

SEQ ID NO: 133568 - DNA, 37 bp, Artificial Sequence
  Description of Artificial Sequence: Synthetic oligonucleotide
cgccaatattatctgtccaagattgaagaactccagc

SEQ ID NO: 133569 - DNA, 38 bp, Artificial Sequence
  Description of Artificial Sequence: Synthetic oligonucleotide
gccaatattatctgtccaagattgaagaactccagctg

SEQ ID NO: 133570 - DNA, 41 bp, Artificial Sequence
  Description of Artificial Sequence: Synthetic oligonucleotide
ccaatattatctgtccaagattgaagaactccagctgattg

SEQ ID NO: 133571 - DNA, 42 bp, Artificial Sequence
  Description of Artificial Sequence: Synthetic oligonucleotide
caatattatctgtccaagattgaagaactccagctgattgtg

SEQ ID NO: 133572 - DNA, 45 bp, Artificial Sequence
  Description of Artificial Sequence: Synthetic oligonucleotide
aatattatctgtccaagattgaagaactccagctgattgtgaatg

SEQ ID NO: 133573 - DNA, 44 bp, Artificial Sequence
  Description of Artificial Sequence: Synthetic oligonucleotide
atattatctgtccaagattgaagaactccagctgattgtgaatg

SEQ ID NO: 133574 - DNA, 43 bp, Artificial Sequence
  Description of Artificial Sequence: Synthetic oligonucleotide
tattatctgtccaagattgaagaactccagctgattgtgaatg

SEQ ID NO: 133575 - DNA, 42 bp, Artificial Sequence
  Description of Artificial Sequence: Synthetic oligonucleotide
attatctgtccaagattgaagaactccagctgattgtgaatg

SEQ ID NO: 133576 - DNA, 41 bp, Artificial Sequence
  Description of Artificial Sequence: Synthetic oligonucleotide
ttatctgtccaagattgaagaactccagctgattgtgaatg

SEQ ID NO: 133577 - DNA, 40 bp, Artificial Sequence
  Description of Artificial Sequence: Synthetic oligonucleotide
tatctgtccaagattgaagaactccagctgattgtgaatg

SEQ ID NO: 133578 - DNA, 39 bp, Artificial Sequence
  Description of Artificial Sequence: Synthetic oligonucleotide
atctgtccaagattgaagaactccagctgattgtgaatg

SEQ ID NO: 133579 - DNA, 38 bp, Artificial Sequence
  Description of Artificial Sequence: Synthetic oligonucleotide
tctgtccaagattgaagaactccagctgattgtgaatg

SEQ ID NO: 133580 - DNA, 37 bp, Artificial Sequence
  Description of Artificial Sequence: Synthetic oligonucleotide
ctgtccaagattgaagaactccagctgattgtgaatg

SEQ ID NO: 133581 - DNA, 41 bp, Artificial Sequence
  Description of Artificial Sequence: Synthetic oligonucleotide
tgtccaagattgaagaactccagctgattgtgaatgataag

SEQ ID NO: 133582 - DNA, 40 bp, Artificial Sequence
  Description of Artificial Sequence: Synthetic oligonucleotide
gtccaagattgaagaactccagctgattgtgaatgataag

SEQ ID NO: 133583 - DNA, 41 bp, Artificial Sequence
  Description of Artificial Sequence: Synthetic oligonucleotide
tccaagattgaagaactccagctgattgtgaatgataagag

SEQ ID NO: 133584 - DNA, 40 bp, Artificial Sequence
  Description of Artificial Sequence: Synthetic oligonucleotide
ccaagattgaagaactccagctgattgtgaatgataagag

SEQ ID NO: 133585 - DNA, 40 bp, Artificial Sequence
  Description of Artificial Sequence: Synthetic oligonucleotide
caagattgaagaactccagctgattgtgaatgataagagc

SEQ ID NO: 133586 - DNA, 40 bp, Artificial Sequence
  Description of Artificial Sequence: Synthetic oligonucleotide
aagattgaagaactccagctgattgtgaatgataagagcc

SEQ ID NO: 133587 - DNA, 39 bp, Artificial Sequence
  Description of Artificial Sequence: Synthetic oligonucleotide
agattgaagaactccagctgattgtgaatgataagagcc

SEQ ID NO: 133588 - DNA, 38 bp, Artificial Sequence
  Description of Artificial Sequence: Synthetic oligonucleotide
gattgaagaactccagctgattgtgaatgataagagcc

SEQ ID NO: 133589 - DNA, 42 bp, Artificial Sequence
  Description of Artificial Sequence: Synthetic oligonucleotide
attgaagaactccagctgattgtgaatgataagagccaaaac

SEQ ID NO: 133590 - DNA, 41 bp, Artificial Sequence
  Description of Artificial Sequence: Synthetic oligonucleotide
ttgaagaactccagctgattgtgaatgataagagccaaaac

SEQ ID NO: 133591 - DNA, 40 bp, Artificial Sequence
  Description of Artificial Sequence: Synthetic oligonucleotide
tgaagaactccagctgattgtgaatgataagagccaaaac

SEQ ID NO: 133592 - DNA, 39 bp, Artificial Sequence
  Description of Artificial Sequence: Synthetic oligonucleotide
gaagaactccagctgattgtgaatgataagagccaaaac

SEQ ID NO: 133593 - DNA, 39 bp, Artificial Sequence
  Description of Artificial Sequence: Synthetic oligonucleotide
aagaactccagctgattgtgaatgataagagccaaaacc

SEQ ID NO: 133594 - DNA, 38 bp, Artificial Sequence
  Description of Artificial Sequence: Synthetic oligonucleotide
agaactccagctgattgtgaatgataagagccaaaacc

SEQ ID NO: 133595 - DNA, 37 bp, Artificial Sequence
  Description of Artificial Sequence: Synthetic oligonucleotide
gaactccagctgattgtgaatgataagagccaaaacc

SEQ ID NO: 133596 - DNA, 38 bp, Artificial Sequence
  Description of Artificial Sequence: Synthetic oligonucleotide
aactccagctgattgtgaatgataagagccaaaacctc

SEQ ID NO: 133597 - DNA, 37 bp, Artificial Sequence
  Description of Artificial Sequence: Synthetic oligonucleotide
actccagctgattgtgaatgataagagccaaaacctc

SEQ ID NO: 133598 - DNA, 36 bp, Artificial Sequence
  Description of Artificial Sequence: Synthetic oligonucleotide
ctccagctgattgtgaatgataagagccaaaacctc

SEQ ID NO: 133599 - DNA, 36 bp, Artificial Sequence
  Description of Artificial Sequence: Synthetic oligonucleotide
tccagctgattgtgaatgataagagccaaaacctcc

SEQ ID NO: 133600 - DNA, 35 bp, Artificial Sequence
  Description of Artificial Sequence: Synthetic oligonucleotide
ccagctgattgtgaatgataagagccaaaacctcc

SEQ ID NO: 133601 - DNA, 35 bp, Artificial Sequence
  Description of Artificial Sequence: Synthetic oligonucleotide
cagctgattgtgaatgataagagccaaaacctccg

SEQ ID NO: 133602 - DNA, 35 bp, Artificial Sequence
  Description of Artificial Sequence: Synthetic oligonucleotide
agctgattgtgaatgataagagccaaaacctccgg

SEQ ID NO: 133603 - DNA, 34 bp, Artificial Sequence
  Description of Artificial Sequence: Synthetic oligonucleotide
gctgattgtgaatgataagagccaaaacctccgg

SEQ ID NO: 133604 - DNA, 35 bp, Artificial Sequence
  Description of Artificial Sequence: Synthetic oligonucleotide
ctgattgtgaatgataagagccaaaacctccggag

SEQ ID NO: 133605 - DNA, 35 bp, Artificial Sequence
  Description of Artificial Sequence: Synthetic oligonucleotide
tgattgtgaatgataagagccaaaacctccggagg

SEQ ID NO: 133606 - DNA, 34 bp, Artificial Sequence
  Description of Artificial Sequence: Synthetic oligonucleotide
gattgtgaatgataagagccaaaacctccggagg

SEQ ID NO: 133607 - DNA, 34 bp, Artificial Sequence
  Description of Artificial Sequence: Synthetic oligonucleotide
attgtgaatgataagagccaaaacctccggaggc

SEQ ID NO: 133608 - DNA, 33 bp, Artificial Sequence
  Description of Artificial Sequence: Synthetic oligonucleotide
ttgtgaatgataagagccaaaacctccggaggc

SEQ ID NO: 133609 - DNA, 32 bp, Artificial Sequence
  Description of Artificial Sequence: Synthetic oligonucleotide
tgtgaatgataagagccaaaacctccggaggc

SEQ ID NO: 133610 - DNA, 31 bp, Artificial Sequence
  Description of Artificial Sequence: Synthetic oligonucleotide
gtgaatgataagagccaaaacctccggaggc

SEQ ID NO: 133611 - DNA, 32 bp, Artificial Sequence
  Description of Artificial Sequence: Synthetic oligonucleotide
tgaatgataagagccaaaacctccggaggctg

SEQ ID NO: 133612 - DNA, 31 bp, Artificial Sequence
  Description of Artificial Sequence: Synthetic oligonucleotide
gaatgataagagccaaaacctccggaggctg

SEQ ID NO: 133613 - DNA, 31 bp, Artificial Sequence
  Description of Artificial Sequence: Synthetic oligonucleotide
aatgataagagccaaaacctccggaggctgc

SEQ ID NO: 133614 - DNA, 30 bp, Artificial Sequence
  Description of Artificial Sequence: Synthetic oligonucleotide
atgataagagccaaaacctccggaggctgc

SEQ ID NO: 133615 - DNA, 29 bp, Artificial Sequence
  Description of Artificial Sequence: Synthetic oligonucleotide
tgataagagccaaaacctccggaggctgc

SEQ ID NO: 133616 - DNA, 28 bp, Artificial Sequence
  Description of Artificial Sequence: Synthetic oligonucleotide
gataagagccaaaacctccggaggctgc

SEQ ID NO: 133617 - DNA, 29 bp, Artificial Sequence
  Description of Artificial Sequence: Synthetic oligonucleotide
ataagagccaaaacctccggaggctgcag

SEQ ID NO: 133618 - DNA, 28 bp, Artificial Sequence
  Description of Artificial Sequence: Synthetic oligonucleotide
taagagccaaaacctccggaggctgcag

SEQ ID NO: 133619 - DNA, 27 bp, Artificial Sequence
  Description of Artificial Sequence: Synthetic oligonucleotide
aagagccaaaacctccggaggctgcag

SEQ ID NO: 133620 - DNA, 26 bp, Artificial Sequence
  Description of Artificial Sequence: Synthetic oligonucleotide
agagccaaaacctccggaggctgcag

SEQ ID NO: 133621 - DNA, 25 bp, Artificial Sequence
  Description of Artificial Sequence: Synthetic oligonucleotide
gagccaaaacctccggaggctgcag

SEQ ID NO: 133622 - DNA, 25 bp, Artificial Sequence
  Description of Artificial Sequence: Synthetic oligonucleotide
agccaaaacctccggaggctgcagg

SEQ ID NO: 133623 - DNA, 24 bp, Artificial Sequence
  Description of Artificial Sequence: Synthetic oligonucleotide
gccaaaacctccggaggctgcagg

SEQ ID NO: 133624 - DNA, 25 bp, Artificial Sequence
  Description of Artificial Sequence: Synthetic oligonucleotide
ccaaaacctccggaggctgcaggca

SEQ ID NO: 133625 - DNA, 26 bp, Artificial Sequence
  Description of Artificial Sequence: Synthetic oligonucleotide
caaaacctccggaggctgcaggcaca

SEQ ID NO: 133626 - DNA, 27 bp, Artificial Sequence
  Description of Artificial Sequence: Synthetic oligonucleotide
aaaacctccggaggctgcaggcacaga

SEQ ID NO: 133627 - DNA, 26 bp, Artificial Sequence
  Description of Artificial Sequence: Synthetic oligonucleotide
aaacctccggaggctgcaggcacaga

SEQ ID NO: 133628 - DNA, 25 bp, Artificial Sequence
  Description of Artificial Sequence: Synthetic oligonucleotide
aacctccggaggctgcaggcacaga

SEQ ID NO: 133629 - DNA, 24 bp, Artificial Sequence
  Description of Artificial Sequence: Synthetic oligonucleotide
acctccggaggctgcaggcacaga

SEQ ID NO: 133630 - DNA, 23 bp, Artificial Sequence
  Description of Artificial Sequence: Synthetic oligonucleotide
cctccggaggctgcaggcacaga

SEQ ID NO: 133631 - DNA, 23 bp, Artificial Sequence
  Description of Artificial Sequence: Synthetic oligonucleotide
ctccggaggctgcaggcacagag

SEQ ID NO: 133632 - DNA, 25 bp, Artificial Sequence
  Description of Artificial Sequence: Synthetic oligonucleotide
tccggaggctgcaggcacagaggaa

SEQ ID NO: 133633 - DNA, 24 bp, Artificial Sequence
  Description of Artificial Sequence: Synthetic oligonucleotide
ccggaggctgcaggcacagaggaa

SEQ ID NO: 133634 - DNA, 24 bp, Artificial Sequence
  Description of Artificial Sequence: Synthetic oligonucleotide
cggaggctgcaggcacagaggaac

SEQ ID NO: 133635 - DNA, 26 bp, Artificial Sequence
  Description of Artificial Sequence: Synthetic oligonucleotide
ggaggctgcaggcacagaggaacgaa

SEQ ID NO: 133636 - DNA, 27 bp, Artificial Sequence
  Description of Artificial Sequence: Synthetic oligonucleotide
gaggctgcaggcacagaggaacgaact

SEQ ID NO: 133637 - DNA, 31 bp, Artificial Sequence
  Description of Artificial Sequence: Synthetic oligonucleotide
aggctgcaggcacagaggaacgaactaaatg

SEQ ID NO: 133638 - DNA, 30 bp, Artificial Sequence
  Description of Artificial Sequence: Synthetic oligonucleotide
ggctgcaggcacagaggaacgaactaaatg

SEQ ID NO: 133639 - DNA, 30 bp, Artificial Sequence
  Description of Artificial Sequence: Synthetic oligonucleotide
gctgcaggcacagaggaacgaactaaatgc

SEQ ID NO: 133640 - DNA, 34 bp, Artificial Sequence
  Description of Artificial Sequence: Synthetic oligonucleotide
ctgcaggcacagaggaacgaactaaatgctaaag

SEQ ID NO: 133641 - DNA, 36 bp, Artificial Sequence
  Description of Artificial Sequence: Synthetic oligonucleotide
tgcaggcacagaggaacgaactaaatgctaaagttc

SEQ ID NO: 133642 - DNA, 35 bp, Artificial Sequence
  Description of Artificial Sequence: Synthetic oligonucleotide
gcaggcacagaggaacgaactaaatgctaaagttc

SEQ ID NO: 133643 - DNA, 35 bp, Artificial Sequence
  Description of Artificial Sequence: Synthetic oligonucleotide
caggcacagaggaacgaactaaatgctaaagttcg

SEQ ID NO: 133644 - DNA, 35 bp, Artificial Sequence
  Description of Artificial Sequence: Synthetic oligonucleotide
aggcacagaggaacgaactaaatgctaaagttcgc

SEQ ID NO: 133645 - DNA, 34 bp, Artificial Sequence
  Description of Artificial Sequence: Synthetic oligonucleotide
ggcacagaggaacgaactaaatgctaaagttcgc

SEQ ID NO: 133646 - DNA, 34 bp, Artificial Sequence
  Description of Artificial Sequence: Synthetic oligonucleotide
gcacagaggaacgaactaaatgctaaagttcgcc

SEQ ID NO: 133647 - DNA, 38 bp, Artificial Sequence
  Description of Artificial Sequence: Synthetic oligonucleotide
cacagaggaacgaactaaatgctaaagttcgcctattg

SEQ ID NO: 133648 - DNA, 38 bp, Artificial Sequence
  Description of Artificial Sequence: Synthetic oligonucleotide
acagaggaacgaactaaatgctaaagttcgcctattgc

SEQ ID NO: 133649 - DNA, 37 bp, Artificial Sequence
  Description of Artificial Sequence: Synthetic oligonucleotide
cagaggaacgaactaaatgctaaagttcgcctattgc

SEQ ID NO: 133650 - DNA, 37 bp, Artificial Sequence
  Description of Artificial Sequence: Synthetic oligonucleotide
agaggaacgaactaaatgctaaagttcgcctattgcg

SEQ ID NO: 133651 - DNA, 36 bp, Artificial Sequence
  Description of Artificial Sequence: Synthetic oligonucleotide
gaggaacgaactaaatgctaaagttcgcctattgcg

SEQ ID NO: 133652 - DNA, 36 bp, Artificial Sequence
  Description of Artificial Sequence: Synthetic oligonucleotide
aggaacgaactaaatgctaaagttcgcctattgcgg

SEQ ID NO: 133653 - DNA, 35 bp, Artificial Sequence
  Description of Artificial Sequence: Synthetic oligonucleotide
ggaacgaactaaatgctaaagttcgcctattgcgg

SEQ ID NO: 133654 - DNA, 35 bp, Artificial Sequence
  Description of Artificial Sequence: Synthetic oligonucleotide
gaacgaactaaatgctaaagttcgcctattgcggg

SEQ ID NO: 133655 - DNA, 36 bp, Artificial Sequence
  Description of Artificial Sequence: Synthetic oligonucleotide
aacgaactaaatgctaaagttcgcctattgcgggag

SEQ ID NO: 133656 - DNA, 35 bp, Artificial Sequence
  Description of Artificial Sequence: Synthetic oligonucleotide
acgaactaaatgctaaagttcgcctattgcgggag

SEQ ID NO: 133657 - DNA, 34 bp, Artificial Sequence
  Description of Artificial Sequence: Synthetic oligonucleotide
cgaactaaatgctaaagttcgcctattgcgggag

SEQ ID NO: 133658 - DNA, 34 bp, Artificial Sequence
  Description of Artificial Sequence: Synthetic oligonucleotide
gaactaaatgctaaagttcgcctattgcgggagg

SEQ ID NO: 133659 - DNA, 35 bp, Artificial Sequence
  Description of Artificial Sequence: Synthetic oligonucleotide
aactaaatgctaaagttcgcctattgcgggaggag

SEQ ID NO: 133660 - DNA, 34 bp, Artificial Sequence
  Description of Artificial Sequence: Synthetic oligonucleotide
actaaatgctaaagttcgcctattgcgggaggag

SEQ ID NO: 133661 - DNA, 33 bp, Artificial Sequence
  Description of Artificial Sequence: Synthetic oligonucleotide
ctaaatgctaaagttcgcctattgcgggaggag

SEQ ID NO: 133662 - DNA, 33 bp, Artificial Sequence
  Description of Artificial Sequence: Synthetic oligonucleotide
taaatgctaaagttcgcctattgcgggaggagc

SEQ ID NO: 133663 - DNA, 32 bp, Artificial Sequence
  Description of Artificial Sequence: Synthetic oligonucleotide
aaatgctaaagttcgcctattgcgggaggagc

SEQ ID NO: 133664 - DNA, 31 bp, Artificial Sequence
  Description of Artificial Sequence: Synthetic oligonucleotide
aatgctaaagttcgcctattgcgggaggagc

SEQ ID NO: 133665 - DNA, 30 bp, Artificial Sequence
  Description of Artificial Sequence: Synthetic oligonucleotide
atgctaaagttcgcctattgcgggaggagc

SEQ ID NO: 133666 - DNA, 29 bp, Artificial Sequence
  Description of Artificial Sequence: Synthetic oligonucleotide
tgctaaagttcgcctattgcgggaggagc

SEQ ID NO: 133667 - DNA, 28 bp, Artificial Sequence
  Description of Artificial Sequence: Synthetic oligonucleotide
gctaaagttcgcctattgcgggaggagc

SEQ ID NO: 133668 - DNA, 30 bp, Artificial Sequence
  Description of Artificial Sequence: Synthetic oligonucleotide
ctaaagttcgcctattgcgggaggagctac

SEQ ID NO: 133669 - DNA, 31 bp, Artificial Sequence
  Description of Artificial Sequence: Synthetic oligonucleotide
taaagttcgcctattgcgggaggagctacag

SEQ ID NO: 133670 - DNA, 30 bp, Artificial Sequence
  Description of Artificial Sequence: Synthetic oligonucleotide
aaagttcgcctattgcgggaggagctacag

SEQ ID NO: 133671 - DNA, 29 bp, Artificial Sequence
  Description of Artificial Sequence: Synthetic oligonucleotide
aagttcgcctattgcgggaggagctacag

SEQ ID NO: 133672 - DNA, 28 bp, Artificial Sequence
  Description of Artificial Sequence: Synthetic oligonucleotide
agttcgcctattgcgggaggagctacag

SEQ ID NO: 133673 - DNA, 27 bp, Artificial Sequence
  Description of Artificial Sequence: Synthetic oligonucleotide
gttcgcctattgcgggaggagctacag

SEQ ID NO: 133674 - DNA, 27 bp, Artificial Sequence
  Description of Artificial Sequence: Synthetic oligonucleotide
ttcgcctattgcgggaggagctacagc

SEQ ID NO: 133675 - DNA, 27 bp, Artificial Sequence
  Description of Artificial Sequence: Synthetic oligonucleotide
tcgcctattgcgggaggagctacagct

SEQ ID NO: 133676 - DNA, 26 bp, Artificial Sequence
  Description of Artificial Sequence: Synthetic oligonucleotide
cgcctattgcgggaggagctacagct

SEQ ID NO: 133677 - DNA, 26 bp, Artificial Sequence
  Description of Artificial Sequence: Synthetic oligonucleotide
gcctattgcgggaggagctacagctg

SEQ ID NO: 133678 - DNA, 27 bp, Artificial Sequence
  Description of Artificial Sequence: Synthetic oligonucleotide
cctattgcgggaggagctacagctgct

SEQ ID NO: 133679 - DNA, 27 bp, Artificial Sequence
  Description of Artificial Sequence: Synthetic oligonucleotide
ctattgcgggaggagctacagctgctg

SEQ ID NO: 133680 - DNA, 27 bp, Artificial Sequence
  Description of Artificial Sequence: Synthetic oligonucleotide
tattgcgggaggagctacagctgctgc

SEQ ID NO: 133681 - DNA, 27 bp, Artificial Sequence
  Description of Artificial Sequence: Synthetic oligonucleotide
attgcgggaggagctacagctgctgca

SEQ ID NO: 133682 - DNA, 26 bp, Artificial Sequence
  Description of Artificial Sequence: Synthetic oligonucleotide
ttgcgggaggagctacagctgctgca

SEQ ID NO: 133683 - DNA, 25 bp, Artificial Sequence
  Description of Artificial Sequence: Synthetic oligonucleotide
tgcgggaggagctacagctgctgca

SEQ ID NO: 133684 - DNA, 24 bp, Artificial Sequence
  Description of Artificial Sequence: Synthetic oligonucleotide
gcgggaggagctacagctgctgca

SEQ ID NO: 133685 - DNA, 24 bp, Artificial Sequence
  Description of Artificial Sequence: Synthetic oligonucleotide
cgggaggagctacagctgctgcag

SEQ ID NO: 133686 - DNA, 25 bp, Artificial Sequence
  Description of Artificial Sequence: Synthetic oligonucleotide
gggaggagctacagctgctgcagga

SEQ ID NO: 133687 - DNA, 25 bp, Artificial Sequence
  Description of Artificial Sequence: Synthetic oligonucleotide
ggaggagctacagctgctgcaggag

SEQ ID NO: 133688 - DNA, 26 bp, Artificial Sequence
  Description of Artificial Sequence: Synthetic oligonucleotide
gaggagctacagctgctgcaggagca

SEQ ID NO: 133689 - DNA, 26 bp, Artificial Sequence
  Description of Artificial Sequence: Synthetic oligonucleotide
aggagctacagctgctgcaggagcag

SEQ ID NO: 133690 - DNA, 25 bp, Artificial Sequence
  Description of Artificial Sequence: Synthetic oligonucleotide
ggagctacagctgctgcaggagcag

SEQ ID NO: 133691 - DNA, 25 bp, Artificial Sequence
  Description of Artificial Sequence: Synthetic oligonucleotide
gagctacagctgctgcaggagcagg

SEQ ID NO: 133692 - DNA, 25 bp, Artificial Sequence
  Description of Artificial Sequence: Synthetic oligonucleotide
agctacagctgctgcaggagcaggg

SEQ ID NO: 133693 - DNA, 24 bp, Artificial Sequence
  Description of Artificial Sequence: Synthetic oligonucleotide
gctacagctgctgcaggagcaggg

SEQ ID NO: 133694 - DNA, 25 bp, Artificial Sequence
  Description of Artificial Sequence: Synthetic oligonucleotide
ctacagctgctgcaggagcagggct

SEQ ID NO: 133695 - DNA, 25 bp, Artificial Sequence
  Description of Artificial Sequence: Synthetic oligonucleotide
tacagctgctgcaggagcagggctc

SEQ ID NO: 133696 - DNA, 24 bp, Artificial Sequence
  Description of Artificial Sequence: Synthetic oligonucleotide
acagctgctgcaggagcagggctc

SEQ ID NO: 133697 - DNA, 23 bp, Artificial Sequence
  Description of Artificial Sequence: Synthetic oligonucleotide
cagctgctgcaggagcagggctc

SEQ ID NO: 133698 - DNA, 26 bp, Artificial Sequence
  Description of Artificial Sequence: Synthetic oligonucleotide
agctgctgcaggagcagggctcctat

SEQ ID NO: 133699 - DNA, 25 bp, Artificial Sequence
  Description of Artificial Sequence: Synthetic oligonucleotide
gctgctgcaggagcagggctcctat

SEQ ID NO: 133700 - DNA, 26 bp, Artificial Sequence
  Description of Artificial Sequence: Synthetic oligonucleotide
ctgctgcaggagcagggctcctatgt

SEQ ID NO: 133701 - DNA, 26 bp, Artificial Sequence
  Description of Artificial Sequence: Synthetic oligonucleotide
tgctgcaggagcagggctcctatgtg

SEQ ID NO: 133702 - DNA, 25 bp, Artificial Sequence
  Description of Artificial Sequence: Synthetic oligonucleotide
gctgcaggagcagggctcctatgtg

SEQ ID NO: 133703 - DNA, 25 bp, Artificial Sequence
  Description of Artificial Sequence: Synthetic oligonucleotide
ctgcaggagcagggctcctatgtgg

SEQ ID NO: 133704 - DNA, 25 bp, Artificial Sequence
  Description of Artificial Sequence: Synthetic oligonucleotide
tgcaggagcagggctcctatgtggg

SEQ ID NO: 133705 - DNA, 24 bp, Artificial Sequence
  Description of Artificial Sequence: Synthetic oligonucleotide
gcaggagcagggctcctatgtggg

SEQ ID NO: 133706 - DNA, 24 bp, Artificial Sequence
  Description of Artificial Sequence: Synthetic oligonucleotide
caggagcagggctcctatgtgggg

SEQ ID NO: 133707 - DNA, 26 bp, Artificial Sequence
  Description of Artificial Sequence: Synthetic oligonucleotide
aggagcagggctcctatgtgggggaa

SEQ ID NO: 133708 - DNA, 25 bp, Artificial Sequence
  Description of Artificial Sequence: Synthetic oligonucleotide
ggagcagggctcctatgtgggggaa

SEQ ID NO: 133709 - DNA, 27 bp, Artificial Sequence
  Description of Artificial Sequence: Synthetic oligonucleotide
gagcagggctcctatgtgggggaagta

SEQ ID NO: 133710 - DNA, 27 bp, Artificial Sequence
  Description of Artificial Sequence: Synthetic oligonucleotide
agcagggctcctatgtgggggaagtag

SEQ ID NO: 133711 - DNA, 27 bp, Artificial Sequence
  Description of Artificial Sequence: Synthetic oligonucleotide
gcagggctcctatgtgggggaagtagt

SEQ ID NO: 133712 - DNA, 27 bp, Artificial Sequence
  Description of Artificial Sequence: Synthetic oligonucleotide
cagggctcctatgtgggggaagtagtc

SEQ ID NO: 133713 - DNA, 27 bp, Artificial Sequence
  Description of Artificial Sequence: Synthetic oligonucleotide
agggctcctatgtgggggaagtagtcc

SEQ ID NO: 133714 - DNA, 26 bp, Artificial Sequence
  Description of Artificial Sequence: Synthetic oligonucleotide
gggctcctatgtgggggaagtagtcc

SEQ ID NO: 133715 - DNA, 26 bp, Artificial Sequence
  Description of Artificial Sequence: Synthetic oligonucleotide
ggctcctatgtgggggaagtagtccg

SEQ ID NO: 133716 - DNA, 26 bp, Artificial Sequence
  Description of Artificial Sequence: Synthetic oligonucleotide
gctcctatgtgggggaagtagtccgg

SEQ ID NO: 133717 - DNA, 26 bp, Artificial Sequence
  Description of Artificial Sequence: Synthetic oligonucleotide
ctcctatgtgggggaagtagtccggg

SEQ ID NO: 133718 - DNA, 26 bp, Artificial Sequence
  Description of Artificial Sequence: Synthetic oligonucleotide
tcctatgtgggggaagtagtccgggc

SEQ ID NO: 133719 - DNA, 25 bp, Artificial Sequence
  Description of Artificial Sequence: Synthetic oligonucleotide
cctatgtgggggaagtagtccgggc

SEQ ID NO: 133720 - DNA, 27 bp, Artificial Sequence
  Description of Artificial Sequence: Synthetic oligonucleotide
ctatgtgggggaagtagtccgggccat

SEQ ID NO: 133721 - DNA, 27 bp, Artificial Sequence
  Description of Artificial Sequence: Synthetic oligonucleotide
tatgtgggggaagtagtccgggccatg

SEQ ID NO: 133722 - DNA, 26 bp, Artificial Sequence
  Description of Artificial Sequence: Synthetic oligonucleotide
atgtgggggaagtagtccgggccatg

SEQ ID NO: 133723 - DNA, 25 bp, Artificial Sequence
  Description of Artificial Sequence: Synthetic oligonucleotide
tgtgggggaagtagtccgggccatg

SEQ ID NO: 133724 - DNA, 24 bp, Artificial Sequence
  Description of Artificial Sequence: Synthetic oligonucleotide
gtgggggaagtagtccgggccatg

SEQ ID NO: 133725 - DNA, 27 bp, Artificial Sequence
  Description of Artificial Sequence: Synthetic oligonucleotide
tgggggaagtagtccgggccatggata

SEQ ID NO: 133726 - DNA, 27 bp, Artificial Sequence
  Description of Artificial Sequence: Synthetic oligonucleotide
gggggaagtagtccgggccatggataa

SEQ ID NO: 133727 - DNA, 27 bp, Artificial Sequence
  Description of Artificial Sequence: Synthetic oligonucleotide
ggggaagtagtccgggccatggataag

SEQ ID NO: 133728 - DNA, 29 bp, Artificial Sequence
  Description of Artificial Sequence: Synthetic oligonucleotide
gggaagtagtccgggccatggataagaag

SEQ ID NO: 133729 - DNA, 32 bp, Artificial Sequence
  Description of Artificial Sequence: Synthetic oligonucleotide
ggaagtagtccgggccatggataagaagaaag

SEQ ID NO: 133730 - DNA, 33 bp, Artificial Sequence
  Description of Artificial Sequence: Synthetic oligonucleotide
gaagtagtccgggccatggataagaagaaagtg

SEQ ID NO: 133731 - DNA, 35 bp, Artificial Sequence
  Description of Artificial Sequence: Synthetic oligonucleotide
aagtagtccgggccatggataagaagaaagtgttg

SEQ ID NO: 133732 - DNA, 34 bp, Artificial Sequence
  Description of Artificial Sequence: Synthetic oligonucleotide
agtagtccgggccatggataagaagaaagtgttg

SEQ ID NO: 133733 - DNA, 33 bp, Artificial Sequence
  Description of Artificial Sequence: Synthetic oligonucleotide
gtagtccgggccatggataagaagaaagtgttg

SEQ ID NO: 133734 - DNA, 33 bp, Artificial Sequence
  Description of Artificial Sequence: Synthetic oligonucleotide
tagtccgggccatggataagaagaaagtgttgg

SEQ ID NO: 133735 - DNA, 32 bp, Artificial Sequence
  Description of Artificial Sequence: Synthetic oligonucleotide
agtccgggccatggataagaagaaagtgttgg

SEQ ID NO: 133736 - DNA, 31 bp, Artificial Sequence
  Description of Artificial Sequence: Synthetic oligonucleotide
gtccgggccatggataagaagaaagtgttgg

SEQ ID NO: 133737 - DNA, 32 bp, Artificial Sequence
  Description of Artificial Sequence: Synthetic oligonucleotide
tccgggccatggataagaagaaagtgttggtc

SEQ ID NO: 133738 - DNA, 31 bp, Artificial Sequence
  Description of Artificial Sequence: Synthetic oligonucleotide
ccgggccatggataagaagaaagtgttggtc

SEQ ID NO: 133739 - DNA, 33 bp, Artificial Sequence
  Description of Artificial Sequence: Synthetic oligonucleotide
cgggccatggataagaagaaagtgttggtcaag

SEQ ID NO: 133740 - DNA, 33 bp, Artificial Sequence
  Description of Artificial Sequence: Synthetic oligonucleotide
gggccatggataagaagaaagtgttggtcaagg

SEQ ID NO: 133741 - DNA, 35 bp, Artificial Sequence
  Description of Artificial Sequence: Synthetic oligonucleotide
ggccatggataagaagaaagtgttggtcaaggtac

SEQ ID NO: 133742 - DNA, 37 bp, Artificial Sequence
  Description of Artificial Sequence: Synthetic oligonucleotide
gccatggataagaagaaagtgttggtcaaggtacatc

SEQ ID NO: 133743 - DNA, 37 bp, Artificial Sequence
  Description of Artificial Sequence: Synthetic oligonucleotide
ccatggataagaagaaagtgttggtcaaggtacatcc

SEQ ID NO: 133744 - DNA, 38 bp, Artificial Sequence
  Description of Artificial Sequence: Synthetic oligonucleotide
catggataagaagaaagtgttggtcaaggtacatcctg

SEQ ID NO: 133745 - DNA, 40 bp, Artificial Sequence
  Description of Artificial Sequence: Synthetic oligonucleotide
atggataagaagaaagtgttggtcaaggtacatcctgaag

SEQ ID NO: 133746 - DNA, 39 bp, Artificial Sequence
  Description of Artificial Sequence: Synthetic oligonucleotide
tggataagaagaaagtgttggtcaaggtacatcctgaag

SEQ ID NO: 133747 - DNA, 38 bp, Artificial Sequence
  Description of Artificial Sequence: Synthetic oligonucleotide
ggataagaagaaagtgttggtcaaggtacatcctgaag

SEQ ID NO: 133748 - DNA, 38 bp, Artificial Sequence
  Description of Artificial Sequence: Synthetic oligonucleotide
gataagaagaaagtgttggtcaaggtacatcctgaagg

SEQ ID NO: 133749 - DNA, 45 bp, Artificial Sequence
  Description of Artificial Sequence: Synthetic oligonucleotide
ataagaagaaagtgttggtcaaggtacatcctgaaggtaaatttg

SEQ ID NO: 133750 - DNA, 44 bp, Artificial Sequence
  Description of Artificial Sequence: Synthetic oligonucleotide
taagaagaaagtgttggtcaaggtacatcctgaaggtaaatttg

SEQ ID NO: 133751 - DNA, 43 bp, Artificial Sequence
  Description of Artificial Sequence: Synthetic oligonucleotide
aagaagaaagtgttggtcaaggtacatcctgaaggtaaatttg

SEQ ID NO: 133752 - DNA, 42 bp, Artificial Sequence
  Description of Artificial Sequence: Synthetic oligonucleotide
agaagaaagtgttggtcaaggtacatcctgaaggtaaatttg

SEQ ID NO: 133753 - DNA, 41 bp, Artificial Sequence
  Description of Artificial Sequence: Synthetic oligonucleotide
gaagaaagtgttggtcaaggtacatcctgaaggtaaatttg

SEQ ID NO: 133754 - DNA, 43 bp, Artificial Sequence
  Description of Artificial Sequence: Synthetic oligonucleotide
aagaaagtgttggtcaaggtacatcctgaaggtaaatttgttg

SEQ ID NO: 133755 - DNA, 42 bp, Artificial Sequence
  Description of Artificial Sequence: Synthetic oligonucleotide
agaaagtgttggtcaaggtacatcctgaaggtaaatttgttg

SEQ ID NO: 133756 - DNA, 41 bp, Artificial Sequence
  Description of Artificial Sequence: Synthetic oligonucleotide
gaaagtgttggtcaaggtacatcctgaaggtaaatttgttg

SEQ ID NO: 133757 - DNA, 43 bp, Artificial Sequence
  Description of Artificial Sequence: Synthetic oligonucleotide
aaagtgttggtcaaggtacatcctgaaggtaaatttgttgtag

SEQ ID NO: 133758 - DNA, 42 bp, Artificial Sequence
  Description of Artificial Sequence: Synthetic oligonucleotide
aagtgttggtcaaggtacatcctgaaggtaaatttgttgtag

SEQ ID NO: 133759 - DNA, 41 bp, Artificial Sequence
  Description of Artificial Sequence: Synthetic oligonucleotide
agtgttggtcaaggtacatcctgaaggtaaatttgttgtag

SEQ ID NO: 133760 - DNA, 40 bp, Artificial Sequence
  Description of Artificial Sequence: Synthetic oligonucleotide
gtgttggtcaaggtacatcctgaaggtaaatttgttgtag

SEQ ID NO: 133761 - DNA, 41 bp, Artificial Sequence
  Description of Artificial Sequence: Synthetic oligonucleotide
tgttggtcaaggtacatcctgaaggtaaatttgttgtagac

SEQ ID NO: 133762 - DNA, 40 bp, Artificial Sequence
  Description of Artificial Sequence: Synthetic oligonucleotide
gttggtcaaggtacatcctgaaggtaaatttgttgtagac

SEQ ID NO: 133763 - DNA, 40 bp, Artificial Sequence
  Description of Artificial Sequence: Synthetic oligonucleotide
ttggtcaaggtacatcctgaaggtaaatttgttgtagacg

SEQ ID NO: 133764 - DNA, 39 bp, Artificial Sequence
  Description of Artificial Sequence: Synthetic oligonucleotide
tggtcaaggtacatcctgaaggtaaatttgttgtagacg

SEQ ID NO: 133765 - DNA, 38 bp, Artificial Sequence
  Description of Artificial Sequence: Synthetic oligonucleotide
ggtcaaggtacatcctgaaggtaaatttgttgtagacg

SEQ ID NO: 133766 - DNA, 39 bp, Artificial Sequence
  Description of Artificial Sequence: Synthetic oligonucleotide
gtcaaggtacatcctgaaggtaaatttgttgtagacgtg

SEQ ID NO: 133767 - DNA, 39 bp, Artificial Sequence
  Description of Artificial Sequence: Synthetic oligonucleotide
tcaaggtacatcctgaaggtaaatttgttgtagacgtgg

SEQ ID NO: 133768 - DNA, 38 bp, Artificial Sequence
  Description of Artificial Sequence: Synthetic oligonucleotide
caaggtacatcctgaaggtaaatttgttgtagacgtgg

SEQ ID NO: 133769 - DNA, 39 bp, Artificial Sequence
  Description of Artificial Sequence: Synthetic oligonucleotide
aaggtacatcctgaaggtaaatttgttgtagacgtggac

SEQ ID NO: 133770 - DNA, 38 bp, Artificial Sequence
  Description of Artificial Sequence: Synthetic oligonucleotide
aggtacatcctgaaggtaaatttgttgtagacgtggac

SEQ ID NO: 133771 - DNA, 37 bp, Artificial Sequence
  Description of Artificial Sequence: Synthetic oligonucleotide
ggtacatcctgaaggtaaatttgttgtagacgtggac

SEQ ID NO: 133772 - DNA, 42 bp, Artificial Sequence
  Description of Artificial Sequence: Synthetic oligonucleotide
gtacatcctgaaggtaaatttgttgtagacgtggacaaaaac

SEQ ID NO: 133773 - DNA, 45 bp, Artificial Sequence
  Description of Artificial Sequence: Synthetic oligonucleotide
tacatcctgaaggtaaatttgttgtagacgtggacaaaaacattg

SEQ ID NO: 133774 - DNA, 44 bp, Artificial Sequence
  Description of Artificial Sequence: Synthetic oligonucleotide
acatcctgaaggtaaatttgttgtagacgtggacaaaaacattg

SEQ ID NO: 133775 - DNA, 43 bp, Artificial Sequence
  Description of Artificial Sequence: Synthetic oligonucleotide
catcctgaaggtaaatttgttgtagacgtggacaaaaacattg

SEQ ID NO: 133776 - DNA, 44 bp, Artificial Sequence
  Description of Artificial Sequence: Synthetic oligonucleotide
atcctgaaggtaaatttgttgtagacgtggacaaaaacattgac

SEQ ID NO: 133777 - DNA, 43 bp, Artificial Sequence
  Description of Artificial Sequence: Synthetic oligonucleotide
tcctgaaggtaaatttgttgtagacgtggacaaaaacattgac

SEQ ID NO: 133778 - DNA, 42 bp, Artificial Sequence
  Description of Artificial Sequence: Synthetic oligonucleotide
cctgaaggtaaatttgttgtagacgtggacaaaaacattgac

SEQ ID NO: 133779 - DNA, 44 bp, Artificial Sequence
  Description of Artificial Sequence: Synthetic oligonucleotide
ctgaaggtaaatttgttgtagacgtggacaaaaacattgacatc

SEQ ID NO: 133780 - DNA, 47 bp, Artificial Sequence
  Description of Artificial Sequence: Synthetic oligonucleotide
tgaaggtaaatttgttgtagacgtggacaaaaacattgacatcaatg

SEQ ID NO: 133781 - DNA, 46 bp, Artificial Sequence
  Description of Artificial Sequence: Synthetic oligonucleotide
gaaggtaaatttgttgtagacgtggacaaaaacattgacatcaatg

SEQ ID NO: 133782 - DNA, 48 bp, Artificial Sequence
  Description of Artificial Sequence: Synthetic oligonucleotide
aaggtaaatttgttgtagacgtggacaaaaacattgacatcaatgatg

SEQ ID NO: 133783 - DNA, 47 bp, Artificial Sequence
  Description of Artificial Sequence: Synthetic oligonucleotide
aggtaaatttgttgtagacgtggacaaaaacattgacatcaatgatg

SEQ ID NO: 133784 - DNA, 46 bp, Artificial Sequence
  Description of Artificial Sequence: Synthetic oligonucleotide
ggtaaatttgttgtagacgtggacaaaaacattgacatcaatgatg

SEQ ID NO: 133785 - DNA, 47 bp, Artificial Sequence
  Description of Artificial Sequence: Synthetic oligonucleotide
gtaaatttgttgtagacgtggacaaaaacattgacatcaatgatgtg

SEQ ID NO: 133786 - DNA, 48 bp, Artificial Sequence
  Description of Artificial Sequence: Synthetic oligonucleotide
taaatttgttgtagacgtggacaaaaacattgacatcaatgatgtgac

SEQ ID NO: 133787 - DNA, 47 bp, Artificial Sequence
  Description of Artificial Sequence: Synthetic oligonucleotide
aaatttgttgtagacgtggacaaaaacattgacatcaatgatgtgac

SEQ ID NO: 133788 - DNA, 46 bp, Artificial Sequence
  Description of Artificial Sequence: Synthetic oligonucleotide
aatttgttgtagacgtggacaaaaacattgacatcaatgatgtgac

SEQ ID NO: 133789 - DNA, 45 bp, Artificial Sequence
  Description of Artificial Sequence: Synthetic oligonucleotide
atttgttgtagacgtggacaaaaacattgacatcaatgatgtgac

SEQ ID NO: 133790 - DNA, 44 bp, Artificial Sequence
  Description of Artificial Sequence: Synthetic oligonucleotide
tttgttgtagacgtggacaaaaacattgacatcaatgatgtgac

SEQ ID NO: 133791 - DNA, 43 bp, Artificial Sequence
  Description of Artificial Sequence: Synthetic oligonucleotide
ttgttgtagacgtggacaaaaacattgacatcaatgatgtgac

SEQ ID NO: 133792 - DNA, 42 bp, Artificial Sequence
  Description of Artificial Sequence: Synthetic oligonucleotide
tgttgtagacgtggacaaaaacattgacatcaatgatgtgac

SEQ ID NO: 133793 - DNA, 41 bp, Artificial Sequence
  Description of Artificial Sequence: Synthetic oligonucleotide
gttgtagacgtggacaaaaacattgacatcaatgatgtgac

SEQ ID NO: 133794 - DNA, 42 bp, Artificial Sequence
  Description of Artificial Sequence: Synthetic oligonucleotide
ttgtagacgtggacaaaaacattgacatcaatgatgtgacac

SEQ ID NO: 133795 - DNA, 41 bp, Artificial Sequence
  Description of Artificial Sequence: Synthetic oligonucleotide
tgtagacgtggacaaaaacattgacatcaatgatgtgacac

SEQ ID NO: 133796 - DNA, 40 bp, Artificial Sequence
  Description of Artificial Sequence: Synthetic oligonucleotide
gtagacgtggacaaaaacattgacatcaatgatgtgacac

SEQ ID NO: 133797 - DNA, 40 bp, Artificial Sequence
  Description of Artificial Sequence: Synthetic oligonucleotide
tagacgtggacaaaaacattgacatcaatgatgtgacacc

SEQ ID NO: 133798 - DNA, 39 bp, Artificial Sequence
  Description of Artificial Sequence: Synthetic oligonucleotide
agacgtggacaaaaacattgacatcaatgatgtgacacc

SEQ ID NO: 133799 - DNA, 38 bp, Artificial Sequence
  Description of Artificial Sequence: Synthetic oligonucleotide
gacgtggacaaaaacattgacatcaatgatgtgacacc

SEQ ID NO: 133800 - DNA, 38 bp, Artificial Sequence
  Description of Artificial Sequence: Synthetic oligonucleotide
acgtggacaaaaacattgacatcaatgatgtgacaccc

SEQ ID NO: 133801 - DNA, 37 bp, Artificial Sequence
  Description of Artificial Sequence: Synthetic oligonucleotide
cgtggacaaaaacattgacatcaatgatgtgacaccc

SEQ ID NO: 133802 - DNA, 41 bp, Artificial Sequence
  Description of Artificial Sequence: Synthetic oligonucleotide
gtggacaaaaacattgacatcaatgatgtgacacccaattg

SEQ ID NO: 133803 - DNA, 41 bp, Artificial Sequence
  Description of Artificial Sequence: Synthetic oligonucleotide
tggacaaaaacattgacatcaatgatgtgacacccaattgc

SEQ ID NO: 133804 - DNA, 40 bp, Artificial Sequence
  Description of Artificial Sequence: Synthetic oligonucleotide
ggacaaaaacattgacatcaatgatgtgacacccaattgc

SEQ ID NO: 133805 - DNA, 40 bp, Artificial Sequence
  Description of Artificial Sequence: Synthetic oligonucleotide
gacaaaaacattgacatcaatgatgtgacacccaattgcc

SEQ ID NO: 133806 - DNA, 40 bp, Artificial Sequence
  Description of Artificial Sequence: Synthetic oligonucleotide
acaaaaacattgacatcaatgatgtgacacccaattgccg

SEQ ID NO: 133807 - DNA, 39 bp, Artificial Sequence
  Description of Artificial Sequence: Synthetic oligonucleotide
caaaaacattgacatcaatgatgtgacacccaattgccg

SEQ ID NO: 133808 - DNA, 39 bp, Artificial Sequence
  Description of Artificial Sequence: Synthetic oligonucleotide
aaaaacattgacatcaatgatgtgacacccaattgccgg

SEQ ID NO: 133809 - DNA, 38 bp, Artificial Sequence
  Description of Artificial Sequence: Synthetic oligonucleotide
aaaacattgacatcaatgatgtgacacccaattgccgg

SEQ ID NO: 133810 - DNA, 37 bp, Artificial Sequence
  Description of Artificial Sequence: Synthetic oligonucleotide
aaacattgacatcaatgatgtgacacccaattgccgg

SEQ ID NO: 133811 - DNA, 36 bp, Artificial Sequence
  Description of Artificial Sequence: Synthetic oligonucleotide
aacattgacatcaatgatgtgacacccaattgccgg

SEQ ID NO: 133812 - DNA, 35 bp, Artificial Sequence
  Description of Artificial Sequence: Synthetic oligonucleotide
acattgacatcaatgatgtgacacccaattgccgg

SEQ ID NO: 133813 - DNA, 34 bp, Artificial Sequence
  Description of Artificial Sequence: Synthetic oligonucleotide
cattgacatcaatgatgtgacacccaattgccgg

SEQ ID NO: 133814 - DNA, 34 bp, Artificial Sequence
  Description of Artificial Sequence: Synthetic oligonucleotide
attgacatcaatgatgtgacacccaattgccggg

SEQ ID NO: 133815 - DNA, 33 bp, Artificial Sequence
  Description of Artificial Sequence: Synthetic oligonucleotide
ttgacatcaatgatgtgacacccaattgccggg

SEQ ID NO: 133816 - DNA, 32 bp, Artificial Sequence
  Description of Artificial Sequence: Synthetic oligonucleotide
tgacatcaatgatgtgacacccaattgccggg

SEQ ID NO: 133817 - DNA, 31 bp, Artificial Sequence
  Description of Artificial Sequence: Synthetic oligonucleotide
gacatcaatgatgtgacacccaattgccggg

SEQ ID NO: 133818 - DNA, 32 bp, Artificial Sequence
  Description of Artificial Sequence: Synthetic oligonucleotide
acatcaatgatgtgacacccaattgccgggtg

SEQ ID NO: 133819 - DNA, 31 bp, Artificial Sequence
  Description of Artificial Sequence: Synthetic oligonucleotide
catcaatgatgtgacacccaattgccgggtg

SEQ ID NO: 133820 - DNA, 31 bp, Artificial Sequence
  Description of Artificial Sequence: Synthetic oligonucleotide
atcaatgatgtgacacccaattgccgggtgg

SEQ ID NO: 133821 - DNA, 30 bp, Artificial Sequence
  Description of Artificial Sequence: Synthetic oligonucleotide
tcaatgatgtgacacccaattgccgggtgg

SEQ ID NO: 133822 - DNA, 29 bp, Artificial Sequence
  Description of Artificial Sequence: Synthetic oligonucleotide
caatgatgtgacacccaattgccgggtgg

SEQ ID NO: 133823 - DNA, 29 bp, Artificial Sequence
  Description of Artificial Sequence: Synthetic oligonucleotide
aatgatgtgacacccaattgccgggtggc

SEQ ID NO: 133824 - DNA, 28 bp, Artificial Sequence
  Description of Artificial Sequence: Synthetic oligonucleotide
atgatgtgacacccaattgccgggtggc

SEQ ID NO: 133825 - DNA, 27 bp, Artificial Sequence
  Description of Artificial Sequence: Synthetic oligonucleotide
tgatgtgacacccaattgccgggtggc

SEQ ID NO: 133826 - DNA, 27 bp, Artificial Sequence
  Description of Artificial Sequence: Synthetic oligonucleotide
gatgtgacacccaattgccgggtggct

SEQ ID NO: 133827 - DNA, 27 bp, Artificial Sequence
  Description of Artificial Sequence: Synthetic oligonucleotide
atgtgacacccaattgccgggtggctc

SEQ ID NO: 133828 - DNA, 27 bp, Artificial Sequence
  Description of Artificial Sequence: Synthetic oligonucleotide
tgtgacacccaattgccgggtggctct

SEQ ID NO: 133829 - DNA, 27 bp, Artificial Sequence
  Description of Artificial Sequence: Synthetic oligonucleotide
gtgacacccaattgccgggtggctcta

SEQ ID NO: 133830 - DNA, 28 bp, Artificial Sequence
  Description of Artificial Sequence: Synthetic oligonucleotide
tgacacccaattgccgggtggctctaag

SEQ ID NO: 133831 - DNA, 27 bp, Artificial Sequence
  Description of Artificial Sequence: Synthetic oligonucleotide
gacacccaattgccgggtggctctaag

SEQ ID NO: 133832 - DNA, 27 bp, Artificial Sequence
  Description of Artificial Sequence: Synthetic oligonucleotide
acacccaattgccgggtggctctaagg

SEQ ID NO: 133833 - DNA, 27 bp, Artificial Sequence
  Description of Artificial Sequence: Synthetic oligonucleotide
cacccaattgccgggtggctctaagga

SEQ ID NO: 133834 - DNA, 29 bp, Artificial Sequence
  Description of Artificial Sequence: Synthetic oligonucleotide
acccaattgccgggtggctctaaggaatg

SEQ ID NO: 133835 - DNA, 28 bp, Artificial Sequence
  Description of Artificial Sequence: Synthetic oligonucleotide
cccaattgccgggtggctctaaggaatg

SEQ ID NO: 133836 - DNA, 29 bp, Artificial Sequence
  Description of Artificial Sequence: Synthetic oligonucleotide
ccaattgccgggtggctctaaggaatgac

SEQ ID NO: 133837 - DNA, 30 bp, Artificial Sequence
  Description of Artificial Sequence: Synthetic oligonucleotide
caattgccgggtggctctaaggaatgacag

SEQ ID NO: 133838 - DNA, 30 bp, Artificial Sequence
  Description of Artificial Sequence: Synthetic oligonucleotide
aattgccgggtggctctaaggaatgacagc

SEQ ID NO: 133839 - DNA, 29 bp, Artificial Sequence
  Description of Artificial Sequence: Synthetic oligonucleotide
attgccgggtggctctaaggaatgacagc

SEQ ID NO: 133840 - DNA, 28 bp, Artificial Sequence
  Description of Artificial Sequence: Synthetic oligonucleotide
ttgccgggtggctctaaggaatgacagc

SEQ ID NO: 133841 - DNA, 27 bp, Artificial Sequence
  Description of Artificial Sequence: Synthetic oligonucleotide
tgccgggtggctctaaggaatgacagc

SEQ ID NO: 133842 - DNA, 27 bp, Artificial Sequence
  Description of Artificial Sequence: Synthetic oligonucleotide
gccgggtggctctaaggaatgacagct

SEQ ID NO: 133843 - DNA, 28 bp, Artificial Sequence
  Description of Artificial Sequence: Synthetic oligonucleotide
ccgggtggctctaaggaatgacagctac

SEQ ID NO: 133844 - DNA, 29 bp, Artificial Sequence
  Description of Artificial Sequence: Synthetic oligonucleotide
cgggtggctctaaggaatgacagctacac

SEQ ID NO: 133845 - DNA, 30 bp, Artificial Sequence
  Description of Artificial Sequence: Synthetic oligonucleotide
gggtggctctaaggaatgacagctacactc

SEQ ID NO: 133846 - DNA, 31 bp, Artificial Sequence
  Description of Artificial Sequence: Synthetic oligonucleotide
ggtggctctaaggaatgacagctacactctg

SEQ ID NO: 133847 - DNA, 31 bp, Artificial Sequence
  Description of Artificial Sequence: Synthetic oligonucleotide
gtggctctaaggaatgacagctacactctgc

SEQ ID NO: 133848 - DNA, 32 bp, Artificial Sequence
  Description of Artificial Sequence: Synthetic oligonucleotide
tggctctaaggaatgacagctacactctgcac

SEQ ID NO: 133849 - DNA, 31 bp, Artificial Sequence
  Description of Artificial Sequence: Synthetic oligonucleotide
ggctctaaggaatgacagctacactctgcac

SEQ ID NO: 133850 - DNA, 33 bp, Artificial Sequence
  Description of Artificial Sequence: Synthetic oligonucleotide
gctctaaggaatgacagctacactctgcacaag

SEQ ID NO: 133851 - DNA, 35 bp, Artificial Sequence
  Description of Artificial Sequence: Synthetic oligonucleotide
ctctaaggaatgacagctacactctgcacaagatc

SEQ ID NO: 133852 - DNA, 35 bp, Artificial Sequence
  Description of Artificial Sequence: Synthetic oligonucleotide
tctaaggaatgacagctacactctgcacaagatcc

SEQ ID NO: 133853 - DNA, 34 bp, Artificial Sequence
  Description of Artificial Sequence: Synthetic oligonucleotide
ctaaggaatgacagctacactctgcacaagatcc

SEQ ID NO: 133854 - DNA, 35 bp, Artificial Sequence
  Description of Artificial Sequence: Synthetic oligonucleotide
taaggaatgacagctacactctgcacaagatcctg

SEQ ID NO: 133855 - DNA, 34 bp, Artificial Sequence
  Description of Artificial Sequence: Synthetic oligonucleotide
aaggaatgacagctacactctgcacaagatcctg

SEQ ID NO: 133856 - DNA, 33 bp, Artificial Sequence
  Description of Artificial Sequence: Synthetic oligonucleotide
aggaatgacagctacactctgcacaagatcctg

SEQ ID NO: 133857 - DNA, 32 bp, Artificial Sequence
  Description of Artificial Sequence: Synthetic oligonucleotide
ggaatgacagctacactctgcacaagatcctg

SEQ ID NO: 133858 - DNA, 32 bp, Artificial Sequence
  Description of Artificial Sequence: Synthetic oligonucleotide
gaatgacagctacactctgcacaagatcctgc

SEQ ID NO: 133859 - DNA, 32 bp, Artificial Sequence
  Description of Artificial Sequence: Synthetic oligonucleotide
aatgacagctacactctgcacaagatcctgcc

SEQ ID NO: 133860 - DNA, 31 bp, Artificial Sequence
  Description of Artificial Sequence: Synthetic oligonucleotide
atgacagctacactctgcacaagatcctgcc

SEQ ID NO: 133861 - DNA, 30 bp, Artificial Sequence
  Description of Artificial Sequence: Synthetic oligonucleotide
tgacagctacactctgcacaagatcctgcc

SEQ ID NO: 133862 - DNA, 29 bp, Artificial Sequence
  Description of Artificial Sequence: Synthetic oligonucleotide
gacagctacactctgcacaagatcctgcc

SEQ ID NO: 133863 - DNA, 29 bp, Artificial Sequence
  Description of Artificial Sequence: Synthetic oligonucleotide
acagctacactctgcacaagatcctgccc

SEQ ID NO: 133864 - DNA, 28 bp, Artificial Sequence
  Description of Artificial Sequence: Synthetic oligonucleotide
cagctacactctgcacaagatcctgccc

SEQ ID NO: 133865 - DNA, 30 bp, Artificial Sequence
  Description of Artificial Sequence: Synthetic oligonucleotide
agctacactctgcacaagatcctgcccaac

SEQ ID NO: 133866 - DNA, 29 bp, Artificial Sequence
  Description of Artificial Sequence: Synthetic oligonucleotide
gctacactctgcacaagatcctgcccaac

SEQ ID NO: 133867 - DNA, 31 bp, Artificial Sequence
  Description of Artificial Sequence: Synthetic oligonucleotide
ctacactctgcacaagatcctgcccaacaag

SEQ ID NO: 133868 - DNA, 31 bp, Artificial Sequence
  Description of Artificial Sequence: Synthetic oligonucleotide
tacactctgcacaagatcctgcccaacaagg

SEQ ID NO: 133869 - DNA, 30 bp, Artificial Sequence
  Description of Artificial Sequence: Synthetic oligonucleotide
acactctgcacaagatcctgcccaacaagg

SEQ ID NO: 133870 - DNA, 29 bp, Artificial Sequence
  Description of Artificial Sequence: Synthetic oligonucleotide
cactctgcacaagatcctgcccaacaagg

SEQ ID NO: 133871 - DNA, 31 bp, Artificial Sequence
  Description of Artificial Sequence: Synthetic oligonucleotide
actctgcacaagatcctgcccaacaaggtag

SEQ ID NO: 133872 - DNA, 30 bp, Artificial Sequence
  Description of Artificial Sequence: Synthetic oligonucleotide
ctctgcacaagatcctgcccaacaaggtag

SEQ ID NO: 133873 - DNA, 31 bp, Artificial Sequence
  Description of Artificial Sequence: Synthetic oligonucleotide
tctgcacaagatcctgcccaacaaggtagac

SEQ ID NO: 133874 - DNA, 30 bp, Artificial Sequence
  Description of Artificial Sequence: Synthetic oligonucleotide
ctgcacaagatcctgcccaacaaggtagac

SEQ ID NO: 133875 - DNA, 30 bp, Artificial Sequence
  Description of Artificial Sequence: Synthetic oligonucleotide
tgcacaagatcctgcccaacaaggtagacc

SEQ ID NO: 133876 - DNA, 29 bp, Artificial Sequence
  Description of Artificial Sequence: Synthetic oligonucleotide
gcacaagatcctgcccaacaaggtagacc

SEQ ID NO: 133877 - DNA, 29 bp, Artificial Sequence
  Description of Artificial Sequence: Synthetic oligonucleotide
cacaagatcctgcccaacaaggtagaccc

SEQ ID NO: 133878 - DNA, 33 bp, Artificial Sequence
  Description of Artificial Sequence: Synthetic oligonucleotide
acaagatcctgcccaacaaggtagacccattag

SEQ ID NO: 133879 - DNA, 32 bp, Artificial Sequence
  Description of Artificial Sequence: Synthetic oligonucleotide
caagatcctgcccaacaaggtagacccattag

SEQ ID NO: 133880 - DNA, 33 bp, Artificial Sequence
  Description of Artificial Sequence: Synthetic oligonucleotide
aagatcctgcccaacaaggtagacccattagtg

SEQ ID NO: 133881 - DNA, 32 bp, Artificial Sequence
  Description of Artificial Sequence: Synthetic oligonucleotide
agatcctgcccaacaaggtagacccattagtg

SEQ ID NO: 133882 - DNA, 31 bp, Artificial Sequence
  Description of Artificial Sequence: Synthetic oligonucleotide
gatcctgcccaacaaggtagacccattagtg

SEQ ID NO: 133883 - DNA, 32 bp, Artificial Sequence
  Description of Artificial Sequence: Synthetic oligonucleotide
atcctgcccaacaaggtagacccattagtgtc

SEQ ID NO: 133884 - DNA, 31 bp, Artificial Sequence
  Description of Artificial Sequence: Synthetic oligonucleotide
tcctgcccaacaaggtagacccattagtgtc

SEQ ID NO: 133885 - DNA, 30 bp, Artificial Sequence
  Description of Artificial Sequence: Synthetic oligonucleotide
cctgcccaacaaggtagacccattagtgtc

SEQ ID NO: 133886 - DNA, 31 bp, Artificial Sequence
  Description of Artificial Sequence: Synthetic oligonucleotide
ctgcccaacaaggtagacccattagtgtcac

SEQ ID NO: 133887 - DNA, 32 bp, Artificial Sequence
  Description of Artificial Sequence: Synthetic oligonucleotide
tgcccaacaaggtagacccattagtgtcactg

SEQ ID NO: 133888 - DNA, 31 bp, Artificial Sequence
  Description of Artificial Sequence: Synthetic oligonucleotide
gcccaacaaggtagacccattagtgtcactg

SEQ ID NO: 133889 - DNA, 33 bp, Artificial Sequence
  Description of Artificial Sequence: Synthetic oligonucleotide
cccaacaaggtagacccattagtgtcactgatg

SEQ ID NO: 133890 - DNA, 35 bp, Artificial Sequence
  Description of Artificial Sequence: Synthetic oligonucleotide
ccaacaaggtagacccattagtgtcactgatgatg

SEQ ID NO: 133891 - DNA, 35 bp, Artificial Sequence
  Description of Artificial Sequence: Synthetic oligonucleotide
caacaaggtagacccattagtgtcactgatgatgg

SEQ ID NO: 133892 - DNA, 36 bp, Artificial Sequence
  Description of Artificial Sequence: Synthetic oligonucleotide
aacaaggtagacccattagtgtcactgatgatggtg

SEQ ID NO: 133893 - DNA, 35 bp, Artificial Sequence
  Description of Artificial Sequence: Synthetic oligonucleotide
acaaggtagacccattagtgtcactgatgatggtg

SEQ ID NO: 133894 - DNA, 34 bp, Artificial Sequence
  Description of Artificial Sequence: Synthetic oligonucleotide
caaggtagacccattagtgtcactgatgatggtg

SEQ ID NO: 133895 - DNA, 34 bp, Artificial Sequence
  Description of Artificial Sequence: Synthetic oligonucleotide
aaggtagacccattagtgtcactgatgatggtgg

SEQ ID NO: 133896 - DNA, 33 bp, Artificial Sequence
  Description of Artificial Sequence: Synthetic oligonucleotide
aggtagacccattagtgtcactgatgatggtgg

SEQ ID NO: 133897 - DNA, 32 bp, Artificial Sequence
  Description of Artificial Sequence: Synthetic oligonucleotide
ggtagacccattagtgtcactgatgatggtgg

SEQ ID NO: 133898 - DNA, 33 bp, Artificial Sequence
  Description of Artificial Sequence: Synthetic oligonucleotide
gtagacccattagtgtcactgatgatggtggag

SEQ ID NO: 133899 - DNA, 36 bp, Artificial Sequence
  Description of Artificial Sequence: Synthetic oligonucleotide
tagacccattagtgtcactgatgatggtggagaaag

SEQ ID NO: 133900 - DNA, 35 bp, Artificial Sequence
  Description of Artificial Sequence: Synthetic oligonucleotide
agacccattagtgtcactgatgatggtggagaaag

SEQ ID NO: 133901 - DNA, 34 bp, Artificial Sequence
  Description of Artificial Sequence: Synthetic oligonucleotide
gacccattagtgtcactgatgatggtggagaaag

SEQ ID NO: 133902 - DNA, 36 bp, Artificial Sequence
  Description of Artificial Sequence: Synthetic oligonucleotide
acccattagtgtcactgatgatggtggagaaagtac

SEQ ID NO: 133903 - DNA, 35 bp, Artificial Sequence
  Description of Artificial Sequence: Synthetic oligonucleotide
cccattagtgtcactgatgatggtggagaaagtac

SEQ ID NO: 133904 - DNA, 35 bp, Artificial Sequence
  Description of Artificial Sequence: Synthetic oligonucleotide
ccattagtgtcactgatgatggtggagaaagtacc

SEQ ID NO: 133905 - DNA, 36 bp, Artificial Sequence
  Description of Artificial Sequence: Synthetic oligonucleotide
cattagtgtcactgatgatggtggagaaagtaccag

SEQ ID NO: 133906 - DNA, 39 bp, Artificial Sequence
  Description of Artificial Sequence: Synthetic oligonucleotide
attagtgtcactgatgatggtggagaaagtaccagattc

SEQ ID NO: 133907 - DNA, 38 bp, Artificial Sequence
  Description of Artificial Sequence: Synthetic oligonucleotide
ttagtgtcactgatgatggtggagaaagtaccagattc

SEQ ID NO: 133908 - DNA, 37 bp, Artificial Sequence
  Description of Artificial Sequence: Synthetic oligonucleotide
tagtgtcactgatgatggtggagaaagtaccagattc

SEQ ID NO: 133909 - DNA, 36 bp, Artificial Sequence
  Description of Artificial Sequence: Synthetic oligonucleotide
agtgtcactgatgatggtggagaaagtaccagattc

SEQ ID NO: 133910 - DNA, 35 bp, Artificial Sequence
  Description of Artificial Sequence: Synthetic oligonucleotide
gtgtcactgatgatggtggagaaagtaccagattc

SEQ ID NO: 133911 - DNA, 37 bp, Artificial Sequence
  Description of Artificial Sequence: Synthetic oligonucleotide
tgtcactgatgatggtggagaaagtaccagattcaac

SEQ ID NO: 133912 - DNA, 36 bp, Artificial Sequence
  Description of Artificial Sequence: Synthetic oligonucleotide
gtcactgatgatggtggagaaagtaccagattcaac

SEQ ID NO: 133913 - DNA, 40 bp, Artificial Sequence
  Description of Artificial Sequence: Synthetic oligonucleotide
tcactgatgatggtggagaaagtaccagattcaacttatg

SEQ ID NO: 133914 - DNA, 39 bp, Artificial Sequence
  Description of Artificial Sequence: Synthetic oligonucleotide
cactgatgatggtggagaaagtaccagattcaacttatg

SEQ ID NO: 133915 - DNA, 40 bp, Artificial Sequence
  Description of Artificial Sequence: Synthetic oligonucleotide
actgatgatggtggagaaagtaccagattcaacttatgag

SEQ ID NO: 133916 - DNA, 39 bp, Artificial Sequence
  Description of Artificial Sequence: Synthetic oligonucleotide
ctgatgatggtggagaaagtaccagattcaacttatgag

SEQ ID NO: 133917 - DNA, 41 bp, Artificial Sequence
  Description of Artificial Sequence: Synthetic oligonucleotide
tgatgatggtggagaaagtaccagattcaacttatgagatg

SEQ ID NO: 133918 - DNA, 40 bp, Artificial Sequence
  Description of Artificial Sequence: Synthetic oligonucleotide
gatgatggtggagaaagtaccagattcaacttatgagatg

SEQ ID NO: 133919 - DNA, 43 bp, Artificial Sequence
  Description of Artificial Sequence: Synthetic oligonucleotide
atgatggtggagaaagtaccagattcaacttatgagatgattg

SEQ ID NO: 133920 - DNA, 42 bp, Artificial Sequence
  Description of Artificial Sequence: Synthetic oligonucleotide
tgatggtggagaaagtaccagattcaacttatgagatgattg

SEQ ID NO: 133921 - DNA, 41 bp, Artificial Sequence
  Description of Artificial Sequence: Synthetic oligonucleotide
gatggtggagaaagtaccagattcaacttatgagatgattg

SEQ ID NO: 133922 - DNA, 41 bp, Artificial Sequence
  Description of Artificial Sequence: Synthetic oligonucleotide
atggtggagaaagtaccagattcaacttatgagatgattgg

SEQ ID NO: 133923 - DNA, 40 bp, Artificial Sequence
  Description of Artificial Sequence: Synthetic oligonucleotide
tggtggagaaagtaccagattcaacttatgagatgattgg

SEQ ID NO: 133924 - DNA, 39 bp, Artificial Sequence
  Description of Artificial Sequence: Synthetic oligonucleotide
ggtggagaaagtaccagattcaacttatgagatgattgg

SEQ ID NO: 133925 - DNA, 40 bp, Artificial Sequence
  Description of Artificial Sequence: Synthetic oligonucleotide
gtggagaaagtaccagattcaacttatgagatgattggtg

SEQ ID NO: 133926 - DNA, 40 bp, Artificial Sequence
  Description of Artificial Sequence: Synthetic oligonucleotide
tggagaaagtaccagattcaacttatgagatgattggtgg

SEQ ID NO: 133927 - DNA, 39 bp, Artificial Sequence
  Description of Artificial Sequence: Synthetic oligonucleotide
ggagaaagtaccagattcaacttatgagatgattggtgg

SEQ ID NO: 133928 - DNA, 40 bp, Artificial Sequence
  Description of Artificial Sequence: Synthetic oligonucleotide
gagaaagtaccagattcaacttatgagatgattggtggac

SEQ ID NO: 133929 - DNA, 41 bp, Artificial Sequence
  Description of Artificial Sequence: Synthetic oligonucleotide
agaaagtaccagattcaacttatgagatgattggtggactg

SEQ ID NO: 133930 - DNA, 40 bp, Artificial Sequence
  Description of Artificial Sequence: Synthetic oligonucleotide
gaaagtaccagattcaacttatgagatgattggtggactg

SEQ ID NO: 133931 - DNA, 40 bp, Artificial Sequence
  Description of Artificial Sequence: Synthetic oligonucleotide
aaagtaccagattcaacttatgagatgattggtggactgg

SEQ ID NO: 133932 - DNA, 39 bp, Artificial Sequence
  Description of Artificial Sequence: Synthetic oligonucleotide
aagtaccagattcaacttatgagatgattggtggactgg

SEQ ID NO: 133933 - DNA, 38 bp, Artificial Sequence
  Description of Artificial Sequence: Synthetic oligonucleotide
agtaccagattcaacttatgagatgattggtggactgg

SEQ ID NO: 133934 - DNA, 37 bp, Artificial Sequence
  Description of Artificial Sequence: Synthetic oligonucleotide
gtaccagattcaacttatgagatgattggtggactgg

SEQ ID NO: 133935 - DNA, 38 bp, Artificial Sequence
  Description of Artificial Sequence: Synthetic oligonucleotide
taccagattcaacttatgagatgattggtggactggac

SEQ ID NO: 133936 - DNA, 37 bp, Artificial Sequence
  Description of Artificial Sequence: Synthetic oligonucleotide
accagattcaacttatgagatgattggtggactggac

SEQ ID NO: 133937 - DNA, 36 bp, Artificial Sequence
  Description of Artificial Sequence: Synthetic oligonucleotide
ccagattcaacttatgagatgattggtggactggac

SEQ ID NO: 133938 - DNA, 39 bp, Artificial Sequence
  Description of Artificial Sequence: Synthetic oligonucleotide
cagattcaacttatgagatgattggtggactggacaaac

SEQ ID NO: 133939 - DNA, 40 bp, Artificial Sequence
  Description of Artificial Sequence: Synthetic oligonucleotide
agattcaacttatgagatgattggtggactggacaaacag

SEQ ID NO: 133940 - DNA, 39 bp, Artificial Sequence
  Description of Artificial Sequence: Synthetic oligonucleotide
gattcaacttatgagatgattggtggactggacaaacag

SEQ ID NO: 133941 - DNA, 41 bp, Artificial Sequence
  Description of Artificial Sequence: Synthetic oligonucleotide
attcaacttatgagatgattggtggactggacaaacagatc

SEQ ID NO: 133942 - DNA, 40 bp, Artificial Sequence
  Description of Artificial Sequence: Synthetic oligonucleotide
ttcaacttatgagatgattggtggactggacaaacagatc

SEQ ID NO: 133943 - DNA, 39 bp, Artificial Sequence
  Description of Artificial Sequence: Synthetic oligonucleotide
tcaacttatgagatgattggtggactggacaaacagatc

SEQ ID NO: 133944 - DNA, 38 bp, Artificial Sequence
  Description of Artificial Sequence: Synthetic oligonucleotide
caacttatgagatgattggtggactggacaaacagatc

SEQ ID NO: 133945 - DNA, 40 bp, Artificial Sequence
  Description of Artificial Sequence: Synthetic oligonucleotide
aacttatgagatgattggtggactggacaaacagatcaag

SEQ ID NO: 133946 - DNA, 39 bp, Artificial Sequence
  Description of Artificial Sequence: Synthetic oligonucleotide
acttatgagatgattggtggactggacaaacagatcaag

SEQ ID NO: 133947 - DNA, 38 bp, Artificial Sequence
  Description of Artificial Sequence: Synthetic oligonucleotide
cttatgagatgattggtggactggacaaacagatcaag

SEQ ID NO: 133948 - DNA, 38 bp, Artificial Sequence
  Description of Artificial Sequence: Synthetic oligonucleotide
ttatgagatgattggtggactggacaaacagatcaagg

SEQ ID NO: 133949 - DNA, 37 bp, Artificial Sequence
  Description of Artificial Sequence: Synthetic oligonucleotide
tatgagatgattggtggactggacaaacagatcaagg

SEQ ID NO: 133950 - DNA, 36 bp, Artificial Sequence
  Description of Artificial Sequence: Synthetic oligonucleotide
atgagatgattggtggactggacaaacagatcaagg

SEQ ID NO: 133951 - DNA, 35 bp, Artificial Sequence
  Description of Artificial Sequence: Synthetic oligonucleotide
tgagatgattggtggactggacaaacagatcaagg

SEQ ID NO: 133952 - DNA, 34 bp, Artificial Sequence
  Description of Artificial Sequence: Synthetic oligonucleotide
gagatgattggtggactggacaaacagatcaagg

SEQ ID NO: 133953 - DNA, 35 bp, Artificial Sequence
  Description of Artificial Sequence: Synthetic oligonucleotide
agatgattggtggactggacaaacagatcaaggag

SEQ ID NO: 133954 - DNA, 34 bp, Artificial Sequence
  Description of Artificial Sequence: Synthetic oligonucleotide
gatgattggtggactggacaaacagatcaaggag

SEQ ID NO: 133955 - DNA, 36 bp, Artificial Sequence
  Description of Artificial Sequence: Synthetic oligonucleotide
atgattggtggactggacaaacagatcaaggagatc

SEQ ID NO: 133956 - DNA, 35 bp, Artificial Sequence
  Description of Artificial Sequence: Synthetic oligonucleotide
tgattggtggactggacaaacagatcaaggagatc

SEQ ID NO: 133957 - DNA, 34 bp, Artificial Sequence
  Description of Artificial Sequence: Synthetic oligonucleotide
gattggtggactggacaaacagatcaaggagatc

SEQ ID NO: 133958 - DNA, 37 bp, Artificial Sequence
  Description of Artificial Sequence: Synthetic oligonucleotide
attggtggactggacaaacagatcaaggagatcaaag

SEQ ID NO: 133959 - DNA, 36 bp, Artificial Sequence
  Description of Artificial Sequence: Synthetic oligonucleotide
ttggtggactggacaaacagatcaaggagatcaaag

SEQ ID NO: 133960 - DNA, 35 bp, Artificial Sequence
  Description of Artificial Sequence: Synthetic oligonucleotide
tggtggactggacaaacagatcaaggagatcaaag

SEQ ID NO: 133961 - DNA, 34 bp, Artificial Sequence
  Description of Artificial Sequence: Synthetic oligonucleotide
ggtggactggacaaacagatcaaggagatcaaag

SEQ ID NO: 133962 - DNA, 36 bp, Artificial Sequence
  Description of Artificial Sequence: Synthetic oligonucleotide
gtggactggacaaacagatcaaggagatcaaagaag

SEQ ID NO: 133963 - DNA, 37 bp, Artificial Sequence
  Description of Artificial Sequence: Synthetic oligonucleotide
tggactggacaaacagatcaaggagatcaaagaagtg

SEQ ID NO: 133964 - DNA, 36 bp, Artificial Sequence
  Description of Artificial Sequence: Synthetic oligonucleotide
ggactggacaaacagatcaaggagatcaaagaagtg

SEQ ID NO: 133965 - DNA, 38 bp, Artificial Sequence
  Description of Artificial Sequence: Synthetic oligonucleotide
gactggacaaacagatcaaggagatcaaagaagtgatc

SEQ ID NO: 133966 - DNA, 38 bp, Artificial Sequence
  Description of Artificial Sequence: Synthetic oligonucleotide
actggacaaacagatcaaggagatcaaagaagtgatcg

SEQ ID NO: 133967 - DNA, 37 bp, Artificial Sequence
  Description of Artificial Sequence: Synthetic oligonucleotide
ctggacaaacagatcaaggagatcaaagaagtgatcg

SEQ ID NO: 133968 - DNA, 38 bp, Artificial Sequence
  Description of Artificial Sequence: Synthetic oligonucleotide
tggacaaacagatcaaggagatcaaagaagtgatcgag

SEQ ID NO: 133969 - DNA, 37 bp, Artificial Sequence
  Description of Artificial Sequence: Synthetic oligonucleotide
ggacaaacagatcaaggagatcaaagaagtgatcgag

SEQ ID NO: 133970 - DNA, 37 bp, Artificial Sequence
  Description of Artificial Sequence: Synthetic oligonucleotide
gacaaacagatcaaggagatcaaagaagtgatcgagc

SEQ ID NO: 133971 - DNA, 38 bp, Artificial Sequence
  Description of Artificial Sequence: Synthetic oligonucleotide
acaaacagatcaaggagatcaaagaagtgatcgagctg

SEQ ID NO: 133972 - DNA, 37 bp, Artificial Sequence
  Description of Artificial Sequence: Synthetic oligonucleotide
caaacagatcaaggagatcaaagaagtgatcgagctg

SEQ ID NO: 133973 - DNA, 37 bp, Artificial Sequence
  Description of Artificial Sequence: Synthetic oligonucleotide
aaacagatcaaggagatcaaagaagtgatcgagctgc

SEQ ID NO: 133974 - DNA, 36 bp, Artificial Sequence
  Description of Artificial Sequence: Synthetic oligonucleotide
aacagatcaaggagatcaaagaagtgatcgagctgc

SEQ ID NO: 133975 - DNA, 35 bp, Artificial Sequence
  Description of Artificial Sequence: Synthetic oligonucleotide
acagatcaaggagatcaaagaagtgatcgagctgc

SEQ ID NO: 133976 - DNA, 34 bp, Artificial Sequence
  Description of Artificial Sequence: Synthetic oligonucleotide
cagatcaaggagatcaaagaagtgatcgagctgc

SEQ ID NO: 133977 - DNA, 34 bp, Artificial Sequence
  Description of Artificial Sequence: Synthetic oligonucleotide
agatcaaggagatcaaagaagtgatcgagctgcc

SEQ ID NO: 133978 - DNA, 33 bp, Artificial Sequence
  Description of Artificial Sequence: Synthetic oligonucleotide
gatcaaggagatcaaagaagtgatcgagctgcc

SEQ ID NO: 133979 - DNA, 34 bp, Artificial Sequence
  Description of Artificial Sequence: Synthetic oligonucleotide
atcaaggagatcaaagaagtgatcgagctgcctg

SEQ ID NO: 133980 - DNA, 33 bp, Artificial Sequence
  Description of Artificial Sequence: Synthetic oligonucleotide
tcaaggagatcaaagaagtgatcgagctgcctg

SEQ ID NO: 133981 - DNA, 32 bp, Artificial Sequence
  Description of Artificial Sequence: Synthetic oligonucleotide
caaggagatcaaagaagtgatcgagctgcctg

SEQ ID NO: 133982 - DNA, 36 bp, Artificial Sequence
  Description of Artificial Sequence: Synthetic oligonucleotide
aaggagatcaaagaagtgatcgagctgcctgttaag

SEQ ID NO: 133983 - DNA, 35 bp, Artificial Sequence
  Description of Artificial Sequence: Synthetic oligonucleotide
aggagatcaaagaagtgatcgagctgcctgttaag

SEQ ID NO: 133984 - DNA, 34 bp, Artificial Sequence
  Description of Artificial Sequence: Synthetic oligonucleotide
ggagatcaaagaagtgatcgagctgcctgttaag

SEQ ID NO: 133985 - DNA, 34 bp, Artificial Sequence
  Description of Artificial Sequence: Synthetic oligonucleotide
gagatcaaagaagtgatcgagctgcctgttaagc

SEQ ID NO: 133986 - DNA, 36 bp, Artificial Sequence
  Description of Artificial Sequence: Synthetic oligonucleotide
agatcaaagaagtgatcgagctgcctgttaagcatc

SEQ ID NO: 133987 - DNA, 35 bp, Artificial Sequence
  Description of Artificial Sequence: Synthetic oligonucleotide
gatcaaagaagtgatcgagctgcctgttaagcatc

SEQ ID NO: 133988 - DNA, 35 bp, Artificial Sequence
  Description of Artificial Sequence: Synthetic oligonucleotide
atcaaagaagtgatcgagctgcctgttaagcatcc

SEQ ID NO: 133989 - DNA, 34 bp, Artificial Sequence
  Description of Artificial Sequence: Synthetic oligonucleotide
tcaaagaagtgatcgagctgcctgttaagcatcc

SEQ ID NO: 133990 - DNA, 33 bp, Artificial Sequence
  Description of Artificial Sequence: Synthetic oligonucleotide
caaagaagtgatcgagctgcctgttaagcatcc

SEQ ID NO: 133991 - DNA, 34 bp, Artificial Sequence
  Description of Artificial Sequence: Synthetic oligonucleotide
aaagaagtgatcgagctgcctgttaagcatcctg

SEQ ID NO: 133992 - DNA, 33 bp, Artificial Sequence
  Description of Artificial Sequence: Synthetic oligonucleotide
aagaagtgatcgagctgcctgttaagcatcctg

SEQ ID NO: 133993 - DNA, 32 bp, Artificial Sequence
  Description of Artificial Sequence: Synthetic oligonucleotide
agaagtgatcgagctgcctgttaagcatcctg

SEQ ID NO: 133994 - DNA, 31 bp, Artificial Sequence
  Description of Artificial Sequence: Synthetic oligonucleotide
gaagtgatcgagctgcctgttaagcatcctg

SEQ ID NO: 133995 - DNA, 32 bp, Artificial Sequence
  Description of Artificial Sequence: Synthetic oligonucleotide
aagtgatcgagctgcctgttaagcatcctgag

SEQ ID NO: 133996 - DNA, 31 bp, Artificial Sequence
  Description of Artificial Sequence: Synthetic oligonucleotide
agtgatcgagctgcctgttaagcatcctgag

SEQ ID NO: 133997 - DNA, 30 bp, Artificial Sequence
  Description of Artificial Sequence: Synthetic oligonucleotide
gtgatcgagctgcctgttaagcatcctgag

SEQ ID NO: 133998 - DNA, 30 bp, Artificial Sequence
  Description of Artificial Sequence: Synthetic oligonucleotide
tgatcgagctgcctgttaagcatcctgagc

SEQ ID NO: 133999 - DNA, 29 bp, Artificial Sequence
  Description of Artificial Sequence: Synthetic oligonucleotide
gatcgagctgcctgttaagcatcctgagc

SEQ ID NO: 134000 - DNA, 30 bp, Artificial Sequence
  Description of Artificial Sequence: Synthetic oligonucleotide
atcgagctgcctgttaagcatcctgagctc

SEQ ID NO: 134001 - DNA, 29 bp, Artificial Sequence
  Description of Artificial Sequence: Synthetic oligonucleotide
tcgagctgcctgttaagcatcctgagctc

SEQ ID NO: 134002 - DNA, 28 bp, Artificial Sequence
  Description of Artificial Sequence: Synthetic oligonucleotide
cgagctgcctgttaagcatcctgagctc

SEQ ID NO: 134003 - DNA, 30 bp, Artificial Sequence
  Description of Artificial Sequence: Synthetic oligonucleotide
gagctgcctgttaagcatcctgagctcttc

SEQ ID NO: 134004 - DNA, 30 bp, Artificial Sequence
  Description of Artificial Sequence: Synthetic oligonucleotide
agctgcctgttaagcatcctgagctcttcg

SEQ ID NO: 134005 - DNA, 29 bp, Artificial Sequence
  Description of Artificial Sequence: Synthetic oligonucleotide
gctgcctgttaagcatcctgagctcttcg

SEQ ID NO: 134006 - DNA, 31 bp, Artificial Sequence
  Description of Artificial Sequence: Synthetic oligonucleotide
ctgcctgttaagcatcctgagctcttcgaag

SEQ ID NO: 134007 - DNA, 31 bp, Artificial Sequence
  Description of Artificial Sequence: Synthetic oligonucleotide
tgcctgttaagcatcctgagctcttcgaagc

SEQ ID NO: 134008 - DNA, 30 bp, Artificial Sequence
  Description of Artificial Sequence: Synthetic oligonucleotide
gcctgttaagcatcctgagctcttcgaagc

SEQ ID NO: 134009 - DNA, 31 bp, Artificial Sequence
  Description of Artificial Sequence: Synthetic oligonucleotide
cctgttaagcatcctgagctcttcgaagcac

SEQ ID NO: 134010 - DNA, 32 bp, Artificial Sequence
  Description of Artificial Sequence: Synthetic oligonucleotide
ctgttaagcatcctgagctcttcgaagcactg

SEQ ID NO: 134011 - DNA, 32 bp, Artificial Sequence
  Description of Artificial Sequence: Synthetic oligonucleotide
tgttaagcatcctgagctcttcgaagcactgg

SEQ ID NO: 134012 - DNA, 31 bp, Artificial Sequence
  Description of Artificial Sequence: Synthetic oligonucleotide
gttaagcatcctgagctcttcgaagcactgg

SEQ ID NO: 134013 - DNA, 31 bp, Artificial Sequence
  Description of Artificial Sequence: Synthetic oligonucleotide
ttaagcatcctgagctcttcgaagcactggg

SEQ ID NO: 134014 - DNA, 30 bp, Artificial Sequence
  Description of Artificial Sequence: Synthetic oligonucleotide
taagcatcctgagctcttcgaagcactggg

SEQ ID NO: 134015 - DNA, 29 bp, Artificial Sequence
  Description of Artificial Sequence: Synthetic oligonucleotide
aagcatcctgagctcttcgaagcactggg

SEQ ID NO: 134016 - DNA, 28 bp, Artificial Sequence
  Description of Artificial Sequence: Synthetic oligonucleotide
agcatcctgagctcttcgaagcactggg

SEQ ID NO: 134017 - DNA, 27 bp, Artificial Sequence
  Description of Artificial Sequence: Synthetic oligonucleotide
gcatcctgagctcttcgaagcactggg

SEQ ID NO: 134018 - DNA, 27 bp, Artificial Sequence
  Description of Artificial Sequence: Synthetic oligonucleotide
catcctgagctcttcgaagcactgggc

SEQ ID NO: 134019 - DNA, 30 bp, Artificial Sequence
  Description of Artificial Sequence: Synthetic oligonucleotide
atcctgagctcttcgaagcactgggcattg

SEQ ID NO: 134020 - DNA, 29 bp, Artificial Sequence
  Description of Artificial Sequence: Synthetic oligonucleotide
tcctgagctcttcgaagcactgggcattg

SEQ ID NO: 134021 - DNA, 28 bp, Artificial Sequence
  Description of Artificial Sequence: Synthetic oligonucleotide
cctgagctcttcgaagcactgggcattg

SEQ ID NO: 134022 - DNA, 28 bp, Artificial Sequence
  Description of Artificial Sequence: Synthetic oligonucleotide
ctgagctcttcgaagcactgggcattgc

SEQ ID NO: 134023 - DNA, 29 bp, Artificial Sequence
  Description of Artificial Sequence: Synthetic oligonucleotide
tgagctcttcgaagcactgggcattgctc

SEQ ID NO: 134024 - DNA, 28 bp, Artificial Sequence
  Description of Artificial Sequence: Synthetic oligonucleotide
gagctcttcgaagcactgggcattgctc

SEQ ID NO: 134025 - DNA, 29 bp, Artificial Sequence
  Description of Artificial Sequence: Synthetic oligonucleotide
agctcttcgaagcactgggcattgctcag

SEQ ID NO: 134026 - DNA, 28 bp, Artificial Sequence
  Description of Artificial Sequence: Synthetic oligonucleotide
gctcttcgaagcactgggcattgctcag

SEQ ID NO: 134027 - DNA, 28 bp, Artificial Sequence
  Description of Artificial Sequence: Synthetic oligonucleotide
ctcttcgaagcactgggcattgctcagc

SEQ ID NO: 134028 - DNA, 28 bp, Artificial Sequence
  Description of Artificial Sequence: Synthetic oligonucleotide
tcttcgaagcactgggcattgctcagcc

SEQ ID NO: 134029 - DNA, 27 bp, Artificial Sequence
  Description of Artificial Sequence: Synthetic oligonucleotide
cttcgaagcactgggcattgctcagcc

SEQ ID NO: 134030 - DNA, 27 bp, Artificial Sequence
  Description of Artificial Sequence: Synthetic oligonucleotide
ttcgaagcactgggcattgctcagccc

SEQ ID NO: 134031 - DNA, 27 bp, Artificial Sequence
  Description of Artificial Sequence: Synthetic oligonucleotide
tcgaagcactgggcattgctcagccca

SEQ ID NO: 134032 - DNA, 27 bp, Artificial Sequence
  Description of Artificial Sequence: Synthetic oligonucleotide
cgaagcactgggcattgctcagcccaa

SEQ ID NO: 134033 - DNA, 27 bp, Artificial Sequence
  Description of Artificial Sequence: Synthetic oligonucleotide
gaagcactgggcattgctcagcccaag

SEQ ID NO: 134034 - DNA, 27 bp, Artificial Sequence
  Description of Artificial Sequence: Synthetic oligonucleotide
aagcactgggcattgctcagcccaagg

SEQ ID NO: 134035 - DNA, 26 bp, Artificial Sequence
  Description of Artificial Sequence: Synthetic oligonucleotide
agcactgggcattgctcagcccaagg

SEQ ID NO: 134036 - DNA, 25 bp, Artificial Sequence
  Description of Artificial Sequence: Synthetic oligonucleotide
gcactgggcattgctcagcccaagg

SEQ ID NO: 134037 - DNA, 26 bp, Artificial Sequence
  Description of Artificial Sequence: Synthetic oligonucleotide
cactgggcattgctcagcccaaggga

SEQ ID NO: 134038 - DNA, 27 bp, Artificial Sequence
  Description of Artificial Sequence: Synthetic oligonucleotide
actgggcattgctcagcccaagggagt

SEQ ID NO: 134039 - DNA, 26 bp, Artificial Sequence
  Description of Artificial Sequence: Synthetic oligonucleotide
ctgggcattgctcagcccaagggagt

SEQ ID NO: 134040 - DNA, 26 bp, Artificial Sequence
  Description of Artificial Sequence: Synthetic oligonucleotide
tgggcattgctcagcccaagggagtg

SEQ ID NO: 134041 - DNA, 25 bp, Artificial Sequence
  Description of Artificial Sequence: Synthetic oligonucleotide
gggcattgctcagcccaagggagtg

SEQ ID NO: 134042 - DNA, 26 bp, Artificial Sequence
  Description of Artificial Sequence: Synthetic oligonucleotide
ggcattgctcagcccaagggagtgct

SEQ ID NO: 134043 - DNA, 26 bp, Artificial Sequence
  Description of Artificial Sequence: Synthetic oligonucleotide
gcattgctcagcccaagggagtgctg

SEQ ID NO: 134044 - DNA, 27 bp, Artificial Sequence
  Description of Artificial Sequence: Synthetic oligonucleotide
cattgctcagcccaagggagtgctgct

SEQ ID NO: 134045 - DNA, 27 bp, Artificial Sequence
  Description of Artificial Sequence: Synthetic oligonucleotide
attgctcagcccaagggagtgctgctg

SEQ ID NO: 134046 - DNA, 27 bp, Artificial Sequence
  Description of Artificial Sequence: Synthetic oligonucleotide
ttgctcagcccaagggagtgctgctgt

SEQ ID NO: 134047 - DNA, 27 bp, Artificial Sequence
  Description of Artificial Sequence: Synthetic oligonucleotide
tgctcagcccaagggagtgctgctgta

SEQ ID NO: 134048 - DNA, 27 bp, Artificial Sequence
  Description of Artificial Sequence: Synthetic oligonucleotide
gctcagcccaagggagtgctgctgtat

SEQ ID NO: 134049 - DNA, 27 bp, Artificial Sequence
  Description of Artificial Sequence: Synthetic oligonucleotide
ctcagcccaagggagtgctgctgtatg

SEQ ID NO: 134050 - DNA, 27 bp, Artificial Sequence
  Description of Artificial Sequence: Synthetic oligonucleotide
tcagcccaagggagtgctgctgtatgg

SEQ ID NO: 134051 - DNA, 27 bp, Artificial Sequence
  Description of Artificial Sequence: Synthetic oligonucleotide
cagcccaagggagtgctgctgtatgga

SEQ ID NO: 134052 - DNA, 27 bp, Artificial Sequence
  Description of Artificial Sequence: Synthetic oligonucleotide
agcccaagggagtgctgctgtatggac

SEQ ID NO: 134053 - DNA, 26 bp, Artificial Sequence
  Description of Artificial Sequence: Synthetic oligonucleotide
gcccaagggagtgctgctgtatggac

SEQ ID NO: 134054 - DNA, 27 bp, Artificial Sequence
  Description of Artificial Sequence: Synthetic oligonucleotide
cccaagggagtgctgctgtatggacct

SEQ ID NO: 134055 - DNA, 27 bp, Artificial Sequence
  Description of Artificial Sequence: Synthetic oligonucleotide
ccaagggagtgctgctgtatggacctc

SEQ ID NO: 134056 - DNA, 27 bp, Artificial Sequence
  Description of Artificial Sequence: Synthetic oligonucleotide
caagggagtgctgctgtatggacctcc

SEQ ID NO: 134057 - DNA, 28 bp, Artificial Sequence
  Description of Artificial Sequence: Synthetic oligonucleotide
aagggagtgctgctgtatggacctccag

SEQ ID NO: 134058 - DNA, 27 bp, Artificial Sequence
  Description of Artificial Sequence: Synthetic oligonucleotide
agggagtgctgctgtatggacctccag

SEQ ID NO: 134059 - DNA, 26 bp, Artificial Sequence
  Description of Artificial Sequence: Synthetic oligonucleotide
gggagtgctgctgtatggacctccag

SEQ ID NO: 134060 - DNA, 26 bp, Artificial Sequence
  Description of Artificial Sequence: Synthetic oligonucleotide
ggagtgctgctgtatggacctccagg

SEQ ID NO: 134061 - DNA, 27 bp, Artificial Sequence
  Description of Artificial Sequence: Synthetic oligonucleotide
gagtgctgctgtatggacctccaggca

SEQ ID NO: 134062 - DNA, 27 bp, Artificial Sequence
  Description of Artificial Sequence: Synthetic oligonucleotide
agtgctgctgtatggacctccaggcac

SEQ ID NO: 134063 - DNA, 27 bp, Artificial Sequence
  Description of Artificial Sequence: Synthetic oligonucleotide
gtgctgctgtatggacctccaggcact

SEQ ID NO: 134064 - DNA, 27 bp, Artificial Sequence
  Description of Artificial Sequence: Synthetic oligonucleotide
tgctgctgtatggacctccaggcactg

SEQ ID NO: 134065 - DNA, 26 bp, Artificial Sequence
  Description of Artificial Sequence: Synthetic oligonucleotide
gctgctgtatggacctccaggcactg

SEQ ID NO: 134066 - DNA, 26 bp, Artificial Sequence
  Description of Artificial Sequence: Synthetic oligonucleotide
ctgctgtatggacctccaggcactgg

SEQ ID NO: 134067 - DNA, 27 bp, Artificial Sequence
  Description of Artificial Sequence: Synthetic oligonucleotide
tgctgtatggacctccaggcactggga

SEQ ID NO: 134068 - DNA, 27 bp, Artificial Sequence
  Description of Artificial Sequence: Synthetic oligonucleotide
gctgtatggacctccaggcactgggaa

SEQ ID NO: 134069 - DNA, 27 bp, Artificial Sequence
  Description of Artificial Sequence: Synthetic oligonucleotide
ctgtatggacctccaggcactgggaag

SEQ ID NO: 134070 - DNA, 28 bp, Artificial Sequence
  Description of Artificial Sequence: Synthetic oligonucleotide
tgtatggacctccaggcactgggaagac

SEQ ID NO: 134071 - DNA, 27 bp, Artificial Sequence
  Description of Artificial Sequence: Synthetic oligonucleotide
gtatggacctccaggcactgggaagac

SEQ ID NO: 134072 - DNA, 28 bp, Artificial Sequence
  Description of Artificial Sequence: Synthetic oligonucleotide
tatggacctccaggcactgggaagacac

SEQ ID NO: 134073 - DNA, 27 bp, Artificial Sequence
  Description of Artificial Sequence: Synthetic oligonucleotide
atggacctccaggcactgggaagacac

SEQ ID NO: 134074 - DNA, 27 bp, Artificial Sequence
  Description of Artificial Sequence: Synthetic oligonucleotide
tggacctccaggcactgggaagacact

SEQ ID NO: 134075 - DNA, 26 bp, Artificial Sequence
  Description of Artificial Sequence: Synthetic oligonucleotide
ggacctccaggcactgggaagacact

SEQ ID NO: 134076 - DNA, 27 bp, Artificial Sequence
  Description of Artificial Sequence: Synthetic oligonucleotide
gacctccaggcactgggaagacactgt

SEQ ID NO: 134077 - DNA, 28 bp, Artificial Sequence
  Description of Artificial Sequence: Synthetic oligonucleotide
acctccaggcactgggaagacactgttg

SEQ ID NO: 134078 - DNA, 27 bp, Artificial Sequence
  Description of Artificial Sequence: Synthetic oligonucleotide
cctccaggcactgggaagacactgttg

SEQ ID NO: 134079 - DNA, 27 bp, Artificial Sequence
  Description of Artificial Sequence: Synthetic oligonucleotide
ctccaggcactgggaagacactgttgg

SEQ ID NO: 134080 - DNA, 27 bp, Artificial Sequence
  Description of Artificial Sequence: Synthetic oligonucleotide
tccaggcactgggaagacactgttggc

SEQ ID NO: 134081 - DNA, 26 bp, Artificial Sequence
  Description of Artificial Sequence: Synthetic oligonucleotide
ccaggcactgggaagacactgttggc

SEQ ID NO: 134082 - DNA, 26 bp, Artificial Sequence
  Description of Artificial Sequence: Synthetic oligonucleotide
caggcactgggaagacactgttggcc

SEQ ID NO: 134083 - DNA, 26 bp, Artificial Sequence
  Description of Artificial Sequence: Synthetic oligonucleotide
aggcactgggaagacactgttggccc

SEQ ID NO: 134084 - DNA, 25 bp, Artificial Sequence
  Description of Artificial Sequence: Synthetic oligonucleotide
ggcactgggaagacactgttggccc

SEQ ID NO: 134085 - DNA, 25 bp, Artificial Sequence
  Description of Artificial Sequence: Synthetic oligonucleotide
gcactgggaagacactgttggcccg

SEQ ID NO: 134086 - DNA, 25 bp, Artificial Sequence
  Description of Artificial Sequence: Synthetic oligonucleotide
cactgggaagacactgttggcccgg

SEQ ID NO: 134087 - DNA, 25 bp, Artificial Sequence
  Description of Artificial Sequence: Synthetic oligonucleotide
actgggaagacactgttggcccggg

SEQ ID NO: 134088 - DNA, 24 bp, Artificial Sequence
  Description of Artificial Sequence: Synthetic oligonucleotide
ctgggaagacactgttggcccggg

SEQ ID NO: 134089 - DNA, 25 bp, Artificial Sequence
  Description of Artificial Sequence: Synthetic oligonucleotide
tgggaagacactgttggcccgggct

SEQ ID NO: 134090 - DNA, 24 bp, Artificial Sequence
  Description of Artificial Sequence: Synthetic oligonucleotide
gggaagacactgttggcccgggct

SEQ ID NO: 134091 - DNA, 25 bp, Artificial Sequence
  Description of Artificial Sequence: Synthetic oligonucleotide
ggaagacactgttggcccgggctgt

SEQ ID NO: 134092 - DNA, 25 bp, Artificial Sequence
  Description of Artificial Sequence: Synthetic oligonucleotide
gaagacactgttggcccgggctgtg

SEQ ID NO: 134093 - DNA, 25 bp, Artificial Sequence
  Description of Artificial Sequence: Synthetic oligonucleotide
aagacactgttggcccgggctgtgg

SEQ ID NO: 134094 - DNA, 24 bp, Artificial Sequence
  Description of Artificial Sequence: Synthetic oligonucleotide
agacactgttggcccgggctgtgg

SEQ ID NO: 134095 - DNA, 23 bp, Artificial Sequence
  Description of Artificial Sequence: Synthetic oligonucleotide
gacactgttggcccgggctgtgg

SEQ ID NO: 134096 - DNA, 24 bp, Artificial Sequence
  Description of Artificial Sequence: Synthetic oligonucleotide
acactgttggcccgggctgtggct

SEQ ID NO: 134097 - DNA, 23 bp, Artificial Sequence
  Description of Artificial Sequence: Synthetic oligonucleotide
cactgttggcccgggctgtggct

SEQ ID NO: 134098 - DNA, 25 bp, Artificial Sequence
  Description of Artificial Sequence: Synthetic oligonucleotide
actgttggcccgggctgtggctcat

SEQ ID NO: 134099 - DNA, 24 bp, Artificial Sequence
  Description of Artificial Sequence: Synthetic oligonucleotide
ctgttggcccgggctgtggctcat

SEQ ID NO: 134100 - DNA, 27 bp, Artificial Sequence
  Description of Artificial Sequence: Synthetic oligonucleotide
tgttggcccgggctgtggctcatcata

SEQ ID NO: 134101 - DNA, 26 bp, Artificial Sequence
  Description of Artificial Sequence: Synthetic oligonucleotide
gttggcccgggctgtggctcatcata

SEQ ID NO: 134102 - DNA, 26 bp, Artificial Sequence
  Description of Artificial Sequence: Synthetic oligonucleotide
ttggcccgggctgtggctcatcatac

SEQ ID NO: 134103 - DNA, 25 bp, Artificial Sequence
  Description of Artificial Sequence: Synthetic oligonucleotide
tggcccgggctgtggctcatcatac

SEQ ID NO: 134104 - DNA, 24 bp, Artificial Sequence
  Description of Artificial Sequence: Synthetic oligonucleotide
ggcccgggctgtggctcatcatac

SEQ ID NO: 134105 - DNA, 24 bp, Artificial Sequence
  Description of Artificial Sequence: Synthetic oligonucleotide
gcccgggctgtggctcatcatacg

SEQ ID NO: 134106 - DNA, 25 bp, Artificial Sequence
  Description of Artificial Sequence: Synthetic oligonucleotide
cccgggctgtggctcatcatacgga

SEQ ID NO: 134107 - DNA, 26 bp, Artificial Sequence
  Description of Artificial Sequence: Synthetic oligonucleotide
ccgggctgtggctcatcatacggact

SEQ ID NO: 134108 - DNA, 27 bp, Artificial Sequence
  Description of Artificial Sequence: Synthetic oligonucleotide
cgggctgtggctcatcatacggactgt

SEQ ID NO: 134109 - DNA, 28 bp, Artificial Sequence
  Description of Artificial Sequence: Synthetic oligonucleotide
gggctgtggctcatcatacggactgtac

SEQ ID NO: 134110 - DNA, 28 bp, Artificial Sequence
  Description of Artificial Sequence: Synthetic oligonucleotide
ggctgtggctcatcatacggactgtacc

SEQ ID NO: 134111 - DNA, 34 bp, Artificial Sequence
  Description of Artificial Sequence: Synthetic oligonucleotide
gctgtggctcatcatacggactgtacctttattc

SEQ ID NO: 134112 - DNA, 34 bp, Artificial Sequence
  Description of Artificial Sequence: Synthetic oligonucleotide
ctgtggctcatcatacggactgtacctttattcg

SEQ ID NO: 134113 - DNA, 35 bp, Artificial Sequence
  Description of Artificial Sequence: Synthetic oligonucleotide
tgtggctcatcatacggactgtacctttattcgtg

SEQ ID NO: 134114 - DNA, 34 bp, Artificial Sequence
  Description of Artificial Sequence: Synthetic oligonucleotide
gtggctcatcatacggactgtacctttattcgtg

SEQ ID NO: 134115 - DNA, 35 bp, Artificial Sequence
  Description of Artificial Sequence: Synthetic oligonucleotide
tggctcatcatacggactgtacctttattcgtgtc

SEQ ID NO: 134116 - DNA, 34 bp, Artificial Sequence
  Description of Artificial Sequence: Synthetic oligonucleotide
ggctcatcatacggactgtacctttattcgtgtc

SEQ ID NO: 134117 - DNA, 35 bp, Artificial Sequence
  Description of Artificial Sequence: Synthetic oligonucleotide
gctcatcatacggactgtacctttattcgtgtctc

SEQ ID NO: 134118 - DNA, 36 bp, Artificial Sequence
  Description of Artificial Sequence: Synthetic oligonucleotide
ctcatcatacggactgtacctttattcgtgtctctg

SEQ ID NO: 134119 - DNA, 36 bp, Artificial Sequence
  Description of Artificial Sequence: Synthetic oligonucleotide
tcatcatacggactgtacctttattcgtgtctctgg

SEQ ID NO: 134120 - DNA, 35 bp, Artificial Sequence
  Description of Artificial Sequence: Synthetic oligonucleotide
catcatacggactgtacctttattcgtgtctctgg

SEQ ID NO: 134121 - DNA, 35 bp, Artificial Sequence
  Description of Artificial Sequence: Synthetic oligonucleotide
atcatacggactgtacctttattcgtgtctctggc

SEQ ID NO: 134122 - DNA, 34 bp, Artificial Sequence
  Description of Artificial Sequence: Synthetic oligonucleotide
tcatacggactgtacctttattcgtgtctctggc

SEQ ID NO: 134123 - DNA, 33 bp, Artificial Sequence
  Description of Artificial Sequence: Synthetic oligonucleotide
catacggactgtacctttattcgtgtctctggc

SEQ ID NO: 134124 - DNA, 34 bp, Artificial Sequence
  Description of Artificial Sequence: Synthetic oligonucleotide
atacggactgtacctttattcgtgtctctggctc

SEQ ID NO: 134125 - DNA, 33 bp, Artificial Sequence
  Description of Artificial Sequence: Synthetic oligonucleotide
tacggactgtacctttattcgtgtctctggctc

SEQ ID NO: 134126 - DNA, 32 bp, Artificial Sequence
  Description of Artificial Sequence: Synthetic oligonucleotide
acggactgtacctttattcgtgtctctggctc

SEQ ID NO: 134127 - DNA, 31 bp, Artificial Sequence
  Description of Artificial Sequence: Synthetic oligonucleotide
cggactgtacctttattcgtgtctctggctc

SEQ ID NO: 134128 - DNA, 32 bp, Artificial Sequence
  Description of Artificial Sequence: Synthetic oligonucleotide
ggactgtacctttattcgtgtctctggctctg

SEQ ID NO: 134129 - DNA, 34 bp, Artificial Sequence
  Description of Artificial Sequence: Synthetic oligonucleotide
gactgtacctttattcgtgtctctggctctgaac

SEQ ID NO: 134130 - DNA, 35 bp, Artificial Sequence
  Description of Artificial Sequence: Synthetic oligonucleotide
actgtacctttattcgtgtctctggctctgaactg

SEQ ID NO: 134131 - DNA, 34 bp, Artificial Sequence
  Description of Artificial Sequence: Synthetic oligonucleotide
ctgtacctttattcgtgtctctggctctgaactg

SEQ ID NO: 134132 - DNA, 34 bp, Artificial Sequence
  Description of Artificial Sequence: Synthetic oligonucleotide
tgtacctttattcgtgtctctggctctgaactgg

SEQ ID NO: 134133 - DNA, 33 bp, Artificial Sequence
  Description of Artificial Sequence: Synthetic oligonucleotide
gtacctttattcgtgtctctggctctgaactgg

SEQ ID NO: 134134 - DNA, 35 bp, Artificial Sequence
  Description of Artificial Sequence: Synthetic oligonucleotide
tacctttattcgtgtctctggctctgaactggtac

SEQ ID NO: 134135 - DNA, 34 bp, Artificial Sequence
  Description of Artificial Sequence: Synthetic oligonucleotide
acctttattcgtgtctctggctctgaactggtac

SEQ ID NO: 134136 - DNA, 33 bp, Artificial Sequence
  Description of Artificial Sequence: Synthetic oligonucleotide
cctttattcgtgtctctggctctgaactggtac

SEQ ID NO: 134137 - DNA, 34 bp, Artificial Sequence
  Description of Artificial Sequence: Synthetic oligonucleotide
ctttattcgtgtctctggctctgaactggtacag

SEQ ID NO: 134138 - DNA, 39 bp, Artificial Sequence
  Description of Artificial Sequence: Synthetic oligonucleotide
tttattcgtgtctctggctctgaactggtacagaaattc

SEQ ID NO: 134139 - DNA, 38 bp, Artificial Sequence
  Description of Artificial Sequence: Synthetic oligonucleotide
ttattcgtgtctctggctctgaactggtacagaaattc

SEQ ID NO: 134140 - DNA, 37 bp, Artificial Sequence
  Description of Artificial Sequence: Synthetic oligonucleotide
tattcgtgtctctggctctgaactggtacagaaattc

SEQ ID NO: 134141 - DNA, 36 bp, Artificial Sequence
  Description of Artificial Sequence: Synthetic oligonucleotide
attcgtgtctctggctctgaactggtacagaaattc

SEQ ID NO: 134142 - DNA, 35 bp, Artificial Sequence
  Description of Artificial Sequence: Synthetic oligonucleotide
ttcgtgtctctggctctgaactggtacagaaattc

SEQ ID NO: 134143 - DNA, 34 bp, Artificial Sequence
  Description of Artificial Sequence: Synthetic oligonucleotide
tcgtgtctctggctctgaactggtacagaaattc

SEQ ID NO: 134144 - DNA, 33 bp, Artificial Sequence
  Description of Artificial Sequence: Synthetic oligonucleotide
cgtgtctctggctctgaactggtacagaaattc

SEQ ID NO: 134145 - DNA, 36 bp, Artificial Sequence
  Description of Artificial Sequence: Synthetic oligonucleotide
gtgtctctggctctgaactggtacagaaattcatag

SEQ ID NO: 134146 - DNA, 36 bp, Artificial Sequence
  Description of Artificial Sequence: Synthetic oligonucleotide
tgtctctggctctgaactggtacagaaattcatagg

SEQ ID NO: 134147 - DNA, 35 bp, Artificial Sequence
  Description of Artificial Sequence: Synthetic oligonucleotide
gtctctggctctgaactggtacagaaattcatagg

SEQ ID NO: 134148 - DNA, 35 bp, Artificial Sequence
  Description of Artificial Sequence: Synthetic oligonucleotide
tctctggctctgaactggtacagaaattcataggg

SEQ ID NO: 134149 - DNA, 34 bp, Artificial Sequence
  Description of Artificial Sequence: Synthetic oligonucleotide
ctctggctctgaactggtacagaaattcataggg

SEQ ID NO: 134150 - DNA, 34 bp, Artificial Sequence
  Description of Artificial Sequence: Synthetic oligonucleotide
tctggctctgaactggtacagaaattcatagggg

SEQ ID NO: 134151 - DNA, 33 bp, Artificial Sequence
  Description of Artificial Sequence: Synthetic oligonucleotide
ctggctctgaactggtacagaaattcatagggg

SEQ ID NO: 134152 - DNA, 35 bp, Artificial Sequence
  Description of Artificial Sequence: Synthetic oligonucleotide
tggctctgaactggtacagaaattcataggggaag

SEQ ID NO: 134153 - DNA, 34 bp, Artificial Sequence
  Description of Artificial Sequence: Synthetic oligonucleotide
ggctctgaactggtacagaaattcataggggaag

SEQ ID NO: 134154 - DNA, 34 bp, Artificial Sequence
  Description of Artificial Sequence: Synthetic oligonucleotide
gctctgaactggtacagaaattcataggggaagg

SEQ ID NO: 134155 - DNA, 34 bp, Artificial Sequence
  Description of Artificial Sequence: Synthetic oligonucleotide
ctctgaactggtacagaaattcataggggaaggg

SEQ ID NO: 134156 - DNA, 34 bp, Artificial Sequence
  Description of Artificial Sequence: Synthetic oligonucleotide
tctgaactggtacagaaattcataggggaagggg

SEQ ID NO: 134157 - DNA, 33 bp, Artificial Sequence
  Description of Artificial Sequence: Synthetic oligonucleotide
ctgaactggtacagaaattcataggggaagggg

SEQ ID NO: 134158 - DNA, 33 bp, Artificial Sequence
  Description of Artificial Sequence: Synthetic oligonucleotide
tgaactggtacagaaattcataggggaaggggc

SEQ ID NO: 134159 - DNA, 32 bp, Artificial Sequence
  Description of Artificial Sequence: Synthetic oligonucleotide
gaactggtacagaaattcataggggaaggggc

SEQ ID NO: 134160 - DNA, 34 bp, Artificial Sequence
  Description of Artificial Sequence: Synthetic oligonucleotide
aactggtacagaaattcataggggaaggggcaag

SEQ ID NO: 134161 - DNA, 33 bp, Artificial Sequence
  Description of Artificial Sequence: Synthetic oligonucleotide
actggtacagaaattcataggggaaggggcaag

SEQ ID NO: 134162 - DNA, 32 bp, Artificial Sequence
  Description of Artificial Sequence: Synthetic oligonucleotide
ctggtacagaaattcataggggaaggggcaag

SEQ ID NO: 134163 - DNA, 35 bp, Artificial Sequence
  Description of Artificial Sequence: Synthetic oligonucleotide
tggtacagaaattcataggggaaggggcaagaatg

SEQ ID NO: 134164 - DNA, 34 bp, Artificial Sequence
  Description of Artificial Sequence: Synthetic oligonucleotide
ggtacagaaattcataggggaaggggcaagaatg

SEQ ID NO: 134165 - DNA, 34 bp, Artificial Sequence
  Description of Artificial Sequence: Synthetic oligonucleotide
gtacagaaattcataggggaaggggcaagaatgg

SEQ ID NO: 134166 - DNA, 35 bp, Artificial Sequence
  Description of Artificial Sequence: Synthetic oligonucleotide
tacagaaattcataggggaaggggcaagaatggtg

SEQ ID NO: 134167 - DNA, 34 bp, Artificial Sequence
  Description of Artificial Sequence: Synthetic oligonucleotide
acagaaattcataggggaaggggcaagaatggtg

SEQ ID NO: 134168 - DNA, 33 bp, Artificial Sequence
  Description of Artificial Sequence: Synthetic oligonucleotide
cagaaattcataggggaaggggcaagaatggtg

SEQ ID NO: 134169 - DNA, 34 bp, Artificial Sequence
  Description of Artificial Sequence: Synthetic oligonucleotide
agaaattcataggggaaggggcaagaatggtgag

SEQ ID NO: 134170 - DNA, 33 bp, Artificial Sequence
  Description of Artificial Sequence: Synthetic oligonucleotide
gaaattcataggggaaggggcaagaatggtgag

SEQ ID NO: 134171 - DNA, 33 bp, Artificial Sequence
  Description of Artificial Sequence: Synthetic oligonucleotide
aaattcataggggaaggggcaagaatggtgagg

SEQ ID NO: 134172 - DNA, 32 bp, Artificial Sequence
  Description of Artificial Sequence: Synthetic oligonucleotide
aattcataggggaaggggcaagaatggtgagg

SEQ ID NO: 134173 - DNA, 31 bp, Artificial Sequence
  Description of Artificial Sequence: Synthetic oligonucleotide
attcataggggaaggggcaagaatggtgagg

SEQ ID NO: 134174 - DNA, 30 bp, Artificial Sequence
  Description of Artificial Sequence: Synthetic oligonucleotide
ttcataggggaaggggcaagaatggtgagg

SEQ ID NO: 134175 - DNA, 29 bp, Artificial Sequence
  Description of Artificial Sequence: Synthetic oligonucleotide
tcataggggaaggggcaagaatggtgagg

SEQ ID NO: 134176 - DNA, 28 bp, Artificial Sequence
  Description of Artificial Sequence: Synthetic oligonucleotide
cataggggaaggggcaagaatggtgagg

SEQ ID NO: 134177 - DNA, 28 bp, Artificial Sequence
  Description of Artificial Sequence: Synthetic oligonucleotide
ataggggaaggggcaagaatggtgaggg

SEQ ID NO: 134178 - DNA, 27 bp, Artificial Sequence
  Description of Artificial Sequence: Synthetic oligonucleotide
taggggaaggggcaagaatggtgaggg

SEQ ID NO: 134179 - DNA, 27 bp, Artificial Sequence
  Description of Artificial Sequence: Synthetic oligonucleotide
aggggaaggggcaagaatggtgaggga

SEQ ID NO: 134180 - DNA, 26 bp, Artificial Sequence
  Description of Artificial Sequence: Synthetic oligonucleotide
ggggaaggggcaagaatggtgaggga

SEQ ID NO: 134181 - DNA, 26 bp, Artificial Sequence
  Description of Artificial Sequence: Synthetic oligonucleotide
gggaaggggcaagaatggtgagggag

SEQ ID NO: 134182 - DNA, 27 bp, Artificial Sequence
  Description of Artificial Sequence: Synthetic oligonucleotide
ggaaggggcaagaatggtgagggagct

SEQ ID NO: 134183 - DNA, 27 bp, Artificial Sequence
  Description of Artificial Sequence: Synthetic oligonucleotide
gaaggggcaagaatggtgagggagctg

SEQ ID NO: 134184 - DNA, 30 bp, Artificial Sequence
  Description of Artificial Sequence: Synthetic oligonucleotide
aaggggcaagaatggtgagggagctgtttg

SEQ ID NO: 134185 - DNA, 29 bp, Artificial Sequence
  Description of Artificial Sequence: Synthetic oligonucleotide
aggggcaagaatggtgagggagctgtttg

SEQ ID NO: 134186 - DNA, 28 bp, Artificial Sequence
  Description of Artificial Sequence: Synthetic oligonucleotide
ggggcaagaatggtgagggagctgtttg

SEQ ID NO: 134187 - DNA, 29 bp, Artificial Sequence
  Description of Artificial Sequence: Synthetic oligonucleotide
gggcaagaatggtgagggagctgtttgtc

SEQ ID NO: 134188 - DNA, 31 bp, Artificial Sequence
  Description of Artificial Sequence: Synthetic oligonucleotide
ggcaagaatggtgagggagctgtttgtcatg

SEQ ID NO: 134189 - DNA, 31 bp, Artificial Sequence
  Description of Artificial Sequence: Synthetic oligonucleotide
gcaagaatggtgagggagctgtttgtcatgg

SEQ ID NO: 134190 - DNA, 31 bp, Artificial Sequence
  Description of Artificial Sequence: Synthetic oligonucleotide
caagaatggtgagggagctgtttgtcatggc

SEQ ID NO: 134191 - DNA, 32 bp, Artificial Sequence
  Description of Artificial Sequence: Synthetic oligonucleotide
aagaatggtgagggagctgtttgtcatggcac

SEQ ID NO: 134192 - DNA, 31 bp, Artificial Sequence
  Description of Artificial Sequence: Synthetic oligonucleotide
agaatggtgagggagctgtttgtcatggcac

SEQ ID NO: 134193 - DNA, 30 bp, Artificial Sequence
  Description of Artificial Sequence: Synthetic oligonucleotide
gaatggtgagggagctgtttgtcatggcac

SEQ ID NO: 134194 - DNA, 30 bp, Artificial Sequence
  Description of Artificial Sequence: Synthetic oligonucleotide
aatggtgagggagctgtttgtcatggcacg

SEQ ID NO: 134195 - DNA, 29 bp, Artificial Sequence
  Description of Artificial Sequence: Synthetic oligonucleotide
atggtgagggagctgtttgtcatggcacg

SEQ ID NO: 134196 - DNA, 28 bp, Artificial Sequence
  Description of Artificial Sequence: Synthetic oligonucleotide
tggtgagggagctgtttgtcatggcacg

SEQ ID NO: 134197 - DNA, 27 bp, Artificial Sequence
  Description of Artificial Sequence: Synthetic oligonucleotide
ggtgagggagctgtttgtcatggcacg

SEQ ID NO: 134198 - DNA, 27 bp, Artificial Sequence
  Description of Artificial Sequence: Synthetic oligonucleotide
gtgagggagctgtttgtcatggcacgg

SEQ ID NO: 134199 - DNA, 27 bp, Artificial Sequence
  Description of Artificial Sequence: Synthetic oligonucleotide
tgagggagctgtttgtcatggcacggg

SEQ ID NO: 134200 - DNA, 27 bp, Artificial Sequence
  Description of Artificial Sequence: Synthetic oligonucleotide
gagggagctgtttgtcatggcacggga

SEQ ID NO: 134201 - DNA, 28 bp, Artificial Sequence
  Description of Artificial Sequence: Synthetic oligonucleotide
agggagctgtttgtcatggcacgggaac

SEQ ID NO: 134202 - DNA, 27 bp, Artificial Sequence
  Description of Artificial Sequence: Synthetic oligonucleotide
gggagctgtttgtcatggcacgggaac

SEQ ID NO: 134203 - DNA, 29 bp, Artificial Sequence
  Description of Artificial Sequence: Synthetic oligonucleotide
ggagctgtttgtcatggcacgggaacatg

SEQ ID NO: 134204 - DNA, 29 bp, Artificial Sequence
  Description of Artificial Sequence: Synthetic oligonucleotide
gagctgtttgtcatggcacgggaacatgc

SEQ ID NO: 134205 - DNA, 30 bp, Artificial Sequence
  Description of Artificial Sequence: Synthetic oligonucleotide
agctgtttgtcatggcacgggaacatgctc

SEQ ID NO: 134206 - DNA, 29 bp, Artificial Sequence
  Description of Artificial Sequence: Synthetic oligonucleotide
gctgtttgtcatggcacgggaacatgctc

SEQ ID NO: 134207 - DNA, 29 bp, Artificial Sequence
  Description of Artificial Sequence: Synthetic oligonucleotide
ctgtttgtcatggcacgggaacatgctcc

SEQ ID NO: 134208 - DNA, 31 bp, Artificial Sequence
  Description of Artificial Sequence: Synthetic oligonucleotide
tgtttgtcatggcacgggaacatgctccatc

SEQ ID NO: 134209 - DNA, 30 bp, Artificial Sequence
  Description of Artificial Sequence: Synthetic oligonucleotide
gtttgtcatggcacgggaacatgctccatc

SEQ ID NO: 134210 - DNA, 33 bp, Artificial Sequence
  Description of Artificial Sequence: Synthetic oligonucleotide
tttgtcatggcacgggaacatgctccatctatc

SEQ ID NO: 134211 - DNA, 32 bp, Artificial Sequence
  Description of Artificial Sequence: Synthetic oligonucleotide
ttgtcatggcacgggaacatgctccatctatc

SEQ ID NO: 134212 - DNA, 31 bp, Artificial Sequence
  Description of Artificial Sequence: Synthetic oligonucleotide
tgtcatggcacgggaacatgctccatctatc

SEQ ID NO: 134213 - DNA, 30 bp, Artificial Sequence
  Description of Artificial Sequence: Synthetic oligonucleotide
gtcatggcacgggaacatgctccatctatc

SEQ ID NO: 134214 - DNA, 32 bp, Artificial Sequence
  Description of Artificial Sequence: Synthetic oligonucleotide
tcatggcacgggaacatgctccatctatcatc

SEQ ID NO: 134215 - DNA, 31 bp, Artificial Sequence
  Description of Artificial Sequence: Synthetic oligonucleotide
catggcacgggaacatgctccatctatcatc

SEQ ID NO: 134216 - DNA, 33 bp, Artificial Sequence
  Description of Artificial Sequence: Synthetic oligonucleotide
atggcacgggaacatgctccatctatcatcttc

SEQ ID NO: 134217 - DNA, 32 bp, Artificial Sequence
  Description of Artificial Sequence: Synthetic oligonucleotide
tggcacgggaacatgctccatctatcatcttc

SEQ ID NO: 134218 - DNA, 31 bp, Artificial Sequence
  Description of Artificial Sequence: Synthetic oligonucleotide
ggcacgggaacatgctccatctatcatcttc

SEQ ID NO: 134219 - DNA, 33 bp, Artificial Sequence
  Description of Artificial Sequence: Synthetic oligonucleotide
gcacgggaacatgctccatctatcatcttcatg

SEQ ID NO: 134220 - DNA, 33 bp, Artificial Sequence
  Description of Artificial Sequence: Synthetic oligonucleotide
cacgggaacatgctccatctatcatcttcatgg

SEQ ID NO: 134221 - DNA, 34 bp, Artificial Sequence
  Description of Artificial Sequence: Synthetic oligonucleotide
acgggaacatgctccatctatcatcttcatggac

SEQ ID NO: 134222 - DNA, 33 bp, Artificial Sequence
  Description of Artificial Sequence: Synthetic oligonucleotide
cgggaacatgctccatctatcatcttcatggac

SEQ ID NO: 134223 - DNA, 33 bp, Artificial Sequence
  Description of Artificial Sequence: Synthetic oligonucleotide
gggaacatgctccatctatcatcttcatggacg

SEQ ID NO: 134224 - DNA, 37 bp, Artificial Sequence
  Description of Artificial Sequence: Synthetic oligonucleotide
ggaacatgctccatctatcatcttcatggacgaaatc

SEQ ID NO: 134225 - DNA, 37 bp, Artificial Sequence
  Description of Artificial Sequence: Synthetic oligonucleotide
gaacatgctccatctatcatcttcatggacgaaatcg

SEQ ID NO: 134226 - DNA, 38 bp, Artificial Sequence
  Description of Artificial Sequence: Synthetic oligonucleotide
aacatgctccatctatcatcttcatggacgaaatcgac

SEQ ID NO: 134227 - DNA, 37 bp, Artificial Sequence
  Description of Artificial Sequence: Synthetic oligonucleotide
acatgctccatctatcatcttcatggacgaaatcgac

SEQ ID NO: 134228 - DNA, 36 bp, Artificial Sequence
  Description of Artificial Sequence: Synthetic oligonucleotide
catgctccatctatcatcttcatggacgaaatcgac

SEQ ID NO: 134229 - DNA, 37 bp, Artificial Sequence
  Description of Artificial Sequence: Synthetic oligonucleotide
atgctccatctatcatcttcatggacgaaatcgactc

SEQ ID NO: 134230 - DNA, 36 bp, Artificial Sequence
  Description of Artificial Sequence: Synthetic oligonucleotide
tgctccatctatcatcttcatggacgaaatcgactc

SEQ ID NO: 134231 - DNA, 35 bp, Artificial Sequence
  Description of Artificial Sequence: Synthetic oligonucleotide
gctccatctatcatcttcatggacgaaatcgactc

SEQ ID NO: 134232 - DNA, 35 bp, Artificial Sequence
  Description of Artificial Sequence: Synthetic oligonucleotide
ctccatctatcatcttcatggacgaaatcgactcc

SEQ ID NO: 134233 - DNA, 37 bp, Artificial Sequence
  Description of Artificial Sequence: Synthetic oligonucleotide
tccatctatcatcttcatggacgaaatcgactccatc

SEQ ID NO: 134234 - DNA, 36 bp, Artificial Sequence
  Description of Artificial Sequence: Synthetic oligonucleotide
ccatctatcatcttcatggacgaaatcgactccatc

SEQ ID NO: 134235 - DNA, 36 bp, Artificial Sequence
  Description of Artificial Sequence: Synthetic oligonucleotide
catctatcatcttcatggacgaaatcgactccatcg

SEQ ID NO: 134236 - DNA, 36 bp, Artificial Sequence
  Description of Artificial Sequence: Synthetic oligonucleotide
atctatcatcttcatggacgaaatcgactccatcgg

SEQ ID NO: 134237 - DNA, 35 bp, Artificial Sequence
  Description of Artificial Sequence: Synthetic oligonucleotide
tctatcatcttcatggacgaaatcgactccatcgg

SEQ ID NO: 134238 - DNA, 34 bp, Artificial Sequence
  Description of Artificial Sequence: Synthetic oligonucleotide
ctatcatcttcatggacgaaatcgactccatcgg

SEQ ID NO: 134239 - DNA, 34 bp, Artificial Sequence
  Description of Artificial Sequence: Synthetic oligonucleotide
tatcatcttcatggacgaaatcgactccatcggc

SEQ ID NO: 134240 - DNA, 33 bp, Artificial Sequence
  Description of Artificial Sequence: Synthetic oligonucleotide
atcatcttcatggacgaaatcgactccatcggc

SEQ ID NO: 134241 - DNA, 32 bp, Artificial Sequence
  Description of Artificial Sequence: Synthetic oligonucleotide
tcatcttcatggacgaaatcgactccatcggc

SEQ ID NO: 134242 - DNA, 31 bp, Artificial Sequence
  Description of Artificial Sequence: Synthetic oligonucleotide
catcttcatggacgaaatcgactccatcggc

SEQ ID NO: 134243 - DNA, 32 bp, Artificial Sequence
  Description of Artificial Sequence: Synthetic oligonucleotide
atcttcatggacgaaatcgactccatcggctc

SEQ ID NO: 134244 - DNA, 31 bp, Artificial Sequence
  Description of Artificial Sequence: Synthetic oligonucleotide
tcttcatggacgaaatcgactccatcggctc

SEQ ID NO: 134245 - DNA, 30 bp, Artificial Sequence
  Description of Artificial Sequence: Synthetic oligonucleotide
cttcatggacgaaatcgactccatcggctc

SEQ ID NO: 134246 - DNA, 30 bp, Artificial Sequence
  Description of Artificial Sequence: Synthetic oligonucleotide
ttcatggacgaaatcgactccatcggctcc

SEQ ID NO: 134247 - DNA, 29 bp, Artificial Sequence
  Description of Artificial Sequence: Synthetic oligonucleotide
tcatggacgaaatcgactccatcggctcc

SEQ ID NO: 134248 - DNA, 28 bp, Artificial Sequence
  Description of Artificial Sequence: Synthetic oligonucleotide
catggacgaaatcgactccatcggctcc

SEQ ID NO: 134249 - DNA, 29 bp, Artificial Sequence
  Description of Artificial Sequence: Synthetic oligonucleotide
atggacgaaatcgactccatcggctcctc

SEQ ID NO: 134250 - DNA, 28 bp, Artificial Sequence
  Description of Artificial Sequence: Synthetic oligonucleotide
tggacgaaatcgactccatcggctcctc

SEQ ID NO: 134251 - DNA, 27 bp, Artificial Sequence
  Description of Artificial Sequence: Synthetic oligonucleotide
ggacgaaatcgactccatcggctcctc

SEQ ID NO: 134252 - DNA, 27 bp, Artificial Sequence
  Description of Artificial Sequence: Synthetic oligonucleotide
gacgaaatcgactccatcggctcctcg

SEQ ID NO: 134253 - DNA, 27 bp, Artificial Sequence
  Description of Artificial Sequence: Synthetic oligonucleotide
acgaaatcgactccatcggctcctcgc

SEQ ID NO: 134254 - DNA, 26 bp, Artificial Sequence
  Description of Artificial Sequence: Synthetic oligonucleotide
cgaaatcgactccatcggctcctcgc

SEQ ID NO: 134255 - DNA, 26 bp, Artificial Sequence
  Description of Artificial Sequence: Synthetic oligonucleotide
gaaatcgactccatcggctcctcgcg

SEQ ID NO: 134256 - DNA, 26 bp, Artificial Sequence
  Description of Artificial Sequence: Synthetic oligonucleotide
aaatcgactccatcggctcctcgcgg

SEQ ID NO: 134257 - DNA, 25 bp, Artificial Sequence
  Description of Artificial Sequence: Synthetic oligonucleotide
aatcgactccatcggctcctcgcgg

SEQ ID NO: 134258 - DNA, 24 bp, Artificial Sequence
  Description of Artificial Sequence: Synthetic oligonucleotide
atcgactccatcggctcctcgcgg

SEQ ID NO: 134259 - DNA, 23 bp, Artificial Sequence
  Description of Artificial Sequence: Synthetic oligonucleotide
tcgactccatcggctcctcgcgg

SEQ ID NO: 134260 - DNA, 22 bp, Artificial Sequence
  Description of Artificial Sequence: Synthetic oligonucleotide
cgactccatcggctcctcgcgg

SEQ ID NO: 134261 - DNA, 23 bp, Artificial Sequence
  Description of Artificial Sequence: Synthetic oligonucleotide
gactccatcggctcctcgcggct

SEQ ID NO: 134262 - DNA, 23 bp, Artificial Sequence
  Description of Artificial Sequence: Synthetic oligonucleotide
actccatcggctcctcgcggctg

SEQ ID NO: 134263 - DNA, 22 bp, Artificial Sequence
  Description of Artificial Sequence: Synthetic oligonucleotide
ctccatcggctcctcgcggctg

SEQ ID NO: 134264 - DNA, 23 bp, Artificial Sequence
  Description of Artificial Sequence: Synthetic oligonucleotide
tccatcggctcctcgcggctgga

SEQ ID NO: 134265 - DNA, 22 bp, Artificial Sequence
  Description of Artificial Sequence: Synthetic oligonucleotide
ccatcggctcctcgcggctgga

SEQ ID NO: 134266 - DNA, 22 bp, Artificial Sequence
  Description of Artificial Sequence: Synthetic oligonucleotide
catcggctcctcgcggctggag

SEQ ID NO: 134267 - DNA, 22 bp, Artificial Sequence
  Description of Artificial Sequence: Synthetic oligonucleotide
atcggctcctcgcggctggagg

SEQ ID NO: 134268 - DNA, 21 bp, Artificial Sequence
  Description of Artificial Sequence: Synthetic oligonucleotide
tcggctcctcgcggctggagg

SEQ ID NO: 134269 - DNA, 20 bp, Artificial Sequence
  Description of Artificial Sequence: Synthetic oligonucleotide
cggctcctcgcggctggagg

SEQ ID NO: 134270 - DNA, 20 bp, Artificial Sequence
  Description of Artificial Sequence: Synthetic oligonucleotide
ggctcctcgcggctggaggg

SEQ ID NO: 134271 - DNA, 20 bp, Artificial Sequence
  Description of Artificial Sequence: Synthetic oligonucleotide
gctcctcgcggctggagggg

SEQ ID NO: 134272 - DNA, 20 bp, Artificial Sequence
  Description of Artificial Sequence: Synthetic oligonucleotide
ctcctcgcggctggaggggg

SEQ ID NO: 134273 - DNA, 22 bp, Artificial Sequence
  Description of Artificial Sequence: Synthetic oligonucleotide
tcctcgcggctggaggggggtt

SEQ ID NO: 134274 - DNA, 21 bp, Artificial Sequence
  Description of Artificial Sequence: Synthetic oligonucleotide
cctcgcggctggaggggggtt

SEQ ID NO: 134275 - DNA, 22 bp, Artificial Sequence
  Description of Artificial Sequence: Synthetic oligonucleotide
ctcgcggctggaggggggttct

SEQ ID NO: 134276 - DNA, 22 bp, Artificial Sequence
  Description of Artificial Sequence: Synthetic oligonucleotide
tcgcggctggaggggggttctg

SEQ ID NO: 134277 - DNA, 21 bp, Artificial Sequence
  Description of Artificial Sequence: Synthetic oligonucleotide
cgcggctggaggggggttctg

SEQ ID NO: 134278 - DNA, 22 bp, Artificial Sequence
  Description of Artificial Sequence: Synthetic oligonucleotide
gcggctggaggggggttctgga

SEQ ID NO: 134279 - DNA, 22 bp, Artificial Sequence
  Description of Artificial Sequence: Synthetic oligonucleotide
cggctggaggggggttctggag

SEQ ID NO: 134280 - DNA, 22 bp, Artificial Sequence
  Description of Artificial Sequence: Synthetic oligonucleotide
ggctggaggggggttctggagg

SEQ ID NO: 134281 - DNA, 22 bp, Artificial Sequence
  Description of Artificial Sequence: Synthetic oligonucleotide
gctggaggggggttctggaggg

SEQ ID NO: 134282 - DNA, 23 bp, Artificial Sequence
  Description of Artificial Sequence: Synthetic oligonucleotide
ctggaggggggttctggagggga

SEQ ID NO: 134283 - DNA, 24 bp, Artificial Sequence
  Description of Artificial Sequence: Synthetic oligonucleotide
tggaggggggttctggaggggaca

SEQ ID NO: 134284 - DNA, 23 bp, Artificial Sequence
  Description of Artificial Sequence: Synthetic oligonucleotide
ggaggggggttctggaggggaca

SEQ ID NO: 134285 - DNA, 24 bp, Artificial Sequence
  Description of Artificial Sequence: Synthetic oligonucleotide
gaggggggttctggaggggacagt

SEQ ID NO: 134286 - DNA, 26 bp, Artificial Sequence
  Description of Artificial Sequence: Synthetic oligonucleotide
aggggggttctggaggggacagtgaa

SEQ ID NO: 134287 - DNA, 25 bp, Artificial Sequence
  Description of Artificial Sequence: Synthetic oligonucleotide
ggggggttctggaggggacagtgaa

SEQ ID NO: 134288 - DNA, 26 bp, Artificial Sequence
  Description of Artificial Sequence: Synthetic oligonucleotide
gggggttctggaggggacagtgaagt

SEQ ID NO: 134289 - DNA, 26 bp, Artificial Sequence
  Description of Artificial Sequence: Synthetic oligonucleotide
ggggttctggaggggacagtgaagtg

SEQ ID NO: 134290 - DNA, 27 bp, Artificial Sequence
  Description of Artificial Sequence: Synthetic oligonucleotide
gggttctggaggggacagtgaagtgca

SEQ ID NO: 134291 - DNA, 27 bp, Artificial Sequence
  Description of Artificial Sequence: Synthetic oligonucleotide
ggttctggaggggacagtgaagtgcag

SEQ ID NO: 134292 - DNA, 27 bp, Artificial Sequence
  Description of Artificial Sequence: Synthetic oligonucleotide
gttctggaggggacagtgaagtgcagc

SEQ ID NO: 134293 - DNA, 27 bp, Artificial Sequence
  Description of Artificial Sequence: Synthetic oligonucleotide
ttctggaggggacagtgaagtgcagcg

SEQ ID NO: 134294 - DNA, 26 bp, Artificial Sequence
  Description of Artificial Sequence: Synthetic oligonucleotide
tctggaggggacagtgaagtgcagcg

SEQ ID NO: 134295 - DNA, 25 bp, Artificial Sequence
  Description of Artificial Sequence: Synthetic oligonucleotide
ctggaggggacagtgaagtgcagcg

SEQ ID NO: 134296 - DNA, 26 bp, Artificial Sequence
  Description of Artificial Sequence: Synthetic oligonucleotide
tggaggggacagtgaagtgcagcgca

SEQ ID NO: 134297 - DNA, 25 bp, Artificial Sequence
  Description of Artificial Sequence: Synthetic oligonucleotide
ggaggggacagtgaagtgcagcgca

SEQ ID NO: 134298 - DNA, 25 bp, Artificial Sequence
  Description of Artificial Sequence: Synthetic oligonucleotide
gaggggacagtgaagtgcagcgcac

SEQ ID NO: 134299 - DNA, 27 bp, Artificial Sequence
  Description of Artificial Sequence: Synthetic oligonucleotide
aggggacagtgaagtgcagcgcacgat

SEQ ID NO: 134300 - DNA, 26 bp, Artificial Sequence
  Description of Artificial Sequence: Synthetic oligonucleotide
ggggacagtgaagtgcagcgcacgat

SEQ ID NO: 134301 - DNA, 26 bp, Artificial Sequence
  Description of Artificial Sequence: Synthetic oligonucleotide
gggacagtgaagtgcagcgcacgatg

SEQ ID NO: 134302 - DNA, 27 bp, Artificial Sequence
  Description of Artificial Sequence: Synthetic oligonucleotide
ggacagtgaagtgcagcgcacgatgct

SEQ ID NO: 134303 - DNA, 27 bp, Artificial Sequence
  Description of Artificial Sequence: Synthetic oligonucleotide
gacagtgaagtgcagcgcacgatgctg

SEQ ID NO: 134304 - DNA, 27 bp, Artificial Sequence
  Description of Artificial Sequence: Synthetic oligonucleotide
acagtgaagtgcagcgcacgatgctgg

SEQ ID NO: 134305 - DNA, 27 bp, Artificial Sequence
  Description of Artificial Sequence: Synthetic oligonucleotide
cagtgaagtgcagcgcacgatgctgga

SEQ ID NO: 134306 - DNA, 27 bp, Artificial Sequence
  Description of Artificial Sequence: Synthetic oligonucleotide
agtgaagtgcagcgcacgatgctggag

SEQ ID NO: 134307 - DNA, 27 bp, Artificial Sequence
  Description of Artificial Sequence: Synthetic oligonucleotide
gtgaagtgcagcgcacgatgctggagt

SEQ ID NO: 134308 - DNA, 28 bp, Artificial Sequence
  Description of Artificial Sequence: Synthetic oligonucleotide
tgaagtgcagcgcacgatgctggagttg

SEQ ID NO: 134309 - DNA, 27 bp, Artificial Sequence
  Description of Artificial Sequence: Synthetic oligonucleotide
gaagtgcagcgcacgatgctggagttg

SEQ ID NO: 134310 - DNA, 27 bp, Artificial Sequence
  Description of Artificial Sequence: Synthetic oligonucleotide
aagtgcagcgcacgatgctggagttgc

SEQ ID NO: 134311 - DNA, 27 bp, Artificial Sequence
  Description of Artificial Sequence: Synthetic oligonucleotide
agtgcagcgcacgatgctggagttgct

SEQ ID NO: 134312 - DNA, 26 bp, Artificial Sequence
  Description of Artificial Sequence: Synthetic oligonucleotide
gtgcagcgcacgatgctggagttgct

SEQ ID NO: 134313 - DNA, 27 bp, Artificial Sequence
  Description of Artificial Sequence: Synthetic oligonucleotide
tgcagcgcacgatgctggagttgctca

SEQ ID NO: 134314 - DNA, 27 bp, Artificial Sequence
  Description of Artificial Sequence: Synthetic oligonucleotide
gcagcgcacgatgctggagttgctcaa

SEQ ID NO: 134315 - DNA, 27 bp, Artificial Sequence
  Description of Artificial Sequence: Synthetic oligonucleotide
cagcgcacgatgctggagttgctcaac

SEQ ID NO: 134316 - DNA, 27 bp, Artificial Sequence
  Description of Artificial Sequence: Synthetic oligonucleotide
agcgcacgatgctggagttgctcaacc

SEQ ID NO: 134317 - DNA, 27 bp, Artificial Sequence
  Description of Artificial Sequence: Synthetic oligonucleotide
gcgcacgatgctggagttgctcaacca

SEQ ID NO: 134318 - DNA, 27 bp, Artificial Sequence
  Description of Artificial Sequence: Synthetic oligonucleotide
cgcacgatgctggagttgctcaaccag

SEQ ID NO: 134319 - DNA, 27 bp, Artificial Sequence
  Description of Artificial Sequence: Synthetic oligonucleotide
gcacgatgctggagttgctcaaccagc

SEQ ID NO: 134320 - DNA, 28 bp, Artificial Sequence
  Description of Artificial Sequence: Synthetic oligonucleotide
cacgatgctggagttgctcaaccagctc

SEQ ID NO: 134321 - DNA, 28 bp, Artificial Sequence
  Description of Artificial Sequence: Synthetic oligonucleotide
acgatgctggagttgctcaaccagctcg

SEQ ID NO: 134322 - DNA, 27 bp, Artificial Sequence
  Description of Artificial Sequence: Synthetic oligonucleotide
cgatgctggagttgctcaaccagctcg

SEQ ID NO: 134323 - DNA, 28 bp, Artificial Sequence
  Description of Artificial Sequence: Synthetic oligonucleotide
gatgctggagttgctcaaccagctcgac

SEQ ID NO: 134324 - DNA, 28 bp, Artificial Sequence
  Description of Artificial Sequence: Synthetic oligonucleotide
atgctggagttgctcaaccagctcgacg

SEQ ID NO: 134325 - DNA, 27 bp, Artificial Sequence
  Description of Artificial Sequence: Synthetic oligonucleotide
tgctggagttgctcaaccagctcgacg

SEQ ID NO: 134326 - DNA, 26 bp, Artificial Sequence
  Description of Artificial Sequence: Synthetic oligonucleotide
gctggagttgctcaaccagctcgacg

SEQ ID NO: 134327 - DNA, 26 bp, Artificial Sequence
  Description of Artificial Sequence: Synthetic oligonucleotide
ctggagttgctcaaccagctcgacgg

SEQ ID NO: 134328 - DNA, 27 bp, Artificial Sequence
  Description of Artificial Sequence: Synthetic oligonucleotide
tggagttgctcaaccagctcgacggct

SEQ ID NO: 134329 - DNA, 27 bp, Artificial Sequence
  Description of Artificial Sequence: Synthetic oligonucleotide
ggagttgctcaaccagctcgacggctt

SEQ ID NO: 134330 - DNA, 28 bp, Artificial Sequence
  Description of Artificial Sequence: Synthetic oligonucleotide
gagttgctcaaccagctcgacggctttg

SEQ ID NO: 134331 - DNA, 29 bp, Artificial Sequence
  Description of Artificial Sequence: Synthetic oligonucleotide
agttgctcaaccagctcgacggctttgag

SEQ ID NO: 134332 - DNA, 28 bp, Artificial Sequence
  Description of Artificial Sequence: Synthetic oligonucleotide
gttgctcaaccagctcgacggctttgag

SEQ ID NO: 134333 - DNA, 28 bp, Artificial Sequence
  Description of Artificial Sequence: Synthetic oligonucleotide
ttgctcaaccagctcgacggctttgagg

SEQ ID NO: 134334 - DNA, 27 bp, Artificial Sequence
  Description of Artificial Sequence: Synthetic oligonucleotide
tgctcaaccagctcgacggctttgagg

SEQ ID NO: 134335 - DNA, 26 bp, Artificial Sequence
  Description of Artificial Sequence: Synthetic oligonucleotide
gctcaaccagctcgacggctttgagg

SEQ ID NO: 134336 - DNA, 26 bp, Artificial Sequence
  Description of Artificial Sequence: Synthetic oligonucleotide
ctcaaccagctcgacggctttgaggc

SEQ ID NO: 134337 - DNA, 27 bp, Artificial Sequence
  Description of Artificial Sequence: Synthetic oligonucleotide
tcaaccagctcgacggctttgaggcca

SEQ ID NO: 134338 - DNA, 26 bp, Artificial Sequence
  Description of Artificial Sequence: Synthetic oligonucleotide
caaccagctcgacggctttgaggcca

SEQ ID NO: 134339 - DNA, 26 bp, Artificial Sequence
  Description of Artificial Sequence: Synthetic oligonucleotide
aaccagctcgacggctttgaggccac

SEQ ID NO: 134340 - DNA, 25 bp, Artificial Sequence
  Description of Artificial Sequence: Synthetic oligonucleotide
accagctcgacggctttgaggccac

SEQ ID NO: 134341 - DNA, 24 bp, Artificial Sequence
  Description of Artificial Sequence: Synthetic oligonucleotide
ccagctcgacggctttgaggccac

SEQ ID NO: 134342 - DNA, 26 bp, Artificial Sequence
  Description of Artificial Sequence: Synthetic oligonucleotide
cagctcgacggctttgaggccaccaa

SEQ ID NO: 134343 - DNA, 27 bp, Artificial Sequence
  Description of Artificial Sequence: Synthetic oligonucleotide
agctcgacggctttgaggccaccaaga

SEQ ID NO: 134344 - DNA, 27 bp, Artificial Sequence
  Description of Artificial Sequence: Synthetic oligonucleotide
gctcgacggctttgaggccaccaagaa

SEQ ID NO: 134345 - DNA, 27 bp, Artificial Sequence
  Description of Artificial Sequence: Synthetic oligonucleotide
ctcgacggctttgaggccaccaagaac

SEQ ID NO: 134346 - DNA, 29 bp, Artificial Sequence
  Description of Artificial Sequence: Synthetic oligonucleotide
tcgacggctttgaggccaccaagaacatc

SEQ ID NO: 134347 - DNA, 28 bp, Artificial Sequence
  Description of Artificial Sequence: Synthetic oligonucleotide
cgacggctttgaggccaccaagaacatc

SEQ ID NO: 134348 - DNA, 30 bp, Artificial Sequence
  Description of Artificial Sequence: Synthetic oligonucleotide
gacggctttgaggccaccaagaacatcaag

SEQ ID NO: 134349 - DNA, 30 bp, Artificial Sequence
  Description of Artificial Sequence: Synthetic oligonucleotide
acggctttgaggccaccaagaacatcaagg

SEQ ID NO: 134350 - DNA, 29 bp, Artificial Sequence
  Description of Artificial Sequence: Synthetic oligonucleotide
cggctttgaggccaccaagaacatcaagg

SEQ ID NO: 134351 - DNA, 33 bp, Artificial Sequence
  Description of Artificial Sequence: Synthetic oligonucleotide
ggctttgaggccaccaagaacatcaaggttatc

SEQ ID NO: 134352 - DNA, 35 bp, Artificial Sequence
  Description of Artificial Sequence: Synthetic oligonucleotide
gctttgaggccaccaagaacatcaaggttatcatg

SEQ ID NO: 134353 - DNA, 35 bp, Artificial Sequence
  Description of Artificial Sequence: Synthetic oligonucleotide
ctttgaggccaccaagaacatcaaggttatcatgg

SEQ ID NO: 134354 - DNA, 35 bp, Artificial Sequence
  Description of Artificial Sequence: Synthetic oligonucleotide
tttgaggccaccaagaacatcaaggttatcatggc

SEQ ID NO: 134355 - DNA, 34 bp, Artificial Sequence
  Description of Artificial Sequence: Synthetic oligonucleotide
ttgaggccaccaagaacatcaaggttatcatggc

SEQ ID NO: 134356 - DNA, 33 bp, Artificial Sequence
  Description of Artificial Sequence: Synthetic oligonucleotide
tgaggccaccaagaacatcaaggttatcatggc

SEQ ID NO: 134357 - DNA, 32 bp, Artificial Sequence
  Description of Artificial Sequence: Synthetic oligonucleotide
gaggccaccaagaacatcaaggttatcatggc

SEQ ID NO: 134358 - DNA, 34 bp, Artificial Sequence
  Description of Artificial Sequence: Synthetic oligonucleotide
aggccaccaagaacatcaaggttatcatggctac

SEQ ID NO: 134359 - DNA, 33 bp, Artificial Sequence
  Description of Artificial Sequence: Synthetic oligonucleotide
ggccaccaagaacatcaaggttatcatggctac

SEQ ID NO: 134360 - DNA, 38 bp, Artificial Sequence
  Description of Artificial Sequence: Synthetic oligonucleotide
gccaccaagaacatcaaggttatcatggctactaatag

SEQ ID NO: 134361 - DNA, 38 bp, Artificial Sequence
  Description of Artificial Sequence: Synthetic oligonucleotide
ccaccaagaacatcaaggttatcatggctactaatagg

SEQ ID NO: 134362 - DNA, 41 bp, Artificial Sequence
  Description of Artificial Sequence: Synthetic oligonucleotide
caccaagaacatcaaggttatcatggctactaataggattg

SEQ ID NO: 134363 - DNA, 45 bp, Artificial Sequence
  Description of Artificial Sequence: Synthetic oligonucleotide
accaagaacatcaaggttatcatggctactaataggattgatatc

SEQ ID NO: 134364 - DNA, 44 bp, Artificial Sequence
  Description of Artificial Sequence: Synthetic oligonucleotide
ccaagaacatcaaggttatcatggctactaataggattgatatc

SEQ ID NO: 134365 - DNA, 44 bp, Artificial Sequence
  Description of Artificial Sequence: Synthetic oligonucleotide
caagaacatcaaggttatcatggctactaataggattgatatcc

SEQ ID NO: 134366 - DNA, 45 bp, Artificial Sequence
  Description of Artificial Sequence: Synthetic oligonucleotide
aagaacatcaaggttatcatggctactaataggattgatatcctg

SEQ ID NO: 134367 - DNA, 44 bp, Artificial Sequence
  Description of Artificial Sequence: Synthetic oligonucleotide
agaacatcaaggttatcatggctactaataggattgatatcctg

SEQ ID NO: 134368 - DNA, 43 bp, Artificial Sequence
  Description of Artificial Sequence: Synthetic oligonucleotide
gaacatcaaggttatcatggctactaataggattgatatcctg

SEQ ID NO: 134369 - DNA, 43 bp, Artificial Sequence
  Description of Artificial Sequence: Synthetic oligonucleotide
aacatcaaggttatcatggctactaataggattgatatcctgg

SEQ ID NO: 134370 - DNA, 42 bp, Artificial Sequence
  Description of Artificial Sequence: Synthetic oligonucleotide
acatcaaggttatcatggctactaataggattgatatcctgg

SEQ ID NO: 134371 - DNA, 41 bp, Artificial Sequence
  Description of Artificial Sequence: Synthetic oligonucleotide
catcaaggttatcatggctactaataggattgatatcctgg

SEQ ID NO: 134372 - DNA, 42 bp, Artificial Sequence
  Description of Artificial Sequence: Synthetic oligonucleotide
atcaaggttatcatggctactaataggattgatatcctggac

SEQ ID NO: 134373 - DNA, 41 bp, Artificial Sequence
  Description of Artificial Sequence: Synthetic oligonucleotide
tcaaggttatcatggctactaataggattgatatcctggac

SEQ ID NO: 134374 - DNA, 40 bp, Artificial Sequence
  Description of Artificial Sequence: Synthetic oligonucleotide
caaggttatcatggctactaataggattgatatcctggac

SEQ ID NO: 134375 - DNA, 41 bp, Artificial Sequence
  Description of Artificial Sequence: Synthetic oligonucleotide
aaggttatcatggctactaataggattgatatcctggactc

SEQ ID NO: 134376 - DNA, 40 bp, Artificial Sequence
  Description of Artificial Sequence: Synthetic oligonucleotide
aggttatcatggctactaataggattgatatcctggactc

SEQ ID NO: 134377 - DNA, 39 bp, Artificial Sequence
  Description of Artificial Sequence: Synthetic oligonucleotide
ggttatcatggctactaataggattgatatcctggactc

SEQ ID NO: 134378 - DNA, 39 bp, Artificial Sequence
  Description of Artificial Sequence: Synthetic oligonucleotide
gttatcatggctactaataggattgatatcctggactcg

SEQ ID NO: 134379 - DNA, 39 bp, Artificial Sequence
  Description of Artificial Sequence: Synthetic oligonucleotide
ttatcatggctactaataggattgatatcctggactcgg

SEQ ID NO: 134380 - DNA, 38 bp, Artificial Sequence
  Description of Artificial Sequence: Synthetic oligonucleotide
tatcatggctactaataggattgatatcctggactcgg

SEQ ID NO: 134381 - DNA, 37 bp, Artificial Sequence
  Description of Artificial Sequence: Synthetic oligonucleotide
atcatggctactaataggattgatatcctggactcgg

SEQ ID NO: 134382 - DNA, 36 bp, Artificial Sequence
  Description of Artificial Sequence: Synthetic oligonucleotide
tcatggctactaataggattgatatcctggactcgg

SEQ ID NO: 134383 - DNA, 35 bp, Artificial Sequence
  Description of Artificial Sequence: Synthetic oligonucleotide
catggctactaataggattgatatcctggactcgg

SEQ ID NO: 134384 - DNA, 35 bp, Artificial Sequence
  Description of Artificial Sequence: Synthetic oligonucleotide
atggctactaataggattgatatcctggactcggc

SEQ ID NO: 134385 - DNA, 34 bp, Artificial Sequence
  Description of Artificial Sequence: Synthetic oligonucleotide
tggctactaataggattgatatcctggactcggc

SEQ ID NO: 134386 - DNA, 33 bp, Artificial Sequence
  Description of Artificial Sequence: Synthetic oligonucleotide
ggctactaataggattgatatcctggactcggc

SEQ ID NO: 134387 - DNA, 34 bp, Artificial Sequence
  Description of Artificial Sequence: Synthetic oligonucleotide
gctactaataggattgatatcctggactcggcac

SEQ ID NO: 134388 - DNA, 35 bp, Artificial Sequence
  Description of Artificial Sequence: Synthetic oligonucleotide
ctactaataggattgatatcctggactcggcactg

SEQ ID NO: 134389 - DNA, 35 bp, Artificial Sequence
  Description of Artificial Sequence: Synthetic oligonucleotide
tactaataggattgatatcctggactcggcactgc

SEQ ID NO: 134390 - DNA, 34 bp, Artificial Sequence
  Description of Artificial Sequence: Synthetic oligonucleotide
actaataggattgatatcctggactcggcactgc

SEQ ID NO: 134391 - DNA, 33 bp, Artificial Sequence
  Description of Artificial Sequence: Synthetic oligonucleotide
ctaataggattgatatcctggactcggcactgc

SEQ ID NO: 134392 - DNA, 35 bp, Artificial Sequence
  Description of Artificial Sequence: Synthetic oligonucleotide
taataggattgatatcctggactcggcactgcttc

SEQ ID NO: 134393 - DNA, 34 bp, Artificial Sequence
  Description of Artificial Sequence: Synthetic oligonucleotide
aataggattgatatcctggactcggcactgcttc

SEQ ID NO: 134394 - DNA, 33 bp, Artificial Sequence
  Description of Artificial Sequence: Synthetic oligonucleotide
ataggattgatatcctggactcggcactgcttc

SEQ ID NO: 134395 - DNA, 32 bp, Artificial Sequence
  Description of Artificial Sequence: Synthetic oligonucleotide
taggattgatatcctggactcggcactgcttc

SEQ ID NO: 134396 - DNA, 31 bp, Artificial Sequence
  Description of Artificial Sequence: Synthetic oligonucleotide
aggattgatatcctggactcggcactgcttc

SEQ ID NO: 134397 - DNA, 30 bp, Artificial Sequence
  Description of Artificial Sequence: Synthetic oligonucleotide
ggattgatatcctggactcggcactgcttc

SEQ ID NO: 134398 - DNA, 30 bp, Artificial Sequence
  Description of Artificial Sequence: Synthetic oligonucleotide
gattgatatcctggactcggcactgcttcg

SEQ ID NO: 134399 - DNA, 30 bp, Artificial Sequence
  Description of Artificial Sequence: Synthetic oligonucleotide
attgatatcctggactcggcactgcttcgc

SEQ ID NO: 134400 - DNA, 29 bp, Artificial Sequence
  Description of Artificial Sequence: Synthetic oligonucleotide
ttgatatcctggactcggcactgcttcgc

SEQ ID NO: 134401 - DNA, 28 bp, Artificial Sequence
  Description of Artificial Sequence: Synthetic oligonucleotide
tgatatcctggactcggcactgcttcgc

SEQ ID NO: 134402 - DNA, 27 bp, Artificial Sequence
  Description of Artificial Sequence: Synthetic oligonucleotide
gatatcctggactcggcactgcttcgc

SEQ ID NO: 134403 - DNA, 27 bp, Artificial Sequence
  Description of Artificial Sequence: Synthetic oligonucleotide
atatcctggactcggcactgcttcgcc

SEQ ID NO: 134404 - DNA, 26 bp, Artificial Sequence
  Description of Artificial Sequence: Synthetic oligonucleotide
tatcctggactcggcactgcttcgcc

SEQ ID NO: 134405 - DNA, 25 bp, Artificial Sequence
  Description of Artificial Sequence: Synthetic oligonucleotide
atcctggactcggcactgcttcgcc

SEQ ID NO: 134406 - DNA, 24 bp, Artificial Sequence
  Description of Artificial Sequence: Synthetic oligonucleotide
tcctggactcggcactgcttcgcc

SEQ ID NO: 134407 - DNA, 23 bp, Artificial Sequence
  Description of Artificial Sequence: Synthetic oligonucleotide
cctggactcggcactgcttcgcc

SEQ ID NO: 134408 - DNA, 24 bp, Artificial Sequence
  Description of Artificial Sequence: Synthetic oligonucleotide
ctggactcggcactgcttcgccca

SEQ ID NO: 134409 - DNA, 24 bp, Artificial Sequence
  Description of Artificial Sequence: Synthetic oligonucleotide
tggactcggcactgcttcgcccag

SEQ ID NO: 134410 - DNA, 23 bp, Artificial Sequence
  Description of Artificial Sequence: Synthetic oligonucleotide
ggactcggcactgcttcgcccag

SEQ ID NO: 134411 - DNA, 23 bp, Artificial Sequence
  Description of Artificial Sequence: Synthetic oligonucleotide
gactcggcactgcttcgcccagg

SEQ ID NO: 134412 - DNA, 23 bp, Artificial Sequence
  Description of Artificial Sequence: Synthetic oligonucleotide
actcggcactgcttcgcccaggg

SEQ ID NO: 134413 - DNA, 22 bp, Artificial Sequence
  Description of Artificial Sequence: Synthetic oligonucleotide
ctcggcactgcttcgcccaggg

SEQ ID NO: 134414 - DNA, 22 bp, Artificial Sequence
  Description of Artificial Sequence: Synthetic oligonucleotide
tcggcactgcttcgcccagggc

SEQ ID NO: 134415 - DNA, 21 bp, Artificial Sequence
  Description of Artificial Sequence: Synthetic oligonucleotide
cggcactgcttcgcccagggc

SEQ ID NO: 134416 - DNA, 21 bp, Artificial Sequence
  Description of Artificial Sequence: Synthetic oligonucleotide
ggcactgcttcgcccagggcg

SEQ ID NO: 134417 - DNA, 24 bp, Artificial Sequence
  Description of Artificial Sequence: Synthetic oligonucleotide
gcactgcttcgcccagggcgcatt

SEQ ID NO: 134418 - DNA, 25 bp, Artificial Sequence
  Description of Artificial Sequence: Synthetic oligonucleotide
cactgcttcgcccagggcgcattga

SEQ ID NO: 134419 - DNA, 26 bp, Artificial Sequence
  Description of Artificial Sequence: Synthetic oligonucleotide
actgcttcgcccagggcgcattgaca

SEQ ID NO: 134420 - DNA, 25 bp, Artificial Sequence
  Description of Artificial Sequence: Synthetic oligonucleotide
ctgcttcgcccagggcgcattgaca

SEQ ID NO: 134421 - DNA, 27 bp, Artificial Sequence
  Description of Artificial Sequence: Synthetic oligonucleotide
tgcttcgcccagggcgcattgacagaa

SEQ ID NO: 134422 - DNA, 27 bp, Artificial Sequence
  Description of Artificial Sequence: Synthetic oligonucleotide
gcttcgcccagggcgcattgacagaaa

SEQ ID NO: 134423 - DNA, 31 bp, Artificial Sequence
  Description of Artificial Sequence: Synthetic oligonucleotide
cttcgcccagggcgcattgacagaaaaattg

SEQ ID NO: 134424 - DNA, 35 bp, Artificial Sequence
  Description of Artificial Sequence: Synthetic oligonucleotide
ttcgcccagggcgcattgacagaaaaattgaattc

SEQ ID NO: 134425 - DNA, 34 bp, Artificial Sequence
  Description of Artificial Sequence: Synthetic oligonucleotide
tcgcccagggcgcattgacagaaaaattgaattc

SEQ ID NO: 134426 - DNA, 33 bp, Artificial Sequence
  Description of Artificial Sequence: Synthetic oligonucleotide
cgcccagggcgcattgacagaaaaattgaattc

SEQ ID NO: 134427 - DNA, 33 bp, Artificial Sequence
  Description of Artificial Sequence: Synthetic oligonucleotide
gcccagggcgcattgacagaaaaattgaattcc

SEQ ID NO: 134428 - DNA, 33 bp, Artificial Sequence
  Description of Artificial Sequence: Synthetic oligonucleotide
cccagggcgcattgacagaaaaattgaattccc

SEQ ID NO: 134429 - DNA, 34 bp, Artificial Sequence
  Description of Artificial Sequence: Synthetic oligonucleotide
ccagggcgcattgacagaaaaattgaattcccac

SEQ ID NO: 134430 - DNA, 34 bp, Artificial Sequence
  Description of Artificial Sequence: Synthetic oligonucleotide
cagggcgcattgacagaaaaattgaattcccacc

SEQ ID NO: 134431 - DNA, 34 bp, Artificial Sequence
  Description of Artificial Sequence: Synthetic oligonucleotide
agggcgcattgacagaaaaattgaattcccaccc

SEQ ID NO: 134432 - DNA, 33 bp, Artificial Sequence
  Description of Artificial Sequence: Synthetic oligonucleotide
gggcgcattgacagaaaaattgaattcccaccc

SEQ ID NO: 134433 - DNA, 33 bp, Artificial Sequence
  Description of Artificial Sequence: Synthetic oligonucleotide
ggcgcattgacagaaaaattgaattcccacccc

SEQ ID NO: 134434 - DNA, 33 bp, Artificial Sequence
  Description of Artificial Sequence: Synthetic oligonucleotide
gcgcattgacagaaaaattgaattcccaccccc

SEQ ID NO: 134435 - DNA, 33 bp, Artificial Sequence
  Description of Artificial Sequence: Synthetic oligonucleotide
cgcattgacagaaaaattgaattcccacccccc

SEQ ID NO: 134436 - DNA, 36 bp, Artificial Sequence
  Description of Artificial Sequence: Synthetic oligonucleotide
gcattgacagaaaaattgaattcccaccccccaatg

SEQ ID NO: 134437 - DNA, 37 bp, Artificial Sequence
  Description of Artificial Sequence: Synthetic oligonucleotide
cattgacagaaaaattgaattcccaccccccaatgag

SEQ ID NO: 134438 - DNA, 37 bp, Artificial Sequence
  Description of Artificial Sequence: Synthetic oligonucleotide
attgacagaaaaattgaattcccaccccccaatgagg

SEQ ID NO: 134439 - DNA, 36 bp, Artificial Sequence
  Description of Artificial Sequence: Synthetic oligonucleotide
ttgacagaaaaattgaattcccaccccccaatgagg

SEQ ID NO: 134440 - DNA, 35 bp, Artificial Sequence
  Description of Artificial Sequence: Synthetic oligonucleotide
tgacagaaaaattgaattcccaccccccaatgagg

SEQ ID NO: 134441 - DNA, 34 bp, Artificial Sequence
  Description of Artificial Sequence: Synthetic oligonucleotide
gacagaaaaattgaattcccaccccccaatgagg

SEQ ID NO: 134442 - DNA, 35 bp, Artificial Sequence
  Description of Artificial Sequence: Synthetic oligonucleotide
acagaaaaattgaattcccaccccccaatgaggag

SEQ ID NO: 134443 - DNA, 34 bp, Artificial Sequence
  Description of Artificial Sequence: Synthetic oligonucleotide
cagaaaaattgaattcccaccccccaatgaggag

SEQ ID NO: 134444 - DNA, 34 bp, Artificial Sequence
  Description of Artificial Sequence: Synthetic oligonucleotide
agaaaaattgaattcccaccccccaatgaggagg

SEQ ID NO: 134445 - DNA, 33 bp, Artificial Sequence
  Description of Artificial Sequence: Synthetic oligonucleotide
gaaaaattgaattcccaccccccaatgaggagg

SEQ ID NO: 134446 - DNA, 33 bp, Artificial Sequence
  Description of Artificial Sequence: Synthetic oligonucleotide
aaaaattgaattcccaccccccaatgaggaggc

SEQ ID NO: 134447 - DNA, 32 bp, Artificial Sequence
  Description of Artificial Sequence: Synthetic oligonucleotide
aaaattgaattcccaccccccaatgaggaggc

SEQ ID NO: 134448 - DNA, 31 bp, Artificial Sequence
  Description of Artificial Sequence: Synthetic oligonucleotide
aaattgaattcccaccccccaatgaggaggc

SEQ ID NO: 134449 - DNA, 30 bp, Artificial Sequence
  Description of Artificial Sequence: Synthetic oligonucleotide
aattgaattcccaccccccaatgaggaggc

SEQ ID NO: 134450 - DNA, 29 bp, Artificial Sequence
  Description of Artificial Sequence: Synthetic oligonucleotide
attgaattcccaccccccaatgaggaggc

SEQ ID NO: 134451 - DNA, 28 bp, Artificial Sequence
  Description of Artificial Sequence: Synthetic oligonucleotide
ttgaattcccaccccccaatgaggaggc

SEQ ID NO: 134452 - DNA, 27 bp, Artificial Sequence
  Description of Artificial Sequence: Synthetic oligonucleotide
tgaattcccaccccccaatgaggaggc

SEQ ID NO: 134453 - DNA, 26 bp, Artificial Sequence
  Description of Artificial Sequence: Synthetic oligonucleotide
gaattcccaccccccaatgaggaggc

SEQ ID NO: 134454 - DNA, 26 bp, Artificial Sequence
  Description of Artificial Sequence: Synthetic oligonucleotide
aattcccaccccccaatgaggaggcc

SEQ ID NO: 134455 - DNA, 25 bp, Artificial Sequence
  Description of Artificial Sequence: Synthetic oligonucleotide
attcccaccccccaatgaggaggcc

SEQ ID NO: 134456 - DNA, 24 bp, Artificial Sequence
  Description of Artificial Sequence: Synthetic oligonucleotide
ttcccaccccccaatgaggaggcc

SEQ ID NO: 134457 - DNA, 23 bp, Artificial Sequence
  Description of Artificial Sequence: Synthetic oligonucleotide
tcccaccccccaatgaggaggcc

SEQ ID NO: 134458 - DNA, 22 bp, Artificial Sequence
  Description of Artificial Sequence: Synthetic oligonucleotide
cccaccccccaatgaggaggcc

SEQ ID NO: 134459 - DNA, 22 bp, Artificial Sequence
  Description of Artificial Sequence: Synthetic oligonucleotide
ccaccccccaatgaggaggccc

SEQ ID NO: 134460 - DNA, 22 bp, Artificial Sequence
  Description of Artificial Sequence: Synthetic oligonucleotide
caccccccaatgaggaggcccg

SEQ ID NO: 134461 - DNA, 22 bp, Artificial Sequence
  Description of Artificial Sequence: Synthetic oligonucleotide
accccccaatgaggaggcccgg

SEQ ID NO: 134462 - DNA, 21 bp, Artificial Sequence
  Description of Artificial Sequence: Synthetic oligonucleotide
ccccccaatgaggaggcccgg

SEQ ID NO: 134463 - DNA, 22 bp, Artificial Sequence
  Description of Artificial Sequence: Synthetic oligonucleotide
cccccaatgaggaggcccggct

SEQ ID NO: 134464 - DNA, 22 bp, Artificial Sequence
  Description of Artificial Sequence: Synthetic oligonucleotide
ccccaatgaggaggcccggctg

SEQ ID NO: 134465 - DNA, 23 bp, Artificial Sequence
  Description of Artificial Sequence: Synthetic oligonucleotide
cccaatgaggaggcccggctgga

SEQ ID NO: 134466 - DNA, 27 bp, Artificial Sequence
  Description of Artificial Sequence: Synthetic oligonucleotide
ccaatgaggaggcccggctggacattt

SEQ ID NO: 134467 - DNA, 28 bp, Artificial Sequence
  Description of Artificial Sequence: Synthetic oligonucleotide
caatgaggaggcccggctggacattttg

SEQ ID NO: 134468 - DNA, 30 bp, Artificial Sequence
  Description of Artificial Sequence: Synthetic oligonucleotide
aatgaggaggcccggctggacattttgaag

SEQ ID NO: 134469 - DNA, 29 bp, Artificial Sequence
  Description of Artificial Sequence: Synthetic oligonucleotide
atgaggaggcccggctggacattttgaag

SEQ ID NO: 134470 - DNA, 28 bp, Artificial Sequence
  Description of Artificial Sequence: Synthetic oligonucleotide
tgaggaggcccggctggacattttgaag

SEQ ID NO: 134471 - DNA, 27 bp, Artificial Sequence
  Description of Artificial Sequence: Synthetic oligonucleotide
gaggaggcccggctggacattttgaag

SEQ ID NO: 134472 - DNA, 30 bp, Artificial Sequence
  Description of Artificial Sequence: Synthetic oligonucleotide
aggaggcccggctggacattttgaagattc

SEQ ID NO: 134473 - DNA, 29 bp, Artificial Sequence
  Description of Artificial Sequence: Synthetic oligonucleotide
ggaggcccggctggacattttgaagattc

SEQ ID NO: 134474 - DNA, 32 bp, Artificial Sequence
  Description of Artificial Sequence: Synthetic oligonucleotide
gaggcccggctggacattttgaagattcattc

SEQ ID NO: 134475 - DNA, 33 bp, Artificial Sequence
  Description of Artificial Sequence: Synthetic oligonucleotide
aggcccggctggacattttgaagattcattctc

SEQ ID NO: 134476 - DNA, 32 bp, Artificial Sequence
  Description of Artificial Sequence: Synthetic oligonucleotide
ggcccggctggacattttgaagattcattctc

SEQ ID NO: 134477 - DNA, 32 bp, Artificial Sequence
  Description of Artificial Sequence: Synthetic oligonucleotide
gcccggctggacattttgaagattcattctcg

SEQ ID NO: 134478 - DNA, 32 bp, Artificial Sequence
  Description of Artificial Sequence: Synthetic oligonucleotide
cccggctggacattttgaagattcattctcgg

SEQ ID NO: 134479 - DNA, 34 bp, Artificial Sequence
  Description of Artificial Sequence: Synthetic oligonucleotide
ccggctggacattttgaagattcattctcggaag

SEQ ID NO: 134480 - DNA, 36 bp, Artificial Sequence
  Description of Artificial Sequence: Synthetic oligonucleotide
cggctggacattttgaagattcattctcggaagatg

SEQ ID NO: 134481 - DNA, 38 bp, Artificial Sequence
  Description of Artificial Sequence: Synthetic oligonucleotide
ggctggacattttgaagattcattctcggaagatgaac

SEQ ID NO: 134482 - DNA, 38 bp, Artificial Sequence
  Description of Artificial Sequence: Synthetic oligonucleotide
gctggacattttgaagattcattctcggaagatgaacc

SEQ ID NO: 134483 - DNA, 39 bp, Artificial Sequence
  Description of Artificial Sequence: Synthetic oligonucleotide
ctggacattttgaagattcattctcggaagatgaacctg

SEQ ID NO: 134484 - DNA, 40 bp, Artificial Sequence
  Description of Artificial Sequence: Synthetic oligonucleotide
tggacattttgaagattcattctcggaagatgaacctgac

SEQ ID NO: 134485 - DNA, 39 bp, Artificial Sequence
  Description of Artificial Sequence: Synthetic oligonucleotide
ggacattttgaagattcattctcggaagatgaacctgac

SEQ ID NO: 134486 - DNA, 39 bp, Artificial Sequence
  Description of Artificial Sequence: Synthetic oligonucleotide
gacattttgaagattcattctcggaagatgaacctgacc

SEQ ID NO: 134487 - DNA, 39 bp, Artificial Sequence
  Description of Artificial Sequence: Synthetic oligonucleotide
acattttgaagattcattctcggaagatgaacctgaccc

SEQ ID NO: 134488 - DNA, 38 bp, Artificial Sequence
  Description of Artificial Sequence: Synthetic oligonucleotide
cattttgaagattcattctcggaagatgaacctgaccc

SEQ ID NO: 134489 - DNA, 38 bp, Artificial Sequence
  Description of Artificial Sequence: Synthetic oligonucleotide
attttgaagattcattctcggaagatgaacctgacccg

SEQ ID NO: 134490 - DNA, 37 bp, Artificial Sequence
  Description of Artificial Sequence: Synthetic oligonucleotide
ttttgaagattcattctcggaagatgaacctgacccg

SEQ ID NO: 134491 - DNA, 36 bp, Artificial Sequence
  Description of Artificial Sequence: Synthetic oligonucleotide
tttgaagattcattctcggaagatgaacctgacccg

SEQ ID NO: 134492 - DNA, 35 bp, Artificial Sequence
  Description of Artificial Sequence: Synthetic oligonucleotide
ttgaagattcattctcggaagatgaacctgacccg

SEQ ID NO: 134493 - DNA, 34 bp, Artificial Sequence
  Description of Artificial Sequence: Synthetic oligonucleotide
tgaagattcattctcggaagatgaacctgacccg

SEQ ID NO: 134494 - DNA, 33 bp, Artificial Sequence
  Description of Artificial Sequence: Synthetic oligonucleotide
gaagattcattctcggaagatgaacctgacccg

SEQ ID NO: 134495 - DNA, 33 bp, Artificial Sequence
  Description of Artificial Sequence: Synthetic oligonucleotide
aagattcattctcggaagatgaacctgacccgg

SEQ ID NO: 134496 - DNA, 32 bp, Artificial Sequence
  Description of Artificial Sequence: Synthetic oligonucleotide
agattcattctcggaagatgaacctgacccgg

SEQ ID NO: 134497 - DNA, 31 bp, Artificial Sequence
  Description of Artificial Sequence: Synthetic oligonucleotide
gattcattctcggaagatgaacctgacccgg

SEQ ID NO: 134498 - DNA, 31 bp, Artificial Sequence
  Description of Artificial Sequence: Synthetic oligonucleotide
attcattctcggaagatgaacctgacccggg

SEQ ID NO: 134499 - DNA, 30 bp, Artificial Sequence
  Description of Artificial Sequence: Synthetic oligonucleotide
ttcattctcggaagatgaacctgacccggg

SEQ ID NO: 134500 - DNA, 29 bp, Artificial Sequence
  Description of Artificial Sequence: Synthetic oligonucleotide
tcattctcggaagatgaacctgacccggg

SEQ ID NO: 134501 - DNA, 28 bp, Artificial Sequence
  Description of Artificial Sequence: Synthetic oligonucleotide
cattctcggaagatgaacctgacccggg

SEQ ID NO: 134502 - DNA, 28 bp, Artificial Sequence
  Description of Artificial Sequence: Synthetic oligonucleotide
attctcggaagatgaacctgacccgggg

SEQ ID NO: 134503 - DNA, 27 bp, Artificial Sequence
  Description of Artificial Sequence: Synthetic oligonucleotide
ttctcggaagatgaacctgacccgggg

SEQ ID NO: 134504 - DNA, 26 bp, Artificial Sequence
  Description of Artificial Sequence: Synthetic oligonucleotide
tctcggaagatgaacctgacccgggg

SEQ ID NO: 134505 - DNA, 25 bp, Artificial Sequence
  Description of Artificial Sequence: Synthetic oligonucleotide
ctcggaagatgaacctgacccgggg

SEQ ID NO: 134506 - DNA, 27 bp, Artificial Sequence
  Description of Artificial Sequence: Synthetic oligonucleotide
tcggaagatgaacctgacccgggggat

SEQ ID NO: 134507 - DNA, 26 bp, Artificial Sequence
  Description of Artificial Sequence: Synthetic oligonucleotide
cggaagatgaacctgacccgggggat

SEQ ID NO: 134508 - DNA, 27 bp, Artificial Sequence
  Description of Artificial Sequence: Synthetic oligonucleotide
ggaagatgaacctgacccgggggatca

SEQ ID NO: 134509 - DNA, 28 bp, Artificial Sequence
  Description of Artificial Sequence: Synthetic oligonucleotide
gaagatgaacctgacccgggggatcaac

SEQ ID NO: 134510 - DNA, 28 bp, Artificial Sequence
  Description of Artificial Sequence: Synthetic oligonucleotide
aagatgaacctgacccgggggatcaacc

SEQ ID NO: 134511 - DNA, 27 bp, Artificial Sequence
  Description of Artificial Sequence: Synthetic oligonucleotide
agatgaacctgacccgggggatcaacc

SEQ ID NO: 134512 - DNA, 27 bp, Artificial Sequence
  Description of Artificial Sequence: Synthetic oligonucleotide
gatgaacctgacccgggggatcaacct

SEQ ID NO: 134513 - DNA, 27 bp, Artificial Sequence
  Description of Artificial Sequence: Synthetic oligonucleotide
atgaacctgacccgggggatcaacctg

SEQ ID NO: 134514 - DNA, 27 bp, Artificial Sequence
  Description of Artificial Sequence: Synthetic oligonucleotide
tgaacctgacccgggggatcaacctga

SEQ ID NO: 134515 - DNA, 26 bp, Artificial Sequence
  Description of Artificial Sequence: Synthetic oligonucleotide
gaacctgacccgggggatcaacctga

SEQ ID NO: 134516 - DNA, 27 bp, Artificial Sequence
  Description of Artificial Sequence: Synthetic oligonucleotide
aacctgacccgggggatcaacctgaga

SEQ ID NO: 134517 - DNA, 27 bp, Artificial Sequence
  Description of Artificial Sequence: Synthetic oligonucleotide
acctgacccgggggatcaacctgagaa

SEQ ID NO: 134518 - DNA, 27 bp, Artificial Sequence
  Description of Artificial Sequence: Synthetic oligonucleotide
cctgacccgggggatcaacctgagaaa

SEQ ID NO: 134519 - DNA, 31 bp, Artificial Sequence
  Description of Artificial Sequence: Synthetic oligonucleotide
ctgacccgggggatcaacctgagaaaaattg

SEQ ID NO: 134520 - DNA, 31 bp, Artificial Sequence
  Description of Artificial Sequence: Synthetic oligonucleotide
tgacccgggggatcaacctgagaaaaattgc

SEQ ID NO: 134521 - DNA, 30 bp, Artificial Sequence
  Description of Artificial Sequence: Synthetic oligonucleotide
gacccgggggatcaacctgagaaaaattgc

SEQ ID NO: 134522 - DNA, 31 bp, Artificial Sequence
  Description of Artificial Sequence: Synthetic oligonucleotide
acccgggggatcaacctgagaaaaattgctg

SEQ ID NO: 134523 - DNA, 30 bp, Artificial Sequence
  Description of Artificial Sequence: Synthetic oligonucleotide
cccgggggatcaacctgagaaaaattgctg

SEQ ID NO: 134524 - DNA, 31 bp, Artificial Sequence
  Description of Artificial Sequence: Synthetic oligonucleotide
ccgggggatcaacctgagaaaaattgctgag

SEQ ID NO: 134525 - DNA, 31 bp, Artificial Sequence
  Description of Artificial Sequence: Synthetic oligonucleotide
cgggggatcaacctgagaaaaattgctgagc

SEQ ID NO: 134526 - DNA, 32 bp, Artificial Sequence
  Description of Artificial Sequence: Synthetic oligonucleotide
gggggatcaacctgagaaaaattgctgagctc

SEQ ID NO: 134527 - DNA, 34 bp, Artificial Sequence
  Description of Artificial Sequence: Synthetic oligonucleotide
ggggatcaacctgagaaaaattgctgagctcatg

SEQ ID NO: 134528 - DNA, 34 bp, Artificial Sequence
  Description of Artificial Sequence: Synthetic oligonucleotide
gggatcaacctgagaaaaattgctgagctcatgc

SEQ ID NO: 134529 - DNA, 34 bp, Artificial Sequence
  Description of Artificial Sequence: Synthetic oligonucleotide
ggatcaacctgagaaaaattgctgagctcatgcc

SEQ ID NO: 134530 - DNA, 35 bp, Artificial Sequence
  Description of Artificial Sequence: Synthetic oligonucleotide
gatcaacctgagaaaaattgctgagctcatgccag

SEQ ID NO: 134531 - DNA, 35 bp, Artificial Sequence
  Description of Artificial Sequence: Synthetic oligonucleotide
atcaacctgagaaaaattgctgagctcatgccagg

SEQ ID NO: 134532 - DNA, 34 bp, Artificial Sequence
  Description of Artificial Sequence: Synthetic oligonucleotide
tcaacctgagaaaaattgctgagctcatgccagg

SEQ ID NO: 134533 - DNA, 33 bp, Artificial Sequence
  Description of Artificial Sequence: Synthetic oligonucleotide
caacctgagaaaaattgctgagctcatgccagg

SEQ ID NO: 134534 - DNA, 34 bp, Artificial Sequence
  Description of Artificial Sequence: Synthetic oligonucleotide
aacctgagaaaaattgctgagctcatgccaggag

SEQ ID NO: 134535 - DNA, 33 bp, Artificial Sequence
  Description of Artificial Sequence: Synthetic oligonucleotide
acctgagaaaaattgctgagctcatgccaggag

SEQ ID NO: 134536 - DNA, 32 bp, Artificial Sequence
  Description of Artificial Sequence: Synthetic oligonucleotide
cctgagaaaaattgctgagctcatgccaggag

SEQ ID NO: 134537 - DNA, 32 bp, Artificial Sequence
  Description of Artificial Sequence: Synthetic oligonucleotide
ctgagaaaaattgctgagctcatgccaggagc

SEQ ID NO: 134538 - DNA, 34 bp, Artificial Sequence
  Description of Artificial Sequence: Synthetic oligonucleotide
tgagaaaaattgctgagctcatgccaggagcatc

SEQ ID NO: 134539 - DNA, 33 bp, Artificial Sequence
  Description of Artificial Sequence: Synthetic oligonucleotide
gagaaaaattgctgagctcatgccaggagcatc

SEQ ID NO: 134540 - DNA, 34 bp, Artificial Sequence
  Description of Artificial Sequence: Synthetic oligonucleotide
agaaaaattgctgagctcatgccaggagcatcag

SEQ ID NO: 134541 - DNA, 33 bp, Artificial Sequence
  Description of Artificial Sequence: Synthetic oligonucleotide
gaaaaattgctgagctcatgccaggagcatcag

SEQ ID NO: 134542 - DNA, 33 bp, Artificial Sequence
  Description of Artificial Sequence: Synthetic oligonucleotide
aaaaattgctgagctcatgccaggagcatcagg

SEQ ID NO: 134543 - DNA, 32 bp, Artificial Sequence
  Description of Artificial Sequence: Synthetic oligonucleotide
aaaattgctgagctcatgccaggagcatcagg

SEQ ID NO: 134544 - DNA, 31 bp, Artificial Sequence
  Description of Artificial Sequence: Synthetic oligonucleotide
aaattgctgagctcatgccaggagcatcagg

SEQ ID NO: 134545 - DNA, 30 bp, Artificial Sequence
  Description of Artificial Sequence: Synthetic oligonucleotide
aattgctgagctcatgccaggagcatcagg

SEQ ID NO: 134546 - DNA, 29 bp, Artificial Sequence
  Description of Artificial Sequence: Synthetic oligonucleotide
attgctgagctcatgccaggagcatcagg

SEQ ID NO: 134547 - DNA, 28 bp, Artificial Sequence
  Description of Artificial Sequence: Synthetic oligonucleotide
ttgctgagctcatgccaggagcatcagg

SEQ ID NO: 134548 - DNA, 27 bp, Artificial Sequence
  Description of Artificial Sequence: Synthetic oligonucleotide
tgctgagctcatgccaggagcatcagg

SEQ ID NO: 134549 - DNA, 26 bp, Artificial Sequence
  Description of Artificial Sequence: Synthetic oligonucleotide
gctgagctcatgccaggagcatcagg

SEQ ID NO: 134550 - DNA, 26 bp, Artificial Sequence
  Description of Artificial Sequence: Synthetic oligonucleotide
ctgagctcatgccaggagcatcaggg

SEQ ID NO: 134551 - DNA, 26 bp, Artificial Sequence
  Description of Artificial Sequence: Synthetic oligonucleotide
tgagctcatgccaggagcatcagggg

SEQ ID NO: 134552 - DNA, 25 bp, Artificial Sequence
  Description of Artificial Sequence: Synthetic oligonucleotide
gagctcatgccaggagcatcagggg

SEQ ID NO: 134553 - DNA, 26 bp, Artificial Sequence
  Description of Artificial Sequence: Synthetic oligonucleotide
agctcatgccaggagcatcaggggct

SEQ ID NO: 134554 - DNA, 25 bp, Artificial Sequence
  Description of Artificial Sequence: Synthetic oligonucleotide
gctcatgccaggagcatcaggggct

SEQ ID NO: 134555 - DNA, 27 bp, Artificial Sequence
  Description of Artificial Sequence: Synthetic oligonucleotide
ctcatgccaggagcatcaggggctgaa

SEQ ID NO: 134556 - DNA, 27 bp, Artificial Sequence
  Description of Artificial Sequence: Synthetic oligonucleotide
tcatgccaggagcatcaggggctgaag

SEQ ID NO: 134557 - DNA, 27 bp, Artificial Sequence
  Description of Artificial Sequence: Synthetic oligonucleotide
catgccaggagcatcaggggctgaagt

SEQ ID NO: 134558 - DNA, 27 bp, Artificial Sequence
  Description of Artificial Sequence: Synthetic oligonucleotide
atgccaggagcatcaggggctgaagtg

SEQ ID NO: 134559 - DNA, 27 bp, Artificial Sequence
  Description of Artificial Sequence: Synthetic oligonucleotide
tgccaggagcatcaggggctgaagtga

SEQ ID NO: 134560 - DNA, 27 bp, Artificial Sequence
  Description of Artificial Sequence: Synthetic oligonucleotide
gccaggagcatcaggggctgaagtgaa

SEQ ID NO: 134561 - DNA, 27 bp, Artificial Sequence
  Description of Artificial Sequence: Synthetic oligonucleotide
ccaggagcatcaggggctgaagtgaag

SEQ ID NO: 134562 - DNA, 27 bp, Artificial Sequence
  Description of Artificial Sequence: Synthetic oligonucleotide
caggagcatcaggggctgaagtgaagg

SEQ ID NO: 134563 - DNA, 27 bp, Artificial Sequence
  Description of Artificial Sequence: Synthetic oligonucleotide
aggagcatcaggggctgaagtgaaggg

SEQ ID NO: 134564 - DNA, 26 bp, Artificial Sequence
  Description of Artificial Sequence: Synthetic oligonucleotide
ggagcatcaggggctgaagtgaaggg

SEQ ID NO: 134565 - DNA, 26 bp, Artificial Sequence
  Description of Artificial Sequence: Synthetic oligonucleotide
gagcatcaggggctgaagtgaagggc

SEQ ID NO: 134566 - DNA, 27 bp, Artificial Sequence
  Description of Artificial Sequence: Synthetic oligonucleotide
agcatcaggggctgaagtgaagggcgt

SEQ ID NO: 134567 - DNA, 26 bp, Artificial Sequence
  Description of Artificial Sequence: Synthetic oligonucleotide
gcatcaggggctgaagtgaagggcgt

SEQ ID NO: 134568 - DNA, 27 bp, Artificial Sequence
  Description of Artificial Sequence: Synthetic oligonucleotide
catcaggggctgaagtgaagggcgtgt

SEQ ID NO: 134569 - DNA, 27 bp, Artificial Sequence
  Description of Artificial Sequence: Synthetic oligonucleotide
atcaggggctgaagtgaagggcgtgtg

SEQ ID NO: 134570 - DNA, 26 bp, Artificial Sequence
  Description of Artificial Sequence: Synthetic oligonucleotide
tcaggggctgaagtgaagggcgtgtg

SEQ ID NO: 134571 - DNA, 25 bp, Artificial Sequence
  Description of Artificial Sequence: Synthetic oligonucleotide
caggggctgaagtgaagggcgtgtg

SEQ ID NO: 134572 - DNA, 26 bp, Artificial Sequence
  Description of Artificial Sequence: Synthetic oligonucleotide
aggggctgaagtgaagggcgtgtgca

SEQ ID NO: 134573 - DNA, 25 bp, Artificial Sequence
  Description of Artificial Sequence: Synthetic oligonucleotide
ggggctgaagtgaagggcgtgtgca

SEQ ID NO: 134574 - DNA, 26 bp, Artificial Sequence
  Description of Artificial Sequence: Synthetic oligonucleotide
gggctgaagtgaagggcgtgtgcaca

SEQ ID NO: 134575 - DNA, 27 bp, Artificial Sequence
  Description of Artificial Sequence: Synthetic oligonucleotide
ggctgaagtgaagggcgtgtgcacaga

SEQ ID NO: 134576 - DNA, 28 bp, Artificial Sequence
  Description of Artificial Sequence: Synthetic oligonucleotide
gctgaagtgaagggcgtgtgcacagaag

SEQ ID NO: 134577 - DNA, 28 bp, Artificial Sequence
  Description of Artificial Sequence: Synthetic oligonucleotide
ctgaagtgaagggcgtgtgcacagaagc

SEQ ID NO: 134578 - DNA, 29 bp, Artificial Sequence
  Description of Artificial Sequence: Synthetic oligonucleotide
tgaagtgaagggcgtgtgcacagaagctg

SEQ ID NO: 134579 - DNA, 28 bp, Artificial Sequence
  Description of Artificial Sequence: Synthetic oligonucleotide
gaagtgaagggcgtgtgcacagaagctg

SEQ ID NO: 134580 - DNA, 28 bp, Artificial Sequence
  Description of Artificial Sequence: Synthetic oligonucleotide
aagtgaagggcgtgtgcacagaagctgg

SEQ ID NO: 134581 - DNA, 27 bp, Artificial Sequence
  Description of Artificial Sequence: Synthetic oligonucleotide
agtgaagggcgtgtgcacagaagctgg

SEQ ID NO: 134582 - DNA, 26 bp, Artificial Sequence
  Description of Artificial Sequence: Synthetic oligonucleotide
gtgaagggcgtgtgcacagaagctgg

SEQ ID NO: 134583 - DNA, 27 bp, Artificial Sequence
  Description of Artificial Sequence: Synthetic oligonucleotide
tgaagggcgtgtgcacagaagctggca

SEQ ID NO: 134584 - DNA, 27 bp, Artificial Sequence
  Description of Artificial Sequence: Synthetic oligonucleotide
gaagggcgtgtgcacagaagctggcat

SEQ ID NO: 134585 - DNA, 27 bp, Artificial Sequence
  Description of Artificial Sequence: Synthetic oligonucleotide
aagggcgtgtgcacagaagctggcatg

SEQ ID NO: 134586 - DNA, 27 bp, Artificial Sequence
  Description of Artificial Sequence: Synthetic oligonucleotide
agggcgtgtgcacagaagctggcatgt

SEQ ID NO: 134587 - DNA, 27 bp, Artificial Sequence
  Description of Artificial Sequence: Synthetic oligonucleotide
gggcgtgtgcacagaagctggcatgta

SEQ ID NO: 134588 - DNA, 28 bp, Artificial Sequence
  Description of Artificial Sequence: Synthetic oligonucleotide
ggcgtgtgcacagaagctggcatgtatg

SEQ ID NO: 134589 - DNA, 28 bp, Artificial Sequence
  Description of Artificial Sequence: Synthetic oligonucleotide
gcgtgtgcacagaagctggcatgtatgc

SEQ ID NO: 134590 - DNA, 28 bp, Artificial Sequence
  Description of Artificial Sequence: Synthetic oligonucleotide
cgtgtgcacagaagctggcatgtatgcc

SEQ ID NO: 134591 - DNA, 28 bp, Artificial Sequence
  Description of Artificial Sequence: Synthetic oligonucleotide
gtgtgcacagaagctggcatgtatgccc

SEQ ID NO: 134592 - DNA, 29 bp, Artificial Sequence
  Description of Artificial Sequence: Synthetic oligonucleotide
tgtgcacagaagctggcatgtatgccctg

SEQ ID NO: 134593 - DNA, 28 bp, Artificial Sequence
  Description of Artificial Sequence: Synthetic oligonucleotide
gtgcacagaagctggcatgtatgccctg

SEQ ID NO: 134594 - DNA, 28 bp, Artificial Sequence
  Description of Artificial Sequence: Synthetic oligonucleotide
tgcacagaagctggcatgtatgccctgc

SEQ ID NO: 134595 - DNA, 27 bp, Artificial Sequence
  Description of Artificial Sequence: Synthetic oligonucleotide
gcacagaagctggcatgtatgccctgc

SEQ ID NO: 134596 - DNA, 27 bp, Artificial Sequence
  Description of Artificial Sequence: Synthetic oligonucleotide
cacagaagctggcatgtatgccctgcg

SEQ ID NO: 134597 - DNA, 28 bp, Artificial Sequence
  Description of Artificial Sequence: Synthetic oligonucleotide
acagaagctggcatgtatgccctgcgag

SEQ ID NO: 134598 - DNA, 27 bp, Artificial Sequence
  Description of Artificial Sequence: Synthetic oligonucleotide
cagaagctggcatgtatgccctgcgag

SEQ ID NO: 134599 - DNA, 29 bp, Artificial Sequence
  Description of Artificial Sequence: Synthetic oligonucleotide
agaagctggcatgtatgccctgcgagaac

SEQ ID NO: 134600 - DNA, 28 bp, Artificial Sequence
  Description of Artificial Sequence: Synthetic oligonucleotide
gaagctggcatgtatgccctgcgagaac

SEQ ID NO: 134601 - DNA, 28 bp, Artificial Sequence
  Description of Artificial Sequence: Synthetic oligonucleotide
aagctggcatgtatgccctgcgagaacg

SEQ ID NO: 134602 - DNA, 27 bp, Artificial Sequence
  Description of Artificial Sequence: Synthetic oligonucleotide
agctggcatgtatgccctgcgagaacg

SEQ ID NO: 134603 - DNA, 26 bp, Artificial Sequence
  Description of Artificial Sequence: Synthetic oligonucleotide
gctggcatgtatgccctgcgagaacg

SEQ ID NO: 134604 - DNA, 26 bp, Artificial Sequence
  Description of Artificial Sequence: Synthetic oligonucleotide
ctggcatgtatgccctgcgagaacgg

SEQ ID NO: 134605 - DNA, 26 bp, Artificial Sequence
  Description of Artificial Sequence: Synthetic oligonucleotide
tggcatgtatgccctgcgagaacggc

SEQ ID NO: 134606 - DNA, 25 bp, Artificial Sequence
  Description of Artificial Sequence: Synthetic oligonucleotide
ggcatgtatgccctgcgagaacggc

SEQ ID NO: 134607 - DNA, 26 bp, Artificial Sequence
  Description of Artificial Sequence: Synthetic oligonucleotide
gcatgtatgccctgcgagaacggcga

SEQ ID NO: 134608 - DNA, 27 bp, Artificial Sequence
  Description of Artificial Sequence: Synthetic oligonucleotide
catgtatgccctgcgagaacggcgagt

SEQ ID NO: 134609 - DNA, 27 bp, Artificial Sequence
  Description of Artificial Sequence: Synthetic oligonucleotide
atgtatgccctgcgagaacggcgagtc

SEQ ID NO: 134610 - DNA, 26 bp, Artificial Sequence
  Description of Artificial Sequence: Synthetic oligonucleotide
tgtatgccctgcgagaacggcgagtc

SEQ ID NO: 134611 - DNA, 25 bp, Artificial Sequence
  Description of Artificial Sequence: Synthetic oligonucleotide
gtatgccctgcgagaacggcgagtc

SEQ ID NO: 134612 - DNA, 27 bp, Artificial Sequence
  Description of Artificial Sequence: Synthetic oligonucleotide
tatgccctgcgagaacggcgagtccat

SEQ ID NO: 134613 - DNA, 26 bp, Artificial Sequence
  Description of Artificial Sequence: Synthetic oligonucleotide
atgccctgcgagaacggcgagtccat

SEQ ID NO: 134614 - DNA, 25 bp, Artificial Sequence
  Description of Artificial Sequence: Synthetic oligonucleotide
tgccctgcgagaacggcgagtccat

SEQ ID NO: 134615 - DNA, 24 bp, Artificial Sequence
  Description of Artificial Sequence: Synthetic oligonucleotide
gccctgcgagaacggcgagtccat

SEQ ID NO: 134616 - DNA, 25 bp, Artificial Sequence
  Description of Artificial Sequence: Synthetic oligonucleotide
ccctgcgagaacggcgagtccatgt

SEQ ID NO: 134617 - DNA, 26 bp, Artificial Sequence
  Description of Artificial Sequence: Synthetic oligonucleotide
cctgcgagaacggcgagtccatgtca

SEQ ID NO: 134618 - DNA, 27 bp, Artificial Sequence
  Description of Artificial Sequence: Synthetic oligonucleotide
ctgcgagaacggcgagtccatgtcact

SEQ ID NO: 134619 - DNA, 27 bp, Artificial Sequence
  Description of Artificial Sequence: Synthetic oligonucleotide
tgcgagaacggcgagtccatgtcactc

SEQ ID NO: 134620 - DNA, 27 bp, Artificial Sequence
  Description of Artificial Sequence: Synthetic oligonucleotide
gcgagaacggcgagtccatgtcactca

SEQ ID NO: 134621 - DNA, 27 bp, Artificial Sequence
  Description of Artificial Sequence: Synthetic oligonucleotide
cgagaacggcgagtccatgtcactcag

SEQ ID NO: 134622 - DNA, 27 bp, Artificial Sequence
  Description of Artificial Sequence: Synthetic oligonucleotide
gagaacggcgagtccatgtcactcagg

SEQ ID NO: 134623 - DNA, 28 bp, Artificial Sequence
  Description of Artificial Sequence: Synthetic oligonucleotide
agaacggcgagtccatgtcactcaggag

SEQ ID NO: 134624 - DNA, 27 bp, Artificial Sequence
  Description of Artificial Sequence: Synthetic oligonucleotide
gaacggcgagtccatgtcactcaggag

SEQ ID NO: 134625 - DNA, 27 bp, Artificial Sequence
  Description of Artificial Sequence: Synthetic oligonucleotide
aacggcgagtccatgtcactcaggagg

SEQ ID NO: 134626 - DNA, 27 bp, Artificial Sequence
  Description of Artificial Sequence: Synthetic oligonucleotide
acggcgagtccatgtcactcaggagga

SEQ ID NO: 134627 - DNA, 26 bp, Artificial Sequence
  Description of Artificial Sequence: Synthetic oligonucleotide
cggcgagtccatgtcactcaggagga

SEQ ID NO: 134628 - DNA, 27 bp, Artificial Sequence
  Description of Artificial Sequence: Synthetic oligonucleotide
ggcgagtccatgtcactcaggaggact

SEQ ID NO: 134629 - DNA, 29 bp, Artificial Sequence
  Description of Artificial Sequence: Synthetic oligonucleotide
gcgagtccatgtcactcaggaggactttg

SEQ ID NO: 134630 - DNA, 30 bp, Artificial Sequence
  Description of Artificial Sequence: Synthetic oligonucleotide
cgagtccatgtcactcaggaggactttgag

SEQ ID NO: 134631 - DNA, 32 bp, Artificial Sequence
  Description of Artificial Sequence: Synthetic oligonucleotide
gagtccatgtcactcaggaggactttgagatg

SEQ ID NO: 134632 - DNA, 32 bp, Artificial Sequence
  Description of Artificial Sequence: Synthetic oligonucleotide
agtccatgtcactcaggaggactttgagatgg

SEQ ID NO: 134633 - DNA, 31 bp, Artificial Sequence
  Description of Artificial Sequence: Synthetic oligonucleotide
gtccatgtcactcaggaggactttgagatgg

SEQ ID NO: 134634 - DNA, 31 bp, Artificial Sequence
  Description of Artificial Sequence: Synthetic oligonucleotide
tccatgtcactcaggaggactttgagatggc

SEQ ID NO: 134635 - DNA, 30 bp, Artificial Sequence
  Description of Artificial Sequence: Synthetic oligonucleotide
ccatgtcactcaggaggactttgagatggc

SEQ ID NO: 134636 - DNA, 31 bp, Artificial Sequence
  Description of Artificial Sequence: Synthetic oligonucleotide
catgtcactcaggaggactttgagatggcag

SEQ ID NO: 134637 - DNA, 33 bp, Artificial Sequence
  Description of Artificial Sequence: Synthetic oligonucleotide
atgtcactcaggaggactttgagatggcagtag

SEQ ID NO: 134638 - DNA, 32 bp, Artificial Sequence
  Description of Artificial Sequence: Synthetic oligonucleotide
tgtcactcaggaggactttgagatggcagtag

SEQ ID NO: 134639 - DNA, 31 bp, Artificial Sequence
  Description of Artificial Sequence: Synthetic oligonucleotide
gtcactcaggaggactttgagatggcagtag

SEQ ID NO: 134640 - DNA, 31 bp, Artificial Sequence
  Description of Artificial Sequence: Synthetic oligonucleotide
tcactcaggaggactttgagatggcagtagc

SEQ ID NO: 134641 - DNA, 30 bp, Artificial Sequence
  Description of Artificial Sequence: Synthetic oligonucleotide
cactcaggaggactttgagatggcagtagc

SEQ ID NO: 134642 - DNA, 30 bp, Artificial Sequence
  Description of Artificial Sequence: Synthetic oligonucleotide
actcaggaggactttgagatggcagtagcc

SEQ ID NO: 134643 - DNA, 29 bp, Artificial Sequence
  Description of Artificial Sequence: Synthetic oligonucleotide
ctcaggaggactttgagatggcagtagcc

SEQ ID NO: 134644 - DNA, 31 bp, Artificial Sequence
  Description of Artificial Sequence: Synthetic oligonucleotide
tcaggaggactttgagatggcagtagccaag

SEQ ID NO: 134645 - DNA, 30 bp, Artificial Sequence
  Description of Artificial Sequence: Synthetic oligonucleotide
caggaggactttgagatggcagtagccaag

SEQ ID NO: 134646 - DNA, 30 bp, Artificial Sequence
  Description of Artificial Sequence: Synthetic oligonucleotide
aggaggactttgagatggcagtagccaagg

SEQ ID NO: 134647 - DNA, 29 bp, Artificial Sequence
  Description of Artificial Sequence: Synthetic oligonucleotide
ggaggactttgagatggcagtagccaagg

SEQ ID NO: 134648 - DNA, 30 bp, Artificial Sequence
  Description of Artificial Sequence: Synthetic oligonucleotide
gaggactttgagatggcagtagccaaggtc

SEQ ID NO: 134649 - DNA, 32 bp, Artificial Sequence
  Description of Artificial Sequence: Synthetic oligonucleotide
aggactttgagatggcagtagccaaggtcatg

SEQ ID NO: 134650 - DNA, 31 bp, Artificial Sequence
  Description of Artificial Sequence: Synthetic oligonucleotide
ggactttgagatggcagtagccaaggtcatg

SEQ ID NO: 134651 - DNA, 31 bp, Artificial Sequence
  Description of Artificial Sequence: Synthetic oligonucleotide
gactttgagatggcagtagccaaggtcatgc

SEQ ID NO: 134652 - DNA, 32 bp, Artificial Sequence
  Description of Artificial Sequence: Synthetic oligonucleotide
actttgagatggcagtagccaaggtcatgcag

SEQ ID NO: 134653 - DNA, 31 bp, Artificial Sequence
  Description of Artificial Sequence: Synthetic oligonucleotide
ctttgagatggcagtagccaaggtcatgcag

SEQ ID NO: 134654 - DNA, 33 bp, Artificial Sequence
  Description of Artificial Sequence: Synthetic oligonucleotide
tttgagatggcagtagccaaggtcatgcagaag

SEQ ID NO: 134655 - DNA, 32 bp, Artificial Sequence
  Description of Artificial Sequence: Synthetic oligonucleotide
ttgagatggcagtagccaaggtcatgcagaag

SEQ ID NO: 134656 - DNA, 31 bp, Artificial Sequence
  Description of Artificial Sequence: Synthetic oligonucleotide
tgagatggcagtagccaaggtcatgcagaag

SEQ ID NO: 134657 - DNA, 30 bp, Artificial Sequence
  Description of Artificial Sequence: Synthetic oligonucleotide
gagatggcagtagccaaggtcatgcagaag

SEQ ID NO: 134658 - DNA, 30 bp, Artificial Sequence
  Description of Artificial Sequence: Synthetic oligonucleotide
agatggcagtagccaaggtcatgcagaagg

SEQ ID NO: 134659 - DNA, 29 bp, Artificial Sequence
  Description of Artificial Sequence: Synthetic oligonucleotide
gatggcagtagccaaggtcatgcagaagg

SEQ ID NO: 134660 - DNA, 30 bp, Artificial Sequence
  Description of Artificial Sequence: Synthetic oligonucleotide
atggcagtagccaaggtcatgcagaaggac

SEQ ID NO: 134661 - DNA, 29 bp, Artificial Sequence
  Description of Artificial Sequence: Synthetic oligonucleotide
tggcagtagccaaggtcatgcagaaggac

SEQ ID NO: 134662 - DNA, 28 bp, Artificial Sequence
  Description of Artificial Sequence: Synthetic oligonucleotide
ggcagtagccaaggtcatgcagaaggac

SEQ ID NO: 134663 - DNA, 29 bp, Artificial Sequence
  Description of Artificial Sequence: Synthetic oligonucleotide
gcagtagccaaggtcatgcagaaggacag

SEQ ID NO: 134664 - DNA, 30 bp, Artificial Sequence
  Description of Artificial Sequence: Synthetic oligonucleotide
cagtagccaaggtcatgcagaaggacagtg

SEQ ID NO: 134665 - DNA, 31 bp, Artificial Sequence
  Description of Artificial Sequence: Synthetic oligonucleotide
agtagccaaggtcatgcagaaggacagtgag

SEQ ID NO: 134666 - DNA, 30 bp, Artificial Sequence
  Description of Artificial Sequence: Synthetic oligonucleotide
gtagccaaggtcatgcagaaggacagtgag

SEQ ID NO: 134667 - DNA, 35 bp, Artificial Sequence
  Description of Artificial Sequence: Synthetic oligonucleotide
tagccaaggtcatgcagaaggacagtgagaaaaac

SEQ ID NO: 134668 - DNA, 34 bp, Artificial Sequence
  Description of Artificial Sequence: Synthetic oligonucleotide
agccaaggtcatgcagaaggacagtgagaaaaac

SEQ ID NO: 134669 - DNA, 33 bp, Artificial Sequence
  Description of Artificial Sequence: Synthetic oligonucleotide
gccaaggtcatgcagaaggacagtgagaaaaac

SEQ ID NO: 134670 - DNA, 35 bp, Artificial Sequence
  Description of Artificial Sequence: Synthetic oligonucleotide
ccaaggtcatgcagaaggacagtgagaaaaacatg

SEQ ID NO: 134671 - DNA, 36 bp, Artificial Sequence
  Description of Artificial Sequence: Synthetic oligonucleotide
caaggtcatgcagaaggacagtgagaaaaacatgtc

SEQ ID NO: 134672 - DNA, 36 bp, Artificial Sequence
  Description of Artificial Sequence: Synthetic oligonucleotide
aaggtcatgcagaaggacagtgagaaaaacatgtcc

SEQ ID NO: 134673 - DNA, 35 bp, Artificial Sequence
  Description of Artificial Sequence: Synthetic oligonucleotide
aggtcatgcagaaggacagtgagaaaaacatgtcc

SEQ ID NO: 134674 - DNA, 34 bp, Artificial Sequence
  Description of Artificial Sequence: Synthetic oligonucleotide
ggtcatgcagaaggacagtgagaaaaacatgtcc

SEQ ID NO: 134675 - DNA, 36 bp, Artificial Sequence
  Description of Artificial Sequence: Synthetic oligonucleotide
gtcatgcagaaggacagtgagaaaaacatgtccatc

SEQ ID NO: 134676 - DNA, 38 bp, Artificial Sequence
  Description of Artificial Sequence: Synthetic oligonucleotide
tcatgcagaaggacagtgagaaaaacatgtccatcaag

SEQ ID NO: 134677 - DNA, 37 bp, Artificial Sequence
  Description of Artificial Sequence: Synthetic oligonucleotide
catgcagaaggacagtgagaaaaacatgtccatcaag

SEQ ID NO: 134678 - DNA, 44 bp, Artificial Sequence
  Description of Artificial Sequence: Synthetic oligonucleotide
atgcagaaggacagtgagaaaaacatgtccatcaagaaattatg

SEQ ID NO: 134679 - DNA, 43 bp, Artificial Sequence
  Description of Artificial Sequence: Synthetic oligonucleotide
tgcagaaggacagtgagaaaaacatgtccatcaagaaattatg

SEQ ID NO: 134680 - DNA, 42 bp, Artificial Sequence
  Description of Artificial Sequence: Synthetic oligonucleotide
gcagaaggacagtgagaaaaacatgtccatcaagaaattatg

SEQ ID NO: 134681 - DNA, 42 bp, Artificial Sequence
  Description of Artificial Sequence: Synthetic oligonucleotide
cagaaggacagtgagaaaaacatgtccatcaagaaattatgg

SEQ ID NO: 134682 - DNA, 44 bp, Artificial Sequence
  Description of Artificial Sequence: Synthetic oligonucleotide
agaaggacagtgagaaaaacatgtccatcaagaaattatggaag

SEQ ID NO: 134683 - DNA, 43 bp, Artificial Sequence
  Description of Artificial Sequence: Synthetic oligonucleotide
gaaggacagtgagaaaaacatgtccatcaagaaattatggaag

SEQ ID NO: 134684 - DNA, 44 bp, Artificial Sequence
  Description of Artificial Sequence: Synthetic oligonucleotide
aaggacagtgagaaaaacatgtccatcaagaaattatggaagtg

SEQ ID NO: 134685 - DNA, 43 bp, Artificial Sequence
  Description of Artificial Sequence: Synthetic oligonucleotide
aggacagtgagaaaaacatgtccatcaagaaattatggaagtg

SEQ ID NO: 134686 - DNA, 42 bp, Artificial Sequence
  Description of Artificial Sequence: Synthetic oligonucleotide
ggacagtgagaaaaacatgtccatcaagaaattatggaagtg

SEQ ID NO: 134687 - DNA, 27 bp, Artificial Sequence
  Description of Artificial Sequence: Synthetic oligonucleotide
atggccattcccggcatcccctatgag

SEQ ID NO: 134688 - DNA, 27 bp, Artificial Sequence
  Description of Artificial Sequence: Synthetic oligonucleotide
tggccattcccggcatcccctatgaga

SEQ ID NO: 134689 - DNA, 26 bp, Artificial Sequence
  Description of Artificial Sequence: Synthetic oligonucleotide
ggccattcccggcatcccctatgaga

SEQ ID NO: 134690 - DNA, 27 bp, Artificial Sequence
  Description of Artificial Sequence: Synthetic oligonucleotide
gccattcccggcatcccctatgagaga

SEQ ID NO: 134691 - DNA, 27 bp, Artificial Sequence
  Description of Artificial Sequence: Synthetic oligonucleotide
ccattcccggcatcccctatgagagac

SEQ ID NO: 134692 - DNA, 27 bp, Artificial Sequence
  Description of Artificial Sequence: Synthetic oligonucleotide
cattcccggcatcccctatgagagacg

SEQ ID NO: 134693 - DNA, 27 bp, Artificial Sequence
  Description of Artificial Sequence: Synthetic oligonucleotide
attcccggcatcccctatgagagacgg

SEQ ID NO: 134694 - DNA, 26 bp, Artificial Sequence
  Description of Artificial Sequence: Synthetic oligonucleotide
ttcccggcatcccctatgagagacgg

SEQ ID NO: 134695 - DNA, 25 bp, Artificial Sequence
  Description of Artificial Sequence: Synthetic oligonucleotide
tcccggcatcccctatgagagacgg

SEQ ID NO: 134696 - DNA, 24 bp, Artificial Sequence
  Description of Artificial Sequence: Synthetic oligonucleotide
cccggcatcccctatgagagacgg

SEQ ID NO: 134697 - DNA, 26 bp, Artificial Sequence
  Description of Artificial Sequence: Synthetic oligonucleotide
ccggcatcccctatgagagacggctt

SEQ ID NO: 134698 - DNA, 27 bp, Artificial Sequence
  Description of Artificial Sequence: Synthetic oligonucleotide
cggcatcccctatgagagacggcttct

SEQ ID NO: 134699 - DNA, 27 bp, Artificial Sequence
  Description of Artificial Sequence: Synthetic oligonucleotide
ggcatcccctatgagagacggcttctc

SEQ ID NO: 134700 - DNA, 29 bp, Artificial Sequence
  Description of Artificial Sequence: Synthetic oligonucleotide
gcatcccctatgagagacggcttctcatc

SEQ ID NO: 134701 - DNA, 31 bp, Artificial Sequence
  Description of Artificial Sequence: Synthetic oligonucleotide
catcccctatgagagacggcttctcatcatg

SEQ ID NO: 134702 - DNA, 31 bp, Artificial Sequence
  Description of Artificial Sequence: Synthetic oligonucleotide
atcccctatgagagacggcttctcatcatgg

SEQ ID NO: 134703 - DNA, 30 bp, Artificial Sequence
  Description of Artificial Sequence: Synthetic oligonucleotide
tcccctatgagagacggcttctcatcatgg

SEQ ID NO: 134704 - DNA, 29 bp, Artificial Sequence
  Description of Artificial Sequence: Synthetic oligonucleotide
cccctatgagagacggcttctcatcatgg

SEQ ID NO: 134705 - DNA, 29 bp, Artificial Sequence
  Description of Artificial Sequence: Synthetic oligonucleotide
ccctatgagagacggcttctcatcatggc

SEQ ID NO: 134706 - DNA, 29 bp, Artificial Sequence
  Description of Artificial Sequence: Synthetic oligonucleotide
cctatgagagacggcttctcatcatggcg

SEQ ID NO: 134707 - DNA, 29 bp, Artificial Sequence
  Description of Artificial Sequence: Synthetic oligonucleotide
ctatgagagacggcttctcatcatggcgg

SEQ ID NO: 134708 - DNA, 30 bp, Artificial Sequence
  Description of Artificial Sequence: Synthetic oligonucleotide
tatgagagacggcttctcatcatggcggac

SEQ ID NO: 134709 - DNA, 29 bp, Artificial Sequence
  Description of Artificial Sequence: Synthetic oligonucleotide
atgagagacggcttctcatcatggcggac

SEQ ID NO: 134710 - DNA, 28 bp, Artificial Sequence
  Description of Artificial Sequence: Synthetic oligonucleotide
tgagagacggcttctcatcatggcggac

SEQ ID NO: 134711 - DNA, 27 bp, Artificial Sequence
  Description of Artificial Sequence: Synthetic oligonucleotide
gagagacggcttctcatcatggcggac

SEQ ID NO: 134712 - DNA, 27 bp, Artificial Sequence
  Description of Artificial Sequence: Synthetic oligonucleotide
agagacggcttctcatcatggcggacc

SEQ ID NO: 134713 - DNA, 26 bp, Artificial Sequence
  Description of Artificial Sequence: Synthetic oligonucleotide
gagacggcttctcatcatggcggacc

SEQ ID NO: 134714 - DNA, 27 bp, Artificial Sequence
  Description of Artificial Sequence: Synthetic oligonucleotide
agacggcttctcatcatggcggaccct

SEQ ID NO: 134715 - DNA, 27 bp, Artificial Sequence
  Description of Artificial Sequence: Synthetic oligonucleotide
gacggcttctcatcatggcggacccta

SEQ ID NO: 134716 - DNA, 27 bp, Artificial Sequence
  Description of Artificial Sequence: Synthetic oligonucleotide
acggcttctcatcatggcggaccctag

SEQ ID NO: 134717 - DNA, 27 bp, Artificial Sequence
  Description of Artificial Sequence: Synthetic oligonucleotide
cggcttctcatcatggcggaccctaga

SEQ ID NO: 134718 - DNA, 27 bp, Artificial Sequence
  Description of Artificial Sequence: Synthetic oligonucleotide
ggcttctcatcatggcggaccctagag

SEQ ID NO: 134719 - DNA, 31 bp, Artificial Sequence
  Description of Artificial Sequence: Synthetic oligonucleotide
gcttctcatcatggcggaccctagagataag

SEQ ID NO: 134720 - DNA, 31 bp, Artificial Sequence
  Description of Artificial Sequence: Synthetic oligonucleotide
cttctcatcatggcggaccctagagataagg

SEQ ID NO: 134721 - DNA, 31 bp, Artificial Sequence
  Description of Artificial Sequence: Synthetic oligonucleotide
ttctcatcatggcggaccctagagataaggc

SEQ ID NO: 134722 - DNA, 30 bp, Artificial Sequence
  Description of Artificial Sequence: Synthetic oligonucleotide
tctcatcatggcggaccctagagataaggc

SEQ ID NO: 134723 - DNA, 29 bp, Artificial Sequence
  Description of Artificial Sequence: Synthetic oligonucleotide
ctcatcatggcggaccctagagataaggc

SEQ ID NO: 134724 - DNA, 29 bp, Artificial Sequence
  Description of Artificial Sequence: Synthetic oligonucleotide
tcatcatggcggaccctagagataaggcg

SEQ ID NO: 134725 - DNA, 28 bp, Artificial Sequence
  Description of Artificial Sequence: Synthetic oligonucleotide
catcatggcggaccctagagataaggcg

SEQ ID NO: 134726 - DNA, 28 bp, Artificial Sequence
  Description of Artificial Sequence: Synthetic oligonucleotide
atcatggcggaccctagagataaggcgc

SEQ ID NO: 134727 - DNA, 27 bp, Artificial Sequence
  Description of Artificial Sequence: Synthetic oligonucleotide
tcatggcggaccctagagataaggcgc

SEQ ID NO: 134728 - DNA, 27 bp, Artificial Sequence
  Description of Artificial Sequence: Synthetic oligonucleotide
catggcggaccctagagataaggcgct

SEQ ID NO: 134729 - DNA, 28 bp, Artificial Sequence
  Description of Artificial Sequence: Synthetic oligonucleotide
atggcggaccctagagataaggcgcttc

SEQ ID NO: 134730 - DNA, 27 bp, Artificial Sequence
  Description of Artificial Sequence: Synthetic oligonucleotide
tggcggaccctagagataaggcgcttc

SEQ ID NO: 134731 - DNA, 27 bp, Artificial Sequence
  Description of Artificial Sequence: Synthetic oligonucleotide
ggcggaccctagagataaggcgcttca

SEQ ID NO: 134732 - DNA, 27 bp, Artificial Sequence
  Description of Artificial Sequence: Synthetic oligonucleotide
gcggaccctagagataaggcgcttcag

SEQ ID NO: 134733 - DNA, 27 bp, Artificial Sequence
  Description of Artificial Sequence: Synthetic oligonucleotide
cggaccctagagataaggcgcttcagg

SEQ ID NO: 134734 - DNA, 28 bp, Artificial Sequence
  Description of Artificial Sequence: Synthetic oligonucleotide
ggaccctagagataaggcgcttcaggac

SEQ ID NO: 134735 - DNA, 30 bp, Artificial Sequence
  Description of Artificial Sequence: Synthetic oligonucleotide
gaccctagagataaggcgcttcaggactac

SEQ ID NO: 134736 - DNA, 30 bp, Artificial Sequence
  Description of Artificial Sequence: Synthetic oligonucleotide
accctagagataaggcgcttcaggactacc

SEQ ID NO: 134737 - DNA, 29 bp, Artificial Sequence
  Description of Artificial Sequence: Synthetic oligonucleotide
ccctagagataaggcgcttcaggactacc

SEQ ID NO: 134738 - DNA, 29 bp, Artificial Sequence
  Description of Artificial Sequence: Synthetic oligonucleotide
cctagagataaggcgcttcaggactaccg

SEQ ID NO: 134739 - DNA, 29 bp, Artificial Sequence
  Description of Artificial Sequence: Synthetic oligonucleotide
ctagagataaggcgcttcaggactaccgc

SEQ ID NO: 134740 - DNA, 31 bp, Artificial Sequence
  Description of Artificial Sequence: Synthetic oligonucleotide
tagagataaggcgcttcaggactaccgcaag

SEQ ID NO: 134741 - DNA, 30 bp, Artificial Sequence
  Description of Artificial Sequence: Synthetic oligonucleotide
agagataaggcgcttcaggactaccgcaag

SEQ ID NO: 134742 - DNA, 29 bp, Artificial Sequence
  Description of Artificial Sequence: Synthetic oligonucleotide
gagataaggcgcttcaggactaccgcaag

SEQ ID NO: 134743 - DNA, 31 bp, Artificial Sequence
  Description of Artificial Sequence: Synthetic oligonucleotide
agataaggcgcttcaggactaccgcaagaag

SEQ ID NO: 134744 - DNA, 30 bp, Artificial Sequence
  Description of Artificial Sequence: Synthetic oligonucleotide
gataaggcgcttcaggactaccgcaagaag

SEQ ID NO: 134745 - DNA, 32 bp, Artificial Sequence
  Description of Artificial Sequence: Synthetic oligonucleotide
ataaggcgcttcaggactaccgcaagaagttg

SEQ ID NO: 134746 - DNA, 31 bp, Artificial Sequence
  Description of Artificial Sequence: Synthetic oligonucleotide
taaggcgcttcaggactaccgcaagaagttg

SEQ ID NO: 134747 - DNA, 30 bp, Artificial Sequence
  Description of Artificial Sequence: Synthetic oligonucleotide
aaggcgcttcaggactaccgcaagaagttg

SEQ ID NO: 134748 - DNA, 29 bp, Artificial Sequence
  Description of Artificial Sequence: Synthetic oligonucleotide
aggcgcttcaggactaccgcaagaagttg

SEQ ID NO: 134749 - DNA, 28 bp, Artificial Sequence
  Description of Artificial Sequence: Synthetic oligonucleotide
ggcgcttcaggactaccgcaagaagttg

SEQ ID NO: 134750 - DNA, 28 bp, Artificial Sequence
  Description of Artificial Sequence: Synthetic oligonucleotide
gcgcttcaggactaccgcaagaagttgc

SEQ ID NO: 134751 - DNA, 30 bp, Artificial Sequence
  Description of Artificial Sequence: Synthetic oligonucleotide
cgcttcaggactaccgcaagaagttgcttg

SEQ ID NO: 134752 - DNA, 32 bp, Artificial Sequence
  Description of Artificial Sequence: Synthetic oligonucleotide
gcttcaggactaccgcaagaagttgcttgaac

SEQ ID NO: 134753 - DNA, 33 bp, Artificial Sequence
  Description of Artificial Sequence: Synthetic oligonucleotide
cttcaggactaccgcaagaagttgcttgaacac

SEQ ID NO: 134754 - DNA, 35 bp, Artificial Sequence
  Description of Artificial Sequence: Synthetic oligonucleotide
ttcaggactaccgcaagaagttgcttgaacacaag

SEQ ID NO: 134755 - DNA, 34 bp, Artificial Sequence
  Description of Artificial Sequence: Synthetic oligonucleotide
tcaggactaccgcaagaagttgcttgaacacaag

SEQ ID NO: 134756 - DNA, 33 bp, Artificial Sequence
  Description of Artificial Sequence: Synthetic oligonucleotide
caggactaccgcaagaagttgcttgaacacaag

SEQ ID NO: 134757 - DNA, 33 bp, Artificial Sequence
  Description of Artificial Sequence: Synthetic oligonucleotide
aggactaccgcaagaagttgcttgaacacaagg

SEQ ID NO: 134758 - DNA, 32 bp, Artificial Sequence
  Description of Artificial Sequence: Synthetic oligonucleotide
ggactaccgcaagaagttgcttgaacacaagg

SEQ ID NO: 134759 - DNA, 33 bp, Artificial Sequence
  Description of Artificial Sequence: Synthetic oligonucleotide
gactaccgcaagaagttgcttgaacacaaggag

SEQ ID NO: 134760 - DNA, 35 bp, Artificial Sequence
  Description of Artificial Sequence: Synthetic oligonucleotide
actaccgcaagaagttgcttgaacacaaggagatc

SEQ ID NO: 134761 - DNA, 34 bp, Artificial Sequence
  Description of Artificial Sequence: Synthetic oligonucleotide
ctaccgcaagaagttgcttgaacacaaggagatc

SEQ ID NO: 134762 - DNA, 34 bp, Artificial Sequence
  Description of Artificial Sequence: Synthetic oligonucleotide
taccgcaagaagttgcttgaacacaaggagatcg

SEQ ID NO: 134763 - DNA, 33 bp, Artificial Sequence
  Description of Artificial Sequence: Synthetic oligonucleotide
accgcaagaagttgcttgaacacaaggagatcg

SEQ ID NO: 134764 - DNA, 32 bp, Artificial Sequence
  Description of Artificial Sequence: Synthetic oligonucleotide
ccgcaagaagttgcttgaacacaaggagatcg

SEQ ID NO: 134765 - DNA, 33 bp, Artificial Sequence
  Description of Artificial Sequence: Synthetic oligonucleotide
cgcaagaagttgcttgaacacaaggagatcgac

SEQ ID NO: 134766 - DNA, 33 bp, Artificial Sequence
  Description of Artificial Sequence: Synthetic oligonucleotide
gcaagaagttgcttgaacacaaggagatcgacg

SEQ ID NO: 134767 - DNA, 33 bp, Artificial Sequence
  Description of Artificial Sequence: Synthetic oligonucleotide
caagaagttgcttgaacacaaggagatcgacgg

SEQ ID NO: 134768 - DNA, 33 bp, Artificial Sequence
  Description of Artificial Sequence: Synthetic oligonucleotide
aagaagttgcttgaacacaaggagatcgacggc

SEQ ID NO: 134769 - DNA, 32 bp, Artificial Sequence
  Description of Artificial Sequence: Synthetic oligonucleotide
agaagttgcttgaacacaaggagatcgacggc

SEQ ID NO: 134770 - DNA, 31 bp, Artificial Sequence
  Description of Artificial Sequence: Synthetic oligonucleotide
gaagttgcttgaacacaaggagatcgacggc

SEQ ID NO: 134771 - DNA, 31 bp, Artificial Sequence
  Description of Artificial Sequence: Synthetic oligonucleotide
aagttgcttgaacacaaggagatcgacggcc

SEQ ID NO: 134772 - DNA, 30 bp, Artificial Sequence
  Description of Artificial Sequence: Synthetic oligonucleotide
agttgcttgaacacaaggagatcgacggcc

SEQ ID NO: 134773 - DNA, 29 bp, Artificial Sequence
  Description of Artificial Sequence: Synthetic oligonucleotide
gttgcttgaacacaaggagatcgacggcc

SEQ ID NO: 134774 - DNA, 29 bp, Artificial Sequence
  Description of Artificial Sequence: Synthetic oligonucleotide
ttgcttgaacacaaggagatcgacggccg

SEQ ID NO: 134775 - DNA, 28 bp, Artificial Sequence
  Description of Artificial Sequence: Synthetic oligonucleotide
tgcttgaacacaaggagatcgacggccg

SEQ ID NO: 134776 - DNA, 27 bp, Artificial Sequence
  Description of Artificial Sequence: Synthetic oligonucleotide
gcttgaacacaaggagatcgacggccg

SEQ ID NO: 134777 - DNA, 28 bp, Artificial Sequence
  Description of Artificial Sequence: Synthetic oligonucleotide
cttgaacacaaggagatcgacggccgtc

SEQ ID NO: 134778 - DNA, 32 bp, Artificial Sequence
  Description of Artificial Sequence: Synthetic oligonucleotide
ttgaacacaaggagatcgacggccgtcttaag

SEQ ID NO: 134779 - DNA, 31 bp, Artificial Sequence
  Description of Artificial Sequence: Synthetic oligonucleotide
tgaacacaaggagatcgacggccgtcttaag

SEQ ID NO: 134780 - DNA, 30 bp, Artificial Sequence
  Description of Artificial Sequence: Synthetic oligonucleotide
gaacacaaggagatcgacggccgtcttaag

SEQ ID NO: 134781 - DNA, 30 bp, Artificial Sequence
  Description of Artificial Sequence: Synthetic oligonucleotide
aacacaaggagatcgacggccgtcttaagg

SEQ ID NO: 134782 - DNA, 29 bp, Artificial Sequence
  Description of Artificial Sequence: Synthetic oligonucleotide
acacaaggagatcgacggccgtcttaagg

SEQ ID NO: 134783 - DNA, 28 bp, Artificial Sequence
  Description of Artificial Sequence: Synthetic oligonucleotide
cacaaggagatcgacggccgtcttaagg

SEQ ID NO: 134784 - DNA, 29 bp, Artificial Sequence
  Description of Artificial Sequence: Synthetic oligonucleotide
acaaggagatcgacggccgtcttaaggag

SEQ ID NO: 134785 - DNA, 28 bp, Artificial Sequence
  Description of Artificial Sequence: Synthetic oligonucleotide
caaggagatcgacggccgtcttaaggag

SEQ ID NO: 134786 - DNA, 32 bp, Artificial Sequence
  Description of Artificial Sequence: Synthetic oligonucleotide
aaggagatcgacggccgtcttaaggagttaag

SEQ ID NO: 134787 - DNA, 31 bp, Artificial Sequence
  Description of Artificial Sequence: Synthetic oligonucleotide
aggagatcgacggccgtcttaaggagttaag

SEQ ID NO: 134788 - DNA, 30 bp, Artificial Sequence
  Description of Artificial Sequence: Synthetic oligonucleotide
ggagatcgacggccgtcttaaggagttaag

SEQ ID NO: 134789 - DNA, 30 bp, Artificial Sequence
  Description of Artificial Sequence: Synthetic oligonucleotide
gagatcgacggccgtcttaaggagttaagg

SEQ ID NO: 134790 - DNA, 30 bp, Artificial Sequence
  Description of Artificial Sequence: Synthetic oligonucleotide
agatcgacggccgtcttaaggagttaaggg

SEQ ID NO: 134791 - DNA, 29 bp, Artificial Sequence
  Description of Artificial Sequence: Synthetic oligonucleotide
gatcgacggccgtcttaaggagttaaggg

SEQ ID NO: 134792 - DNA, 31 bp, Artificial Sequence
  Description of Artificial Sequence: Synthetic oligonucleotide
atcgacggccgtcttaaggagttaagggaac

SEQ ID NO: 134793 - DNA, 30 bp, Artificial Sequence
  Description of Artificial Sequence: Synthetic oligonucleotide
tcgacggccgtcttaaggagttaagggaac

SEQ ID NO: 134794 - DNA, 29 bp, Artificial Sequence
  Description of Artificial Sequence: Synthetic oligonucleotide
cgacggccgtcttaaggagttaagggaac

SEQ ID NO: 134795 - DNA, 37 bp, Artificial Sequence
  Description of Artificial Sequence: Synthetic oligonucleotide
gacggccgtcttaaggagttaagggaacaattaaaag

SEQ ID NO: 134796 - DNA, 39 bp, Artificial Sequence
  Description of Artificial Sequence: Synthetic oligonucleotide
acggccgtcttaaggagttaagggaacaattaaaagaac

SEQ ID NO: 134797 - DNA, 38 bp, Artificial Sequence
  Description of Artificial Sequence: Synthetic oligonucleotide
cggccgtcttaaggagttaagggaacaattaaaagaac

SEQ ID NO: 134798 - DNA, 41 bp, Artificial Sequence
  Description of Artificial Sequence: Synthetic oligonucleotide
ggccgtcttaaggagttaagggaacaattaaaagaacttac

SEQ ID NO: 134799 - DNA, 41 bp, Artificial Sequence
  Description of Artificial Sequence: Synthetic oligonucleotide
gccgtcttaaggagttaagggaacaattaaaagaacttacc

SEQ ID NO: 134800 - DNA, 43 bp, Artificial Sequence
  Description of Artificial Sequence: Synthetic oligonucleotide
ccgtcttaaggagttaagggaacaattaaaagaacttaccaag

SEQ ID NO: 134801 - DNA, 43 bp, Artificial Sequence
  Description of Artificial Sequence: Synthetic oligonucleotide
cgtcttaaggagttaagggaacaattaaaagaacttaccaagc

SEQ ID NO: 134802 - DNA, 44 bp, Artificial Sequence
  Description of Artificial Sequence: Synthetic oligonucleotide
gtcttaaggagttaagggaacaattaaaagaacttaccaagcag

SEQ ID NO: 134803 - DNA, 47 bp, Artificial Sequence
  Description of Artificial Sequence: Synthetic oligonucleotide
tcttaaggagttaagggaacaattaaaagaacttaccaagcagtatg

SEQ ID NO: 134804 - DNA, 46 bp, Artificial Sequence
  Description of Artificial Sequence: Synthetic oligonucleotide
cttaaggagttaagggaacaattaaaagaacttaccaagcagtatg

SEQ ID NO: 134805 - DNA, 50 bp, Artificial Sequence
  Description of Artificial Sequence: Synthetic oligonucleotide
ttaaggagttaagggaacaattaaaagaacttaccaagcagtatgaaaag

SEQ ID NO: 134806 - DNA, 49 bp, Artificial Sequence
  Description of Artificial Sequence: Synthetic oligonucleotide
taaggagttaagggaacaattaaaagaacttaccaagcagtatgaaaag

SEQ ID NO: 134807 - DNA, 48 bp, Artificial Sequence
  Description of Artificial Sequence: Synthetic oligonucleotide
aaggagttaagggaacaattaaaagaacttaccaagcagtatgaaaag

SEQ ID NO: 134808 - DNA, 47 bp, Artificial Sequence
  Description of Artificial Sequence: Synthetic oligonucleotide
aggagttaagggaacaattaaaagaacttaccaagcagtatgaaaag

SEQ ID NO: 134809 - DNA, 46 bp, Artificial Sequence
  Description of Artificial Sequence: Synthetic oligonucleotide
ggagttaagggaacaattaaaagaacttaccaagcagtatgaaaag

SEQ ID NO: 134810 - DNA, 47 bp, Artificial Sequence
  Description of Artificial Sequence: Synthetic oligonucleotide
gagttaagggaacaattaaaagaacttaccaagcagtatgaaaagtc

SEQ ID NO: 134811 - DNA, 48 bp, Artificial Sequence
  Description of Artificial Sequence: Synthetic oligonucleotide
agttaagggaacaattaaaagaacttaccaagcagtatgaaaagtctg

SEQ ID NO: 134812 - DNA, 47 bp, Artificial Sequence
  Description of Artificial Sequence: Synthetic oligonucleotide
gttaagggaacaattaaaagaacttaccaagcagtatgaaaagtctg

SEQ ID NO: 134813 - DNA, 52 bp, Artificial Sequence
  Description of Artificial Sequence: Synthetic oligonucleotide
ttaagggaacaattaaaagaacttaccaagcagtatgaaaagtctgaaaatg

SEQ ID NO: 134814 - DNA, 51 bp, Artificial Sequence
  Description of Artificial Sequence: Synthetic oligonucleotide
taagggaacaattaaaagaacttaccaagcagtatgaaaagtctgaaaatg

SEQ ID NO: 134815 - DNA, 50 bp, Artificial Sequence
  Description of Artificial Sequence: Synthetic oligonucleotide
aagggaacaattaaaagaacttaccaagcagtatgaaaagtctgaaaatg

SEQ ID NO: 134816 - DNA, 49 bp, Artificial Sequence
  Description of Artificial Sequence: Synthetic oligonucleotide
agggaacaattaaaagaacttaccaagcagtatgaaaagtctgaaaatg

SEQ ID NO: 134817 - DNA, 48 bp, Artificial Sequence
  Description of Artificial Sequence: Synthetic oligonucleotide
gggaacaattaaaagaacttaccaagcagtatgaaaagtctgaaaatg

SEQ ID NO: 134818 - DNA, 50 bp, Artificial Sequence
  Description of Artificial Sequence: Synthetic oligonucleotide
ggaacaattaaaagaacttaccaagcagtatgaaaagtctgaaaatgatc

SEQ ID NO: 134819 - DNA, 51 bp, Artificial Sequence
  Description of Artificial Sequence: Synthetic oligonucleotide
gaacaattaaaagaacttaccaagcagtatgaaaagtctgaaaatgatctg

SEQ ID NO: 134820 - DNA, 53 bp, Artificial Sequence
  Description of Artificial Sequence: Synthetic oligonucleotide
aacaattaaaagaacttaccaagcagtatgaaaagtctgaaaatgatctgaag

SEQ ID NO: 134821 - DNA, 52 bp, Artificial Sequence
  Description of Artificial Sequence: Synthetic oligonucleotide
acaattaaaagaacttaccaagcagtatgaaaagtctgaaaatgatctgaag

SEQ ID NO: 134822 - DNA, 51 bp, Artificial Sequence
  Description of Artificial Sequence: Synthetic oligonucleotide
caattaaaagaacttaccaagcagtatgaaaagtctgaaaatgatctgaag

SEQ ID NO: 134823 - DNA, 51 bp, Artificial Sequence
  Description of Artificial Sequence: Synthetic oligonucleotide
aattaaaagaacttaccaagcagtatgaaaagtctgaaaatgatctgaagg

SEQ ID NO: 134824 - DNA, 50 bp, Artificial Sequence
  Description of Artificial Sequence: Synthetic oligonucleotide
attaaaagaacttaccaagcagtatgaaaagtctgaaaatgatctgaagg

SEQ ID NO: 134825 - DNA, 49 bp, Artificial Sequence
  Description of Artificial Sequence: Synthetic oligonucleotide
ttaaaagaacttaccaagcagtatgaaaagtctgaaaatgatctgaagg

SEQ ID NO: 134826 - DNA, 48 bp, Artificial Sequence
  Description of Artificial Sequence: Synthetic oligonucleotide
taaaagaacttaccaagcagtatgaaaagtctgaaaatgatctgaagg

SEQ ID NO: 134827 - DNA, 47 bp, Artificial Sequence
  Description of Artificial Sequence: Synthetic oligonucleotide
aaaagaacttaccaagcagtatgaaaagtctgaaaatgatctgaagg

SEQ ID NO: 134828 - DNA, 46 bp, Artificial Sequence
  Description of Artificial Sequence: Synthetic oligonucleotide
aaagaacttaccaagcagtatgaaaagtctgaaaatgatctgaagg

SEQ ID NO: 134829 - DNA, 45 bp, Artificial Sequence
  Description of Artificial Sequence: Synthetic oligonucleotide
aagaacttaccaagcagtatgaaaagtctgaaaatgatctgaagg

SEQ ID NO: 134830 - DNA, 44 bp, Artificial Sequence
  Description of Artificial Sequence: Synthetic oligonucleotide
agaacttaccaagcagtatgaaaagtctgaaaatgatctgaagg

SEQ ID NO: 134831 - DNA, 43 bp, Artificial Sequence
  Description of Artificial Sequence: Synthetic oligonucleotide
gaacttaccaagcagtatgaaaagtctgaaaatgatctgaagg

SEQ ID NO: 134832 - DNA, 43 bp, Artificial Sequence
  Description of Artificial Sequence: Synthetic oligonucleotide
aacttaccaagcagtatgaaaagtctgaaaatgatctgaaggc

SEQ ID NO: 134833 - DNA, 42 bp, Artificial Sequence
  Description of Artificial Sequence: Synthetic oligonucleotide
acttaccaagcagtatgaaaagtctgaaaatgatctgaaggc

SEQ ID NO: 134834 - DNA, 41 bp, Artificial Sequence
  Description of Artificial Sequence: Synthetic oligonucleotide
cttaccaagcagtatgaaaagtctgaaaatgatctgaaggc

SEQ ID NO: 134835 - DNA, 41 bp, Artificial Sequence
  Description of Artificial Sequence: Synthetic oligonucleotide
ttaccaagcagtatgaaaagtctgaaaatgatctgaaggcc

SEQ ID NO: 134836 - DNA, 40 bp, Artificial Sequence
  Description of Artificial Sequence: Synthetic oligonucleotide
taccaagcagtatgaaaagtctgaaaatgatctgaaggcc

SEQ ID NO: 134837 - DNA, 39 bp, Artificial Sequence
  Description of Artificial Sequence: Synthetic oligonucleotide
accaagcagtatgaaaagtctgaaaatgatctgaaggcc

SEQ ID NO: 134838 - DNA, 38 bp, Artificial Sequence
  Description of Artificial Sequence: Synthetic oligonucleotide
ccaagcagtatgaaaagtctgaaaatgatctgaaggcc

SEQ ID NO: 134839 - DNA, 38 bp, Artificial Sequence
  Description of Artificial Sequence: Synthetic oligonucleotide
caagcagtatgaaaagtctgaaaatgatctgaaggccc

SEQ ID NO: 134840 - DNA, 40 bp, Artificial Sequence
  Description of Artificial Sequence: Synthetic oligonucleotide
aagcagtatgaaaagtctgaaaatgatctgaaggccctac

SEQ ID NO: 134841 - DNA, 39 bp, Artificial Sequence
  Description of Artificial Sequence: Synthetic oligonucleotide
agcagtatgaaaagtctgaaaatgatctgaaggccctac

SEQ ID NO: 134842 - DNA, 38 bp, Artificial Sequence
  Description of Artificial Sequence: Synthetic oligonucleotide
gcagtatgaaaagtctgaaaatgatctgaaggccctac

SEQ ID NO: 134843 - DNA, 39 bp, Artificial Sequence
  Description of Artificial Sequence: Synthetic oligonucleotide
cagtatgaaaagtctgaaaatgatctgaaggccctacag

SEQ ID NO: 134844 - DNA, 40 bp, Artificial Sequence
  Description of Artificial Sequence: Synthetic oligonucleotide
agtatgaaaagtctgaaaatgatctgaaggccctacagag

SEQ ID NO: 134845 - DNA, 39 bp, Artificial Sequence
  Description of Artificial Sequence: Synthetic oligonucleotide
gtatgaaaagtctgaaaatgatctgaaggccctacagag

SEQ ID NO: 134846 - DNA, 40 bp, Artificial Sequence
  Description of Artificial Sequence: Synthetic oligonucleotide
tatgaaaagtctgaaaatgatctgaaggccctacagagtg

SEQ ID NO: 134847 - DNA, 39 bp, Artificial Sequence
  Description of Artificial Sequence: Synthetic oligonucleotide
atgaaaagtctgaaaatgatctgaaggccctacagagtg

SEQ ID NO: 134848 - DNA, 38 bp, Artificial Sequence
  Description of Artificial Sequence: Synthetic oligonucleotide
tgaaaagtctgaaaatgatctgaaggccctacagagtg

SEQ ID NO: 134849 - DNA, 37 bp, Artificial Sequence
  Description of Artificial Sequence: Synthetic oligonucleotide
gaaaagtctgaaaatgatctgaaggccctacagagtg

SEQ ID NO: 134850 - DNA, 39 bp, Artificial Sequence
  Description of Artificial Sequence: Synthetic oligonucleotide
aaaagtctgaaaatgatctgaaggccctacagagtgttg

SEQ ID NO: 134851 - DNA, 38 bp, Artificial Sequence
  Description of Artificial Sequence: Synthetic oligonucleotide
aaagtctgaaaatgatctgaaggccctacagagtgttg

SEQ ID NO: 134852 - DNA, 37 bp, Artificial Sequence
  Description of Artificial Sequence: Synthetic oligonucleotide
aagtctgaaaatgatctgaaggccctacagagtgttg

SEQ ID NO: 134853 - DNA, 36 bp, Artificial Sequence
  Description of Artificial Sequence: Synthetic oligonucleotide
agtctgaaaatgatctgaaggccctacagagtgttg

SEQ ID NO: 134854 - DNA, 35 bp, Artificial Sequence
  Description of Artificial Sequence: Synthetic oligonucleotide
gtctgaaaatgatctgaaggccctacagagtgttg

SEQ ID NO: 134855 - DNA, 35 bp, Artificial Sequence
  Description of Artificial Sequence: Synthetic oligonucleotide
tctgaaaatgatctgaaggccctacagagtgttgg

SEQ ID NO: 134856 - DNA, 34 bp, Artificial Sequence
  Description of Artificial Sequence: Synthetic oligonucleotide
ctgaaaatgatctgaaggccctacagagtgttgg

SEQ ID NO: 134857 - DNA, 34 bp, Artificial Sequence
  Description of Artificial Sequence: Synthetic oligonucleotide
tgaaaatgatctgaaggccctacagagtgttggg

SEQ ID NO: 134858 - DNA, 33 bp, Artificial Sequence
  Description of Artificial Sequence: Synthetic oligonucleotide
gaaaatgatctgaaggccctacagagtgttggg

SEQ ID NO: 134859 - DNA, 33 bp, Artificial Sequence
  Description of Artificial Sequence: Synthetic oligonucleotide
aaaatgatctgaaggccctacagagtgttgggc

SEQ ID NO: 134860 - DNA, 32 bp, Artificial Sequence
  Description of Artificial Sequence: Synthetic oligonucleotide
aaatgatctgaaggccctacagagtgttgggc

SEQ ID NO: 134861 - DNA, 31 bp, Artificial Sequence
  Description of Artificial Sequence: Synthetic oligonucleotide
aatgatctgaaggccctacagagtgttgggc

SEQ ID NO: 134862 - DNA, 30 bp, Artificial Sequence
  Description of Artificial Sequence: Synthetic oligonucleotide
atgatctgaaggccctacagagtgttgggc

SEQ ID NO: 134863 - DNA, 29 bp, Artificial Sequence
  Description of Artificial Sequence: Synthetic oligonucleotide
tgatctgaaggccctacagagtgttgggc

SEQ ID NO: 134864 - DNA, 28 bp, Artificial Sequence
  Description of Artificial Sequence: Synthetic oligonucleotide
gatctgaaggccctacagagtgttgggc

SEQ ID NO: 134865 - DNA, 29 bp, Artificial Sequence
  Description of Artificial Sequence: Synthetic oligonucleotide
atctgaaggccctacagagtgttgggcag

SEQ ID NO: 134866 - DNA, 28 bp, Artificial Sequence
  Description of Artificial Sequence: Synthetic oligonucleotide
tctgaaggccctacagagtgttgggcag

SEQ ID NO: 134867 - DNA, 27 bp, Artificial Sequence
  Description of Artificial Sequence: Synthetic oligonucleotide
ctgaaggccctacagagtgttgggcag

SEQ ID NO: 134868 - DNA, 29 bp, Artificial Sequence
  Description of Artificial Sequence: Synthetic oligonucleotide
tgaaggccctacagagtgttgggcagatc

SEQ ID NO: 134869 - DNA, 28 bp, Artificial Sequence
  Description of Artificial Sequence: Synthetic oligonucleotide
gaaggccctacagagtgttgggcagatc

SEQ ID NO: 134870 - DNA, 28 bp, Artificial Sequence
  Description of Artificial Sequence: Synthetic oligonucleotide
aaggccctacagagtgttgggcagatcg

SEQ ID NO: 134871 - DNA, 27 bp, Artificial Sequence
  Description of Artificial Sequence: Synthetic oligonucleotide
aggccctacagagtgttgggcagatcg

SEQ ID NO: 134872 - DNA, 27 bp, Artificial Sequence
  Description of Artificial Sequence: Synthetic oligonucleotide
ggccctacagagtgttgggcagatcgt

SEQ ID NO: 134873 - DNA, 27 bp, Artificial Sequence
  Description of Artificial Sequence: Synthetic oligonucleotide
gccctacagagtgttgggcagatcgtg

SEQ ID NO: 134874 - DNA, 27 bp, Artificial Sequence
  Description of Artificial Sequence: Synthetic oligonucleotide
ccctacagagtgttgggcagatcgtgg

SEQ ID NO: 134875 - DNA, 27 bp, Artificial Sequence
  Description of Artificial Sequence: Synthetic oligonucleotide
cctacagagtgttgggcagatcgtggg

SEQ ID NO: 134876 - DNA, 28 bp, Artificial Sequence
  Description of Artificial Sequence: Synthetic oligonucleotide
ctacagagtgttgggcagatcgtgggtg

SEQ ID NO: 134877 - DNA, 30 bp, Artificial Sequence
  Description of Artificial Sequence: Synthetic oligonucleotide
tacagagtgttgggcagatcgtgggtgaag

SEQ ID NO: 134878 - DNA, 29 bp, Artificial Sequence
  Description of Artificial Sequence: Synthetic oligonucleotide
acagagtgttgggcagatcgtgggtgaag

SEQ ID NO: 134879 - DNA, 28 bp, Artificial Sequence
  Description of Artificial Sequence: Synthetic oligonucleotide
cagagtgttgggcagatcgtgggtgaag

SEQ ID NO: 134880 - DNA, 29 bp, Artificial Sequence
  Description of Artificial Sequence: Synthetic oligonucleotide
agagtgttgggcagatcgtgggtgaagtg

SEQ ID NO: 134881 - DNA, 28 bp, Artificial Sequence
  Description of Artificial Sequence: Synthetic oligonucleotide
gagtgttgggcagatcgtgggtgaagtg

SEQ ID NO: 134882 - DNA, 28 bp, Artificial Sequence
  Description of Artificial Sequence: Synthetic oligonucleotide
agtgttgggcagatcgtgggtgaagtgc

SEQ ID NO: 134883 - DNA, 27 bp, Artificial Sequence
  Description of Artificial Sequence: Synthetic oligonucleotide
gtgttgggcagatcgtgggtgaagtgc

SEQ ID NO: 134884 - DNA, 32 bp, Artificial Sequence
  Description of Artificial Sequence: Synthetic oligonucleotide
tgttgggcagatcgtgggtgaagtgcttaaac

SEQ ID NO: 134885 - DNA, 31 bp, Artificial Sequence
  Description of Artificial Sequence: Synthetic oligonucleotide
gttgggcagatcgtgggtgaagtgcttaaac

SEQ ID NO: 134886 - DNA, 32 bp, Artificial Sequence
  Description of Artificial Sequence: Synthetic oligonucleotide
ttgggcagatcgtgggtgaagtgcttaaacag

SEQ ID NO: 134887 - DNA, 31 bp, Artificial Sequence
  Description of Artificial Sequence: Synthetic oligonucleotide
tgggcagatcgtgggtgaagtgcttaaacag

SEQ ID NO: 134888 - DNA, 30 bp, Artificial Sequence
  Description of Artificial Sequence: Synthetic oligonucleotide
gggcagatcgtgggtgaagtgcttaaacag

SEQ ID NO: 134889 - DNA, 34 bp, Artificial Sequence
  Description of Artificial Sequence: Synthetic oligonucleotide
ggcagatcgtgggtgaagtgcttaaacagttaac

SEQ ID NO: 134890 - DNA, 35 bp, Artificial Sequence
  Description of Artificial Sequence: Synthetic oligonucleotide
gcagatcgtgggtgaagtgcttaaacagttaactg

SEQ ID NO: 134891 - DNA, 37 bp, Artificial Sequence
  Description of Artificial Sequence: Synthetic oligonucleotide
cagatcgtgggtgaagtgcttaaacagttaactgaag

SEQ ID NO: 134892 - DNA, 44 bp, Artificial Sequence
  Description of Artificial Sequence: Synthetic oligonucleotide
agatcgtgggtgaagtgcttaaacagttaactgaagaaaaattc

SEQ ID NO: 134893 - DNA, 43 bp, Artificial Sequence
  Description of Artificial Sequence: Synthetic oligonucleotide
gatcgtgggtgaagtgcttaaacagttaactgaagaaaaattc

SEQ ID NO: 134894 - DNA, 46 bp, Artificial Sequence
  Description of Artificial Sequence: Synthetic oligonucleotide
atcgtgggtgaagtgcttaaacagttaactgaagaaaaattcattg

SEQ ID NO: 134895 - DNA, 45 bp, Artificial Sequence
  Description of Artificial Sequence: Synthetic oligonucleotide
tcgtgggtgaagtgcttaaacagttaactgaagaaaaattcattg

SEQ ID NO: 134896 - DNA, 44 bp, Artificial Sequence
  Description of Artificial Sequence: Synthetic oligonucleotide
cgtgggtgaagtgcttaaacagttaactgaagaaaaattcattg

SEQ ID NO: 134897 - DNA, 49 bp, Artificial Sequence
  Description of Artificial Sequence: Synthetic oligonucleotide
gtgggtgaagtgcttaaacagttaactgaagaaaaattcattgttaaag

SEQ ID NO: 134898 - DNA, 49 bp, Artificial Sequence
  Description of Artificial Sequence: Synthetic oligonucleotide
tgggtgaagtgcttaaacagttaactgaagaaaaattcattgttaaagc

SEQ ID NO: 134899 - DNA, 48 bp, Artificial Sequence
  Description of Artificial Sequence: Synthetic oligonucleotide
gggtgaagtgcttaaacagttaactgaagaaaaattcattgttaaagc

SEQ ID NO: 134900 - DNA, 50 bp, Artificial Sequence
  Description of Artificial Sequence: Synthetic oligonucleotide
ggtgaagtgcttaaacagttaactgaagaaaaattcattgttaaagctac

SEQ ID NO: 134901 - DNA, 50 bp, Artificial Sequence
  Description of Artificial Sequence: Synthetic oligonucleotide
gtgaagtgcttaaacagttaactgaagaaaaattcattgttaaagctacc

SEQ ID NO: 134902 - DNA, 53 bp, Artificial Sequence
  Description of Artificial Sequence: Synthetic oligonucleotide
tgaagtgcttaaacagttaactgaagaaaaattcattgttaaagctaccaatg

SEQ ID NO: 134903 - DNA, 52 bp, Artificial Sequence
  Description of Artificial Sequence: Synthetic oligonucleotide
gaagtgcttaaacagttaactgaagaaaaattcattgttaaagctaccaatg

SEQ ID NO: 134904 - DNA, 52 bp, Artificial Sequence
  Description of Artificial Sequence: Synthetic oligonucleotide
aagtgcttaaacagttaactgaagaaaaattcattgttaaagctaccaatgg

SEQ ID NO: 134905 - DNA, 51 bp, Artificial Sequence
  Description of Artificial Sequence: Synthetic oligonucleotide
agtgcttaaacagttaactgaagaaaaattcattgttaaagctaccaatgg

SEQ ID NO: 134906 - DNA, 50 bp, Artificial Sequence
  Description of Artificial Sequence: Synthetic oligonucleotide
gtgcttaaacagttaactgaagaaaaattcattgttaaagctaccaatgg

SEQ ID NO: 134907 - DNA, 51 bp, Artificial Sequence
  Description of Artificial Sequence: Synthetic oligonucleotide
tgcttaaacagttaactgaagaaaaattcattgttaaagctaccaatggac

SEQ ID NO: 134908 - DNA, 50 bp, Artificial Sequence
  Description of Artificial Sequence: Synthetic oligonucleotide
gcttaaacagttaactgaagaaaaattcattgttaaagctaccaatggac

SEQ ID NO: 134909 - DNA, 50 bp, Artificial Sequence
  Description of Artificial Sequence: Synthetic oligonucleotide
cttaaacagttaactgaagaaaaattcattgttaaagctaccaatggacc

SEQ ID NO: 134910 - DNA, 52 bp, Artificial Sequence
  Description of Artificial Sequence: Synthetic oligonucleotide
ttaaacagttaactgaagaaaaattcattgttaaagctaccaatggaccaag

SEQ ID NO: 134911 - DNA, 51 bp, Artificial Sequence
  Description of Artificial Sequence: Synthetic oligonucleotide
taaacagttaactgaagaaaaattcattgttaaagctaccaatggaccaag

SEQ ID NO: 134912 - DNA, 50 bp, Artificial Sequence
  Description of Artificial Sequence: Synthetic oligonucleotide
aaacagttaactgaagaaaaattcattgttaaagctaccaatggaccaag

SEQ ID NO: 134913 - DNA, 49 bp, Artificial Sequence
  Description of Artificial Sequence: Synthetic oligonucleotide
aacagttaactgaagaaaaattcattgttaaagctaccaatggaccaag

SEQ ID NO: 134914 - DNA, 48 bp, Artificial Sequence
  Description of Artificial Sequence: Synthetic oligonucleotide
acagttaactgaagaaaaattcattgttaaagctaccaatggaccaag

SEQ ID NO: 134915 - DNA, 47 bp, Artificial Sequence
  Description of Artificial Sequence: Synthetic oligonucleotide
cagttaactgaagaaaaattcattgttaaagctaccaatggaccaag

SEQ ID NO: 134916 - DNA, 51 bp, Artificial Sequence
  Description of Artificial Sequence: Synthetic oligonucleotide
agttaactgaagaaaaattcattgttaaagctaccaatggaccaagatatg

SEQ ID NO: 134917 - DNA, 50 bp, Artificial Sequence
  Description of Artificial Sequence: Synthetic oligonucleotide
gttaactgaagaaaaattcattgttaaagctaccaatggaccaagatatg

SEQ ID NO: 134918 - DNA, 52 bp, Artificial Sequence
  Description of Artificial Sequence: Synthetic oligonucleotide
ttaactgaagaaaaattcattgttaaagctaccaatggaccaagatatgttg

SEQ ID NO: 134919 - DNA, 51 bp, Artificial Sequence
  Description of Artificial Sequence: Synthetic oligonucleotide
taactgaagaaaaattcattgttaaagctaccaatggaccaagatatgttg

SEQ ID NO: 134920 - DNA, 50 bp, Artificial Sequence
  Description of Artificial Sequence: Synthetic oligonucleotide
aactgaagaaaaattcattgttaaagctaccaatggaccaagatatgttg

SEQ ID NO: 134921 - DNA, 49 bp, Artificial Sequence
  Description of Artificial Sequence: Synthetic oligonucleotide
actgaagaaaaattcattgttaaagctaccaatggaccaagatatgttg

SEQ ID NO: 134922 - DNA, 48 bp, Artificial Sequence
  Description of Artificial Sequence: Synthetic oligonucleotide
ctgaagaaaaattcattgttaaagctaccaatggaccaagatatgttg

SEQ ID NO: 134923 - DNA, 49 bp, Artificial Sequence
  Description of Artificial Sequence: Synthetic oligonucleotide
tgaagaaaaattcattgttaaagctaccaatggaccaagatatgttgtg

SEQ ID NO: 134924 - DNA, 48 bp, Artificial Sequence
  Description of Artificial Sequence: Synthetic oligonucleotide
gaagaaaaattcattgttaaagctaccaatggaccaagatatgttgtg

SEQ ID NO: 134925 - DNA, 48 bp, Artificial Sequence
  Description of Artificial Sequence: Synthetic oligonucleotide
aagaaaaattcattgttaaagctaccaatggaccaagatatgttgtgg

SEQ ID NO: 134926 - DNA, 47 bp, Artificial Sequence
  Description of Artificial Sequence: Synthetic oligonucleotide
agaaaaattcattgttaaagctaccaatggaccaagatatgttgtgg

SEQ ID NO: 134927 - DNA, 46 bp, Artificial Sequence
  Description of Artificial Sequence: Synthetic oligonucleotide
gaaaaattcattgttaaagctaccaatggaccaagatatgttgtgg

SEQ ID NO: 134928 - DNA, 46 bp, Artificial Sequence
  Description of Artificial Sequence: Synthetic oligonucleotide
aaaaattcattgttaaagctaccaatggaccaagatatgttgtggg

SEQ ID NO: 134929 - DNA, 45 bp, Artificial Sequence
  Description of Artificial Sequence: Synthetic oligonucleotide
aaaattcattgttaaagctaccaatggaccaagatatgttgtggg

SEQ ID NO: 134930 - DNA, 44 bp, Artificial Sequence
  Description of Artificial Sequence: Synthetic oligonucleotide
aaattcattgttaaagctaccaatggaccaagatatgttgtggg

SEQ ID NO: 134931 - DNA, 43 bp, Artificial Sequence
  Description of Artificial Sequence: Synthetic oligonucleotide
aattcattgttaaagctaccaatggaccaagatatgttgtggg

SEQ ID NO: 134932 - DNA, 42 bp, Artificial Sequence
  Description of Artificial Sequence: Synthetic oligonucleotide
attcattgttaaagctaccaatggaccaagatatgttgtggg

SEQ ID NO: 134933 - DNA, 41 bp, Artificial Sequence
  Description of Artificial Sequence: Synthetic oligonucleotide
ttcattgttaaagctaccaatggaccaagatatgttgtggg

SEQ ID NO: 134934 - DNA, 40 bp, Artificial Sequence
  Description of Artificial Sequence: Synthetic oligonucleotide
tcattgttaaagctaccaatggaccaagatatgttgtggg

SEQ ID NO: 134935 - DNA, 39 bp, Artificial Sequence
  Description of Artificial Sequence: Synthetic oligonucleotide
cattgttaaagctaccaatggaccaagatatgttgtggg

SEQ ID NO: 134936 - DNA, 41 bp, Artificial Sequence
  Description of Artificial Sequence: Synthetic oligonucleotide
attgttaaagctaccaatggaccaagatatgttgtgggttg

SEQ ID NO: 134937 - DNA, 40 bp, Artificial Sequence
  Description of Artificial Sequence: Synthetic oligonucleotide
ttgttaaagctaccaatggaccaagatatgttgtgggttg

SEQ ID NO: 134938 - DNA, 39 bp, Artificial Sequence
  Description of Artificial Sequence: Synthetic oligonucleotide
tgttaaagctaccaatggaccaagatatgttgtgggttg

SEQ ID NO: 134939 - DNA, 38 bp, Artificial Sequence
  Description of Artificial Sequence: Synthetic oligonucleotide
gttaaagctaccaatggaccaagatatgttgtgggttg

SEQ ID NO: 134940 - DNA, 39 bp, Artificial Sequence
  Description of Artificial Sequence: Synthetic oligonucleotide
ttaaagctaccaatggaccaagatatgttgtgggttgtc

SEQ ID NO: 134941 - DNA, 38 bp, Artificial Sequence
  Description of Artificial Sequence: Synthetic oligonucleotide
taaagctaccaatggaccaagatatgttgtgggttgtc

SEQ ID NO: 134942 - DNA, 37 bp, Artificial Sequence
  Description of Artificial Sequence: Synthetic oligonucleotide
aaagctaccaatggaccaagatatgttgtgggttgtc

SEQ ID NO: 134943 - DNA, 36 bp, Artificial Sequence
  Description of Artificial Sequence: Synthetic oligonucleotide
aagctaccaatggaccaagatatgttgtgggttgtc

SEQ ID NO: 134944 - DNA, 35 bp, Artificial Sequence
  Description of Artificial Sequence: Synthetic oligonucleotide
agctaccaatggaccaagatatgttgtgggttgtc

SEQ ID NO: 134945 - DNA, 34 bp, Artificial Sequence
  Description of Artificial Sequence: Synthetic oligonucleotide
gctaccaatggaccaagatatgttgtgggttgtc

SEQ ID NO: 134946 - DNA, 34 bp, Artificial Sequence
  Description of Artificial Sequence: Synthetic oligonucleotide
ctaccaatggaccaagatatgttgtgggttgtcg

SEQ ID NO: 134947 - DNA, 35 bp, Artificial Sequence
  Description of Artificial Sequence: Synthetic oligonucleotide
taccaatggaccaagatatgttgtgggttgtcgtc

SEQ ID NO: 134948 - DNA, 34 bp, Artificial Sequence
  Description of Artificial Sequence: Synthetic oligonucleotide
accaatggaccaagatatgttgtgggttgtcgtc

SEQ ID NO: 134949 - DNA, 33 bp, Artificial Sequence
  Description of Artificial Sequence: Synthetic oligonucleotide
ccaatggaccaagatatgttgtgggttgtcgtc

SEQ ID NO: 134950 - DNA, 33 bp, Artificial Sequence
  Description of Artificial Sequence: Synthetic oligonucleotide
caatggaccaagatatgttgtgggttgtcgtcg

SEQ ID NO: 134951 - DNA, 34 bp, Artificial Sequence
  Description of Artificial Sequence: Synthetic oligonucleotide
aatggaccaagatatgttgtgggttgtcgtcgac

SEQ ID NO: 134952 - DNA, 33 bp, Artificial Sequence
  Description of Artificial Sequence: Synthetic oligonucleotide
atggaccaagatatgttgtgggttgtcgtcgac

SEQ ID NO: 134953 - DNA, 32 bp, Artificial Sequence
  Description of Artificial Sequence: Synthetic oligonucleotide
tggaccaagatatgttgtgggttgtcgtcgac

SEQ ID NO: 134954 - DNA, 31 bp, Artificial Sequence
  Description of Artificial Sequence: Synthetic oligonucleotide
ggaccaagatatgttgtgggttgtcgtcgac

SEQ ID NO: 134955 - DNA, 32 bp, Artificial Sequence
  Description of Artificial Sequence: Synthetic oligonucleotide
gaccaagatatgttgtgggttgtcgtcgacag

SEQ ID NO: 134956 - DNA, 32 bp, Artificial Sequence
  Description of Artificial Sequence: Synthetic oligonucleotide
accaagatatgttgtgggttgtcgtcgacagc

SEQ ID NO: 134957 - DNA, 31 bp, Artificial Sequence
  Description of Artificial Sequence: Synthetic oligonucleotide
ccaagatatgttgtgggttgtcgtcgacagc

SEQ ID NO: 134958 - DNA, 33 bp, Artificial Sequence
  Description of Artificial Sequence: Synthetic oligonucleotide
caagatatgttgtgggttgtcgtcgacagcttg

SEQ ID NO: 134959 - DNA, 34 bp, Artificial Sequence
  Description of Artificial Sequence: Synthetic oligonucleotide
aagatatgttgtgggttgtcgtcgacagcttgac

SEQ ID NO: 134960 - DNA, 33 bp, Artificial Sequence
  Description of Artificial Sequence: Synthetic oligonucleotide
agatatgttgtgggttgtcgtcgacagcttgac

SEQ ID NO: 134961 - DNA, 32 bp, Artificial Sequence
  Description of Artificial Sequence: Synthetic oligonucleotide
gatatgttgtgggttgtcgtcgacagcttgac

SEQ ID NO: 134962 - DNA, 36 bp, Artificial Sequence
  Description of Artificial Sequence: Synthetic oligonucleotide
atatgttgtgggttgtcgtcgacagcttgacaaaag

SEQ ID NO: 134963 - DNA, 35 bp, Artificial Sequence
  Description of Artificial Sequence: Synthetic oligonucleotide
tatgttgtgggttgtcgtcgacagcttgacaaaag

SEQ ID NO: 134964 - DNA, 34 bp, Artificial Sequence
  Description of Artificial Sequence: Synthetic oligonucleotide
atgttgtgggttgtcgtcgacagcttgacaaaag

SEQ ID NO: 134965 - DNA, 33 bp, Artificial Sequence
  Description of Artificial Sequence: Synthetic oligonucleotide
tgttgtgggttgtcgtcgacagcttgacaaaag

SEQ ID NO: 134966 - DNA, 32 bp, Artificial Sequence
  Description of Artificial Sequence: Synthetic oligonucleotide
gttgtgggttgtcgtcgacagcttgacaaaag

SEQ ID NO: 134967 - DNA, 35 bp, Artificial Sequence
  Description of Artificial Sequence: Synthetic oligonucleotide
ttgtgggttgtcgtcgacagcttgacaaaagtaag

SEQ ID NO: 134968 - DNA, 34 bp, Artificial Sequence
  Description of Artificial Sequence: Synthetic oligonucleotide
tgtgggttgtcgtcgacagcttgacaaaagtaag

SEQ ID NO: 134969 - DNA, 33 bp, Artificial Sequence
  Description of Artificial Sequence: Synthetic oligonucleotide
gtgggttgtcgtcgacagcttgacaaaagtaag

SEQ ID NO: 134970 - DNA, 33 bp, Artificial Sequence
  Description of Artificial Sequence: Synthetic oligonucleotide
tgggttgtcgtcgacagcttgacaaaagtaagc

SEQ ID NO: 134971 - DNA, 32 bp, Artificial Sequence
  Description of Artificial Sequence: Synthetic oligonucleotide
gggttgtcgtcgacagcttgacaaaagtaagc

SEQ ID NO: 134972 - DNA, 33 bp, Artificial Sequence
  Description of Artificial Sequence: Synthetic oligonucleotide
ggttgtcgtcgacagcttgacaaaagtaagctg

SEQ ID NO: 134973 - DNA, 35 bp, Artificial Sequence
  Description of Artificial Sequence: Synthetic oligonucleotide
gttgtcgtcgacagcttgacaaaagtaagctgaag

SEQ ID NO: 134974 - DNA, 35 bp, Artificial Sequence
  Description of Artificial Sequence: Synthetic oligonucleotide
ttgtcgtcgacagcttgacaaaagtaagctgaagc

SEQ ID NO: 134975 - DNA, 34 bp, Artificial Sequence
  Description of Artificial Sequence: Synthetic oligonucleotide
tgtcgtcgacagcttgacaaaagtaagctgaagc

SEQ ID NO: 134976 - DNA, 33 bp, Artificial Sequence
  Description of Artificial Sequence: Synthetic oligonucleotide
gtcgtcgacagcttgacaaaagtaagctgaagc

SEQ ID NO: 134977 - DNA, 33 bp, Artificial Sequence
  Description of Artificial Sequence: Synthetic oligonucleotide
tcgtcgacagcttgacaaaagtaagctgaagcc

SEQ ID NO: 134978 - DNA, 32 bp, Artificial Sequence
  Description of Artificial Sequence: Synthetic oligonucleotide
cgtcgacagcttgacaaaagtaagctgaagcc

SEQ ID NO: 134979 - DNA, 33 bp, Artificial Sequence
  Description of Artificial Sequence: Synthetic oligonucleotide
gtcgacagcttgacaaaagtaagctgaagccag

SEQ ID NO: 134980 - DNA, 33 bp, Artificial Sequence
  Description of Artificial Sequence: Synthetic oligonucleotide
tcgacagcttgacaaaagtaagctgaagccagg

SEQ ID NO: 134981 - DNA, 32 bp, Artificial Sequence
  Description of Artificial Sequence: Synthetic oligonucleotide
cgacagcttgacaaaagtaagctgaagccagg

SEQ ID NO: 134982 - DNA, 34 bp, Artificial Sequence
  Description of Artificial Sequence: Synthetic oligonucleotide
gacagcttgacaaaagtaagctgaagccaggaac

SEQ ID NO: 134983 - DNA, 36 bp, Artificial Sequence
  Description of Artificial Sequence: Synthetic oligonucleotide
acagcttgacaaaagtaagctgaagccaggaacaag

SEQ ID NO: 134984 - DNA, 35 bp, Artificial Sequence
  Description of Artificial Sequence: Synthetic oligonucleotide
cagcttgacaaaagtaagctgaagccaggaacaag

SEQ ID NO: 134985 - DNA, 36 bp, Artificial Sequence
  Description of Artificial Sequence: Synthetic oligonucleotide
agcttgacaaaagtaagctgaagccaggaacaagag

SEQ ID NO: 134986 - DNA, 35 bp, Artificial Sequence
  Description of Artificial Sequence: Synthetic oligonucleotide
gcttgacaaaagtaagctgaagccaggaacaagag

SEQ ID NO: 134987 - DNA, 37 bp, Artificial Sequence
  Description of Artificial Sequence: Synthetic oligonucleotide
cttgacaaaagtaagctgaagccaggaacaagagttg

SEQ ID NO: 134988 - DNA, 37 bp, Artificial Sequence
  Description of Artificial Sequence: Synthetic oligonucleotide
ttgacaaaagtaagctgaagccaggaacaagagttgc

SEQ ID NO: 134989 - DNA, 36 bp, Artificial Sequence
  Description of Artificial Sequence: Synthetic oligonucleotide
tgacaaaagtaagctgaagccaggaacaagagttgc

SEQ ID NO: 134990 - DNA, 35 bp, Artificial Sequence
  Description of Artificial Sequence: Synthetic oligonucleotide
gacaaaagtaagctgaagccaggaacaagagttgc

SEQ ID NO: 134991 - DNA, 38 bp, Artificial Sequence
  Description of Artificial Sequence: Synthetic oligonucleotide
acaaaagtaagctgaagccaggaacaagagttgctttg

SEQ ID NO: 134992 - DNA, 37 bp, Artificial Sequence
  Description of Artificial Sequence: Synthetic oligonucleotide
caaaagtaagctgaagccaggaacaagagttgctttg

SEQ ID NO: 134993 - DNA, 37 bp, Artificial Sequence
  Description of Artificial Sequence: Synthetic oligonucleotide
aaaagtaagctgaagccaggaacaagagttgctttgg

SEQ ID NO: 134994 - DNA, 36 bp, Artificial Sequence
  Description of Artificial Sequence: Synthetic oligonucleotide
aaagtaagctgaagccaggaacaagagttgctttgg

SEQ ID NO: 134995 - DNA, 35 bp, Artificial Sequence
  Description of Artificial Sequence: Synthetic oligonucleotide
aagtaagctgaagccaggaacaagagttgctttgg

SEQ ID NO: 134996 - DNA, 34 bp, Artificial Sequence
  Description of Artificial Sequence: Synthetic oligonucleotide
agtaagctgaagccaggaacaagagttgctttgg

SEQ ID NO: 134997 - DNA, 33 bp, Artificial Sequence
  Description of Artificial Sequence: Synthetic oligonucleotide
gtaagctgaagccaggaacaagagttgctttgg

SEQ ID NO: 134998 - DNA, 37 bp, Artificial Sequence
  Description of Artificial Sequence: Synthetic oligonucleotide
taagctgaagccaggaacaagagttgctttggatatg

SEQ ID NO: 134999 - DNA, 36 bp, Artificial Sequence
  Description of Artificial Sequence: Synthetic oligonucleotide
aagctgaagccaggaacaagagttgctttggatatg

SEQ ID NO: 135000 - DNA, 35 bp, Artificial Sequence
  Description of Artificial Sequence: Synthetic oligonucleotide
agctgaagccaggaacaagagttgctttggatatg

SEQ ID NO: 135001 - DNA, 34 bp, Artificial Sequence
  Description of Artificial Sequence: Synthetic oligonucleotide
gctgaagccaggaacaagagttgctttggatatg

SEQ ID NO: 135002 - DNA, 35 bp, Artificial Sequence
  Description of Artificial Sequence: Synthetic oligonucleotide
ctgaagccaggaacaagagttgctttggatatgac

SEQ ID NO: 135003 - DNA, 37 bp, Artificial Sequence
  Description of Artificial Sequence: Synthetic oligonucleotide
tgaagccaggaacaagagttgctttggatatgactac

SEQ ID NO: 135004 - DNA, 36 bp, Artificial Sequence
  Description of Artificial Sequence: Synthetic oligonucleotide
gaagccaggaacaagagttgctttggatatgactac

SEQ ID NO: 135005 - DNA, 37 bp, Artificial Sequence
  Description of Artificial Sequence: Synthetic oligonucleotide
aagccaggaacaagagttgctttggatatgactacac

SEQ ID NO: 135006 - DNA, 36 bp, Artificial Sequence
  Description of Artificial Sequence: Synthetic oligonucleotide
agccaggaacaagagttgctttggatatgactacac

SEQ ID NO: 135007 - DNA, 35 bp, Artificial Sequence
  Description of Artificial Sequence: Synthetic oligonucleotide
gccaggaacaagagttgctttggatatgactacac

SEQ ID NO: 135008 - DNA, 38 bp, Artificial Sequence
  Description of Artificial Sequence: Synthetic oligonucleotide
ccaggaacaagagttgctttggatatgactacactaac

SEQ ID NO: 135009 - DNA, 41 bp, Artificial Sequence
  Description of Artificial Sequence: Synthetic oligonucleotide
caggaacaagagttgctttggatatgactacactaactatc

SEQ ID NO: 135010 - DNA, 43 bp, Artificial Sequence
  Description of Artificial Sequence: Synthetic oligonucleotide
aggaacaagagttgctttggatatgactacactaactatcatg

SEQ ID NO: 135011 - DNA, 42 bp, Artificial Sequence
  Description of Artificial Sequence: Synthetic oligonucleotide
ggaacaagagttgctttggatatgactacactaactatcatg

SEQ ID NO: 135012 - DNA, 43 bp, Artificial Sequence
  Description of Artificial Sequence: Synthetic oligonucleotide
gaacaagagttgctttggatatgactacactaactatcatgag

SEQ ID NO: 135013 - DNA, 49 bp, Artificial Sequence
  Description of Artificial Sequence: Synthetic oligonucleotide
aacaagagttgctttggatatgactacactaactatcatgagatatttg

SEQ ID NO: 135014 - DNA, 48 bp, Artificial Sequence
  Description of Artificial Sequence: Synthetic oligonucleotide
acaagagttgctttggatatgactacactaactatcatgagatatttg

SEQ ID NO: 135015 - DNA, 47 bp, Artificial Sequence
  Description of Artificial Sequence: Synthetic oligonucleotide
caagagttgctttggatatgactacactaactatcatgagatatttg

SEQ ID NO: 135016 - DNA, 47 bp, Artificial Sequence
  Description of Artificial Sequence: Synthetic oligonucleotide
aagagttgctttggatatgactacactaactatcatgagatatttgc

SEQ ID NO: 135017 - DNA, 46 bp, Artificial Sequence
  Description of Artificial Sequence: Synthetic oligonucleotide
agagttgctttggatatgactacactaactatcatgagatatttgc

SEQ ID NO: 135018 - DNA, 45 bp, Artificial Sequence
  Description of Artificial Sequence: Synthetic oligonucleotide
gagttgctttggatatgactacactaactatcatgagatatttgc

SEQ ID NO: 135019 - DNA, 45 bp, Artificial Sequence
  Description of Artificial Sequence: Synthetic oligonucleotide
agttgctttggatatgactacactaactatcatgagatatttgcc

SEQ ID NO: 135020 - DNA, 44 bp, Artificial Sequence
  Description of Artificial Sequence: Synthetic oligonucleotide
gttgctttggatatgactacactaactatcatgagatatttgcc

SEQ ID NO: 135021 - DNA, 44 bp, Artificial Sequence
  Description of Artificial Sequence: Synthetic oligonucleotide
ttgctttggatatgactacactaactatcatgagatatttgccg

SEQ ID NO: 135022 - DNA, 43 bp, Artificial Sequence
  Description of Artificial Sequence: Synthetic oligonucleotide
tgctttggatatgactacactaactatcatgagatatttgccg

SEQ ID NO: 135023 - DNA, 42 bp, Artificial Sequence
  Description of Artificial Sequence: Synthetic oligonucleotide
gctttggatatgactacactaactatcatgagatatttgccg

SEQ ID NO: 135024 - DNA, 43 bp, Artificial Sequence
  Description of Artificial Sequence: Synthetic oligonucleotide
ctttggatatgactacactaactatcatgagatatttgccgag

SEQ ID NO: 135025 - DNA, 44 bp, Artificial Sequence
  Description of Artificial Sequence: Synthetic oligonucleotide
tttggatatgactacactaactatcatgagatatttgccgagag

SEQ ID NO: 135026 - DNA, 43 bp, Artificial Sequence
  Description of Artificial Sequence: Synthetic oligonucleotide
ttggatatgactacactaactatcatgagatatttgccgagag

SEQ ID NO: 135027 - DNA, 42 bp, Artificial Sequence
  Description of Artificial Sequence: Synthetic oligonucleotide
tggatatgactacactaactatcatgagatatttgccgagag

SEQ ID NO: 135028 - DNA, 41 bp, Artificial Sequence
  Description of Artificial Sequence: Synthetic oligonucleotide
ggatatgactacactaactatcatgagatatttgccgagag

SEQ ID NO: 135029 - DNA, 42 bp, Artificial Sequence
  Description of Artificial Sequence: Synthetic oligonucleotide
gatatgactacactaactatcatgagatatttgccgagagag

SEQ ID NO: 135030 - DNA, 42 bp, Artificial Sequence
  Description of Artificial Sequence: Synthetic oligonucleotide
atatgactacactaactatcatgagatatttgccgagagagg

SEQ ID NO: 135031 - DNA, 41 bp, Artificial Sequence
  Description of Artificial Sequence: Synthetic oligonucleotide
tatgactacactaactatcatgagatatttgccgagagagg

SEQ ID NO: 135032 - DNA, 40 bp, Artificial Sequence
  Description of Artificial Sequence: Synthetic oligonucleotide
atgactacactaactatcatgagatatttgccgagagagg

SEQ ID NO: 135033 - DNA, 39 bp, Artificial Sequence
  Description of Artificial Sequence: Synthetic oligonucleotide
tgactacactaactatcatgagatatttgccgagagagg

SEQ ID NO: 135034 - DNA, 38 bp, Artificial Sequence
  Description of Artificial Sequence: Synthetic oligonucleotide
gactacactaactatcatgagatatttgccgagagagg

SEQ ID NO: 135035 - DNA, 39 bp, Artificial Sequence
  Description of Artificial Sequence: Synthetic oligonucleotide
actacactaactatcatgagatatttgccgagagaggtg

SEQ ID NO: 135036 - DNA, 38 bp, Artificial Sequence
  Description of Artificial Sequence: Synthetic oligonucleotide
ctacactaactatcatgagatatttgccgagagaggtg

SEQ ID NO: 135037 - DNA, 38 bp, Artificial Sequence
  Description of Artificial Sequence: Synthetic oligonucleotide
tacactaactatcatgagatatttgccgagagaggtgg

SEQ ID NO: 135038 - DNA, 37 bp, Artificial Sequence
  Description of Artificial Sequence: Synthetic oligonucleotide
acactaactatcatgagatatttgccgagagaggtgg

SEQ ID NO: 135039 - DNA, 36 bp, Artificial Sequence
  Description of Artificial Sequence: Synthetic oligonucleotide
cactaactatcatgagatatttgccgagagaggtgg

SEQ ID NO: 135040 - DNA, 38 bp, Artificial Sequence
  Description of Artificial Sequence: Synthetic oligonucleotide
actaactatcatgagatatttgccgagagaggtggatc

SEQ ID NO: 135041 - DNA, 37 bp, Artificial Sequence
  Description of Artificial Sequence: Synthetic oligonucleotide
ctaactatcatgagatatttgccgagagaggtggatc

SEQ ID NO: 135042 - DNA, 37 bp, Artificial Sequence
  Description of Artificial Sequence: Synthetic oligonucleotide
taactatcatgagatatttgccgagagaggtggatcc

SEQ ID NO: 135043 - DNA, 36 bp, Artificial Sequence
  Description of Artificial Sequence: Synthetic oligonucleotide
aactatcatgagatatttgccgagagaggtggatcc

SEQ ID NO: 135044 - DNA, 35 bp, Artificial Sequence
  Description of Artificial Sequence: Synthetic oligonucleotide
actatcatgagatatttgccgagagaggtggatcc

SEQ ID NO: 135045 - DNA, 34 bp, Artificial Sequence
  Description of Artificial Sequence: Synthetic oligonucleotide
ctatcatgagatatttgccgagagaggtggatcc

SEQ ID NO: 135046 - DNA, 35 bp, Artificial Sequence
  Description of Artificial Sequence: Synthetic oligonucleotide
tatcatgagatatttgccgagagaggtggatccac

SEQ ID NO: 135047 - DNA, 34 bp, Artificial Sequence
  Description of Artificial Sequence: Synthetic oligonucleotide
atcatgagatatttgccgagagaggtggatccac

SEQ ID NO: 135048 - DNA, 33 bp, Artificial Sequence
  Description of Artificial Sequence: Synthetic oligonucleotide
tcatgagatatttgccgagagaggtggatccac

SEQ ID NO: 135049 - DNA, 32 bp, Artificial Sequence
  Description of Artificial Sequence: Synthetic oligonucleotide
catgagatatttgccgagagaggtggatccac

SEQ ID NO: 135050 - DNA, 33 bp, Artificial Sequence
  Description of Artificial Sequence: Synthetic oligonucleotide
atgagatatttgccgagagaggtggatccactg

SEQ ID NO: 135051 - DNA, 32 bp, Artificial Sequence
  Description of Artificial Sequence: Synthetic oligonucleotide
tgagatatttgccgagagaggtggatccactg

SEQ ID NO: 135052 - DNA, 31 bp, Artificial Sequence
  Description of Artificial Sequence: Synthetic oligonucleotide
gagatatttgccgagagaggtggatccactg

SEQ ID NO: 135053 - DNA, 31 bp, Artificial Sequence
  Description of Artificial Sequence: Synthetic oligonucleotide
agatatttgccgagagaggtggatccactgg

SEQ ID NO: 135054 - DNA, 30 bp, Artificial Sequence
  Description of Artificial Sequence: Synthetic oligonucleotide
gatatttgccgagagaggtggatccactgg

SEQ ID NO: 135055 - DNA, 37 bp, Artificial Sequence
  Description of Artificial Sequence: Synthetic oligonucleotide
atatttgccgagagaggtggatccactggtttataac

SEQ ID NO: 135056 - DNA, 36 bp, Artificial Sequence
  Description of Artificial Sequence: Synthetic oligonucleotide
tatttgccgagagaggtggatccactggtttataac

SEQ ID NO: 135057 - DNA, 35 bp, Artificial Sequence
  Description of Artificial Sequence: Synthetic oligonucleotide
atttgccgagagaggtggatccactggtttataac

SEQ ID NO: 135058 - DNA, 34 bp, Artificial Sequence
  Description of Artificial Sequence: Synthetic oligonucleotide
tttgccgagagaggtggatccactggtttataac

SEQ ID NO: 135059 - DNA, 33 bp, Artificial Sequence
  Description of Artificial Sequence: Synthetic oligonucleotide
ttgccgagagaggtggatccactggtttataac

SEQ ID NO: 135060 - DNA, 32 bp, Artificial Sequence
  Description of Artificial Sequence: Synthetic oligonucleotide
tgccgagagaggtggatccactggtttataac

SEQ ID NO: 135061 - DNA, 31 bp, Artificial Sequence
  Description of Artificial Sequence: Synthetic oligonucleotide
gccgagagaggtggatccactggtttataac

SEQ ID NO: 135062 - DNA, 33 bp, Artificial Sequence
  Description of Artificial Sequence: Synthetic oligonucleotide
ccgagagaggtggatccactggtttataacatg

SEQ ID NO: 135063 - DNA, 34 bp, Artificial Sequence
  Description of Artificial Sequence: Synthetic oligonucleotide
cgagagaggtggatccactggtttataacatgtc

SEQ ID NO: 135064 - DNA, 35 bp, Artificial Sequence
  Description of Artificial Sequence: Synthetic oligonucleotide
gagagaggtggatccactggtttataacatgtctc

SEQ ID NO: 135065 - DNA, 37 bp, Artificial Sequence
  Description of Artificial Sequence: Synthetic oligonucleotide
agagaggtggatccactggtttataacatgtctcatg

SEQ ID NO: 135066 - DNA, 36 bp, Artificial Sequence
  Description of Artificial Sequence: Synthetic oligonucleotide
gagaggtggatccactggtttataacatgtctcatg

SEQ ID NO: 135067 - DNA, 37 bp, Artificial Sequence
  Description of Artificial Sequence: Synthetic oligonucleotide
agaggtggatccactggtttataacatgtctcatgag

SEQ ID NO: 135068 - DNA, 36 bp, Artificial Sequence
  Description of Artificial Sequence: Synthetic oligonucleotide
gaggtggatccactggtttataacatgtctcatgag

SEQ ID NO: 135069 - DNA, 36 bp, Artificial Sequence
  Description of Artificial Sequence: Synthetic oligonucleotide
aggtggatccactggtttataacatgtctcatgagg

SEQ ID NO: 135070 - DNA, 35 bp, Artificial Sequence
  Description of Artificial Sequence: Synthetic oligonucleotide
ggtggatccactggtttataacatgtctcatgagg

SEQ ID NO: 135071 - DNA, 36 bp, Artificial Sequence
  Description of Artificial Sequence: Synthetic oligonucleotide
gtggatccactggtttataacatgtctcatgaggac

SEQ ID NO: 135072 - DNA, 36 bp, Artificial Sequence
  Description of Artificial Sequence: Synthetic oligonucleotide
tggatccactggtttataacatgtctcatgaggacc

SEQ ID NO: 135073 - DNA, 35 bp, Artificial Sequence
  Description of Artificial Sequence: Synthetic oligonucleotide
ggatccactggtttataacatgtctcatgaggacc

SEQ ID NO: 135074 - DNA, 35 bp, Artificial Sequence
  Description of Artificial Sequence: Synthetic oligonucleotide
gatccactggtttataacatgtctcatgaggaccc

SEQ ID NO: 135075 - DNA, 36 bp, Artificial Sequence
  Description of Artificial Sequence: Synthetic oligonucleotide
atccactggtttataacatgtctcatgaggaccctg

SEQ ID NO: 135076 - DNA, 35 bp, Artificial Sequence
  Description of Artificial Sequence: Synthetic oligonucleotide
tccactggtttataacatgtctcatgaggaccctg

SEQ ID NO: 135077 - DNA, 34 bp, Artificial Sequence
  Description of Artificial Sequence: Synthetic oligonucleotide
ccactggtttataacatgtctcatgaggaccctg

SEQ ID NO: 135078 - DNA, 34 bp, Artificial Sequence
  Description of Artificial Sequence: Synthetic oligonucleotide
cactggtttataacatgtctcatgaggaccctgg

SEQ ID NO: 135079 - DNA, 34 bp, Artificial Sequence
  Description of Artificial Sequence: Synthetic oligonucleotide
actggtttataacatgtctcatgaggaccctggg

SEQ ID NO: 135080 - DNA, 33 bp, Artificial Sequence
  Description of Artificial Sequence: Synthetic oligonucleotide
ctggtttataacatgtctcatgaggaccctggg

SEQ ID NO: 135081 - DNA, 36 bp, Artificial Sequence
  Description of Artificial Sequence: Synthetic oligonucleotide
tggtttataacatgtctcatgaggaccctgggaatg

SEQ ID NO: 135082 - DNA, 35 bp, Artificial Sequence
  Description of Artificial Sequence: Synthetic oligonucleotide
ggtttataacatgtctcatgaggaccctgggaatg

SEQ ID NO: 135083 - DNA, 38 bp, Artificial Sequence
  Description of Artificial Sequence: Synthetic oligonucleotide
gtttataacatgtctcatgaggaccctgggaatgtttc

SEQ ID NO: 135084 - DNA, 43 bp, Artificial Sequence
  Description of Artificial Sequence: Synthetic oligonucleotide
tttataacatgtctcatgaggaccctgggaatgtttcttattc

SEQ ID NO: 135085 - DNA, 42 bp, Artificial Sequence
  Description of Artificial Sequence: Synthetic oligonucleotide
ttataacatgtctcatgaggaccctgggaatgtttcttattc

SEQ ID NO: 135086 - DNA, 41 bp, Artificial Sequence
  Description of Artificial Sequence: Synthetic oligonucleotide
tataacatgtctcatgaggaccctgggaatgtttcttattc

SEQ ID NO: 135087 - DNA, 40 bp, Artificial Sequence
  Description of Artificial Sequence: Synthetic oligonucleotide
ataacatgtctcatgaggaccctgggaatgtttcttattc

SEQ ID NO: 135088 - DNA, 39 bp, Artificial Sequence
  Description of Artificial Sequence: Synthetic oligonucleotide
taacatgtctcatgaggaccctgggaatgtttcttattc

SEQ ID NO: 135089 - DNA, 38 bp, Artificial Sequence
  Description of Artificial Sequence: Synthetic oligonucleotide
aacatgtctcatgaggaccctgggaatgtttcttattc

SEQ ID NO: 135090 - DNA, 37 bp, Artificial Sequence
  Description of Artificial Sequence: Synthetic oligonucleotide
acatgtctcatgaggaccctgggaatgtttcttattc

SEQ ID NO: 135091 - DNA, 36 bp, Artificial Sequence
  Description of Artificial Sequence: Synthetic oligonucleotide
catgtctcatgaggaccctgggaatgtttcttattc

SEQ ID NO: 135092 - DNA, 37 bp, Artificial Sequence
  Description of Artificial Sequence: Synthetic oligonucleotide
atgtctcatgaggaccctgggaatgtttcttattctg

SEQ ID NO: 135093 - DNA, 36 bp, Artificial Sequence
  Description of Artificial Sequence: Synthetic oligonucleotide
tgtctcatgaggaccctgggaatgtttcttattctg

SEQ ID NO: 135094 - DNA, 35 bp, Artificial Sequence
  Description of Artificial Sequence: Synthetic oligonucleotide
gtctcatgaggaccctgggaatgtttcttattctg

SEQ ID NO: 135095 - DNA, 36 bp, Artificial Sequence
  Description of Artificial Sequence: Synthetic oligonucleotide
tctcatgaggaccctgggaatgtttcttattctgag

SEQ ID NO: 135096 - DNA, 35 bp, Artificial Sequence
  Description of Artificial Sequence: Synthetic oligonucleotide
ctcatgaggaccctgggaatgtttcttattctgag

SEQ ID NO: 135097 - DNA, 38 bp, Artificial Sequence
  Description of Artificial Sequence: Synthetic oligonucleotide
tcatgaggaccctgggaatgtttcttattctgagattg

SEQ ID NO: 135098 - DNA, 37 bp, Artificial Sequence
  Description of Artificial Sequence: Synthetic oligonucleotide
catgaggaccctgggaatgtttcttattctgagattg

SEQ ID NO: 135099 - DNA, 37 bp, Artificial Sequence
  Description of Artificial Sequence: Synthetic oligonucleotide
atgaggaccctgggaatgtttcttattctgagattgg

SEQ ID NO: 135100 - DNA, 36 bp, Artificial Sequence
  Description of Artificial Sequence: Synthetic oligonucleotide
tgaggaccctgggaatgtttcttattctgagattgg

SEQ ID NO: 135101 - DNA, 35 bp, Artificial Sequence
  Description of Artificial Sequence: Synthetic oligonucleotide
gaggaccctgggaatgtttcttattctgagattgg

SEQ ID NO: 135102 - DNA, 36 bp, Artificial Sequence
  Description of Artificial Sequence: Synthetic oligonucleotide
aggaccctgggaatgtttcttattctgagattggag

SEQ ID NO: 135103 - DNA, 35 bp, Artificial Sequence
  Description of Artificial Sequence: Synthetic oligonucleotide
ggaccctgggaatgtttcttattctgagattggag

SEQ ID NO: 135104 - DNA, 35 bp, Artificial Sequence
  Description of Artificial Sequence: Synthetic oligonucleotide
gaccctgggaatgtttcttattctgagattggagg

SEQ ID NO: 135105 - DNA, 35 bp, Artificial Sequence
  Description of Artificial Sequence: Synthetic oligonucleotide
accctgggaatgtttcttattctgagattggaggg

SEQ ID NO: 135106 - DNA, 34 bp, Artificial Sequence
  Description of Artificial Sequence: Synthetic oligonucleotide
ccctgggaatgtttcttattctgagattggaggg

SEQ ID NO: 135107 - DNA, 34 bp, Artificial Sequence
  Description of Artificial Sequence: Synthetic oligonucleotide
cctgggaatgtttcttattctgagattggagggc

SEQ ID NO: 135108 - DNA, 37 bp, Artificial Sequence
  Description of Artificial Sequence: Synthetic oligonucleotide
ctgggaatgtttcttattctgagattggagggctatc

SEQ ID NO: 135109 - DNA, 38 bp, Artificial Sequence
  Description of Artificial Sequence: Synthetic oligonucleotide
tgggaatgtttcttattctgagattggagggctatcag

SEQ ID NO: 135110 - DNA, 37 bp, Artificial Sequence
  Description of Artificial Sequence: Synthetic oligonucleotide
gggaatgtttcttattctgagattggagggctatcag

SEQ ID NO: 135111 - DNA, 39 bp, Artificial Sequence
  Description of Artificial Sequence: Synthetic oligonucleotide
ggaatgtttcttattctgagattggagggctatcagaac

SEQ ID NO: 135112 - DNA, 40 bp, Artificial Sequence
  Description of Artificial Sequence: Synthetic oligonucleotide
gaatgtttcttattctgagattggagggctatcagaacag

SEQ ID NO: 135113 - DNA, 42 bp, Artificial Sequence
  Description of Artificial Sequence: Synthetic oligonucleotide
aatgtttcttattctgagattggagggctatcagaacagatc

SEQ ID NO: 135114 - DNA, 41 bp, Artificial Sequence
  Description of Artificial Sequence: Synthetic oligonucleotide
atgtttcttattctgagattggagggctatcagaacagatc

SEQ ID NO: 135115 - DNA, 40 bp, Artificial Sequence
  Description of Artificial Sequence: Synthetic oligonucleotide
tgtttcttattctgagattggagggctatcagaacagatc

SEQ ID NO: 135116 - DNA, 39 bp, Artificial Sequence
  Description of Artificial Sequence: Synthetic oligonucleotide
gtttcttattctgagattggagggctatcagaacagatc

SEQ ID NO: 135117 - DNA, 39 bp, Artificial Sequence
  Description of Artificial Sequence: Synthetic oligonucleotide
tttcttattctgagattggagggctatcagaacagatcc

SEQ ID NO: 135118 - DNA, 38 bp, Artificial Sequence
  Description of Artificial Sequence: Synthetic oligonucleotide
ttcttattctgagattggagggctatcagaacagatcc

SEQ ID NO: 135119 - DNA, 37 bp, Artificial Sequence
  Description of Artificial Sequence: Synthetic oligonucleotide
tcttattctgagattggagggctatcagaacagatcc

SEQ ID NO: 135120 - DNA, 36 bp, Artificial Sequence
  Description of Artificial Sequence: Synthetic oligonucleotide
cttattctgagattggagggctatcagaacagatcc

SEQ ID NO: 135121 - DNA, 36 bp, Artificial Sequence
  Description of Artificial Sequence: Synthetic oligonucleotide
ttattctgagattggagggctatcagaacagatccg

SEQ ID NO: 135122 - DNA, 35 bp, Artificial Sequence
  Description of Artificial Sequence: Synthetic oligonucleotide
tattctgagattggagggctatcagaacagatccg

SEQ ID NO: 135123 - DNA, 34 bp, Artificial Sequence
  Description of Artificial Sequence: Synthetic oligonucleotide
attctgagattggagggctatcagaacagatccg

SEQ ID NO: 135124 - DNA, 33 bp, Artificial Sequence
  Description of Artificial Sequence: Synthetic oligonucleotide
ttctgagattggagggctatcagaacagatccg

SEQ ID NO: 135125 - DNA, 32 bp, Artificial Sequence
  Description of Artificial Sequence: Synthetic oligonucleotide
tctgagattggagggctatcagaacagatccg

SEQ ID NO: 135126 - DNA, 31 bp, Artificial Sequence
  Description of Artificial Sequence: Synthetic oligonucleotide
ctgagattggagggctatcagaacagatccg

SEQ ID NO: 135127 - DNA, 31 bp, Artificial Sequence
  Description of Artificial Sequence: Synthetic oligonucleotide
tgagattggagggctatcagaacagatccgg

SEQ ID NO: 135128 - DNA, 30 bp, Artificial Sequence
  Description of Artificial Sequence: Synthetic oligonucleotide
gagattggagggctatcagaacagatccgg

SEQ ID NO: 135129 - DNA, 30 bp, Artificial Sequence
  Description of Artificial Sequence: Synthetic oligonucleotide
agattggagggctatcagaacagatccggg

SEQ ID NO: 135130 - DNA, 29 bp, Artificial Sequence
  Description of Artificial Sequence: Synthetic oligonucleotide
gattggagggctatcagaacagatccggg

SEQ ID NO: 135131 - DNA, 35 bp, Artificial Sequence
  Description of Artificial Sequence: Synthetic oligonucleotide
attggagggctatcagaacagatccgggaattaag

SEQ ID NO: 135132 - DNA, 34 bp, Artificial Sequence
  Description of Artificial Sequence: Synthetic oligonucleotide
ttggagggctatcagaacagatccgggaattaag

SEQ ID NO: 135133 - DNA, 33 bp, Artificial Sequence
  Description of Artificial Sequence: Synthetic oligonucleotide
tggagggctatcagaacagatccgggaattaag

SEQ ID NO: 135134 - DNA, 32 bp, Artificial Sequence
  Description of Artificial Sequence: Synthetic oligonucleotide
ggagggctatcagaacagatccgggaattaag

SEQ ID NO: 135135 - DNA, 33 bp, Artificial Sequence
  Description of Artificial Sequence: Synthetic oligonucleotide
gagggctatcagaacagatccgggaattaagag

SEQ ID NO: 135136 - DNA, 34 bp, Artificial Sequence
  Description of Artificial Sequence: Synthetic oligonucleotide
agggctatcagaacagatccgggaattaagagag

SEQ ID NO: 135137 - DNA, 33 bp, Artificial Sequence
  Description of Artificial Sequence: Synthetic oligonucleotide
gggctatcagaacagatccgggaattaagagag

SEQ ID NO: 135138 - DNA, 33 bp, Artificial Sequence
  Description of Artificial Sequence: Synthetic oligonucleotide
ggctatcagaacagatccgggaattaagagagg

SEQ ID NO: 135139 - DNA, 34 bp, Artificial Sequence
  Description of Artificial Sequence: Synthetic oligonucleotide
gctatcagaacagatccgggaattaagagaggtg

SEQ ID NO: 135140 - DNA, 37 bp, Artificial Sequence
  Description of Artificial Sequence: Synthetic oligonucleotide
ctatcagaacagatccgggaattaagagaggtgatag

SEQ ID NO: 135141 - DNA, 42 bp, Artificial Sequence
  Description of Artificial Sequence: Synthetic oligonucleotide
tatcagaacagatccgggaattaagagaggtgatagaattac

SEQ ID NO: 135142 - DNA, 41 bp, Artificial Sequence
  Description of Artificial Sequence: Synthetic oligonucleotide
atcagaacagatccgggaattaagagaggtgatagaattac

SEQ ID NO: 135143 - DNA, 40 bp, Artificial Sequence
  Description of Artificial Sequence: Synthetic oligonucleotide
tcagaacagatccgggaattaagagaggtgatagaattac

SEQ ID NO: 135144 - DNA, 39 bp, Artificial Sequence
  Description of Artificial Sequence: Synthetic oligonucleotide
cagaacagatccgggaattaagagaggtgatagaattac

SEQ ID NO: 135145 - DNA, 39 bp, Artificial Sequence
  Description of Artificial Sequence: Synthetic oligonucleotide
agaacagatccgggaattaagagaggtgatagaattacc

SEQ ID NO: 135146 - DNA, 38 bp, Artificial Sequence
  Description of Artificial Sequence: Synthetic oligonucleotide
gaacagatccgggaattaagagaggtgatagaattacc

SEQ ID NO: 135147 - DNA, 39 bp, Artificial Sequence
  Description of Artificial Sequence: Synthetic oligonucleotide
aacagatccgggaattaagagaggtgatagaattacctc

SEQ ID NO: 135148 - DNA, 38 bp, Artificial Sequence
  Description of Artificial Sequence: Synthetic oligonucleotide
acagatccgggaattaagagaggtgatagaattacctc

SEQ ID NO: 135149 - DNA, 37 bp, Artificial Sequence
  Description of Artificial Sequence: Synthetic oligonucleotide
cagatccgggaattaagagaggtgatagaattacctc

SEQ ID NO: 135150 - DNA, 40 bp, Artificial Sequence
  Description of Artificial Sequence: Synthetic oligonucleotide
agatccgggaattaagagaggtgatagaattacctcttac

SEQ ID NO: 135151 - DNA, 39 bp, Artificial Sequence
  Description of Artificial Sequence: Synthetic oligonucleotide
gatccgggaattaagagaggtgatagaattacctcttac

SEQ ID NO: 135152 - DNA, 42 bp, Artificial Sequence
  Description of Artificial Sequence: Synthetic oligonucleotide
atccgggaattaagagaggtgatagaattacctcttacaaac

SEQ ID NO: 135153 - DNA, 41 bp, Artificial Sequence
  Description of Artificial Sequence: Synthetic oligonucleotide
tccgggaattaagagaggtgatagaattacctcttacaaac

SEQ ID NO: 135154 - DNA, 40 bp, Artificial Sequence
  Description of Artificial Sequence: Synthetic oligonucleotide
ccgggaattaagagaggtgatagaattacctcttacaaac

SEQ ID NO: 135155 - DNA, 40 bp, Artificial Sequence
  Description of Artificial Sequence: Synthetic oligonucleotide
cgggaattaagagaggtgatagaattacctcttacaaacc

SEQ ID NO: 135156 - DNA, 40 bp, Artificial Sequence
  Description of Artificial Sequence: Synthetic oligonucleotide
gggaattaagagaggtgatagaattacctcttacaaaccc

SEQ ID NO: 135157 - DNA, 41 bp, Artificial Sequence
  Description of Artificial Sequence: Synthetic oligonucleotide
ggaattaagagaggtgatagaattacctcttacaaacccag

SEQ ID NO: 135158 - DNA, 42 bp, Artificial Sequence
  Description of Artificial Sequence: Synthetic oligonucleotide
gaattaagagaggtgatagaattacctcttacaaacccagag

SEQ ID NO: 135159 - DNA, 48 bp, Artificial Sequence
  Description of Artificial Sequence: Synthetic oligonucleotide
aattaagagaggtgatagaattacctcttacaaacccagagttatttc

SEQ ID NO: 135160 - DNA, 47 bp, Artificial Sequence
  Description of Artificial Sequence: Synthetic oligonucleotide
attaagagaggtgatagaattacctcttacaaacccagagttatttc

SEQ ID NO: 135161 - DNA, 46 bp, Artificial Sequence
  Description of Artificial Sequence: Synthetic oligonucleotide
ttaagagaggtgatagaattacctcttacaaacccagagttatttc

SEQ ID NO: 135162 - DNA, 45 bp, Artificial Sequence
  Description of Artificial Sequence: Synthetic oligonucleotide
taagagaggtgatagaattacctcttacaaacccagagttatttc

SEQ ID NO: 135163 - DNA, 44 bp, Artificial Sequence
  Description of Artificial Sequence: Synthetic oligonucleotide
aagagaggtgatagaattacctcttacaaacccagagttatttc

SEQ ID NO: 135164 - DNA, 43 bp, Artificial Sequence
  Description of Artificial Sequence: Synthetic oligonucleotide
agagaggtgatagaattacctcttacaaacccagagttatttc

SEQ ID NO: 135165 - DNA, 42 bp, Artificial Sequence
  Description of Artificial Sequence: Synthetic oligonucleotide
gagaggtgatagaattacctcttacaaacccagagttatttc

SEQ ID NO: 135166 - DNA, 43 bp, Artificial Sequence
  Description of Artificial Sequence: Synthetic oligonucleotide
agaggtgatagaattacctcttacaaacccagagttatttcag

SEQ ID NO: 135167 - DNA, 42 bp, Artificial Sequence
  Description of Artificial Sequence: Synthetic oligonucleotide
gaggtgatagaattacctcttacaaacccagagttatttcag

SEQ ID NO: 135168 - DNA, 42 bp, Artificial Sequence
  Description of Artificial Sequence: Synthetic oligonucleotide
aggtgatagaattacctcttacaaacccagagttatttcagc

SEQ ID NO: 135169 - DNA, 41 bp, Artificial Sequence
  Description of Artificial Sequence: Synthetic oligonucleotide
ggtgatagaattacctcttacaaacccagagttatttcagc

SEQ ID NO: 135170 - DNA, 41 bp, Artificial Sequence
  Description of Artificial Sequence: Synthetic oligonucleotide
gtgatagaattacctcttacaaacccagagttatttcagcg

SEQ ID NO: 135171 - DNA, 42 bp, Artificial Sequence
  Description of Artificial Sequence: Synthetic oligonucleotide
tgatagaattacctcttacaaacccagagttatttcagcgtg

SEQ ID NO: 135172 - DNA, 41 bp, Artificial Sequence
  Description of Artificial Sequence: Synthetic oligonucleotide
gatagaattacctcttacaaacccagagttatttcagcgtg

SEQ ID NO: 135173 - DNA, 43 bp, Artificial Sequence
  Description of Artificial Sequence: Synthetic oligonucleotide
atagaattacctcttacaaacccagagttatttcagcgtgtag

SEQ ID NO: 135174 - DNA, 42 bp, Artificial Sequence
  Description of Artificial Sequence: Synthetic oligonucleotide
tagaattacctcttacaaacccagagttatttcagcgtgtag

SEQ ID NO: 135175 - DNA, 41 bp, Artificial Sequence
  Description of Artificial Sequence: Synthetic oligonucleotide
agaattacctcttacaaacccagagttatttcagcgtgtag

SEQ ID NO: 135176 - DNA, 40 bp, Artificial Sequence
  Description of Artificial Sequence: Synthetic oligonucleotide
gaattacctcttacaaacccagagttatttcagcgtgtag

SEQ ID NO: 135177 - DNA, 40 bp, Artificial Sequence
  Description of Artificial Sequence: Synthetic oligonucleotide
aattacctcttacaaacccagagttatttcagcgtgtagg

SEQ ID NO: 135178 - DNA, 39 bp, Artificial Sequence
  Description of Artificial Sequence: Synthetic oligonucleotide
attacctcttacaaacccagagttatttcagcgtgtagg

SEQ ID NO: 135179 - DNA, 38 bp, Artificial Sequence
  Description of Artificial Sequence: Synthetic oligonucleotide
ttacctcttacaaacccagagttatttcagcgtgtagg

SEQ ID NO: 135180 - DNA, 37 bp, Artificial Sequence
  Description of Artificial Sequence: Synthetic oligonucleotide
tacctcttacaaacccagagttatttcagcgtgtagg

SEQ ID NO: 135181 - DNA, 36 bp, Artificial Sequence
  Description of Artificial Sequence: Synthetic oligonucleotide
acctcttacaaacccagagttatttcagcgtgtagg

SEQ ID NO: 135182 - DNA, 35 bp, Artificial Sequence
  Description of Artificial Sequence: Synthetic oligonucleotide
cctcttacaaacccagagttatttcagcgtgtagg

SEQ ID NO: 135183 - DNA, 42 bp, Artificial Sequence
  Description of Artificial Sequence: Synthetic oligonucleotide
ctcttacaaacccagagttatttcagcgtgtaggaataatac

SEQ ID NO: 135184 - DNA, 42 bp, Artificial Sequence
  Description of Artificial Sequence: Synthetic oligonucleotide
tcttacaaacccagagttatttcagcgtgtaggaataatacc

SEQ ID NO: 135185 - DNA, 41 bp, Artificial Sequence
  Description of Artificial Sequence: Synthetic oligonucleotide
cttacaaacccagagttatttcagcgtgtaggaataatacc

SEQ ID NO: 135186 - DNA, 42 bp, Artificial Sequence
  Description of Artificial Sequence: Synthetic oligonucleotide
ttacaaacccagagttatttcagcgtgtaggaataatacctc

SEQ ID NO: 135187 - DNA, 41 bp, Artificial Sequence
  Description of Artificial Sequence: Synthetic oligonucleotide
tacaaacccagagttatttcagcgtgtaggaataatacctc

SEQ ID NO: 135188 - DNA, 40 bp, Artificial Sequence
  Description of Artificial Sequence: Synthetic oligonucleotide
acaaacccagagttatttcagcgtgtaggaataatacctc

SEQ ID NO: 135189 - DNA, 39 bp, Artificial Sequence
  Description of Artificial Sequence: Synthetic oligonucleotide
caaacccagagttatttcagcgtgtaggaataatacctc

SEQ ID NO: 135190 - DNA, 39 bp, Artificial Sequence
  Description of Artificial Sequence: Synthetic oligonucleotide
aaacccagagttatttcagcgtgtaggaataatacctcc

SEQ ID NO: 135191 - DNA, 38 bp, Artificial Sequence
  Description of Artificial Sequence: Synthetic oligonucleotide
aacccagagttatttcagcgtgtaggaataatacctcc

SEQ ID NO: 135192 - DNA, 37 bp, Artificial Sequence
  Description of Artificial Sequence: Synthetic oligonucleotide
acccagagttatttcagcgtgtaggaataatacctcc

SEQ ID NO: 135193 - DNA, 36 bp, Artificial Sequence
  Description of Artificial Sequence: Synthetic oligonucleotide
cccagagttatttcagcgtgtaggaataatacctcc

SEQ ID NO: 135194 - DNA, 40 bp, Artificial Sequence
  Description of Artificial Sequence: Synthetic oligonucleotide
ccagagttatttcagcgtgtaggaataatacctccaaaag

SEQ ID NO: 135195 - DNA, 40 bp, Artificial Sequence
  Description of Artificial Sequence: Synthetic oligonucleotide
cagagttatttcagcgtgtaggaataatacctccaaaagg

SEQ ID NO: 135196 - DNA, 40 bp, Artificial Sequence
  Description of Artificial Sequence: Synthetic oligonucleotide
agagttatttcagcgtgtaggaataatacctccaaaaggc

SEQ ID NO: 135197 - DNA, 39 bp, Artificial Sequence
  Description of Artificial Sequence: Synthetic oligonucleotide
gagttatttcagcgtgtaggaataatacctccaaaaggc

SEQ ID NO: 135198 - DNA, 40 bp, Artificial Sequence
  Description of Artificial Sequence: Synthetic oligonucleotide
agttatttcagcgtgtaggaataatacctccaaaaggctg

SEQ ID NO: 135199 - DNA, 39 bp, Artificial Sequence
  Description of Artificial Sequence: Synthetic oligonucleotide
gttatttcagcgtgtaggaataatacctccaaaaggctg

SEQ ID NO: 135200 - DNA, 42 bp, Artificial Sequence
  Description of Artificial Sequence: Synthetic oligonucleotide
ttatttcagcgtgtaggaataatacctccaaaaggctgtttg

SEQ ID NO: 135201 - DNA, 41 bp, Artificial Sequence
  Description of Artificial Sequence: Synthetic oligonucleotide
tatttcagcgtgtaggaataatacctccaaaaggctgtttg

SEQ ID NO: 135202 - DNA, 40 bp, Artificial Sequence
  Description of Artificial Sequence: Synthetic oligonucleotide
atttcagcgtgtaggaataatacctccaaaaggctgtttg

SEQ ID NO: 135203 - DNA, 39 bp, Artificial Sequence
  Description of Artificial Sequence: Synthetic oligonucleotide
tttcagcgtgtaggaataatacctccaaaaggctgtttg

SEQ ID NO: 135204 - DNA, 38 bp, Artificial Sequence
  Description of Artificial Sequence: Synthetic oligonucleotide
ttcagcgtgtaggaataatacctccaaaaggctgtttg

SEQ ID NO: 135205 - DNA, 37 bp, Artificial Sequence
  Description of Artificial Sequence: Synthetic oligonucleotide
tcagcgtgtaggaataatacctccaaaaggctgtttg

SEQ ID NO: 135206 - DNA, 36 bp, Artificial Sequence
  Description of Artificial Sequence: Synthetic oligonucleotide
cagcgtgtaggaataatacctccaaaaggctgtttg

SEQ ID NO: 135207 - DNA, 42 bp, Artificial Sequence
  Description of Artificial Sequence: Synthetic oligonucleotide
agcgtgtaggaataatacctccaaaaggctgtttgttatatg

SEQ ID NO: 135208 - DNA, 41 bp, Artificial Sequence
  Description of Artificial Sequence: Synthetic oligonucleotide
gcgtgtaggaataatacctccaaaaggctgtttgttatatg

SEQ ID NO: 135209 - DNA, 41 bp, Artificial Sequence
  Description of Artificial Sequence: Synthetic oligonucleotide
cgtgtaggaataatacctccaaaaggctgtttgttatatgg

SEQ ID NO: 135210 - DNA, 42 bp, Artificial Sequence
  Description of Artificial Sequence: Synthetic oligonucleotide
gtgtaggaataatacctccaaaaggctgtttgttatatggac

SEQ ID NO: 135211 - DNA, 42 bp, Artificial Sequence
  Description of Artificial Sequence: Synthetic oligonucleotide
tgtaggaataatacctccaaaaggctgtttgttatatggacc

SEQ ID NO: 135212 - DNA, 41 bp, Artificial Sequence
  Description of Artificial Sequence: Synthetic oligonucleotide
gtaggaataatacctccaaaaggctgtttgttatatggacc

SEQ ID NO: 135213 - DNA, 42 bp, Artificial Sequence
  Description of Artificial Sequence: Synthetic oligonucleotide
taggaataatacctccaaaaggctgtttgttatatggaccac

SEQ ID NO: 135214 - DNA, 41 bp, Artificial Sequence
  Description of Artificial Sequence: Synthetic oligonucleotide
aggaataatacctccaaaaggctgtttgttatatggaccac

SEQ ID NO: 135215 - DNA, 40 bp, Artificial Sequence
  Description of Artificial Sequence: Synthetic oligonucleotide
ggaataatacctccaaaaggctgtttgttatatggaccac

SEQ ID NO: 135216 - DNA, 40 bp, Artificial Sequence
  Description of Artificial Sequence: Synthetic oligonucleotide
gaataatacctccaaaaggctgtttgttatatggaccacc

SEQ ID NO: 135217 - DNA, 41 bp, Artificial Sequence
  Description of Artificial Sequence: Synthetic oligonucleotide
aataatacctccaaaaggctgtttgttatatggaccaccag

SEQ ID NO: 135218 - DNA, 40 bp, Artificial Sequence
  Description of Artificial Sequence: Synthetic oligonucleotide
ataatacctccaaaaggctgtttgttatatggaccaccag

SEQ ID NO: 135219 - DNA, 39 bp, Artificial Sequence
  Description of Artificial Sequence: Synthetic oligonucleotide
taatacctccaaaaggctgtttgttatatggaccaccag

SEQ ID NO: 135220 - DNA, 38 bp, Artificial Sequence
  Description of Artificial Sequence: Synthetic oligonucleotide
aatacctccaaaaggctgtttgttatatggaccaccag

SEQ ID NO: 135221 - DNA, 37 bp, Artificial Sequence
  Description of Artificial Sequence: Synthetic oligonucleotide
atacctccaaaaggctgtttgttatatggaccaccag

SEQ ID NO: 135222 - DNA, 36 bp, Artificial Sequence
  Description of Artificial Sequence: Synthetic oligonucleotide
tacctccaaaaggctgtttgttatatggaccaccag

SEQ ID NO: 135223 - DNA, 35 bp, Artificial Sequence
  Description of Artificial Sequence: Synthetic oligonucleotide
acctccaaaaggctgtttgttatatggaccaccag

SEQ ID NO: 135224 - DNA, 34 bp, Artificial Sequence
  Description of Artificial Sequence: Synthetic oligonucleotide
cctccaaaaggctgtttgttatatggaccaccag

SEQ ID NO: 135225 - DNA, 34 bp, Artificial Sequence
  Description of Artificial Sequence: Synthetic oligonucleotide
ctccaaaaggctgtttgttatatggaccaccagg

SEQ ID NO: 135226 - DNA, 36 bp, Artificial Sequence
  Description of Artificial Sequence: Synthetic oligonucleotide
tccaaaaggctgtttgttatatggaccaccaggtac

SEQ ID NO: 135227 - DNA, 35 bp, Artificial Sequence
  Description of Artificial Sequence: Synthetic oligonucleotide
ccaaaaggctgtttgttatatggaccaccaggtac

SEQ ID NO: 135228 - DNA, 35 bp, Artificial Sequence
  Description of Artificial Sequence: Synthetic oligonucleotide
caaaaggctgtttgttatatggaccaccaggtacg

SEQ ID NO: 135229 - DNA, 35 bp, Artificial Sequence
  Description of Artificial Sequence: Synthetic oligonucleotide
aaaaggctgtttgttatatggaccaccaggtacgg

SEQ ID NO: 135230 - DNA, 34 bp, Artificial Sequence
  Description of Artificial Sequence: Synthetic oligonucleotide
aaaggctgtttgttatatggaccaccaggtacgg

SEQ ID NO: 135231 - DNA, 33 bp, Artificial Sequence
  Description of Artificial Sequence: Synthetic oligonucleotide
aaggctgtttgttatatggaccaccaggtacgg

SEQ ID NO: 135232 - DNA, 32 bp, Artificial Sequence
  Description of Artificial Sequence: Synthetic oligonucleotide
aggctgtttgttatatggaccaccaggtacgg

SEQ ID NO: 135233 - DNA, 31 bp, Artificial Sequence
  Description of Artificial Sequence: Synthetic oligonucleotide
ggctgtttgttatatggaccaccaggtacgg

SEQ ID NO: 135234 - DNA, 31 bp, Artificial Sequence
  Description of Artificial Sequence: Synthetic oligonucleotide
gctgtttgttatatggaccaccaggtacggg

SEQ ID NO: 135235 - DNA, 36 bp, Artificial Sequence
  Description of Artificial Sequence: Synthetic oligonucleotide
ctgtttgttatatggaccaccaggtacgggaaaaac

SEQ ID NO: 135236 - DNA, 37 bp, Artificial Sequence
  Description of Artificial Sequence: Synthetic oligonucleotide
tgtttgttatatggaccaccaggtacgggaaaaacac

SEQ ID NO: 135237 - DNA, 36 bp, Artificial Sequence
  Description of Artificial Sequence: Synthetic oligonucleotide
gtttgttatatggaccaccaggtacgggaaaaacac

SEQ ID NO: 135238 - DNA, 37 bp, Artificial Sequence
  Description of Artificial Sequence: Synthetic oligonucleotide
tttgttatatggaccaccaggtacgggaaaaacactc

SEQ ID NO: 135239 - DNA, 36 bp, Artificial Sequence
  Description of Artificial Sequence: Synthetic oligonucleotide
ttgttatatggaccaccaggtacgggaaaaacactc

SEQ ID NO: 135240 - DNA, 35 bp, Artificial Sequence
  Description of Artificial Sequence: Synthetic oligonucleotide
tgttatatggaccaccaggtacgggaaaaacactc

SEQ ID NO: 135241 - DNA, 34 bp, Artificial Sequence
  Description of Artificial Sequence: Synthetic oligonucleotide
gttatatggaccaccaggtacgggaaaaacactc

SEQ ID NO: 135242 - DNA, 36 bp, Artificial Sequence
  Description of Artificial Sequence: Synthetic oligonucleotide
ttatatggaccaccaggtacgggaaaaacactcttg

SEQ ID NO: 135243 - DNA, 35 bp, Artificial Sequence
  Description of Artificial Sequence: Synthetic oligonucleotide
tatatggaccaccaggtacgggaaaaacactcttg

SEQ ID NO: 135244 - DNA, 34 bp, Artificial Sequence
  Description of Artificial Sequence: Synthetic oligonucleotide
atatggaccaccaggtacgggaaaaacactcttg

SEQ ID NO: 135245 - DNA, 33 bp, Artificial Sequence
  Description of Artificial Sequence: Synthetic oligonucleotide
tatggaccaccaggtacgggaaaaacactcttg

SEQ ID NO: 135246 - DNA, 32 bp, Artificial Sequence
  Description of Artificial Sequence: Synthetic oligonucleotide
atggaccaccaggtacgggaaaaacactcttg

SEQ ID NO: 135247 - DNA, 31 bp, Artificial Sequence
  Description of Artificial Sequence: Synthetic oligonucleotide
tggaccaccaggtacgggaaaaacactcttg

SEQ ID NO: 135248 - DNA, 30 bp, Artificial Sequence
  Description of Artificial Sequence: Synthetic oligonucleotide
ggaccaccaggtacgggaaaaacactcttg

SEQ ID NO: 135249 - DNA, 30 bp, Artificial Sequence
  Description of Artificial Sequence: Synthetic oligonucleotide
gaccaccaggtacgggaaaaacactcttgg

SEQ ID NO: 135250 - DNA, 30 bp, Artificial Sequence
  Description of Artificial Sequence: Synthetic oligonucleotide
accaccaggtacgggaaaaacactcttggc

SEQ ID NO: 135251 - DNA, 29 bp, Artificial Sequence
  Description of Artificial Sequence: Synthetic oligonucleotide
ccaccaggtacgggaaaaacactcttggc

SEQ ID NO: 135252 - DNA, 30 bp, Artificial Sequence
  Description of Artificial Sequence: Synthetic oligonucleotide
caccaggtacgggaaaaacactcttggcac

SEQ ID NO: 135253 - DNA, 30 bp, Artificial Sequence
  Description of Artificial Sequence: Synthetic oligonucleotide
accaggtacgggaaaaacactcttggcacg

SEQ ID NO: 135254 - DNA, 29 bp, Artificial Sequence
  Description of Artificial Sequence: Synthetic oligonucleotide
ccaggtacgggaaaaacactcttggcacg

SEQ ID NO: 135255 - DNA, 30 bp, Artificial Sequence
  Description of Artificial Sequence: Synthetic oligonucleotide
caggtacgggaaaaacactcttggcacgag

SEQ ID NO: 135256 - DNA, 30 bp, Artificial Sequence
  Description of Artificial Sequence: Synthetic oligonucleotide
aggtacgggaaaaacactcttggcacgagc

SEQ ID NO: 135257 - DNA, 29 bp, Artificial Sequence
  Description of Artificial Sequence: Synthetic oligonucleotide
ggtacgggaaaaacactcttggcacgagc

SEQ ID NO: 135258 - DNA, 29 bp, Artificial Sequence
  Description of Artificial Sequence: Synthetic oligonucleotide
gtacgggaaaaacactcttggcacgagcc

SEQ ID NO: 135259 - DNA, 29 bp, Artificial Sequence
  Description of Artificial Sequence: Synthetic oligonucleotide
tacgggaaaaacactcttggcacgagccg

SEQ ID NO: 135260 - DNA, 28 bp, Artificial Sequence
  Description of Artificial Sequence: Synthetic oligonucleotide
acgggaaaaacactcttggcacgagccg

SEQ ID NO: 135261 - DNA, 27 bp, Artificial Sequence
  Description of Artificial Sequence: Synthetic oligonucleotide
cgggaaaaacactcttggcacgagccg

SEQ ID NO: 135262 - DNA, 29 bp, Artificial Sequence
  Description of Artificial Sequence: Synthetic oligonucleotide
gggaaaaacactcttggcacgagccgttg

SEQ ID NO: 135263 - DNA, 29 bp, Artificial Sequence
  Description of Artificial Sequence: Synthetic oligonucleotide
ggaaaaacactcttggcacgagccgttgc

SEQ ID NO: 135264 - DNA, 31 bp, Artificial Sequence
  Description of Artificial Sequence: Synthetic oligonucleotide
gaaaaacactcttggcacgagccgttgctag

SEQ ID NO: 135265 - DNA, 31 bp, Artificial Sequence
  Description of Artificial Sequence: Synthetic oligonucleotide
aaaaacactcttggcacgagccgttgctagc

SEQ ID NO: 135266 - DNA, 30 bp, Artificial Sequence
  Description of Artificial Sequence: Synthetic oligonucleotide
aaaacactcttggcacgagccgttgctagc

SEQ ID NO: 135267 - DNA, 29 bp, Artificial Sequence
  Description of Artificial Sequence: Synthetic oligonucleotide
aaacactcttggcacgagccgttgctagc

SEQ ID NO: 135268 - DNA, 28 bp, Artificial Sequence
  Description of Artificial Sequence: Synthetic oligonucleotide
aacactcttggcacgagccgttgctagc

SEQ ID NO: 135269 - DNA, 27 bp, Artificial Sequence
  Description of Artificial Sequence: Synthetic oligonucleotide
acactcttggcacgagccgttgctagc

SEQ ID NO: 135270 - DNA, 26 bp, Artificial Sequence
  Description of Artificial Sequence: Synthetic oligonucleotide
cactcttggcacgagccgttgctagc

SEQ ID NO: 135271 - DNA, 27 bp, Artificial Sequence
  Description of Artificial Sequence: Synthetic oligonucleotide
actcttggcacgagccgttgctagcca

SEQ ID NO: 135272 - DNA, 26 bp, Artificial Sequence
  Description of Artificial Sequence: Synthetic oligonucleotide
ctcttggcacgagccgttgctagcca

SEQ ID NO: 135273 - DNA, 26 bp, Artificial Sequence
  Description of Artificial Sequence: Synthetic oligonucleotide
tcttggcacgagccgttgctagccag

SEQ ID NO: 135274 - DNA, 25 bp, Artificial Sequence
  Description of Artificial Sequence: Synthetic oligonucleotide
cttggcacgagccgttgctagccag

SEQ ID NO: 135275 - DNA, 26 bp, Artificial Sequence
  Description of Artificial Sequence: Synthetic oligonucleotide
ttggcacgagccgttgctagccagct

SEQ ID NO: 135276 - DNA, 25 bp, Artificial Sequence
  Description of Artificial Sequence: Synthetic oligonucleotide
tggcacgagccgttgctagccagct

SEQ ID NO: 135277 - DNA, 24 bp, Artificial Sequence
  Description of Artificial Sequence: Synthetic oligonucleotide
ggcacgagccgttgctagccagct

SEQ ID NO: 135278 - DNA, 24 bp, Artificial Sequence
  Description of Artificial Sequence: Synthetic oligonucleotide
gcacgagccgttgctagccagctg

SEQ ID NO: 135279 - DNA, 25 bp, Artificial Sequence
  Description of Artificial Sequence: Synthetic oligonucleotide
cacgagccgttgctagccagctgga

SEQ ID NO: 135280 - DNA, 26 bp, Artificial Sequence
  Description of Artificial Sequence: Synthetic oligonucleotide
acgagccgttgctagccagctggact

SEQ ID NO: 135281 - DNA, 25 bp, Artificial Sequence
  Description of Artificial Sequence: Synthetic oligonucleotide
cgagccgttgctagccagctggact

SEQ ID NO: 135282 - DNA, 25 bp, Artificial Sequence
  Description of Artificial Sequence: Synthetic oligonucleotide
gagccgttgctagccagctggactg

SEQ ID NO: 135283 - DNA, 27 bp, Artificial Sequence
  Description of Artificial Sequence: Synthetic oligonucleotide
agccgttgctagccagctggactgcaa

SEQ ID NO: 135284 - DNA, 27 bp, Artificial Sequence
  Description of Artificial Sequence: Synthetic oligonucleotide
gccgttgctagccagctggactgcaat

SEQ ID NO: 135285 - DNA, 29 bp, Artificial Sequence
  Description of Artificial Sequence: Synthetic oligonucleotide
ccgttgctagccagctggactgcaatttc

SEQ ID NO: 135286 - DNA, 34 bp, Artificial Sequence
  Description of Artificial Sequence: Synthetic oligonucleotide
cgttgctagccagctggactgcaatttcttaaag

SEQ ID NO: 135287 - DNA, 34 bp, Artificial Sequence
  Description of Artificial Sequence: Synthetic oligonucleotide
gttgctagccagctggactgcaatttcttaaagg

SEQ ID NO: 135288 - DNA, 36 bp, Artificial Sequence
  Description of Artificial Sequence: Synthetic oligonucleotide
ttgctagccagctggactgcaatttcttaaaggttg

SEQ ID NO: 135289 - DNA, 35 bp, Artificial Sequence
  Description of Artificial Sequence: Synthetic oligonucleotide
tgctagccagctggactgcaatttcttaaaggttg

SEQ ID NO: 135290 - DNA, 34 bp, Artificial Sequence
  Description of Artificial Sequence: Synthetic oligonucleotide
gctagccagctggactgcaatttcttaaaggttg

SEQ ID NO: 135291 - DNA, 37 bp, Artificial Sequence
  Description of Artificial Sequence: Synthetic oligonucleotide
ctagccagctggactgcaatttcttaaaggttgtatc

SEQ ID NO: 135292 - DNA, 39 bp, Artificial Sequence
  Description of Artificial Sequence: Synthetic oligonucleotide
tagccagctggactgcaatttcttaaaggttgtatctag

SEQ ID NO: 135293 - DNA, 38 bp, Artificial Sequence
  Description of Artificial Sequence: Synthetic oligonucleotide
agccagctggactgcaatttcttaaaggttgtatctag

SEQ ID NO: 135294 - DNA, 37 bp, Artificial Sequence
  Description of Artificial Sequence: Synthetic oligonucleotide
gccagctggactgcaatttcttaaaggttgtatctag

SEQ ID NO: 135295 - DNA, 39 bp, Artificial Sequence
  Description of Artificial Sequence: Synthetic oligonucleotide
ccagctggactgcaatttcttaaaggttgtatctagttc

SEQ ID NO: 135296 - DNA, 43 bp, Artificial Sequence
  Description of Artificial Sequence: Synthetic oligonucleotide
cagctggactgcaatttcttaaaggttgtatctagttctattg

SEQ ID NO: 135297 - DNA, 45 bp, Artificial Sequence
  Description of Artificial Sequence: Synthetic oligonucleotide
agctggactgcaatttcttaaaggttgtatctagttctattgtag

SEQ ID NO: 135298 - DNA, 44 bp, Artificial Sequence
  Description of Artificial Sequence: Synthetic oligonucleotide
gctggactgcaatttcttaaaggttgtatctagttctattgtag

SEQ ID NO: 135299 - DNA, 45 bp, Artificial Sequence
  Description of Artificial Sequence: Synthetic oligonucleotide
ctggactgcaatttcttaaaggttgtatctagttctattgtagac

SEQ ID NO: 135300 - DNA, 47 bp, Artificial Sequence
  Description of Artificial Sequence: Synthetic oligonucleotide
tggactgcaatttcttaaaggttgtatctagttctattgtagacaag

SEQ ID NO: 135301 - DNA, 46 bp, Artificial Sequence
  Description of Artificial Sequence: Synthetic oligonucleotide
ggactgcaatttcttaaaggttgtatctagttctattgtagacaag

SEQ ID NO: 135302 - DNA, 48 bp, Artificial Sequence
  Description of Artificial Sequence: Synthetic oligonucleotide
gactgcaatttcttaaaggttgtatctagttctattgtagacaagtac

SEQ ID NO: 135303 - DNA, 51 bp, Artificial Sequence
  Description of Artificial Sequence: Synthetic oligonucleotide
actgcaatttcttaaaggttgtatctagttctattgtagacaagtacattg

SEQ ID NO: 135304 - DNA, 50 bp, Artificial Sequence
  Description of Artificial Sequence: Synthetic oligonucleotide
ctgcaatttcttaaaggttgtatctagttctattgtagacaagtacattg

SEQ ID NO: 135305 - DNA, 50 bp, Artificial Sequence
  Description of Artificial Sequence: Synthetic oligonucleotide
tgcaatttcttaaaggttgtatctagttctattgtagacaagtacattgg

SEQ ID NO: 135306 - DNA, 49 bp, Artificial Sequence
  Description of Artificial Sequence: Synthetic oligonucleotide
gcaatttcttaaaggttgtatctagttctattgtagacaagtacattgg

SEQ ID NO: 135307 - DNA, 50 bp, Artificial Sequence
  Description of Artificial Sequence: Synthetic oligonucleotide
caatttcttaaaggttgtatctagttctattgtagacaagtacattggtg

SEQ ID NO: 135308 - DNA, 53 bp, Artificial Sequence
  Description of Artificial Sequence: Synthetic oligonucleotide
aatttcttaaaggttgtatctagttctattgtagacaagtacattggtgaaag

SEQ ID NO: 135309 - DNA, 52 bp, Artificial Sequence
  Description of Artificial Sequence: Synthetic oligonucleotide
atttcttaaaggttgtatctagttctattgtagacaagtacattggtgaaag

SEQ ID NO: 135310 - DNA, 51 bp, Artificial Sequence
  Description of Artificial Sequence: Synthetic oligonucleotide
tttcttaaaggttgtatctagttctattgtagacaagtacattggtgaaag

SEQ ID NO: 135311 - DNA, 50 bp, Artificial Sequence
  Description of Artificial Sequence: Synthetic oligonucleotide
ttcttaaaggttgtatctagttctattgtagacaagtacattggtgaaag

SEQ ID NO: 135312 - DNA, 49 bp, Artificial Sequence
  Description of Artificial Sequence: Synthetic oligonucleotide
tcttaaaggttgtatctagttctattgtagacaagtacattggtgaaag

SEQ ID NO: 135313 - DNA, 48 bp, Artificial Sequence
  Description of Artificial Sequence: Synthetic oligonucleotide
cttaaaggttgtatctagttctattgtagacaagtacattggtgaaag

SEQ ID NO: 135314 - DNA, 49 bp, Artificial Sequence
  Description of Artificial Sequence: Synthetic oligonucleotide
ttaaaggttgtatctagttctattgtagacaagtacattggtgaaagtg

SEQ ID NO: 135315 - DNA, 48 bp, Artificial Sequence
  Description of Artificial Sequence: Synthetic oligonucleotide
taaaggttgtatctagttctattgtagacaagtacattggtgaaagtg

SEQ ID NO: 135316 - DNA, 47 bp, Artificial Sequence
  Description of Artificial Sequence: Synthetic oligonucleotide
aaaggttgtatctagttctattgtagacaagtacattggtgaaagtg

SEQ ID NO: 135317 - DNA, 46 bp, Artificial Sequence
  Description of Artificial Sequence: Synthetic oligonucleotide
aaggttgtatctagttctattgtagacaagtacattggtgaaagtg

SEQ ID NO: 135318 - DNA, 45 bp, Artificial Sequence
  Description of Artificial Sequence: Synthetic oligonucleotide
aggttgtatctagttctattgtagacaagtacattggtgaaagtg

SEQ ID NO: 135319 - DNA, 44 bp, Artificial Sequence
  Description of Artificial Sequence: Synthetic oligonucleotide
ggttgtatctagttctattgtagacaagtacattggtgaaagtg

SEQ ID NO: 135320 - DNA, 44 bp, Artificial Sequence
  Description of Artificial Sequence: Synthetic oligonucleotide
gttgtatctagttctattgtagacaagtacattggtgaaagtgc

SEQ ID NO: 135321 - DNA, 45 bp, Artificial Sequence
  Description of Artificial Sequence: Synthetic oligonucleotide
ttgtatctagttctattgtagacaagtacattggtgaaagtgctc

SEQ ID NO: 135322 - DNA, 44 bp, Artificial Sequence
  Description of Artificial Sequence: Synthetic oligonucleotide
tgtatctagttctattgtagacaagtacattggtgaaagtgctc

SEQ ID NO: 135323 - DNA, 43 bp, Artificial Sequence
  Description of Artificial Sequence: Synthetic oligonucleotide
gtatctagttctattgtagacaagtacattggtgaaagtgctc

SEQ ID NO: 135324 - DNA, 43 bp, Artificial Sequence
  Description of Artificial Sequence: Synthetic oligonucleotide
tatctagttctattgtagacaagtacattggtgaaagtgctcg

SEQ ID NO: 135325 - DNA, 42 bp, Artificial Sequence
  Description of Artificial Sequence: Synthetic oligonucleotide
atctagttctattgtagacaagtacattggtgaaagtgctcg

SEQ ID NO: 135326 - DNA, 41 bp, Artificial Sequence
  Description of Artificial Sequence: Synthetic oligonucleotide
tctagttctattgtagacaagtacattggtgaaagtgctcg

SEQ ID NO: 135327 - DNA, 40 bp, Artificial Sequence
  Description of Artificial Sequence: Synthetic oligonucleotide
ctagttctattgtagacaagtacattggtgaaagtgctcg

SEQ ID NO: 135328 - DNA, 43 bp, Artificial Sequence
  Description of Artificial Sequence: Synthetic oligonucleotide
tagttctattgtagacaagtacattggtgaaagtgctcgtttg

SEQ ID NO: 135329 - DNA, 42 bp, Artificial Sequence
  Description of Artificial Sequence: Synthetic oligonucleotide
agttctattgtagacaagtacattggtgaaagtgctcgtttg

SEQ ID NO: 135330 - DNA, 41 bp, Artificial Sequence
  Description of Artificial Sequence: Synthetic oligonucleotide
gttctattgtagacaagtacattggtgaaagtgctcgtttg

SEQ ID NO: 135331 - DNA, 43 bp, Artificial Sequence
  Description of Artificial Sequence: Synthetic oligonucleotide
ttctattgtagacaagtacattggtgaaagtgctcgtttgatc

SEQ ID NO: 135332 - DNA, 42 bp, Artificial Sequence
  Description of Artificial Sequence: Synthetic oligonucleotide
tctattgtagacaagtacattggtgaaagtgctcgtttgatc

SEQ ID NO: 135333 - DNA, 41 bp, Artificial Sequence
  Description of Artificial Sequence: Synthetic oligonucleotide
ctattgtagacaagtacattggtgaaagtgctcgtttgatc

SEQ ID NO: 135334 - DNA, 42 bp, Artificial Sequence
  Description of Artificial Sequence: Synthetic oligonucleotide
tattgtagacaagtacattggtgaaagtgctcgtttgatcag

SEQ ID NO: 135335 - DNA, 41 bp, Artificial Sequence
  Description of Artificial Sequence: Synthetic oligonucleotide
attgtagacaagtacattggtgaaagtgctcgtttgatcag

SEQ ID NO: 135336 - DNA, 40 bp, Artificial Sequence
  Description of Artificial Sequence: Synthetic oligonucleotide
ttgtagacaagtacattggtgaaagtgctcgtttgatcag

SEQ ID NO: 135337 - DNA, 39 bp, Artificial Sequence
  Description of Artificial Sequence: Synthetic oligonucleotide
tgtagacaagtacattggtgaaagtgctcgtttgatcag

SEQ ID NO: 135338 - DNA, 38 bp, Artificial Sequence
  Description of Artificial Sequence: Synthetic oligonucleotide
gtagacaagtacattggtgaaagtgctcgtttgatcag

SEQ ID NO: 135339 - DNA, 39 bp, Artificial Sequence
  Description of Artificial Sequence: Synthetic oligonucleotide
tagacaagtacattggtgaaagtgctcgtttgatcagag

SEQ ID NO: 135340 - DNA, 38 bp, Artificial Sequence
  Description of Artificial Sequence: Synthetic oligonucleotide
agacaagtacattggtgaaagtgctcgtttgatcagag

SEQ ID NO: 135341 - DNA, 37 bp, Artificial Sequence
  Description of Artificial Sequence: Synthetic oligonucleotide
gacaagtacattggtgaaagtgctcgtttgatcagag

SEQ ID NO: 135342 - DNA, 41 bp, Artificial Sequence
  Description of Artificial Sequence: Synthetic oligonucleotide
acaagtacattggtgaaagtgctcgtttgatcagagaaatg

SEQ ID NO: 135343 - DNA, 40 bp, Artificial Sequence
  Description of Artificial Sequence: Synthetic oligonucleotide
caagtacattggtgaaagtgctcgtttgatcagagaaatg

SEQ ID NO: 135344 - DNA, 49 bp, Artificial Sequence
  Description of Artificial Sequence: Synthetic oligonucleotide
aagtacattggtgaaagtgctcgtttgatcagagaaatgtttaattatg

SEQ ID NO: 135345 - DNA, 48 bp, Artificial Sequence
  Description of Artificial Sequence: Synthetic oligonucleotide
agtacattggtgaaagtgctcgtttgatcagagaaatgtttaattatg

SEQ ID NO: 135346 - DNA, 47 bp, Artificial Sequence
  Description of Artificial Sequence: Synthetic oligonucleotide
gtacattggtgaaagtgctcgtttgatcagagaaatgtttaattatg

SEQ ID NO: 135347 - DNA, 47 bp, Artificial Sequence
  Description of Artificial Sequence: Synthetic oligonucleotide
tacattggtgaaagtgctcgtttgatcagagaaatgtttaattatgc

SEQ ID NO: 135348 - DNA, 46 bp, Artificial Sequence
  Description of Artificial Sequence: Synthetic oligonucleotide
acattggtgaaagtgctcgtttgatcagagaaatgtttaattatgc

SEQ ID NO: 135349 - DNA, 45 bp, Artificial Sequence
  Description of Artificial Sequence: Synthetic oligonucleotide
cattggtgaaagtgctcgtttgatcagagaaatgtttaattatgc

SEQ ID NO: 135350 - DNA, 47 bp, Artificial Sequence
  Description of Artificial Sequence: Synthetic oligonucleotide
attggtgaaagtgctcgtttgatcagagaaatgtttaattatgctag

SEQ ID NO: 135351 - DNA, 46 bp, Artificial Sequence
  Description of Artificial Sequence: Synthetic oligonucleotide
ttggtgaaagtgctcgtttgatcagagaaatgtttaattatgctag

SEQ ID NO: 135352 - DNA, 45 bp, Artificial Sequence
  Description of Artificial Sequence: Synthetic oligonucleotide
tggtgaaagtgctcgtttgatcagagaaatgtttaattatgctag

SEQ ID NO: 135353 - DNA, 44 bp, Artificial Sequence
  Description of Artificial Sequence: Synthetic oligonucleotide
ggtgaaagtgctcgtttgatcagagaaatgtttaattatgctag

SEQ ID NO: 135354 - DNA, 45 bp, Artificial Sequence
  Description of Artificial Sequence: Synthetic oligonucleotide
gtgaaagtgctcgtttgatcagagaaatgtttaattatgctagag

SEQ ID NO: 135355 - DNA, 47 bp, Artificial Sequence
  Description of Artificial Sequence: Synthetic oligonucleotide
tgaaagtgctcgtttgatcagagaaatgtttaattatgctagagatc

SEQ ID NO: 135356 - DNA, 46 bp, Artificial Sequence
  Description of Artificial Sequence: Synthetic oligonucleotide
gaaagtgctcgtttgatcagagaaatgtttaattatgctagagatc

SEQ ID NO: 135357 - DNA, 48 bp, Artificial Sequence
  Description of Artificial Sequence: Synthetic oligonucleotide
aaagtgctcgtttgatcagagaaatgtttaattatgctagagatcatc

SEQ ID NO: 135358 - DNA, 47 bp, Artificial Sequence
  Description of Artificial Sequence: Synthetic oligonucleotide
aagtgctcgtttgatcagagaaatgtttaattatgctagagatcatc

SEQ ID NO: 135359 - DNA, 46 bp, Artificial Sequence
  Description of Artificial Sequence: Synthetic oligonucleotide
agtgctcgtttgatcagagaaatgtttaattatgctagagatcatc

SEQ ID NO: 135360 - DNA, 45 bp, Artificial Sequence
  Description of Artificial Sequence: Synthetic oligonucleotide
gtgctcgtttgatcagagaaatgtttaattatgctagagatcatc

SEQ ID NO: 135361 - DNA, 47 bp, Artificial Sequence
  Description of Artificial Sequence: Synthetic oligonucleotide
tgctcgtttgatcagagaaatgtttaattatgctagagatcatcaac

SEQ ID NO: 135362 - DNA, 46 bp, Artificial Sequence
  Description of Artificial Sequence: Synthetic oligonucleotide
gctcgtttgatcagagaaatgtttaattatgctagagatcatcaac

SEQ ID NO: 135363 - DNA, 46 bp, Artificial Sequence
  Description of Artificial Sequence: Synthetic oligonucleotide
ctcgtttgatcagagaaatgtttaattatgctagagatcatcaacc

SEQ ID NO: 135364 - DNA, 48 bp, Artificial Sequence
  Description of Artificial Sequence: Synthetic oligonucleotide
tcgtttgatcagagaaatgtttaattatgctagagatcatcaaccatg

SEQ ID NO: 135365 - DNA, 47 bp, Artificial Sequence
  Description of Artificial Sequence: Synthetic oligonucleotide
cgtttgatcagagaaatgtttaattatgctagagatcatcaaccatg

SEQ ID NO: 135366 - DNA, 47 bp, Artificial Sequence
  Description of Artificial Sequence: Synthetic oligonucleotide
gtttgatcagagaaatgtttaattatgctagagatcatcaaccatgc

SEQ ID NO: 135367 - DNA, 49 bp, Artificial Sequence
  Description of Artificial Sequence: Synthetic oligonucleotide
tttgatcagagaaatgtttaattatgctagagatcatcaaccatgcatc

SEQ ID NO: 135368 - DNA, 48 bp, Artificial Sequence
  Description of Artificial Sequence: Synthetic oligonucleotide
ttgatcagagaaatgtttaattatgctagagatcatcaaccatgcatc

SEQ ID NO: 135369 - DNA, 47 bp, Artificial Sequence
  Description of Artificial Sequence: Synthetic oligonucleotide
tgatcagagaaatgtttaattatgctagagatcatcaaccatgcatc

SEQ ID NO: 135370 - DNA, 46 bp, Artificial Sequence
  Description of Artificial Sequence: Synthetic oligonucleotide
gatcagagaaatgtttaattatgctagagatcatcaaccatgcatc

SEQ ID NO: 135371 - DNA, 54 bp, Artificial Sequence
  Description of Artificial Sequence: Synthetic oligonucleotide
atcagagaaatgtttaattatgctagagatcatcaaccatgcatcatttttatg

SEQ ID NO: 135372 - DNA, 53 bp, Artificial Sequence
  Description of Artificial Sequence: Synthetic oligonucleotide
tcagagaaatgtttaattatgctagagatcatcaaccatgcatcatttttatg

SEQ ID NO: 135373 - DNA, 52 bp, Artificial Sequence
  Description of Artificial Sequence: Synthetic oligonucleotide
cagagaaatgtttaattatgctagagatcatcaaccatgcatcatttttatg

SEQ ID NO: 135374 - DNA, 52 bp, Artificial Sequence
  Description of Artificial Sequence: Synthetic oligonucleotide
agagaaatgtttaattatgctagagatcatcaaccatgcatcatttttatgg

SEQ ID NO: 135375 - DNA, 51 bp, Artificial Sequence
  Description of Artificial Sequence: Synthetic oligonucleotide
gagaaatgtttaattatgctagagatcatcaaccatgcatcatttttatgg

SEQ ID NO: 135376 - DNA, 53 bp, Artificial Sequence
  Description of Artificial Sequence: Synthetic oligonucleotide
agaaatgtttaattatgctagagatcatcaaccatgcatcatttttatggatg

SEQ ID NO: 135377 - DNA, 52 bp, Artificial Sequence
  Description of Artificial Sequence: Synthetic oligonucleotide
gaaatgtttaattatgctagagatcatcaaccatgcatcatttttatggatg

SEQ ID NO: 135378 - DNA, 57 bp, Artificial Sequence
  Description of Artificial Sequence: Synthetic oligonucleotide
aaatgtttaattatgctagagatcatcaaccatgcatcatttttatggatgaaatag

SEQ ID NO: 135379 - DNA, 56 bp, Artificial Sequence
  Description of Artificial Sequence: Synthetic oligonucleotide
aatgtttaattatgctagagatcatcaaccatgcatcatttttatggatgaaatag

SEQ ID NO: 135380 - DNA, 55 bp, Artificial Sequence
  Description of Artificial Sequence: Synthetic oligonucleotide
atgtttaattatgctagagatcatcaaccatgcatcatttttatggatgaaatag

SEQ ID NO: 135381 - DNA, 54 bp, Artificial Sequence
  Description of Artificial Sequence: Synthetic oligonucleotide
tgtttaattatgctagagatcatcaaccatgcatcatttttatggatgaaatag

SEQ ID NO: 135382 - DNA, 53 bp, Artificial Sequence
  Description of Artificial Sequence: Synthetic oligonucleotide
gtttaattatgctagagatcatcaaccatgcatcatttttatggatgaaatag

SEQ ID NO: 135383 - DNA, 55 bp, Artificial Sequence
  Description of Artificial Sequence: Synthetic oligonucleotide
tttaattatgctagagatcatcaaccatgcatcatttttatggatgaaatagatg

SEQ ID NO: 135384 - DNA, 54 bp, Artificial Sequence
  Description of Artificial Sequence: Synthetic oligonucleotide
ttaattatgctagagatcatcaaccatgcatcatttttatggatgaaatagatg

SEQ ID NO: 135385 - DNA, 53 bp, Artificial Sequence
  Description of Artificial Sequence: Synthetic oligonucleotide
taattatgctagagatcatcaaccatgcatcatttttatggatgaaatagatg

SEQ ID NO: 135386 - DNA, 52 bp, Artificial Sequence
  Description of Artificial Sequence: Synthetic oligonucleotide
aattatgctagagatcatcaaccatgcatcatttttatggatgaaatagatg

SEQ ID NO: 135387 - DNA, 51 bp, Artificial Sequence
  Description of Artificial Sequence: Synthetic oligonucleotide
attatgctagagatcatcaaccatgcatcatttttatggatgaaatagatg

SEQ ID NO: 135388 - DNA, 50 bp, Artificial Sequence
  Description of Artificial Sequence: Synthetic oligonucleotide
ttatgctagagatcatcaaccatgcatcatttttatggatgaaatagatg

SEQ ID NO: 135389 - DNA, 49 bp, Artificial Sequence
  Description of Artificial Sequence: Synthetic oligonucleotide
tatgctagagatcatcaaccatgcatcatttttatggatgaaatagatg

SEQ ID NO: 135390 - DNA, 48 bp, Artificial Sequence
  Description of Artificial Sequence: Synthetic oligonucleotide
atgctagagatcatcaaccatgcatcatttttatggatgaaatagatg

SEQ ID NO: 135391 - DNA, 47 bp, Artificial Sequence
  Description of Artificial Sequence: Synthetic oligonucleotide
tgctagagatcatcaaccatgcatcatttttatggatgaaatagatg

SEQ ID NO: 135392 - DNA, 46 bp, Artificial Sequence
  Description of Artificial Sequence: Synthetic oligonucleotide
gctagagatcatcaaccatgcatcatttttatggatgaaatagatg

SEQ ID NO: 135393 - DNA, 46 bp, Artificial Sequence
  Description of Artificial Sequence: Synthetic oligonucleotide
ctagagatcatcaaccatgcatcatttttatggatgaaatagatgc

SEQ ID NO: 135394 - DNA, 50 bp, Artificial Sequence
  Description of Artificial Sequence: Synthetic oligonucleotide
tagagatcatcaaccatgcatcatttttatggatgaaatagatgctattg

SEQ ID NO: 135395 - DNA, 49 bp, Artificial Sequence
  Description of Artificial Sequence: Synthetic oligonucleotide
agagatcatcaaccatgcatcatttttatggatgaaatagatgctattg

SEQ ID NO: 135396 - DNA, 48 bp, Artificial Sequence
  Description of Artificial Sequence: Synthetic oligonucleotide
gagatcatcaaccatgcatcatttttatggatgaaatagatgctattg

SEQ ID NO: 135397 - DNA, 48 bp, Artificial Sequence
  Description of Artificial Sequence: Synthetic oligonucleotide
agatcatcaaccatgcatcatttttatggatgaaatagatgctattgg

SEQ ID NO: 135398 - DNA, 47 bp, Artificial Sequence
  Description of Artificial Sequence: Synthetic oligonucleotide
gatcatcaaccatgcatcatttttatggatgaaatagatgctattgg

SEQ ID NO: 135399 - DNA, 48 bp, Artificial Sequence
  Description of Artificial Sequence: Synthetic oligonucleotide
atcatcaaccatgcatcatttttatggatgaaatagatgctattggtg

SEQ ID NO: 135400 - DNA, 47 bp, Artificial Sequence
  Description of Artificial Sequence: Synthetic oligonucleotide
tcatcaaccatgcatcatttttatggatgaaatagatgctattggtg

SEQ ID NO: 135401 - DNA, 46 bp, Artificial Sequence
  Description of Artificial Sequence: Synthetic oligonucleotide
catcaaccatgcatcatttttatggatgaaatagatgctattggtg

SEQ ID NO: 135402 - DNA, 46 bp, Artificial Sequence
  Description of Artificial Sequence: Synthetic oligonucleotide
atcaaccatgcatcatttttatggatgaaatagatgctattggtgg

SEQ ID NO: 135403 - DNA, 45 bp, Artificial Sequence
  Description of Artificial Sequence: Synthetic oligonucleotide
tcaaccatgcatcatttttatggatgaaatagatgctattggtgg

SEQ ID NO: 135404 - DNA, 44 bp, Artificial Sequence
  Description of Artificial Sequence: Synthetic oligonucleotide
caaccatgcatcatttttatggatgaaatagatgctattggtgg

SEQ ID NO: 135405 - DNA, 45 bp, Artificial Sequence
  Description of Artificial Sequence: Synthetic oligonucleotide
aaccatgcatcatttttatggatgaaatagatgctattggtggtc

SEQ ID NO: 135406 - DNA, 44 bp, Artificial Sequence
  Description of Artificial Sequence: Synthetic oligonucleotide
accatgcatcatttttatggatgaaatagatgctattggtggtc

SEQ ID NO: 135407 - DNA, 43 bp, Artificial Sequence
  Description of Artificial Sequence: Synthetic oligonucleotide
ccatgcatcatttttatggatgaaatagatgctattggtggtc

SEQ ID NO: 135408 - DNA, 43 bp, Artificial Sequence
  Description of Artificial Sequence: Synthetic oligonucleotide
catgcatcatttttatggatgaaatagatgctattggtggtcg

SEQ ID NO: 135409 - DNA, 44 bp, Artificial Sequence
  Description of Artificial Sequence: Synthetic oligonucleotide
atgcatcatttttatggatgaaatagatgctattggtggtcgtc

SEQ ID NO: 135410 - DNA, 43 bp, Artificial Sequence
  Description of Artificial Sequence: Synthetic oligonucleotide
tgcatcatttttatggatgaaatagatgctattggtggtcgtc

SEQ ID NO: 135411 - DNA, 42 bp, Artificial Sequence
  Description of Artificial Sequence: Synthetic oligonucleotide
gcatcatttttatggatgaaatagatgctattggtggtcgtc

SEQ ID NO: 135412 - DNA, 42 bp, Artificial Sequence
  Description of Artificial Sequence: Synthetic oligonucleotide
catcatttttatggatgaaatagatgctattggtggtcgtcg

SEQ ID NO: 135413 - DNA, 42 bp, Artificial Sequence
  Description of Artificial Sequence: Synthetic oligonucleotide
atcatttttatggatgaaatagatgctattggtggtcgtcgg

SEQ ID NO: 135414 - DNA, 41 bp, Artificial Sequence
  Description of Artificial Sequence: Synthetic oligonucleotide
tcatttttatggatgaaatagatgctattggtggtcgtcgg

SEQ ID NO: 135415 - DNA, 40 bp, Artificial Sequence
  Description of Artificial Sequence: Synthetic oligonucleotide
catttttatggatgaaatagatgctattggtggtcgtcgg

SEQ ID NO: 135416 - DNA, 44 bp, Artificial Sequence
  Description of Artificial Sequence: Synthetic oligonucleotide
atttttatggatgaaatagatgctattggtggtcgtcggttttc

SEQ ID NO: 135417 - DNA, 43 bp, Artificial Sequence
  Description of Artificial Sequence: Synthetic oligonucleotide
tttttatggatgaaatagatgctattggtggtcgtcggttttc

SEQ ID NO: 135418 - DNA, 42 bp, Artificial Sequence
  Description of Artificial Sequence: Synthetic oligonucleotide
ttttatggatgaaatagatgctattggtggtcgtcggttttc

SEQ ID NO: 135419 - DNA, 41 bp, Artificial Sequence
  Description of Artificial Sequence: Synthetic oligonucleotide
tttatggatgaaatagatgctattggtggtcgtcggttttc

SEQ ID NO: 135420 - DNA, 40 bp, Artificial Sequence
  Description of Artificial Sequence: Synthetic oligonucleotide
ttatggatgaaatagatgctattggtggtcgtcggttttc

SEQ ID NO: 135421 - DNA, 39 bp, Artificial Sequence
  Description of Artificial Sequence: Synthetic oligonucleotide
tatggatgaaatagatgctattggtggtcgtcggttttc

SEQ ID NO: 135422 - DNA, 38 bp, Artificial Sequence
  Description of Artificial Sequence: Synthetic oligonucleotide
atggatgaaatagatgctattggtggtcgtcggttttc

SEQ ID NO: 135423 - DNA, 37 bp, Artificial Sequence
  Description of Artificial Sequence: Synthetic oligonucleotide
tggatgaaatagatgctattggtggtcgtcggttttc

SEQ ID NO: 135424 - DNA, 36 bp, Artificial Sequence
  Description of Artificial Sequence: Synthetic oligonucleotide
ggatgaaatagatgctattggtggtcgtcggttttc

SEQ ID NO: 135425 - DNA, 37 bp, Artificial Sequence
  Description of Artificial Sequence: Synthetic oligonucleotide
gatgaaatagatgctattggtggtcgtcggttttctg

SEQ ID NO: 135426 - DNA, 38 bp, Artificial Sequence
  Description of Artificial Sequence: Synthetic oligonucleotide
atgaaatagatgctattggtggtcgtcggttttctgag

SEQ ID NO: 135427 - DNA, 37 bp, Artificial Sequence
  Description of Artificial Sequence: Synthetic oligonucleotide
tgaaatagatgctattggtggtcgtcggttttctgag

SEQ ID NO: 135428 - DNA, 36 bp, Artificial Sequence
  Description of Artificial Sequence: Synthetic oligonucleotide
gaaatagatgctattggtggtcgtcggttttctgag

SEQ ID NO: 135429 - DNA, 36 bp, Artificial Sequence
  Description of Artificial Sequence: Synthetic oligonucleotide
aaatagatgctattggtggtcgtcggttttctgagg

SEQ ID NO: 135430 - DNA, 35 bp, Artificial Sequence
  Description of Artificial Sequence: Synthetic oligonucleotide
aatagatgctattggtggtcgtcggttttctgagg

SEQ ID NO: 135431 - DNA, 34 bp, Artificial Sequence
  Description of Artificial Sequence: Synthetic oligonucleotide
atagatgctattggtggtcgtcggttttctgagg

SEQ ID NO: 135432 - DNA, 33 bp, Artificial Sequence
  Description of Artificial Sequence: Synthetic oligonucleotide
tagatgctattggtggtcgtcggttttctgagg

SEQ ID NO: 135433 - DNA, 32 bp, Artificial Sequence
  Description of Artificial Sequence: Synthetic oligonucleotide
agatgctattggtggtcgtcggttttctgagg

SEQ ID NO: 135434 - DNA, 31 bp, Artificial Sequence
  Description of Artificial Sequence: Synthetic oligonucleotide
gatgctattggtggtcgtcggttttctgagg

SEQ ID NO: 135435 - DNA, 31 bp, Artificial Sequence
  Description of Artificial Sequence: Synthetic oligonucleotide
atgctattggtggtcgtcggttttctgaggg

SEQ ID NO: 135436 - DNA, 30 bp, Artificial Sequence
  Description of Artificial Sequence: Synthetic oligonucleotide
tgctattggtggtcgtcggttttctgaggg

SEQ ID NO: 135437 - DNA, 29 bp, Artificial Sequence
  Description of Artificial Sequence: Synthetic oligonucleotide
gctattggtggtcgtcggttttctgaggg

SEQ ID NO: 135438 - DNA, 31 bp, Artificial Sequence
  Description of Artificial Sequence: Synthetic oligonucleotide
ctattggtggtcgtcggttttctgagggtac

SEQ ID NO: 135439 - DNA, 33 bp, Artificial Sequence
  Description of Artificial Sequence: Synthetic oligonucleotide
tattggtggtcgtcggttttctgagggtacttc

SEQ ID NO: 135440 - DNA, 32 bp, Artificial Sequence
  Description of Artificial Sequence: Synthetic oligonucleotide
attggtggtcgtcggttttctgagggtacttc

SEQ ID NO: 135441 - DNA, 31 bp, Artificial Sequence
  Description of Artificial Sequence: Synthetic oligonucleotide
ttggtggtcgtcggttttctgagggtacttc

SEQ ID NO: 135442 - DNA, 30 bp, Artificial Sequence
  Description of Artificial Sequence: Synthetic oligonucleotide
tggtggtcgtcggttttctgagggtacttc

SEQ ID NO: 135443 - DNA, 29 bp, Artificial Sequence
  Description of Artificial Sequence: Synthetic oligonucleotide
ggtggtcgtcggttttctgagggtacttc

SEQ ID NO: 135444 - DNA, 30 bp, Artificial Sequence
  Description of Artificial Sequence: Synthetic oligonucleotide
gtggtcgtcggttttctgagggtacttcag

SEQ ID NO: 135445 - DNA, 30 bp, Artificial Sequence
  Description of Artificial Sequence: Synthetic oligonucleotide
tggtcgtcggttttctgagggtacttcagc

SEQ ID NO: 135446 - DNA, 29 bp, Artificial Sequence
  Description of Artificial Sequence: Synthetic oligonucleotide
ggtcgtcggttttctgagggtacttcagc

SEQ ID NO: 135447 - DNA, 30 bp, Artificial Sequence
  Description of Artificial Sequence: Synthetic oligonucleotide
gtcgtcggttttctgagggtacttcagctg

SEQ ID NO: 135448 - DNA, 31 bp, Artificial Sequence
  Description of Artificial Sequence: Synthetic oligonucleotide
tcgtcggttttctgagggtacttcagctgac

SEQ ID NO: 135449 - DNA, 30 bp, Artificial Sequence
  Description of Artificial Sequence: Synthetic oligonucleotide
cgtcggttttctgagggtacttcagctgac

SEQ ID NO: 135450 - DNA, 31 bp, Artificial Sequence
  Description of Artificial Sequence: Synthetic oligonucleotide
gtcggttttctgagggtacttcagctgacag

SEQ ID NO: 135451 - DNA, 32 bp, Artificial Sequence
  Description of Artificial Sequence: Synthetic oligonucleotide
tcggttttctgagggtacttcagctgacagag

SEQ ID NO: 135452 - DNA, 31 bp, Artificial Sequence
  Description of Artificial Sequence: Synthetic oligonucleotide
cggttttctgagggtacttcagctgacagag

SEQ ID NO: 135453 - DNA, 32 bp, Artificial Sequence
  Description of Artificial Sequence: Synthetic oligonucleotide
ggttttctgagggtacttcagctgacagagag

SEQ ID NO: 135454 - DNA, 35 bp, Artificial Sequence
  Description of Artificial Sequence: Synthetic oligonucleotide
gttttctgagggtacttcagctgacagagagattc

SEQ ID NO: 135455 - DNA, 36 bp, Artificial Sequence
  Description of Artificial Sequence: Synthetic oligonucleotide
ttttctgagggtacttcagctgacagagagattcag

SEQ ID NO: 135456 - DNA, 35 bp, Artificial Sequence
  Description of Artificial Sequence: Synthetic oligonucleotide
tttctgagggtacttcagctgacagagagattcag

SEQ ID NO: 135457 - DNA, 34 bp, Artificial Sequence
  Description of Artificial Sequence: Synthetic oligonucleotide
ttctgagggtacttcagctgacagagagattcag

SEQ ID NO: 135458 - DNA, 33 bp, Artificial Sequence
  Description of Artificial Sequence: Synthetic oligonucleotide
tctgagggtacttcagctgacagagagattcag

SEQ ID NO: 135459 - DNA, 32 bp, Artificial Sequence
  Description of Artificial Sequence: Synthetic oligonucleotide
ctgagggtacttcagctgacagagagattcag

SEQ ID NO: 135460 - DNA, 33 bp, Artificial Sequence
  Description of Artificial Sequence: Synthetic oligonucleotide
tgagggtacttcagctgacagagagattcagag

SEQ ID NO: 135461 - DNA, 32 bp, Artificial Sequence
  Description of Artificial Sequence: Synthetic oligonucleotide
gagggtacttcagctgacagagagattcagag

SEQ ID NO: 135462 - DNA, 34 bp, Artificial Sequence
  Description of Artificial Sequence: Synthetic oligonucleotide
agggtacttcagctgacagagagattcagagaac

SEQ ID NO: 135463 - DNA, 33 bp, Artificial Sequence
  Description of Artificial Sequence: Synthetic oligonucleotide
gggtacttcagctgacagagagattcagagaac

SEQ ID NO: 135464 - DNA, 33 bp, Artificial Sequence
  Description of Artificial Sequence: Synthetic oligonucleotide
ggtacttcagctgacagagagattcagagaacg

SEQ ID NO: 135465 - DNA, 38 bp, Artificial Sequence
  Description of Artificial Sequence: Synthetic oligonucleotide
gtacttcagctgacagagagattcagagaacgttaatg

SEQ ID NO: 135466 - DNA, 38 bp, Artificial Sequence
  Description of Artificial Sequence: Synthetic oligonucleotide
tacttcagctgacagagagattcagagaacgttaatgg

SEQ ID NO: 135467 - DNA, 37 bp, Artificial Sequence
  Description of Artificial Sequence: Synthetic oligonucleotide
acttcagctgacagagagattcagagaacgttaatgg

SEQ ID NO: 135468 - DNA, 36 bp, Artificial Sequence
  Description of Artificial Sequence: Synthetic oligonucleotide
cttcagctgacagagagattcagagaacgttaatgg

SEQ ID NO: 135469 - DNA, 37 bp, Artificial Sequence
  Description of Artificial Sequence: Synthetic oligonucleotide
ttcagctgacagagagattcagagaacgttaatggag

SEQ ID NO: 135470 - DNA, 36 bp, Artificial Sequence
  Description of Artificial Sequence: Synthetic oligonucleotide
tcagctgacagagagattcagagaacgttaatggag

SEQ ID NO: 135471 - DNA, 35 bp, Artificial Sequence
  Description of Artificial Sequence: Synthetic oligonucleotide
cagctgacagagagattcagagaacgttaatggag

SEQ ID NO: 135472 - DNA, 38 bp, Artificial Sequence
  Description of Artificial Sequence: Synthetic oligonucleotide
agctgacagagagattcagagaacgttaatggagttac

SEQ ID NO: 135473 - DNA, 37 bp, Artificial Sequence
  Description of Artificial Sequence: Synthetic oligonucleotide
gctgacagagagattcagagaacgttaatggagttac

SEQ ID NO: 135474 - DNA, 38 bp, Artificial Sequence
  Description of Artificial Sequence: Synthetic oligonucleotide
ctgacagagagattcagagaacgttaatggagttactg

SEQ ID NO: 135475 - DNA, 41 bp, Artificial Sequence
  Description of Artificial Sequence: Synthetic oligonucleotide
tgacagagagattcagagaacgttaatggagttactgaatc

SEQ ID NO: 135476 - DNA, 40 bp, Artificial Sequence
  Description of Artificial Sequence: Synthetic oligonucleotide
gacagagagattcagagaacgttaatggagttactgaatc

SEQ ID NO: 135477 - DNA, 44 bp, Artificial Sequence
  Description of Artificial Sequence: Synthetic oligonucleotide
acagagagattcagagaacgttaatggagttactgaatcaaatg

SEQ ID NO: 135478 - DNA, 43 bp, Artificial Sequence
  Description of Artificial Sequence: Synthetic oligonucleotide
cagagagattcagagaacgttaatggagttactgaatcaaatg

SEQ ID NO: 135479 - DNA, 43 bp, Artificial Sequence
  Description of Artificial Sequence: Synthetic oligonucleotide
agagagattcagagaacgttaatggagttactgaatcaaatgg

SEQ ID NO: 135480 - DNA, 42 bp, Artificial Sequence
  Description of Artificial Sequence: Synthetic oligonucleotide
gagagattcagagaacgttaatggagttactgaatcaaatgg

SEQ ID NO: 135481 - DNA, 44 bp, Artificial Sequence
  Description of Artificial Sequence: Synthetic oligonucleotide
agagattcagagaacgttaatggagttactgaatcaaatggatg

SEQ ID NO: 135482 - DNA, 43 bp, Artificial Sequence
  Description of Artificial Sequence: Synthetic oligonucleotide
gagattcagagaacgttaatggagttactgaatcaaatggatg

SEQ ID NO: 135483 - DNA, 43 bp, Artificial Sequence
  Description of Artificial Sequence: Synthetic oligonucleotide
agattcagagaacgttaatggagttactgaatcaaatggatgg

SEQ ID NO: 135484 - DNA, 42 bp, Artificial Sequence
  Description of Artificial Sequence: Synthetic oligonucleotide
gattcagagaacgttaatggagttactgaatcaaatggatgg

SEQ ID NO: 135485 - DNA, 46 bp, Artificial Sequence
  Description of Artificial Sequence: Synthetic oligonucleotide
attcagagaacgttaatggagttactgaatcaaatggatggatttg

SEQ ID NO: 135486 - DNA, 45 bp, Artificial Sequence
  Description of Artificial Sequence: Synthetic oligonucleotide
ttcagagaacgttaatggagttactgaatcaaatggatggatttg

SEQ ID NO: 135487 - DNA, 44 bp, Artificial Sequence
  Description of Artificial Sequence: Synthetic oligonucleotide
tcagagaacgttaatggagttactgaatcaaatggatggatttg

SEQ ID NO: 135488 - DNA, 43 bp, Artificial Sequence
  Description of Artificial Sequence: Synthetic oligonucleotide
cagagaacgttaatggagttactgaatcaaatggatggatttg

SEQ ID NO: 135489 - DNA, 46 bp, Artificial Sequence
  Description of Artificial Sequence: Synthetic oligonucleotide
agagaacgttaatggagttactgaatcaaatggatggatttgatac

SEQ ID NO: 135490 - DNA, 45 bp, Artificial Sequence
  Description of Artificial Sequence: Synthetic oligonucleotide
gagaacgttaatggagttactgaatcaaatggatggatttgatac

SEQ ID NO: 135491 - DNA, 46 bp, Artificial Sequence
  Description of Artificial Sequence: Synthetic oligonucleotide
agaacgttaatggagttactgaatcaaatggatggatttgatactc

SEQ ID NO: 135492 - DNA, 45 bp, Artificial Sequence
  Description of Artificial Sequence: Synthetic oligonucleotide
gaacgttaatggagttactgaatcaaatggatggatttgatactc

SEQ ID NO: 135493 - DNA, 46 bp, Artificial Sequence
  Description of Artificial Sequence: Synthetic oligonucleotide
aacgttaatggagttactgaatcaaatggatggatttgatactctg

SEQ ID NO: 135494 - DNA, 45 bp, Artificial Sequence
  Description of Artificial Sequence: Synthetic oligonucleotide
acgttaatggagttactgaatcaaatggatggatttgatactctg

SEQ ID NO: 135495 - DNA, 44 bp, Artificial Sequence
  Description of Artificial Sequence: Synthetic oligonucleotide
cgttaatggagttactgaatcaaatggatggatttgatactctg

SEQ ID NO: 135496 - DNA, 44 bp, Artificial Sequence
  Description of Artificial Sequence: Synthetic oligonucleotide
gttaatggagttactgaatcaaatggatggatttgatactctgc

SEQ ID NO: 135497 - DNA, 47 bp, Artificial Sequence
  Description of Artificial Sequence: Synthetic oligonucleotide
ttaatggagttactgaatcaaatggatggatttgatactctgcatag

SEQ ID NO: 135498 - DNA, 46 bp, Artificial Sequence
  Description of Artificial Sequence: Synthetic oligonucleotide
taatggagttactgaatcaaatggatggatttgatactctgcatag

SEQ ID NO: 135499 - DNA, 45 bp, Artificial Sequence
  Description of Artificial Sequence: Synthetic oligonucleotide
aatggagttactgaatcaaatggatggatttgatactctgcatag

SEQ ID NO: 135500 - DNA, 44 bp, Artificial Sequence
  Description of Artificial Sequence: Synthetic oligonucleotide
atggagttactgaatcaaatggatggatttgatactctgcatag

SEQ ID NO: 135501 - DNA, 43 bp, Artificial Sequence
  Description of Artificial Sequence: Synthetic oligonucleotide
tggagttactgaatcaaatggatggatttgatactctgcatag

SEQ ID NO: 135502 - DNA, 42 bp, Artificial Sequence
  Description of Artificial Sequence: Synthetic oligonucleotide
ggagttactgaatcaaatggatggatttgatactctgcatag

SEQ ID NO: 135503 - DNA, 43 bp, Artificial Sequence
  Description of Artificial Sequence: Synthetic oligonucleotide
gagttactgaatcaaatggatggatttgatactctgcatagag

SEQ ID NO: 135504 - DNA, 50 bp, Artificial Sequence
  Description of Artificial Sequence: Synthetic oligonucleotide
agttactgaatcaaatggatggatttgatactctgcatagagttaaaatg

SEQ ID NO: 135505 - DNA, 49 bp, Artificial Sequence
  Description of Artificial Sequence: Synthetic oligonucleotide
gttactgaatcaaatggatggatttgatactctgcatagagttaaaatg

SEQ ID NO: 135506 - DNA, 51 bp, Artificial Sequence
  Description of Artificial Sequence: Synthetic oligonucleotide
ttactgaatcaaatggatggatttgatactctgcatagagttaaaatgatc

SEQ ID NO: 135507 - DNA, 50 bp, Artificial Sequence
  Description of Artificial Sequence: Synthetic oligonucleotide
tactgaatcaaatggatggatttgatactctgcatagagttaaaatgatc

SEQ ID NO: 135508 - DNA, 49 bp, Artificial Sequence
  Description of Artificial Sequence: Synthetic oligonucleotide
actgaatcaaatggatggatttgatactctgcatagagttaaaatgatc

SEQ ID NO: 135509 - DNA, 48 bp, Artificial Sequence
  Description of Artificial Sequence: Synthetic oligonucleotide
ctgaatcaaatggatggatttgatactctgcatagagttaaaatgatc

SEQ ID NO: 135510 - DNA, 50 bp, Artificial Sequence
  Description of Artificial Sequence: Synthetic oligonucleotide
tgaatcaaatggatggatttgatactctgcatagagttaaaatgatcatg

SEQ ID NO: 135511 - DNA, 49 bp, Artificial Sequence
  Description of Artificial Sequence: Synthetic oligonucleotide
gaatcaaatggatggatttgatactctgcatagagttaaaatgatcatg

SEQ ID NO: 135512 - DNA, 49 bp, Artificial Sequence
  Description of Artificial Sequence: Synthetic oligonucleotide
aatcaaatggatggatttgatactctgcatagagttaaaatgatcatgg

SEQ ID NO: 135513 - DNA, 48 bp, Artificial Sequence
  Description of Artificial Sequence: Synthetic oligonucleotide
atcaaatggatggatttgatactctgcatagagttaaaatgatcatgg

SEQ ID NO: 135514 - DNA, 47 bp, Artificial Sequence
  Description of Artificial Sequence: Synthetic oligonucleotide
tcaaatggatggatttgatactctgcatagagttaaaatgatcatgg

SEQ ID NO: 135515 - DNA, 46 bp, Artificial Sequence
  Description of Artificial Sequence: Synthetic oligonucleotide
caaatggatggatttgatactctgcatagagttaaaatgatcatgg

SEQ ID NO: 135516 - DNA, 46 bp, Artificial Sequence
  Description of Artificial Sequence: Synthetic oligonucleotide
aaatggatggatttgatactctgcatagagttaaaatgatcatggc

SEQ ID NO: 135517 - DNA, 45 bp, Artificial Sequence
  Description of Artificial Sequence: Synthetic oligonucleotide
aatggatggatttgatactctgcatagagttaaaatgatcatggc

SEQ ID NO: 135518 - DNA, 44 bp, Artificial Sequence
  Description of Artificial Sequence: Synthetic oligonucleotide
atggatggatttgatactctgcatagagttaaaatgatcatggc

SEQ ID NO: 135519 - DNA, 43 bp, Artificial Sequence
  Description of Artificial Sequence: Synthetic oligonucleotide
tggatggatttgatactctgcatagagttaaaatgatcatggc

SEQ ID NO: 135520 - DNA, 42 bp, Artificial Sequence
  Description of Artificial Sequence: Synthetic oligonucleotide
ggatggatttgatactctgcatagagttaaaatgatcatggc

SEQ ID NO: 135521 - DNA, 44 bp, Artificial Sequence
  Description of Artificial Sequence: Synthetic oligonucleotide
gatggatttgatactctgcatagagttaaaatgatcatggctac

SEQ ID NO: 135522 - DNA, 47 bp, Artificial Sequence
  Description of Artificial Sequence: Synthetic oligonucleotide
atggatttgatactctgcatagagttaaaatgatcatggctacaaac

SEQ ID NO: 135523 - DNA, 46 bp, Artificial Sequence
  Description of Artificial Sequence: Synthetic oligonucleotide
tggatttgatactctgcatagagttaaaatgatcatggctacaaac

SEQ ID NO: 135524 - DNA, 45 bp, Artificial Sequence
  Description of Artificial Sequence: Synthetic oligonucleotide
ggatttgatactctgcatagagttaaaatgatcatggctacaaac

SEQ ID NO: 135525 - DNA, 46 bp, Artificial Sequence
  Description of Artificial Sequence: Synthetic oligonucleotide
gatttgatactctgcatagagttaaaatgatcatggctacaaacag

SEQ ID NO: 135526 - DNA, 47 bp, Artificial Sequence
  Description of Artificial Sequence: Synthetic oligonucleotide
atttgatactctgcatagagttaaaatgatcatggctacaaacagac

SEQ ID NO: 135527 - DNA, 46 bp, Artificial Sequence
  Description of Artificial Sequence: Synthetic oligonucleotide
tttgatactctgcatagagttaaaatgatcatggctacaaacagac

SEQ ID NO: 135528 - DNA, 45 bp, Artificial Sequence
  Description of Artificial Sequence: Synthetic oligonucleotide
ttgatactctgcatagagttaaaatgatcatggctacaaacagac

SEQ ID NO: 135529 - DNA, 44 bp, Artificial Sequence
  Description of Artificial Sequence: Synthetic oligonucleotide
tgatactctgcatagagttaaaatgatcatggctacaaacagac

SEQ ID NO: 135530 - DNA, 43 bp, Artificial Sequence
  Description of Artificial Sequence: Synthetic oligonucleotide
gatactctgcatagagttaaaatgatcatggctacaaacagac

SEQ ID NO: 135531 - DNA, 43 bp, Artificial Sequence
  Description of Artificial Sequence: Synthetic oligonucleotide
atactctgcatagagttaaaatgatcatggctacaaacagacc

SEQ ID NO: 135532 - DNA, 42 bp, Artificial Sequence
  Description of Artificial Sequence: Synthetic oligonucleotide
tactctgcatagagttaaaatgatcatggctacaaacagacc

SEQ ID NO: 135533 - DNA, 41 bp, Artificial Sequence
  Description of Artificial Sequence: Synthetic oligonucleotide
actctgcatagagttaaaatgatcatggctacaaacagacc

SEQ ID NO: 135534 - DNA, 40 bp, Artificial Sequence
  Description of Artificial Sequence: Synthetic oligonucleotide
ctctgcatagagttaaaatgatcatggctacaaacagacc

SEQ ID NO: 135535 - DNA, 41 bp, Artificial Sequence
  Description of Artificial Sequence: Synthetic oligonucleotide
tctgcatagagttaaaatgatcatggctacaaacagaccag

SEQ ID NO: 135536 - DNA, 40 bp, Artificial Sequence
  Description of Artificial Sequence: Synthetic oligonucleotide
ctgcatagagttaaaatgatcatggctacaaacagaccag

SEQ ID NO: 135537 - DNA, 43 bp, Artificial Sequence
  Description of Artificial Sequence: Synthetic oligonucleotide
tgcatagagttaaaatgatcatggctacaaacagaccagatac

SEQ ID NO: 135538 - DNA, 42 bp, Artificial Sequence
  Description of Artificial Sequence: Synthetic oligonucleotide
gcatagagttaaaatgatcatggctacaaacagaccagatac

SEQ ID NO: 135539 - DNA, 43 bp, Artificial Sequence
  Description of Artificial Sequence: Synthetic oligonucleotide
catagagttaaaatgatcatggctacaaacagaccagatacac

SEQ ID NO: 135540 - DNA, 44 bp, Artificial Sequence
  Description of Artificial Sequence: Synthetic oligonucleotide
atagagttaaaatgatcatggctacaaacagaccagatacactg

SEQ ID NO: 135541 - DNA, 43 bp, Artificial Sequence
  Description of Artificial Sequence: Synthetic oligonucleotide
tagagttaaaatgatcatggctacaaacagaccagatacactg

SEQ ID NO: 135542 - DNA, 42 bp, Artificial Sequence
  Description of Artificial Sequence: Synthetic oligonucleotide
agagttaaaatgatcatggctacaaacagaccagatacactg

SEQ ID NO: 135543 - DNA, 41 bp, Artificial Sequence
  Description of Artificial Sequence: Synthetic oligonucleotide
gagttaaaatgatcatggctacaaacagaccagatacactg

SEQ ID NO: 135544 - DNA, 41 bp, Artificial Sequence
  Description of Artificial Sequence: Synthetic oligonucleotide
agttaaaatgatcatggctacaaacagaccagatacactgg

SEQ ID NO: 135545 - DNA, 40 bp, Artificial Sequence
  Description of Artificial Sequence: Synthetic oligonucleotide
gttaaaatgatcatggctacaaacagaccagatacactgg

SEQ ID NO: 135546 - DNA, 42 bp, Artificial Sequence
  Description of Artificial Sequence: Synthetic oligonucleotide
ttaaaatgatcatggctacaaacagaccagatacactggatc

SEQ ID NO: 135547 - DNA, 41 bp, Artificial Sequence
  Description of Artificial Sequence: Synthetic oligonucleotide
taaaatgatcatggctacaaacagaccagatacactggatc

SEQ ID NO: 135548 - DNA, 40 bp, Artificial Sequence
  Description of Artificial Sequence: Synthetic oligonucleotide
aaaatgatcatggctacaaacagaccagatacactggatc

SEQ ID NO: 135549 - DNA, 39 bp, Artificial Sequence
  Description of Artificial Sequence: Synthetic oligonucleotide
aaatgatcatggctacaaacagaccagatacactggatc

SEQ ID NO: 135550 - DNA, 38 bp, Artificial Sequence
  Description of Artificial Sequence: Synthetic oligonucleotide
aatgatcatggctacaaacagaccagatacactggatc

SEQ ID NO: 135551 - DNA, 37 bp, Artificial Sequence
  Description of Artificial Sequence: Synthetic oligonucleotide
atgatcatggctacaaacagaccagatacactggatc

SEQ ID NO: 135552 - DNA, 36 bp, Artificial Sequence
  Description of Artificial Sequence: Synthetic oligonucleotide
tgatcatggctacaaacagaccagatacactggatc

SEQ ID NO: 135553 - DNA, 35 bp, Artificial Sequence
  Description of Artificial Sequence: Synthetic oligonucleotide
gatcatggctacaaacagaccagatacactggatc

SEQ ID NO: 135554 - DNA, 35 bp, Artificial Sequence
  Description of Artificial Sequence: Synthetic oligonucleotide
atcatggctacaaacagaccagatacactggatcc

SEQ ID NO: 135555 - DNA, 34 bp, Artificial Sequence
  Description of Artificial Sequence: Synthetic oligonucleotide
tcatggctacaaacagaccagatacactggatcc

SEQ ID NO: 135556 - DNA, 33 bp, Artificial Sequence
  Description of Artificial Sequence: Synthetic oligonucleotide
catggctacaaacagaccagatacactggatcc

SEQ ID NO: 135557 - DNA, 34 bp, Artificial Sequence
  Description of Artificial Sequence: Synthetic oligonucleotide
atggctacaaacagaccagatacactggatcctg

SEQ ID NO: 135558 - DNA, 33 bp, Artificial Sequence
  Description of Artificial Sequence: Synthetic oligonucleotide
tggctacaaacagaccagatacactggatcctg

SEQ ID NO: 135559 - DNA, 32 bp, Artificial Sequence
  Description of Artificial Sequence: Synthetic oligonucleotide
ggctacaaacagaccagatacactggatcctg

SEQ ID NO: 135560 - DNA, 32 bp, Artificial Sequence
  Description of Artificial Sequence: Synthetic oligonucleotide
gctacaaacagaccagatacactggatcctgc

SEQ ID NO: 135561 - DNA, 35 bp, Artificial Sequence
  Description of Artificial Sequence: Synthetic oligonucleotide
ctacaaacagaccagatacactggatcctgctttg

SEQ ID NO: 135562 - DNA, 35 bp, Artificial Sequence
  Description of Artificial Sequence: Synthetic oligonucleotide
tacaaacagaccagatacactggatcctgctttgc

SEQ ID NO: 135563 - DNA, 34 bp, Artificial Sequence
  Description of Artificial Sequence: Synthetic oligonucleotide
acaaacagaccagatacactggatcctgctttgc

SEQ ID NO: 135564 - DNA, 33 bp, Artificial Sequence
  Description of Artificial Sequence: Synthetic oligonucleotide
caaacagaccagatacactggatcctgctttgc

SEQ ID NO: 135565 - DNA, 34 bp, Artificial Sequence
  Description of Artificial Sequence: Synthetic oligonucleotide
aaacagaccagatacactggatcctgctttgctg

SEQ ID NO: 135566 - DNA, 33 bp, Artificial Sequence
  Description of Artificial Sequence: Synthetic oligonucleotide
aacagaccagatacactggatcctgctttgctg

SEQ ID NO: 135567 - DNA, 32 bp, Artificial Sequence
  Description of Artificial Sequence: Synthetic oligonucleotide
acagaccagatacactggatcctgctttgctg

SEQ ID NO: 135568 - DNA, 31 bp, Artificial Sequence
  Description of Artificial Sequence: Synthetic oligonucleotide
cagaccagatacactggatcctgctttgctg

SEQ ID NO: 135569 - DNA, 31 bp, Artificial Sequence
  Description of Artificial Sequence: Synthetic oligonucleotide
agaccagatacactggatcctgctttgctgc

SEQ ID NO: 135570 - DNA, 30 bp, Artificial Sequence
  Description of Artificial Sequence: Synthetic oligonucleotide
gaccagatacactggatcctgctttgctgc

SEQ ID NO: 135571 - DNA, 30 bp, Artificial Sequence
  Description of Artificial Sequence: Synthetic oligonucleotide
accagatacactggatcctgctttgctgcg

SEQ ID NO: 135572 - DNA, 29 bp, Artificial Sequence
  Description of Artificial Sequence: Synthetic oligonucleotide
ccagatacactggatcctgctttgctgcg

SEQ ID NO: 135573 - DNA, 30 bp, Artificial Sequence
  Description of Artificial Sequence: Synthetic oligonucleotide
cagatacactggatcctgctttgctgcgtc

SEQ ID NO: 135574 - DNA, 30 bp, Artificial Sequence
  Description of Artificial Sequence: Synthetic oligonucleotide
agatacactggatcctgctttgctgcgtcc

SEQ ID NO: 135575 - DNA, 29 bp, Artificial Sequence
  Description of Artificial Sequence: Synthetic oligonucleotide
gatacactggatcctgctttgctgcgtcc

SEQ ID NO: 135576 - DNA, 30 bp, Artificial Sequence
  Description of Artificial Sequence: Synthetic oligonucleotide
atacactggatcctgctttgctgcgtccag

SEQ ID NO: 135577 - DNA, 29 bp, Artificial Sequence
  Description of Artificial Sequence: Synthetic oligonucleotide
tacactggatcctgctttgctgcgtccag

SEQ ID NO: 135578 - DNA, 28 bp, Artificial Sequence
  Description of Artificial Sequence: Synthetic oligonucleotide
acactggatcctgctttgctgcgtccag

SEQ ID NO: 135579 - DNA, 27 bp, Artificial Sequence
  Description of Artificial Sequence: Synthetic oligonucleotide
cactggatcctgctttgctgcgtccag

SEQ ID NO: 135580 - DNA, 27 bp, Artificial Sequence
  Description of Artificial Sequence: Synthetic oligonucleotide
actggatcctgctttgctgcgtccagg

SEQ ID NO: 135581 - DNA, 27 bp, Artificial Sequence
  Description of Artificial Sequence: Synthetic oligonucleotide
ctggatcctgctttgctgcgtccagga

SEQ ID NO: 135582 - DNA, 28 bp, Artificial Sequence
  Description of Artificial Sequence: Synthetic oligonucleotide
tggatcctgctttgctgcgtccaggaag

SEQ ID NO: 135583 - DNA, 27 bp, Artificial Sequence
  Description of Artificial Sequence: Synthetic oligonucleotide
ggatcctgctttgctgcgtccaggaag

SEQ ID NO: 135584 - DNA, 31 bp, Artificial Sequence
  Description of Artificial Sequence: Synthetic oligonucleotide
gatcctgctttgctgcgtccaggaagattag

SEQ ID NO: 135585 - DNA, 34 bp, Artificial Sequence
  Description of Artificial Sequence: Synthetic oligonucleotide
atcctgctttgctgcgtccaggaagattagatag

SEQ ID NO: 135586 - DNA, 33 bp, Artificial Sequence
  Description of Artificial Sequence: Synthetic oligonucleotide
tcctgctttgctgcgtccaggaagattagatag

SEQ ID NO: 135587 - DNA, 32 bp, Artificial Sequence
  Description of Artificial Sequence: Synthetic oligonucleotide
cctgctttgctgcgtccaggaagattagatag

SEQ ID NO: 135588 - DNA, 39 bp, Artificial Sequence
  Description of Artificial Sequence: Synthetic oligonucleotide
ctgctttgctgcgtccaggaagattagatagaaaaatac

SEQ ID NO: 135589 - DNA, 44 bp, Artificial Sequence
  Description of Artificial Sequence: Synthetic oligonucleotide
tgctttgctgcgtccaggaagattagatagaaaaatacatattg

SEQ ID NO: 135590 - DNA, 43 bp, Artificial Sequence
  Description of Artificial Sequence: Synthetic oligonucleotide
gctttgctgcgtccaggaagattagatagaaaaatacatattg

SEQ ID NO: 135591 - DNA, 47 bp, Artificial Sequence
  Description of Artificial Sequence: Synthetic oligonucleotide
ctttgctgcgtccaggaagattagatagaaaaatacatattgatttg

SEQ ID NO: 135592 - DNA, 47 bp, Artificial Sequence
  Description of Artificial Sequence: Synthetic oligonucleotide
tttgctgcgtccaggaagattagatagaaaaatacatattgatttgc

SEQ ID NO: 135593 - DNA, 46 bp, Artificial Sequence
  Description of Artificial Sequence: Synthetic oligonucleotide
ttgctgcgtccaggaagattagatagaaaaatacatattgatttgc

SEQ ID NO: 135594 - DNA, 45 bp, Artificial Sequence
  Description of Artificial Sequence: Synthetic oligonucleotide
tgctgcgtccaggaagattagatagaaaaatacatattgatttgc

SEQ ID NO: 135595 - DNA, 44 bp, Artificial Sequence
  Description of Artificial Sequence: Synthetic oligonucleotide
gctgcgtccaggaagattagatagaaaaatacatattgatttgc

SEQ ID NO: 135596 - DNA, 44 bp, Artificial Sequence
  Description of Artificial Sequence: Synthetic oligonucleotide
ctgcgtccaggaagattagatagaaaaatacatattgatttgcc

SEQ ID NO: 135597 - DNA, 48 bp, Artificial Sequence
  Description of Artificial Sequence: Synthetic oligonucleotide
tgcgtccaggaagattagatagaaaaatacatattgatttgccaaatg

SEQ ID NO: 135598 - DNA, 47 bp, Artificial Sequence
  Description of Artificial Sequence: Synthetic oligonucleotide
gcgtccaggaagattagatagaaaaatacatattgatttgccaaatg

SEQ ID NO: 135599 - DNA, 49 bp, Artificial Sequence
  Description of Artificial Sequence: Synthetic oligonucleotide
cgtccaggaagattagatagaaaaatacatattgatttgccaaatgaac

SEQ ID NO: 135600 - DNA, 51 bp, Artificial Sequence
  Description of Artificial Sequence: Synthetic oligonucleotide
gtccaggaagattagatagaaaaatacatattgatttgccaaatgaacaag

SEQ ID NO: 135601 - DNA, 51 bp, Artificial Sequence
  Description of Artificial Sequence: Synthetic oligonucleotide
tccaggaagattagatagaaaaatacatattgatttgccaaatgaacaagc

SEQ ID NO: 135602 - DNA, 50 bp, Artificial Sequence
  Description of Artificial Sequence: Synthetic oligonucleotide
ccaggaagattagatagaaaaatacatattgatttgccaaatgaacaagc

SEQ ID NO: 135603 - DNA, 52 bp, Artificial Sequence
  Description of Artificial Sequence: Synthetic oligonucleotide
caggaagattagatagaaaaatacatattgatttgccaaatgaacaagcaag

SEQ ID NO: 135604 - DNA, 56 bp, Artificial Sequence
  Description of Artificial Sequence: Synthetic oligonucleotide
aggaagattagatagaaaaatacatattgatttgccaaatgaacaagcaagattag

SEQ ID NO: 135605 - DNA, 55 bp, Artificial Sequence
  Description of Artificial Sequence: Synthetic oligonucleotide
ggaagattagatagaaaaatacatattgatttgccaaatgaacaagcaagattag

SEQ ID NO: 135606 - DNA, 56 bp, Artificial Sequence
  Description of Artificial Sequence: Synthetic oligonucleotide
gaagattagatagaaaaatacatattgatttgccaaatgaacaagcaagattagac

SEQ ID NO: 135607 - DNA, 59 bp, Artificial Sequence
  Description of Artificial Sequence: Synthetic oligonucleotide
aagattagatagaaaaatacatattgatttgccaaatgaacaagcaagattagacatac

SEQ ID NO: 135608 - DNA, 58 bp, Artificial Sequence
  Description of Artificial Sequence: Synthetic oligonucleotide
agattagatagaaaaatacatattgatttgccaaatgaacaagcaagattagacatac

SEQ ID NO: 135609 - DNA, 57 bp, Artificial Sequence
  Description of Artificial Sequence: Synthetic oligonucleotide
gattagatagaaaaatacatattgatttgccaaatgaacaagcaagattagacatac

SEQ ID NO: 135610 - DNA, 58 bp, Artificial Sequence
  Description of Artificial Sequence: Synthetic oligonucleotide
attagatagaaaaatacatattgatttgccaaatgaacaagcaagattagacatactg

SEQ ID NO: 135611 - DNA, 57 bp, Artificial Sequence
  Description of Artificial Sequence: Synthetic oligonucleotide
ttagatagaaaaatacatattgatttgccaaatgaacaagcaagattagacatactg

SEQ ID NO: 135612 - DNA, 56 bp, Artificial Sequence
  Description of Artificial Sequence: Synthetic oligonucleotide
tagatagaaaaatacatattgatttgccaaatgaacaagcaagattagacatactg

SEQ ID NO: 135613 - DNA, 55 bp, Artificial Sequence
  Description of Artificial Sequence: Synthetic oligonucleotide
agatagaaaaatacatattgatttgccaaatgaacaagcaagattagacatactg

SEQ ID NO: 135614 - DNA, 54 bp, Artificial Sequence
  Description of Artificial Sequence: Synthetic oligonucleotide
gatagaaaaatacatattgatttgccaaatgaacaagcaagattagacatactg

SEQ ID NO: 135615 - DNA, 59 bp, Artificial Sequence
  Description of Artificial Sequence: Synthetic oligonucleotide
atagaaaaatacatattgatttgccaaatgaacaagcaagattagacatactgaaaatc

SEQ ID NO: 135616 - DNA, 58 bp, Artificial Sequence
  Description of Artificial Sequence: Synthetic oligonucleotide
tagaaaaatacatattgatttgccaaatgaacaagcaagattagacatactgaaaatc

SEQ ID NO: 135617 - DNA, 57 bp, Artificial Sequence
  Description of Artificial Sequence: Synthetic oligonucleotide
agaaaaatacatattgatttgccaaatgaacaagcaagattagacatactgaaaatc

SEQ ID NO: 135618 - DNA, 56 bp, Artificial Sequence
  Description of Artificial Sequence: Synthetic oligonucleotide
gaaaaatacatattgatttgccaaatgaacaagcaagattagacatactgaaaatc

SEQ ID NO: 135619 - DNA, 56 bp, Artificial Sequence
  Description of Artificial Sequence: Synthetic oligonucleotide
aaaaatacatattgatttgccaaatgaacaagcaagattagacatactgaaaatcc

SEQ ID NO: 135620 - DNA, 55 bp, Artificial Sequence
  Description of Artificial Sequence: Synthetic oligonucleotide
aaaatacatattgatttgccaaatgaacaagcaagattagacatactgaaaatcc

SEQ ID NO: 135621 - DNA, 54 bp, Artificial Sequence
  Description of Artificial Sequence: Synthetic oligonucleotide
aaatacatattgatttgccaaatgaacaagcaagattagacatactgaaaatcc

SEQ ID NO: 135622 - DNA, 53 bp, Artificial Sequence
  Description of Artificial Sequence: Synthetic oligonucleotide
aatacatattgatttgccaaatgaacaagcaagattagacatactgaaaatcc

SEQ ID NO: 135623 - DNA, 52 bp, Artificial Sequence
  Description of Artificial Sequence: Synthetic oligonucleotide
atacatattgatttgccaaatgaacaagcaagattagacatactgaaaatcc

SEQ ID NO: 135624 - DNA, 51 bp, Artificial Sequence
  Description of Artificial Sequence: Synthetic oligonucleotide
tacatattgatttgccaaatgaacaagcaagattagacatactgaaaatcc

SEQ ID NO: 135625 - DNA, 50 bp, Artificial Sequence
  Description of Artificial Sequence: Synthetic oligonucleotide
acatattgatttgccaaatgaacaagcaagattagacatactgaaaatcc

SEQ ID NO: 135626 - DNA, 49 bp, Artificial Sequence
  Description of Artificial Sequence: Synthetic oligonucleotide
catattgatttgccaaatgaacaagcaagattagacatactgaaaatcc

SEQ ID NO: 135627 - DNA, 51 bp, Artificial Sequence
  Description of Artificial Sequence: Synthetic oligonucleotide
atattgatttgccaaatgaacaagcaagattagacatactgaaaatccatg

SEQ ID NO: 135628 - DNA, 50 bp, Artificial Sequence
  Description of Artificial Sequence: Synthetic oligonucleotide
tattgatttgccaaatgaacaagcaagattagacatactgaaaatccatg

SEQ ID NO: 135629 - DNA, 49 bp, Artificial Sequence
  Description of Artificial Sequence: Synthetic oligonucleotide
attgatttgccaaatgaacaagcaagattagacatactgaaaatccatg

SEQ ID NO: 135630 - DNA, 48 bp, Artificial Sequence
  Description of Artificial Sequence: Synthetic oligonucleotide
ttgatttgccaaatgaacaagcaagattagacatactgaaaatccatg

SEQ ID NO: 135631 - DNA, 47 bp, Artificial Sequence
  Description of Artificial Sequence: Synthetic oligonucleotide
tgatttgccaaatgaacaagcaagattagacatactgaaaatccatg

SEQ ID NO: 135632 - DNA, 46 bp, Artificial Sequence
  Description of Artificial Sequence: Synthetic oligonucleotide
gatttgccaaatgaacaagcaagattagacatactgaaaatccatg

SEQ ID NO: 135633 - DNA, 46 bp, Artificial Sequence
  Description of Artificial Sequence: Synthetic oligonucleotide
atttgccaaatgaacaagcaagattagacatactgaaaatccatgc

SEQ ID NO: 135634 - DNA, 45 bp, Artificial Sequence
  Description of Artificial Sequence: Synthetic oligonucleotide
tttgccaaatgaacaagcaagattagacatactgaaaatccatgc

SEQ ID NO: 135635 - DNA, 44 bp, Artificial Sequence
  Description of Artificial Sequence: Synthetic oligonucleotide
ttgccaaatgaacaagcaagattagacatactgaaaatccatgc

SEQ ID NO: 135636 - DNA, 43 bp, Artificial Sequence
  Description of Artificial Sequence: Synthetic oligonucleotide
tgccaaatgaacaagcaagattagacatactgaaaatccatgc

SEQ ID NO: 135637 - DNA, 42 bp, Artificial Sequence
  Description of Artificial Sequence: Synthetic oligonucleotide
gccaaatgaacaagcaagattagacatactgaaaatccatgc

SEQ ID NO: 135638 - DNA, 43 bp, Artificial Sequence
  Description of Artificial Sequence: Synthetic oligonucleotide
ccaaatgaacaagcaagattagacatactgaaaatccatgcag

SEQ ID NO: 135639 - DNA, 43 bp, Artificial Sequence
  Description of Artificial Sequence: Synthetic oligonucleotide
caaatgaacaagcaagattagacatactgaaaatccatgcagg

SEQ ID NO: 135640 - DNA, 44 bp, Artificial Sequence
  Description of Artificial Sequence: Synthetic oligonucleotide
aaatgaacaagcaagattagacatactgaaaatccatgcaggtc

SEQ ID NO: 135641 - DNA, 43 bp, Artificial Sequence
  Description of Artificial Sequence: Synthetic oligonucleotide
aatgaacaagcaagattagacatactgaaaatccatgcaggtc

SEQ ID NO: 135642 - DNA, 42 bp, Artificial Sequence
  Description of Artificial Sequence: Synthetic oligonucleotide
atgaacaagcaagattagacatactgaaaatccatgcaggtc

SEQ ID NO: 135643 - DNA, 41 bp, Artificial Sequence
  Description of Artificial Sequence: Synthetic oligonucleotide
tgaacaagcaagattagacatactgaaaatccatgcaggtc

SEQ ID NO: 135644 - DNA, 40 bp, Artificial Sequence
  Description of Artificial Sequence: Synthetic oligonucleotide
gaacaagcaagattagacatactgaaaatccatgcaggtc

SEQ ID NO: 135645 - DNA, 40 bp, Artificial Sequence
  Description of Artificial Sequence: Synthetic oligonucleotide
aacaagcaagattagacatactgaaaatccatgcaggtcc

SEQ ID NO: 135646 - DNA, 39 bp, Artificial Sequence
  Description of Artificial Sequence: Synthetic oligonucleotide
acaagcaagattagacatactgaaaatccatgcaggtcc

SEQ ID NO: 135647 - DNA, 38 bp, Artificial Sequence
  Description of Artificial Sequence: Synthetic oligonucleotide
caagcaagattagacatactgaaaatccatgcaggtcc

SEQ ID NO: 135648 - DNA, 38 bp, Artificial Sequence
  Description of Artificial Sequence: Synthetic oligonucleotide
aagcaagattagacatactgaaaatccatgcaggtccc

SEQ ID NO: 135649 - DNA, 37 bp, Artificial Sequence
  Description of Artificial Sequence: Synthetic oligonucleotide
agcaagattagacatactgaaaatccatgcaggtccc

SEQ ID NO: 135650 - DNA, 36 bp, Artificial Sequence
  Description of Artificial Sequence: Synthetic oligonucleotide
gcaagattagacatactgaaaatccatgcaggtccc

SEQ ID NO: 135651 - DNA, 40 bp, Artificial Sequence
  Description of Artificial Sequence: Synthetic oligonucleotide
caagattagacatactgaaaatccatgcaggtcccattac

SEQ ID NO: 135652 - DNA, 43 bp, Artificial Sequence
  Description of Artificial Sequence: Synthetic oligonucleotide
aagattagacatactgaaaatccatgcaggtcccattacaaag

SEQ ID NO: 135653 - DNA, 42 bp, Artificial Sequence
  Description of Artificial Sequence: Synthetic oligonucleotide
agattagacatactgaaaatccatgcaggtcccattacaaag

SEQ ID NO: 135654 - DNA, 41 bp, Artificial Sequence
  Description of Artificial Sequence: Synthetic oligonucleotide
gattagacatactgaaaatccatgcaggtcccattacaaag

SEQ ID NO: 135655 - DNA, 41 bp, Artificial Sequence
  Description of Artificial Sequence: Synthetic oligonucleotide
attagacatactgaaaatccatgcaggtcccattacaaagc

SEQ ID NO: 135656 - DNA, 40 bp, Artificial Sequence
  Description of Artificial Sequence: Synthetic oligonucleotide
ttagacatactgaaaatccatgcaggtcccattacaaagc

SEQ ID NO: 135657 - DNA, 39 bp, Artificial Sequence
  Description of Artificial Sequence: Synthetic oligonucleotide
tagacatactgaaaatccatgcaggtcccattacaaagc

SEQ ID NO: 135658 - DNA, 38 bp, Artificial Sequence
  Description of Artificial Sequence: Synthetic oligonucleotide
agacatactgaaaatccatgcaggtcccattacaaagc

SEQ ID NO: 135659 - DNA, 37 bp, Artificial Sequence
  Description of Artificial Sequence: Synthetic oligonucleotide
gacatactgaaaatccatgcaggtcccattacaaagc

SEQ ID NO: 135660 - DNA, 39 bp, Artificial Sequence
  Description of Artificial Sequence: Synthetic oligonucleotide
acatactgaaaatccatgcaggtcccattacaaagcatg

SEQ ID NO: 135661 - DNA, 38 bp, Artificial Sequence
  Description of Artificial Sequence: Synthetic oligonucleotide
catactgaaaatccatgcaggtcccattacaaagcatg

SEQ ID NO: 135662 - DNA, 38 bp, Artificial Sequence
  Description of Artificial Sequence: Synthetic oligonucleotide
atactgaaaatccatgcaggtcccattacaaagcatgg

SEQ ID NO: 135663 - DNA, 37 bp, Artificial Sequence
  Description of Artificial Sequence: Synthetic oligonucleotide
tactgaaaatccatgcaggtcccattacaaagcatgg

SEQ ID NO: 135664 - DNA, 36 bp, Artificial Sequence
  Description of Artificial Sequence: Synthetic oligonucleotide
actgaaaatccatgcaggtcccattacaaagcatgg

SEQ ID NO: 135665 - DNA, 35 bp, Artificial Sequence
  Description of Artificial Sequence: Synthetic oligonucleotide
ctgaaaatccatgcaggtcccattacaaagcatgg

SEQ ID NO: 135666 - DNA, 36 bp, Artificial Sequence
  Description of Artificial Sequence: Synthetic oligonucleotide
tgaaaatccatgcaggtcccattacaaagcatggtg

SEQ ID NO: 135667 - DNA, 35 bp, Artificial Sequence
  Description of Artificial Sequence: Synthetic oligonucleotide
gaaaatccatgcaggtcccattacaaagcatggtg

SEQ ID NO: 135668 - DNA, 40 bp, Artificial Sequence
  Description of Artificial Sequence: Synthetic oligonucleotide
aaaatccatgcaggtcccattacaaagcatggtgaaatag

SEQ ID NO: 135669 - DNA, 39 bp, Artificial Sequence
  Description of Artificial Sequence: Synthetic oligonucleotide
aaatccatgcaggtcccattacaaagcatggtgaaatag

SEQ ID NO: 135670 - DNA, 38 bp, Artificial Sequence
  Description of Artificial Sequence: Synthetic oligonucleotide
aatccatgcaggtcccattacaaagcatggtgaaatag

SEQ ID NO: 135671 - DNA, 37 bp, Artificial Sequence
  Description of Artificial Sequence: Synthetic oligonucleotide
atccatgcaggtcccattacaaagcatggtgaaatag

SEQ ID NO: 135672 - DNA, 36 bp, Artificial Sequence
  Description of Artificial Sequence: Synthetic oligonucleotide
tccatgcaggtcccattacaaagcatggtgaaatag

SEQ ID NO: 135673 - DNA, 35 bp, Artificial Sequence
  Description of Artificial Sequence: Synthetic oligonucleotide
ccatgcaggtcccattacaaagcatggtgaaatag

SEQ ID NO: 135674 - DNA, 40 bp, Artificial Sequence
  Description of Artificial Sequence: Synthetic oligonucleotide
catgcaggtcccattacaaagcatggtgaaatagattatg

SEQ ID NO: 135675 - DNA, 42 bp, Artificial Sequence
  Description of Artificial Sequence: Synthetic oligonucleotide
atgcaggtcccattacaaagcatggtgaaatagattatgaag

SEQ ID NO: 135676 - DNA, 41 bp, Artificial Sequence
  Description of Artificial Sequence: Synthetic oligonucleotide
tgcaggtcccattacaaagcatggtgaaatagattatgaag

SEQ ID NO: 135677 - DNA, 40 bp, Artificial Sequence
  Description of Artificial Sequence: Synthetic oligonucleotide
gcaggtcccattacaaagcatggtgaaatagattatgaag

SEQ ID NO: 135678 - DNA, 40 bp, Artificial Sequence
  Description of Artificial Sequence: Synthetic oligonucleotide
caggtcccattacaaagcatggtgaaatagattatgaagc

SEQ ID NO: 135679 - DNA, 44 bp, Artificial Sequence
  Description of Artificial Sequence: Synthetic oligonucleotide
aggtcccattacaaagcatggtgaaatagattatgaagcaattg

SEQ ID NO: 135680 - DNA, 43 bp, Artificial Sequence
  Description of Artificial Sequence: Synthetic oligonucleotide
ggtcccattacaaagcatggtgaaatagattatgaagcaattg

SEQ ID NO: 135681 - DNA, 44 bp, Artificial Sequence
  Description of Artificial Sequence: Synthetic oligonucleotide
gtcccattacaaagcatggtgaaatagattatgaagcaattgtg

SEQ ID NO: 135682 - DNA, 46 bp, Artificial Sequence
  Description of Artificial Sequence: Synthetic oligonucleotide
tcccattacaaagcatggtgaaatagattatgaagcaattgtgaag

SEQ ID NO: 135683 - DNA, 45 bp, Artificial Sequence
  Description of Artificial Sequence: Synthetic oligonucleotide
cccattacaaagcatggtgaaatagattatgaagcaattgtgaag

SEQ ID NO: 135684 - DNA, 45 bp, Artificial Sequence
  Description of Artificial Sequence: Synthetic oligonucleotide
ccattacaaagcatggtgaaatagattatgaagcaattgtgaagc

SEQ ID NO: 135685 - DNA, 48 bp, Artificial Sequence
  Description of Artificial Sequence: Synthetic oligonucleotide
cattacaaagcatggtgaaatagattatgaagcaattgtgaagctttc

SEQ ID NO: 135686 - DNA, 48 bp, Artificial Sequence
  Description of Artificial Sequence: Synthetic oligonucleotide
attacaaagcatggtgaaatagattatgaagcaattgtgaagctttcg

SEQ ID NO: 135687 - DNA, 47 bp, Artificial Sequence
  Description of Artificial Sequence: Synthetic oligonucleotide
ttacaaagcatggtgaaatagattatgaagcaattgtgaagctttcg

SEQ ID NO: 135688 - DNA, 46 bp, Artificial Sequence
  Description of Artificial Sequence: Synthetic oligonucleotide
tacaaagcatggtgaaatagattatgaagcaattgtgaagctttcg

SEQ ID NO: 135689 - DNA, 45 bp, Artificial Sequence
  Description of Artificial Sequence: Synthetic oligonucleotide
acaaagcatggtgaaatagattatgaagcaattgtgaagctttcg

SEQ ID NO: 135690 - DNA, 44 bp, Artificial Sequence
  Description of Artificial Sequence: Synthetic oligonucleotide
caaagcatggtgaaatagattatgaagcaattgtgaagctttcg

SEQ ID NO: 135691 - DNA, 44 bp, Artificial Sequence
  Description of Artificial Sequence: Synthetic oligonucleotide
aaagcatggtgaaatagattatgaagcaattgtgaagctttcgg

SEQ ID NO: 135692 - DNA, 43 bp, Artificial Sequence
  Description of Artificial Sequence: Synthetic oligonucleotide
aagcatggtgaaatagattatgaagcaattgtgaagctttcgg

SEQ ID NO: 135693 - DNA, 42 bp, Artificial Sequence
  Description of Artificial Sequence: Synthetic oligonucleotide
agcatggtgaaatagattatgaagcaattgtgaagctttcgg

SEQ ID NO: 135694 - DNA, 41 bp, Artificial Sequence
  Description of Artificial Sequence: Synthetic oligonucleotide
gcatggtgaaatagattatgaagcaattgtgaagctttcgg

SEQ ID NO: 135695 - DNA, 43 bp, Artificial Sequence
  Description of Artificial Sequence: Synthetic oligonucleotide
catggtgaaatagattatgaagcaattgtgaagctttcggatg

SEQ ID NO: 135696 - DNA, 43 bp, Artificial Sequence
  Description of Artificial Sequence: Synthetic oligonucleotide
atggtgaaatagattatgaagcaattgtgaagctttcggatgg

SEQ ID NO: 135697 - DNA, 42 bp, Artificial Sequence
  Description of Artificial Sequence: Synthetic oligonucleotide
tggtgaaatagattatgaagcaattgtgaagctttcggatgg

SEQ ID NO: 135698 - DNA, 41 bp, Artificial Sequence
  Description of Artificial Sequence: Synthetic oligonucleotide
ggtgaaatagattatgaagcaattgtgaagctttcggatgg

SEQ ID NO: 135699 - DNA, 41 bp, Artificial Sequence
  Description of Artificial Sequence: Synthetic oligonucleotide
gtgaaatagattatgaagcaattgtgaagctttcggatggc

SEQ ID NO: 135700 - DNA, 47 bp, Artificial Sequence
  Description of Artificial Sequence: Synthetic oligonucleotide
tgaaatagattatgaagcaattgtgaagctttcggatggctttaatg

SEQ ID NO: 135701 - DNA, 46 bp, Artificial Sequence
  Description of Artificial Sequence: Synthetic oligonucleotide
gaaatagattatgaagcaattgtgaagctttcggatggctttaatg

SEQ ID NO: 135702 - DNA, 46 bp, Artificial Sequence
  Description of Artificial Sequence: Synthetic oligonucleotide
aaatagattatgaagcaattgtgaagctttcggatggctttaatgg

SEQ ID NO: 135703 - DNA, 45 bp, Artificial Sequence
  Description of Artificial Sequence: Synthetic oligonucleotide
aatagattatgaagcaattgtgaagctttcggatggctttaatgg

SEQ ID NO: 135704 - DNA, 44 bp, Artificial Sequence
  Description of Artificial Sequence: Synthetic oligonucleotide
atagattatgaagcaattgtgaagctttcggatggctttaatgg

SEQ ID NO: 135705 - DNA, 43 bp, Artificial Sequence
  Description of Artificial Sequence: Synthetic oligonucleotide
tagattatgaagcaattgtgaagctttcggatggctttaatgg

SEQ ID NO: 135706 - DNA, 42 bp, Artificial Sequence
  Description of Artificial Sequence: Synthetic oligonucleotide
agattatgaagcaattgtgaagctttcggatggctttaatgg

SEQ ID NO: 135707 - DNA, 41 bp, Artificial Sequence
  Description of Artificial Sequence: Synthetic oligonucleotide
gattatgaagcaattgtgaagctttcggatggctttaatgg

SEQ ID NO: 135708 - DNA, 42 bp, Artificial Sequence
  Description of Artificial Sequence: Synthetic oligonucleotide
attatgaagcaattgtgaagctttcggatggctttaatggag

SEQ ID NO: 135709 - DNA, 41 bp, Artificial Sequence
  Description of Artificial Sequence: Synthetic oligonucleotide
ttatgaagcaattgtgaagctttcggatggctttaatggag

SEQ ID NO: 135710 - DNA, 40 bp, Artificial Sequence
  Description of Artificial Sequence: Synthetic oligonucleotide
tatgaagcaattgtgaagctttcggatggctttaatggag

SEQ ID NO: 135711 - DNA, 39 bp, Artificial Sequence
  Description of Artificial Sequence: Synthetic oligonucleotide
atgaagcaattgtgaagctttcggatggctttaatggag

SEQ ID NO: 135712 - DNA, 38 bp, Artificial Sequence
  Description of Artificial Sequence: Synthetic oligonucleotide
tgaagcaattgtgaagctttcggatggctttaatggag

SEQ ID NO: 135713 - DNA, 37 bp, Artificial Sequence
  Description of Artificial Sequence: Synthetic oligonucleotide
gaagcaattgtgaagctttcggatggctttaatggag

SEQ ID NO: 135714 - DNA, 37 bp, Artificial Sequence
  Description of Artificial Sequence: Synthetic oligonucleotide
aagcaattgtgaagctttcggatggctttaatggagc

SEQ ID NO: 135715 - DNA, 36 bp, Artificial Sequence
  Description of Artificial Sequence: Synthetic oligonucleotide
agcaattgtgaagctttcggatggctttaatggagc

SEQ ID NO: 135716 - DNA, 35 bp, Artificial Sequence
  Description of Artificial Sequence: Synthetic oligonucleotide
gcaattgtgaagctttcggatggctttaatggagc

SEQ ID NO: 135717 - DNA, 36 bp, Artificial Sequence
  Description of Artificial Sequence: Synthetic oligonucleotide
caattgtgaagctttcggatggctttaatggagcag

SEQ ID NO: 135718 - DNA, 38 bp, Artificial Sequence
  Description of Artificial Sequence: Synthetic oligonucleotide
aattgtgaagctttcggatggctttaatggagcagatc

SEQ ID NO: 135719 - DNA, 37 bp, Artificial Sequence
  Description of Artificial Sequence: Synthetic oligonucleotide
attgtgaagctttcggatggctttaatggagcagatc

SEQ ID NO: 135720 - DNA, 36 bp, Artificial Sequence
  Description of Artificial Sequence: Synthetic oligonucleotide
ttgtgaagctttcggatggctttaatggagcagatc

SEQ ID NO: 135721 - DNA, 35 bp, Artificial Sequence
  Description of Artificial Sequence: Synthetic oligonucleotide
tgtgaagctttcggatggctttaatggagcagatc

SEQ ID NO: 135722 - DNA, 34 bp, Artificial Sequence
  Description of Artificial Sequence: Synthetic oligonucleotide
gtgaagctttcggatggctttaatggagcagatc

SEQ ID NO: 135723 - DNA, 35 bp, Artificial Sequence
  Description of Artificial Sequence: Synthetic oligonucleotide
tgaagctttcggatggctttaatggagcagatctg

SEQ ID NO: 135724 - DNA, 34 bp, Artificial Sequence
  Description of Artificial Sequence: Synthetic oligonucleotide
gaagctttcggatggctttaatggagcagatctg

SEQ ID NO: 135725 - DNA, 35 bp, Artificial Sequence
  Description of Artificial Sequence: Synthetic oligonucleotide
aagctttcggatggctttaatggagcagatctgag

SEQ ID NO: 135726 - DNA, 34 bp, Artificial Sequence
  Description of Artificial Sequence: Synthetic oligonucleotide
agctttcggatggctttaatggagcagatctgag

SEQ ID NO: 135727 - DNA, 33 bp, Artificial Sequence
  Description of Artificial Sequence: Synthetic oligonucleotide
gctttcggatggctttaatggagcagatctgag

SEQ ID NO: 135728 - DNA, 37 bp, Artificial Sequence
  Description of Artificial Sequence: Synthetic oligonucleotide
ctttcggatggctttaatggagcagatctgagaaatg

SEQ ID NO: 135729 - DNA, 40 bp, Artificial Sequence
  Description of Artificial Sequence: Synthetic oligonucleotide
tttcggatggctttaatggagcagatctgagaaatgtttg

SEQ ID NO: 135730 - DNA, 39 bp, Artificial Sequence
  Description of Artificial Sequence: Synthetic oligonucleotide
ttcggatggctttaatggagcagatctgagaaatgtttg

SEQ ID NO: 135731 - DNA, 38 bp, Artificial Sequence
  Description of Artificial Sequence: Synthetic oligonucleotide
tcggatggctttaatggagcagatctgagaaatgtttg

SEQ ID NO: 135732 - DNA, 37 bp, Artificial Sequence
  Description of Artificial Sequence: Synthetic oligonucleotide
cggatggctttaatggagcagatctgagaaatgtttg

SEQ ID NO: 135733 - DNA, 39 bp, Artificial Sequence
  Description of Artificial Sequence: Synthetic oligonucleotide
ggatggctttaatggagcagatctgagaaatgtttgtac

SEQ ID NO: 135734 - DNA, 40 bp, Artificial Sequence
  Description of Artificial Sequence: Synthetic oligonucleotide
gatggctttaatggagcagatctgagaaatgtttgtactg

SEQ ID NO: 135735 - DNA, 42 bp, Artificial Sequence
  Description of Artificial Sequence: Synthetic oligonucleotide
atggctttaatggagcagatctgagaaatgtttgtactgaag

SEQ ID NO: 135736 - DNA, 41 bp, Artificial Sequence
  Description of Artificial Sequence: Synthetic oligonucleotide
tggctttaatggagcagatctgagaaatgtttgtactgaag

SEQ ID NO: 135737 - DNA, 40 bp, Artificial Sequence
  Description of Artificial Sequence: Synthetic oligonucleotide
ggctttaatggagcagatctgagaaatgtttgtactgaag

SEQ ID NO: 135738 - DNA, 40 bp, Artificial Sequence
  Description of Artificial Sequence: Synthetic oligonucleotide
gctttaatggagcagatctgagaaatgtttgtactgaagc

SEQ ID NO: 135739 - DNA, 41 bp, Artificial Sequence
  Description of Artificial Sequence: Synthetic oligonucleotide
ctttaatggagcagatctgagaaatgtttgtactgaagcag

SEQ ID NO: 135740 - DNA, 41 bp, Artificial Sequence
  Description of Artificial Sequence: Synthetic oligonucleotide
tttaatggagcagatctgagaaatgtttgtactgaagcagg

SEQ ID NO: 135741 - DNA, 40 bp, Artificial Sequence
  Description of Artificial Sequence: Synthetic oligonucleotide
ttaatggagcagatctgagaaatgtttgtactgaagcagg

SEQ ID NO: 135742 - DNA, 39 bp, Artificial Sequence
  Description of Artificial Sequence: Synthetic oligonucleotide
taatggagcagatctgagaaatgtttgtactgaagcagg

SEQ ID NO: 135743 - DNA, 38 bp, Artificial Sequence
  Description of Artificial Sequence: Synthetic oligonucleotide
aatggagcagatctgagaaatgtttgtactgaagcagg

SEQ ID NO: 135744 - DNA, 37 bp, Artificial Sequence
  Description of Artificial Sequence: Synthetic oligonucleotide
atggagcagatctgagaaatgtttgtactgaagcagg

SEQ ID NO: 135745 - DNA, 36 bp, Artificial Sequence
  Description of Artificial Sequence: Synthetic oligonucleotide
tggagcagatctgagaaatgtttgtactgaagcagg

SEQ ID NO: 135746 - DNA, 35 bp, Artificial Sequence
  Description of Artificial Sequence: Synthetic oligonucleotide
ggagcagatctgagaaatgtttgtactgaagcagg

SEQ ID NO: 135747 - DNA, 38 bp, Artificial Sequence
  Description of Artificial Sequence: Synthetic oligonucleotide
gagcagatctgagaaatgtttgtactgaagcaggtatg

SEQ ID NO: 135748 - DNA, 40 bp, Artificial Sequence
  Description of Artificial Sequence: Synthetic oligonucleotide
agcagatctgagaaatgtttgtactgaagcaggtatgttc

SEQ ID NO: 135749 - DNA, 39 bp, Artificial Sequence
  Description of Artificial Sequence: Synthetic oligonucleotide
gcagatctgagaaatgtttgtactgaagcaggtatgttc

SEQ ID NO: 135750 - DNA, 39 bp, Artificial Sequence
  Description of Artificial Sequence: Synthetic oligonucleotide
cagatctgagaaatgtttgtactgaagcaggtatgttcg

SEQ ID NO: 135751 - DNA, 39 bp, Artificial Sequence
  Description of Artificial Sequence: Synthetic oligonucleotide
agatctgagaaatgtttgtactgaagcaggtatgttcgc

SEQ ID NO: 135752 - DNA, 38 bp, Artificial Sequence
  Description of Artificial Sequence: Synthetic oligonucleotide
gatctgagaaatgtttgtactgaagcaggtatgttcgc

SEQ ID NO: 135753 - DNA, 42 bp, Artificial Sequence
  Description of Artificial Sequence: Synthetic oligonucleotide
atctgagaaatgtttgtactgaagcaggtatgttcgcaattc

SEQ ID NO: 135754 - DNA, 41 bp, Artificial Sequence
  Description of Artificial Sequence: Synthetic oligonucleotide
tctgagaaatgtttgtactgaagcaggtatgttcgcaattc

SEQ ID NO: 135755 - DNA, 40 bp, Artificial Sequence
  Description of Artificial Sequence: Synthetic oligonucleotide
ctgagaaatgtttgtactgaagcaggtatgttcgcaattc

SEQ ID NO: 135756 - DNA, 40 bp, Artificial Sequence
  Description of Artificial Sequence: Synthetic oligonucleotide
tgagaaatgtttgtactgaagcaggtatgttcgcaattcg

SEQ ID NO: 135757 - DNA, 39 bp, Artificial Sequence
  Description of Artificial Sequence: Synthetic oligonucleotide
gagaaatgtttgtactgaagcaggtatgttcgcaattcg

SEQ ID NO: 135758 - DNA, 40 bp, Artificial Sequence
  Description of Artificial Sequence: Synthetic oligonucleotide
agaaatgtttgtactgaagcaggtatgttcgcaattcgtg

SEQ ID NO: 135759 - DNA, 39 bp, Artificial Sequence
  Description of Artificial Sequence: Synthetic oligonucleotide
gaaatgtttgtactgaagcaggtatgttcgcaattcgtg

SEQ ID NO: 135760 - DNA, 39 bp, Artificial Sequence
  Description of Artificial Sequence: Synthetic oligonucleotide
aaatgtttgtactgaagcaggtatgttcgcaattcgtgc

SEQ ID NO: 135761 - DNA, 38 bp, Artificial Sequence
  Description of Artificial Sequence: Synthetic oligonucleotide
aatgtttgtactgaagcaggtatgttcgcaattcgtgc

SEQ ID NO: 135762 - DNA, 37 bp, Artificial Sequence
  Description of Artificial Sequence: Synthetic oligonucleotide
atgtttgtactgaagcaggtatgttcgcaattcgtgc

SEQ ID NO: 135763 - DNA, 36 bp, Artificial Sequence
  Description of Artificial Sequence: Synthetic oligonucleotide
tgtttgtactgaagcaggtatgttcgcaattcgtgc

SEQ ID NO: 135764 - DNA, 35 bp, Artificial Sequence
  Description of Artificial Sequence: Synthetic oligonucleotide
gtttgtactgaagcaggtatgttcgcaattcgtgc

SEQ ID NO: 135765 - DNA, 36 bp, Artificial Sequence
  Description of Artificial Sequence: Synthetic oligonucleotide
tttgtactgaagcaggtatgttcgcaattcgtgctg

SEQ ID NO: 135766 - DNA, 35 bp, Artificial Sequence
  Description of Artificial Sequence: Synthetic oligonucleotide
ttgtactgaagcaggtatgttcgcaattcgtgctg

SEQ ID NO: 135767 - DNA, 34 bp, Artificial Sequence
  Description of Artificial Sequence: Synthetic oligonucleotide
tgtactgaagcaggtatgttcgcaattcgtgctg

SEQ ID NO: 135768 - DNA, 33 bp, Artificial Sequence
  Description of Artificial Sequence: Synthetic oligonucleotide
gtactgaagcaggtatgttcgcaattcgtgctg

SEQ ID NO: 135769 - DNA, 35 bp, Artificial Sequence
  Description of Artificial Sequence: Synthetic oligonucleotide
tactgaagcaggtatgttcgcaattcgtgctgatc

SEQ ID NO: 135770 - DNA, 34 bp, Artificial Sequence
  Description of Artificial Sequence: Synthetic oligonucleotide
actgaagcaggtatgttcgcaattcgtgctgatc

SEQ ID NO: 135771 - DNA, 33 bp, Artificial Sequence
  Description of Artificial Sequence: Synthetic oligonucleotide
ctgaagcaggtatgttcgcaattcgtgctgatc

SEQ ID NO: 135772 - DNA, 35 bp, Artificial Sequence
  Description of Artificial Sequence: Synthetic oligonucleotide
tgaagcaggtatgttcgcaattcgtgctgatcatg

SEQ ID NO: 135773 - DNA, 34 bp, Artificial Sequence
  Description of Artificial Sequence: Synthetic oligonucleotide
gaagcaggtatgttcgcaattcgtgctgatcatg

SEQ ID NO: 135774 - DNA, 39 bp, Artificial Sequence
  Description of Artificial Sequence: Synthetic oligonucleotide
aagcaggtatgttcgcaattcgtgctgatcatgattttg

SEQ ID NO: 135775 - DNA, 38 bp, Artificial Sequence
  Description of Artificial Sequence: Synthetic oligonucleotide
agcaggtatgttcgcaattcgtgctgatcatgattttg

SEQ ID NO: 135776 - DNA, 37 bp, Artificial Sequence
  Description of Artificial Sequence: Synthetic oligonucleotide
gcaggtatgttcgcaattcgtgctgatcatgattttg

SEQ ID NO: 135777 - DNA, 39 bp, Artificial Sequence
  Description of Artificial Sequence: Synthetic oligonucleotide
caggtatgttcgcaattcgtgctgatcatgattttgtag

SEQ ID NO: 135778 - DNA, 41 bp, Artificial Sequence
  Description of Artificial Sequence: Synthetic oligonucleotide
aggtatgttcgcaattcgtgctgatcatgattttgtagtac

SEQ ID NO: 135779 - DNA, 40 bp, Artificial Sequence
  Description of Artificial Sequence: Synthetic oligonucleotide
ggtatgttcgcaattcgtgctgatcatgattttgtagtac

SEQ ID NO: 135780 - DNA, 41 bp, Artificial Sequence
  Description of Artificial Sequence: Synthetic oligonucleotide
gtatgttcgcaattcgtgctgatcatgattttgtagtacag

SEQ ID NO: 135781 - DNA, 41 bp, Artificial Sequence
  Description of Artificial Sequence: Synthetic oligonucleotide
tatgttcgcaattcgtgctgatcatgattttgtagtacagg

SEQ ID NO: 135782 - DNA, 40 bp, Artificial Sequence
  Description of Artificial Sequence: Synthetic oligonucleotide
atgttcgcaattcgtgctgatcatgattttgtagtacagg

SEQ ID NO: 135783 - DNA, 39 bp, Artificial Sequence
  Description of Artificial Sequence: Synthetic oligonucleotide
tgttcgcaattcgtgctgatcatgattttgtagtacagg

SEQ ID NO: 135784 - DNA, 38 bp, Artificial Sequence
  Description of Artificial Sequence: Synthetic oligonucleotide
gttcgcaattcgtgctgatcatgattttgtagtacagg

SEQ ID NO: 135785 - DNA, 40 bp, Artificial Sequence
  Description of Artificial Sequence: Synthetic oligonucleotide
ttcgcaattcgtgctgatcatgattttgtagtacaggaag

SEQ ID NO: 135786 - DNA, 39 bp, Artificial Sequence
  Description of Artificial Sequence: Synthetic oligonucleotide
tcgcaattcgtgctgatcatgattttgtagtacaggaag

SEQ ID NO: 135787 - DNA, 38 bp, Artificial Sequence
  Description of Artificial Sequence: Synthetic oligonucleotide
cgcaattcgtgctgatcatgattttgtagtacaggaag

SEQ ID NO: 135788 - DNA, 39 bp, Artificial Sequence
  Description of Artificial Sequence: Synthetic oligonucleotide
gcaattcgtgctgatcatgattttgtagtacaggaagac

SEQ ID NO: 135789 - DNA, 41 bp, Artificial Sequence
  Description of Artificial Sequence: Synthetic oligonucleotide
caattcgtgctgatcatgattttgtagtacaggaagacttc

SEQ ID NO: 135790 - DNA, 43 bp, Artificial Sequence
  Description of Artificial Sequence: Synthetic oligonucleotide
aattcgtgctgatcatgattttgtagtacaggaagacttcatg

SEQ ID NO: 135791 - DNA, 42 bp, Artificial Sequence
  Description of Artificial Sequence: Synthetic oligonucleotide
attcgtgctgatcatgattttgtagtacaggaagacttcatg

SEQ ID NO: 135792 - DNA, 41 bp, Artificial Sequence
  Description of Artificial Sequence: Synthetic oligonucleotide
ttcgtgctgatcatgattttgtagtacaggaagacttcatg

SEQ ID NO: 135793 - DNA, 40 bp, Artificial Sequence
  Description of Artificial Sequence: Synthetic oligonucleotide
tcgtgctgatcatgattttgtagtacaggaagacttcatg

SEQ ID NO: 135794 - DNA, 39 bp, Artificial Sequence
  Description of Artificial Sequence: Synthetic oligonucleotide
cgtgctgatcatgattttgtagtacaggaagacttcatg

SEQ ID NO: 135795 - DNA, 42 bp, Artificial Sequence
  Description of Artificial Sequence: Synthetic oligonucleotide
gtgctgatcatgattttgtagtacaggaagacttcatgaaag

SEQ ID NO: 135796 - DNA, 42 bp, Artificial Sequence
  Description of Artificial Sequence: Synthetic oligonucleotide
tgctgatcatgattttgtagtacaggaagacttcatgaaagc

SEQ ID NO: 135797 - DNA, 41 bp, Artificial Sequence
  Description of Artificial Sequence: Synthetic oligonucleotide
gctgatcatgattttgtagtacaggaagacttcatgaaagc

SEQ ID NO: 135798 - DNA, 42 bp, Artificial Sequence
  Description of Artificial Sequence: Synthetic oligonucleotide
ctgatcatgattttgtagtacaggaagacttcatgaaagcag

SEQ ID NO: 135799 - DNA, 43 bp, Artificial Sequence
  Description of Artificial Sequence: Synthetic oligonucleotide
tgatcatgattttgtagtacaggaagacttcatgaaagcagtc

SEQ ID NO: 135800 - DNA, 42 bp, Artificial Sequence
  Description of Artificial Sequence: Synthetic oligonucleotide
gatcatgattttgtagtacaggaagacttcatgaaagcagtc

SEQ ID NO: 135801 - DNA, 43 bp, Artificial Sequence
  Description of Artificial Sequence: Synthetic oligonucleotide
atcatgattttgtagtacaggaagacttcatgaaagcagtcag

SEQ ID NO: 135802 - DNA, 42 bp, Artificial Sequence
  Description of Artificial Sequence: Synthetic oligonucleotide
tcatgattttgtagtacaggaagacttcatgaaagcagtcag

SEQ ID NO: 135803 - DNA, 41 bp, Artificial Sequence
  Description of Artificial Sequence: Synthetic oligonucleotide
catgattttgtagtacaggaagacttcatgaaagcagtcag

SEQ ID NO: 135804 - DNA, 45 bp, Artificial Sequence
  Description of Artificial Sequence: Synthetic oligonucleotide
atgattttgtagtacaggaagacttcatgaaagcagtcagaaaag

SEQ ID NO: 135805 - DNA, 44 bp, Artificial Sequence
  Description of Artificial Sequence: Synthetic oligonucleotide
tgattttgtagtacaggaagacttcatgaaagcagtcagaaaag

SEQ ID NO: 135806 - DNA, 43 bp, Artificial Sequence
  Description of Artificial Sequence: Synthetic oligonucleotide
gattttgtagtacaggaagacttcatgaaagcagtcagaaaag

SEQ ID NO: 135807 - DNA, 44 bp, Artificial Sequence
  Description of Artificial Sequence: Synthetic oligonucleotide
attttgtagtacaggaagacttcatgaaagcagtcagaaaagtg

SEQ ID NO: 135808 - DNA, 43 bp, Artificial Sequence
  Description of Artificial Sequence: Synthetic oligonucleotide
ttttgtagtacaggaagacttcatgaaagcagtcagaaaagtg

SEQ ID NO: 135809 - DNA, 42 bp, Artificial Sequence
  Description of Artificial Sequence: Synthetic oligonucleotide
tttgtagtacaggaagacttcatgaaagcagtcagaaaagtg

SEQ ID NO: 135810 - DNA, 41 bp, Artificial Sequence
  Description of Artificial Sequence: Synthetic oligonucleotide
ttgtagtacaggaagacttcatgaaagcagtcagaaaagtg

SEQ ID NO: 135811 - DNA, 40 bp, Artificial Sequence
  Description of Artificial Sequence: Synthetic oligonucleotide
tgtagtacaggaagacttcatgaaagcagtcagaaaagtg

SEQ ID NO: 135812 - DNA, 39 bp, Artificial Sequence
  Description of Artificial Sequence: Synthetic oligonucleotide
gtagtacaggaagacttcatgaaagcagtcagaaaagtg

SEQ ID NO: 135813 - DNA, 39 bp, Artificial Sequence
  Description of Artificial Sequence: Synthetic oligonucleotide
tagtacaggaagacttcatgaaagcagtcagaaaagtgg

SEQ ID NO: 135814 - DNA, 38 bp, Artificial Sequence
  Description of Artificial Sequence: Synthetic oligonucleotide
agtacaggaagacttcatgaaagcagtcagaaaagtgg

SEQ ID NO: 135815 - DNA, 37 bp, Artificial Sequence
  Description of Artificial Sequence: Synthetic oligonucleotide
gtacaggaagacttcatgaaagcagtcagaaaagtgg

SEQ ID NO: 135816 - DNA, 37 bp, Artificial Sequence
  Description of Artificial Sequence: Synthetic oligonucleotide
tacaggaagacttcatgaaagcagtcagaaaagtggc

SEQ ID NO: 135817 - DNA, 36 bp, Artificial Sequence
  Description of Artificial Sequence: Synthetic oligonucleotide
acaggaagacttcatgaaagcagtcagaaaagtggc

SEQ ID NO: 135818 - DNA, 35 bp, Artificial Sequence
  Description of Artificial Sequence: Synthetic oligonucleotide
caggaagacttcatgaaagcagtcagaaaagtggc

SEQ ID NO: 135819 - DNA, 36 bp, Artificial Sequence
  Description of Artificial Sequence: Synthetic oligonucleotide
aggaagacttcatgaaagcagtcagaaaagtggctg

SEQ ID NO: 135820 - DNA, 35 bp, Artificial Sequence
  Description of Artificial Sequence: Synthetic oligonucleotide
ggaagacttcatgaaagcagtcagaaaagtggctg

SEQ ID NO: 135821 - DNA, 38 bp, Artificial Sequence
  Description of Artificial Sequence: Synthetic oligonucleotide
gaagacttcatgaaagcagtcagaaaagtggctgattc

SEQ ID NO: 135822 - DNA, 41 bp, Artificial Sequence
  Description of Artificial Sequence: Synthetic oligonucleotide
aagacttcatgaaagcagtcagaaaagtggctgattctaag

SEQ ID NO: 135823 - DNA, 40 bp, Artificial Sequence
  Description of Artificial Sequence: Synthetic oligonucleotide
agacttcatgaaagcagtcagaaaagtggctgattctaag

SEQ ID NO: 135824 - DNA, 39 bp, Artificial Sequence
  Description of Artificial Sequence: Synthetic oligonucleotide
gacttcatgaaagcagtcagaaaagtggctgattctaag

SEQ ID NO: 135825 - DNA, 41 bp, Artificial Sequence
  Description of Artificial Sequence: Synthetic oligonucleotide
acttcatgaaagcagtcagaaaagtggctgattctaagaag

SEQ ID NO: 135826 - DNA, 40 bp, Artificial Sequence
  Description of Artificial Sequence: Synthetic oligonucleotide
cttcatgaaagcagtcagaaaagtggctgattctaagaag

SEQ ID NO: 135827 - DNA, 40 bp, Artificial Sequence
  Description of Artificial Sequence: Synthetic oligonucleotide
ttcatgaaagcagtcagaaaagtggctgattctaagaagc

SEQ ID NO: 135828 - DNA, 39 bp, Artificial Sequence
  Description of Artificial Sequence: Synthetic oligonucleotide
tcatgaaagcagtcagaaaagtggctgattctaagaagc

SEQ ID NO: 135829 - DNA, 38 bp, Artificial Sequence
  Description of Artificial Sequence: Synthetic oligonucleotide
catgaaagcagtcagaaaagtggctgattctaagaagc

SEQ ID NO: 135830 - DNA, 39 bp, Artificial Sequence
  Description of Artificial Sequence: Synthetic oligonucleotide
atgaaagcagtcagaaaagtggctgattctaagaagctg

SEQ ID NO: 135831 - DNA, 38 bp, Artificial Sequence
  Description of Artificial Sequence: Synthetic oligonucleotide
tgaaagcagtcagaaaagtggctgattctaagaagctg

SEQ ID NO: 135832 - DNA, 37 bp, Artificial Sequence
  Description of Artificial Sequence: Synthetic oligonucleotide
gaaagcagtcagaaaagtggctgattctaagaagctg

SEQ ID NO: 135833 - DNA, 37 bp, Artificial Sequence
  Description of Artificial Sequence: Synthetic oligonucleotide
aaagcagtcagaaaagtggctgattctaagaagctgg

SEQ ID NO: 135834 - DNA, 36 bp, Artificial Sequence
  Description of Artificial Sequence: Synthetic oligonucleotide
aagcagtcagaaaagtggctgattctaagaagctgg

SEQ ID NO: 135835 - DNA, 35 bp, Artificial Sequence
  Description of Artificial Sequence: Synthetic oligonucleotide
agcagtcagaaaagtggctgattctaagaagctgg

SEQ ID NO: 135836 - DNA, 34 bp, Artificial Sequence
  Description of Artificial Sequence: Synthetic oligonucleotide
gcagtcagaaaagtggctgattctaagaagctgg

SEQ ID NO: 135837 - DNA, 35 bp, Artificial Sequence
  Description of Artificial Sequence: Synthetic oligonucleotide
cagtcagaaaagtggctgattctaagaagctggag

SEQ ID NO: 135838 - DNA, 36 bp, Artificial Sequence
  Description of Artificial Sequence: Synthetic oligonucleotide
agtcagaaaagtggctgattctaagaagctggagtc

SEQ ID NO: 135839 - DNA, 35 bp, Artificial Sequence
  Description of Artificial Sequence: Synthetic oligonucleotide
gtcagaaaagtggctgattctaagaagctggagtc

SEQ ID NO: 135840 - DNA, 41 bp, Artificial Sequence
  Description of Artificial Sequence: Synthetic oligonucleotide
tcagaaaagtggctgattctaagaagctggagtctaaattg

SEQ ID NO: 135841 - DNA, 40 bp, Artificial Sequence
  Description of Artificial Sequence: Synthetic oligonucleotide
cagaaaagtggctgattctaagaagctggagtctaaattg

SEQ ID NO: 135842 - DNA, 40 bp, Artificial Sequence
  Description of Artificial Sequence: Synthetic oligonucleotide
agaaaagtggctgattctaagaagctggagtctaaattgg

SEQ ID NO: 135843 - DNA, 39 bp, Artificial Sequence
  Description of Artificial Sequence: Synthetic oligonucleotide
gaaaagtggctgattctaagaagctggagtctaaattgg

SEQ ID NO: 135844 - DNA, 40 bp, Artificial Sequence
  Description of Artificial Sequence: Synthetic oligonucleotide
aaaagtggctgattctaagaagctggagtctaaattggac

SEQ ID NO: 135845 - DNA, 39 bp, Artificial Sequence
  Description of Artificial Sequence: Synthetic oligonucleotide
aaagtggctgattctaagaagctggagtctaaattggac

SEQ ID NO: 135846 - DNA, 38 bp, Artificial Sequence
  Description of Artificial Sequence: Synthetic oligonucleotide
aagtggctgattctaagaagctggagtctaaattggac

SEQ ID NO: 135847 - DNA, 37 bp, Artificial Sequence
  Description of Artificial Sequence: Synthetic oligonucleotide
agtggctgattctaagaagctggagtctaaattggac

SEQ ID NO: 135848 - DNA, 36 bp, Artificial Sequence
  Description of Artificial Sequence: Synthetic oligonucleotide
gtggctgattctaagaagctggagtctaaattggac

SEQ ID NO: 135849 - DNA, 38 bp, Artificial Sequence
  Description of Artificial Sequence: Synthetic oligonucleotide
tggctgattctaagaagctggagtctaaattggactac

SEQ ID NO: 135850 - DNA, 37 bp, Artificial Sequence
  Description of Artificial Sequence: Synthetic oligonucleotide
ggctgattctaagaagctggagtctaaattggactac

SEQ ID NO: 135851 - DNA, 40 bp, Artificial Sequence
  Description of Artificial Sequence: Synthetic oligonucleotide
gctgattctaagaagctggagtctaaattggactacaaac

SEQ ID NO: 135852 - DNA, 40 bp, Artificial Sequence
  Description of Artificial Sequence: Synthetic oligonucleotide
ctgattctaagaagctggagtctaaattggactacaaacc

SEQ ID NO: 135853 - DNA, 41 bp, Artificial Sequence
  Description of Artificial Sequence: Synthetic oligonucleotide
tgattctaagaagctggagtctaaattggactacaaacctg

SEQ ID NO: 135854 - DNA, 40 bp, Artificial Sequence
  Description of Artificial Sequence: Synthetic oligonucleotide
gattctaagaagctggagtctaaattggactacaaacctg

SEQ ID NO: 135855 - DNA, 41 bp, Artificial Sequence
  Description of Artificial Sequence: Synthetic oligonucleotide
attctaagaagctggagtctaaattggactacaaacctgtg

SEQ ID NO: 135856 - DNA, 40 bp, Artificial Sequence
  Description of Artificial Sequence: Synthetic oligonucleotide
ttctaagaagctggagtctaaattggactacaaacctgtg

SEQ ID NO: 135857 - DNA, 39 bp, Artificial Sequence
  Description of Artificial Sequence: Synthetic oligonucleotide
tctaagaagctggagtctaaattggactacaaacctgtg

SEQ ID NO: 135858 - DNA, 38 bp, Artificial Sequence
  Description of Artificial Sequence: Synthetic oligonucleotide
ctaagaagctggagtctaaattggactacaaacctgtg

SEQ ID NO: 135859 - DNA, 24 bp, Artificial Sequence
  Description of Artificial Sequence: Synthetic oligonucleotide
atggaggagggaggccgggacaag

SEQ ID NO: 135860 - DNA, 23 bp, Artificial Sequence
  Description of Artificial Sequence: Synthetic oligonucleotide
tggaggagggaggccgggacaag

SEQ ID NO: 135861 - DNA, 22 bp, Artificial Sequence
  Description of Artificial Sequence: Synthetic oligonucleotide
ggaggagggaggccgggacaag

SEQ ID NO: 135862 - DNA, 22 bp, Artificial Sequence
  Description of Artificial Sequence: Synthetic oligonucleotide
gaggagggaggccgggacaagg

SEQ ID NO: 135863 - DNA, 22 bp, Artificial Sequence
  Description of Artificial Sequence: Synthetic oligonucleotide
aggagggaggccgggacaaggc

SEQ ID NO: 135864 - DNA, 21 bp, Artificial Sequence
  Description of Artificial Sequence: Synthetic oligonucleotide
ggagggaggccgggacaaggc

SEQ ID NO: 135865 - DNA, 21 bp, Artificial Sequence
  Description of Artificial Sequence: Synthetic oligonucleotide
gagggaggccgggacaaggcg

SEQ ID NO: 135866 - DNA, 21 bp, Artificial Sequence
  Description of Artificial Sequence: Synthetic oligonucleotide
agggaggccgggacaaggcgc

SEQ ID NO: 135867 - DNA, 20 bp, Artificial Sequence
  Description of Artificial Sequence: Synthetic oligonucleotide
gggaggccgggacaaggcgc

SEQ ID NO: 135868 - DNA, 20 bp, Artificial Sequence
  Description of Artificial Sequence: Synthetic oligonucleotide
ggaggccgggacaaggcgcc

SEQ ID NO: 135869 - DNA, 20 bp, Artificial Sequence
  Description of Artificial Sequence: Synthetic oligonucleotide
gaggccgggacaaggcgccg

SEQ ID NO: 135870 - DNA, 21 bp, Artificial Sequence
  Description of Artificial Sequence: Synthetic oligonucleotide
aggccgggacaaggcgccggt

SEQ ID NO: 135871 - DNA, 20 bp, Artificial Sequence
  Description of Artificial Sequence: Synthetic oligonucleotide
ggccgggacaaggcgccggt

SEQ ID NO: 135872 - DNA, 20 bp, Artificial Sequence
  Description of Artificial Sequence: Synthetic oligonucleotide
gccgggacaaggcgccggtg

SEQ ID NO: 135873 - DNA, 21 bp, Artificial Sequence
  Description of Artificial Sequence: Synthetic oligonucleotide
ccgggacaaggcgccggtgca

SEQ ID NO: 135874 - DNA, 21 bp, Artificial Sequence
  Description of Artificial Sequence: Synthetic oligonucleotide
cgggacaaggcgccggtgcag

SEQ ID NO: 135875 - DNA, 21 bp, Artificial Sequence
  Description of Artificial Sequence: Synthetic oligonucleotide
gggacaaggcgccggtgcagc

SEQ ID NO: 135876 - DNA, 21 bp, Artificial Sequence
  Description of Artificial Sequence: Synthetic oligonucleotide
ggacaaggcgccggtgcagcc

SEQ ID NO: 135877 - DNA, 21 bp, Artificial Sequence
  Description of Artificial Sequence: Synthetic oligonucleotide
gacaaggcgccggtgcagccc

SEQ ID NO: 135878 - DNA, 22 bp, Artificial Sequence
  Description of Artificial Sequence: Synthetic oligonucleotide
acaaggcgccggtgcagcccca

SEQ ID NO: 135879 - DNA, 21 bp, Artificial Sequence
  Description of Artificial Sequence: Synthetic oligonucleotide
caaggcgccggtgcagcccca

SEQ ID NO: 135880 - DNA, 21 bp, Artificial Sequence
  Description of Artificial Sequence: Synthetic oligonucleotide
aaggcgccggtgcagccccag

SEQ ID NO: 135881 - DNA, 20 bp, Artificial Sequence
  Description of Artificial Sequence: Synthetic oligonucleotide
aggcgccggtgcagccccag

SEQ ID NO: 135882 - DNA, 20 bp, Artificial Sequence
  Description of Artificial Sequence: Synthetic oligonucleotide
ggcgccggtgcagccccagt

SEQ ID NO: 135883 - DNA, 20 bp, Artificial Sequence
  Description of Artificial Sequence: Synthetic oligonucleotide
gcgccggtgcagccccagca

SEQ ID NO: 135884 - DNA, 21 bp, Artificial Sequence
  Description of Artificial Sequence: Synthetic oligonucleotide
cgccggtgcagccccagcagt

SEQ ID NO: 135885 - DNA, 22 bp, Artificial Sequence
  Description of Artificial Sequence: Synthetic oligonucleotide
gccggtgcagccccagcagtct

SEQ ID NO: 135886 - DNA, 22 bp, Artificial Sequence
  Description of Artificial Sequence: Synthetic oligonucleotide
ccggtgcagccccagcagtctc

SEQ ID NO: 135887 - DNA, 23 bp, Artificial Sequence
  Description of Artificial Sequence: Synthetic oligonucleotide
cggtgcagccccagcagtctcca

SEQ ID NO: 135888 - DNA, 23 bp, Artificial Sequence
  Description of Artificial Sequence: Synthetic oligonucleotide
ggtgcagccccagcagtctccag

SEQ ID NO: 135889 - DNA, 23 bp, Artificial Sequence
  Description of Artificial Sequence: Synthetic oligonucleotide
gtgcagccccagcagtctccagc

SEQ ID NO: 135890 - DNA, 23 bp, Artificial Sequence
  Description of Artificial Sequence: Synthetic oligonucleotide
tgcagccccagcagtctccagcg

SEQ ID NO: 135891 - DNA, 22 bp, Artificial Sequence
  Description of Artificial Sequence: Synthetic oligonucleotide
gcagccccagcagtctccagcg

SEQ ID NO: 135892 - DNA, 22 bp, Artificial Sequence
  Description of Artificial Sequence: Synthetic oligonucleotide
cagccccagcagtctccagcgg

SEQ ID NO: 135893 - DNA, 22 bp, Artificial Sequence
  Description of Artificial Sequence: Synthetic oligonucleotide
agccccagcagtctccagcggc

SEQ ID NO: 135894 - DNA, 21 bp, Artificial Sequence
  Description of Artificial Sequence: Synthetic oligonucleotide
gccccagcagtctccagcggc

SEQ ID NO: 135895 - DNA, 21 bp, Artificial Sequence
  Description of Artificial Sequence: Synthetic oligonucleotide
ccccagcagtctccagcggcg

SEQ ID NO: 135896 - DNA, 21 bp, Artificial Sequence
  Description of Artificial Sequence: Synthetic oligonucleotide
cccagcagtctccagcggcgg

SEQ ID NO: 135897 - DNA, 21 bp, Artificial Sequence
  Description of Artificial Sequence: Synthetic oligonucleotide
ccagcagtctccagcggcggc

SEQ ID NO: 135898 - DNA, 21 bp, Artificial Sequence
  Description of Artificial Sequence: Synthetic oligonucleotide
cagcagtctccagcggcggcc

SEQ ID NO: 135899 - DNA, 21 bp, Artificial Sequence
  Description of Artificial Sequence: Synthetic oligonucleotide
agcagtctccagcggcggccc

SEQ ID NO: 135900 - DNA, 20 bp, Artificial Sequence
  Description of Artificial Sequence: Synthetic oligonucleotide
gcagtctccagcggcggccc

SEQ ID NO: 135901 - DNA, 20 bp, Artificial Sequence
  Description of Artificial Sequence: Synthetic oligonucleotide
cagtctccagcggcggcccc

SEQ ID NO: 135902 - DNA, 20 bp, Artificial Sequence
  Description of Artificial Sequence: Synthetic oligonucleotide
agtctccagcggcggccccc

SEQ ID NO: 135903 - DNA, 20 bp, Artificial Sequence
  Description of Artificial Sequence: Synthetic oligonucleotide
gtctccagcggcggccccct

SEQ ID NO: 135904 - DNA, 20 bp, Artificial Sequence
  Description of Artificial Sequence: Synthetic oligonucleotide
tctccagcggcggcccccgt

SEQ ID NO: 135905 - DNA, 20 bp, Artificial Sequence
  Description of Artificial Sequence: Synthetic oligonucleotide
ctccagcggcggcccccgtt

SEQ ID NO: 135906 - DNA, 20 bp, Artificial Sequence
  Description of Artificial Sequence: Synthetic oligonucleotide
tccagcggcggcccccggtt

SEQ ID NO: 135907 - DNA, 20 bp, Artificial Sequence
  Description of Artificial Sequence: Synthetic oligonucleotide
ccagcggcggcccccggttt

SEQ ID NO: 135908 - DNA, 20 bp, Artificial Sequence
  Description of Artificial Sequence: Synthetic oligonucleotide
cagcggcggcccccggcttt

SEQ ID NO: 135909 - DNA, 20 bp, Artificial Sequence
  Description of Artificial Sequence: Synthetic oligonucleotide
agcggcggcccccggcgttt

SEQ ID NO: 135910 - DNA, 20 bp, Artificial Sequence
  Description of Artificial Sequence: Synthetic oligonucleotide
gcggcggcccccggcgtttt

SEQ ID NO: 135911 - DNA, 20 bp, Artificial Sequence
  Description of Artificial Sequence: Synthetic oligonucleotide
cggcggcccccggcggtttt

SEQ ID NO: 135912 - DNA, 20 bp, Artificial Sequence
  Description of Artificial Sequence: Synthetic oligonucleotide
ggcggcccccggcggcattt

SEQ ID NO: 135913 - DNA, 20 bp, Artificial Sequence
  Description of Artificial Sequence: Synthetic oligonucleotide
gcggcccccggcggcacttt

SEQ ID NO: 135914 - DNA, 20 bp, Artificial Sequence
  Description of Artificial Sequence: Synthetic oligonucleotide
cggcccccggcggcacgttt

SEQ ID NO: 135915 - DNA, 20 bp, Artificial Sequence
  Description of Artificial Sequence: Synthetic oligonucleotide
ggcccccggcggcacggatt

SEQ ID NO: 135916 - DNA, 20 bp, Artificial Sequence
  Description of Artificial Sequence: Synthetic oligonucleotide
gcccccggcggcacggactt

SEQ ID NO: 135917 - DNA, 20 bp, Artificial Sequence
  Description of Artificial Sequence: Synthetic oligonucleotide
cccccggcggcacggacgat

SEQ ID NO: 135918 - DNA, 21 bp, Artificial Sequence
  Description of Artificial Sequence: Synthetic oligonucleotide
ccccggcggcacggacgagaa

SEQ ID NO: 135919 - DNA, 21 bp, Artificial Sequence
  Description of Artificial Sequence: Synthetic oligonucleotide
cccggcggcacggacgagaag

SEQ ID NO: 135920 - DNA, 21 bp, Artificial Sequence
  Description of Artificial Sequence: Synthetic oligonucleotide
ccggcggcacggacgagaagc

SEQ ID NO: 135921 - DNA, 21 bp, Artificial Sequence
  Description of Artificial Sequence: Synthetic oligonucleotide
cggcggcacggacgagaagcc

SEQ ID NO: 135922 - DNA, 22 bp, Artificial Sequence
  Description of Artificial Sequence: Synthetic oligonucleotide
ggcggcacggacgagaagccga

SEQ ID NO: 135923 - DNA, 22 bp, Artificial Sequence
  Description of Artificial Sequence: Synthetic oligonucleotide
gcggcacggacgagaagccgag

SEQ ID NO: 135924 - DNA, 22 bp, Artificial Sequence
  Description of Artificial Sequence: Synthetic oligonucleotide
cggcacggacgagaagccgagc

SEQ ID NO: 135925 - DNA, 22 bp, Artificial Sequence
  Description of Artificial Sequence: Synthetic oligonucleotide
ggcacggacgagaagccgagcg

SEQ ID NO: 135926 - DNA, 22 bp, Artificial Sequence
  Description of Artificial Sequence: Synthetic oligonucleotide
gcacggacgagaagccgagcgg

SEQ ID NO: 135927 - DNA, 24 bp, Artificial Sequence
  Description of Artificial Sequence: Synthetic oligonucleotide
cacggacgagaagccgagcggcaa

SEQ ID NO: 135928 - DNA, 24 bp, Artificial Sequence
  Description of Artificial Sequence: Synthetic oligonucleotide
acggacgagaagccgagcggcaag

SEQ ID NO: 135929 - DNA, 23 bp, Artificial Sequence
  Description of Artificial Sequence: Synthetic oligonucleotide
cggacgagaagccgagcggcaag

SEQ ID NO: 135930 - DNA, 24 bp, Artificial Sequence
  Description of Artificial Sequence: Synthetic oligonucleotide
ggacgagaagccgagcggcaagga

SEQ ID NO: 135931 - DNA, 24 bp, Artificial Sequence
  Description of Artificial Sequence: Synthetic oligonucleotide
gacgagaagccgagcggcaaggag

SEQ ID NO: 135932 - DNA, 24 bp, Artificial Sequence
  Description of Artificial Sequence: Synthetic oligonucleotide
acgagaagccgagcggcaaggagc

SEQ ID NO: 135933 - DNA, 23 bp, Artificial Sequence
  Description of Artificial Sequence: Synthetic oligonucleotide
cgagaagccgagcggcaaggagc

SEQ ID NO: 135934 - DNA, 23 bp, Artificial Sequence
  Description of Artificial Sequence: Synthetic oligonucleotide
gagaagccgagcggcaaggagcg

SEQ ID NO: 135935 - DNA, 23 bp, Artificial Sequence
  Description of Artificial Sequence: Synthetic oligonucleotide
agaagccgagcggcaaggagcgg

SEQ ID NO: 135936 - DNA, 22 bp, Artificial Sequence
  Description of Artificial Sequence: Synthetic oligonucleotide
gaagccgagcggcaaggagcgg

SEQ ID NO: 135937 - DNA, 22 bp, Artificial Sequence
  Description of Artificial Sequence: Synthetic oligonucleotide
aagccgagcggcaaggagcggc

SEQ ID NO: 135938 - DNA, 21 bp, Artificial Sequence
  Description of Artificial Sequence: Synthetic oligonucleotide
agccgagcggcaaggagcggc

SEQ ID NO: 135939 - DNA, 20 bp, Artificial Sequence
  Description of Artificial Sequence: Synthetic oligonucleotide
gccgagcggcaaggagcggc

SEQ ID NO: 135940 - DNA, 20 bp, Artificial Sequence
  Description of Artificial Sequence: Synthetic oligonucleotide
ccgagcggcaaggagcggcg

SEQ ID NO: 135941 - DNA, 20 bp, Artificial Sequence
  Description of Artificial Sequence: Synthetic oligonucleotide
cgagcggcaaggagcggcgg

SEQ ID NO: 135942 - DNA, 22 bp, Artificial Sequence
  Description of Artificial Sequence: Synthetic oligonucleotide
gagcggcaaggagcggcgggat

SEQ ID NO: 135943 - DNA, 22 bp, Artificial Sequence
  Description of Artificial Sequence: Synthetic oligonucleotide
agcggcaaggagcggcgggatg

SEQ ID NO: 135944 - DNA, 21 bp, Artificial Sequence
  Description of Artificial Sequence: Synthetic oligonucleotide
gcggcaaggagcggcgggatg

SEQ ID NO: 135945 - DNA, 21 bp, Artificial Sequence
  Description of Artificial Sequence: Synthetic oligonucleotide
cggcaaggagcggcgggatgc

SEQ ID NO: 135946 - DNA, 21 bp, Artificial Sequence
  Description of Artificial Sequence: Synthetic oligonucleotide
ggcaaggagcggcgggatgcc

SEQ ID NO: 135947 - DNA, 21 bp, Artificial Sequence
  Description of Artificial Sequence: Synthetic oligonucleotide
gcaaggagcggcgggatgccg

SEQ ID NO: 135948 - DNA, 21 bp, Artificial Sequence
  Description of Artificial Sequence: Synthetic oligonucleotide
caaggagcggcgggatgccgg

SEQ ID NO: 135949 - DNA, 21 bp, Artificial Sequence
  Description of Artificial Sequence: Synthetic oligonucleotide
aaggagcggcgggatgccggg

SEQ ID NO: 135950 - DNA, 20 bp, Artificial Sequence
  Description of Artificial Sequence: Synthetic oligonucleotide
aggagcggcgggatgccggg

SEQ ID NO: 135951 - DNA, 20 bp, Artificial Sequence
  Description of Artificial Sequence: Synthetic oligonucleotide
ggagcggcgggatgccgggt

SEQ ID NO: 135952 - DNA, 20 bp, Artificial Sequence
  Description of Artificial Sequence: Synthetic oligonucleotide
gagcggcgggatgccgggga

SEQ ID NO: 135953 - DNA, 22 bp, Artificial Sequence
  Description of Artificial Sequence: Synthetic oligonucleotide
agcggcgggatgccggggacaa

SEQ ID NO: 135954 - DNA, 21 bp, Artificial Sequence
  Description of Artificial Sequence: Synthetic oligonucleotide
gcggcgggatgccggggacaa

SEQ ID NO: 135955 - DNA, 21 bp, Artificial Sequence
  Description of Artificial Sequence: Synthetic oligonucleotide
cggcgggatgccggggacaag

SEQ ID NO: 135956 - DNA, 22 bp, Artificial Sequence
  Description of Artificial Sequence: Synthetic oligonucleotide
ggcgggatgccggggacaagga

SEQ ID NO: 135957 - DNA, 25 bp, Artificial Sequence
  Description of Artificial Sequence: Synthetic oligonucleotide
gcgggatgccggggacaaggacaaa

SEQ ID NO: 135958 - DNA, 27 bp, Artificial Sequence
  Description of Artificial Sequence: Synthetic oligonucleotide
cgggatgccggggacaaggacaaagaa

SEQ ID NO: 135959 - DNA, 27 bp, Artificial Sequence
  Description of Artificial Sequence: Synthetic oligonucleotide
gggatgccggggacaaggacaaagaac

SEQ ID NO: 135960 - DNA, 28 bp, Artificial Sequence
  Description of Artificial Sequence: Synthetic oligonucleotide
ggatgccggggacaaggacaaagaacag

SEQ ID NO: 135961 - DNA, 28 bp, Artificial Sequence
  Description of Artificial Sequence: Synthetic oligonucleotide
gatgccggggacaaggacaaagaacagg

SEQ ID NO: 135962 - DNA, 29 bp, Artificial Sequence
  Description of Artificial Sequence: Synthetic oligonucleotide
atgccggggacaaggacaaagaacaggag

SEQ ID NO: 135963 - DNA, 28 bp, Artificial Sequence
  Description of Artificial Sequence: Synthetic oligonucleotide
tgccggggacaaggacaaagaacaggag

SEQ ID NO: 135964 - DNA, 27 bp, Artificial Sequence
  Description of Artificial Sequence: Synthetic oligonucleotide
gccggggacaaggacaaagaacaggag

SEQ ID NO: 135965 - DNA, 27 bp, Artificial Sequence
  Description of Artificial Sequence: Synthetic oligonucleotide
ccggggacaaggacaaagaacaggagc

SEQ ID NO: 135966 - DNA, 28 bp, Artificial Sequence
  Description of Artificial Sequence: Synthetic oligonucleotide
cggggacaaggacaaagaacaggagctg

SEQ ID NO: 135967 - DNA, 29 bp, Artificial Sequence
  Description of Artificial Sequence: Synthetic oligonucleotide
ggggacaaggacaaagaacaggagctgtc

SEQ ID NO: 135968 - DNA, 30 bp, Artificial Sequence
  Description of Artificial Sequence: Synthetic oligonucleotide
gggacaaggacaaagaacaggagctgtctg

SEQ ID NO: 135969 - DNA, 32 bp, Artificial Sequence
  Description of Artificial Sequence: Synthetic oligonucleotide
ggacaaggacaaagaacaggagctgtctgaag

SEQ ID NO: 135970 - DNA, 33 bp, Artificial Sequence
  Description of Artificial Sequence: Synthetic oligonucleotide
gacaaggacaaagaacaggagctgtctgaagag

SEQ ID NO: 135971 - DNA, 33 bp, Artificial Sequence
  Description of Artificial Sequence: Synthetic oligonucleotide
acaaggacaaagaacaggagctgtctgaagagg

SEQ ID NO: 135972 - DNA, 32 bp, Artificial Sequence
  Description of Artificial Sequence: Synthetic oligonucleotide
caaggacaaagaacaggagctgtctgaagagg

SEQ ID NO: 135973 - DNA, 37 bp, Artificial Sequence
  Description of Artificial Sequence: Synthetic oligonucleotide
aaggacaaagaacaggagctgtctgaagaggataaac

SEQ ID NO: 135974 - DNA, 36 bp, Artificial Sequence
  Description of Artificial Sequence: Synthetic oligonucleotide
aggacaaagaacaggagctgtctgaagaggataaac

SEQ ID NO: 135975 - DNA, 35 bp, Artificial Sequence
  Description of Artificial Sequence: Synthetic oligonucleotide
ggacaaagaacaggagctgtctgaagaggataaac

SEQ ID NO: 135976 - DNA, 36 bp, Artificial Sequence
  Description of Artificial Sequence: Synthetic oligonucleotide
gacaaagaacaggagctgtctgaagaggataaacag

SEQ ID NO: 135977 - DNA, 36 bp, Artificial Sequence
  Description of Artificial Sequence: Synthetic oligonucleotide
acaaagaacaggagctgtctgaagaggataaacagc

SEQ ID NO: 135978 - DNA, 35 bp, Artificial Sequence
  Description of Artificial Sequence: Synthetic oligonucleotide
caaagaacaggagctgtctgaagaggataaacagc

SEQ ID NO: 135979 - DNA, 37 bp, Artificial Sequence
  Description of Artificial Sequence: Synthetic oligonucleotide
aaagaacaggagctgtctgaagaggataaacagcttc

SEQ ID NO: 135980 - DNA, 36 bp, Artificial Sequence
  Description of Artificial Sequence: Synthetic oligonucleotide
aagaacaggagctgtctgaagaggataaacagcttc

SEQ ID NO: 135981 - DNA, 35 bp, Artificial Sequence
  Description of Artificial Sequence: Synthetic oligonucleotide
agaacaggagctgtctgaagaggataaacagcttc

SEQ ID NO: 135982 - DNA, 34 bp, Artificial Sequence
  Description of Artificial Sequence: Synthetic oligonucleotide
gaacaggagctgtctgaagaggataaacagcttc

SEQ ID NO: 135983 - DNA, 36 bp, Artificial Sequence
  Description of Artificial Sequence: Synthetic oligonucleotide
aacaggagctgtctgaagaggataaacagcttcaag

SEQ ID NO: 135984 - DNA, 35 bp, Artificial Sequence
  Description of Artificial Sequence: Synthetic oligonucleotide
acaggagctgtctgaagaggataaacagcttcaag

SEQ ID NO: 135985 - DNA, 34 bp, Artificial Sequence
  Description of Artificial Sequence: Synthetic oligonucleotide
caggagctgtctgaagaggataaacagcttcaag

SEQ ID NO: 135986 - DNA, 36 bp, Artificial Sequence
  Description of Artificial Sequence: Synthetic oligonucleotide
aggagctgtctgaagaggataaacagcttcaagatg

SEQ ID NO: 135987 - DNA, 35 bp, Artificial Sequence
  Description of Artificial Sequence: Synthetic oligonucleotide
ggagctgtctgaagaggataaacagcttcaagatg

SEQ ID NO: 135988 - DNA, 37 bp, Artificial Sequence
  Description of Artificial Sequence: Synthetic oligonucleotide
gagctgtctgaagaggataaacagcttcaagatgaac

SEQ ID NO: 135989 - DNA, 38 bp, Artificial Sequence
  Description of Artificial Sequence: Synthetic oligonucleotide
agctgtctgaagaggataaacagcttcaagatgaactg

SEQ ID NO: 135990 - DNA, 37 bp, Artificial Sequence
  Description of Artificial Sequence: Synthetic oligonucleotide
gctgtctgaagaggataaacagcttcaagatgaactg

SEQ ID NO: 135991 - DNA, 37 bp, Artificial Sequence
  Description of Artificial Sequence: Synthetic oligonucleotide
ctgtctgaagaggataaacagcttcaagatgaactgg

SEQ ID NO: 135992 - DNA, 38 bp, Artificial Sequence
  Description of Artificial Sequence: Synthetic oligonucleotide
tgtctgaagaggataaacagcttcaagatgaactggag

SEQ ID NO: 135993 - DNA, 37 bp, Artificial Sequence
  Description of Artificial Sequence: Synthetic oligonucleotide
gtctgaagaggataaacagcttcaagatgaactggag

SEQ ID NO: 135994 - DNA, 39 bp, Artificial Sequence
  Description of Artificial Sequence: Synthetic oligonucleotide
tctgaagaggataaacagcttcaagatgaactggagatg

SEQ ID NO: 135995 - DNA, 38 bp, Artificial Sequence
  Description of Artificial Sequence: Synthetic oligonucleotide
ctgaagaggataaacagcttcaagatgaactggagatg

SEQ ID NO: 135996 - DNA, 38 bp, Artificial Sequence
  Description of Artificial Sequence: Synthetic oligonucleotide
tgaagaggataaacagcttcaagatgaactggagatgc

SEQ ID NO: 135997 - DNA, 37 bp, Artificial Sequence
  Description of Artificial Sequence: Synthetic oligonucleotide
gaagaggataaacagcttcaagatgaactggagatgc

SEQ ID NO: 135998 - DNA, 38 bp, Artificial Sequence
  Description of Artificial Sequence: Synthetic oligonucleotide
aagaggataaacagcttcaagatgaactggagatgctc

SEQ ID NO: 135999 - DNA, 37 bp, Artificial Sequence
  Description of Artificial Sequence: Synthetic oligonucleotide
agaggataaacagcttcaagatgaactggagatgctc

SEQ ID NO: 136000 - DNA, 36 bp, Artificial Sequence
  Description of Artificial Sequence: Synthetic oligonucleotide
gaggataaacagcttcaagatgaactggagatgctc

SEQ ID NO: 136001 - DNA, 36 bp, Artificial Sequence
  Description of Artificial Sequence: Synthetic oligonucleotide
aggataaacagcttcaagatgaactggagatgctcg

SEQ ID NO: 136002 - DNA, 35 bp, Artificial Sequence
  Description of Artificial Sequence: Synthetic oligonucleotide
ggataaacagcttcaagatgaactggagatgctcg

SEQ ID NO: 136003 - DNA, 36 bp, Artificial Sequence
  Description of Artificial Sequence: Synthetic oligonucleotide
gataaacagcttcaagatgaactggagatgctcgtg

SEQ ID NO: 136004 - DNA, 36 bp, Artificial Sequence
  Description of Artificial Sequence: Synthetic oligonucleotide
ataaacagcttcaagatgaactggagatgctcgtgg

SEQ ID NO: 136005 - DNA, 35 bp, Artificial Sequence
  Description of Artificial Sequence: Synthetic oligonucleotide
taaacagcttcaagatgaactggagatgctcgtgg

SEQ ID NO: 136006 - DNA, 34 bp, Artificial Sequence
  Description of Artificial Sequence: Synthetic oligonucleotide
aaacagcttcaagatgaactggagatgctcgtgg

SEQ ID NO: 136007 - DNA, 33 bp, Artificial Sequence
  Description of Artificial Sequence: Synthetic oligonucleotide
aacagcttcaagatgaactggagatgctcgtgg

SEQ ID NO: 136008 - DNA, 32 bp, Artificial Sequence
  Description of Artificial Sequence: Synthetic oligonucleotide
acagcttcaagatgaactggagatgctcgtgg

SEQ ID NO: 136009 - DNA, 31 bp, Artificial Sequence
  Description of Artificial Sequence: Synthetic oligonucleotide
cagcttcaagatgaactggagatgctcgtgg

SEQ ID NO: 136010 - DNA, 33 bp, Artificial Sequence
  Description of Artificial Sequence: Synthetic oligonucleotide
agcttcaagatgaactggagatgctcgtggaac

SEQ ID NO: 136011 - DNA, 32 bp, Artificial Sequence
  Description of Artificial Sequence: Synthetic oligonucleotide
gcttcaagatgaactggagatgctcgtggaac

SEQ ID NO: 136012 - DNA, 32 bp, Artificial Sequence
  Description of Artificial Sequence: Synthetic oligonucleotide
cttcaagatgaactggagatgctcgtggaacg

SEQ ID NO: 136013 - DNA, 33 bp, Artificial Sequence
  Description of Artificial Sequence: Synthetic oligonucleotide
ttcaagatgaactggagatgctcgtggaacgac

SEQ ID NO: 136014 - DNA, 32 bp, Artificial Sequence
  Description of Artificial Sequence: Synthetic oligonucleotide
tcaagatgaactggagatgctcgtggaacgac

SEQ ID NO: 136015 - DNA, 31 bp, Artificial Sequence
  Description of Artificial Sequence: Synthetic oligonucleotide
caagatgaactggagatgctcgtggaacgac

SEQ ID NO: 136016 - DNA, 33 bp, Artificial Sequence
  Description of Artificial Sequence: Synthetic oligonucleotide
aagatgaactggagatgctcgtggaacgactag

SEQ ID NO: 136017 - DNA, 32 bp, Artificial Sequence
  Description of Artificial Sequence: Synthetic oligonucleotide
agatgaactggagatgctcgtggaacgactag

SEQ ID NO: 136018 - DNA, 31 bp, Artificial Sequence
  Description of Artificial Sequence: Synthetic oligonucleotide
gatgaactggagatgctcgtggaacgactag

SEQ ID NO: 136019 - DNA, 31 bp, Artificial Sequence
  Description of Artificial Sequence: Synthetic oligonucleotide
atgaactggagatgctcgtggaacgactagg

SEQ ID NO: 136020 - DNA, 30 bp, Artificial Sequence
  Description of Artificial Sequence: Synthetic oligonucleotide
tgaactggagatgctcgtggaacgactagg

SEQ ID NO: 136021 - DNA, 29 bp, Artificial Sequence
  Description of Artificial Sequence: Synthetic oligonucleotide
gaactggagatgctcgtggaacgactagg

SEQ ID NO: 136022 - DNA, 29 bp, Artificial Sequence
  Description of Artificial Sequence: Synthetic oligonucleotide
aactggagatgctcgtggaacgactaggg

SEQ ID NO: 136023 - DNA, 28 bp, Artificial Sequence
  Description of Artificial Sequence: Synthetic oligonucleotide
actggagatgctcgtggaacgactaggg

SEQ ID NO: 136024 - DNA, 27 bp, Artificial Sequence
  Description of Artificial Sequence: Synthetic oligonucleotide
ctggagatgctcgtggaacgactaggg

SEQ ID NO: 136025 - DNA, 27 bp, Artificial Sequence
  Description of Artificial Sequence: Synthetic oligonucleotide
tggagatgctcgtggaacgactagggg

SEQ ID NO: 136026 - DNA, 27 bp, Artificial Sequence
  Description of Artificial Sequence: Synthetic oligonucleotide
ggagatgctcgtggaacgactagggga

SEQ ID NO: 136027 - DNA, 27 bp, Artificial Sequence
  Description of Artificial Sequence: Synthetic oligonucleotide
gagatgctcgtggaacgactaggggag

SEQ ID NO: 136028 - DNA, 29 bp, Artificial Sequence
  Description of Artificial Sequence: Synthetic oligonucleotide
agatgctcgtggaacgactaggggagaag

SEQ ID NO: 136029 - DNA, 28 bp, Artificial Sequence
  Description of Artificial Sequence: Synthetic oligonucleotide
gatgctcgtggaacgactaggggagaag

SEQ ID NO: 136030 - DNA, 28 bp, Artificial Sequence
  Description of Artificial Sequence: Synthetic oligonucleotide
atgctcgtggaacgactaggggagaagg

SEQ ID NO: 136031 - DNA, 27 bp, Artificial Sequence
  Description of Artificial Sequence: Synthetic oligonucleotide
tgctcgtggaacgactaggggagaagg

SEQ ID NO: 136032 - DNA, 27 bp, Artificial Sequence
  Description of Artificial Sequence: Synthetic oligonucleotide
gctcgtggaacgactaggggagaagga

SEQ ID NO: 136033 - DNA, 29 bp, Artificial Sequence
  Description of Artificial Sequence: Synthetic oligonucleotide
ctcgtggaacgactaggggagaaggatac

SEQ ID NO: 136034 - DNA, 31 bp, Artificial Sequence
  Description of Artificial Sequence: Synthetic oligonucleotide
tcgtggaacgactaggggagaaggatacatc

SEQ ID NO: 136035 - DNA, 30 bp, Artificial Sequence
  Description of Artificial Sequence: Synthetic oligonucleotide
cgtggaacgactaggggagaaggatacatc

SEQ ID NO: 136036 - DNA, 30 bp, Artificial Sequence
  Description of Artificial Sequence: Synthetic oligonucleotide
gtggaacgactaggggagaaggatacatcc

SEQ ID NO: 136037 - DNA, 30 bp, Artificial Sequence
  Description of Artificial Sequence: Synthetic oligonucleotide
tggaacgactaggggagaaggatacatccc

SEQ ID NO: 136038 - DNA, 29 bp, Artificial Sequence
  Description of Artificial Sequence: Synthetic oligonucleotide
ggaacgactaggggagaaggatacatccc

SEQ ID NO: 136039 - DNA, 30 bp, Artificial Sequence
  Description of Artificial Sequence: Synthetic oligonucleotide
gaacgactaggggagaaggatacatccctg

SEQ ID NO: 136040 - DNA, 33 bp, Artificial Sequence
  Description of Artificial Sequence: Synthetic oligonucleotide
aacgactaggggagaaggatacatccctgtatc

SEQ ID NO: 136041 - DNA, 32 bp, Artificial Sequence
  Description of Artificial Sequence: Synthetic oligonucleotide
acgactaggggagaaggatacatccctgtatc

SEQ ID NO: 136042 - DNA, 31 bp, Artificial Sequence
  Description of Artificial Sequence: Synthetic oligonucleotide
cgactaggggagaaggatacatccctgtatc

SEQ ID NO: 136043 - DNA, 31 bp, Artificial Sequence
  Description of Artificial Sequence: Synthetic oligonucleotide
gactaggggagaaggatacatccctgtatcg

SEQ ID NO: 136044 - DNA, 32 bp, Artificial Sequence
  Description of Artificial Sequence: Synthetic oligonucleotide
actaggggagaaggatacatccctgtatcgac

SEQ ID NO: 136045 - DNA, 31 bp, Artificial Sequence
  Description of Artificial Sequence: Synthetic oligonucleotide
ctaggggagaaggatacatccctgtatcgac

SEQ ID NO: 136046 - DNA, 31 bp, Artificial Sequence
  Description of Artificial Sequence: Synthetic oligonucleotide
taggggagaaggatacatccctgtatcgacc

SEQ ID NO: 136047 - DNA, 30 bp, Artificial Sequence
  Description of Artificial Sequence: Synthetic oligonucleotide
aggggagaaggatacatccctgtatcgacc

SEQ ID NO: 136048 - DNA, 29 bp, Artificial Sequence
  Description of Artificial Sequence: Synthetic oligonucleotide
ggggagaaggatacatccctgtatcgacc

SEQ ID NO: 136049 - DNA, 30 bp, Artificial Sequence
  Description of Artificial Sequence: Synthetic oligonucleotide
gggagaaggatacatccctgtatcgaccag

SEQ ID NO: 136050 - DNA, 30 bp, Artificial Sequence
  Description of Artificial Sequence: Synthetic oligonucleotide
ggagaaggatacatccctgtatcgaccagc

SEQ ID NO: 136051 - DNA, 30 bp, Artificial Sequence
  Description of Artificial Sequence: Synthetic oligonucleotide
gagaaggatacatccctgtatcgaccagcg

SEQ ID NO: 136052 - DNA, 30 bp, Artificial Sequence
  Description of Artificial Sequence: Synthetic oligonucleotide
agaaggatacatccctgtatcgaccagcgc

SEQ ID NO: 136053 - DNA, 29 bp, Artificial Sequence
  Description of Artificial Sequence: Synthetic oligonucleotide
gaaggatacatccctgtatcgaccagcgc

SEQ ID NO: 136054 - DNA, 30 bp, Artificial Sequence
  Description of Artificial Sequence: Synthetic oligonucleotide
aaggatacatccctgtatcgaccagcgctg

SEQ ID NO: 136055 - DNA, 29 bp, Artificial Sequence
  Description of Artificial Sequence: Synthetic oligonucleotide
aggatacatccctgtatcgaccagcgctg

SEQ ID NO: 136056 - DNA, 28 bp, Artificial Sequence
  Description of Artificial Sequence: Synthetic oligonucleotide
ggatacatccctgtatcgaccagcgctg

SEQ ID NO: 136057 - DNA, 28 bp, Artificial Sequence
  Description of Artificial Sequence: Synthetic oligonucleotide
gatacatccctgtatcgaccagcgctgg

SEQ ID NO: 136058 - DNA, 29 bp, Artificial Sequence
  Description of Artificial Sequence: Synthetic oligonucleotide
atacatccctgtatcgaccagcgctggag

SEQ ID NO: 136059 - DNA, 28 bp, Artificial Sequence
  Description of Artificial Sequence: Synthetic oligonucleotide
tacatccctgtatcgaccagcgctggag

SEQ ID NO: 136060 - DNA, 27 bp, Artificial Sequence
  Description of Artificial Sequence: Synthetic oligonucleotide
acatccctgtatcgaccagcgctggag

SEQ ID NO: 136061 - DNA, 26 bp, Artificial Sequence
  Description of Artificial Sequence: Synthetic oligonucleotide
catccctgtatcgaccagcgctggag

SEQ ID NO: 136062 - DNA, 27 bp, Artificial Sequence
  Description of Artificial Sequence: Synthetic oligonucleotide
atccctgtatcgaccagcgctggagga

SEQ ID NO: 136063 - DNA, 27 bp, Artificial Sequence
  Description of Artificial Sequence: Synthetic oligonucleotide
tccctgtatcgaccagcgctggaggaa

SEQ ID NO: 136064 - DNA, 27 bp, Artificial Sequence
  Description of Artificial Sequence: Synthetic oligonucleotide
ccctgtatcgaccagcgctggaggaat

SEQ ID NO: 136065 - DNA, 28 bp, Artificial Sequence
  Description of Artificial Sequence: Synthetic oligonucleotide
cctgtatcgaccagcgctggaggaattg

SEQ ID NO: 136066 - DNA, 28 bp, Artificial Sequence
  Description of Artificial Sequence: Synthetic oligonucleotide
ctgtatcgaccagcgctggaggaattgc

SEQ ID NO: 136067 - DNA, 28 bp, Artificial Sequence
  Description of Artificial Sequence: Synthetic oligonucleotide
tgtatcgaccagcgctggaggaattgcg

SEQ ID NO: 136068 - DNA, 27 bp, Artificial Sequence
  Description of Artificial Sequence: Synthetic oligonucleotide
gtatcgaccagcgctggaggaattgcg

SEQ ID NO: 136069 - DNA, 29 bp, Artificial Sequence
  Description of Artificial Sequence: Synthetic oligonucleotide
tatcgaccagcgctggaggaattgcgaag

SEQ ID NO: 136070 - DNA, 28 bp, Artificial Sequence
  Description of Artificial Sequence: Synthetic oligonucleotide
atcgaccagcgctggaggaattgcgaag

SEQ ID NO: 136071 - DNA, 27 bp, Artificial Sequence
  Description of Artificial Sequence: Synthetic oligonucleotide
tcgaccagcgctggaggaattgcgaag

SEQ ID NO: 136072 - DNA, 26 bp, Artificial Sequence
  Description of Artificial Sequence: Synthetic oligonucleotide
cgaccagcgctggaggaattgcgaag

SEQ ID NO: 136073 - DNA, 26 bp, Artificial Sequence
  Description of Artificial Sequence: Synthetic oligonucleotide
gaccagcgctggaggaattgcgaagg

SEQ ID NO: 136074 - DNA, 27 bp, Artificial Sequence
  Description of Artificial Sequence: Synthetic oligonucleotide
accagcgctggaggaattgcgaaggca

SEQ ID NO: 136075 - DNA, 26 bp, Artificial Sequence
  Description of Artificial Sequence: Synthetic oligonucleotide
ccagcgctggaggaattgcgaaggca

SEQ ID NO: 136076 - DNA, 27 bp, Artificial Sequence
  Description of Artificial Sequence: Synthetic oligonucleotide
cagcgctggaggaattgcgaaggcaga

SEQ ID NO: 136077 - DNA, 29 bp, Artificial Sequence
  Description of Artificial Sequence: Synthetic oligonucleotide
agcgctggaggaattgcgaaggcagattc

SEQ ID NO: 136078 - DNA, 28 bp, Artificial Sequence
  Description of Artificial Sequence: Synthetic oligonucleotide
gcgctggaggaattgcgaaggcagattc

SEQ ID NO: 136079 - DNA, 28 bp, Artificial Sequence
  Description of Artificial Sequence: Synthetic oligonucleotide
cgctggaggaattgcgaaggcagattcg

SEQ ID NO: 136080 - DNA, 30 bp, Artificial Sequence
  Description of Artificial Sequence: Synthetic oligonucleotide
gctggaggaattgcgaaggcagattcgttc

SEQ ID NO: 136081 - DNA, 32 bp, Artificial Sequence
  Description of Artificial Sequence: Synthetic oligonucleotide
ctggaggaattgcgaaggcagattcgttcttc

SEQ ID NO: 136082 - DNA, 34 bp, Artificial Sequence
  Description of Artificial Sequence: Synthetic oligonucleotide
tggaggaattgcgaaggcagattcgttcttctac

SEQ ID NO: 136083 - DNA, 33 bp, Artificial Sequence
  Description of Artificial Sequence: Synthetic oligonucleotide
ggaggaattgcgaaggcagattcgttcttctac

SEQ ID NO: 136084 - DNA, 35 bp, Artificial Sequence
  Description of Artificial Sequence: Synthetic oligonucleotide
gaggaattgcgaaggcagattcgttcttctacaac

SEQ ID NO: 136085 - DNA, 37 bp, Artificial Sequence
  Description of Artificial Sequence: Synthetic oligonucleotide
aggaattgcgaaggcagattcgttcttctacaacttc

SEQ ID NO: 136086 - DNA, 36 bp, Artificial Sequence
  Description of Artificial Sequence: Synthetic oligonucleotide
ggaattgcgaaggcagattcgttcttctacaacttc

SEQ ID NO: 136087 - DNA, 36 bp, Artificial Sequence
  Description of Artificial Sequence: Synthetic oligonucleotide
gaattgcgaaggcagattcgttcttctacaacttcc

SEQ ID NO: 136088 - DNA, 38 bp, Artificial Sequence
  Description of Artificial Sequence: Synthetic oligonucleotide
aattgcgaaggcagattcgttcttctacaacttccatg

SEQ ID NO: 136089 - DNA, 37 bp, Artificial Sequence
  Description of Artificial Sequence: Synthetic oligonucleotide
attgcgaaggcagattcgttcttctacaacttccatg

SEQ ID NO: 136090 - DNA, 36 bp, Artificial Sequence
  Description of Artificial Sequence: Synthetic oligonucleotide
ttgcgaaggcagattcgttcttctacaacttccatg

SEQ ID NO: 136091 - DNA, 35 bp, Artificial Sequence
  Description of Artificial Sequence: Synthetic oligonucleotide
tgcgaaggcagattcgttcttctacaacttccatg

SEQ ID NO: 136092 - DNA, 34 bp, Artificial Sequence
  Description of Artificial Sequence: Synthetic oligonucleotide
gcgaaggcagattcgttcttctacaacttccatg

SEQ ID NO: 136093 - DNA, 35 bp, Artificial Sequence
  Description of Artificial Sequence: Synthetic oligonucleotide
cgaaggcagattcgttcttctacaacttccatgac

SEQ ID NO: 136094 - DNA, 37 bp, Artificial Sequence
  Description of Artificial Sequence: Synthetic oligonucleotide
gaaggcagattcgttcttctacaacttccatgacttc

SEQ ID NO: 136095 - DNA, 38 bp, Artificial Sequence
  Description of Artificial Sequence: Synthetic oligonucleotide
aaggcagattcgttcttctacaacttccatgacttcag

SEQ ID NO: 136096 - DNA, 37 bp, Artificial Sequence
  Description of Artificial Sequence: Synthetic oligonucleotide
aggcagattcgttcttctacaacttccatgacttcag

SEQ ID NO: 136097 - DNA, 36 bp, Artificial Sequence
  Description of Artificial Sequence: Synthetic oligonucleotide
ggcagattcgttcttctacaacttccatgacttcag

SEQ ID NO: 136098 - DNA, 37 bp, Artificial Sequence
  Description of Artificial Sequence: Synthetic oligonucleotide
gcagattcgttcttctacaacttccatgacttcagtg

SEQ ID NO: 136099 - DNA, 37 bp, Artificial Sequence
  Description of Artificial Sequence: Synthetic oligonucleotide
cagattcgttcttctacaacttccatgacttcagtgc

SEQ ID NO: 136100 - DNA, 37 bp, Artificial Sequence
  Description of Artificial Sequence: Synthetic oligonucleotide
agattcgttcttctacaacttccatgacttcagtgcc

SEQ ID NO: 136101 - DNA, 36 bp, Artificial Sequence
  Description of Artificial Sequence: Synthetic oligonucleotide
gattcgttcttctacaacttccatgacttcagtgcc

SEQ ID NO: 136102 - DNA, 36 bp, Artificial Sequence
  Description of Artificial Sequence: Synthetic oligonucleotide
attcgttcttctacaacttccatgacttcagtgccc

SEQ ID NO: 136103 - DNA, 35 bp, Artificial Sequence
  Description of Artificial Sequence: Synthetic oligonucleotide
ttcgttcttctacaacttccatgacttcagtgccc

SEQ ID NO: 136104 - DNA, 34 bp, Artificial Sequence
  Description of Artificial Sequence: Synthetic oligonucleotide
tcgttcttctacaacttccatgacttcagtgccc

SEQ ID NO: 136105 - DNA, 33 bp, Artificial Sequence
  Description of Artificial Sequence: Synthetic oligonucleotide
cgttcttctacaacttccatgacttcagtgccc

SEQ ID NO: 136106 - DNA, 35 bp, Artificial Sequence
  Description of Artificial Sequence: Synthetic oligonucleotide
gttcttctacaacttccatgacttcagtgcccaag

SEQ ID NO: 136107 - DNA, 35 bp, Artificial Sequence
  Description of Artificial Sequence: Synthetic oligonucleotide
ttcttctacaacttccatgacttcagtgcccaagc

SEQ ID NO: 136108 - DNA, 34 bp, Artificial Sequence
  Description of Artificial Sequence: Synthetic oligonucleotide
tcttctacaacttccatgacttcagtgcccaagc

SEQ ID NO: 136109 - DNA, 33 bp, Artificial Sequence
  Description of Artificial Sequence: Synthetic oligonucleotide
cttctacaacttccatgacttcagtgcccaagc

SEQ ID NO: 136110 - DNA, 33 bp, Artificial Sequence
  Description of Artificial Sequence: Synthetic oligonucleotide
ttctacaacttccatgacttcagtgcccaagcc

SEQ ID NO: 136111 - DNA, 32 bp, Artificial Sequence
  Description of Artificial Sequence: Synthetic oligonucleotide
tctacaacttccatgacttcagtgcccaagcc

SEQ ID NO: 136112 - DNA, 31 bp, Artificial Sequence
  Description of Artificial Sequence: Synthetic oligonucleotide
ctacaacttccatgacttcagtgcccaagcc

SEQ ID NO: 136113 - DNA, 32 bp, Artificial Sequence
  Description of Artificial Sequence: Synthetic oligonucleotide
tacaacttccatgacttcagtgcccaagcctc

SEQ ID NO: 136114 - DNA, 31 bp, Artificial Sequence
  Description of Artificial Sequence: Synthetic oligonucleotide
acaacttccatgacttcagtgcccaagcctc

SEQ ID NO: 136115 - DNA, 30 bp, Artificial Sequence
  Description of Artificial Sequence: Synthetic oligonucleotide
caacttccatgacttcagtgcccaagcctc

SEQ ID NO: 136116 - DNA, 31 bp, Artificial Sequence
  Description of Artificial Sequence: Synthetic oligonucleotide
aacttccatgacttcagtgcccaagcctctc

SEQ ID NO: 136117 - DNA, 30 bp, Artificial Sequence
  Description of Artificial Sequence: Synthetic oligonucleotide
acttccatgacttcagtgcccaagcctctc

SEQ ID NO: 136118 - DNA, 29 bp, Artificial Sequence
  Description of Artificial Sequence: Synthetic oligonucleotide
cttccatgacttcagtgcccaagcctctc

SEQ ID NO: 136119 - DNA, 35 bp, Artificial Sequence
  Description of Artificial Sequence: Synthetic oligonucleotide
ttccatgacttcagtgcccaagcctctcaaatttc

SEQ ID NO: 136120 - DNA, 34 bp, Artificial Sequence
  Description of Artificial Sequence: Synthetic oligonucleotide
tccatgacttcagtgcccaagcctctcaaatttc

SEQ ID NO: 136121 - DNA, 33 bp, Artificial Sequence
  Description of Artificial Sequence: Synthetic oligonucleotide
ccatgacttcagtgcccaagcctctcaaatttc

SEQ ID NO: 136122 - DNA, 34 bp, Artificial Sequence
  Description of Artificial Sequence: Synthetic oligonucleotide
catgacttcagtgcccaagcctctcaaatttctg

SEQ ID NO: 136123 - DNA, 34 bp, Artificial Sequence
  Description of Artificial Sequence: Synthetic oligonucleotide
atgacttcagtgcccaagcctctcaaatttctgc

SEQ ID NO: 136124 - DNA, 33 bp, Artificial Sequence
  Description of Artificial Sequence: Synthetic oligonucleotide
tgacttcagtgcccaagcctctcaaatttctgc

SEQ ID NO: 136125 - DNA, 32 bp, Artificial Sequence
  Description of Artificial Sequence: Synthetic oligonucleotide
gacttcagtgcccaagcctctcaaatttctgc

SEQ ID NO: 136126 - DNA, 32 bp, Artificial Sequence
  Description of Artificial Sequence: Synthetic oligonucleotide
acttcagtgcccaagcctctcaaatttctgcg

SEQ ID NO: 136127 - DNA, 31 bp, Artificial Sequence
  Description of Artificial Sequence: Synthetic oligonucleotide
cttcagtgcccaagcctctcaaatttctgcg

SEQ ID NO: 136128 - DNA, 32 bp, Artificial Sequence
  Description of Artificial Sequence: Synthetic oligonucleotide
ttcagtgcccaagcctctcaaatttctgcgtc

SEQ ID NO: 136129 - DNA, 31 bp, Artificial Sequence
  Description of Artificial Sequence: Synthetic oligonucleotide
tcagtgcccaagcctctcaaatttctgcgtc

SEQ ID NO: 136130 - DNA, 30 bp, Artificial Sequence
  Description of Artificial Sequence: Synthetic oligonucleotide
cagtgcccaagcctctcaaatttctgcgtc

SEQ ID NO: 136131 - DNA, 30 bp, Artificial Sequence
  Description of Artificial Sequence: Synthetic oligonucleotide
agtgcccaagcctctcaaatttctgcgtcc

SEQ ID NO: 136132 - DNA, 29 bp, Artificial Sequence
  Description of Artificial Sequence: Synthetic oligonucleotide
gtgcccaagcctctcaaatttctgcgtcc

SEQ ID NO: 136133 - DNA, 30 bp, Artificial Sequence
  Description of Artificial Sequence: Synthetic oligonucleotide
tgcccaagcctctcaaatttctgcgtccac

SEQ ID NO: 136134 - DNA, 29 bp, Artificial Sequence
  Description of Artificial Sequence: Synthetic oligonucleotide
gcccaagcctctcaaatttctgcgtccac

SEQ ID NO: 136135 - DNA, 30 bp, Artificial Sequence
  Description of Artificial Sequence: Synthetic oligonucleotide
cccaagcctctcaaatttctgcgtccacac

SEQ ID NO: 136136 - DNA, 33 bp, Artificial Sequence
  Description of Artificial Sequence: Synthetic oligonucleotide
ccaagcctctcaaatttctgcgtccacactatg

SEQ ID NO: 136137 - DNA, 33 bp, Artificial Sequence
  Description of Artificial Sequence: Synthetic oligonucleotide
caagcctctcaaatttctgcgtccacactatgg

SEQ ID NO: 136138 - DNA, 33 bp, Artificial Sequence
  Description of Artificial Sequence: Synthetic oligonucleotide
aagcctctcaaatttctgcgtccacactatggc

SEQ ID NO: 136139 - DNA, 32 bp, Artificial Sequence
  Description of Artificial Sequence: Synthetic oligonucleotide
agcctctcaaatttctgcgtccacactatggc

SEQ ID NO: 136140 - DNA, 31 bp, Artificial Sequence
  Description of Artificial Sequence: Synthetic oligonucleotide
gcctctcaaatttctgcgtccacactatggc

SEQ ID NO: 136141 - DNA, 34 bp, Artificial Sequence
  Description of Artificial Sequence: Synthetic oligonucleotide
cctctcaaatttctgcgtccacactatggcaaac

SEQ ID NO: 136142 - DNA, 35 bp, Artificial Sequence
  Description of Artificial Sequence: Synthetic oligonucleotide
ctctcaaatttctgcgtccacactatggcaaactg

SEQ ID NO: 136143 - DNA, 37 bp, Artificial Sequence
  Description of Artificial Sequence: Synthetic oligonucleotide
tctcaaatttctgcgtccacactatggcaaactgaag

SEQ ID NO: 136144 - DNA, 36 bp, Artificial Sequence
  Description of Artificial Sequence: Synthetic oligonucleotide
ctcaaatttctgcgtccacactatggcaaactgaag

SEQ ID NO: 136145 - DNA, 36 bp, Artificial Sequence
  Description of Artificial Sequence: Synthetic oligonucleotide
tcaaatttctgcgtccacactatggcaaactgaagg

SEQ ID NO: 136146 - DNA, 35 bp, Artificial Sequence
  Description of Artificial Sequence: Synthetic oligonucleotide
caaatttctgcgtccacactatggcaaactgaagg

SEQ ID NO: 136147 - DNA, 39 bp, Artificial Sequence
  Description of Artificial Sequence: Synthetic oligonucleotide
aaatttctgcgtccacactatggcaaactgaaggaaatc

SEQ ID NO: 136148 - DNA, 38 bp, Artificial Sequence
  Description of Artificial Sequence: Synthetic oligonucleotide
aatttctgcgtccacactatggcaaactgaaggaaatc

SEQ ID NO: 136149 - DNA, 37 bp, Artificial Sequence
  Description of Artificial Sequence: Synthetic oligonucleotide
atttctgcgtccacactatggcaaactgaaggaaatc

SEQ ID NO: 136150 - DNA, 36 bp, Artificial Sequence
  Description of Artificial Sequence: Synthetic oligonucleotide
tttctgcgtccacactatggcaaactgaaggaaatc

SEQ ID NO: 136151 - DNA, 35 bp, Artificial Sequence
  Description of Artificial Sequence: Synthetic oligonucleotide
ttctgcgtccacactatggcaaactgaaggaaatc

SEQ ID NO: 136152 - DNA, 34 bp, Artificial Sequence
  Description of Artificial Sequence: Synthetic oligonucleotide
tctgcgtccacactatggcaaactgaaggaaatc

SEQ ID NO: 136153 - DNA, 33 bp, Artificial Sequence
  Description of Artificial Sequence: Synthetic oligonucleotide
ctgcgtccacactatggcaaactgaaggaaatc

SEQ ID NO: 136154 - DNA, 36 bp, Artificial Sequence
  Description of Artificial Sequence: Synthetic oligonucleotide
tgcgtccacactatggcaaactgaaggaaatctatg

SEQ ID NO: 136155 - DNA, 35 bp, Artificial Sequence
  Description of Artificial Sequence: Synthetic oligonucleotide
gcgtccacactatggcaaactgaaggaaatctatg

SEQ ID NO: 136156 - DNA, 36 bp, Artificial Sequence
  Description of Artificial Sequence: Synthetic oligonucleotide
cgtccacactatggcaaactgaaggaaatctatgag

SEQ ID NO: 136157 - DNA, 38 bp, Artificial Sequence
  Description of Artificial Sequence: Synthetic oligonucleotide
gtccacactatggcaaactgaaggaaatctatgagaac

SEQ ID NO: 136158 - DNA, 40 bp, Artificial Sequence
  Description of Artificial Sequence: Synthetic oligonucleotide
tccacactatggcaaactgaaggaaatctatgagaacatg

SEQ ID NO: 136159 - DNA, 39 bp, Artificial Sequence
  Description of Artificial Sequence: Synthetic oligonucleotide
ccacactatggcaaactgaaggaaatctatgagaacatg

SEQ ID NO: 136160 - DNA, 39 bp, Artificial Sequence
  Description of Artificial Sequence: Synthetic oligonucleotide
cacactatggcaaactgaaggaaatctatgagaacatgg

SEQ ID NO: 136161 - DNA, 39 bp, Artificial Sequence
  Description of Artificial Sequence: Synthetic oligonucleotide
acactatggcaaactgaaggaaatctatgagaacatggc

SEQ ID NO: 136162 - DNA, 38 bp, Artificial Sequence
  Description of Artificial Sequence: Synthetic oligonucleotide
cactatggcaaactgaaggaaatctatgagaacatggc

SEQ ID NO: 136163 - DNA, 38 bp, Artificial Sequence
  Description of Artificial Sequence: Synthetic oligonucleotide
actatggcaaactgaaggaaatctatgagaacatggcc

SEQ ID NO: 136164 - DNA, 37 bp, Artificial Sequence
  Description of Artificial Sequence: Synthetic oligonucleotide
ctatggcaaactgaaggaaatctatgagaacatggcc

SEQ ID NO: 136165 - DNA, 37 bp, Artificial Sequence
  Description of Artificial Sequence: Synthetic oligonucleotide
tatggcaaactgaaggaaatctatgagaacatggccc

SEQ ID NO: 136166 - DNA, 36 bp, Artificial Sequence
  Description of Artificial Sequence: Synthetic oligonucleotide
atggcaaactgaaggaaatctatgagaacatggccc

SEQ ID NO: 136167 - DNA, 35 bp, Artificial Sequence
  Description of Artificial Sequence: Synthetic oligonucleotide
tggcaaactgaaggaaatctatgagaacatggccc

SEQ ID NO: 136168 - DNA, 34 bp, Artificial Sequence
  Description of Artificial Sequence: Synthetic oligonucleotide
ggcaaactgaaggaaatctatgagaacatggccc

SEQ ID NO: 136169 - DNA, 34 bp, Artificial Sequence
  Description of Artificial Sequence: Synthetic oligonucleotide
gcaaactgaaggaaatctatgagaacatggcccc

SEQ ID NO: 136170 - DNA, 35 bp, Artificial Sequence
  Description of Artificial Sequence: Synthetic oligonucleotide
caaactgaaggaaatctatgagaacatggcccctg

SEQ ID NO: 136171 - DNA, 35 bp, Artificial Sequence
  Description of Artificial Sequence: Synthetic oligonucleotide
aaactgaaggaaatctatgagaacatggcccctgg

SEQ ID NO: 136172 - DNA, 34 bp, Artificial Sequence
  Description of Artificial Sequence: Synthetic oligonucleotide
aactgaaggaaatctatgagaacatggcccctgg

SEQ ID NO: 136173 - DNA, 33 bp, Artificial Sequence
  Description of Artificial Sequence: Synthetic oligonucleotide
actgaaggaaatctatgagaacatggcccctgg

SEQ ID NO: 136174 - DNA, 32 bp, Artificial Sequence
  Description of Artificial Sequence: Synthetic oligonucleotide
ctgaaggaaatctatgagaacatggcccctgg

SEQ ID NO: 136175 - DNA, 32 bp, Artificial Sequence
  Description of Artificial Sequence: Synthetic oligonucleotide
tgaaggaaatctatgagaacatggcccctggg

SEQ ID NO: 136176 - DNA, 31 bp, Artificial Sequence
  Description of Artificial Sequence: Synthetic oligonucleotide
gaaggaaatctatgagaacatggcccctggg

SEQ ID NO: 136177 - DNA, 31 bp, Artificial Sequence
  Description of Artificial Sequence: Synthetic oligonucleotide
aaggaaatctatgagaacatggcccctgggg

SEQ ID NO: 136178 - DNA, 30 bp, Artificial Sequence
  Description of Artificial Sequence: Synthetic oligonucleotide
aggaaatctatgagaacatggcccctgggg

SEQ ID NO: 136179 - DNA, 29 bp, Artificial Sequence
  Description of Artificial Sequence: Synthetic oligonucleotide
ggaaatctatgagaacatggcccctgggg

SEQ ID NO: 136180 - DNA, 30 bp, Artificial Sequence
  Description of Artificial Sequence: Synthetic oligonucleotide
gaaatctatgagaacatggcccctggggag

SEQ ID NO: 136181 - DNA, 35 bp, Artificial Sequence
  Description of Artificial Sequence: Synthetic oligonucleotide
aaatctatgagaacatggcccctggggagaataag

SEQ ID NO: 136182 - DNA, 34 bp, Artificial Sequence
  Description of Artificial Sequence: Synthetic oligonucleotide
aatctatgagaacatggcccctggggagaataag

SEQ ID NO: 136183 - DNA, 33 bp, Artificial Sequence
  Description of Artificial Sequence: Synthetic oligonucleotide
atctatgagaacatggcccctggggagaataag

SEQ ID NO: 136184 - DNA, 32 bp, Artificial Sequence
  Description of Artificial Sequence: Synthetic oligonucleotide
tctatgagaacatggcccctggggagaataag

SEQ ID NO: 136185 - DNA, 31 bp, Artificial Sequence
  Description of Artificial Sequence: Synthetic oligonucleotide
ctatgagaacatggcccctggggagaataag

SEQ ID NO: 136186 - DNA, 31 bp, Artificial Sequence
  Description of Artificial Sequence: Synthetic oligonucleotide
tatgagaacatggcccctggggagaataagc

SEQ ID NO: 136187 - DNA, 30 bp, Artificial Sequence
  Description of Artificial Sequence: Synthetic oligonucleotide
atgagaacatggcccctggggagaataagc

SEQ ID NO: 136188 - DNA, 29 bp, Artificial Sequence
  Description of Artificial Sequence: Synthetic oligonucleotide
tgagaacatggcccctggggagaataagc

SEQ ID NO: 136189 - DNA, 28 bp, Artificial Sequence
  Description of Artificial Sequence: Synthetic oligonucleotide
gagaacatggcccctggggagaataagc

SEQ ID NO: 136190 - DNA, 28 bp, Artificial Sequence
  Description of Artificial Sequence: Synthetic oligonucleotide
agaacatggcccctggggagaataagcg

SEQ ID NO: 136191 - DNA, 27 bp, Artificial Sequence
  Description of Artificial Sequence: Synthetic oligonucleotide
gaacatggcccctggggagaataagcg

SEQ ID NO: 136192 - DNA, 31 bp, Artificial Sequence
  Description of Artificial Sequence: Synthetic oligonucleotide
aacatggcccctggggagaataagcgttttg

SEQ ID NO: 136193 - DNA, 30 bp, Artificial Sequence
  Description of Artificial Sequence: Synthetic oligonucleotide
acatggcccctggggagaataagcgttttg

SEQ ID NO: 136194 - DNA, 29 bp, Artificial Sequence
  Description of Artificial Sequence: Synthetic oligonucleotide
catggcccctggggagaataagcgttttg

SEQ ID NO: 136195 - DNA, 29 bp, Artificial Sequence
  Description of Artificial Sequence: Synthetic oligonucleotide
atggcccctggggagaataagcgttttgc

SEQ ID NO: 136196 - DNA, 28 bp, Artificial Sequence
  Description of Artificial Sequence: Synthetic oligonucleotide
tggcccctggggagaataagcgttttgc

SEQ ID NO: 136197 - DNA, 27 bp, Artificial Sequence
  Description of Artificial Sequence: Synthetic oligonucleotide
ggcccctggggagaataagcgttttgc

SEQ ID NO: 136198 - DNA, 28 bp, Artificial Sequence
  Description of Artificial Sequence: Synthetic oligonucleotide
gcccctggggagaataagcgttttgctg

SEQ ID NO: 136199 - DNA, 28 bp, Artificial Sequence
  Description of Artificial Sequence: Synthetic oligonucleotide
cccctggggagaataagcgttttgctgc

SEQ ID NO: 136200 - DNA, 29 bp, Artificial Sequence
  Description of Artificial Sequence: Synthetic oligonucleotide
ccctggggagaataagcgttttgctgctg

SEQ ID NO: 136201 - DNA, 30 bp, Artificial Sequence
  Description of Artificial Sequence: Synthetic oligonucleotide
cctggggagaataagcgttttgctgctgac

SEQ ID NO: 136202 - DNA, 32 bp, Artificial Sequence
  Description of Artificial Sequence: Synthetic oligonucleotide
ctggggagaataagcgttttgctgctgacatc

SEQ ID NO: 136203 - DNA, 34 bp, Artificial Sequence
  Description of Artificial Sequence: Synthetic oligonucleotide
tggggagaataagcgttttgctgctgacatcatc

SEQ ID NO: 136204 - DNA, 33 bp, Artificial Sequence
  Description of Artificial Sequence: Synthetic oligonucleotide
ggggagaataagcgttttgctgctgacatcatc

SEQ ID NO: 136205 - DNA, 34 bp, Artificial Sequence
  Description of Artificial Sequence: Synthetic oligonucleotide
gggagaataagcgttttgctgctgacatcatctc

SEQ ID NO: 136206 - DNA, 34 bp, Artificial Sequence
  Description of Artificial Sequence: Synthetic oligonucleotide
ggagaataagcgttttgctgctgacatcatctcc

SEQ ID NO: 136207 - DNA, 34 bp, Artificial Sequence
  Description of Artificial Sequence: Synthetic oligonucleotide
gagaataagcgttttgctgctgacatcatctccg

SEQ ID NO: 136208 - DNA, 38 bp, Artificial Sequence
  Description of Artificial Sequence: Synthetic oligonucleotide
agaataagcgttttgctgctgacatcatctccgttttg

SEQ ID NO: 136209 - DNA, 37 bp, Artificial Sequence
  Description of Artificial Sequence: Synthetic oligonucleotide
gaataagcgttttgctgctgacatcatctccgttttg

SEQ ID NO: 136210 - DNA, 37 bp, Artificial Sequence
  Description of Artificial Sequence: Synthetic oligonucleotide
aataagcgttttgctgctgacatcatctccgttttgg

SEQ ID NO: 136211 - DNA, 36 bp, Artificial Sequence
  Description of Artificial Sequence: Synthetic oligonucleotide
ataagcgttttgctgctgacatcatctccgttttgg

SEQ ID NO: 136212 - DNA, 35 bp, Artificial Sequence
  Description of Artificial Sequence: Synthetic oligonucleotide
taagcgttttgctgctgacatcatctccgttttgg

SEQ ID NO: 136213 - DNA, 34 bp, Artificial Sequence
  Description of Artificial Sequence: Synthetic oligonucleotide
aagcgttttgctgctgacatcatctccgttttgg

SEQ ID NO: 136214 - DNA, 33 bp, Artificial Sequence
  Description of Artificial Sequence: Synthetic oligonucleotide
agcgttttgctgctgacatcatctccgttttgg

SEQ ID NO: 136215 - DNA, 32 bp, Artificial Sequence
  Description of Artificial Sequence: Synthetic oligonucleotide
gcgttttgctgctgacatcatctccgttttgg

SEQ ID NO: 136216 - DNA, 32 bp, Artificial Sequence
  Description of Artificial Sequence: Synthetic oligonucleotide
cgttttgctgctgacatcatctccgttttggc

SEQ ID NO: 136217 - DNA, 32 bp, Artificial Sequence
  Description of Artificial Sequence: Synthetic oligonucleotide
gttttgctgctgacatcatctccgttttggcc

SEQ ID NO: 136218 - DNA, 34 bp, Artificial Sequence
  Description of Artificial Sequence: Synthetic oligonucleotide
ttttgctgctgacatcatctccgttttggccatg

SEQ ID NO: 136219 - DNA, 33 bp, Artificial Sequence
  Description of Artificial Sequence: Synthetic oligonucleotide
tttgctgctgacatcatctccgttttggccatg

SEQ ID NO: 136220 - DNA, 32 bp, Artificial Sequence
  Description of Artificial Sequence: Synthetic oligonucleotide
ttgctgctgacatcatctccgttttggccatg

SEQ ID NO: 136221 - DNA, 31 bp, Artificial Sequence
  Description of Artificial Sequence: Synthetic oligonucleotide
tgctgctgacatcatctccgttttggccatg

SEQ ID NO: 136222 - DNA, 30 bp, Artificial Sequence
  Description of Artificial Sequence: Synthetic oligonucleotide
gctgctgacatcatctccgttttggccatg

SEQ ID NO: 136223 - DNA, 31 bp, Artificial Sequence
  Description of Artificial Sequence: Synthetic oligonucleotide
ctgctgacatcatctccgttttggccatgac

SEQ ID NO: 136224 - DNA, 31 bp, Artificial Sequence
  Description of Artificial Sequence: Synthetic oligonucleotide
tgctgacatcatctccgttttggccatgacc

SEQ ID NO: 136225 - DNA, 30 bp, Artificial Sequence
  Description of Artificial Sequence: Synthetic oligonucleotide
gctgacatcatctccgttttggccatgacc

SEQ ID NO: 136226 - DNA, 32 bp, Artificial Sequence
  Description of Artificial Sequence: Synthetic oligonucleotide
ctgacatcatctccgttttggccatgaccatg

SEQ ID NO: 136227 - DNA, 33 bp, Artificial Sequence
  Description of Artificial Sequence: Synthetic oligonucleotide
tgacatcatctccgttttggccatgaccatgag

SEQ ID NO: 136228 - DNA, 32 bp, Artificial Sequence
  Description of Artificial Sequence: Synthetic oligonucleotide
gacatcatctccgttttggccatgaccatgag

SEQ ID NO: 136229 - DNA, 33 bp, Artificial Sequence
  Description of Artificial Sequence: Synthetic oligonucleotide
acatcatctccgttttggccatgaccatgagtg

SEQ ID NO: 136230 - DNA, 32 bp, Artificial Sequence
  Description of Artificial Sequence: Synthetic oligonucleotide
catcatctccgttttggccatgaccatgagtg

SEQ ID NO: 136231 - DNA, 32 bp, Artificial Sequence
  Description of Artificial Sequence: Synthetic oligonucleotide
atcatctccgttttggccatgaccatgagtgg

SEQ ID NO: 136232 - DNA, 31 bp, Artificial Sequence
  Description of Artificial Sequence: Synthetic oligonucleotide
tcatctccgttttggccatgaccatgagtgg

SEQ ID NO: 136233 - DNA, 30 bp, Artificial Sequence
  Description of Artificial Sequence: Synthetic oligonucleotide
catctccgttttggccatgaccatgagtgg

SEQ ID NO: 136234 - DNA, 30 bp, Artificial Sequence
  Description of Artificial Sequence: Synthetic oligonucleotide
atctccgttttggccatgaccatgagtggg

SEQ ID NO: 136235 - DNA, 29 bp, Artificial Sequence
  Description of Artificial Sequence: Synthetic oligonucleotide
tctccgttttggccatgaccatgagtggg

SEQ ID NO: 136236 - DNA, 28 bp, Artificial Sequence
  Description of Artificial Sequence: Synthetic oligonucleotide
ctccgttttggccatgaccatgagtggg

SEQ ID NO: 136237 - DNA, 28 bp, Artificial Sequence
  Description of Artificial Sequence: Synthetic oligonucleotide
tccgttttggccatgaccatgagtgggg

SEQ ID NO: 136238 - DNA, 27 bp, Artificial Sequence
  Description of Artificial Sequence: Synthetic oligonucleotide
ccgttttggccatgaccatgagtgggg

SEQ ID NO: 136239 - DNA, 28 bp, Artificial Sequence
  Description of Artificial Sequence: Synthetic oligonucleotide
cgttttggccatgaccatgagtggggag

SEQ ID NO: 136240 - DNA, 28 bp, Artificial Sequence
  Description of Artificial Sequence: Synthetic oligonucleotide
gttttggccatgaccatgagtggggagc

SEQ ID NO: 136241 - DNA, 28 bp, Artificial Sequence
  Description of Artificial Sequence: Synthetic oligonucleotide
ttttggccatgaccatgagtggggagcg

SEQ ID NO: 136242 - DNA, 27 bp, Artificial Sequence
  Description of Artificial Sequence: Synthetic oligonucleotide
tttggccatgaccatgagtggggagcg

SEQ ID NO: 136243 - DNA, 27 bp, Artificial Sequence
  Description of Artificial Sequence: Synthetic oligonucleotide
ttggccatgaccatgagtggggagcgt

SEQ ID NO: 136244 - DNA, 26 bp, Artificial Sequence
  Description of Artificial Sequence: Synthetic oligonucleotide
tggccatgaccatgagtggggagcgt

SEQ ID NO: 136245 - DNA, 25 bp, Artificial Sequence
  Description of Artificial Sequence: Synthetic oligonucleotide
ggccatgaccatgagtggggagcgt

SEQ ID NO: 136246 - DNA, 26 bp, Artificial Sequence
  Description of Artificial Sequence: Synthetic oligonucleotide
gccatgaccatgagtggggagcgtga

SEQ ID NO: 136247 - DNA, 27 bp, Artificial Sequence
  Description of Artificial Sequence: Synthetic oligonucleotide
ccatgaccatgagtggggagcgtgagt

SEQ ID NO: 136248 - DNA, 27 bp, Artificial Sequence
  Description of Artificial Sequence: Synthetic oligonucleotide
catgaccatgagtggggagcgtgagtg

SEQ ID NO: 136249 - DNA, 27 bp, Artificial Sequence
  Description of Artificial Sequence: Synthetic oligonucleotide
atgaccatgagtggggagcgtgagtgc

SEQ ID NO: 136250 - DNA, 26 bp, Artificial Sequence
  Description of Artificial Sequence: Synthetic oligonucleotide
tgaccatgagtggggagcgtgagtgc

SEQ ID NO: 136251 - DNA, 25 bp, Artificial Sequence
  Description of Artificial Sequence: Synthetic oligonucleotide
gaccatgagtggggagcgtgagtgc

SEQ ID NO: 136252 - DNA, 26 bp, Artificial Sequence
  Description of Artificial Sequence: Synthetic oligonucleotide
accatgagtggggagcgtgagtgcct

SEQ ID NO: 136253 - DNA, 25 bp, Artificial Sequence
  Description of Artificial Sequence: Synthetic oligonucleotide
ccatgagtggggagcgtgagtgcct

SEQ ID NO: 136254 - DNA, 27 bp, Artificial Sequence
  Description of Artificial Sequence: Synthetic oligonucleotide
catgagtggggagcgtgagtgcctcaa

SEQ ID NO: 136255 - DNA, 27 bp, Artificial Sequence
  Description of Artificial Sequence: Synthetic oligonucleotide
atgagtggggagcgtgagtgcctcaag

SEQ ID NO: 136256 - DNA, 27 bp, Artificial Sequence
  Description of Artificial Sequence: Synthetic oligonucleotide
tgagtggggagcgtgagtgcctcaagt

SEQ ID NO: 136257 - DNA, 27 bp, Artificial Sequence
  Description of Artificial Sequence: Synthetic oligonucleotide
gagtggggagcgtgagtgcctcaagta

SEQ ID NO: 136258 - DNA, 28 bp, Artificial Sequence
  Description of Artificial Sequence: Synthetic oligonucleotide
agtggggagcgtgagtgcctcaagtatc

SEQ ID NO: 136259 - DNA, 27 bp, Artificial Sequence
  Description of Artificial Sequence: Synthetic oligonucleotide
gtggggagcgtgagtgcctcaagtatc

SEQ ID NO: 136260 - DNA, 27 bp, Artificial Sequence
  Description of Artificial Sequence: Synthetic oligonucleotide
tggggagcgtgagtgcctcaagtatcg

SEQ ID NO: 136261 - DNA, 26 bp, Artificial Sequence
  Description of Artificial Sequence: Synthetic oligonucleotide
ggggagcgtgagtgcctcaagtatcg

SEQ ID NO: 136262 - DNA, 26 bp, Artificial Sequence
  Description of Artificial Sequence: Synthetic oligonucleotide
gggagcgtgagtgcctcaagtatcgg

SEQ ID NO: 136263 - DNA, 27 bp, Artificial Sequence
  Description of Artificial Sequence: Synthetic oligonucleotide
ggagcgtgagtgcctcaagtatcggct

SEQ ID NO: 136264 - DNA, 28 bp, Artificial Sequence
  Description of Artificial Sequence: Synthetic oligonucleotide
gagcgtgagtgcctcaagtatcggctag

SEQ ID NO: 136265 - DNA, 29 bp, Artificial Sequence
  Description of Artificial Sequence: Synthetic oligonucleotide
agcgtgagtgcctcaagtatcggctagtg

SEQ ID NO: 136266 - DNA, 28 bp, Artificial Sequence
  Description of Artificial Sequence: Synthetic oligonucleotide
gcgtgagtgcctcaagtatcggctagtg

SEQ ID NO: 136267 - DNA, 28 bp, Artificial Sequence
  Description of Artificial Sequence: Synthetic oligonucleotide
cgtgagtgcctcaagtatcggctagtgg

SEQ ID NO: 136268 - DNA, 28 bp, Artificial Sequence
  Description of Artificial Sequence: Synthetic oligonucleotide
gtgagtgcctcaagtatcggctagtggg

SEQ ID NO: 136269 - DNA, 28 bp, Artificial Sequence
  Description of Artificial Sequence: Synthetic oligonucleotide
tgagtgcctcaagtatcggctagtgggc

SEQ ID NO: 136270 - DNA, 27 bp, Artificial Sequence
  Description of Artificial Sequence: Synthetic oligonucleotide
gagtgcctcaagtatcggctagtgggc

SEQ ID NO: 136271 - DNA, 28 bp, Artificial Sequence
  Description of Artificial Sequence: Synthetic oligonucleotide
agtgcctcaagtatcggctagtgggctc

SEQ ID NO: 136272 - DNA, 27 bp, Artificial Sequence
  Description of Artificial Sequence: Synthetic oligonucleotide
gtgcctcaagtatcggctagtgggctc

SEQ ID NO: 136273 - DNA, 27 bp, Artificial Sequence
  Description of Artificial Sequence: Synthetic oligonucleotide
tgcctcaagtatcggctagtgggctcc

SEQ ID NO: 136274 - DNA, 26 bp, Artificial Sequence
  Description of Artificial Sequence: Synthetic oligonucleotide
gcctcaagtatcggctagtgggctcc

SEQ ID NO: 136275 - DNA, 27 bp, Artificial Sequence
  Description of Artificial Sequence: Synthetic oligonucleotide
cctcaagtatcggctagtgggctccca

SEQ ID NO: 136276 - DNA, 27 bp, Artificial Sequence
  Description of Artificial Sequence: Synthetic oligonucleotide
ctcaagtatcggctagtgggctcccag

SEQ ID NO: 136277 - DNA, 27 bp, Artificial Sequence
  Description of Artificial Sequence: Synthetic oligonucleotide
tcaagtatcggctagtgggctcccagg

SEQ ID NO: 136278 - DNA, 27 bp, Artificial Sequence
  Description of Artificial Sequence: Synthetic oligonucleotide
caagtatcggctagtgggctcccagga

SEQ ID NO: 136279 - DNA, 27 bp, Artificial Sequence
  Description of Artificial Sequence: Synthetic oligonucleotide
aagtatcggctagtgggctcccaggag

SEQ ID NO: 136280 - DNA, 26 bp, Artificial Sequence
  Description of Artificial Sequence: Synthetic oligonucleotide
agtatcggctagtgggctcccaggag

SEQ ID NO: 136281 - DNA, 25 bp, Artificial Sequence
  Description of Artificial Sequence: Synthetic oligonucleotide
gtatcggctagtgggctcccaggag

SEQ ID NO: 136282 - DNA, 27 bp, Artificial Sequence
  Description of Artificial Sequence: Synthetic oligonucleotide
tatcggctagtgggctcccaggaggaa

SEQ ID NO: 136283 - DNA, 27 bp, Artificial Sequence
  Description of Artificial Sequence: Synthetic oligonucleotide
atcggctagtgggctcccaggaggaat

SEQ ID NO: 136284 - DNA, 27 bp, Artificial Sequence
  Description of Artificial Sequence: Synthetic oligonucleotide
tcggctagtgggctcccaggaggaatt

SEQ ID NO: 136285 - DNA, 26 bp, Artificial Sequence
  Description of Artificial Sequence: Synthetic oligonucleotide
cggctagtgggctcccaggaggaatt

SEQ ID NO: 136286 - DNA, 26 bp, Artificial Sequence
  Description of Artificial Sequence: Synthetic oligonucleotide
ggctagtgggctcccaggaggaattg

SEQ ID NO: 136287 - DNA, 26 bp, Artificial Sequence
  Description of Artificial Sequence: Synthetic oligonucleotide
gctagtgggctcccaggaggaattgg

SEQ ID NO: 136288 - DNA, 27 bp, Artificial Sequence
  Description of Artificial Sequence: Synthetic oligonucleotide
ctagtgggctcccaggaggaattggca

SEQ ID NO: 136289 - DNA, 28 bp, Artificial Sequence
  Description of Artificial Sequence: Synthetic oligonucleotide
tagtgggctcccaggaggaattggcatc

SEQ ID NO: 136290 - DNA, 27 bp, Artificial Sequence
  Description of Artificial Sequence: Synthetic oligonucleotide
agtgggctcccaggaggaattggcatc

SEQ ID NO: 136291 - DNA, 27 bp, Artificial Sequence
  Description of Artificial Sequence: Synthetic oligonucleotide
gtgggctcccaggaggaattggcatca

SEQ ID NO: 136292 - DNA, 28 bp, Artificial Sequence
  Description of Artificial Sequence: Synthetic oligonucleotide
tgggctcccaggaggaattggcatcatg

SEQ ID NO: 136293 - DNA, 27 bp, Artificial Sequence
  Description of Artificial Sequence: Synthetic oligonucleotide
gggctcccaggaggaattggcatcatg

SEQ ID NO: 136294 - DNA, 27 bp, Artificial Sequence
  Description of Artificial Sequence: Synthetic oligonucleotide
ggctcccaggaggaattggcatcatgg

SEQ ID NO: 136295 - DNA, 27 bp, Artificial Sequence
  Description of Artificial Sequence: Synthetic oligonucleotide
gctcccaggaggaattggcatcatggg

SEQ ID NO: 136296 - DNA, 27 bp, Artificial Sequence
  Description of Artificial Sequence: Synthetic oligonucleotide
ctcccaggaggaattggcatcatgggg

SEQ ID NO: 136297 - DNA, 28 bp, Artificial Sequence
  Description of Artificial Sequence: Synthetic oligonucleotide
tcccaggaggaattggcatcatggggtc

SEQ ID NO: 136298 - DNA, 27 bp, Artificial Sequence
  Description of Artificial Sequence: Synthetic oligonucleotide
cccaggaggaattggcatcatggggtc

SEQ ID NO: 136299 - DNA, 29 bp, Artificial Sequence
  Description of Artificial Sequence: Synthetic oligonucleotide
ccaggaggaattggcatcatggggtcatg

SEQ ID NO: 136300 - DNA, 30 bp, Artificial Sequence
  Description of Artificial Sequence: Synthetic oligonucleotide
caggaggaattggcatcatggggtcatgag

SEQ ID NO: 136301 - DNA, 33 bp, Artificial Sequence
  Description of Artificial Sequence: Synthetic oligonucleotide
aggaggaattggcatcatggggtcatgagtatg

SEQ ID NO: 136302 - DNA, 32 bp, Artificial Sequence
  Description of Artificial Sequence: Synthetic oligonucleotide
ggaggaattggcatcatggggtcatgagtatg

SEQ ID NO: 136303 - DNA, 33 bp, Artificial Sequence
  Description of Artificial Sequence: Synthetic oligonucleotide
gaggaattggcatcatggggtcatgagtatgtc

SEQ ID NO: 136304 - DNA, 34 bp, Artificial Sequence
  Description of Artificial Sequence: Synthetic oligonucleotide
aggaattggcatcatggggtcatgagtatgtcag

SEQ ID NO: 136305 - DNA, 33 bp, Artificial Sequence
  Description of Artificial Sequence: Synthetic oligonucleotide
ggaattggcatcatggggtcatgagtatgtcag

SEQ ID NO: 136306 - DNA, 33 bp, Artificial Sequence
  Description of Artificial Sequence: Synthetic oligonucleotide
gaattggcatcatggggtcatgagtatgtcagg

SEQ ID NO: 136307 - DNA, 33 bp, Artificial Sequence
  Description of Artificial Sequence: Synthetic oligonucleotide
aattggcatcatggggtcatgagtatgtcaggc

SEQ ID NO: 136308 - DNA, 32 bp, Artificial Sequence
  Description of Artificial Sequence: Synthetic oligonucleotide
attggcatcatggggtcatgagtatgtcaggc

SEQ ID NO: 136309 - DNA, 31 bp, Artificial Sequence
  Description of Artificial Sequence: Synthetic oligonucleotide
ttggcatcatggggtcatgagtatgtcaggc

SEQ ID NO: 136310 - DNA, 30 bp, Artificial Sequence
  Description of Artificial Sequence: Synthetic oligonucleotide
tggcatcatggggtcatgagtatgtcaggc

SEQ ID NO: 136311 - DNA, 29 bp, Artificial Sequence
  Description of Artificial Sequence: Synthetic oligonucleotide
ggcatcatggggtcatgagtatgtcaggc

SEQ ID NO: 136312 - DNA, 31 bp, Artificial Sequence
  Description of Artificial Sequence: Synthetic oligonucleotide
gcatcatggggtcatgagtatgtcaggcatc

SEQ ID NO: 136313 - DNA, 32 bp, Artificial Sequence
  Description of Artificial Sequence: Synthetic oligonucleotide
catcatggggtcatgagtatgtcaggcatctg

SEQ ID NO: 136314 - DNA, 32 bp, Artificial Sequence
  Description of Artificial Sequence: Synthetic oligonucleotide
atcatggggtcatgagtatgtcaggcatctgg

SEQ ID NO: 136315 - DNA, 31 bp, Artificial Sequence
  Description of Artificial Sequence: Synthetic oligonucleotide
tcatggggtcatgagtatgtcaggcatctgg

SEQ ID NO: 136316 - DNA, 30 bp, Artificial Sequence
  Description of Artificial Sequence: Synthetic oligonucleotide
catggggtcatgagtatgtcaggcatctgg

SEQ ID NO: 136317 - DNA, 30 bp, Artificial Sequence
  Description of Artificial Sequence: Synthetic oligonucleotide
atggggtcatgagtatgtcaggcatctggc

SEQ ID NO: 136318 - DNA, 29 bp, Artificial Sequence
  Description of Artificial Sequence: Synthetic oligonucleotide
tggggtcatgagtatgtcaggcatctggc

SEQ ID NO: 136319 - DNA, 28 bp, Artificial Sequence
  Description of Artificial Sequence: Synthetic oligonucleotide
ggggtcatgagtatgtcaggcatctggc

SEQ ID NO: 136320 - DNA, 29 bp, Artificial Sequence
  Description of Artificial Sequence: Synthetic oligonucleotide
gggtcatgagtatgtcaggcatctggcag

SEQ ID NO: 136321 - DNA, 29 bp, Artificial Sequence
  Description of Artificial Sequence: Synthetic oligonucleotide
ggtcatgagtatgtcaggcatctggcagg

SEQ ID NO: 136322 - DNA, 30 bp, Artificial Sequence
  Description of Artificial Sequence: Synthetic oligonucleotide
gtcatgagtatgtcaggcatctggcaggag

SEQ ID NO: 136323 - DNA, 32 bp, Artificial Sequence
  Description of Artificial Sequence: Synthetic oligonucleotide
tcatgagtatgtcaggcatctggcaggagaag

SEQ ID NO: 136324 - DNA, 31 bp, Artificial Sequence
  Description of Artificial Sequence: Synthetic oligonucleotide
catgagtatgtcaggcatctggcaggagaag

SEQ ID NO: 136325 - DNA, 32 bp, Artificial Sequence
  Description of Artificial Sequence: Synthetic oligonucleotide
atgagtatgtcaggcatctggcaggagaagtg

SEQ ID NO: 136326 - DNA, 31 bp, Artificial Sequence
  Description of Artificial Sequence: Synthetic oligonucleotide
tgagtatgtcaggcatctggcaggagaagtg

SEQ ID NO: 136327 - DNA, 30 bp, Artificial Sequence
  Description of Artificial Sequence: Synthetic oligonucleotide
gagtatgtcaggcatctggcaggagaagtg

SEQ ID NO: 136328 - DNA, 30 bp, Artificial Sequence
  Description of Artificial Sequence: Synthetic oligonucleotide
agtatgtcaggcatctggcaggagaagtgg

SEQ ID NO: 136329 - DNA, 29 bp, Artificial Sequence
  Description of Artificial Sequence: Synthetic oligonucleotide
gtatgtcaggcatctggcaggagaagtgg

SEQ ID NO: 136330 - DNA, 29 bp, Artificial Sequence
  Description of Artificial Sequence: Synthetic oligonucleotide
tatgtcaggcatctggcaggagaagtggc

SEQ ID NO: 136331 - DNA, 28 bp, Artificial Sequence
  Description of Artificial Sequence: Synthetic oligonucleotide
atgtcaggcatctggcaggagaagtggc

SEQ ID NO: 136332 - DNA, 27 bp, Artificial Sequence
  Description of Artificial Sequence: Synthetic oligonucleotide
tgtcaggcatctggcaggagaagtggc

SEQ ID NO: 136333 - DNA, 27 bp, Artificial Sequence
  Description of Artificial Sequence: Synthetic oligonucleotide
gtcaggcatctggcaggagaagtggct

SEQ ID NO: 136334 - DNA, 29 bp, Artificial Sequence
  Description of Artificial Sequence: Synthetic oligonucleotide
tcaggcatctggcaggagaagtggctaag

SEQ ID NO: 136335 - DNA, 28 bp, Artificial Sequence
  Description of Artificial Sequence: Synthetic oligonucleotide
caggcatctggcaggagaagtggctaag

SEQ ID NO: 136336 - DNA, 28 bp, Artificial Sequence
  Description of Artificial Sequence: Synthetic oligonucleotide
aggcatctggcaggagaagtggctaagg

SEQ ID NO: 136337 - DNA, 27 bp, Artificial Sequence
  Description of Artificial Sequence: Synthetic oligonucleotide
ggcatctggcaggagaagtggctaagg

SEQ ID NO: 136338 - DNA, 28 bp, Artificial Sequence
  Description of Artificial Sequence: Synthetic oligonucleotide
gcatctggcaggagaagtggctaaggag

SEQ ID NO: 136339 - DNA, 29 bp, Artificial Sequence
  Description of Artificial Sequence: Synthetic oligonucleotide
catctggcaggagaagtggctaaggagtg

SEQ ID NO: 136340 - DNA, 29 bp, Artificial Sequence
  Description of Artificial Sequence: Synthetic oligonucleotide
atctggcaggagaagtggctaaggagtgg

SEQ ID NO: 136341 - DNA, 28 bp, Artificial Sequence
  Description of Artificial Sequence: Synthetic oligonucleotide
tctggcaggagaagtggctaaggagtgg

SEQ ID NO: 136342 - DNA, 27 bp, Artificial Sequence
  Description of Artificial Sequence: Synthetic oligonucleotide
ctggcaggagaagtggctaaggagtgg

SEQ ID NO: 136343 - DNA, 27 bp, Artificial Sequence
  Description of Artificial Sequence: Synthetic oligonucleotide
tggcaggagaagtggctaaggagtggc

SEQ ID NO: 136344 - DNA, 27 bp, Artificial Sequence
  Description of Artificial Sequence: Synthetic oligonucleotide
ggcaggagaagtggctaaggagtggca

SEQ ID NO: 136345 - DNA, 27 bp, Artificial Sequence
  Description of Artificial Sequence: Synthetic oligonucleotide
gcaggagaagtggctaaggagtggcag

SEQ ID NO: 136346 - DNA, 27 bp, Artificial Sequence
  Description of Artificial Sequence: Synthetic oligonucleotide
caggagaagtggctaaggagtggcagg

SEQ ID NO: 136347 - DNA, 28 bp, Artificial Sequence
  Description of Artificial Sequence: Synthetic oligonucleotide
aggagaagtggctaaggagtggcaggag

SEQ ID NO: 136348 - DNA, 27 bp, Artificial Sequence
  Description of Artificial Sequence: Synthetic oligonucleotide
ggagaagtggctaaggagtggcaggag

SEQ ID NO: 136349 - DNA, 27 bp, Artificial Sequence
  Description of Artificial Sequence: Synthetic oligonucleotide
gagaagtggctaaggagtggcaggagc

SEQ ID NO: 136350 - DNA, 28 bp, Artificial Sequence
  Description of Artificial Sequence: Synthetic oligonucleotide
agaagtggctaaggagtggcaggagctg

SEQ ID NO: 136351 - DNA, 27 bp, Artificial Sequence
  Description of Artificial Sequence: Synthetic oligonucleotide
gaagtggctaaggagtggcaggagctg

SEQ ID NO: 136352 - DNA, 27 bp, Artificial Sequence
  Description of Artificial Sequence: Synthetic oligonucleotide
aagtggctaaggagtggcaggagctgg

SEQ ID NO: 136353 - DNA, 27 bp, Artificial Sequence
  Description of Artificial Sequence: Synthetic oligonucleotide
agtggctaaggagtggcaggagctgga

SEQ ID NO: 136354 - DNA, 27 bp, Artificial Sequence
  Description of Artificial Sequence: Synthetic oligonucleotide
gtggctaaggagtggcaggagctggat

SEQ ID NO: 136355 - DNA, 27 bp, Artificial Sequence
  Description of Artificial Sequence: Synthetic oligonucleotide
tggctaaggagtggcaggagctggatg

SEQ ID NO: 136356 - DNA, 27 bp, Artificial Sequence
  Description of Artificial Sequence: Synthetic oligonucleotide
ggctaaggagtggcaggagctggatga

SEQ ID NO: 136357 - DNA, 27 bp, Artificial Sequence
  Description of Artificial Sequence: Synthetic oligonucleotide
gctaaggagtggcaggagctggatgac

SEQ ID NO: 136358 - DNA, 27 bp, Artificial Sequence
  Description of Artificial Sequence: Synthetic oligonucleotide
ctaaggagtggcaggagctggatgacg

SEQ ID NO: 136359 - DNA, 27 bp, Artificial Sequence
  Description of Artificial Sequence: Synthetic oligonucleotide
taaggagtggcaggagctggatgacgc

SEQ ID NO: 136360 - DNA, 27 bp, Artificial Sequence
  Description of Artificial Sequence: Synthetic oligonucleotide
aaggagtggcaggagctggatgacgca

SEQ ID NO: 136361 - DNA, 26 bp, Artificial Sequence
  Description of Artificial Sequence: Synthetic oligonucleotide
aggagtggcaggagctggatgacgca

SEQ ID NO: 136362 - DNA, 25 bp, Artificial Sequence
  Description of Artificial Sequence: Synthetic oligonucleotide
ggagtggcaggagctggatgacgca

SEQ ID NO: 136363 - DNA, 26 bp, Artificial Sequence
  Description of Artificial Sequence: Synthetic oligonucleotide
gagtggcaggagctggatgacgcaga

SEQ ID NO: 136364 - DNA, 27 bp, Artificial Sequence
  Description of Artificial Sequence: Synthetic oligonucleotide
agtggcaggagctggatgacgcagaga

SEQ ID NO: 136365 - DNA, 27 bp, Artificial Sequence
  Description of Artificial Sequence: Synthetic oligonucleotide
gtggcaggagctggatgacgcagagaa

SEQ ID NO: 136366 - DNA, 27 bp, Artificial Sequence
  Description of Artificial Sequence: Synthetic oligonucleotide
tggcaggagctggatgacgcagagaag

SEQ ID NO: 136367 - DNA, 26 bp, Artificial Sequence
  Description of Artificial Sequence: Synthetic oligonucleotide
ggcaggagctggatgacgcagagaag

SEQ ID NO: 136368 - DNA, 27 bp, Artificial Sequence
  Description of Artificial Sequence: Synthetic oligonucleotide
gcaggagctggatgacgcagagaaggt

SEQ ID NO: 136369 - DNA, 27 bp, Artificial Sequence
  Description of Artificial Sequence: Synthetic oligonucleotide
caggagctggatgacgcagagaaggtc

SEQ ID NO: 136370 - DNA, 27 bp, Artificial Sequence
  Description of Artificial Sequence: Synthetic oligonucleotide
aggagctggatgacgcagagaaggtcc

SEQ ID NO: 136371 - DNA, 27 bp, Artificial Sequence
  Description of Artificial Sequence: Synthetic oligonucleotide
ggagctggatgacgcagagaaggtcca

SEQ ID NO: 136372 - DNA, 27 bp, Artificial Sequence
  Description of Artificial Sequence: Synthetic oligonucleotide
gagctggatgacgcagagaaggtccag

SEQ ID NO: 136373 - DNA, 27 bp, Artificial Sequence
  Description of Artificial Sequence: Synthetic oligonucleotide
agctggatgacgcagagaaggtccagc

SEQ ID NO: 136374 - DNA, 26 bp, Artificial Sequence
  Description of Artificial Sequence: Synthetic oligonucleotide
gctggatgacgcagagaaggtccagc

SEQ ID NO: 136375 - DNA, 26 bp, Artificial Sequence
  Description of Artificial Sequence: Synthetic oligonucleotide
ctggatgacgcagagaaggtccagcg

SEQ ID NO: 136376 - DNA, 26 bp, Artificial Sequence
  Description of Artificial Sequence: Synthetic oligonucleotide
tggatgacgcagagaaggtccagcgg

SEQ ID NO: 136377 - DNA, 25 bp, Artificial Sequence
  Description of Artificial Sequence: Synthetic oligonucleotide
ggatgacgcagagaaggtccagcgg

SEQ ID NO: 136378 - DNA, 26 bp, Artificial Sequence
  Description of Artificial Sequence: Synthetic oligonucleotide
gatgacgcagagaaggtccagcggga

SEQ ID NO: 136379 - DNA, 26 bp, Artificial Sequence
  Description of Artificial Sequence: Synthetic oligonucleotide
atgacgcagagaaggtccagcgggag

SEQ ID NO: 136380 - DNA, 25 bp, Artificial Sequence
  Description of Artificial Sequence: Synthetic oligonucleotide
tgacgcagagaaggtccagcgggag

SEQ ID NO: 136381 - DNA, 24 bp, Artificial Sequence
  Description of Artificial Sequence: Synthetic oligonucleotide
gacgcagagaaggtccagcgggag

SEQ ID NO: 136382 - DNA, 24 bp, Artificial Sequence
  Description of Artificial Sequence: Synthetic oligonucleotide
acgcagagaaggtccagcgggagc

SEQ ID NO: 136383 - DNA, 23 bp, Artificial Sequence
  Description of Artificial Sequence: Synthetic oligonucleotide
cgcagagaaggtccagcgggagc

SEQ ID NO: 136384 - DNA, 24 bp, Artificial Sequence
  Description of Artificial Sequence: Synthetic oligonucleotide
gcagagaaggtccagcgggagcct

SEQ ID NO: 136385 - DNA, 25 bp, Artificial Sequence
  Description of Artificial Sequence: Synthetic oligonucleotide
cagagaaggtccagcgggagcctct

SEQ ID NO: 136386 - DNA, 25 bp, Artificial Sequence
  Description of Artificial Sequence: Synthetic oligonucleotide
agagaaggtccagcgggagcctctg

SEQ ID NO: 136387 - DNA, 24 bp, Artificial Sequence
  Description of Artificial Sequence: Synthetic oligonucleotide
gagaaggtccagcgggagcctctg

SEQ ID NO: 136388 - DNA, 25 bp, Artificial Sequence
  Description of Artificial Sequence: Synthetic oligonucleotide
agaaggtccagcgggagcctctgct

SEQ ID NO: 136389 - DNA, 24 bp, Artificial Sequence
  Description of Artificial Sequence: Synthetic oligonucleotide
gaaggtccagcgggagcctctgct

SEQ ID NO: 136390 - DNA, 25 bp, Artificial Sequence
  Description of Artificial Sequence: Synthetic oligonucleotide
aaggtccagcgggagcctctgctca

SEQ ID NO: 136391 - DNA, 24 bp, Artificial Sequence
  Description of Artificial Sequence: Synthetic oligonucleotide
aggtccagcgggagcctctgctca

SEQ ID NO: 136392 - DNA, 23 bp, Artificial Sequence
  Description of Artificial Sequence: Synthetic oligonucleotide
ggtccagcgggagcctctgctca

SEQ ID NO: 136393 - DNA, 24 bp, Artificial Sequence
  Description of Artificial Sequence: Synthetic oligonucleotide
gtccagcgggagcctctgctcact

SEQ ID NO: 136394 - DNA, 25 bp, Artificial Sequence
  Description of Artificial Sequence: Synthetic oligonucleotide
tccagcgggagcctctgctcactct

SEQ ID NO: 136395 - DNA, 24 bp, Artificial Sequence
  Description of Artificial Sequence: Synthetic oligonucleotide
ccagcgggagcctctgctcactct

SEQ ID NO: 136396 - DNA, 24 bp, Artificial Sequence
  Description of Artificial Sequence: Synthetic oligonucleotide
cagcgggagcctctgctcactctg

SEQ ID NO: 136397 - DNA, 25 bp, Artificial Sequence
  Description of Artificial Sequence: Synthetic oligonucleotide
agcgggagcctctgctcactctggt

SEQ ID NO: 136398 - DNA, 24 bp, Artificial Sequence
  Description of Artificial Sequence: Synthetic oligonucleotide
gcgggagcctctgctcactctggt

SEQ ID NO: 136399 - DNA, 26 bp, Artificial Sequence
  Description of Artificial Sequence: Synthetic oligonucleotide
cgggagcctctgctcactctggtgaa

SEQ ID NO: 136400 - DNA, 26 bp, Artificial Sequence
  Description of Artificial Sequence: Synthetic oligonucleotide
gggagcctctgctcactctggtgaag

SEQ ID NO: 136401 - DNA, 27 bp, Artificial Sequence
  Description of Artificial Sequence: Synthetic oligonucleotide
ggagcctctgctcactctggtgaagga

SEQ ID NO: 136402 - DNA, 30 bp, Artificial Sequence
  Description of Artificial Sequence: Synthetic oligonucleotide
gagcctctgctcactctggtgaaggaaatc

SEQ ID NO: 136403 - DNA, 30 bp, Artificial Sequence
  Description of Artificial Sequence: Synthetic oligonucleotide
agcctctgctcactctggtgaaggaaatcg

SEQ ID NO: 136404 - DNA, 29 bp, Artificial Sequence
  Description of Artificial Sequence: Synthetic oligonucleotide
gcctctgctcactctggtgaaggaaatcg

SEQ ID NO: 136405 - DNA, 30 bp, Artificial Sequence
  Description of Artificial Sequence: Synthetic oligonucleotide
cctctgctcactctggtgaaggaaatcgtc

SEQ ID NO: 136406 - DNA, 30 bp, Artificial Sequence
  Description of Artificial Sequence: Synthetic oligonucleotide
ctctgctcactctggtgaaggaaatcgtcc

SEQ ID NO: 136407 - DNA, 30 bp, Artificial Sequence
  Description of Artificial Sequence: Synthetic oligonucleotide
tctgctcactctggtgaaggaaatcgtccc

SEQ ID NO: 136408 - DNA, 29 bp, Artificial Sequence
  Description of Artificial Sequence: Synthetic oligonucleotide
ctgctcactctggtgaaggaaatcgtccc

SEQ ID NO: 136409 - DNA, 29 bp, Artificial Sequence
  Description of Artificial Sequence: Synthetic oligonucleotide
tgctcactctggtgaaggaaatcgtcccc

SEQ ID NO: 136410 - DNA, 28 bp, Artificial Sequence
  Description of Artificial Sequence: Synthetic oligonucleotide
gctcactctggtgaaggaaatcgtcccc

SEQ ID NO: 136411 - DNA, 33 bp, Artificial Sequence
  Description of Artificial Sequence: Synthetic oligonucleotide
ctcactctggtgaaggaaatcgtcccctataac

SEQ ID NO: 136412 - DNA, 35 bp, Artificial Sequence
  Description of Artificial Sequence: Synthetic oligonucleotide
tcactctggtgaaggaaatcgtcccctataacatg

SEQ ID NO: 136413 - DNA, 34 bp, Artificial Sequence
  Description of Artificial Sequence: Synthetic oligonucleotide
cactctggtgaaggaaatcgtcccctataacatg

SEQ ID NO: 136414 - DNA, 34 bp, Artificial Sequence
  Description of Artificial Sequence: Synthetic oligonucleotide
actctggtgaaggaaatcgtcccctataacatgg

SEQ ID NO: 136415 - DNA, 33 bp, Artificial Sequence
  Description of Artificial Sequence: Synthetic oligonucleotide
ctctggtgaaggaaatcgtcccctataacatgg

SEQ ID NO: 136416 - DNA, 33 bp, Artificial Sequence
  Description of Artificial Sequence: Synthetic oligonucleotide
tctggtgaaggaaatcgtcccctataacatggc

SEQ ID NO: 136417 - DNA, 32 bp, Artificial Sequence
  Description of Artificial Sequence: Synthetic oligonucleotide
ctggtgaaggaaatcgtcccctataacatggc

SEQ ID NO: 136418 - DNA, 32 bp, Artificial Sequence
  Description of Artificial Sequence: Synthetic oligonucleotide
tggtgaaggaaatcgtcccctataacatggcc

SEQ ID NO: 136419 - DNA, 31 bp, Artificial Sequence
  Description of Artificial Sequence: Synthetic oligonucleotide
ggtgaaggaaatcgtcccctataacatggcc

SEQ ID NO: 136420 - DNA, 31 bp, Artificial Sequence
  Description of Artificial Sequence: Synthetic oligonucleotide
gtgaaggaaatcgtcccctataacatggccc

SEQ ID NO: 136421 - DNA, 32 bp, Artificial Sequence
  Description of Artificial Sequence: Synthetic oligonucleotide
tgaaggaaatcgtcccctataacatggcccac

SEQ ID NO: 136422 - DNA, 31 bp, Artificial Sequence
  Description of Artificial Sequence: Synthetic oligonucleotide
gaaggaaatcgtcccctataacatggcccac

SEQ ID NO: 136423 - DNA, 34 bp, Artificial Sequence
  Description of Artificial Sequence: Synthetic oligonucleotide
aaggaaatcgtcccctataacatggcccacaatg

SEQ ID NO: 136424 - DNA, 33 bp, Artificial Sequence
  Description of Artificial Sequence: Synthetic oligonucleotide
aggaaatcgtcccctataacatggcccacaatg

SEQ ID NO: 136425 - DNA, 32 bp, Artificial Sequence
  Description of Artificial Sequence: Synthetic oligonucleotide
ggaaatcgtcccctataacatggcccacaatg

SEQ ID NO: 136426 - DNA, 32 bp, Artificial Sequence
  Description of Artificial Sequence: Synthetic oligonucleotide
gaaatcgtcccctataacatggcccacaatgc

SEQ ID NO: 136427 - DNA, 33 bp, Artificial Sequence
  Description of Artificial Sequence: Synthetic oligonucleotide
aaatcgtcccctataacatggcccacaatgcag

SEQ ID NO: 136428 - DNA, 32 bp, Artificial Sequence
  Description of Artificial Sequence: Synthetic oligonucleotide
aatcgtcccctataacatggcccacaatgcag

SEQ ID NO: 136429 - DNA, 31 bp, Artificial Sequence
  Description of Artificial Sequence: Synthetic oligonucleotide
atcgtcccctataacatggcccacaatgcag

SEQ ID NO: 136430 - DNA, 30 bp, Artificial Sequence
  Description of Artificial Sequence: Synthetic oligonucleotide
tcgtcccctataacatggcccacaatgcag

SEQ ID NO: 136431 - DNA, 29 bp, Artificial Sequence
  Description of Artificial Sequence: Synthetic oligonucleotide
cgtcccctataacatggcccacaatgcag

SEQ ID NO: 136432 - DNA, 30 bp, Artificial Sequence
  Description of Artificial Sequence: Synthetic oligonucleotide
gtcccctataacatggcccacaatgcagag

SEQ ID NO: 136433 - DNA, 30 bp, Artificial Sequence
  Description of Artificial Sequence: Synthetic oligonucleotide
tcccctataacatggcccacaatgcagagc

SEQ ID NO: 136434 - DNA, 29 bp, Artificial Sequence
  Description of Artificial Sequence: Synthetic oligonucleotide
cccctataacatggcccacaatgcagagc

SEQ ID NO: 136435 - DNA, 31 bp, Artificial Sequence
  Description of Artificial Sequence: Synthetic oligonucleotide
ccctataacatggcccacaatgcagagcatg

SEQ ID NO: 136436 - DNA, 32 bp, Artificial Sequence
  Description of Artificial Sequence: Synthetic oligonucleotide
cctataacatggcccacaatgcagagcatgag

SEQ ID NO: 136437 - DNA, 32 bp, Artificial Sequence
  Description of Artificial Sequence: Synthetic oligonucleotide
ctataacatggcccacaatgcagagcatgagg

SEQ ID NO: 136438 - DNA, 32 bp, Artificial Sequence
  Description of Artificial Sequence: Synthetic oligonucleotide
tataacatggcccacaatgcagagcatgaggc

SEQ ID NO: 136439 - DNA, 31 bp, Artificial Sequence
  Description of Artificial Sequence: Synthetic oligonucleotide
ataacatggcccacaatgcagagcatgaggc

SEQ ID NO: 136440 - DNA, 30 bp, Artificial Sequence
  Description of Artificial Sequence: Synthetic oligonucleotide
taacatggcccacaatgcagagcatgaggc

SEQ ID NO: 136441 - DNA, 29 bp, Artificial Sequence
  Description of Artificial Sequence: Synthetic oligonucleotide
aacatggcccacaatgcagagcatgaggc

SEQ ID NO: 136442 - DNA, 28 bp, Artificial Sequence
  Description of Artificial Sequence: Synthetic oligonucleotide
acatggcccacaatgcagagcatgaggc

SEQ ID NO: 136443 - DNA, 27 bp, Artificial Sequence
  Description of Artificial Sequence: Synthetic oligonucleotide
catggcccacaatgcagagcatgaggc

SEQ ID NO: 136444 - DNA, 29 bp, Artificial Sequence
  Description of Artificial Sequence: Synthetic oligonucleotide
atggcccacaatgcagagcatgaggcttg

SEQ ID NO: 136445 - DNA, 28 bp, Artificial Sequence
  Description of Artificial Sequence: Synthetic oligonucleotide
tggcccacaatgcagagcatgaggcttg

SEQ ID NO: 136446 - DNA, 27 bp, Artificial Sequence
  Description of Artificial Sequence: Synthetic oligonucleotide
ggcccacaatgcagagcatgaggcttg

SEQ ID NO: 136447 - DNA, 27 bp, Artificial Sequence
  Description of Artificial Sequence: Synthetic oligonucleotide
gcccacaatgcagagcatgaggcttgc

SEQ ID NO: 136448 - DNA, 27 bp, Artificial Sequence
  Description of Artificial Sequence: Synthetic oligonucleotide
cccacaatgcagagcatgaggcttgcg

SEQ ID NO: 136449 - DNA, 28 bp, Artificial Sequence
  Description of Artificial Sequence: Synthetic oligonucleotide
ccacaatgcagagcatgaggcttgcgac

SEQ ID NO: 136450 - DNA, 28 bp, Artificial Sequence
  Description of Artificial Sequence: Synthetic oligonucleotide
cacaatgcagagcatgaggcttgcgacc

SEQ ID NO: 136451 - DNA, 29 bp, Artificial Sequence
  Description of Artificial Sequence: Synthetic oligonucleotide
acaatgcagagcatgaggcttgcgacctg

SEQ ID NO: 136452 - DNA, 28 bp, Artificial Sequence
  Description of Artificial Sequence: Synthetic oligonucleotide
caatgcagagcatgaggcttgcgacctg

SEQ ID NO: 136453 - DNA, 28 bp, Artificial Sequence
  Description of Artificial Sequence: Synthetic oligonucleotide
aatgcagagcatgaggcttgcgacctgc

SEQ ID NO: 136454 - DNA, 27 bp, Artificial Sequence
  Description of Artificial Sequence: Synthetic oligonucleotide
atgcagagcatgaggcttgcgacctgc

SEQ ID NO: 136455 - DNA, 27 bp, Artificial Sequence
  Description of Artificial Sequence: Synthetic oligonucleotide
tgcagagcatgaggcttgcgacctgct

SEQ ID NO: 136456 - DNA, 27 bp, Artificial Sequence
  Description of Artificial Sequence: Synthetic oligonucleotide
gcagagcatgaggcttgcgacctgctt

SEQ ID NO: 136457 - DNA, 29 bp, Artificial Sequence
  Description of Artificial Sequence: Synthetic oligonucleotide
cagagcatgaggcttgcgacctgcttatg

SEQ ID NO: 136458 - DNA, 29 bp, Artificial Sequence
  Description of Artificial Sequence: Synthetic oligonucleotide
agagcatgaggcttgcgacctgcttatgg

SEQ ID NO: 136459 - DNA, 28 bp, Artificial Sequence
  Description of Artificial Sequence: Synthetic oligonucleotide
gagcatgaggcttgcgacctgcttatgg

SEQ ID NO: 136460 - DNA, 33 bp, Artificial Sequence
  Description of Artificial Sequence: Synthetic oligonucleotide
agcatgaggcttgcgacctgcttatggaaattg

SEQ ID NO: 136461 - DNA, 32 bp, Artificial Sequence
  Description of Artificial Sequence: Synthetic oligonucleotide
gcatgaggcttgcgacctgcttatggaaattg

SEQ ID NO: 136462 - DNA, 33 bp, Artificial Sequence
  Description of Artificial Sequence: Synthetic oligonucleotide
catgaggcttgcgacctgcttatggaaattgag

SEQ ID NO: 136463 - DNA, 33 bp, Artificial Sequence
  Description of Artificial Sequence: Synthetic oligonucleotide
atgaggcttgcgacctgcttatggaaattgagc

SEQ ID NO: 136464 - DNA, 32 bp, Artificial Sequence
  Description of Artificial Sequence: Synthetic oligonucleotide
tgaggcttgcgacctgcttatggaaattgagc

SEQ ID NO: 136465 - DNA, 31 bp, Artificial Sequence
  Description of Artificial Sequence: Synthetic oligonucleotide
gaggcttgcgacctgcttatggaaattgagc

SEQ ID NO: 136466 - DNA, 32 bp, Artificial Sequence
  Description of Artificial Sequence: Synthetic oligonucleotide
aggcttgcgacctgcttatggaaattgagcag

SEQ ID NO: 136467 - DNA, 31 bp, Artificial Sequence
  Description of Artificial Sequence: Synthetic oligonucleotide
ggcttgcgacctgcttatggaaattgagcag

SEQ ID NO: 136468 - DNA, 31 bp, Artificial Sequence
  Description of Artificial Sequence: Synthetic oligonucleotide
gcttgcgacctgcttatggaaattgagcagg

SEQ ID NO: 136469 - DNA, 32 bp, Artificial Sequence
  Description of Artificial Sequence: Synthetic oligonucleotide
cttgcgacctgcttatggaaattgagcaggtg

SEQ ID NO: 136470 - DNA, 32 bp, Artificial Sequence
  Description of Artificial Sequence: Synthetic oligonucleotide
ttgcgacctgcttatggaaattgagcaggtgg

SEQ ID NO: 136471 - DNA, 31 bp, Artificial Sequence
  Description of Artificial Sequence: Synthetic oligonucleotide
tgcgacctgcttatggaaattgagcaggtgg

SEQ ID NO: 136472 - DNA, 30 bp, Artificial Sequence
  Description of Artificial Sequence: Synthetic oligonucleotide
gcgacctgcttatggaaattgagcaggtgg

SEQ ID NO: 136473 - DNA, 31 bp, Artificial Sequence
  Description of Artificial Sequence: Synthetic oligonucleotide
cgacctgcttatggaaattgagcaggtggac

SEQ ID NO: 136474 - DNA, 33 bp, Artificial Sequence
  Description of Artificial Sequence: Synthetic oligonucleotide
gacctgcttatggaaattgagcaggtggacatg

SEQ ID NO: 136475 - DNA, 33 bp, Artificial Sequence
  Description of Artificial Sequence: Synthetic oligonucleotide
acctgcttatggaaattgagcaggtggacatgc

SEQ ID NO: 136476 - DNA, 32 bp, Artificial Sequence
  Description of Artificial Sequence: Synthetic oligonucleotide
cctgcttatggaaattgagcaggtggacatgc

SEQ ID NO: 136477 - DNA, 33 bp, Artificial Sequence
  Description of Artificial Sequence: Synthetic oligonucleotide
ctgcttatggaaattgagcaggtggacatgctg

SEQ ID NO: 136478 - DNA, 33 bp, Artificial Sequence
  Description of Artificial Sequence: Synthetic oligonucleotide
tgcttatggaaattgagcaggtggacatgctgg

SEQ ID NO: 136479 - DNA, 32 bp, Artificial Sequence
  Description of Artificial Sequence: Synthetic oligonucleotide
gcttatggaaattgagcaggtggacatgctgg

SEQ ID NO: 136480 - DNA, 33 bp, Artificial Sequence
  Description of Artificial Sequence: Synthetic oligonucleotide
cttatggaaattgagcaggtggacatgctggag

SEQ ID NO: 136481 - DNA, 35 bp, Artificial Sequence
  Description of Artificial Sequence: Synthetic oligonucleotide
ttatggaaattgagcaggtggacatgctggagaag

SEQ ID NO: 136482 - DNA, 34 bp, Artificial Sequence
  Description of Artificial Sequence: Synthetic oligonucleotide
tatggaaattgagcaggtggacatgctggagaag

SEQ ID NO: 136483 - DNA, 33 bp, Artificial Sequence
  Description of Artificial Sequence: Synthetic oligonucleotide
atggaaattgagcaggtggacatgctggagaag

SEQ ID NO: 136484 - DNA, 32 bp, Artificial Sequence
  Description of Artificial Sequence: Synthetic oligonucleotide
tggaaattgagcaggtggacatgctggagaag

SEQ ID NO: 136485 - DNA, 31 bp, Artificial Sequence
  Description of Artificial Sequence: Synthetic oligonucleotide
ggaaattgagcaggtggacatgctggagaag

SEQ ID NO: 136486 - DNA, 31 bp, Artificial Sequence
  Description of Artificial Sequence: Synthetic oligonucleotide
gaaattgagcaggtggacatgctggagaagg

SEQ ID NO: 136487 - DNA, 32 bp, Artificial Sequence
  Description of Artificial Sequence: Synthetic oligonucleotide
aaattgagcaggtggacatgctggagaaggac

SEQ ID NO: 136488 - DNA, 31 bp, Artificial Sequence
  Description of Artificial Sequence: Synthetic oligonucleotide
aattgagcaggtggacatgctggagaaggac

SEQ ID NO: 136489 - DNA, 30 bp, Artificial Sequence
  Description of Artificial Sequence: Synthetic oligonucleotide
attgagcaggtggacatgctggagaaggac

SEQ ID NO: 136490 - DNA, 29 bp, Artificial Sequence
  Description of Artificial Sequence: Synthetic oligonucleotide
ttgagcaggtggacatgctggagaaggac

SEQ ID NO: 136491 - DNA, 28 bp, Artificial Sequence
  Description of Artificial Sequence: Synthetic oligonucleotide
tgagcaggtggacatgctggagaaggac

SEQ ID NO: 136492 - DNA, 27 bp, Artificial Sequence
  Description of Artificial Sequence: Synthetic oligonucleotide
gagcaggtggacatgctggagaaggac

SEQ ID NO: 136493 - DNA, 30 bp, Artificial Sequence
  Description of Artificial Sequence: Synthetic oligonucleotide
agcaggtggacatgctggagaaggacattg

SEQ ID NO: 136494 - DNA, 29 bp, Artificial Sequence
  Description of Artificial Sequence: Synthetic oligonucleotide
gcaggtggacatgctggagaaggacattg

SEQ ID NO: 136495 - DNA, 31 bp, Artificial Sequence
  Description of Artificial Sequence: Synthetic oligonucleotide
caggtggacatgctggagaaggacattgatg

SEQ ID NO: 136496 - DNA, 36 bp, Artificial Sequence
  Description of Artificial Sequence: Synthetic oligonucleotide
aggtggacatgctggagaaggacattgatgaaaatg

SEQ ID NO: 136497 - DNA, 35 bp, Artificial Sequence
  Description of Artificial Sequence: Synthetic oligonucleotide
ggtggacatgctggagaaggacattgatgaaaatg

SEQ ID NO: 136498 - DNA, 35 bp, Artificial Sequence
  Description of Artificial Sequence: Synthetic oligonucleotide
gtggacatgctggagaaggacattgatgaaaatgc

SEQ ID NO: 136499 - DNA, 39 bp, Artificial Sequence
  Description of Artificial Sequence: Synthetic oligonucleotide
tggacatgctggagaaggacattgatgaaaatgcatatg

SEQ ID NO: 136500 - DNA, 38 bp, Artificial Sequence
  Description of Artificial Sequence: Synthetic oligonucleotide
ggacatgctggagaaggacattgatgaaaatgcatatg

SEQ ID NO: 136501 - DNA, 38 bp, Artificial Sequence
  Description of Artificial Sequence: Synthetic oligonucleotide
gacatgctggagaaggacattgatgaaaatgcatatgc

SEQ ID NO: 136502 - DNA, 41 bp, Artificial Sequence
  Description of Artificial Sequence: Synthetic oligonucleotide
acatgctggagaaggacattgatgaaaatgcatatgcaaag

SEQ ID NO: 136503 - DNA, 40 bp, Artificial Sequence
  Description of Artificial Sequence: Synthetic oligonucleotide
catgctggagaaggacattgatgaaaatgcatatgcaaag

SEQ ID NO: 136504 - DNA, 40 bp, Artificial Sequence
  Description of Artificial Sequence: Synthetic oligonucleotide
atgctggagaaggacattgatgaaaatgcatatgcaaagg

SEQ ID NO: 136505 - DNA, 39 bp, Artificial Sequence
  Description of Artificial Sequence: Synthetic oligonucleotide
tgctggagaaggacattgatgaaaatgcatatgcaaagg

SEQ ID NO: 136506 - DNA, 38 bp, Artificial Sequence
  Description of Artificial Sequence: Synthetic oligonucleotide
gctggagaaggacattgatgaaaatgcatatgcaaagg

SEQ ID NO: 136507 - DNA, 39 bp, Artificial Sequence
  Description of Artificial Sequence: Synthetic oligonucleotide
ctggagaaggacattgatgaaaatgcatatgcaaaggtc

SEQ ID NO: 136508 - DNA, 40 bp, Artificial Sequence
  Description of Artificial Sequence: Synthetic oligonucleotide
tggagaaggacattgatgaaaatgcatatgcaaaggtctg

SEQ ID NO: 136509 - DNA, 39 bp, Artificial Sequence
  Description of Artificial Sequence: Synthetic oligonucleotide
ggagaaggacattgatgaaaatgcatatgcaaaggtctg

SEQ ID NO: 136510 - DNA, 39 bp, Artificial Sequence
  Description of Artificial Sequence: Synthetic oligonucleotide
gagaaggacattgatgaaaatgcatatgcaaaggtctgc

SEQ ID NO: 136511 - DNA, 39 bp, Artificial Sequence
  Description of Artificial Sequence: Synthetic oligonucleotide
agaaggacattgatgaaaatgcatatgcaaaggtctgcc

SEQ ID NO: 136512 - DNA, 38 bp, Artificial Sequence
  Description of Artificial Sequence: Synthetic oligonucleotide
gaaggacattgatgaaaatgcatatgcaaaggtctgcc

SEQ ID NO: 136513 - DNA, 43 bp, Artificial Sequence
  Description of Artificial Sequence: Synthetic oligonucleotide
aaggacattgatgaaaatgcatatgcaaaggtctgcctttatc

SEQ ID NO: 136514 - DNA, 42 bp, Artificial Sequence
  Description of Artificial Sequence: Synthetic oligonucleotide
aggacattgatgaaaatgcatatgcaaaggtctgcctttatc

SEQ ID NO: 136515 - DNA, 41 bp, Artificial Sequence
  Description of Artificial Sequence: Synthetic oligonucleotide
ggacattgatgaaaatgcatatgcaaaggtctgcctttatc

SEQ ID NO: 136516 - DNA, 42 bp, Artificial Sequence
  Description of Artificial Sequence: Synthetic oligonucleotide
gacattgatgaaaatgcatatgcaaaggtctgcctttatctc

SEQ ID NO: 136517 - DNA, 43 bp, Artificial Sequence
  Description of Artificial Sequence: Synthetic oligonucleotide
acattgatgaaaatgcatatgcaaaggtctgcctttatctcac

SEQ ID NO: 136518 - DNA, 42 bp, Artificial Sequence
  Description of Artificial Sequence: Synthetic oligonucleotide
cattgatgaaaatgcatatgcaaaggtctgcctttatctcac

SEQ ID NO: 136519 - DNA, 42 bp, Artificial Sequence
  Description of Artificial Sequence: Synthetic oligonucleotide
attgatgaaaatgcatatgcaaaggtctgcctttatctcacc

SEQ ID NO: 136520 - DNA, 41 bp, Artificial Sequence
  Description of Artificial Sequence: Synthetic oligonucleotide
ttgatgaaaatgcatatgcaaaggtctgcctttatctcacc

SEQ ID NO: 136521 - DNA, 40 bp, Artificial Sequence
  Description of Artificial Sequence: Synthetic oligonucleotide
tgatgaaaatgcatatgcaaaggtctgcctttatctcacc

SEQ ID NO: 136522 - DNA, 39 bp, Artificial Sequence
  Description of Artificial Sequence: Synthetic oligonucleotide
gatgaaaatgcatatgcaaaggtctgcctttatctcacc

SEQ ID NO: 136523 - DNA, 40 bp, Artificial Sequence
  Description of Artificial Sequence: Synthetic oligonucleotide
atgaaaatgcatatgcaaaggtctgcctttatctcaccag

SEQ ID NO: 136524 - DNA, 39 bp, Artificial Sequence
  Description of Artificial Sequence: Synthetic oligonucleotide
tgaaaatgcatatgcaaaggtctgcctttatctcaccag

SEQ ID NO: 136525 - DNA, 38 bp, Artificial Sequence
  Description of Artificial Sequence: Synthetic oligonucleotide
gaaaatgcatatgcaaaggtctgcctttatctcaccag

SEQ ID NO: 136526 - DNA, 40 bp, Artificial Sequence
  Description of Artificial Sequence: Synthetic oligonucleotide
aaaatgcatatgcaaaggtctgcctttatctcaccagttg

SEQ ID NO: 136527 - DNA, 39 bp, Artificial Sequence
  Description of Artificial Sequence: Synthetic oligonucleotide
aaatgcatatgcaaaggtctgcctttatctcaccagttg

SEQ ID NO: 136528 - DNA, 38 bp, Artificial Sequence
  Description of Artificial Sequence: Synthetic oligonucleotide
aatgcatatgcaaaggtctgcctttatctcaccagttg

SEQ ID NO: 136529 - DNA, 37 bp, Artificial Sequence
  Description of Artificial Sequence: Synthetic oligonucleotide
atgcatatgcaaaggtctgcctttatctcaccagttg

SEQ ID NO: 136530 - DNA, 36 bp, Artificial Sequence
  Description of Artificial Sequence: Synthetic oligonucleotide
tgcatatgcaaaggtctgcctttatctcaccagttg

SEQ ID NO: 136531 - DNA, 35 bp, Artificial Sequence
  Description of Artificial Sequence: Synthetic oligonucleotide
gcatatgcaaaggtctgcctttatctcaccagttg

SEQ ID NO: 136532 - DNA, 36 bp, Artificial Sequence
  Description of Artificial Sequence: Synthetic oligonucleotide
catatgcaaaggtctgcctttatctcaccagttgtg

SEQ ID NO: 136533 - DNA, 37 bp, Artificial Sequence
  Description of Artificial Sequence: Synthetic oligonucleotide
atatgcaaaggtctgcctttatctcaccagttgtgtg

SEQ ID NO: 136534 - DNA, 36 bp, Artificial Sequence
  Description of Artificial Sequence: Synthetic oligonucleotide
tatgcaaaggtctgcctttatctcaccagttgtgtg

SEQ ID NO: 136535 - DNA, 35 bp, Artificial Sequence
  Description of Artificial Sequence: Synthetic oligonucleotide
atgcaaaggtctgcctttatctcaccagttgtgtg

SEQ ID NO: 136536 - DNA, 34 bp, Artificial Sequence
  Description of Artificial Sequence: Synthetic oligonucleotide
tgcaaaggtctgcctttatctcaccagttgtgtg

SEQ ID NO: 136537 - DNA, 33 bp, Artificial Sequence
  Description of Artificial Sequence: Synthetic oligonucleotide
gcaaaggtctgcctttatctcaccagttgtgtg

SEQ ID NO: 136538 - DNA, 38 bp, Artificial Sequence
  Description of Artificial Sequence: Synthetic oligonucleotide
caaaggtctgcctttatctcaccagttgtgtgaattac

SEQ ID NO: 136539 - DNA, 38 bp, Artificial Sequence
  Description of Artificial Sequence: Synthetic oligonucleotide
aaaggtctgcctttatctcaccagttgtgtgaattacg

SEQ ID NO: 136540 - DNA, 37 bp, Artificial Sequence
  Description of Artificial Sequence: Synthetic oligonucleotide
aaggtctgcctttatctcaccagttgtgtgaattacg

SEQ ID NO: 136541 - DNA, 36 bp, Artificial Sequence
  Description of Artificial Sequence: Synthetic oligonucleotide
aggtctgcctttatctcaccagttgtgtgaattacg

SEQ ID NO: 136542 - DNA, 35 bp, Artificial Sequence
  Description of Artificial Sequence: Synthetic oligonucleotide
ggtctgcctttatctcaccagttgtgtgaattacg

SEQ ID NO: 136543 - DNA, 36 bp, Artificial Sequence
  Description of Artificial Sequence: Synthetic oligonucleotide
gtctgcctttatctcaccagttgtgtgaattacgtg

SEQ ID NO: 136544 - DNA, 36 bp, Artificial Sequence
  Description of Artificial Sequence: Synthetic oligonucleotide
tctgcctttatctcaccagttgtgtgaattacgtgc

SEQ ID NO: 136545 - DNA, 35 bp, Artificial Sequence
  Description of Artificial Sequence: Synthetic oligonucleotide
ctgcctttatctcaccagttgtgtgaattacgtgc

SEQ ID NO: 136546 - DNA, 35 bp, Artificial Sequence
  Description of Artificial Sequence: Synthetic oligonucleotide
tgcctttatctcaccagttgtgtgaattacgtgcc

SEQ ID NO: 136547 - DNA, 34 bp, Artificial Sequence
  Description of Artificial Sequence: Synthetic oligonucleotide
gcctttatctcaccagttgtgtgaattacgtgcc

SEQ ID NO: 136548 - DNA, 35 bp, Artificial Sequence
  Description of Artificial Sequence: Synthetic oligonucleotide
cctttatctcaccagttgtgtgaattacgtgcctg

SEQ ID NO: 136549 - DNA, 36 bp, Artificial Sequence
  Description of Artificial Sequence: Synthetic oligonucleotide
ctttatctcaccagttgtgtgaattacgtgcctgag

SEQ ID NO: 136550 - DNA, 36 bp, Artificial Sequence
  Description of Artificial Sequence: Synthetic oligonucleotide
tttatctcaccagttgtgtgaattacgtgcctgagc

SEQ ID NO: 136551 - DNA, 35 bp, Artificial Sequence
  Description of Artificial Sequence: Synthetic oligonucleotide
ttatctcaccagttgtgtgaattacgtgcctgagc

SEQ ID NO: 136552 - DNA, 34 bp, Artificial Sequence
  Description of Artificial Sequence: Synthetic oligonucleotide
tatctcaccagttgtgtgaattacgtgcctgagc

SEQ ID NO: 136553 - DNA, 33 bp, Artificial Sequence
  Description of Artificial Sequence: Synthetic oligonucleotide
atctcaccagttgtgtgaattacgtgcctgagc

SEQ ID NO: 136554 - DNA, 32 bp, Artificial Sequence
  Description of Artificial Sequence: Synthetic oligonucleotide
tctcaccagttgtgtgaattacgtgcctgagc

SEQ ID NO: 136555 - DNA, 31 bp, Artificial Sequence
  Description of Artificial Sequence: Synthetic oligonucleotide
ctcaccagttgtgtgaattacgtgcctgagc

SEQ ID NO: 136556 - DNA, 31 bp, Artificial Sequence
  Description of Artificial Sequence: Synthetic oligonucleotide
tcaccagttgtgtgaattacgtgcctgagcc

SEQ ID NO: 136557 - DNA, 30 bp, Artificial Sequence
  Description of Artificial Sequence: Synthetic oligonucleotide
caccagttgtgtgaattacgtgcctgagcc

SEQ ID NO: 136558 - DNA, 31 bp, Artificial Sequence
  Description of Artificial Sequence: Synthetic oligonucleotide
accagttgtgtgaattacgtgcctgagcctg

SEQ ID NO: 136559 - DNA, 30 bp, Artificial Sequence
  Description of Artificial Sequence: Synthetic oligonucleotide
ccagttgtgtgaattacgtgcctgagcctg

SEQ ID NO: 136560 - DNA, 31 bp, Artificial Sequence
  Description of Artificial Sequence: Synthetic oligonucleotide
cagttgtgtgaattacgtgcctgagcctgag

SEQ ID NO: 136561 - DNA, 33 bp, Artificial Sequence
  Description of Artificial Sequence: Synthetic oligonucleotide
agttgtgtgaattacgtgcctgagcctgagaac

SEQ ID NO: 136562 - DNA, 32 bp, Artificial Sequence
  Description of Artificial Sequence: Synthetic oligonucleotide
gttgtgtgaattacgtgcctgagcctgagaac

SEQ ID NO: 136563 - DNA, 33 bp, Artificial Sequence
  Description of Artificial Sequence: Synthetic oligonucleotide
ttgtgtgaattacgtgcctgagcctgagaactc

SEQ ID NO: 136564 - DNA, 32 bp, Artificial Sequence
  Description of Artificial Sequence: Synthetic oligonucleotide
tgtgtgaattacgtgcctgagcctgagaactc

SEQ ID NO: 136565 - DNA, 31 bp, Artificial Sequence
  Description of Artificial Sequence: Synthetic oligonucleotide
gtgtgaattacgtgcctgagcctgagaactc

SEQ ID NO: 136566 - DNA, 32 bp, Artificial Sequence
  Description of Artificial Sequence: Synthetic oligonucleotide
tgtgaattacgtgcctgagcctgagaactcag

SEQ ID NO: 136567 - DNA, 31 bp, Artificial Sequence
  Description of Artificial Sequence: Synthetic oligonucleotide
gtgaattacgtgcctgagcctgagaactcag

SEQ ID NO: 136568 - DNA, 31 bp, Artificial Sequence
  Description of Artificial Sequence: Synthetic oligonucleotide
tgaattacgtgcctgagcctgagaactcagc

SEQ ID NO: 136569 - DNA, 30 bp, Artificial Sequence
  Description of Artificial Sequence: Synthetic oligonucleotide
gaattacgtgcctgagcctgagaactcagc

SEQ ID NO: 136570 - DNA, 30 bp, Artificial Sequence
  Description of Artificial Sequence: Synthetic oligonucleotide
aattacgtgcctgagcctgagaactcagcc

SEQ ID NO: 136571 - DNA, 29 bp, Artificial Sequence
  Description of Artificial Sequence: Synthetic oligonucleotide
attacgtgcctgagcctgagaactcagcc

SEQ ID NO: 136572 - DNA, 28 bp, Artificial Sequence
  Description of Artificial Sequence: Synthetic oligonucleotide
ttacgtgcctgagcctgagaactcagcc

SEQ ID NO: 136573 - DNA, 27 bp, Artificial Sequence
  Description of Artificial Sequence: Synthetic oligonucleotide
tacgtgcctgagcctgagaactcagcc

SEQ ID NO: 136574 - DNA, 26 bp, Artificial Sequence
  Description of Artificial Sequence: Synthetic oligonucleotide
acgtgcctgagcctgagaactcagcc

SEQ ID NO: 136575 - DNA, 25 bp, Artificial Sequence
  Description of Artificial Sequence: Synthetic oligonucleotide
cgtgcctgagcctgagaactcagcc

SEQ ID NO: 136576 - DNA, 27 bp, Artificial Sequence
  Description of Artificial Sequence: Synthetic oligonucleotide
gtgcctgagcctgagaactcagcccta

SEQ ID NO: 136577 - DNA, 27 bp, Artificial Sequence
  Description of Artificial Sequence: Synthetic oligonucleotide
tgcctgagcctgagaactcagccctac

SEQ ID NO: 136578 - DNA, 27 bp, Artificial Sequence
  Description of Artificial Sequence: Synthetic oligonucleotide
gcctgagcctgagaactcagccctact

SEQ ID NO: 136579 - DNA, 27 bp, Artificial Sequence
  Description of Artificial Sequence: Synthetic oligonucleotide
cctgagcctgagaactcagccctactg

SEQ ID NO: 136580 - DNA, 27 bp, Artificial Sequence
  Description of Artificial Sequence: Synthetic oligonucleotide
ctgagcctgagaactcagccctactgc

SEQ ID NO: 136581 - DNA, 27 bp, Artificial Sequence
  Description of Artificial Sequence: Synthetic oligonucleotide
tgagcctgagaactcagccctactgcg

SEQ ID NO: 136582 - DNA, 27 bp, Artificial Sequence
  Description of Artificial Sequence: Synthetic oligonucleotide
gagcctgagaactcagccctactgcgt

SEQ ID NO: 136583 - DNA, 28 bp, Artificial Sequence
  Description of Artificial Sequence: Synthetic oligonucleotide
agcctgagaactcagccctactgcgttg

SEQ ID NO: 136584 - DNA, 27 bp, Artificial Sequence
  Description of Artificial Sequence: Synthetic oligonucleotide
gcctgagaactcagccctactgcgttg

SEQ ID NO: 136585 - DNA, 28 bp, Artificial Sequence
  Description of Artificial Sequence: Synthetic oligonucleotide
cctgagaactcagccctactgcgttgtg

SEQ ID NO: 136586 - DNA, 28 bp, Artificial Sequence
  Description of Artificial Sequence: Synthetic oligonucleotide
ctgagaactcagccctactgcgttgtgc

SEQ ID NO: 136587 - DNA, 28 bp, Artificial Sequence
  Description of Artificial Sequence: Synthetic oligonucleotide
tgagaactcagccctactgcgttgtgcc

SEQ ID NO: 136588 - DNA, 27 bp, Artificial Sequence
  Description of Artificial Sequence: Synthetic oligonucleotide
gagaactcagccctactgcgttgtgcc

SEQ ID NO: 136589 - DNA, 27 bp, Artificial Sequence
  Description of Artificial Sequence: Synthetic oligonucleotide
agaactcagccctactgcgttgtgccc

SEQ ID NO: 136590 - DNA, 27 bp, Artificial Sequence
  Description of Artificial Sequence: Synthetic oligonucleotide
gaactcagccctactgcgttgtgccct

SEQ ID NO: 136591 - DNA, 27 bp, Artificial Sequence
  Description of Artificial Sequence: Synthetic oligonucleotide
aactcagccctactgcgttgtgccctg

SEQ ID NO: 136592 - DNA, 26 bp, Artificial Sequence
  Description of Artificial Sequence: Synthetic oligonucleotide
actcagccctactgcgttgtgccctg

SEQ ID NO: 136593 - DNA, 25 bp, Artificial Sequence
  Description of Artificial Sequence: Synthetic oligonucleotide
ctcagccctactgcgttgtgccctg

SEQ ID NO: 136594 - DNA, 25 bp, Artificial Sequence
  Description of Artificial Sequence: Synthetic oligonucleotide
tcagccctactgcgttgtgccctgg

SEQ ID NO: 136595 - DNA, 24 bp, Artificial Sequence
  Description of Artificial Sequence: Synthetic oligonucleotide
cagccctactgcgttgtgccctgg

SEQ ID NO: 136596 - DNA, 25 bp, Artificial Sequence
  Description of Artificial Sequence: Synthetic oligonucleotide
agccctactgcgttgtgccctgggt

SEQ ID NO: 136597 - DNA, 24 bp, Artificial Sequence
  Description of Artificial Sequence: Synthetic oligonucleotide
gccctactgcgttgtgccctgggt

SEQ ID NO: 136598 - DNA, 25 bp, Artificial Sequence
  Description of Artificial Sequence: Synthetic oligonucleotide
ccctactgcgttgtgccctgggtgt

SEQ ID NO: 136599 - DNA, 27 bp, Artificial Sequence
  Description of Artificial Sequence: Synthetic oligonucleotide
cctactgcgttgtgccctgggtgtgtt

SEQ ID NO: 136600 - DNA, 27 bp, Artificial Sequence
  Description of Artificial Sequence: Synthetic oligonucleotide
ctactgcgttgtgccctgggtgtgttc

SEQ ID NO: 136601 - DNA, 27 bp, Artificial Sequence
  Description of Artificial Sequence: Synthetic oligonucleotide
tactgcgttgtgccctgggtgtgttcc

SEQ ID NO: 136602 - DNA, 26 bp, Artificial Sequence
  Description of Artificial Sequence: Synthetic oligonucleotide
actgcgttgtgccctgggtgtgttcc

SEQ ID NO: 136603 - DNA, 25 bp, Artificial Sequence
  Description of Artificial Sequence: Synthetic oligonucleotide
ctgcgttgtgccctgggtgtgttcc

SEQ ID NO: 136604 - DNA, 27 bp, Artificial Sequence
  Description of Artificial Sequence: Synthetic oligonucleotide
tgcgttgtgccctgggtgtgttccgaa

SEQ ID NO: 136605 - DNA, 27 bp, Artificial Sequence
  Description of Artificial Sequence: Synthetic oligonucleotide
gcgttgtgccctgggtgtgttccgaaa

SEQ ID NO: 136606 - DNA, 27 bp, Artificial Sequence
  Description of Artificial Sequence: Synthetic oligonucleotide
cgttgtgccctgggtgtgttccgaaag

SEQ ID NO: 136607 - DNA, 31 bp, Artificial Sequence
  Description of Artificial Sequence: Synthetic oligonucleotide
gttgtgccctgggtgtgttccgaaagtttag

SEQ ID NO: 136608 - DNA, 31 bp, Artificial Sequence
  Description of Artificial Sequence: Synthetic oligonucleotide
ttgtgccctgggtgtgttccgaaagtttagc

SEQ ID NO: 136609 - DNA, 30 bp, Artificial Sequence
  Description of Artificial Sequence: Synthetic oligonucleotide
tgtgccctgggtgtgttccgaaagtttagc

SEQ ID NO: 136610 - DNA, 29 bp, Artificial Sequence
  Description of Artificial Sequence: Synthetic oligonucleotide
gtgccctgggtgtgttccgaaagtttagc

SEQ ID NO: 136611 - DNA, 29 bp, Artificial Sequence
  Description of Artificial Sequence: Synthetic oligonucleotide
tgccctgggtgtgttccgaaagtttagcc

SEQ ID NO: 136612 - DNA, 28 bp, Artificial Sequence
  Description of Artificial Sequence: Synthetic oligonucleotide
gccctgggtgtgttccgaaagtttagcc

SEQ ID NO: 136613 - DNA, 28 bp, Artificial Sequence
  Description of Artificial Sequence: Synthetic oligonucleotide
ccctgggtgtgttccgaaagtttagccg

SEQ ID NO: 136614 - DNA, 28 bp, Artificial Sequence
  Description of Artificial Sequence: Synthetic oligonucleotide
cctgggtgtgttccgaaagtttagccgc

SEQ ID NO: 136615 - DNA, 30 bp, Artificial Sequence
  Description of Artificial Sequence: Synthetic oligonucleotide
ctgggtgtgttccgaaagtttagccgcttc

SEQ ID NO: 136616 - DNA, 30 bp, Artificial Sequence
  Description of Artificial Sequence: Synthetic oligonucleotide
tgggtgtgttccgaaagtttagccgcttcc

SEQ ID NO: 136617 - DNA, 29 bp, Artificial Sequence
  Description of Artificial Sequence: Synthetic oligonucleotide
gggtgtgttccgaaagtttagccgcttcc

SEQ ID NO: 136618 - DNA, 29 bp, Artificial Sequence
  Description of Artificial Sequence: Synthetic oligonucleotide
ggtgtgttccgaaagtttagccgcttccc

SEQ ID NO: 136619 - DNA, 30 bp, Artificial Sequence
  Description of Artificial Sequence: Synthetic oligonucleotide
gtgtgttccgaaagtttagccgcttccctg

SEQ ID NO: 136620 - DNA, 32 bp, Artificial Sequence
  Description of Artificial Sequence: Synthetic oligonucleotide
tgtgttccgaaagtttagccgcttccctgaag

SEQ ID NO: 136621 - DNA, 31 bp, Artificial Sequence
  Description of Artificial Sequence: Synthetic oligonucleotide
gtgttccgaaagtttagccgcttccctgaag

SEQ ID NO: 136622 - DNA, 31 bp, Artificial Sequence
  Description of Artificial Sequence: Synthetic oligonucleotide
tgttccgaaagtttagccgcttccctgaagc

SEQ ID NO: 136623 - DNA, 30 bp, Artificial Sequence
  Description of Artificial Sequence: Synthetic oligonucleotide
gttccgaaagtttagccgcttccctgaagc

SEQ ID NO: 136624 - DNA, 31 bp, Artificial Sequence
  Description of Artificial Sequence: Synthetic oligonucleotide
ttccgaaagtttagccgcttccctgaagctc

SEQ ID NO: 136625 - DNA, 30 bp, Artificial Sequence
  Description of Artificial Sequence: Synthetic oligonucleotide
tccgaaagtttagccgcttccctgaagctc

SEQ ID NO: 136626 - DNA, 29 bp, Artificial Sequence
  Description of Artificial Sequence: Synthetic oligonucleotide
ccgaaagtttagccgcttccctgaagctc

SEQ ID NO: 136627 - DNA, 30 bp, Artificial Sequence
  Description of Artificial Sequence: Synthetic oligonucleotide
cgaaagtttagccgcttccctgaagctctg

SEQ ID NO: 136628 - DNA, 31 bp, Artificial Sequence
  Description of Artificial Sequence: Synthetic oligonucleotide
gaaagtttagccgcttccctgaagctctgag

SEQ ID NO: 136629 - DNA, 34 bp, Artificial Sequence
  Description of Artificial Sequence: Synthetic oligonucleotide
aaagtttagccgcttccctgaagctctgagattg

SEQ ID NO: 136630 - DNA, 33 bp, Artificial Sequence
  Description of Artificial Sequence: Synthetic oligonucleotide
aagtttagccgcttccctgaagctctgagattg

SEQ ID NO: 136631 - DNA, 32 bp, Artificial Sequence
  Description of Artificial Sequence: Synthetic oligonucleotide
agtttagccgcttccctgaagctctgagattg

SEQ ID NO: 136632 - DNA, 31 bp, Artificial Sequence
  Description of Artificial Sequence: Synthetic oligonucleotide
gtttagccgcttccctgaagctctgagattg

SEQ ID NO: 136633 - DNA, 31 bp, Artificial Sequence
  Description of Artificial Sequence: Synthetic oligonucleotide
tttagccgcttccctgaagctctgagattgg

SEQ ID NO: 136634 - DNA, 30 bp, Artificial Sequence
  Description of Artificial Sequence: Synthetic oligonucleotide
ttagccgcttccctgaagctctgagattgg

SEQ ID NO: 136635 - DNA, 29 bp, Artificial Sequence
  Description of Artificial Sequence: Synthetic oligonucleotide
tagccgcttccctgaagctctgagattgg

SEQ ID NO: 136636 - DNA, 28 bp, Artificial Sequence
  Description of Artificial Sequence: Synthetic oligonucleotide
agccgcttccctgaagctctgagattgg

SEQ ID NO: 136637 - DNA, 27 bp, Artificial Sequence
  Description of Artificial Sequence: Synthetic oligonucleotide
gccgcttccctgaagctctgagattgg

SEQ ID NO: 136638 - DNA, 27 bp, Artificial Sequence
  Description of Artificial Sequence: Synthetic oligonucleotide
ccgcttccctgaagctctgagattggc

SEQ ID NO: 136639 - DNA, 30 bp, Artificial Sequence
  Description of Artificial Sequence: Synthetic oligonucleotide
cgcttccctgaagctctgagattggcattg

SEQ ID NO: 136640 - DNA, 32 bp, Artificial Sequence
  Description of Artificial Sequence: Synthetic oligonucleotide
gcttccctgaagctctgagattggcattgatg

SEQ ID NO: 136641 - DNA, 32 bp, Artificial Sequence
  Description of Artificial Sequence: Synthetic oligonucleotide
cttccctgaagctctgagattggcattgatgc

SEQ ID NO: 136642 - DNA, 33 bp, Artificial Sequence
  Description of Artificial Sequence: Synthetic oligonucleotide
ttccctgaagctctgagattggcattgatgctc

SEQ ID NO: 136643 - DNA, 32 bp, Artificial Sequence
  Description of Artificial Sequence: Synthetic oligonucleotide
tccctgaagctctgagattggcattgatgctc

SEQ ID NO: 136644 - DNA, 31 bp, Artificial Sequence
  Description of Artificial Sequence: Synthetic oligonucleotide
ccctgaagctctgagattggcattgatgctc

SEQ ID NO: 136645 - DNA, 34 bp, Artificial Sequence
  Description of Artificial Sequence: Synthetic oligonucleotide
cctgaagctctgagattggcattgatgctcaatg

SEQ ID NO: 136646 - DNA, 35 bp, Artificial Sequence
  Description of Artificial Sequence: Synthetic oligonucleotide
ctgaagctctgagattggcattgatgctcaatgac

SEQ ID NO: 136647 - DNA, 37 bp, Artificial Sequence
  Description of Artificial Sequence: Synthetic oligonucleotide
tgaagctctgagattggcattgatgctcaatgacatg

SEQ ID NO: 136648 - DNA, 36 bp, Artificial Sequence
  Description of Artificial Sequence: Synthetic oligonucleotide
gaagctctgagattggcattgatgctcaatgacatg

SEQ ID NO: 136649 - DNA, 36 bp, Artificial Sequence
  Description of Artificial Sequence: Synthetic oligonucleotide
aagctctgagattggcattgatgctcaatgacatgg

SEQ ID NO: 136650 - DNA, 35 bp, Artificial Sequence
  Description of Artificial Sequence: Synthetic oligonucleotide
agctctgagattggcattgatgctcaatgacatgg

SEQ ID NO: 136651 - DNA, 34 bp, Artificial Sequence
  Description of Artificial Sequence: Synthetic oligonucleotide
gctctgagattggcattgatgctcaatgacatgg

SEQ ID NO: 136652 - DNA, 35 bp, Artificial Sequence
  Description of Artificial Sequence: Synthetic oligonucleotide
ctctgagattggcattgatgctcaatgacatggag

SEQ ID NO: 136653 - DNA, 37 bp, Artificial Sequence
  Description of Artificial Sequence: Synthetic oligonucleotide
tctgagattggcattgatgctcaatgacatggagttg

SEQ ID NO: 136654 - DNA, 36 bp, Artificial Sequence
  Description of Artificial Sequence: Synthetic oligonucleotide
ctgagattggcattgatgctcaatgacatggagttg

SEQ ID NO: 136655 - DNA, 36 bp, Artificial Sequence
  Description of Artificial Sequence: Synthetic oligonucleotide
tgagattggcattgatgctcaatgacatggagttgg

SEQ ID NO: 136656 - DNA, 35 bp, Artificial Sequence
  Description of Artificial Sequence: Synthetic oligonucleotide
gagattggcattgatgctcaatgacatggagttgg

SEQ ID NO: 136657 - DNA, 37 bp, Artificial Sequence
  Description of Artificial Sequence: Synthetic oligonucleotide
agattggcattgatgctcaatgacatggagttggtag

SEQ ID NO: 136658 - DNA, 36 bp, Artificial Sequence
  Description of Artificial Sequence: Synthetic oligonucleotide
gattggcattgatgctcaatgacatggagttggtag

SEQ ID NO: 136659 - DNA, 38 bp, Artificial Sequence
  Description of Artificial Sequence: Synthetic oligonucleotide
attggcattgatgctcaatgacatggagttggtagaag

SEQ ID NO: 136660 - DNA, 37 bp, Artificial Sequence
  Description of Artificial Sequence: Synthetic oligonucleotide
ttggcattgatgctcaatgacatggagttggtagaag

SEQ ID NO: 136661 - DNA, 36 bp, Artificial Sequence
  Description of Artificial Sequence: Synthetic oligonucleotide
tggcattgatgctcaatgacatggagttggtagaag

SEQ ID NO: 136662 - DNA, 35 bp, Artificial Sequence
  Description of Artificial Sequence: Synthetic oligonucleotide
ggcattgatgctcaatgacatggagttggtagaag

SEQ ID NO: 136663 - DNA, 36 bp, Artificial Sequence
  Description of Artificial Sequence: Synthetic oligonucleotide
gcattgatgctcaatgacatggagttggtagaagac

SEQ ID NO: 136664 - DNA, 38 bp, Artificial Sequence
  Description of Artificial Sequence: Synthetic oligonucleotide
cattgatgctcaatgacatggagttggtagaagacatc

SEQ ID NO: 136665 - DNA, 40 bp, Artificial Sequence
  Description of Artificial Sequence: Synthetic oligonucleotide
attgatgctcaatgacatggagttggtagaagacatcttc

SEQ ID NO: 136666 - DNA, 39 bp, Artificial Sequence
  Description of Artificial Sequence: Synthetic oligonucleotide
ttgatgctcaatgacatggagttggtagaagacatcttc

SEQ ID NO: 136667 - DNA, 38 bp, Artificial Sequence
  Description of Artificial Sequence: Synthetic oligonucleotide
tgatgctcaatgacatggagttggtagaagacatcttc

SEQ ID NO: 136668 - DNA, 37 bp, Artificial Sequence
  Description of Artificial Sequence: Synthetic oligonucleotide
gatgctcaatgacatggagttggtagaagacatcttc

SEQ ID NO: 136669 - DNA, 38 bp, Artificial Sequence
  Description of Artificial Sequence: Synthetic oligonucleotide
atgctcaatgacatggagttggtagaagacatcttcac

SEQ ID NO: 136670 - DNA, 37 bp, Artificial Sequence
  Description of Artificial Sequence: Synthetic oligonucleotide
tgctcaatgacatggagttggtagaagacatcttcac

SEQ ID NO: 136671 - DNA, 36 bp, Artificial Sequence
  Description of Artificial Sequence: Synthetic oligonucleotide
gctcaatgacatggagttggtagaagacatcttcac

SEQ ID NO: 136672 - DNA, 36 bp, Artificial Sequence
  Description of Artificial Sequence: Synthetic oligonucleotide
ctcaatgacatggagttggtagaagacatcttcacc

SEQ ID NO: 136673 - DNA, 37 bp, Artificial Sequence
  Description of Artificial Sequence: Synthetic oligonucleotide
tcaatgacatggagttggtagaagacatcttcacctc

SEQ ID NO: 136674 - DNA, 36 bp, Artificial Sequence
  Description of Artificial Sequence: Synthetic oligonucleotide
caatgacatggagttggtagaagacatcttcacctc

SEQ ID NO: 136675 - DNA, 36 bp, Artificial Sequence
  Description of Artificial Sequence: Synthetic oligonucleotide
aatgacatggagttggtagaagacatcttcacctcc

SEQ ID NO: 136676 - DNA, 35 bp, Artificial Sequence
  Description of Artificial Sequence: Synthetic oligonucleotide
atgacatggagttggtagaagacatcttcacctcc

SEQ ID NO: 136677 - DNA, 34 bp, Artificial Sequence
  Description of Artificial Sequence: Synthetic oligonucleotide
tgacatggagttggtagaagacatcttcacctcc

SEQ ID NO: 136678 - DNA, 33 bp, Artificial Sequence
  Description of Artificial Sequence: Synthetic oligonucleotide
gacatggagttggtagaagacatcttcacctcc

SEQ ID NO: 136679 - DNA, 34 bp, Artificial Sequence
  Description of Artificial Sequence: Synthetic oligonucleotide
acatggagttggtagaagacatcttcacctcctg

SEQ ID NO: 136680 - DNA, 33 bp, Artificial Sequence
  Description of Artificial Sequence: Synthetic oligonucleotide
catggagttggtagaagacatcttcacctcctg

SEQ ID NO: 136681 - DNA, 33 bp, Artificial Sequence
  Description of Artificial Sequence: Synthetic oligonucleotide
atggagttggtagaagacatcttcacctcctgc

SEQ ID NO: 136682 - DNA, 32 bp, Artificial Sequence
  Description of Artificial Sequence: Synthetic oligonucleotide
tggagttggtagaagacatcttcacctcctgc

SEQ ID NO: 136683 - DNA, 31 bp, Artificial Sequence
  Description of Artificial Sequence: Synthetic oligonucleotide
ggagttggtagaagacatcttcacctcctgc

SEQ ID NO: 136684 - DNA, 33 bp, Artificial Sequence
  Description of Artificial Sequence: Synthetic oligonucleotide
gagttggtagaagacatcttcacctcctgcaag

SEQ ID NO: 136685 - DNA, 33 bp, Artificial Sequence
  Description of Artificial Sequence: Synthetic oligonucleotide
agttggtagaagacatcttcacctcctgcaagg

SEQ ID NO: 136686 - DNA, 32 bp, Artificial Sequence
  Description of Artificial Sequence: Synthetic oligonucleotide
gttggtagaagacatcttcacctcctgcaagg

SEQ ID NO: 136687 - DNA, 34 bp, Artificial Sequence
  Description of Artificial Sequence: Synthetic oligonucleotide
ttggtagaagacatcttcacctcctgcaaggatg

SEQ ID NO: 136688 - DNA, 33 bp, Artificial Sequence
  Description of Artificial Sequence: Synthetic oligonucleotide
tggtagaagacatcttcacctcctgcaaggatg

SEQ ID NO: 136689 - DNA, 32 bp, Artificial Sequence
  Description of Artificial Sequence: Synthetic oligonucleotide
ggtagaagacatcttcacctcctgcaaggatg

SEQ ID NO: 136690 - DNA, 33 bp, Artificial Sequence
  Description of Artificial Sequence: Synthetic oligonucleotide
gtagaagacatcttcacctcctgcaaggatgtg

SEQ ID NO: 136691 - DNA, 33 bp, Artificial Sequence
  Description of Artificial Sequence: Synthetic oligonucleotide
tagaagacatcttcacctcctgcaaggatgtgg

SEQ ID NO: 136692 - DNA, 32 bp, Artificial Sequence
  Description of Artificial Sequence: Synthetic oligonucleotide
agaagacatcttcacctcctgcaaggatgtgg

SEQ ID NO: 136693 - DNA, 31 bp, Artificial Sequence
  Description of Artificial Sequence: Synthetic oligonucleotide
gaagacatcttcacctcctgcaaggatgtgg

SEQ ID NO: 136694 - DNA, 33 bp, Artificial Sequence
  Description of Artificial Sequence: Synthetic oligonucleotide
aagacatcttcacctcctgcaaggatgtggtag

SEQ ID NO: 136695 - DNA, 32 bp, Artificial Sequence
  Description of Artificial Sequence: Synthetic oligonucleotide
agacatcttcacctcctgcaaggatgtggtag

SEQ ID NO: 136696 - DNA, 31 bp, Artificial Sequence
  Description of Artificial Sequence: Synthetic oligonucleotide
gacatcttcacctcctgcaaggatgtggtag

SEQ ID NO: 136697 - DNA, 33 bp, Artificial Sequence
  Description of Artificial Sequence: Synthetic oligonucleotide
acatcttcacctcctgcaaggatgtggtagtac

SEQ ID NO: 136698 - DNA, 32 bp, Artificial Sequence
  Description of Artificial Sequence: Synthetic oligonucleotide
catcttcacctcctgcaaggatgtggtagtac

SEQ ID NO: 136699 - DNA, 33 bp, Artificial Sequence
  Description of Artificial Sequence: Synthetic oligonucleotide
atcttcacctcctgcaaggatgtggtagtacag

SEQ ID NO: 136700 - DNA, 32 bp, Artificial Sequence
  Description of Artificial Sequence: Synthetic oligonucleotide
tcttcacctcctgcaaggatgtggtagtacag

SEQ ID NO: 136701 - DNA, 31 bp, Artificial Sequence
  Description of Artificial Sequence: Synthetic oligonucleotide
cttcacctcctgcaaggatgtggtagtacag

SEQ ID NO: 136702 - DNA, 34 bp, Artificial Sequence
  Description of Artificial Sequence: Synthetic oligonucleotide
ttcacctcctgcaaggatgtggtagtacagaaac

SEQ ID NO: 136703 - DNA, 33 bp, Artificial Sequence
  Description of Artificial Sequence: Synthetic oligonucleotide
tcacctcctgcaaggatgtggtagtacagaaac

SEQ ID NO: 136704 - DNA, 32 bp, Artificial Sequence
  Description of Artificial Sequence: Synthetic oligonucleotide
cacctcctgcaaggatgtggtagtacagaaac

SEQ ID NO: 136705 - DNA, 33 bp, Artificial Sequence
  Description of Artificial Sequence: Synthetic oligonucleotide
acctcctgcaaggatgtggtagtacagaaacag

SEQ ID NO: 136706 - DNA, 32 bp, Artificial Sequence
  Description of Artificial Sequence: Synthetic oligonucleotide
cctcctgcaaggatgtggtagtacagaaacag

SEQ ID NO: 136707 - DNA, 34 bp, Artificial Sequence
  Description of Artificial Sequence: Synthetic oligonucleotide
ctcctgcaaggatgtggtagtacagaaacagatg

SEQ ID NO: 136708 - DNA, 34 bp, Artificial Sequence
  Description of Artificial Sequence: Synthetic oligonucleotide
tcctgcaaggatgtggtagtacagaaacagatgg

SEQ ID NO: 136709 - DNA, 33 bp, Artificial Sequence
  Description of Artificial Sequence: Synthetic oligonucleotide
cctgcaaggatgtggtagtacagaaacagatgg

SEQ ID NO: 136710 - DNA, 33 bp, Artificial Sequence
  Description of Artificial Sequence: Synthetic oligonucleotide
ctgcaaggatgtggtagtacagaaacagatggc

SEQ ID NO: 136711 - DNA, 36 bp, Artificial Sequence
  Description of Artificial Sequence: Synthetic oligonucleotide
tgcaaggatgtggtagtacagaaacagatggcattc

SEQ ID NO: 136712 - DNA, 35 bp, Artificial Sequence
  Description of Artificial Sequence: Synthetic oligonucleotide
gcaaggatgtggtagtacagaaacagatggcattc

SEQ ID NO: 136713 - DNA, 37 bp, Artificial Sequence
  Description of Artificial Sequence: Synthetic oligonucleotide
caaggatgtggtagtacagaaacagatggcattcatg

SEQ ID NO: 136714 - DNA, 37 bp, Artificial Sequence
  Description of Artificial Sequence: Synthetic oligonucleotide
aaggatgtggtagtacagaaacagatggcattcatgc

SEQ ID NO: 136715 - DNA, 36 bp, Artificial Sequence
  Description of Artificial Sequence: Synthetic oligonucleotide
aggatgtggtagtacagaaacagatggcattcatgc

SEQ ID NO: 136716 - DNA, 35 bp, Artificial Sequence
  Description of Artificial Sequence: Synthetic oligonucleotide
ggatgtggtagtacagaaacagatggcattcatgc

SEQ ID NO: 136717 - DNA, 37 bp, Artificial Sequence
  Description of Artificial Sequence: Synthetic oligonucleotide
gatgtggtagtacagaaacagatggcattcatgctag

SEQ ID NO: 136718 - DNA, 37 bp, Artificial Sequence
  Description of Artificial Sequence: Synthetic oligonucleotide
atgtggtagtacagaaacagatggcattcatgctagg

SEQ ID NO: 136719 - DNA, 36 bp, Artificial Sequence
  Description of Artificial Sequence: Synthetic oligonucleotide
tgtggtagtacagaaacagatggcattcatgctagg

SEQ ID NO: 136720 - DNA, 35 bp, Artificial Sequence
  Description of Artificial Sequence: Synthetic oligonucleotide
gtggtagtacagaaacagatggcattcatgctagg

SEQ ID NO: 136721 - DNA, 35 bp, Artificial Sequence
  Description of Artificial Sequence: Synthetic oligonucleotide
tggtagtacagaaacagatggcattcatgctaggc

SEQ ID NO: 136722 - DNA, 34 bp, Artificial Sequence
  Description of Artificial Sequence: Synthetic oligonucleotide
ggtagtacagaaacagatggcattcatgctaggc

SEQ ID NO: 136723 - DNA, 34 bp, Artificial Sequence
  Description of Artificial Sequence: Synthetic oligonucleotide
gtagtacagaaacagatggcattcatgctaggcc

SEQ ID NO: 136724 - DNA, 34 bp, Artificial Sequence
  Description of Artificial Sequence: Synthetic oligonucleotide
tagtacagaaacagatggcattcatgctaggccg

SEQ ID NO: 136725 - DNA, 33 bp, Artificial Sequence
  Description of Artificial Sequence: Synthetic oligonucleotide
agtacagaaacagatggcattcatgctaggccg

SEQ ID NO: 136726 - DNA, 32 bp, Artificial Sequence
  Description of Artificial Sequence: Synthetic oligonucleotide
gtacagaaacagatggcattcatgctaggccg

SEQ ID NO: 136727 - DNA, 32 bp, Artificial Sequence
  Description of Artificial Sequence: Synthetic oligonucleotide
tacagaaacagatggcattcatgctaggccgg

SEQ ID NO: 136728 - DNA, 31 bp, Artificial Sequence
  Description of Artificial Sequence: Synthetic oligonucleotide
acagaaacagatggcattcatgctaggccgg

SEQ ID NO: 136729 - DNA, 30 bp, Artificial Sequence
  Description of Artificial Sequence: Synthetic oligonucleotide
cagaaacagatggcattcatgctaggccgg

SEQ ID NO: 136730 - DNA, 30 bp, Artificial Sequence
  Description of Artificial Sequence: Synthetic oligonucleotide
agaaacagatggcattcatgctaggccggc

SEQ ID NO: 136731 - DNA, 29 bp, Artificial Sequence
  Description of Artificial Sequence: Synthetic oligonucleotide
gaaacagatggcattcatgctaggccggc

SEQ ID NO: 136732 - DNA, 31 bp, Artificial Sequence
  Description of Artificial Sequence: Synthetic oligonucleotide
aaacagatggcattcatgctaggccggcatg

SEQ ID NO: 136733 - DNA, 30 bp, Artificial Sequence
  Description of Artificial Sequence: Synthetic oligonucleotide
aacagatggcattcatgctaggccggcatg

SEQ ID NO: 136734 - DNA, 29 bp, Artificial Sequence
  Description of Artificial Sequence: Synthetic oligonucleotide
acagatggcattcatgctaggccggcatg

SEQ ID NO: 136735 - DNA, 28 bp, Artificial Sequence
  Description of Artificial Sequence: Synthetic oligonucleotide
cagatggcattcatgctaggccggcatg

SEQ ID NO: 136736 - DNA, 28 bp, Artificial Sequence
  Description of Artificial Sequence: Synthetic oligonucleotide
agatggcattcatgctaggccggcatgg

SEQ ID NO: 136737 - DNA, 27 bp, Artificial Sequence
  Description of Artificial Sequence: Synthetic oligonucleotide
gatggcattcatgctaggccggcatgg

SEQ ID NO: 136738 - DNA, 27 bp, Artificial Sequence
  Description of Artificial Sequence: Synthetic oligonucleotide
atggcattcatgctaggccggcatggg

SEQ ID NO: 136739 - DNA, 26 bp, Artificial Sequence
  Description of Artificial Sequence: Synthetic oligonucleotide
tggcattcatgctaggccggcatggg

SEQ ID NO: 136740 - DNA, 25 bp, Artificial Sequence
  Description of Artificial Sequence: Synthetic oligonucleotide
ggcattcatgctaggccggcatggg

SEQ ID NO: 136741 - DNA, 26 bp, Artificial Sequence
  Description of Artificial Sequence: Synthetic oligonucleotide
gcattcatgctaggccggcatggggt

SEQ ID NO: 136742 - DNA, 27 bp, Artificial Sequence
  Description of Artificial Sequence: Synthetic oligonucleotide
cattcatgctaggccggcatggggtgt

SEQ ID NO: 136743 - DNA, 28 bp, Artificial Sequence
  Description of Artificial Sequence: Synthetic oligonucleotide
attcatgctaggccggcatggggtgttc

SEQ ID NO: 136744 - DNA, 27 bp, Artificial Sequence
  Description of Artificial Sequence: Synthetic oligonucleotide
ttcatgctaggccggcatggggtgttc

SEQ ID NO: 136745 - DNA, 26 bp, Artificial Sequence
  Description of Artificial Sequence: Synthetic oligonucleotide
tcatgctaggccggcatggggtgttc

SEQ ID NO: 136746 - DNA, 25 bp, Artificial Sequence
  Description of Artificial Sequence: Synthetic oligonucleotide
catgctaggccggcatggggtgttc

SEQ ID NO: 136747 - DNA, 26 bp, Artificial Sequence
  Description of Artificial Sequence: Synthetic oligonucleotide
atgctaggccggcatggggtgttcct

SEQ ID NO: 136748 - DNA, 25 bp, Artificial Sequence
  Description of Artificial Sequence: Synthetic oligonucleotide
tgctaggccggcatggggtgttcct

SEQ ID NO: 136749 - DNA, 24 bp, Artificial Sequence
  Description of Artificial Sequence: Synthetic oligonucleotide
gctaggccggcatggggtgttcct

SEQ ID NO: 136750 - DNA, 24 bp, Artificial Sequence
  Description of Artificial Sequence: Synthetic oligonucleotide
ctaggccggcatggggtgttcctg

SEQ ID NO: 136751 - DNA, 25 bp, Artificial Sequence
  Description of Artificial Sequence: Synthetic oligonucleotide
taggccggcatggggtgttcctgga

SEQ ID NO: 136752 - DNA, 24 bp, Artificial Sequence
  Description of Artificial Sequence: Synthetic oligonucleotide
aggccggcatggggtgttcctgga

SEQ ID NO: 136753 - DNA, 23 bp, Artificial Sequence
  Description of Artificial Sequence: Synthetic oligonucleotide
ggccggcatggggtgttcctgga

SEQ ID NO: 136754 - DNA, 23 bp, Artificial Sequence
  Description of Artificial Sequence: Synthetic oligonucleotide
gccggcatggggtgttcctggag

SEQ ID NO: 136755 - DNA, 24 bp, Artificial Sequence
  Description of Artificial Sequence: Synthetic oligonucleotide
ccggcatggggtgttcctggagct

SEQ ID NO: 136756 - DNA, 25 bp, Artificial Sequence
  Description of Artificial Sequence: Synthetic oligonucleotide
cggcatggggtgttcctggagctga

SEQ ID NO: 136757 - DNA, 26 bp, Artificial Sequence
  Description of Artificial Sequence: Synthetic oligonucleotide
ggcatggggtgttcctggagctgagt

SEQ ID NO: 136758 - DNA, 27 bp, Artificial Sequence
  Description of Artificial Sequence: Synthetic oligonucleotide
gcatggggtgttcctggagctgagtga

SEQ ID NO: 136759 - DNA, 28 bp, Artificial Sequence
  Description of Artificial Sequence: Synthetic oligonucleotide
catggggtgttcctggagctgagtgaag

SEQ ID NO: 136760 - DNA, 30 bp, Artificial Sequence
  Description of Artificial Sequence: Synthetic oligonucleotide
atggggtgttcctggagctgagtgaagatg

SEQ ID NO: 136761 - DNA, 29 bp, Artificial Sequence
  Description of Artificial Sequence: Synthetic oligonucleotide
tggggtgttcctggagctgagtgaagatg

SEQ ID NO: 136762 - DNA, 28 bp, Artificial Sequence
  Description of Artificial Sequence: Synthetic oligonucleotide
ggggtgttcctggagctgagtgaagatg

SEQ ID NO: 136763 - DNA, 29 bp, Artificial Sequence
  Description of Artificial Sequence: Synthetic oligonucleotide
gggtgttcctggagctgagtgaagatgtc

SEQ ID NO: 136764 - DNA, 29 bp, Artificial Sequence
  Description of Artificial Sequence: Synthetic oligonucleotide
ggtgttcctggagctgagtgaagatgtcg

SEQ ID NO: 136765 - DNA, 30 bp, Artificial Sequence
  Description of Artificial Sequence: Synthetic oligonucleotide
gtgttcctggagctgagtgaagatgtcgag

SEQ ID NO: 136766 - DNA, 30 bp, Artificial Sequence
  Description of Artificial Sequence: Synthetic oligonucleotide
tgttcctggagctgagtgaagatgtcgagg

SEQ ID NO: 136767 - DNA, 29 bp, Artificial Sequence
  Description of Artificial Sequence: Synthetic oligonucleotide
gttcctggagctgagtgaagatgtcgagg

SEQ ID NO: 136768 - DNA, 30 bp, Artificial Sequence
  Description of Artificial Sequence: Synthetic oligonucleotide
ttcctggagctgagtgaagatgtcgaggag

SEQ ID NO: 136769 - DNA, 29 bp, Artificial Sequence
  Description of Artificial Sequence: Synthetic oligonucleotide
tcctggagctgagtgaagatgtcgaggag

SEQ ID NO: 136770 - DNA, 28 bp, Artificial Sequence
  Description of Artificial Sequence: Synthetic oligonucleotide
cctggagctgagtgaagatgtcgaggag

SEQ ID NO: 136771 - DNA, 31 bp, Artificial Sequence
  Description of Artificial Sequence: Synthetic oligonucleotide
ctggagctgagtgaagatgtcgaggagtatg

SEQ ID NO: 136772 - DNA, 32 bp, Artificial Sequence
  Description of Artificial Sequence: Synthetic oligonucleotide
tggagctgagtgaagatgtcgaggagtatgag

SEQ ID NO: 136773 - DNA, 31 bp, Artificial Sequence
  Description of Artificial Sequence: Synthetic oligonucleotide
ggagctgagtgaagatgtcgaggagtatgag

SEQ ID NO: 136774 - DNA, 31 bp, Artificial Sequence
  Description of Artificial Sequence: Synthetic oligonucleotide
gagctgagtgaagatgtcgaggagtatgagg

SEQ ID NO: 136775 - DNA, 32 bp, Artificial Sequence
  Description of Artificial Sequence: Synthetic oligonucleotide
agctgagtgaagatgtcgaggagtatgaggac

SEQ ID NO: 136776 - DNA, 31 bp, Artificial Sequence
  Description of Artificial Sequence: Synthetic oligonucleotide
gctgagtgaagatgtcgaggagtatgaggac

SEQ ID NO: 136777 - DNA, 31 bp, Artificial Sequence
  Description of Artificial Sequence: Synthetic oligonucleotide
ctgagtgaagatgtcgaggagtatgaggacc

SEQ ID NO: 136778 - DNA, 32 bp, Artificial Sequence
  Description of Artificial Sequence: Synthetic oligonucleotide
tgagtgaagatgtcgaggagtatgaggacctg

SEQ ID NO: 136779 - DNA, 31 bp, Artificial Sequence
  Description of Artificial Sequence: Synthetic oligonucleotide
gagtgaagatgtcgaggagtatgaggacctg

SEQ ID NO: 136780 - DNA, 32 bp, Artificial Sequence
  Description of Artificial Sequence: Synthetic oligonucleotide
agtgaagatgtcgaggagtatgaggacctgac

SEQ ID NO: 136781 - DNA, 31 bp, Artificial Sequence
  Description of Artificial Sequence: Synthetic oligonucleotide
gtgaagatgtcgaggagtatgaggacctgac

SEQ ID NO: 136782 - DNA, 32 bp, Artificial Sequence
  Description of Artificial Sequence: Synthetic oligonucleotide
tgaagatgtcgaggagtatgaggacctgacag

SEQ ID NO: 136783 - DNA, 31 bp, Artificial Sequence
  Description of Artificial Sequence: Synthetic oligonucleotide
gaagatgtcgaggagtatgaggacctgacag

SEQ ID NO: 136784 - DNA, 32 bp, Artificial Sequence
  Description of Artificial Sequence: Synthetic oligonucleotide
aagatgtcgaggagtatgaggacctgacagag

SEQ ID NO: 136785 - DNA, 31 bp, Artificial Sequence
  Description of Artificial Sequence: Synthetic oligonucleotide
agatgtcgaggagtatgaggacctgacagag

SEQ ID NO: 136786 - DNA, 30 bp, Artificial Sequence
  Description of Artificial Sequence: Synthetic oligonucleotide
gatgtcgaggagtatgaggacctgacagag

SEQ ID NO: 136787 - DNA, 32 bp, Artificial Sequence
  Description of Artificial Sequence: Synthetic oligonucleotide
atgtcgaggagtatgaggacctgacagagatc

SEQ ID NO: 136788 - DNA, 31 bp, Artificial Sequence
  Description of Artificial Sequence: Synthetic oligonucleotide
tgtcgaggagtatgaggacctgacagagatc

SEQ ID NO: 136789 - DNA, 30 bp, Artificial Sequence
  Description of Artificial Sequence: Synthetic oligonucleotide
gtcgaggagtatgaggacctgacagagatc

SEQ ID NO: 136790 - DNA, 32 bp, Artificial Sequence
  Description of Artificial Sequence: Synthetic oligonucleotide
tcgaggagtatgaggacctgacagagatcatg

SEQ ID NO: 136791 - DNA, 31 bp, Artificial Sequence
  Description of Artificial Sequence: Synthetic oligonucleotide
cgaggagtatgaggacctgacagagatcatg

SEQ ID NO: 136792 - DNA, 32 bp, Artificial Sequence
  Description of Artificial Sequence: Synthetic oligonucleotide
gaggagtatgaggacctgacagagatcatgtc

SEQ ID NO: 136793 - DNA, 32 bp, Artificial Sequence
  Description of Artificial Sequence: Synthetic oligonucleotide
aggagtatgaggacctgacagagatcatgtcc

SEQ ID NO: 136794 - DNA, 31 bp, Artificial Sequence
  Description of Artificial Sequence: Synthetic oligonucleotide
ggagtatgaggacctgacagagatcatgtcc

SEQ ID NO: 136795 - DNA, 34 bp, Artificial Sequence
  Description of Artificial Sequence: Synthetic oligonucleotide
gagtatgaggacctgacagagatcatgtccaatg

SEQ ID NO: 136796 - DNA, 36 bp, Artificial Sequence
  Description of Artificial Sequence: Synthetic oligonucleotide
agtatgaggacctgacagagatcatgtccaatgtac

SEQ ID NO: 136797 - DNA, 35 bp, Artificial Sequence
  Description of Artificial Sequence: Synthetic oligonucleotide
gtatgaggacctgacagagatcatgtccaatgtac

SEQ ID NO: 136798 - DNA, 36 bp, Artificial Sequence
  Description of Artificial Sequence: Synthetic oligonucleotide
tatgaggacctgacagagatcatgtccaatgtacag

SEQ ID NO: 136799 - DNA, 35 bp, Artificial Sequence
  Description of Artificial Sequence: Synthetic oligonucleotide
atgaggacctgacagagatcatgtccaatgtacag

SEQ ID NO: 136800 - DNA, 34 bp, Artificial Sequence
  Description of Artificial Sequence: Synthetic oligonucleotide
tgaggacctgacagagatcatgtccaatgtacag

SEQ ID NO: 136801 - DNA, 33 bp, Artificial Sequence
  Description of Artificial Sequence: Synthetic oligonucleotide
gaggacctgacagagatcatgtccaatgtacag

SEQ ID NO: 136802 - DNA, 33 bp, Artificial Sequence
  Description of Artificial Sequence: Synthetic oligonucleotide
aggacctgacagagatcatgtccaatgtacagc

SEQ ID NO: 136803 - DNA, 32 bp, Artificial Sequence
  Description of Artificial Sequence: Synthetic oligonucleotide
ggacctgacagagatcatgtccaatgtacagc

SEQ ID NO: 136804 - DNA, 33 bp, Artificial Sequence
  Description of Artificial Sequence: Synthetic oligonucleotide
gacctgacagagatcatgtccaatgtacagctc

SEQ ID NO: 136805 - DNA, 35 bp, Artificial Sequence
  Description of Artificial Sequence: Synthetic oligonucleotide
acctgacagagatcatgtccaatgtacagctcaac

SEQ ID NO: 136806 - DNA, 34 bp, Artificial Sequence
  Description of Artificial Sequence: Synthetic oligonucleotide
cctgacagagatcatgtccaatgtacagctcaac

SEQ ID NO: 136807 - DNA, 35 bp, Artificial Sequence
  Description of Artificial Sequence: Synthetic oligonucleotide
ctgacagagatcatgtccaatgtacagctcaacag

SEQ ID NO: 136808 - DNA, 35 bp, Artificial Sequence
  Description of Artificial Sequence: Synthetic oligonucleotide
tgacagagatcatgtccaatgtacagctcaacagc

SEQ ID NO: 136809 - DNA, 34 bp, Artificial Sequence
  Description of Artificial Sequence: Synthetic oligonucleotide
gacagagatcatgtccaatgtacagctcaacagc

SEQ ID NO: 136810 - DNA, 36 bp, Artificial Sequence
  Description of Artificial Sequence: Synthetic oligonucleotide
acagagatcatgtccaatgtacagctcaacagcaac

SEQ ID NO: 136811 - DNA, 35 bp, Artificial Sequence
  Description of Artificial Sequence: Synthetic oligonucleotide
cagagatcatgtccaatgtacagctcaacagcaac

SEQ ID NO: 136812 - DNA, 37 bp, Artificial Sequence
  Description of Artificial Sequence: Synthetic oligonucleotide
agagatcatgtccaatgtacagctcaacagcaacttc

SEQ ID NO: 136813 - DNA, 36 bp, Artificial Sequence
  Description of Artificial Sequence: Synthetic oligonucleotide
gagatcatgtccaatgtacagctcaacagcaacttc

SEQ ID NO: 136814 - DNA, 38 bp, Artificial Sequence
  Description of Artificial Sequence: Synthetic oligonucleotide
agatcatgtccaatgtacagctcaacagcaacttcttg

SEQ ID NO: 136815 - DNA, 37 bp, Artificial Sequence
  Description of Artificial Sequence: Synthetic oligonucleotide
gatcatgtccaatgtacagctcaacagcaacttcttg

SEQ ID NO: 136816 - DNA, 37 bp, Artificial Sequence
  Description of Artificial Sequence: Synthetic oligonucleotide
atcatgtccaatgtacagctcaacagcaacttcttgg

SEQ ID NO: 136817 - DNA, 36 bp, Artificial Sequence
  Description of Artificial Sequence: Synthetic oligonucleotide
tcatgtccaatgtacagctcaacagcaacttcttgg

SEQ ID NO: 136818 - DNA, 35 bp, Artificial Sequence
  Description of Artificial Sequence: Synthetic oligonucleotide
catgtccaatgtacagctcaacagcaacttcttgg

SEQ ID NO: 136819 - DNA, 35 bp, Artificial Sequence
  Description of Artificial Sequence: Synthetic oligonucleotide
atgtccaatgtacagctcaacagcaacttcttggc

SEQ ID NO: 136820 - DNA, 34 bp, Artificial Sequence
  Description of Artificial Sequence: Synthetic oligonucleotide
tgtccaatgtacagctcaacagcaacttcttggc

SEQ ID NO: 136821 - DNA, 33 bp, Artificial Sequence
  Description of Artificial Sequence: Synthetic oligonucleotide
gtccaatgtacagctcaacagcaacttcttggc

SEQ ID NO: 136822 - DNA, 33 bp, Artificial Sequence
  Description of Artificial Sequence: Synthetic oligonucleotide
tccaatgtacagctcaacagcaacttcttggcc

SEQ ID NO: 136823 - DNA, 32 bp, Artificial Sequence
  Description of Artificial Sequence: Synthetic oligonucleotide
ccaatgtacagctcaacagcaacttcttggcc

SEQ ID NO: 136824 - DNA, 35 bp, Artificial Sequence
  Description of Artificial Sequence: Synthetic oligonucleotide
caatgtacagctcaacagcaacttcttggccttag

SEQ ID NO: 136825 - DNA, 35 bp, Artificial Sequence
  Description of Artificial Sequence: Synthetic oligonucleotide
aatgtacagctcaacagcaacttcttggccttagc

SEQ ID NO: 136826 - DNA, 34 bp, Artificial Sequence
  Description of Artificial Sequence: Synthetic oligonucleotide
atgtacagctcaacagcaacttcttggccttagc

SEQ ID NO: 136827 - DNA, 33 bp, Artificial Sequence
  Description of Artificial Sequence: Synthetic oligonucleotide
tgtacagctcaacagcaacttcttggccttagc

SEQ ID NO: 136828 - DNA, 32 bp, Artificial Sequence
  Description of Artificial Sequence: Synthetic oligonucleotide
gtacagctcaacagcaacttcttggccttagc

SEQ ID NO: 136829 - DNA, 33 bp, Artificial Sequence
  Description of Artificial Sequence: Synthetic oligonucleotide
tacagctcaacagcaacttcttggccttagctc

SEQ ID NO: 136830 - DNA, 32 bp, Artificial Sequence
  Description of Artificial Sequence: Synthetic oligonucleotide
acagctcaacagcaacttcttggccttagctc

SEQ ID NO: 136831 - DNA, 31 bp, Artificial Sequence
  Description of Artificial Sequence: Synthetic oligonucleotide
cagctcaacagcaacttcttggccttagctc

SEQ ID NO: 136832 - DNA, 31 bp, Artificial Sequence
  Description of Artificial Sequence: Synthetic oligonucleotide
agctcaacagcaacttcttggccttagctcg

SEQ ID NO: 136833 - DNA, 30 bp, Artificial Sequence
  Description of Artificial Sequence: Synthetic oligonucleotide
gctcaacagcaacttcttggccttagctcg

SEQ ID NO: 136834 - DNA, 30 bp, Artificial Sequence
  Description of Artificial Sequence: Synthetic oligonucleotide
ctcaacagcaacttcttggccttagctcgg

SEQ ID NO: 136835 - DNA, 30 bp, Artificial Sequence
  Description of Artificial Sequence: Synthetic oligonucleotide
tcaacagcaacttcttggccttagctcggg

SEQ ID NO: 136836 - DNA, 29 bp, Artificial Sequence
  Description of Artificial Sequence: Synthetic oligonucleotide
caacagcaacttcttggccttagctcggg

SEQ ID NO: 136837 - DNA, 30 bp, Artificial Sequence
  Description of Artificial Sequence: Synthetic oligonucleotide
aacagcaacttcttggccttagctcgggag

SEQ ID NO: 136838 - DNA, 29 bp, Artificial Sequence
  Description of Artificial Sequence: Synthetic oligonucleotide
acagcaacttcttggccttagctcgggag

SEQ ID NO: 136839 - DNA, 28 bp, Artificial Sequence
  Description of Artificial Sequence: Synthetic oligonucleotide
cagcaacttcttggccttagctcgggag

SEQ ID NO: 136840 - DNA, 28 bp, Artificial Sequence
  Description of Artificial Sequence: Synthetic oligonucleotide
agcaacttcttggccttagctcgggagc

SEQ ID NO: 136841 - DNA, 27 bp, Artificial Sequence
  Description of Artificial Sequence: Synthetic oligonucleotide
gcaacttcttggccttagctcgggagc

SEQ ID NO: 136842 - DNA, 28 bp, Artificial Sequence
  Description of Artificial Sequence: Synthetic oligonucleotide
caacttcttggccttagctcgggagctg

SEQ ID NO: 136843 - DNA, 28 bp, Artificial Sequence
  Description of Artificial Sequence: Synthetic oligonucleotide
aacttcttggccttagctcgggagctgg

SEQ ID NO: 136844 - DNA, 27 bp, Artificial Sequence
  Description of Artificial Sequence: Synthetic oligonucleotide
acttcttggccttagctcgggagctgg

SEQ ID NO: 136845 - DNA, 27 bp, Artificial Sequence
  Description of Artificial Sequence: Synthetic oligonucleotide
cttcttggccttagctcgggagctgga

SEQ ID NO: 136846 - DNA, 27 bp, Artificial Sequence
  Description of Artificial Sequence: Synthetic oligonucleotide
ttcttggccttagctcgggagctggac

SEQ ID NO: 136847 - DNA, 27 bp, Artificial Sequence
  Description of Artificial Sequence: Synthetic oligonucleotide
tcttggccttagctcgggagctggaca

SEQ ID NO: 136848 - DNA, 27 bp, Artificial Sequence
  Description of Artificial Sequence: Synthetic oligonucleotide
cttggccttagctcgggagctggacat

SEQ ID NO: 136849 - DNA, 27 bp, Artificial Sequence
  Description of Artificial Sequence: Synthetic oligonucleotide
ttggccttagctcgggagctggacatc

SEQ ID NO: 136850 - DNA, 27 bp, Artificial Sequence
  Description of Artificial Sequence: Synthetic oligonucleotide
tggccttagctcgggagctggacatca

SEQ ID NO: 136851 - DNA, 27 bp, Artificial Sequence
  Description of Artificial Sequence: Synthetic oligonucleotide
ggccttagctcgggagctggacatcat

SEQ ID NO: 136852 - DNA, 27 bp, Artificial Sequence
  Description of Artificial Sequence: Synthetic oligonucleotide
gccttagctcgggagctggacatcatg

SEQ ID NO: 136853 - DNA, 27 bp, Artificial Sequence
  Description of Artificial Sequence: Synthetic oligonucleotide
ccttagctcgggagctggacatcatgg

SEQ ID NO: 136854 - DNA, 28 bp, Artificial Sequence
  Description of Artificial Sequence: Synthetic oligonucleotide
cttagctcgggagctggacatcatggag

SEQ ID NO: 136855 - DNA, 28 bp, Artificial Sequence
  Description of Artificial Sequence: Synthetic oligonucleotide
ttagctcgggagctggacatcatggagc

SEQ ID NO: 136856 - DNA, 27 bp, Artificial Sequence
  Description of Artificial Sequence: Synthetic oligonucleotide
tagctcgggagctggacatcatggagc

SEQ ID NO: 136857 - DNA, 26 bp, Artificial Sequence
  Description of Artificial Sequence: Synthetic oligonucleotide
agctcgggagctggacatcatggagc

SEQ ID NO: 136858 - DNA, 25 bp, Artificial Sequence
  Description of Artificial Sequence: Synthetic oligonucleotide
gctcgggagctggacatcatggagc

SEQ ID NO: 136859 - DNA, 25 bp, Artificial Sequence
  Description of Artificial Sequence: Synthetic oligonucleotide
ctcgggagctggacatcatggagcc

SEQ ID NO: 136860 - DNA, 27 bp, Artificial Sequence
  Description of Artificial Sequence: Synthetic oligonucleotide
tcgggagctggacatcatggagcccaa

SEQ ID NO: 136861 - DNA, 26 bp, Artificial Sequence
  Description of Artificial Sequence: Synthetic oligonucleotide
cgggagctggacatcatggagcccaa

SEQ ID NO: 136862 - DNA, 26 bp, Artificial Sequence
  Description of Artificial Sequence: Synthetic oligonucleotide
gggagctggacatcatggagcccaag

SEQ ID NO: 136863 - DNA, 27 bp, Artificial Sequence
  Description of Artificial Sequence: Synthetic oligonucleotide
ggagctggacatcatggagcccaaggt

SEQ ID NO: 136864 - DNA, 27 bp, Artificial Sequence
  Description of Artificial Sequence: Synthetic oligonucleotide
gagctggacatcatggagcccaaggtg

SEQ ID NO: 136865 - DNA, 27 bp, Artificial Sequence
  Description of Artificial Sequence: Synthetic oligonucleotide
agctggacatcatggagcccaaggtgc

SEQ ID NO: 136866 - DNA, 26 bp, Artificial Sequence
  Description of Artificial Sequence: Synthetic oligonucleotide
gctggacatcatggagcccaaggtgc

SEQ ID NO: 136867 - DNA, 27 bp, Artificial Sequence
  Description of Artificial Sequence: Synthetic oligonucleotide
ctggacatcatggagcccaaggtgcct

SEQ ID NO: 136868 - DNA, 27 bp, Artificial Sequence
  Description of Artificial Sequence: Synthetic oligonucleotide
tggacatcatggagcccaaggtgcctg

SEQ ID NO: 136869 - DNA, 27 bp, Artificial Sequence
  Description of Artificial Sequence: Synthetic oligonucleotide
ggacatcatggagcccaaggtgcctga

SEQ ID NO: 136870 - DNA, 28 bp, Artificial Sequence
  Description of Artificial Sequence: Synthetic oligonucleotide
gacatcatggagcccaaggtgcctgatg

SEQ ID NO: 136871 - DNA, 29 bp, Artificial Sequence
  Description of Artificial Sequence: Synthetic oligonucleotide
acatcatggagcccaaggtgcctgatgac

SEQ ID NO: 136872 - DNA, 28 bp, Artificial Sequence
  Description of Artificial Sequence: Synthetic oligonucleotide
catcatggagcccaaggtgcctgatgac

SEQ ID NO: 136873 - DNA, 30 bp, Artificial Sequence
  Description of Artificial Sequence: Synthetic oligonucleotide
atcatggagcccaaggtgcctgatgacatc

SEQ ID NO: 136874 - DNA, 29 bp, Artificial Sequence
  Description of Artificial Sequence: Synthetic oligonucleotide
tcatggagcccaaggtgcctgatgacatc

SEQ ID NO: 136875 - DNA, 28 bp, Artificial Sequence
  Description of Artificial Sequence: Synthetic oligonucleotide
catggagcccaaggtgcctgatgacatc

SEQ ID NO: 136876 - DNA, 30 bp, Artificial Sequence
  Description of Artificial Sequence: Synthetic oligonucleotide
atggagcccaaggtgcctgatgacatctac

SEQ ID NO: 136877 - DNA, 29 bp, Artificial Sequence
  Description of Artificial Sequence: Synthetic oligonucleotide
tggagcccaaggtgcctgatgacatctac

SEQ ID NO: 136878 - DNA, 28 bp, Artificial Sequence
  Description of Artificial Sequence: Synthetic oligonucleotide
ggagcccaaggtgcctgatgacatctac

SEQ ID NO: 136879 - DNA, 32 bp, Artificial Sequence
  Description of Artificial Sequence: Synthetic oligonucleotide
gagcccaaggtgcctgatgacatctacaaaac

SEQ ID NO: 136880 - DNA, 32 bp, Artificial Sequence
  Description of Artificial Sequence: Synthetic oligonucleotide
agcccaaggtgcctgatgacatctacaaaacc

SEQ ID NO: 136881 - DNA, 31 bp, Artificial Sequence
  Description of Artificial Sequence: Synthetic oligonucleotide
gcccaaggtgcctgatgacatctacaaaacc

SEQ ID NO: 136882 - DNA, 31 bp, Artificial Sequence
  Description of Artificial Sequence: Synthetic oligonucleotide
cccaaggtgcctgatgacatctacaaaaccc

SEQ ID NO: 136883 - DNA, 32 bp, Artificial Sequence
  Description of Artificial Sequence: Synthetic oligonucleotide
ccaaggtgcctgatgacatctacaaaacccac

SEQ ID NO: 136884 - DNA, 32 bp, Artificial Sequence
  Description of Artificial Sequence: Synthetic oligonucleotide
caaggtgcctgatgacatctacaaaacccacc

SEQ ID NO: 136885 - DNA, 34 bp, Artificial Sequence
  Description of Artificial Sequence: Synthetic oligonucleotide
aaggtgcctgatgacatctacaaaacccacctag

SEQ ID NO: 136886 - DNA, 33 bp, Artificial Sequence
  Description of Artificial Sequence: Synthetic oligonucleotide
aggtgcctgatgacatctacaaaacccacctag

SEQ ID NO: 136887 - DNA, 32 bp, Artificial Sequence
  Description of Artificial Sequence: Synthetic oligonucleotide
ggtgcctgatgacatctacaaaacccacctag

SEQ ID NO: 136888 - DNA, 33 bp, Artificial Sequence
  Description of Artificial Sequence: Synthetic oligonucleotide
gtgcctgatgacatctacaaaacccacctagag

SEQ ID NO: 136889 - DNA, 35 bp, Artificial Sequence
  Description of Artificial Sequence: Synthetic oligonucleotide
tgcctgatgacatctacaaaacccacctagagaac

SEQ ID NO: 136890 - DNA, 34 bp, Artificial Sequence
  Description of Artificial Sequence: Synthetic oligonucleotide
gcctgatgacatctacaaaacccacctagagaac

SEQ ID NO: 136891 - DNA, 36 bp, Artificial Sequence
  Description of Artificial Sequence: Synthetic oligonucleotide
cctgatgacatctacaaaacccacctagagaacaac

SEQ ID NO: 136892 - DNA, 37 bp, Artificial Sequence
  Description of Artificial Sequence: Synthetic oligonucleotide
ctgatgacatctacaaaacccacctagagaacaacag

SEQ ID NO: 136893 - DNA, 37 bp, Artificial Sequence
  Description of Artificial Sequence: Synthetic oligonucleotide
tgatgacatctacaaaacccacctagagaacaacagg

SEQ ID NO: 136894 - DNA, 36 bp, Artificial Sequence
  Description of Artificial Sequence: Synthetic oligonucleotide
gatgacatctacaaaacccacctagagaacaacagg

SEQ ID NO: 136895 - DNA, 39 bp, Artificial Sequence
  Description of Artificial Sequence: Synthetic oligonucleotide
atgacatctacaaaacccacctagagaacaacaggtttg

SEQ ID NO: 136896 - DNA, 38 bp, Artificial Sequence
  Description of Artificial Sequence: Synthetic oligonucleotide
tgacatctacaaaacccacctagagaacaacaggtttg

SEQ ID NO: 136897 - DNA, 37 bp, Artificial Sequence
  Description of Artificial Sequence: Synthetic oligonucleotide
gacatctacaaaacccacctagagaacaacaggtttg

SEQ ID NO: 136898 - DNA, 37 bp, Artificial Sequence
  Description of Artificial Sequence: Synthetic oligonucleotide
acatctacaaaacccacctagagaacaacaggtttgg

SEQ ID NO: 136899 - DNA, 36 bp, Artificial Sequence
  Description of Artificial Sequence: Synthetic oligonucleotide
catctacaaaacccacctagagaacaacaggtttgg

SEQ ID NO: 136900 - DNA, 36 bp, Artificial Sequence
  Description of Artificial Sequence: Synthetic oligonucleotide
atctacaaaacccacctagagaacaacaggtttggg

SEQ ID NO: 136901 - DNA, 35 bp, Artificial Sequence
  Description of Artificial Sequence: Synthetic oligonucleotide
tctacaaaacccacctagagaacaacaggtttggg

SEQ ID NO: 136902 - DNA, 34 bp, Artificial Sequence
  Description of Artificial Sequence: Synthetic oligonucleotide
ctacaaaacccacctagagaacaacaggtttggg

SEQ ID NO: 136903 - DNA, 34 bp, Artificial Sequence
  Description of Artificial Sequence: Synthetic oligonucleotide
tacaaaacccacctagagaacaacaggtttgggg

SEQ ID NO: 136904 - DNA, 33 bp, Artificial Sequence
  Description of Artificial Sequence: Synthetic oligonucleotide
acaaaacccacctagagaacaacaggtttgggg

SEQ ID NO: 136905 - DNA, 32 bp, Artificial Sequence
  Description of Artificial Sequence: Synthetic oligonucleotide
caaaacccacctagagaacaacaggtttgggg

SEQ ID NO: 136906 - DNA, 32 bp, Artificial Sequence
  Description of Artificial Sequence: Synthetic oligonucleotide
aaaacccacctagagaacaacaggtttggggg

SEQ ID NO: 136907 - DNA, 31 bp, Artificial Sequence
  Description of Artificial Sequence: Synthetic oligonucleotide
aaacccacctagagaacaacaggtttggggg

SEQ ID NO: 136908 - DNA, 30 bp, Artificial Sequence
  Description of Artificial Sequence: Synthetic oligonucleotide
aacccacctagagaacaacaggtttggggg

SEQ ID NO: 136909 - DNA, 29 bp, Artificial Sequence
  Description of Artificial Sequence: Synthetic oligonucleotide
acccacctagagaacaacaggtttggggg

SEQ ID NO: 136910 - DNA, 28 bp, Artificial Sequence
  Description of Artificial Sequence: Synthetic oligonucleotide
cccacctagagaacaacaggtttggggg

SEQ ID NO: 136911 - DNA, 28 bp, Artificial Sequence
  Description of Artificial Sequence: Synthetic oligonucleotide
ccacctagagaacaacaggtttgggggc

SEQ ID NO: 136912 - DNA, 29 bp, Artificial Sequence
  Description of Artificial Sequence: Synthetic oligonucleotide
cacctagagaacaacaggtttgggggcag

SEQ ID NO: 136913 - DNA, 30 bp, Artificial Sequence
  Description of Artificial Sequence: Synthetic oligonucleotide
acctagagaacaacaggtttgggggcagtg

SEQ ID NO: 136914 - DNA, 29 bp, Artificial Sequence
  Description of Artificial Sequence: Synthetic oligonucleotide
cctagagaacaacaggtttgggggcagtg

SEQ ID NO: 136915 - DNA, 29 bp, Artificial Sequence
  Description of Artificial Sequence: Synthetic oligonucleotide
ctagagaacaacaggtttgggggcagtgg

SEQ ID NO: 136916 - DNA, 29 bp, Artificial Sequence
  Description of Artificial Sequence: Synthetic oligonucleotide
tagagaacaacaggtttgggggcagtggc

SEQ ID NO: 136917 - DNA, 28 bp, Artificial Sequence
  Description of Artificial Sequence: Synthetic oligonucleotide
agagaacaacaggtttgggggcagtggc

SEQ ID NO: 136918 - DNA, 27 bp, Artificial Sequence
  Description of Artificial Sequence: Synthetic oligonucleotide
gagaacaacaggtttgggggcagtggc

SEQ ID NO: 136919 - DNA, 28 bp, Artificial Sequence
  Description of Artificial Sequence: Synthetic oligonucleotide
agaacaacaggtttgggggcagtggctc

SEQ ID NO: 136920 - DNA, 27 bp, Artificial Sequence
  Description of Artificial Sequence: Synthetic oligonucleotide
gaacaacaggtttgggggcagtggctc

SEQ ID NO: 136921 - DNA, 28 bp, Artificial Sequence
  Description of Artificial Sequence: Synthetic oligonucleotide
aacaacaggtttgggggcagtggctctc

SEQ ID NO: 136922 - DNA, 27 bp, Artificial Sequence
  Description of Artificial Sequence: Synthetic oligonucleotide
acaacaggtttgggggcagtggctctc

SEQ ID NO: 136923 - DNA, 27 bp, Artificial Sequence
  Description of Artificial Sequence: Synthetic oligonucleotide
caacaggtttgggggcagtggctctca

SEQ ID NO: 136924 - DNA, 27 bp, Artificial Sequence
  Description of Artificial Sequence: Synthetic oligonucleotide
aacaggtttgggggcagtggctctcag

SEQ ID NO: 136925 - DNA, 26 bp, Artificial Sequence
  Description of Artificial Sequence: Synthetic oligonucleotide
acaggtttgggggcagtggctctcag

SEQ ID NO: 136926 - DNA, 25 bp, Artificial Sequence
  Description of Artificial Sequence: Synthetic oligonucleotide
caggtttgggggcagtggctctcag

SEQ ID NO: 136927 - DNA, 26 bp, Artificial Sequence
  Description of Artificial Sequence: Synthetic oligonucleotide
aggtttgggggcagtggctctcaggt

SEQ ID NO: 136928 - DNA, 25 bp, Artificial Sequence
  Description of Artificial Sequence: Synthetic oligonucleotide
ggtttgggggcagtggctctcaggt

SEQ ID NO: 136929 - DNA, 25 bp, Artificial Sequence
  Description of Artificial Sequence: Synthetic oligonucleotide
gtttgggggcagtggctctcaggtg

SEQ ID NO: 136930 - DNA, 26 bp, Artificial Sequence
  Description of Artificial Sequence: Synthetic oligonucleotide
tttgggggcagtggctctcaggtgga

SEQ ID NO: 136931 - DNA, 25 bp, Artificial Sequence
  Description of Artificial Sequence: Synthetic oligonucleotide
ttgggggcagtggctctcaggtgga

SEQ ID NO: 136932 - DNA, 24 bp, Artificial Sequence
  Description of Artificial Sequence: Synthetic oligonucleotide
tgggggcagtggctctcaggtgga

SEQ ID NO: 136933 - DNA, 23 bp, Artificial Sequence
  Description of Artificial Sequence: Synthetic oligonucleotide
gggggcagtggctctcaggtgga

SEQ ID NO: 136934 - DNA, 24 bp, Artificial Sequence
  Description of Artificial Sequence: Synthetic oligonucleotide
ggggcagtggctctcaggtggact

SEQ ID NO: 136935 - DNA, 25 bp, Artificial Sequence
  Description of Artificial Sequence: Synthetic oligonucleotide
gggcagtggctctcaggtggactct

SEQ ID NO: 136936 - DNA, 25 bp, Artificial Sequence
  Description of Artificial Sequence: Synthetic oligonucleotide
ggcagtggctctcaggtggactctg

SEQ ID NO: 136937 - DNA, 25 bp, Artificial Sequence
  Description of Artificial Sequence: Synthetic oligonucleotide
gcagtggctctcaggtggactctgc

SEQ ID NO: 136938 - DNA, 25 bp, Artificial Sequence
  Description of Artificial Sequence: Synthetic oligonucleotide
cagtggctctcaggtggactctgcc

SEQ ID NO: 136939 - DNA, 25 bp, Artificial Sequence
  Description of Artificial Sequence: Synthetic oligonucleotide
agtggctctcaggtggactctgccc

SEQ ID NO: 136940 - DNA, 24 bp, Artificial Sequence
  Description of Artificial Sequence: Synthetic oligonucleotide
gtggctctcaggtggactctgccc

SEQ ID NO: 136941 - DNA, 24 bp, Artificial Sequence
  Description of Artificial Sequence: Synthetic oligonucleotide
tggctctcaggtggactctgcccg

SEQ ID NO: 136942 - DNA, 23 bp, Artificial Sequence
  Description of Artificial Sequence: Synthetic oligonucleotide
ggctctcaggtggactctgcccg

SEQ ID NO: 136943 - DNA, 25 bp, Artificial Sequence
  Description of Artificial Sequence: Synthetic oligonucleotide
gctctcaggtggactctgcccgcat

SEQ ID NO: 136944 - DNA, 27 bp, Artificial Sequence
  Description of Artificial Sequence: Synthetic oligonucleotide
ctctcaggtggactctgcccgcatgaa

SEQ ID NO: 136945 - DNA, 27 bp, Artificial Sequence
  Description of Artificial Sequence: Synthetic oligonucleotide
tctcaggtggactctgcccgcatgaac

SEQ ID NO: 136946 - DNA, 26 bp, Artificial Sequence
  Description of Artificial Sequence: Synthetic oligonucleotide
ctcaggtggactctgcccgcatgaac

SEQ ID NO: 136947 - DNA, 27 bp, Artificial Sequence
  Description of Artificial Sequence: Synthetic oligonucleotide
tcaggtggactctgcccgcatgaacct

SEQ ID NO: 136948 - DNA, 26 bp, Artificial Sequence
  Description of Artificial Sequence: Synthetic oligonucleotide
caggtggactctgcccgcatgaacct

SEQ ID NO: 136949 - DNA, 26 bp, Artificial Sequence
  Description of Artificial Sequence: Synthetic oligonucleotide
aggtggactctgcccgcatgaacctg

SEQ ID NO: 136950 - DNA, 25 bp, Artificial Sequence
  Description of Artificial Sequence: Synthetic oligonucleotide
ggtggactctgcccgcatgaacctg

SEQ ID NO: 136951 - DNA, 25 bp, Artificial Sequence
  Description of Artificial Sequence: Synthetic oligonucleotide
gtggactctgcccgcatgaacctgg

SEQ ID NO: 136952 - DNA, 25 bp, Artificial Sequence
  Description of Artificial Sequence: Synthetic oligonucleotide
tggactctgcccgcatgaacctggc

SEQ ID NO: 136953 - DNA, 24 bp, Artificial Sequence
  Description of Artificial Sequence: Synthetic oligonucleotide
ggactctgcccgcatgaacctggc

SEQ ID NO: 136954 - DNA, 25 bp, Artificial Sequence
  Description of Artificial Sequence: Synthetic oligonucleotide
gactctgcccgcatgaacctggcct

SEQ ID NO: 136955 - DNA, 25 bp, Artificial Sequence
  Description of Artificial Sequence: Synthetic oligonucleotide
actctgcccgcatgaacctggcctc

SEQ ID NO: 136956 - DNA, 24 bp, Artificial Sequence
  Description of Artificial Sequence: Synthetic oligonucleotide
ctctgcccgcatgaacctggcctc

SEQ ID NO: 136957 - DNA, 25 bp, Artificial Sequence
  Description of Artificial Sequence: Synthetic oligonucleotide
tctgcccgcatgaacctggcctcct

SEQ ID NO: 136958 - DNA, 24 bp, Artificial Sequence
  Description of Artificial Sequence: Synthetic oligonucleotide
ctgcccgcatgaacctggcctcct

SEQ ID NO: 136959 - DNA, 27 bp, Artificial Sequence
  Description of Artificial Sequence: Synthetic oligonucleotide
tgcccgcatgaacctggcctcctcttt

SEQ ID NO: 136960 - DNA, 27 bp, Artificial Sequence
  Description of Artificial Sequence: Synthetic oligonucleotide
gcccgcatgaacctggcctcctctttt

SEQ ID NO: 136961 - DNA, 27 bp, Artificial Sequence
  Description of Artificial Sequence: Synthetic oligonucleotide
cccgcatgaacctggcctcctcttttg

SEQ ID NO: 136962 - DNA, 28 bp, Artificial Sequence
  Description of Artificial Sequence: Synthetic oligonucleotide
ccgcatgaacctggcctcctcttttgtg

SEQ ID NO: 136963 - DNA, 31 bp, Artificial Sequence
  Description of Artificial Sequence: Synthetic oligonucleotide
cgcatgaacctggcctcctcttttgtgaatg

SEQ ID NO: 136964 - DNA, 31 bp, Artificial Sequence
  Description of Artificial Sequence: Synthetic oligonucleotide
gcatgaacctggcctcctcttttgtgaatgg

SEQ ID NO: 136965 - DNA, 31 bp, Artificial Sequence
  Description of Artificial Sequence: Synthetic oligonucleotide
catgaacctggcctcctcttttgtgaatggc

SEQ ID NO: 136966 - DNA, 34 bp, Artificial Sequence
  Description of Artificial Sequence: Synthetic oligonucleotide
atgaacctggcctcctcttttgtgaatggctttg

SEQ ID NO: 136967 - DNA, 33 bp, Artificial Sequence
  Description of Artificial Sequence: Synthetic oligonucleotide
tgaacctggcctcctcttttgtgaatggctttg

SEQ ID NO: 136968 - DNA, 32 bp, Artificial Sequence
  Description of Artificial Sequence: Synthetic oligonucleotide
gaacctggcctcctcttttgtgaatggctttg

SEQ ID NO: 136969 - DNA, 33 bp, Artificial Sequence
  Description of Artificial Sequence: Synthetic oligonucleotide
aacctggcctcctcttttgtgaatggctttgtg

SEQ ID NO: 136970 - DNA, 32 bp, Artificial Sequence
  Description of Artificial Sequence: Synthetic oligonucleotide
acctggcctcctcttttgtgaatggctttgtg

SEQ ID NO: 136971 - DNA, 31 bp, Artificial Sequence
  Description of Artificial Sequence: Synthetic oligonucleotide
cctggcctcctcttttgtgaatggctttgtg

SEQ ID NO: 136972 - DNA, 34 bp, Artificial Sequence
  Description of Artificial Sequence: Synthetic oligonucleotide
ctggcctcctcttttgtgaatggctttgtgaatg

SEQ ID NO: 136973 - DNA, 34 bp, Artificial Sequence
  Description of Artificial Sequence: Synthetic oligonucleotide
tggcctcctcttttgtgaatggctttgtgaatgc

SEQ ID NO: 136974 - DNA, 33 bp, Artificial Sequence
  Description of Artificial Sequence: Synthetic oligonucleotide
ggcctcctcttttgtgaatggctttgtgaatgc

SEQ ID NO: 136975 - DNA, 34 bp, Artificial Sequence
  Description of Artificial Sequence: Synthetic oligonucleotide
gcctcctcttttgtgaatggctttgtgaatgcag

SEQ ID NO: 136976 - DNA, 34 bp, Artificial Sequence
  Description of Artificial Sequence: Synthetic oligonucleotide
cctcctcttttgtgaatggctttgtgaatgcagc

SEQ ID NO: 136977 - DNA, 38 bp, Artificial Sequence
  Description of Artificial Sequence: Synthetic oligonucleotide
ctcctcttttgtgaatggctttgtgaatgcagcttttg

SEQ ID NO: 136978 - DNA, 38 bp, Artificial Sequence
  Description of Artificial Sequence: Synthetic oligonucleotide
tcctcttttgtgaatggctttgtgaatgcagcttttgg

SEQ ID NO: 136979 - DNA, 37 bp, Artificial Sequence
  Description of Artificial Sequence: Synthetic oligonucleotide
cctcttttgtgaatggctttgtgaatgcagcttttgg

SEQ ID NO: 136980 - DNA, 37 bp, Artificial Sequence
  Description of Artificial Sequence: Synthetic oligonucleotide
ctcttttgtgaatggctttgtgaatgcagcttttggc

SEQ ID NO: 136981 - DNA, 37 bp, Artificial Sequence
  Description of Artificial Sequence: Synthetic oligonucleotide
tcttttgtgaatggctttgtgaatgcagcttttggcc

SEQ ID NO: 136982 - DNA, 36 bp, Artificial Sequence
  Description of Artificial Sequence: Synthetic oligonucleotide
cttttgtgaatggctttgtgaatgcagcttttggcc

SEQ ID NO: 136983 - DNA, 38 bp, Artificial Sequence
  Description of Artificial Sequence: Synthetic oligonucleotide
ttttgtgaatggctttgtgaatgcagcttttggccaag

SEQ ID NO: 136984 - DNA, 37 bp, Artificial Sequence
  Description of Artificial Sequence: Synthetic oligonucleotide
tttgtgaatggctttgtgaatgcagcttttggccaag

SEQ ID NO: 136985 - DNA, 36 bp, Artificial Sequence
  Description of Artificial Sequence: Synthetic oligonucleotide
ttgtgaatggctttgtgaatgcagcttttggccaag

SEQ ID NO: 136986 - DNA, 35 bp, Artificial Sequence
  Description of Artificial Sequence: Synthetic oligonucleotide
tgtgaatggctttgtgaatgcagcttttggccaag

SEQ ID NO: 136987 - DNA, 34 bp, Artificial Sequence
  Description of Artificial Sequence: Synthetic oligonucleotide
gtgaatggctttgtgaatgcagcttttggccaag

SEQ ID NO: 136988 - DNA, 35 bp, Artificial Sequence
  Description of Artificial Sequence: Synthetic oligonucleotide
tgaatggctttgtgaatgcagcttttggccaagac

SEQ ID NO: 136989 - DNA, 34 bp, Artificial Sequence
  Description of Artificial Sequence: Synthetic oligonucleotide
gaatggctttgtgaatgcagcttttggccaagac

SEQ ID NO: 136990 - DNA, 36 bp, Artificial Sequence
  Description of Artificial Sequence: Synthetic oligonucleotide
aatggctttgtgaatgcagcttttggccaagacaag

SEQ ID NO: 136991 - DNA, 35 bp, Artificial Sequence
  Description of Artificial Sequence: Synthetic oligonucleotide
atggctttgtgaatgcagcttttggccaagacaag

SEQ ID NO: 136992 - DNA, 34 bp, Artificial Sequence
  Description of Artificial Sequence: Synthetic oligonucleotide
tggctttgtgaatgcagcttttggccaagacaag

SEQ ID NO: 136993 - DNA, 33 bp, Artificial Sequence
  Description of Artificial Sequence: Synthetic oligonucleotide
ggctttgtgaatgcagcttttggccaagacaag

SEQ ID NO: 136994 - DNA, 33 bp, Artificial Sequence
  Description of Artificial Sequence: Synthetic oligonucleotide
gctttgtgaatgcagcttttggccaagacaagc

SEQ ID NO: 136995 - DNA, 34 bp, Artificial Sequence
  Description of Artificial Sequence: Synthetic oligonucleotide
ctttgtgaatgcagcttttggccaagacaagctg

SEQ ID NO: 136996 - DNA, 34 bp, Artificial Sequence
  Description of Artificial Sequence: Synthetic oligonucleotide
tttgtgaatgcagcttttggccaagacaagctgc

SEQ ID NO: 136997 - DNA, 33 bp, Artificial Sequence
  Description of Artificial Sequence: Synthetic oligonucleotide
ttgtgaatgcagcttttggccaagacaagctgc

SEQ ID NO: 136998 - DNA, 32 bp, Artificial Sequence
  Description of Artificial Sequence: Synthetic oligonucleotide
tgtgaatgcagcttttggccaagacaagctgc

SEQ ID NO: 136999 - DNA, 31 bp, Artificial Sequence
  Description of Artificial Sequence: Synthetic oligonucleotide
gtgaatgcagcttttggccaagacaagctgc

SEQ ID NO: 137000 - DNA, 34 bp, Artificial Sequence
  Description of Artificial Sequence: Synthetic oligonucleotide
tgaatgcagcttttggccaagacaagctgctaac

SEQ ID NO: 137001 - DNA, 33 bp, Artificial Sequence
  Description of Artificial Sequence: Synthetic oligonucleotide
gaatgcagcttttggccaagacaagctgctaac

SEQ ID NO: 137002 - DNA, 34 bp, Artificial Sequence
  Description of Artificial Sequence: Synthetic oligonucleotide
aatgcagcttttggccaagacaagctgctaacag

SEQ ID NO: 137003 - DNA, 33 bp, Artificial Sequence
  Description of Artificial Sequence: Synthetic oligonucleotide
atgcagcttttggccaagacaagctgctaacag

SEQ ID NO: 137004 - DNA, 32 bp, Artificial Sequence
  Description of Artificial Sequence: Synthetic oligonucleotide
tgcagcttttggccaagacaagctgctaacag

SEQ ID NO: 137005 - DNA, 31 bp, Artificial Sequence
  Description of Artificial Sequence: Synthetic oligonucleotide
gcagcttttggccaagacaagctgctaacag

SEQ ID NO: 137006 - DNA, 33 bp, Artificial Sequence
  Description of Artificial Sequence: Synthetic oligonucleotide
cagcttttggccaagacaagctgctaacagatg

SEQ ID NO: 137007 - DNA, 35 bp, Artificial Sequence
  Description of Artificial Sequence: Synthetic oligonucleotide
agcttttggccaagacaagctgctaacagatgatg

SEQ ID NO: 137008 - DNA, 34 bp, Artificial Sequence
  Description of Artificial Sequence: Synthetic oligonucleotide
gcttttggccaagacaagctgctaacagatgatg

SEQ ID NO: 137009 - DNA, 34 bp, Artificial Sequence
  Description of Artificial Sequence: Synthetic oligonucleotide
cttttggccaagacaagctgctaacagatgatgg

SEQ ID NO: 137010 - DNA, 34 bp, Artificial Sequence
  Description of Artificial Sequence: Synthetic oligonucleotide
ttttggccaagacaagctgctaacagatgatggc

SEQ ID NO: 137011 - DNA, 33 bp, Artificial Sequence
  Description of Artificial Sequence: Synthetic oligonucleotide
tttggccaagacaagctgctaacagatgatggc

SEQ ID NO: 137012 - DNA, 32 bp, Artificial Sequence
  Description of Artificial Sequence: Synthetic oligonucleotide
ttggccaagacaagctgctaacagatgatggc

SEQ ID NO: 137013 - DNA, 31 bp, Artificial Sequence
  Description of Artificial Sequence: Synthetic oligonucleotide
tggccaagacaagctgctaacagatgatggc

SEQ ID NO: 137014 - DNA, 30 bp, Artificial Sequence
  Description of Artificial Sequence: Synthetic oligonucleotide
ggccaagacaagctgctaacagatgatggc

SEQ ID NO: 137015 - DNA, 32 bp, Artificial Sequence
  Description of Artificial Sequence: Synthetic oligonucleotide
gccaagacaagctgctaacagatgatggcaac

SEQ ID NO: 137016 - DNA, 36 bp, Artificial Sequence
  Description of Artificial Sequence: Synthetic oligonucleotide
ccaagacaagctgctaacagatgatggcaacaaatg

SEQ ID NO: 137017 - DNA, 36 bp, Artificial Sequence
  Description of Artificial Sequence: Synthetic oligonucleotide
caagacaagctgctaacagatgatggcaacaaatgg

SEQ ID NO: 137018 - DNA, 36 bp, Artificial Sequence
  Description of Artificial Sequence: Synthetic oligonucleotide
aagacaagctgctaacagatgatggcaacaaatggc

SEQ ID NO: 137019 - DNA, 35 bp, Artificial Sequence
  Description of Artificial Sequence: Synthetic oligonucleotide
agacaagctgctaacagatgatggcaacaaatggc

SEQ ID NO: 137020 - DNA, 34 bp, Artificial Sequence
  Description of Artificial Sequence: Synthetic oligonucleotide
gacaagctgctaacagatgatggcaacaaatggc

SEQ ID NO: 137021 - DNA, 38 bp, Artificial Sequence
  Description of Artificial Sequence: Synthetic oligonucleotide
acaagctgctaacagatgatggcaacaaatggctttac

SEQ ID NO: 137022 - DNA, 37 bp, Artificial Sequence
  Description of Artificial Sequence: Synthetic oligonucleotide
caagctgctaacagatgatggcaacaaatggctttac

SEQ ID NO: 137023 - DNA, 39 bp, Artificial Sequence
  Description of Artificial Sequence: Synthetic oligonucleotide
aagctgctaacagatgatggcaacaaatggctttacaag

SEQ ID NO: 137024 - DNA, 38 bp, Artificial Sequence
  Description of Artificial Sequence: Synthetic oligonucleotide
agctgctaacagatgatggcaacaaatggctttacaag

SEQ ID NO: 137025 - DNA, 37 bp, Artificial Sequence
  Description of Artificial Sequence: Synthetic oligonucleotide
gctgctaacagatgatggcaacaaatggctttacaag

SEQ ID NO: 137026 - DNA, 39 bp, Artificial Sequence
  Description of Artificial Sequence: Synthetic oligonucleotide
ctgctaacagatgatggcaacaaatggctttacaagaac

SEQ ID NO: 137027 - DNA, 41 bp, Artificial Sequence
  Description of Artificial Sequence: Synthetic oligonucleotide
tgctaacagatgatggcaacaaatggctttacaagaacaag

SEQ ID NO: 137028 - DNA, 40 bp, Artificial Sequence
  Description of Artificial Sequence: Synthetic oligonucleotide
gctaacagatgatggcaacaaatggctttacaagaacaag

SEQ ID NO: 137029 - DNA, 40 bp, Artificial Sequence
  Description of Artificial Sequence: Synthetic oligonucleotide
ctaacagatgatggcaacaaatggctttacaagaacaagg

SEQ ID NO: 137030 - DNA, 41 bp, Artificial Sequence
  Description of Artificial Sequence: Synthetic oligonucleotide
taacagatgatggcaacaaatggctttacaagaacaaggac

SEQ ID NO: 137031 - DNA, 40 bp, Artificial Sequence
  Description of Artificial Sequence: Synthetic oligonucleotide
aacagatgatggcaacaaatggctttacaagaacaaggac

SEQ ID NO: 137032 - DNA, 39 bp, Artificial Sequence
  Description of Artificial Sequence: Synthetic oligonucleotide
acagatgatggcaacaaatggctttacaagaacaaggac

SEQ ID NO: 137033 - DNA, 38 bp, Artificial Sequence
  Description of Artificial Sequence: Synthetic oligonucleotide
cagatgatggcaacaaatggctttacaagaacaaggac

SEQ ID NO: 137034 - DNA, 38 bp, Artificial Sequence
  Description of Artificial Sequence: Synthetic oligonucleotide
agatgatggcaacaaatggctttacaagaacaaggacc

SEQ ID NO: 137035 - DNA, 37 bp, Artificial Sequence
  Description of Artificial Sequence: Synthetic oligonucleotide
gatgatggcaacaaatggctttacaagaacaaggacc

SEQ ID NO: 137036 - DNA, 38 bp, Artificial Sequence
  Description of Artificial Sequence: Synthetic oligonucleotide
atgatggcaacaaatggctttacaagaacaaggaccac

SEQ ID NO: 137037 - DNA, 37 bp, Artificial Sequence
  Description of Artificial Sequence: Synthetic oligonucleotide
tgatggcaacaaatggctttacaagaacaaggaccac

SEQ ID NO: 137038 - DNA, 36 bp, Artificial Sequence
  Description of Artificial Sequence: Synthetic oligonucleotide
gatggcaacaaatggctttacaagaacaaggaccac

SEQ ID NO: 137039 - DNA, 36 bp, Artificial Sequence
  Description of Artificial Sequence: Synthetic oligonucleotide
atggcaacaaatggctttacaagaacaaggaccacg

SEQ ID NO: 137040 - DNA, 35 bp, Artificial Sequence
  Description of Artificial Sequence: Synthetic oligonucleotide
tggcaacaaatggctttacaagaacaaggaccacg

SEQ ID NO: 137041 - DNA, 34 bp, Artificial Sequence
  Description of Artificial Sequence: Synthetic oligonucleotide
ggcaacaaatggctttacaagaacaaggaccacg

SEQ ID NO: 137042 - DNA, 34 bp, Artificial Sequence
  Description of Artificial Sequence: Synthetic oligonucleotide
gcaacaaatggctttacaagaacaaggaccacgg

SEQ ID NO: 137043 - DNA, 37 bp, Artificial Sequence
  Description of Artificial Sequence: Synthetic oligonucleotide
caacaaatggctttacaagaacaaggaccacggaatg

SEQ ID NO: 137044 - DNA, 39 bp, Artificial Sequence
  Description of Artificial Sequence: Synthetic oligonucleotide
aacaaatggctttacaagaacaaggaccacggaatgttg

SEQ ID NO: 137045 - DNA, 38 bp, Artificial Sequence
  Description of Artificial Sequence: Synthetic oligonucleotide
acaaatggctttacaagaacaaggaccacggaatgttg

SEQ ID NO: 137046 - DNA, 37 bp, Artificial Sequence
  Description of Artificial Sequence: Synthetic oligonucleotide
caaatggctttacaagaacaaggaccacggaatgttg

SEQ ID NO: 137047 - DNA, 38 bp, Artificial Sequence
  Description of Artificial Sequence: Synthetic oligonucleotide
aaatggctttacaagaacaaggaccacggaatgttgag

SEQ ID NO: 137048 - DNA, 37 bp, Artificial Sequence
  Description of Artificial Sequence: Synthetic oligonucleotide
aatggctttacaagaacaaggaccacggaatgttgag

SEQ ID NO: 137049 - DNA, 36 bp, Artificial Sequence
  Description of Artificial Sequence: Synthetic oligonucleotide
atggctttacaagaacaaggaccacggaatgttgag

SEQ ID NO: 137050 - DNA, 35 bp, Artificial Sequence
  Description of Artificial Sequence: Synthetic oligonucleotide
tggctttacaagaacaaggaccacggaatgttgag

SEQ ID NO: 137051 - DNA, 34 bp, Artificial Sequence
  Description of Artificial Sequence: Synthetic oligonucleotide
ggctttacaagaacaaggaccacggaatgttgag

SEQ ID NO: 137052 - DNA, 35 bp, Artificial Sequence
  Description of Artificial Sequence: Synthetic oligonucleotide
gctttacaagaacaaggaccacggaatgttgagtg

SEQ ID NO: 137053 - DNA, 35 bp, Artificial Sequence
  Description of Artificial Sequence: Synthetic oligonucleotide
ctttacaagaacaaggaccacggaatgttgagtgc

SEQ ID NO: 137054 - DNA, 36 bp, Artificial Sequence
  Description of Artificial Sequence: Synthetic oligonucleotide
tttacaagaacaaggaccacggaatgttgagtgcag

SEQ ID NO: 137055 - DNA, 35 bp, Artificial Sequence
  Description of Artificial Sequence: Synthetic oligonucleotide
ttacaagaacaaggaccacggaatgttgagtgcag

SEQ ID NO: 137056 - DNA, 34 bp, Artificial Sequence
  Description of Artificial Sequence: Synthetic oligonucleotide
tacaagaacaaggaccacggaatgttgagtgcag

SEQ ID NO: 137057 - DNA, 33 bp, Artificial Sequence
  Description of Artificial Sequence: Synthetic oligonucleotide
acaagaacaaggaccacggaatgttgagtgcag

SEQ ID NO: 137058 - DNA, 32 bp, Artificial Sequence
  Description of Artificial Sequence: Synthetic oligonucleotide
caagaacaaggaccacggaatgttgagtgcag

SEQ ID NO: 137059 - DNA, 32 bp, Artificial Sequence
  Description of Artificial Sequence: Synthetic oligonucleotide
aagaacaaggaccacggaatgttgagtgcagc

SEQ ID NO: 137060 - DNA, 31 bp, Artificial Sequence
  Description of Artificial Sequence: Synthetic oligonucleotide
agaacaaggaccacggaatgttgagtgcagc

SEQ ID NO: 137061 - DNA, 30 bp, Artificial Sequence
  Description of Artificial Sequence: Synthetic oligonucleotide
gaacaaggaccacggaatgttgagtgcagc

SEQ ID NO: 137062 - DNA, 31 bp, Artificial Sequence
  Description of Artificial Sequence: Synthetic oligonucleotide
aacaaggaccacggaatgttgagtgcagctg

SEQ ID NO: 137063 - DNA, 30 bp, Artificial Sequence
  Description of Artificial Sequence: Synthetic oligonucleotide
acaaggaccacggaatgttgagtgcagctg

SEQ ID NO: 137064 - DNA, 29 bp, Artificial Sequence
  Description of Artificial Sequence: Synthetic oligonucleotide
caaggaccacggaatgttgagtgcagctg

SEQ ID NO: 137065 - DNA, 29 bp, Artificial Sequence
  Description of Artificial Sequence: Synthetic oligonucleotide
aaggaccacggaatgttgagtgcagctgc

SEQ ID NO: 137066 - DNA, 28 bp, Artificial Sequence
  Description of Artificial Sequence: Synthetic oligonucleotide
aggaccacggaatgttgagtgcagctgc

SEQ ID NO: 137067 - DNA, 27 bp, Artificial Sequence
  Description of Artificial Sequence: Synthetic oligonucleotide
ggaccacggaatgttgagtgcagctgc

SEQ ID NO: 137068 - DNA, 29 bp, Artificial Sequence
  Description of Artificial Sequence: Synthetic oligonucleotide
gaccacggaatgttgagtgcagctgcatc

SEQ ID NO: 137069 - DNA, 30 bp, Artificial Sequence
  Description of Artificial Sequence: Synthetic oligonucleotide
accacggaatgttgagtgcagctgcatctc

SEQ ID NO: 137070 - DNA, 29 bp, Artificial Sequence
  Description of Artificial Sequence: Synthetic oligonucleotide
ccacggaatgttgagtgcagctgcatctc

SEQ ID NO: 137071 - DNA, 31 bp, Artificial Sequence
  Description of Artificial Sequence: Synthetic oligonucleotide
cacggaatgttgagtgcagctgcatctcttg

SEQ ID NO: 137072 - DNA, 31 bp, Artificial Sequence
  Description of Artificial Sequence: Synthetic oligonucleotide
acggaatgttgagtgcagctgcatctcttgg

SEQ ID NO: 137073 - DNA, 30 bp, Artificial Sequence
  Description of Artificial Sequence: Synthetic oligonucleotide
cggaatgttgagtgcagctgcatctcttgg

SEQ ID NO: 137074 - DNA, 30 bp, Artificial Sequence
  Description of Artificial Sequence: Synthetic oligonucleotide
ggaatgttgagtgcagctgcatctcttggg

SEQ ID NO: 137075 - DNA, 32 bp, Artificial Sequence
  Description of Artificial Sequence: Synthetic oligonucleotide
gaatgttgagtgcagctgcatctcttgggatg

SEQ ID NO: 137076 - DNA, 35 bp, Artificial Sequence
  Description of Artificial Sequence: Synthetic oligonucleotide
aatgttgagtgcagctgcatctcttgggatgattc

SEQ ID NO: 137077 - DNA, 34 bp, Artificial Sequence
  Description of Artificial Sequence: Synthetic oligonucleotide
atgttgagtgcagctgcatctcttgggatgattc

SEQ ID NO: 137078 - DNA, 33 bp, Artificial Sequence
  Description of Artificial Sequence: Synthetic oligonucleotide
tgttgagtgcagctgcatctcttgggatgattc

SEQ ID NO: 137079 - DNA, 32 bp, Artificial Sequence
  Description of Artificial Sequence: Synthetic oligonucleotide
gttgagtgcagctgcatctcttgggatgattc

SEQ ID NO: 137080 - DNA, 33 bp, Artificial Sequence
  Description of Artificial Sequence: Synthetic oligonucleotide
ttgagtgcagctgcatctcttgggatgattctg

SEQ ID NO: 137081 - DNA, 32 bp, Artificial Sequence
  Description of Artificial Sequence: Synthetic oligonucleotide
tgagtgcagctgcatctcttgggatgattctg

SEQ ID NO: 137082 - DNA, 31 bp, Artificial Sequence
  Description of Artificial Sequence: Synthetic oligonucleotide
gagtgcagctgcatctcttgggatgattctg

SEQ ID NO: 137083 - DNA, 31 bp, Artificial Sequence
  Description of Artificial Sequence: Synthetic oligonucleotide
agtgcagctgcatctcttgggatgattctgc

SEQ ID NO: 137084 - DNA, 30 bp, Artificial Sequence
  Description of Artificial Sequence: Synthetic oligonucleotide
gtgcagctgcatctcttgggatgattctgc

SEQ ID NO: 137085 - DNA, 31 bp, Artificial Sequence
  Description of Artificial Sequence: Synthetic oligonucleotide
tgcagctgcatctcttgggatgattctgctg

SEQ ID NO: 137086 - DNA, 30 bp, Artificial Sequence
  Description of Artificial Sequence: Synthetic oligonucleotide
gcagctgcatctcttgggatgattctgctg

SEQ ID NO: 137087 - DNA, 31 bp, Artificial Sequence
  Description of Artificial Sequence: Synthetic oligonucleotide
cagctgcatctcttgggatgattctgctgtg

SEQ ID NO: 137088 - DNA, 31 bp, Artificial Sequence
  Description of Artificial Sequence: Synthetic oligonucleotide
agctgcatctcttgggatgattctgctgtgg

SEQ ID NO: 137089 - DNA, 30 bp, Artificial Sequence
  Description of Artificial Sequence: Synthetic oligonucleotide
gctgcatctcttgggatgattctgctgtgg

SEQ ID NO: 137090 - DNA, 30 bp, Artificial Sequence
  Description of Artificial Sequence: Synthetic oligonucleotide
ctgcatctcttgggatgattctgctgtggg

SEQ ID NO: 137091 - DNA, 32 bp, Artificial Sequence
  Description of Artificial Sequence: Synthetic oligonucleotide
tgcatctcttgggatgattctgctgtgggatg

SEQ ID NO: 137092 - DNA, 31 bp, Artificial Sequence
  Description of Artificial Sequence: Synthetic oligonucleotide
gcatctcttgggatgattctgctgtgggatg

SEQ ID NO: 137093 - DNA, 32 bp, Artificial Sequence
  Description of Artificial Sequence: Synthetic oligonucleotide
catctcttgggatgattctgctgtgggatgtg

SEQ ID NO: 137094 - DNA, 32 bp, Artificial Sequence
  Description of Artificial Sequence: Synthetic oligonucleotide
atctcttgggatgattctgctgtgggatgtgg

SEQ ID NO: 137095 - DNA, 31 bp, Artificial Sequence
  Description of Artificial Sequence: Synthetic oligonucleotide
tctcttgggatgattctgctgtgggatgtgg

SEQ ID NO: 137096 - DNA, 30 bp, Artificial Sequence
  Description of Artificial Sequence: Synthetic oligonucleotide
ctcttgggatgattctgctgtgggatgtgg

SEQ ID NO: 137097 - DNA, 32 bp, Artificial Sequence
  Description of Artificial Sequence: Synthetic oligonucleotide
tcttgggatgattctgctgtgggatgtggatg

SEQ ID NO: 137098 - DNA, 31 bp, Artificial Sequence
  Description of Artificial Sequence: Synthetic oligonucleotide
cttgggatgattctgctgtgggatgtggatg

SEQ ID NO: 137099 - DNA, 31 bp, Artificial Sequence
  Description of Artificial Sequence: Synthetic oligonucleotide
ttgggatgattctgctgtgggatgtggatgg

SEQ ID NO: 137100 - DNA, 30 bp, Artificial Sequence
  Description of Artificial Sequence: Synthetic oligonucleotide
tgggatgattctgctgtgggatgtggatgg

SEQ ID NO: 137101 - DNA, 29 bp, Artificial Sequence
  Description of Artificial Sequence: Synthetic oligonucleotide
gggatgattctgctgtgggatgtggatgg

SEQ ID NO: 137102 - DNA, 30 bp, Artificial Sequence
  Description of Artificial Sequence: Synthetic oligonucleotide
ggatgattctgctgtgggatgtggatggtg

SEQ ID NO: 137103 - DNA, 30 bp, Artificial Sequence
  Description of Artificial Sequence: Synthetic oligonucleotide
gatgattctgctgtgggatgtggatggtgg

SEQ ID NO: 137104 - DNA, 30 bp, Artificial Sequence
  Description of Artificial Sequence: Synthetic oligonucleotide
atgattctgctgtgggatgtggatggtggc

SEQ ID NO: 137105 - DNA, 29 bp, Artificial Sequence
  Description of Artificial Sequence: Synthetic oligonucleotide
tgattctgctgtgggatgtggatggtggc

SEQ ID NO: 137106 - DNA, 28 bp, Artificial Sequence
  Description of Artificial Sequence: Synthetic oligonucleotide
gattctgctgtgggatgtggatggtggc

SEQ ID NO: 137107 - DNA, 28 bp, Artificial Sequence
  Description of Artificial Sequence: Synthetic oligonucleotide
attctgctgtgggatgtggatggtggcc

SEQ ID NO: 137108 - DNA, 27 bp, Artificial Sequence
  Description of Artificial Sequence: Synthetic oligonucleotide
ttctgctgtgggatgtggatggtggcc

SEQ ID NO: 137109 - DNA, 27 bp, Artificial Sequence
  Description of Artificial Sequence: Synthetic oligonucleotide
tctgctgtgggatgtggatggtggcct

SEQ ID NO: 137110 - DNA, 26 bp, Artificial Sequence
  Description of Artificial Sequence: Synthetic oligonucleotide
ctgctgtgggatgtggatggtggcct

SEQ ID NO: 137111 - DNA, 27 bp, Artificial Sequence
  Description of Artificial Sequence: Synthetic oligonucleotide
tgctgtgggatgtggatggtggcctca

SEQ ID NO: 137112 - DNA, 26 bp, Artificial Sequence
  Description of Artificial Sequence: Synthetic oligonucleotide
gctgtgggatgtggatggtggcctca

SEQ ID NO: 137113 - DNA, 26 bp, Artificial Sequence
  Description of Artificial Sequence: Synthetic oligonucleotide
ctgtgggatgtggatggtggcctcac

SEQ ID NO: 137114 - DNA, 26 bp, Artificial Sequence
  Description of Artificial Sequence: Synthetic oligonucleotide
tgtgggatgtggatggtggcctcacc

SEQ ID NO: 137115 - DNA, 25 bp, Artificial Sequence
  Description of Artificial Sequence: Synthetic oligonucleotide
gtgggatgtggatggtggcctcacc

SEQ ID NO: 137116 - DNA, 26 bp, Artificial Sequence
  Description of Artificial Sequence: Synthetic oligonucleotide
tgggatgtggatggtggcctcaccca

SEQ ID NO: 137117 - DNA, 25 bp, Artificial Sequence
  Description of Artificial Sequence: Synthetic oligonucleotide
gggatgtggatggtggcctcaccca

SEQ ID NO: 137118 - DNA, 27 bp, Artificial Sequence
  Description of Artificial Sequence: Synthetic oligonucleotide
ggatgtggatggtggcctcacccagat

SEQ ID NO: 137119 - DNA, 28 bp, Artificial Sequence
  Description of Artificial Sequence: Synthetic oligonucleotide
gatgtggatggtggcctcacccagattg

SEQ ID NO: 137120 - DNA, 29 bp, Artificial Sequence
  Description of Artificial Sequence: Synthetic oligonucleotide
atgtggatggtggcctcacccagattgac

SEQ ID NO: 137121 - DNA, 28 bp, Artificial Sequence
  Description of Artificial Sequence: Synthetic oligonucleotide
tgtggatggtggcctcacccagattgac

SEQ ID NO: 137122 - DNA, 27 bp, Artificial Sequence
  Description of Artificial Sequence: Synthetic oligonucleotide
gtggatggtggcctcacccagattgac

SEQ ID NO: 137123 - DNA, 29 bp, Artificial Sequence
  Description of Artificial Sequence: Synthetic oligonucleotide
tggatggtggcctcacccagattgacaag

SEQ ID NO: 137124 - DNA, 28 bp, Artificial Sequence
  Description of Artificial Sequence: Synthetic oligonucleotide
ggatggtggcctcacccagattgacaag

SEQ ID NO: 137125 - DNA, 30 bp, Artificial Sequence
  Description of Artificial Sequence: Synthetic oligonucleotide
gatggtggcctcacccagattgacaagtac

SEQ ID NO: 137126 - DNA, 30 bp, Artificial Sequence
  Description of Artificial Sequence: Synthetic oligonucleotide
atggtggcctcacccagattgacaagtacc

SEQ ID NO: 137127 - DNA, 29 bp, Artificial Sequence
  Description of Artificial Sequence: Synthetic oligonucleotide
tggtggcctcacccagattgacaagtacc

SEQ ID NO: 137128 - DNA, 28 bp, Artificial Sequence
  Description of Artificial Sequence: Synthetic oligonucleotide
ggtggcctcacccagattgacaagtacc

SEQ ID NO: 137129 - DNA, 29 bp, Artificial Sequence
  Description of Artificial Sequence: Synthetic oligonucleotide
gtggcctcacccagattgacaagtacctg

SEQ ID NO: 137130 - DNA, 31 bp, Artificial Sequence
  Description of Artificial Sequence: Synthetic oligonucleotide
tggcctcacccagattgacaagtacctgtac

SEQ ID NO: 137131 - DNA, 30 bp, Artificial Sequence
  Description of Artificial Sequence: Synthetic oligonucleotide
ggcctcacccagattgacaagtacctgtac

SEQ ID NO: 137132 - DNA, 31 bp, Artificial Sequence
  Description of Artificial Sequence: Synthetic oligonucleotide
gcctcacccagattgacaagtacctgtactc

SEQ ID NO: 137133 - DNA, 31 bp, Artificial Sequence
  Description of Artificial Sequence: Synthetic oligonucleotide
cctcacccagattgacaagtacctgtactcc

SEQ ID NO: 137134 - DNA, 32 bp, Artificial Sequence
  Description of Artificial Sequence: Synthetic oligonucleotide
ctcacccagattgacaagtacctgtactcctc

SEQ ID NO: 137135 - DNA, 33 bp, Artificial Sequence
  Description of Artificial Sequence: Synthetic oligonucleotide
tcacccagattgacaagtacctgtactcctctg

SEQ ID NO: 137136 - DNA, 32 bp, Artificial Sequence
  Description of Artificial Sequence: Synthetic oligonucleotide
cacccagattgacaagtacctgtactcctctg

SEQ ID NO: 137137 - DNA, 33 bp, Artificial Sequence
  Description of Artificial Sequence: Synthetic oligonucleotide
acccagattgacaagtacctgtactcctctgag

SEQ ID NO: 137138 - DNA, 32 bp, Artificial Sequence
  Description of Artificial Sequence: Synthetic oligonucleotide
cccagattgacaagtacctgtactcctctgag

SEQ ID NO: 137139 - DNA, 32 bp, Artificial Sequence
  Description of Artificial Sequence: Synthetic oligonucleotide
ccagattgacaagtacctgtactcctctgagg

SEQ ID NO: 137140 - DNA, 33 bp, Artificial Sequence
  Description of Artificial Sequence: Synthetic oligonucleotide
cagattgacaagtacctgtactcctctgaggac

SEQ ID NO: 137141 - DNA, 35 bp, Artificial Sequence
  Description of Artificial Sequence: Synthetic oligonucleotide
agattgacaagtacctgtactcctctgaggactac

SEQ ID NO: 137142 - DNA, 34 bp, Artificial Sequence
  Description of Artificial Sequence: Synthetic oligonucleotide
gattgacaagtacctgtactcctctgaggactac

SEQ ID NO: 137143 - DNA, 39 bp, Artificial Sequence
  Description of Artificial Sequence: Synthetic oligonucleotide
attgacaagtacctgtactcctctgaggactacattaag

SEQ ID NO: 137144 - DNA, 38 bp, Artificial Sequence
  Description of Artificial Sequence: Synthetic oligonucleotide
ttgacaagtacctgtactcctctgaggactacattaag

SEQ ID NO: 137145 - DNA, 37 bp, Artificial Sequence
  Description of Artificial Sequence: Synthetic oligonucleotide
tgacaagtacctgtactcctctgaggactacattaag

SEQ ID NO: 137146 - DNA, 36 bp, Artificial Sequence
  Description of Artificial Sequence: Synthetic oligonucleotide
gacaagtacctgtactcctctgaggactacattaag

SEQ ID NO: 137147 - DNA, 37 bp, Artificial Sequence
  Description of Artificial Sequence: Synthetic oligonucleotide
acaagtacctgtactcctctgaggactacattaagtc

SEQ ID NO: 137148 - DNA, 36 bp, Artificial Sequence
  Description of Artificial Sequence: Synthetic oligonucleotide
caagtacctgtactcctctgaggactacattaagtc

SEQ ID NO: 137149 - DNA, 37 bp, Artificial Sequence
  Description of Artificial Sequence: Synthetic oligonucleotide
aagtacctgtactcctctgaggactacattaagtcag

SEQ ID NO: 137150 - DNA, 36 bp, Artificial Sequence
  Description of Artificial Sequence: Synthetic oligonucleotide
agtacctgtactcctctgaggactacattaagtcag

SEQ ID NO: 137151 - DNA, 35 bp, Artificial Sequence
  Description of Artificial Sequence: Synthetic oligonucleotide
gtacctgtactcctctgaggactacattaagtcag

SEQ ID NO: 137152 - DNA, 35 bp, Artificial Sequence
  Description of Artificial Sequence: Synthetic oligonucleotide
tacctgtactcctctgaggactacattaagtcagg

SEQ ID NO: 137153 - DNA, 34 bp, Artificial Sequence
  Description of Artificial Sequence: Synthetic oligonucleotide
acctgtactcctctgaggactacattaagtcagg

SEQ ID NO: 137154 - DNA, 33 bp, Artificial Sequence
  Description of Artificial Sequence: Synthetic oligonucleotide
cctgtactcctctgaggactacattaagtcagg

SEQ ID NO: 137155 - DNA, 34 bp, Artificial Sequence
  Description of Artificial Sequence: Synthetic oligonucleotide
ctgtactcctctgaggactacattaagtcaggag

SEQ ID NO: 137156 - DNA, 34 bp, Artificial Sequence
  Description of Artificial Sequence: Synthetic oligonucleotide
tgtactcctctgaggactacattaagtcaggagc

SEQ ID NO: 137157 - DNA, 33 bp, Artificial Sequence
  Description of Artificial Sequence: Synthetic oligonucleotide
gtactcctctgaggactacattaagtcaggagc

SEQ ID NO: 137158 - DNA, 34 bp, Artificial Sequence
  Description of Artificial Sequence: Synthetic oligonucleotide
tactcctctgaggactacattaagtcaggagctc

SEQ ID NO: 137159 - DNA, 33 bp, Artificial Sequence
  Description of Artificial Sequence: Synthetic oligonucleotide
actcctctgaggactacattaagtcaggagctc

SEQ ID NO: 137160 - DNA, 32 bp, Artificial Sequence
  Description of Artificial Sequence: Synthetic oligonucleotide
ctcctctgaggactacattaagtcaggagctc

SEQ ID NO: 137161 - DNA, 34 bp, Artificial Sequence
  Description of Artificial Sequence: Synthetic oligonucleotide
tcctctgaggactacattaagtcaggagctcttc

SEQ ID NO: 137162 - DNA, 33 bp, Artificial Sequence
  Description of Artificial Sequence: Synthetic oligonucleotide
cctctgaggactacattaagtcaggagctcttc

SEQ ID NO: 137163 - DNA, 35 bp, Artificial Sequence
  Description of Artificial Sequence: Synthetic oligonucleotide
ctctgaggactacattaagtcaggagctcttcttg

SEQ ID NO: 137164 - DNA, 35 bp, Artificial Sequence
  Description of Artificial Sequence: Synthetic oligonucleotide
tctgaggactacattaagtcaggagctcttcttgc

SEQ ID NO: 137165 - DNA, 34 bp, Artificial Sequence
  Description of Artificial Sequence: Synthetic oligonucleotide
ctgaggactacattaagtcaggagctcttcttgc

SEQ ID NO: 137166 - DNA, 34 bp, Artificial Sequence
  Description of Artificial Sequence: Synthetic oligonucleotide
tgaggactacattaagtcaggagctcttcttgcc

SEQ ID NO: 137167 - DNA, 33 bp, Artificial Sequence
  Description of Artificial Sequence: Synthetic oligonucleotide
gaggactacattaagtcaggagctcttcttgcc

SEQ ID NO: 137168 - DNA, 34 bp, Artificial Sequence
  Description of Artificial Sequence: Synthetic oligonucleotide
aggactacattaagtcaggagctcttcttgcctg

SEQ ID NO: 137169 - DNA, 33 bp, Artificial Sequence
  Description of Artificial Sequence: Synthetic oligonucleotide
ggactacattaagtcaggagctcttcttgcctg

SEQ ID NO: 137170 - DNA, 34 bp, Artificial Sequence
  Description of Artificial Sequence: Synthetic oligonucleotide
gactacattaagtcaggagctcttcttgcctgtg

SEQ ID NO: 137171 - DNA, 34 bp, Artificial Sequence
  Description of Artificial Sequence: Synthetic oligonucleotide
actacattaagtcaggagctcttcttgcctgtgg

SEQ ID NO: 137172 - DNA, 33 bp, Artificial Sequence
  Description of Artificial Sequence: Synthetic oligonucleotide
ctacattaagtcaggagctcttcttgcctgtgg

SEQ ID NO: 137173 - DNA, 33 bp, Artificial Sequence
  Description of Artificial Sequence: Synthetic oligonucleotide
tacattaagtcaggagctcttcttgcctgtggc

SEQ ID NO: 137174 - DNA, 32 bp, Artificial Sequence
  Description of Artificial Sequence: Synthetic oligonucleotide
acattaagtcaggagctcttcttgcctgtggc

SEQ ID NO: 137175 - DNA, 31 bp, Artificial Sequence
  Description of Artificial Sequence: Synthetic oligonucleotide
cattaagtcaggagctcttcttgcctgtggc

SEQ ID NO: 137176 - DNA, 34 bp, Artificial Sequence
  Description of Artificial Sequence: Synthetic oligonucleotide
attaagtcaggagctcttcttgcctgtggcatag

SEQ ID NO: 137177 - DNA, 33 bp, Artificial Sequence
  Description of Artificial Sequence: Synthetic oligonucleotide
ttaagtcaggagctcttcttgcctgtggcatag

SEQ ID NO: 137178 - DNA, 32 bp, Artificial Sequence
  Description of Artificial Sequence: Synthetic oligonucleotide
taagtcaggagctcttcttgcctgtggcatag

SEQ ID NO: 137179 - DNA, 31 bp, Artificial Sequence
  Description of Artificial Sequence: Synthetic oligonucleotide
aagtcaggagctcttcttgcctgtggcatag

SEQ ID NO: 137180 - DNA, 30 bp, Artificial Sequence
  Description of Artificial Sequence: Synthetic oligonucleotide
agtcaggagctcttcttgcctgtggcatag

SEQ ID NO: 137181 - DNA, 29 bp, Artificial Sequence
  Description of Artificial Sequence: Synthetic oligonucleotide
gtcaggagctcttcttgcctgtggcatag

SEQ ID NO: 137182 - DNA, 30 bp, Artificial Sequence
  Description of Artificial Sequence: Synthetic oligonucleotide
tcaggagctcttcttgcctgtggcatagtg

SEQ ID NO: 137183 - DNA, 29 bp, Artificial Sequence
  Description of Artificial Sequence: Synthetic oligonucleotide
caggagctcttcttgcctgtggcatagtg

SEQ ID NO: 137184 - DNA, 31 bp, Artificial Sequence
  Description of Artificial Sequence: Synthetic oligonucleotide
aggagctcttcttgcctgtggcatagtgaac

SEQ ID NO: 137185 - DNA, 30 bp, Artificial Sequence
  Description of Artificial Sequence: Synthetic oligonucleotide
ggagctcttcttgcctgtggcatagtgaac

SEQ ID NO: 137186 - DNA, 31 bp, Artificial Sequence
  Description of Artificial Sequence: Synthetic oligonucleotide
gagctcttcttgcctgtggcatagtgaactc

SEQ ID NO: 137187 - DNA, 32 bp, Artificial Sequence
  Description of Artificial Sequence: Synthetic oligonucleotide
agctcttcttgcctgtggcatagtgaactctg

SEQ ID NO: 137188 - DNA, 31 bp, Artificial Sequence
  Description of Artificial Sequence: Synthetic oligonucleotide
gctcttcttgcctgtggcatagtgaactctg

SEQ ID NO: 137189 - DNA, 31 bp, Artificial Sequence
  Description of Artificial Sequence: Synthetic oligonucleotide
ctcttcttgcctgtggcatagtgaactctgg

SEQ ID NO: 137190 - DNA, 31 bp, Artificial Sequence
  Description of Artificial Sequence: Synthetic oligonucleotide
tcttcttgcctgtggcatagtgaactctggg

SEQ ID NO: 137191 - DNA, 30 bp, Artificial Sequence
  Description of Artificial Sequence: Synthetic oligonucleotide
cttcttgcctgtggcatagtgaactctggg

SEQ ID NO: 137192 - DNA, 30 bp, Artificial Sequence
  Description of Artificial Sequence: Synthetic oligonucleotide
ttcttgcctgtggcatagtgaactctgggg

SEQ ID NO: 137193 - DNA, 29 bp, Artificial Sequence
  Description of Artificial Sequence: Synthetic oligonucleotide
tcttgcctgtggcatagtgaactctgggg

SEQ ID NO: 137194 - DNA, 28 bp, Artificial Sequence
  Description of Artificial Sequence: Synthetic oligonucleotide
cttgcctgtggcatagtgaactctgggg

SEQ ID NO: 137195 - DNA, 29 bp, Artificial Sequence
  Description of Artificial Sequence: Synthetic oligonucleotide
ttgcctgtggcatagtgaactctggggtc

SEQ ID NO: 137196 - DNA, 28 bp, Artificial Sequence
  Description of Artificial Sequence: Synthetic oligonucleotide
tgcctgtggcatagtgaactctggggtc

SEQ ID NO: 137197 - DNA, 27 bp, Artificial Sequence
  Description of Artificial Sequence: Synthetic oligonucleotide
gcctgtggcatagtgaactctggggtc

SEQ ID NO: 137198 - DNA, 27 bp, Artificial Sequence
  Description of Artificial Sequence: Synthetic oligonucleotide
cctgtggcatagtgaactctggggtcc

SEQ ID NO: 137199 - DNA, 27 bp, Artificial Sequence
  Description of Artificial Sequence: Synthetic oligonucleotide
ctgtggcatagtgaactctggggtccg

SEQ ID NO: 137200 - DNA, 27 bp, Artificial Sequence
  Description of Artificial Sequence: Synthetic oligonucleotide
tgtggcatagtgaactctggggtccgg

SEQ ID NO: 137201 - DNA, 27 bp, Artificial Sequence
  Description of Artificial Sequence: Synthetic oligonucleotide
gtggcatagtgaactctggggtccgga

SEQ ID NO: 137202 - DNA, 29 bp, Artificial Sequence
  Description of Artificial Sequence: Synthetic oligonucleotide
tggcatagtgaactctggggtccggaatg

SEQ ID NO: 137203 - DNA, 28 bp, Artificial Sequence
  Description of Artificial Sequence: Synthetic oligonucleotide
ggcatagtgaactctggggtccggaatg

SEQ ID NO: 137204 - DNA, 29 bp, Artificial Sequence
  Description of Artificial Sequence: Synthetic oligonucleotide
gcatagtgaactctggggtccggaatgag

SEQ ID NO: 137205 - DNA, 30 bp, Artificial Sequence
  Description of Artificial Sequence: Synthetic oligonucleotide
catagtgaactctggggtccggaatgagtg

SEQ ID NO: 137206 - DNA, 31 bp, Artificial Sequence
  Description of Artificial Sequence: Synthetic oligonucleotide
atagtgaactctggggtccggaatgagtgtg

SEQ ID NO: 137207 - DNA, 30 bp, Artificial Sequence
  Description of Artificial Sequence: Synthetic oligonucleotide
tagtgaactctggggtccggaatgagtgtg

SEQ ID NO: 137208 - DNA, 29 bp, Artificial Sequence
  Description of Artificial Sequence: Synthetic oligonucleotide
agtgaactctggggtccggaatgagtgtg

SEQ ID NO: 137209 - DNA, 28 bp, Artificial Sequence
  Description of Artificial Sequence: Synthetic oligonucleotide
gtgaactctggggtccggaatgagtgtg

SEQ ID NO: 137210 - DNA, 29 bp, Artificial Sequence
  Description of Artificial Sequence: Synthetic oligonucleotide
tgaactctggggtccggaatgagtgtgac

SEQ ID NO: 137211 - DNA, 28 bp, Artificial Sequence
  Description of Artificial Sequence: Synthetic oligonucleotide
gaactctggggtccggaatgagtgtgac

SEQ ID NO: 137212 - DNA, 28 bp, Artificial Sequence
  Description of Artificial Sequence: Synthetic oligonucleotide
aactctggggtccggaatgagtgtgacc

SEQ ID NO: 137213 - DNA, 27 bp, Artificial Sequence
  Description of Artificial Sequence: Synthetic oligonucleotide
actctggggtccggaatgagtgtgacc

SEQ ID NO: 137214 - DNA, 26 bp, Artificial Sequence
  Description of Artificial Sequence: Synthetic oligonucleotide
ctctggggtccggaatgagtgtgacc

SEQ ID NO: 137215 - DNA, 27 bp, Artificial Sequence
  Description of Artificial Sequence: Synthetic oligonucleotide
tctggggtccggaatgagtgtgaccct

SEQ ID NO: 137216 - DNA, 26 bp, Artificial Sequence
  Description of Artificial Sequence: Synthetic oligonucleotide
ctggggtccggaatgagtgtgaccct

SEQ ID NO: 137217 - DNA, 26 bp, Artificial Sequence
  Description of Artificial Sequence: Synthetic oligonucleotide
tggggtccggaatgagtgtgaccctg

SEQ ID NO: 137218 - DNA, 25 bp, Artificial Sequence
  Description of Artificial Sequence: Synthetic oligonucleotide
ggggtccggaatgagtgtgaccctg

SEQ ID NO: 137219 - DNA, 26 bp, Artificial Sequence
  Description of Artificial Sequence: Synthetic oligonucleotide
gggtccggaatgagtgtgaccctgct

SEQ ID NO: 137220 - DNA, 27 bp, Artificial Sequence
  Description of Artificial Sequence: Synthetic oligonucleotide
ggtccggaatgagtgtgaccctgctct

SEQ ID NO: 137221 - DNA, 27 bp, Artificial Sequence
  Description of Artificial Sequence: Synthetic oligonucleotide
gtccggaatgagtgtgaccctgctctg

SEQ ID NO: 137222 - DNA, 27 bp, Artificial Sequence
  Description of Artificial Sequence: Synthetic oligonucleotide
tccggaatgagtgtgaccctgctctgg

SEQ ID NO: 137223 - DNA, 26 bp, Artificial Sequence
  Description of Artificial Sequence: Synthetic oligonucleotide
ccggaatgagtgtgaccctgctctgg

SEQ ID NO: 137224 - DNA, 27 bp, Artificial Sequence
  Description of Artificial Sequence: Synthetic oligonucleotide
cggaatgagtgtgaccctgctctggca

SEQ ID NO: 137225 - DNA, 27 bp, Artificial Sequence
  Description of Artificial Sequence: Synthetic oligonucleotide
ggaatgagtgtgaccctgctctggcac

SEQ ID NO: 137226 - DNA, 28 bp, Artificial Sequence
  Description of Artificial Sequence: Synthetic oligonucleotide
gaatgagtgtgaccctgctctggcactg

SEQ ID NO: 137227 - DNA, 28 bp, Artificial Sequence
  Description of Artificial Sequence: Synthetic oligonucleotide
aatgagtgtgaccctgctctggcactgc

SEQ ID NO: 137228 - DNA, 27 bp, Artificial Sequence
  Description of Artificial Sequence: Synthetic oligonucleotide
atgagtgtgaccctgctctggcactgc

SEQ ID NO: 137229 - DNA, 27 bp, Artificial Sequence
  Description of Artificial Sequence: Synthetic oligonucleotide
tgagtgtgaccctgctctggcactgct

SEQ ID NO: 137230 - DNA, 26 bp, Artificial Sequence
  Description of Artificial Sequence: Synthetic oligonucleotide
gagtgtgaccctgctctggcactgct

SEQ ID NO: 137231 - DNA, 27 bp, Artificial Sequence
  Description of Artificial Sequence: Synthetic oligonucleotide
agtgtgaccctgctctggcactgctct

SEQ ID NO: 137232 - DNA, 26 bp, Artificial Sequence
  Description of Artificial Sequence: Synthetic oligonucleotide
gtgtgaccctgctctggcactgctct

SEQ ID NO: 137233 - DNA, 27 bp, Artificial Sequence
  Description of Artificial Sequence: Synthetic oligonucleotide
tgtgaccctgctctggcactgctctca

SEQ ID NO: 137234 - DNA, 26 bp, Artificial Sequence
  Description of Artificial Sequence: Synthetic oligonucleotide
gtgaccctgctctggcactgctctca

SEQ ID NO: 137235 - DNA, 27 bp, Artificial Sequence
  Description of Artificial Sequence: Synthetic oligonucleotide
tgaccctgctctggcactgctctcaga

SEQ ID NO: 137236 - DNA, 26 bp, Artificial Sequence
  Description of Artificial Sequence: Synthetic oligonucleotide
gaccctgctctggcactgctctcaga

SEQ ID NO: 137237 - DNA, 27 bp, Artificial Sequence
  Description of Artificial Sequence: Synthetic oligonucleotide
accctgctctggcactgctctcagact

SEQ ID NO: 137238 - DNA, 27 bp, Artificial Sequence
  Description of Artificial Sequence: Synthetic oligonucleotide
ccctgctctggcactgctctcagacta

SEQ ID NO: 137239 - DNA, 28 bp, Artificial Sequence
  Description of Artificial Sequence: Synthetic oligonucleotide
cctgctctggcactgctctcagactatg

SEQ ID NO: 137240 - DNA, 30 bp, Artificial Sequence
  Description of Artificial Sequence: Synthetic oligonucleotide
ctgctctggcactgctctcagactatgttc

SEQ ID NO: 137241 - DNA, 31 bp, Artificial Sequence
  Description of Artificial Sequence: Synthetic oligonucleotide
tgctctggcactgctctcagactatgttctc

SEQ ID NO: 137242 - DNA, 30 bp, Artificial Sequence
  Description of Artificial Sequence: Synthetic oligonucleotide
gctctggcactgctctcagactatgttctc

SEQ ID NO: 137243 - DNA, 30 bp, Artificial Sequence
  Description of Artificial Sequence: Synthetic oligonucleotide
ctctggcactgctctcagactatgttctcc

SEQ ID NO: 137244 - DNA, 31 bp, Artificial Sequence
  Description of Artificial Sequence: Synthetic oligonucleotide
tctggcactgctctcagactatgttctccac

SEQ ID NO: 137245 - DNA, 30 bp, Artificial Sequence
  Description of Artificial Sequence: Synthetic oligonucleotide
ctggcactgctctcagactatgttctccac

SEQ ID NO: 137246 - DNA, 32 bp, Artificial Sequence
  Description of Artificial Sequence: Synthetic oligonucleotide
tggcactgctctcagactatgttctccacaac

SEQ ID NO: 137247 - DNA, 31 bp, Artificial Sequence
  Description of Artificial Sequence: Synthetic oligonucleotide
ggcactgctctcagactatgttctccacaac

SEQ ID NO: 137248 - DNA, 32 bp, Artificial Sequence
  Description of Artificial Sequence: Synthetic oligonucleotide
gcactgctctcagactatgttctccacaacag

SEQ ID NO: 137249 - DNA, 32 bp, Artificial Sequence
  Description of Artificial Sequence: Synthetic oligonucleotide
cactgctctcagactatgttctccacaacagc

SEQ ID NO: 137250 - DNA, 34 bp, Artificial Sequence
  Description of Artificial Sequence: Synthetic oligonucleotide
actgctctcagactatgttctccacaacagcaac

SEQ ID NO: 137251 - DNA, 33 bp, Artificial Sequence
  Description of Artificial Sequence: Synthetic oligonucleotide
ctgctctcagactatgttctccacaacagcaac

SEQ ID NO: 137252 - DNA, 34 bp, Artificial Sequence
  Description of Artificial Sequence: Synthetic oligonucleotide
tgctctcagactatgttctccacaacagcaacac

SEQ ID NO: 137253 - DNA, 33 bp, Artificial Sequence
  Description of Artificial Sequence: Synthetic oligonucleotide
gctctcagactatgttctccacaacagcaacac

SEQ ID NO: 137254 - DNA, 33 bp, Artificial Sequence
  Description of Artificial Sequence: Synthetic oligonucleotide
ctctcagactatgttctccacaacagcaacacc

SEQ ID NO: 137255 - DNA, 35 bp, Artificial Sequence
  Description of Artificial Sequence: Synthetic oligonucleotide
tctcagactatgttctccacaacagcaacaccatg

SEQ ID NO: 137256 - DNA, 34 bp, Artificial Sequence
  Description of Artificial Sequence: Synthetic oligonucleotide
ctcagactatgttctccacaacagcaacaccatg

SEQ ID NO: 137257 - DNA, 35 bp, Artificial Sequence
  Description of Artificial Sequence: Synthetic oligonucleotide
tcagactatgttctccacaacagcaacaccatgag

SEQ ID NO: 137258 - DNA, 34 bp, Artificial Sequence
  Description of Artificial Sequence: Synthetic oligonucleotide
cagactatgttctccacaacagcaacaccatgag

SEQ ID NO: 137259 - DNA, 35 bp, Artificial Sequence
  Description of Artificial Sequence: Synthetic oligonucleotide
agactatgttctccacaacagcaacaccatgagac

SEQ ID NO: 137260 - DNA, 34 bp, Artificial Sequence
  Description of Artificial Sequence: Synthetic oligonucleotide
gactatgttctccacaacagcaacaccatgagac

SEQ ID NO: 137261 - DNA, 36 bp, Artificial Sequence
  Description of Artificial Sequence: Synthetic oligonucleotide
actatgttctccacaacagcaacaccatgagacttg

SEQ ID NO: 137262 - DNA, 35 bp, Artificial Sequence
  Description of Artificial Sequence: Synthetic oligonucleotide
ctatgttctccacaacagcaacaccatgagacttg

SEQ ID NO: 137263 - DNA, 35 bp, Artificial Sequence
  Description of Artificial Sequence: Synthetic oligonucleotide
tatgttctccacaacagcaacaccatgagacttgg

SEQ ID NO: 137264 - DNA, 34 bp, Artificial Sequence
  Description of Artificial Sequence: Synthetic oligonucleotide
atgttctccacaacagcaacaccatgagacttgg

SEQ ID NO: 137265 - DNA, 33 bp, Artificial Sequence
  Description of Artificial Sequence: Synthetic oligonucleotide
tgttctccacaacagcaacaccatgagacttgg

SEQ ID NO: 137266 - DNA, 32 bp, Artificial Sequence
  Description of Artificial Sequence: Synthetic oligonucleotide
gttctccacaacagcaacaccatgagacttgg

SEQ ID NO: 137267 - DNA, 34 bp, Artificial Sequence
  Description of Artificial Sequence: Synthetic oligonucleotide
ttctccacaacagcaacaccatgagacttggttc

SEQ ID NO: 137268 - DNA, 33 bp, Artificial Sequence
  Description of Artificial Sequence: Synthetic oligonucleotide
tctccacaacagcaacaccatgagacttggttc

SEQ ID NO: 137269 - DNA, 32 bp, Artificial Sequence
  Description of Artificial Sequence: Synthetic oligonucleotide
ctccacaacagcaacaccatgagacttggttc

SEQ ID NO: 137270 - DNA, 32 bp, Artificial Sequence
  Description of Artificial Sequence: Synthetic oligonucleotide
tccacaacagcaacaccatgagacttggttcc

SEQ ID NO: 137271 - DNA, 31 bp, Artificial Sequence
  Description of Artificial Sequence: Synthetic oligonucleotide
ccacaacagcaacaccatgagacttggttcc

SEQ ID NO: 137272 - DNA, 33 bp, Artificial Sequence
  Description of Artificial Sequence: Synthetic oligonucleotide
cacaacagcaacaccatgagacttggttccatc

SEQ ID NO: 137273 - DNA, 36 bp, Artificial Sequence
  Description of Artificial Sequence: Synthetic oligonucleotide
acaacagcaacaccatgagacttggttccatctttg

SEQ ID NO: 137274 - DNA, 35 bp, Artificial Sequence
  Description of Artificial Sequence: Synthetic oligonucleotide
caacagcaacaccatgagacttggttccatctttg

SEQ ID NO: 137275 - DNA, 35 bp, Artificial Sequence
  Description of Artificial Sequence: Synthetic oligonucleotide
aacagcaacaccatgagacttggttccatctttgg

SEQ ID NO: 137276 - DNA, 34 bp, Artificial Sequence
  Description of Artificial Sequence: Synthetic oligonucleotide
acagcaacaccatgagacttggttccatctttgg

SEQ ID NO: 137277 - DNA, 33 bp, Artificial Sequence
  Description of Artificial Sequence: Synthetic oligonucleotide
cagcaacaccatgagacttggttccatctttgg

SEQ ID NO: 137278 - DNA, 33 bp, Artificial Sequence
  Description of Artificial Sequence: Synthetic oligonucleotide
agcaacaccatgagacttggttccatctttggg

SEQ ID NO: 137279 - DNA, 32 bp, Artificial Sequence
  Description of Artificial Sequence: Synthetic oligonucleotide
gcaacaccatgagacttggttccatctttggg

SEQ ID NO: 137280 - DNA, 32 bp, Artificial Sequence
  Description of Artificial Sequence: Synthetic oligonucleotide
caacaccatgagacttggttccatctttgggc

SEQ ID NO: 137281 - DNA, 34 bp, Artificial Sequence
  Description of Artificial Sequence: Synthetic oligonucleotide
aacaccatgagacttggttccatctttgggctag

SEQ ID NO: 137282 - DNA, 33 bp, Artificial Sequence
  Description of Artificial Sequence: Synthetic oligonucleotide
acaccatgagacttggttccatctttgggctag

SEQ ID NO: 137283 - DNA, 32 bp, Artificial Sequence
  Description of Artificial Sequence: Synthetic oligonucleotide
caccatgagacttggttccatctttgggctag

SEQ ID NO: 137284 - DNA, 32 bp, Artificial Sequence
  Description of Artificial Sequence: Synthetic oligonucleotide
accatgagacttggttccatctttgggctagg

SEQ ID NO: 137285 - DNA, 31 bp, Artificial Sequence
  Description of Artificial Sequence: Synthetic oligonucleotide
ccatgagacttggttccatctttgggctagg

SEQ ID NO: 137286 - DNA, 31 bp, Artificial Sequence
  Description of Artificial Sequence: Synthetic oligonucleotide
catgagacttggttccatctttgggctaggc

SEQ ID NO: 137287 - DNA, 33 bp, Artificial Sequence
  Description of Artificial Sequence: Synthetic oligonucleotide
atgagacttggttccatctttgggctaggcttg

SEQ ID NO: 137288 - DNA, 32 bp, Artificial Sequence
  Description of Artificial Sequence: Synthetic oligonucleotide
tgagacttggttccatctttgggctaggcttg

SEQ ID NO: 137289 - DNA, 31 bp, Artificial Sequence
  Description of Artificial Sequence: Synthetic oligonucleotide
gagacttggttccatctttgggctaggcttg

SEQ ID NO: 137290 - DNA, 31 bp, Artificial Sequence
  Description of Artificial Sequence: Synthetic oligonucleotide
agacttggttccatctttgggctaggcttgg

SEQ ID NO: 137291 - DNA, 30 bp, Artificial Sequence
  Description of Artificial Sequence: Synthetic oligonucleotide
gacttggttccatctttgggctaggcttgg

SEQ ID NO: 137292 - DNA, 30 bp, Artificial Sequence
  Description of Artificial Sequence: Synthetic oligonucleotide
acttggttccatctttgggctaggcttggc

SEQ ID NO: 137293 - DNA, 29 bp, Artificial Sequence
  Description of Artificial Sequence: Synthetic oligonucleotide
cttggttccatctttgggctaggcttggc

SEQ ID NO: 137294 - DNA, 33 bp, Artificial Sequence
  Description of Artificial Sequence: Synthetic oligonucleotide
ttggttccatctttgggctaggcttggcttatg

SEQ ID NO: 137295 - DNA, 32 bp, Artificial Sequence
  Description of Artificial Sequence: Synthetic oligonucleotide
tggttccatctttgggctaggcttggcttatg

SEQ ID NO: 137296 - DNA, 31 bp, Artificial Sequence
  Description of Artificial Sequence: Synthetic oligonucleotide
ggttccatctttgggctaggcttggcttatg

SEQ ID NO: 137297 - DNA, 31 bp, Artificial Sequence
  Description of Artificial Sequence: Synthetic oligonucleotide
gttccatctttgggctaggcttggcttatgc

SEQ ID NO: 137298 - DNA, 32 bp, Artificial Sequence
  Description of Artificial Sequence: Synthetic oligonucleotide
ttccatctttgggctaggcttggcttatgctg

SEQ ID NO: 137299 - DNA, 31 bp, Artificial Sequence
  Description of Artificial Sequence: Synthetic oligonucleotide
tccatctttgggctaggcttggcttatgctg

SEQ ID NO: 137300 - DNA, 30 bp, Artificial Sequence
  Description of Artificial Sequence: Synthetic oligonucleotide
ccatctttgggctaggcttggcttatgctg

SEQ ID NO: 137301 - DNA, 30 bp, Artificial Sequence
  Description of Artificial Sequence: Synthetic oligonucleotide
catctttgggctaggcttggcttatgctgg

SEQ ID NO: 137302 - DNA, 30 bp, Artificial Sequence
  Description of Artificial Sequence: Synthetic oligonucleotide
atctttgggctaggcttggcttatgctggc

SEQ ID NO: 137303 - DNA, 29 bp, Artificial Sequence
  Description of Artificial Sequence: Synthetic oligonucleotide
tctttgggctaggcttggcttatgctggc

SEQ ID NO: 137304 - DNA, 28 bp, Artificial Sequence
  Description of Artificial Sequence: Synthetic oligonucleotide
ctttgggctaggcttggcttatgctggc

SEQ ID NO: 137305 - DNA, 29 bp, Artificial Sequence
  Description of Artificial Sequence: Synthetic oligonucleotide
tttgggctaggcttggcttatgctggctc

SEQ ID NO: 137306 - DNA, 28 bp, Artificial Sequence
  Description of Artificial Sequence: Synthetic oligonucleotide
ttgggctaggcttggcttatgctggctc

SEQ ID NO: 137307 - DNA, 27 bp, Artificial Sequence
  Description of Artificial Sequence: Synthetic oligonucleotide
tgggctaggcttggcttatgctggctc

SEQ ID NO: 137308 - DNA, 27 bp, Artificial Sequence
  Description of Artificial Sequence: Synthetic oligonucleotide
gggctaggcttggcttatgctggctca

SEQ ID NO: 137309 - DNA, 30 bp, Artificial Sequence
  Description of Artificial Sequence: Synthetic oligonucleotide
ggctaggcttggcttatgctggctcaaatc

SEQ ID NO: 137310 - DNA, 30 bp, Artificial Sequence
  Description of Artificial Sequence: Synthetic oligonucleotide
gctaggcttggcttatgctggctcaaatcg

SEQ ID NO: 137311 - DNA, 31 bp, Artificial Sequence
  Description of Artificial Sequence: Synthetic oligonucleotide
ctaggcttggcttatgctggctcaaatcgtg

SEQ ID NO: 137312 - DNA, 33 bp, Artificial Sequence
  Description of Artificial Sequence: Synthetic oligonucleotide
taggcttggcttatgctggctcaaatcgtgaag

SEQ ID NO: 137313 - DNA, 32 bp, Artificial Sequence
  Description of Artificial Sequence: Synthetic oligonucleotide
aggcttggcttatgctggctcaaatcgtgaag

SEQ ID NO: 137314 - DNA, 31 bp, Artificial Sequence
  Description of Artificial Sequence: Synthetic oligonucleotide
ggcttggcttatgctggctcaaatcgtgaag

SEQ ID NO: 137315 - DNA, 33 bp, Artificial Sequence
  Description of Artificial Sequence: Synthetic oligonucleotide
gcttggcttatgctggctcaaatcgtgaagatg

SEQ ID NO: 137316 - DNA, 34 bp, Artificial Sequence
  Description of Artificial Sequence: Synthetic oligonucleotide
cttggcttatgctggctcaaatcgtgaagatgtc

SEQ ID NO: 137317 - DNA, 34 bp, Artificial Sequence
  Description of Artificial Sequence: Synthetic oligonucleotide
ttggcttatgctggctcaaatcgtgaagatgtcc

SEQ ID NO: 137318 - DNA, 33 bp, Artificial Sequence
  Description of Artificial Sequence: Synthetic oligonucleotide
tggcttatgctggctcaaatcgtgaagatgtcc

SEQ ID NO: 137319 - DNA, 32 bp, Artificial Sequence
  Description of Artificial Sequence: Synthetic oligonucleotide
ggcttatgctggctcaaatcgtgaagatgtcc

SEQ ID NO: 137320 - DNA, 35 bp, Artificial Sequence
  Description of Artificial Sequence: Synthetic oligonucleotide
gcttatgctggctcaaatcgtgaagatgtcctaac

SEQ ID NO: 137321 - DNA, 36 bp, Artificial Sequence
  Description of Artificial Sequence: Synthetic oligonucleotide
cttatgctggctcaaatcgtgaagatgtcctaacac

SEQ ID NO: 137322 - DNA, 37 bp, Artificial Sequence
  Description of Artificial Sequence: Synthetic oligonucleotide
ttatgctggctcaaatcgtgaagatgtcctaacactg

SEQ ID NO: 137323 - DNA, 36 bp, Artificial Sequence
  Description of Artificial Sequence: Synthetic oligonucleotide
tatgctggctcaaatcgtgaagatgtcctaacactg

SEQ ID NO: 137324 - DNA, 35 bp, Artificial Sequence
  Description of Artificial Sequence: Synthetic oligonucleotide
atgctggctcaaatcgtgaagatgtcctaacactg

SEQ ID NO: 137325 - DNA, 34 bp, Artificial Sequence
  Description of Artificial Sequence: Synthetic oligonucleotide
tgctggctcaaatcgtgaagatgtcctaacactg

SEQ ID NO: 137326 - DNA, 33 bp, Artificial Sequence
  Description of Artificial Sequence: Synthetic oligonucleotide
gctggctcaaatcgtgaagatgtcctaacactg

SEQ ID NO: 137327 - DNA, 33 bp, Artificial Sequence
  Description of Artificial Sequence: Synthetic oligonucleotide
ctggctcaaatcgtgaagatgtcctaacactgc

SEQ ID NO: 137328 - DNA, 34 bp, Artificial Sequence
  Description of Artificial Sequence: Synthetic oligonucleotide
tggctcaaatcgtgaagatgtcctaacactgctg

SEQ ID NO: 137329 - DNA, 33 bp, Artificial Sequence
  Description of Artificial Sequence: Synthetic oligonucleotide
ggctcaaatcgtgaagatgtcctaacactgctg

SEQ ID NO: 137330 - DNA, 33 bp, Artificial Sequence
  Description of Artificial Sequence: Synthetic oligonucleotide
gctcaaatcgtgaagatgtcctaacactgctgc

SEQ ID NO: 137331 - DNA, 34 bp, Artificial Sequence
  Description of Artificial Sequence: Synthetic oligonucleotide
ctcaaatcgtgaagatgtcctaacactgctgctg

SEQ ID NO: 137332 - DNA, 34 bp, Artificial Sequence
  Description of Artificial Sequence: Synthetic oligonucleotide
tcaaatcgtgaagatgtcctaacactgctgctgc

SEQ ID NO: 137333 - DNA, 33 bp, Artificial Sequence
  Description of Artificial Sequence: Synthetic oligonucleotide
caaatcgtgaagatgtcctaacactgctgctgc

SEQ ID NO: 137334 - DNA, 33 bp, Artificial Sequence
  Description of Artificial Sequence: Synthetic oligonucleotide
aaatcgtgaagatgtcctaacactgctgctgcc

SEQ ID NO: 137335 - DNA, 32 bp, Artificial Sequence
  Description of Artificial Sequence: Synthetic oligonucleotide
aatcgtgaagatgtcctaacactgctgctgcc

SEQ ID NO: 137336 - DNA, 31 bp, Artificial Sequence
  Description of Artificial Sequence: Synthetic oligonucleotide
atcgtgaagatgtcctaacactgctgctgcc

SEQ ID NO: 137337 - DNA, 30 bp, Artificial Sequence
  Description of Artificial Sequence: Synthetic oligonucleotide
tcgtgaagatgtcctaacactgctgctgcc

SEQ ID NO: 137338 - DNA, 29 bp, Artificial Sequence
  Description of Artificial Sequence: Synthetic oligonucleotide
cgtgaagatgtcctaacactgctgctgcc

SEQ ID NO: 137339 - DNA, 30 bp, Artificial Sequence
  Description of Artificial Sequence: Synthetic oligonucleotide
gtgaagatgtcctaacactgctgctgcctg

SEQ ID NO: 137340 - DNA, 31 bp, Artificial Sequence
  Description of Artificial Sequence: Synthetic oligonucleotide
tgaagatgtcctaacactgctgctgcctgtg

SEQ ID NO: 137341 - DNA, 30 bp, Artificial Sequence
  Description of Artificial Sequence: Synthetic oligonucleotide
gaagatgtcctaacactgctgctgcctgtg

SEQ ID NO: 137342 - DNA, 32 bp, Artificial Sequence
  Description of Artificial Sequence: Synthetic oligonucleotide
aagatgtcctaacactgctgctgcctgtgatg

SEQ ID NO: 137343 - DNA, 31 bp, Artificial Sequence
  Description of Artificial Sequence: Synthetic oligonucleotide
agatgtcctaacactgctgctgcctgtgatg

SEQ ID NO: 137344 - DNA, 30 bp, Artificial Sequence
  Description of Artificial Sequence: Synthetic oligonucleotide
gatgtcctaacactgctgctgcctgtgatg

SEQ ID NO: 137345 - DNA, 30 bp, Artificial Sequence
  Description of Artificial Sequence: Synthetic oligonucleotide
atgtcctaacactgctgctgcctgtgatgg

SEQ ID NO: 137346 - DNA, 29 bp, Artificial Sequence
  Description of Artificial Sequence: Synthetic oligonucleotide
tgtcctaacactgctgctgcctgtgatgg

SEQ ID NO: 137347 - DNA, 28 bp, Artificial Sequence
  Description of Artificial Sequence: Synthetic oligonucleotide
gtcctaacactgctgctgcctgtgatgg

SEQ ID NO: 137348 - DNA, 28 bp, Artificial Sequence
  Description of Artificial Sequence: Synthetic oligonucleotide
tcctaacactgctgctgcctgtgatggg

SEQ ID NO: 137349 - DNA, 27 bp, Artificial Sequence
  Description of Artificial Sequence: Synthetic oligonucleotide
cctaacactgctgctgcctgtgatggg

SEQ ID NO: 137350 - DNA, 28 bp, Artificial Sequence
  Description of Artificial Sequence: Synthetic oligonucleotide
ctaacactgctgctgcctgtgatgggag

SEQ ID NO: 137351 - DNA, 31 bp, Artificial Sequence
  Description of Artificial Sequence: Synthetic oligonucleotide
taacactgctgctgcctgtgatgggagattc

SEQ ID NO: 137352 - DNA, 30 bp, Artificial Sequence
  Description of Artificial Sequence: Synthetic oligonucleotide
aacactgctgctgcctgtgatgggagattc

SEQ ID NO: 137353 - DNA, 29 bp, Artificial Sequence
  Description of Artificial Sequence: Synthetic oligonucleotide
acactgctgctgcctgtgatgggagattc

SEQ ID NO: 137354 - DNA, 28 bp, Artificial Sequence
  Description of Artificial Sequence: Synthetic oligonucleotide
cactgctgctgcctgtgatgggagattc

SEQ ID NO: 137355 - DNA, 31 bp, Artificial Sequence
  Description of Artificial Sequence: Synthetic oligonucleotide
actgctgctgcctgtgatgggagattcaaag

SEQ ID NO: 137356 - DNA, 30 bp, Artificial Sequence
  Description of Artificial Sequence: Synthetic oligonucleotide
ctgctgctgcctgtgatgggagattcaaag

SEQ ID NO: 137357 - DNA, 31 bp, Artificial Sequence
  Description of Artificial Sequence: Synthetic oligonucleotide
tgctgctgcctgtgatgggagattcaaagtc

SEQ ID NO: 137358 - DNA, 30 bp, Artificial Sequence
  Description of Artificial Sequence: Synthetic oligonucleotide
gctgctgcctgtgatgggagattcaaagtc

SEQ ID NO: 137359 - DNA, 30 bp, Artificial Sequence
  Description of Artificial Sequence: Synthetic oligonucleotide
ctgctgcctgtgatgggagattcaaagtcc

SEQ ID NO: 137360 - DNA, 31 bp, Artificial Sequence
  Description of Artificial Sequence: Synthetic oligonucleotide
tgctgcctgtgatgggagattcaaagtccag

SEQ ID NO: 137361 - DNA, 30 bp, Artificial Sequence
  Description of Artificial Sequence: Synthetic oligonucleotide
gctgcctgtgatgggagattcaaagtccag

SEQ ID NO: 137362 - DNA, 30 bp, Artificial Sequence
  Description of Artificial Sequence: Synthetic oligonucleotide
ctgcctgtgatgggagattcaaagtccagc

SEQ ID NO: 137363 - DNA, 32 bp, Artificial Sequence
  Description of Artificial Sequence: Synthetic oligonucleotide
tgcctgtgatgggagattcaaagtccagcatg

SEQ ID NO: 137364 - DNA, 31 bp, Artificial Sequence
  Description of Artificial Sequence: Synthetic oligonucleotide
gcctgtgatgggagattcaaagtccagcatg

SEQ ID NO: 137365 - DNA, 31 bp, Artificial Sequence
  Description of Artificial Sequence: Synthetic oligonucleotide
cctgtgatgggagattcaaagtccagcatgg

SEQ ID NO: 137366 - DNA, 32 bp, Artificial Sequence
  Description of Artificial Sequence: Synthetic oligonucleotide
ctgtgatgggagattcaaagtccagcatggag

SEQ ID NO: 137367 - DNA, 32 bp, Artificial Sequence
  Description of Artificial Sequence: Synthetic oligonucleotide
tgtgatgggagattcaaagtccagcatggagg

SEQ ID NO: 137368 - DNA, 31 bp, Artificial Sequence
  Description of Artificial Sequence: Synthetic oligonucleotide
gtgatgggagattcaaagtccagcatggagg

SEQ ID NO: 137369 - DNA, 32 bp, Artificial Sequence
  Description of Artificial Sequence: Synthetic oligonucleotide
tgatgggagattcaaagtccagcatggaggtg

SEQ ID NO: 137370 - DNA, 31 bp, Artificial Sequence
  Description of Artificial Sequence: Synthetic oligonucleotide
gatgggagattcaaagtccagcatggaggtg

SEQ ID NO: 137371 - DNA, 31 bp, Artificial Sequence
  Description of Artificial Sequence: Synthetic oligonucleotide
atgggagattcaaagtccagcatggaggtgg

SEQ ID NO: 137372 - DNA, 30 bp, Artificial Sequence
  Description of Artificial Sequence: Synthetic oligonucleotide
tgggagattcaaagtccagcatggaggtgg

SEQ ID NO: 137373 - DNA, 29 bp, Artificial Sequence
  Description of Artificial Sequence: Synthetic oligonucleotide
gggagattcaaagtccagcatggaggtgg

SEQ ID NO: 137374 - DNA, 29 bp, Artificial Sequence
  Description of Artificial Sequence: Synthetic oligonucleotide
ggagattcaaagtccagcatggaggtggc

SEQ ID NO: 137375 - DNA, 30 bp, Artificial Sequence
  Description of Artificial Sequence: Synthetic oligonucleotide
gagattcaaagtccagcatggaggtggcag

SEQ ID NO: 137376 - DNA, 30 bp, Artificial Sequence
  Description of Artificial Sequence: Synthetic oligonucleotide
agattcaaagtccagcatggaggtggcagg

SEQ ID NO: 137377 - DNA, 29 bp, Artificial Sequence
  Description of Artificial Sequence: Synthetic oligonucleotide
gattcaaagtccagcatggaggtggcagg

SEQ ID NO: 137378 - DNA, 30 bp, Artificial Sequence
  Description of Artificial Sequence: Synthetic oligonucleotide
attcaaagtccagcatggaggtggcaggtg

SEQ ID NO: 137379 - DNA, 29 bp, Artificial Sequence
  Description of Artificial Sequence: Synthetic oligonucleotide
ttcaaagtccagcatggaggtggcaggtg

SEQ ID NO: 137380 - DNA, 28 bp, Artificial Sequence
  Description of Artificial Sequence: Synthetic oligonucleotide
tcaaagtccagcatggaggtggcaggtg

SEQ ID NO: 137381 - DNA, 27 bp, Artificial Sequence
  Description of Artificial Sequence: Synthetic oligonucleotide
caaagtccagcatggaggtggcaggtg

SEQ ID NO: 137382 - DNA, 28 bp, Artificial Sequence
  Description of Artificial Sequence: Synthetic oligonucleotide
aaagtccagcatggaggtggcaggtgtc

SEQ ID NO: 137383 - DNA, 27 bp, Artificial Sequence
  Description of Artificial Sequence: Synthetic oligonucleotide
aagtccagcatggaggtggcaggtgtc

SEQ ID NO: 137384 - DNA, 27 bp, Artificial Sequence
  Description of Artificial Sequence: Synthetic oligonucleotide
agtccagcatggaggtggcaggtgtca

SEQ ID NO: 137385 - DNA, 26 bp, Artificial Sequence
  Description of Artificial Sequence: Synthetic oligonucleotide
gtccagcatggaggtggcaggtgtca

SEQ ID NO: 137386 - DNA, 27 bp, Artificial Sequence
  Description of Artificial Sequence: Synthetic oligonucleotide
tccagcatggaggtggcaggtgtcaca

SEQ ID NO: 137387 - DNA, 26 bp, Artificial Sequence
  Description of Artificial Sequence: Synthetic oligonucleotide
ccagcatggaggtggcaggtgtcaca

SEQ ID NO: 137388 - DNA, 26 bp, Artificial Sequence
  Description of Artificial Sequence: Synthetic oligonucleotide
cagcatggaggtggcaggtgtcacag

SEQ ID NO: 137389 - DNA, 27 bp, Artificial Sequence
  Description of Artificial Sequence: Synthetic oligonucleotide
agcatggaggtggcaggtgtcacagct

SEQ ID NO: 137390 - DNA, 27 bp, Artificial Sequence
  Description of Artificial Sequence: Synthetic oligonucleotide
gcatggaggtggcaggtgtcacagctt

SEQ ID NO: 137391 - DNA, 29 bp, Artificial Sequence
  Description of Artificial Sequence: Synthetic oligonucleotide
catggaggtggcaggtgtcacagctttag

SEQ ID NO: 137392 - DNA, 29 bp, Artificial Sequence
  Description of Artificial Sequence: Synthetic oligonucleotide
atggaggtggcaggtgtcacagctttagc

SEQ ID NO: 137393 - DNA, 28 bp, Artificial Sequence
  Description of Artificial Sequence: Synthetic oligonucleotide
tggaggtggcaggtgtcacagctttagc

SEQ ID NO: 137394 - DNA, 27 bp, Artificial Sequence
  Description of Artificial Sequence: Synthetic oligonucleotide
ggaggtggcaggtgtcacagctttagc

SEQ ID NO: 137395 - DNA, 27 bp, Artificial Sequence
  Description of Artificial Sequence: Synthetic oligonucleotide
gaggtggcaggtgtcacagctttagcc

SEQ ID NO: 137396 - DNA, 28 bp, Artificial Sequence
  Description of Artificial Sequence: Synthetic oligonucleotide
aggtggcaggtgtcacagctttagcctg

SEQ ID NO: 137397 - DNA, 27 bp, Artificial Sequence
  Description of Artificial Sequence: Synthetic oligonucleotide
ggtggcaggtgtcacagctttagcctg

SEQ ID NO: 137398 - DNA, 28 bp, Artificial Sequence
  Description of Artificial Sequence: Synthetic oligonucleotide
gtggcaggtgtcacagctttagcctgtg

SEQ ID NO: 137399 - DNA, 28 bp, Artificial Sequence
  Description of Artificial Sequence: Synthetic oligonucleotide
tggcaggtgtcacagctttagcctgtgg

SEQ ID NO: 137400 - DNA, 27 bp, Artificial Sequence
  Description of Artificial Sequence: Synthetic oligonucleotide
ggcaggtgtcacagctttagcctgtgg

SEQ ID NO: 137401 - DNA, 30 bp, Artificial Sequence
  Description of Artificial Sequence: Synthetic oligonucleotide
gcaggtgtcacagctttagcctgtggaatg

SEQ ID NO: 137402 - DNA, 33 bp, Artificial Sequence
  Description of Artificial Sequence: Synthetic oligonucleotide
caggtgtcacagctttagcctgtggaatgatag

SEQ ID NO: 137403 - DNA, 33 bp, Artificial Sequence
  Description of Artificial Sequence: Synthetic oligonucleotide
aggtgtcacagctttagcctgtggaatgatagc

SEQ ID NO: 137404 - DNA, 32 bp, Artificial Sequence
  Description of Artificial Sequence: Synthetic oligonucleotide
ggtgtcacagctttagcctgtggaatgatagc

SEQ ID NO: 137405 - DNA, 33 bp, Artificial Sequence
  Description of Artificial Sequence: Synthetic oligonucleotide
gtgtcacagctttagcctgtggaatgatagcag

SEQ ID NO: 137406 - DNA, 35 bp, Artificial Sequence
  Description of Artificial Sequence: Synthetic oligonucleotide
tgtcacagctttagcctgtggaatgatagcagtag

SEQ ID NO: 137407 - DNA, 34 bp, Artificial Sequence
  Description of Artificial Sequence: Synthetic oligonucleotide
gtcacagctttagcctgtggaatgatagcagtag

SEQ ID NO: 137408 - DNA, 34 bp, Artificial Sequence
  Description of Artificial Sequence: Synthetic oligonucleotide
tcacagctttagcctgtggaatgatagcagtagg

SEQ ID NO: 137409 - DNA, 33 bp, Artificial Sequence
  Description of Artificial Sequence: Synthetic oligonucleotide
cacagctttagcctgtggaatgatagcagtagg

SEQ ID NO: 137410 - DNA, 33 bp, Artificial Sequence
  Description of Artificial Sequence: Synthetic oligonucleotide
acagctttagcctgtggaatgatagcagtaggg

SEQ ID NO: 137411 - DNA, 32 bp, Artificial Sequence
  Description of Artificial Sequence: Synthetic oligonucleotide
cagctttagcctgtggaatgatagcagtaggg

SEQ ID NO: 137412 - DNA, 33 bp, Artificial Sequence
  Description of Artificial Sequence: Synthetic oligonucleotide
agctttagcctgtggaatgatagcagtagggtc

SEQ ID NO: 137413 - DNA, 32 bp, Artificial Sequence
  Description of Artificial Sequence: Synthetic oligonucleotide
gctttagcctgtggaatgatagcagtagggtc

SEQ ID NO: 137414 - DNA, 32 bp, Artificial Sequence
  Description of Artificial Sequence: Synthetic oligonucleotide
ctttagcctgtggaatgatagcagtagggtcc

SEQ ID NO: 137415 - DNA, 33 bp, Artificial Sequence
  Description of Artificial Sequence: Synthetic oligonucleotide
tttagcctgtggaatgatagcagtagggtcctg

SEQ ID NO: 137416 - DNA, 32 bp, Artificial Sequence
  Description of Artificial Sequence: Synthetic oligonucleotide
ttagcctgtggaatgatagcagtagggtcctg

SEQ ID NO: 137417 - DNA, 31 bp, Artificial Sequence
  Description of Artificial Sequence: Synthetic oligonucleotide
tagcctgtggaatgatagcagtagggtcctg

SEQ ID NO: 137418 - DNA, 30 bp, Artificial Sequence
  Description of Artificial Sequence: Synthetic oligonucleotide
agcctgtggaatgatagcagtagggtcctg

SEQ ID NO: 137419 - DNA, 29 bp, Artificial Sequence
  Description of Artificial Sequence: Synthetic oligonucleotide
gcctgtggaatgatagcagtagggtcctg

SEQ ID NO: 137420 - DNA, 29 bp, Artificial Sequence
  Description of Artificial Sequence: Synthetic oligonucleotide
cctgtggaatgatagcagtagggtcctgc

SEQ ID NO: 137421 - DNA, 32 bp, Artificial Sequence
  Description of Artificial Sequence: Synthetic oligonucleotide
ctgtggaatgatagcagtagggtcctgcaatg

SEQ ID NO: 137422 - DNA, 32 bp, Artificial Sequence
  Description of Artificial Sequence: Synthetic oligonucleotide
tgtggaatgatagcagtagggtcctgcaatgg

SEQ ID NO: 137423 - DNA, 31 bp, Artificial Sequence
  Description of Artificial Sequence: Synthetic oligonucleotide
gtggaatgatagcagtagggtcctgcaatgg

SEQ ID NO: 137424 - DNA, 32 bp, Artificial Sequence
  Description of Artificial Sequence: Synthetic oligonucleotide
tggaatgatagcagtagggtcctgcaatggag

SEQ ID NO: 137425 - DNA, 31 bp, Artificial Sequence
  Description of Artificial Sequence: Synthetic oligonucleotide
ggaatgatagcagtagggtcctgcaatggag

SEQ ID NO: 137426 - DNA, 33 bp, Artificial Sequence
  Description of Artificial Sequence: Synthetic oligonucleotide
gaatgatagcagtagggtcctgcaatggagatg

SEQ ID NO: 137427 - DNA, 36 bp, Artificial Sequence
  Description of Artificial Sequence: Synthetic oligonucleotide
aatgatagcagtagggtcctgcaatggagatgtaac

SEQ ID NO: 137428 - DNA, 35 bp, Artificial Sequence
  Description of Artificial Sequence: Synthetic oligonucleotide
atgatagcagtagggtcctgcaatggagatgtaac

SEQ ID NO: 137429 - DNA, 34 bp, Artificial Sequence
  Description of Artificial Sequence: Synthetic oligonucleotide
tgatagcagtagggtcctgcaatggagatgtaac

SEQ ID NO: 137430 - DNA, 33 bp, Artificial Sequence
  Description of Artificial Sequence: Synthetic oligonucleotide
gatagcagtagggtcctgcaatggagatgtaac

SEQ ID NO: 137431 - DNA, 35 bp, Artificial Sequence
  Description of Artificial Sequence: Synthetic oligonucleotide
atagcagtagggtcctgcaatggagatgtaacttc

SEQ ID NO: 137432 - DNA, 34 bp, Artificial Sequence
  Description of Artificial Sequence: Synthetic oligonucleotide
tagcagtagggtcctgcaatggagatgtaacttc

SEQ ID NO: 137433 - DNA, 33 bp, Artificial Sequence
  Description of Artificial Sequence: Synthetic oligonucleotide
agcagtagggtcctgcaatggagatgtaacttc

SEQ ID NO: 137434 - DNA, 32 bp, Artificial Sequence
  Description of Artificial Sequence: Synthetic oligonucleotide
gcagtagggtcctgcaatggagatgtaacttc

SEQ ID NO: 137435 - DNA, 32 bp, Artificial Sequence
  Description of Artificial Sequence: Synthetic oligonucleotide
cagtagggtcctgcaatggagatgtaacttcc

SEQ ID NO: 137436 - DNA, 33 bp, Artificial Sequence
  Description of Artificial Sequence: Synthetic oligonucleotide
agtagggtcctgcaatggagatgtaacttccac

SEQ ID NO: 137437 - DNA, 32 bp, Artificial Sequence
  Description of Artificial Sequence: Synthetic oligonucleotide
gtagggtcctgcaatggagatgtaacttccac

SEQ ID NO: 137438 - DNA, 35 bp, Artificial Sequence
  Description of Artificial Sequence: Synthetic oligonucleotide
tagggtcctgcaatggagatgtaacttccactatc

SEQ ID NO: 137439 - DNA, 34 bp, Artificial Sequence
  Description of Artificial Sequence: Synthetic oligonucleotide
agggtcctgcaatggagatgtaacttccactatc

SEQ ID NO: 137440 - DNA, 33 bp, Artificial Sequence
  Description of Artificial Sequence: Synthetic oligonucleotide
gggtcctgcaatggagatgtaacttccactatc

SEQ ID NO: 137441 - DNA, 33 bp, Artificial Sequence
  Description of Artificial Sequence: Synthetic oligonucleotide
ggtcctgcaatggagatgtaacttccactatcc

SEQ ID NO: 137442 - DNA, 35 bp, Artificial Sequence
  Description of Artificial Sequence: Synthetic oligonucleotide
gtcctgcaatggagatgtaacttccactatccttc

SEQ ID NO: 137443 - DNA, 36 bp, Artificial Sequence
  Description of Artificial Sequence: Synthetic oligonucleotide
tcctgcaatggagatgtaacttccactatccttcag

SEQ ID NO: 137444 - DNA, 35 bp, Artificial Sequence
  Description of Artificial Sequence: Synthetic oligonucleotide
cctgcaatggagatgtaacttccactatccttcag

SEQ ID NO: 137445 - DNA, 36 bp, Artificial Sequence
  Description of Artificial Sequence: Synthetic oligonucleotide
ctgcaatggagatgtaacttccactatccttcagac

SEQ ID NO: 137446 - DNA, 36 bp, Artificial Sequence
  Description of Artificial Sequence: Synthetic oligonucleotide
tgcaatggagatgtaacttccactatccttcagacc

SEQ ID NO: 137447 - DNA, 35 bp, Artificial Sequence
  Description of Artificial Sequence: Synthetic oligonucleotide
gcaatggagatgtaacttccactatccttcagacc

SEQ ID NO: 137448 - DNA, 37 bp, Artificial Sequence
  Description of Artificial Sequence: Synthetic oligonucleotide
caatggagatgtaacttccactatccttcagaccatc

SEQ ID NO: 137449 - DNA, 39 bp, Artificial Sequence
  Description of Artificial Sequence: Synthetic oligonucleotide
aatggagatgtaacttccactatccttcagaccatcatg

SEQ ID NO: 137450 - DNA, 38 bp, Artificial Sequence
  Description of Artificial Sequence: Synthetic oligonucleotide
atggagatgtaacttccactatccttcagaccatcatg

SEQ ID NO: 137451 - DNA, 37 bp, Artificial Sequence
  Description of Artificial Sequence: Synthetic oligonucleotide
tggagatgtaacttccactatccttcagaccatcatg

SEQ ID NO: 137452 - DNA, 36 bp, Artificial Sequence
  Description of Artificial Sequence: Synthetic oligonucleotide
ggagatgtaacttccactatccttcagaccatcatg

SEQ ID NO: 137453 - DNA, 36 bp, Artificial Sequence
  Description of Artificial Sequence: Synthetic oligonucleotide
gagatgtaacttccactatccttcagaccatcatgg

SEQ ID NO: 137454 - DNA, 37 bp, Artificial Sequence
  Description of Artificial Sequence: Synthetic oligonucleotide
agatgtaacttccactatccttcagaccatcatggag

SEQ ID NO: 137455 - DNA, 36 bp, Artificial Sequence
  Description of Artificial Sequence: Synthetic oligonucleotide
gatgtaacttccactatccttcagaccatcatggag

SEQ ID NO: 137456 - DNA, 38 bp, Artificial Sequence
  Description of Artificial Sequence: Synthetic oligonucleotide
atgtaacttccactatccttcagaccatcatggagaag

SEQ ID NO: 137457 - DNA, 37 bp, Artificial Sequence
  Description of Artificial Sequence: Synthetic oligonucleotide
tgtaacttccactatccttcagaccatcatggagaag

SEQ ID NO: 137458 - DNA, 36 bp, Artificial Sequence
  Description of Artificial Sequence: Synthetic oligonucleotide
gtaacttccactatccttcagaccatcatggagaag

SEQ ID NO: 137459 - DNA, 37 bp, Artificial Sequence
  Description of Artificial Sequence: Synthetic oligonucleotide
taacttccactatccttcagaccatcatggagaagtc

SEQ ID NO: 137460 - DNA, 36 bp, Artificial Sequence
  Description of Artificial Sequence: Synthetic oligonucleotide
aacttccactatccttcagaccatcatggagaagtc

SEQ ID NO: 137461 - DNA, 35 bp, Artificial Sequence
  Description of Artificial Sequence: Synthetic oligonucleotide
acttccactatccttcagaccatcatggagaagtc

SEQ ID NO: 137462 - DNA, 34 bp, Artificial Sequence
  Description of Artificial Sequence: Synthetic oligonucleotide
cttccactatccttcagaccatcatggagaagtc

SEQ ID NO: 137463 - DNA, 35 bp, Artificial Sequence
  Description of Artificial Sequence: Synthetic oligonucleotide
ttccactatccttcagaccatcatggagaagtcag

SEQ ID NO: 137464 - DNA, 34 bp, Artificial Sequence
  Description of Artificial Sequence: Synthetic oligonucleotide
tccactatccttcagaccatcatggagaagtcag

SEQ ID NO: 137465 - DNA, 33 bp, Artificial Sequence
  Description of Artificial Sequence: Synthetic oligonucleotide
ccactatccttcagaccatcatggagaagtcag

SEQ ID NO: 137466 - DNA, 34 bp, Artificial Sequence
  Description of Artificial Sequence: Synthetic oligonucleotide
cactatccttcagaccatcatggagaagtcagag

SEQ ID NO: 137467 - DNA, 35 bp, Artificial Sequence
  Description of Artificial Sequence: Synthetic oligonucleotide
actatccttcagaccatcatggagaagtcagagac

SEQ ID NO: 137468 - DNA, 34 bp, Artificial Sequence
  Description of Artificial Sequence: Synthetic oligonucleotide
ctatccttcagaccatcatggagaagtcagagac

SEQ ID NO: 137469 - DNA, 35 bp, Artificial Sequence
  Description of Artificial Sequence: Synthetic oligonucleotide
tatccttcagaccatcatggagaagtcagagactg

SEQ ID NO: 137470 - DNA, 34 bp, Artificial Sequence
  Description of Artificial Sequence: Synthetic oligonucleotide
atccttcagaccatcatggagaagtcagagactg

SEQ ID NO: 137471 - DNA, 33 bp, Artificial Sequence
  Description of Artificial Sequence: Synthetic oligonucleotide
tccttcagaccatcatggagaagtcagagactg

SEQ ID NO: 137472 - DNA, 32 bp, Artificial Sequence
  Description of Artificial Sequence: Synthetic oligonucleotide
ccttcagaccatcatggagaagtcagagactg

SEQ ID NO: 137473 - DNA, 33 bp, Artificial Sequence
  Description of Artificial Sequence: Synthetic oligonucleotide
cttcagaccatcatggagaagtcagagactgag

SEQ ID NO: 137474 - DNA, 33 bp, Artificial Sequence
  Description of Artificial Sequence: Synthetic oligonucleotide
ttcagaccatcatggagaagtcagagactgagc

SEQ ID NO: 137475 - DNA, 32 bp, Artificial Sequence
  Description of Artificial Sequence: Synthetic oligonucleotide
tcagaccatcatggagaagtcagagactgagc

SEQ ID NO: 137476 - DNA, 31 bp, Artificial Sequence
  Description of Artificial Sequence: Synthetic oligonucleotide
cagaccatcatggagaagtcagagactgagc

SEQ ID NO: 137477 - DNA, 32 bp, Artificial Sequence
  Description of Artificial Sequence: Synthetic oligonucleotide
agaccatcatggagaagtcagagactgagctc

SEQ ID NO: 137478 - DNA, 31 bp, Artificial Sequence
  Description of Artificial Sequence: Synthetic oligonucleotide
gaccatcatggagaagtcagagactgagctc

SEQ ID NO: 137479 - DNA, 33 bp, Artificial Sequence
  Description of Artificial Sequence: Synthetic oligonucleotide
accatcatggagaagtcagagactgagctcaag

SEQ ID NO: 137480 - DNA, 32 bp, Artificial Sequence
  Description of Artificial Sequence: Synthetic oligonucleotide
ccatcatggagaagtcagagactgagctcaag

SEQ ID NO: 137481 - DNA, 32 bp, Artificial Sequence
  Description of Artificial Sequence: Synthetic oligonucleotide
catcatggagaagtcagagactgagctcaagg

SEQ ID NO: 137482 - DNA, 35 bp, Artificial Sequence
  Description of Artificial Sequence: Synthetic oligonucleotide
atcatggagaagtcagagactgagctcaaggatac

SEQ ID NO: 137483 - DNA, 34 bp, Artificial Sequence
  Description of Artificial Sequence: Synthetic oligonucleotide
tcatggagaagtcagagactgagctcaaggatac

SEQ ID NO: 137484 - DNA, 33 bp, Artificial Sequence
  Description of Artificial Sequence: Synthetic oligonucleotide
catggagaagtcagagactgagctcaaggatac

SEQ ID NO: 137485 - DNA, 37 bp, Artificial Sequence
  Description of Artificial Sequence: Synthetic oligonucleotide
atggagaagtcagagactgagctcaaggatacttatg

SEQ ID NO: 137486 - DNA, 36 bp, Artificial Sequence
  Description of Artificial Sequence: Synthetic oligonucleotide
tggagaagtcagagactgagctcaaggatacttatg

SEQ ID NO: 137487 - DNA, 35 bp, Artificial Sequence
  Description of Artificial Sequence: Synthetic oligonucleotide
ggagaagtcagagactgagctcaaggatacttatg

SEQ ID NO: 137488 - DNA, 35 bp, Artificial Sequence
  Description of Artificial Sequence: Synthetic oligonucleotide
gagaagtcagagactgagctcaaggatacttatgc

SEQ ID NO: 137489 - DNA, 36 bp, Artificial Sequence
  Description of Artificial Sequence: Synthetic oligonucleotide
agaagtcagagactgagctcaaggatacttatgctc

SEQ ID NO: 137490 - DNA, 35 bp, Artificial Sequence
  Description of Artificial Sequence: Synthetic oligonucleotide
gaagtcagagactgagctcaaggatacttatgctc

SEQ ID NO: 137491 - DNA, 35 bp, Artificial Sequence
  Description of Artificial Sequence: Synthetic oligonucleotide
aagtcagagactgagctcaaggatacttatgctcg

SEQ ID NO: 137492 - DNA, 34 bp, Artificial Sequence
  Description of Artificial Sequence: Synthetic oligonucleotide
agtcagagactgagctcaaggatacttatgctcg

SEQ ID NO: 137493 - DNA, 33 bp, Artificial Sequence
  Description of Artificial Sequence: Synthetic oligonucleotide
gtcagagactgagctcaaggatacttatgctcg

SEQ ID NO: 137494 - DNA, 35 bp, Artificial Sequence
  Description of Artificial Sequence: Synthetic oligonucleotide
tcagagactgagctcaaggatacttatgctcgttg

SEQ ID NO: 137495 - DNA, 34 bp, Artificial Sequence
  Description of Artificial Sequence: Synthetic oligonucleotide
cagagactgagctcaaggatacttatgctcgttg

SEQ ID NO: 137496 - DNA, 34 bp, Artificial Sequence
  Description of Artificial Sequence: Synthetic oligonucleotide
agagactgagctcaaggatacttatgctcgttgg

SEQ ID NO: 137497 - DNA, 33 bp, Artificial Sequence
  Description of Artificial Sequence: Synthetic oligonucleotide
gagactgagctcaaggatacttatgctcgttgg

SEQ ID NO: 137498 - DNA, 33 bp, Artificial Sequence
  Description of Artificial Sequence: Synthetic oligonucleotide
agactgagctcaaggatacttatgctcgttggc

SEQ ID NO: 137499 - DNA, 32 bp, Artificial Sequence
  Description of Artificial Sequence: Synthetic oligonucleotide
gactgagctcaaggatacttatgctcgttggc

SEQ ID NO: 137500 - DNA, 34 bp, Artificial Sequence
  Description of Artificial Sequence: Synthetic oligonucleotide
actgagctcaaggatacttatgctcgttggcttc

SEQ ID NO: 137501 - DNA, 33 bp, Artificial Sequence
  Description of Artificial Sequence: Synthetic oligonucleotide
ctgagctcaaggatacttatgctcgttggcttc

SEQ ID NO: 137502 - DNA, 33 bp, Artificial Sequence
  Description of Artificial Sequence: Synthetic oligonucleotide
tgagctcaaggatacttatgctcgttggcttcc

SEQ ID NO: 137503 - DNA, 32 bp, Artificial Sequence
  Description of Artificial Sequence: Synthetic oligonucleotide
gagctcaaggatacttatgctcgttggcttcc

SEQ ID NO: 137504 - DNA, 33 bp, Artificial Sequence
  Description of Artificial Sequence: Synthetic oligonucleotide
agctcaaggatacttatgctcgttggcttcctc

SEQ ID NO: 137505 - DNA, 32 bp, Artificial Sequence
  Description of Artificial Sequence: Synthetic oligonucleotide
gctcaaggatacttatgctcgttggcttcctc

SEQ ID NO: 137506 - DNA, 34 bp, Artificial Sequence
  Description of Artificial Sequence: Synthetic oligonucleotide
ctcaaggatacttatgctcgttggcttcctcttg

SEQ ID NO: 137507 - DNA, 34 bp, Artificial Sequence
  Description of Artificial Sequence: Synthetic oligonucleotide
tcaaggatacttatgctcgttggcttcctcttgg

SEQ ID NO: 137508 - DNA, 33 bp, Artificial Sequence
  Description of Artificial Sequence: Synthetic oligonucleotide
caaggatacttatgctcgttggcttcctcttgg

SEQ ID NO: 137509 - DNA, 34 bp, Artificial Sequence
  Description of Artificial Sequence: Synthetic oligonucleotide
aaggatacttatgctcgttggcttcctcttggac

SEQ ID NO: 137510 - DNA, 33 bp, Artificial Sequence
  Description of Artificial Sequence: Synthetic oligonucleotide
aggatacttatgctcgttggcttcctcttggac

SEQ ID NO: 137511 - DNA, 32 bp, Artificial Sequence
  Description of Artificial Sequence: Synthetic oligonucleotide
ggatacttatgctcgttggcttcctcttggac

SEQ ID NO: 137512 - DNA, 33 bp, Artificial Sequence
  Description of Artificial Sequence: Synthetic oligonucleotide
gatacttatgctcgttggcttcctcttggactg

SEQ ID NO: 137513 - DNA, 33 bp, Artificial Sequence
  Description of Artificial Sequence: Synthetic oligonucleotide
atacttatgctcgttggcttcctcttggactgg

SEQ ID NO: 137514 - DNA, 32 bp, Artificial Sequence
  Description of Artificial Sequence: Synthetic oligonucleotide
tacttatgctcgttggcttcctcttggactgg

SEQ ID NO: 137515 - DNA, 31 bp, Artificial Sequence
  Description of Artificial Sequence: Synthetic oligonucleotide
acttatgctcgttggcttcctcttggactgg

SEQ ID NO: 137516 - DNA, 30 bp, Artificial Sequence
  Description of Artificial Sequence: Synthetic oligonucleotide
cttatgctcgttggcttcctcttggactgg

SEQ ID NO: 137517 - DNA, 30 bp, Artificial Sequence
  Description of Artificial Sequence: Synthetic oligonucleotide
ttatgctcgttggcttcctcttggactggg

SEQ ID NO: 137518 - DNA, 29 bp, Artificial Sequence
  Description of Artificial Sequence: Synthetic oligonucleotide
tatgctcgttggcttcctcttggactggg

SEQ ID NO: 137519 - DNA, 28 bp, Artificial Sequence
  Description of Artificial Sequence: Synthetic oligonucleotide
atgctcgttggcttcctcttggactggg

SEQ ID NO: 137520 - DNA, 27 bp, Artificial Sequence
  Description of Artificial Sequence: Synthetic oligonucleotide
tgctcgttggcttcctcttggactggg

SEQ ID NO: 137521 - DNA, 27 bp, Artificial Sequence
  Description of Artificial Sequence: Synthetic oligonucleotide
gctcgttggcttcctcttggactgggt

SEQ ID NO: 137522 - DNA, 27 bp, Artificial Sequence
  Description of Artificial Sequence: Synthetic oligonucleotide
ctcgttggcttcctcttggactgggtc

SEQ ID NO: 137523 - DNA, 28 bp, Artificial Sequence
  Description of Artificial Sequence: Synthetic oligonucleotide
tcgttggcttcctcttggactgggtctc

SEQ ID NO: 137524 - DNA, 27 bp, Artificial Sequence
  Description of Artificial Sequence: Synthetic oligonucleotide
cgttggcttcctcttggactgggtctc

SEQ ID NO: 137525 - DNA, 29 bp, Artificial Sequence
  Description of Artificial Sequence: Synthetic oligonucleotide
gttggcttcctcttggactgggtctcaac

SEQ ID NO: 137526 - DNA, 29 bp, Artificial Sequence
  Description of Artificial Sequence: Synthetic oligonucleotide
ttggcttcctcttggactgggtctcaacc

SEQ ID NO: 137527 - DNA, 28 bp, Artificial Sequence
  Description of Artificial Sequence: Synthetic oligonucleotide
tggcttcctcttggactgggtctcaacc

SEQ ID NO: 137528 - DNA, 27 bp, Artificial Sequence
  Description of Artificial Sequence: Synthetic oligonucleotide
ggcttcctcttggactgggtctcaacc

SEQ ID NO: 137529 - DNA, 28 bp, Artificial Sequence
  Description of Artificial Sequence: Synthetic oligonucleotide
gcttcctcttggactgggtctcaaccac

SEQ ID NO: 137530 - DNA, 28 bp, Artificial Sequence
  Description of Artificial Sequence: Synthetic oligonucleotide
cttcctcttggactgggtctcaaccacc

SEQ ID NO: 137531 - DNA, 29 bp, Artificial Sequence
  Description of Artificial Sequence: Synthetic oligonucleotide
ttcctcttggactgggtctcaaccacctg

SEQ ID NO: 137532 - DNA, 28 bp, Artificial Sequence
  Description of Artificial Sequence: Synthetic oligonucleotide
tcctcttggactgggtctcaaccacctg

SEQ ID NO: 137533 - DNA, 27 bp, Artificial Sequence
  Description of Artificial Sequence: Synthetic oligonucleotide
cctcttggactgggtctcaaccacctg

SEQ ID NO: 137534 - DNA, 27 bp, Artificial Sequence
  Description of Artificial Sequence: Synthetic oligonucleotide
ctcttggactgggtctcaaccacctgg

SEQ ID NO: 137535 - DNA, 27 bp, Artificial Sequence
  Description of Artificial Sequence: Synthetic oligonucleotide
tcttggactgggtctcaaccacctggg

SEQ ID NO: 137536 - DNA, 26 bp, Artificial Sequence
  Description of Artificial Sequence: Synthetic oligonucleotide
cttggactgggtctcaaccacctggg

SEQ ID NO: 137537 - DNA, 27 bp, Artificial Sequence
  Description of Artificial Sequence: Synthetic oligonucleotide
ttggactgggtctcaaccacctgggga

SEQ ID NO: 137538 - DNA, 27 bp, Artificial Sequence
  Description of Artificial Sequence: Synthetic oligonucleotide
tggactgggtctcaaccacctggggaa

SEQ ID NO: 137539 - DNA, 26 bp, Artificial Sequence
  Description of Artificial Sequence: Synthetic oligonucleotide
ggactgggtctcaaccacctggggaa

SEQ ID NO: 137540 - DNA, 26 bp, Artificial Sequence
  Description of Artificial Sequence: Synthetic oligonucleotide
gactgggtctcaaccacctggggaag

SEQ ID NO: 137541 - DNA, 26 bp, Artificial Sequence
  Description of Artificial Sequence: Synthetic oligonucleotide
actgggtctcaaccacctggggaagg

SEQ ID NO: 137542 - DNA, 25 bp, Artificial Sequence
  Description of Artificial Sequence: Synthetic oligonucleotide
ctgggtctcaaccacctggggaagg

SEQ ID NO: 137543 - DNA, 26 bp, Artificial Sequence
  Description of Artificial Sequence: Synthetic oligonucleotide
tgggtctcaaccacctggggaagggt

SEQ ID NO: 137544 - DNA, 25 bp, Artificial Sequence
  Description of Artificial Sequence: Synthetic oligonucleotide
gggtctcaaccacctggggaagggt

SEQ ID NO: 137545 - DNA, 26 bp, Artificial Sequence
  Description of Artificial Sequence: Synthetic oligonucleotide
ggtctcaaccacctggggaagggtga

SEQ ID NO: 137546 - DNA, 26 bp, Artificial Sequence
  Description of Artificial Sequence: Synthetic oligonucleotide
gtctcaaccacctggggaagggtgag

SEQ ID NO: 137547 - DNA, 26 bp, Artificial Sequence
  Description of Artificial Sequence: Synthetic oligonucleotide
tctcaaccacctggggaagggtgagg

SEQ ID NO: 137548 - DNA, 25 bp, Artificial Sequence
  Description of Artificial Sequence: Synthetic oligonucleotide
ctcaaccacctggggaagggtgagg

SEQ ID NO: 137549 - DNA, 25 bp, Artificial Sequence
  Description of Artificial Sequence: Synthetic oligonucleotide
tcaaccacctggggaagggtgaggc

SEQ ID NO: 137550 - DNA, 24 bp, Artificial Sequence
  Description of Artificial Sequence: Synthetic oligonucleotide
caaccacctggggaagggtgaggc

SEQ ID NO: 137551 - DNA, 26 bp, Artificial Sequence
  Description of Artificial Sequence: Synthetic oligonucleotide
aaccacctggggaagggtgaggccat

SEQ ID NO: 137552 - DNA, 25 bp, Artificial Sequence
  Description of Artificial Sequence: Synthetic oligonucleotide
accacctggggaagggtgaggccat

SEQ ID NO: 137553 - DNA, 24 bp, Artificial Sequence
  Description of Artificial Sequence: Synthetic oligonucleotide
ccacctggggaagggtgaggccat

SEQ ID NO: 137554 - DNA, 24 bp, Artificial Sequence
  Description of Artificial Sequence: Synthetic oligonucleotide
cacctggggaagggtgaggccatc

SEQ ID NO: 137555 - DNA, 25 bp, Artificial Sequence
  Description of Artificial Sequence: Synthetic oligonucleotide
acctggggaagggtgaggccatcga

SEQ ID NO: 137556 - DNA, 24 bp, Artificial Sequence
  Description of Artificial Sequence: Synthetic oligonucleotide
cctggggaagggtgaggccatcga

SEQ ID NO: 137557 - DNA, 24 bp, Artificial Sequence
  Description of Artificial Sequence: Synthetic oligonucleotide
ctggggaagggtgaggccatcgag

SEQ ID NO: 137558 - DNA, 24 bp, Artificial Sequence
  Description of Artificial Sequence: Synthetic oligonucleotide
tggggaagggtgaggccatcgagg

SEQ ID NO: 137559 - DNA, 23 bp, Artificial Sequence
  Description of Artificial Sequence: Synthetic oligonucleotide
ggggaagggtgaggccatcgagg

SEQ ID NO: 137560 - DNA, 26 bp, Artificial Sequence
  Description of Artificial Sequence: Synthetic oligonucleotide
gggaagggtgaggccatcgaggcaat

SEQ ID NO: 137561 - DNA, 26 bp, Artificial Sequence
  Description of Artificial Sequence: Synthetic oligonucleotide
ggaagggtgaggccatcgaggcaatc

SEQ ID NO: 137562 - DNA, 27 bp, Artificial Sequence
  Description of Artificial Sequence: Synthetic oligonucleotide
gaagggtgaggccatcgaggcaatcct

SEQ ID NO: 137563 - DNA, 27 bp, Artificial Sequence
  Description of Artificial Sequence: Synthetic oligonucleotide
aagggtgaggccatcgaggcaatcctg

SEQ ID NO: 137564 - DNA, 26 bp, Artificial Sequence
  Description of Artificial Sequence: Synthetic oligonucleotide
agggtgaggccatcgaggcaatcctg

SEQ ID NO: 137565 - DNA, 25 bp, Artificial Sequence
  Description of Artificial Sequence: Synthetic oligonucleotide
gggtgaggccatcgaggcaatcctg

SEQ ID NO: 137566 - DNA, 25 bp, Artificial Sequence
  Description of Artificial Sequence: Synthetic oligonucleotide
ggtgaggccatcgaggcaatcctgg

SEQ ID NO: 137567 - DNA, 26 bp, Artificial Sequence
  Description of Artificial Sequence: Synthetic oligonucleotide
gtgaggccatcgaggcaatcctggct

SEQ ID NO: 137568 - DNA, 26 bp, Artificial Sequence
  Description of Artificial Sequence: Synthetic oligonucleotide
tgaggccatcgaggcaatcctggctg

SEQ ID NO: 137569 - DNA, 25 bp, Artificial Sequence
  Description of Artificial Sequence: Synthetic oligonucleotide
gaggccatcgaggcaatcctggctg

SEQ ID NO: 137570 - DNA, 26 bp, Artificial Sequence
  Description of Artificial Sequence: Synthetic oligonucleotide
aggccatcgaggcaatcctggctgca

SEQ ID NO: 137571 - DNA, 25 bp, Artificial Sequence
  Description of Artificial Sequence: Synthetic oligonucleotide
ggccatcgaggcaatcctggctgca

SEQ ID NO: 137572 - DNA, 26 bp, Artificial Sequence
  Description of Artificial Sequence: Synthetic oligonucleotide
gccatcgaggcaatcctggctgcact

SEQ ID NO: 137573 - DNA, 26 bp, Artificial Sequence
  Description of Artificial Sequence: Synthetic oligonucleotide
ccatcgaggcaatcctggctgcactg

SEQ ID NO: 137574 - DNA, 27 bp, Artificial Sequence
  Description of Artificial Sequence: Synthetic oligonucleotide
catcgaggcaatcctggctgcactgga

SEQ ID NO: 137575 - DNA, 27 bp, Artificial Sequence
  Description of Artificial Sequence: Synthetic oligonucleotide
atcgaggcaatcctggctgcactggag

SEQ ID NO: 137576 - DNA, 26 bp, Artificial Sequence
  Description of Artificial Sequence: Synthetic oligonucleotide
tcgaggcaatcctggctgcactggag

SEQ ID NO: 137577 - DNA, 25 bp, Artificial Sequence
  Description of Artificial Sequence: Synthetic oligonucleotide
cgaggcaatcctggctgcactggag

SEQ ID NO: 137578 - DNA, 27 bp, Artificial Sequence
  Description of Artificial Sequence: Synthetic oligonucleotide
gaggcaatcctggctgcactggaggtt

SEQ ID NO: 137579 - DNA, 27 bp, Artificial Sequence
  Description of Artificial Sequence: Synthetic oligonucleotide
aggcaatcctggctgcactggaggttg

SEQ ID NO: 137580 - DNA, 27 bp, Artificial Sequence
  Description of Artificial Sequence: Synthetic oligonucleotide
ggcaatcctggctgcactggaggttgt

SEQ ID NO: 137581 - DNA, 27 bp, Artificial Sequence
  Description of Artificial Sequence: Synthetic oligonucleotide
gcaatcctggctgcactggaggttgtg

SEQ ID NO: 137582 - DNA, 28 bp, Artificial Sequence
  Description of Artificial Sequence: Synthetic oligonucleotide
caatcctggctgcactggaggttgtgtc

SEQ ID NO: 137583 - DNA, 29 bp, Artificial Sequence
  Description of Artificial Sequence: Synthetic oligonucleotide
aatcctggctgcactggaggttgtgtcag

SEQ ID NO: 137584 - DNA, 28 bp, Artificial Sequence
  Description of Artificial Sequence: Synthetic oligonucleotide
atcctggctgcactggaggttgtgtcag

SEQ ID NO: 137585 - DNA, 27 bp, Artificial Sequence
  Description of Artificial Sequence: Synthetic oligonucleotide
tcctggctgcactggaggttgtgtcag

SEQ ID NO: 137586 - DNA, 27 bp, Artificial Sequence
  Description of Artificial Sequence: Synthetic oligonucleotide
cctggctgcactggaggttgtgtcaga

SEQ ID NO: 137587 - DNA, 27 bp, Artificial Sequence
  Description of Artificial Sequence: Synthetic oligonucleotide
ctggctgcactggaggttgtgtcagag

SEQ ID NO: 137588 - DNA, 27 bp, Artificial Sequence
  Description of Artificial Sequence: Synthetic oligonucleotide
tggctgcactggaggttgtgtcagagc

SEQ ID NO: 137589 - DNA, 26 bp, Artificial Sequence
  Description of Artificial Sequence: Synthetic oligonucleotide
ggctgcactggaggttgtgtcagagc

SEQ ID NO: 137590 - DNA, 27 bp, Artificial Sequence
  Description of Artificial Sequence: Synthetic oligonucleotide
gctgcactggaggttgtgtcagagcca

SEQ ID NO: 137591 - DNA, 29 bp, Artificial Sequence
  Description of Artificial Sequence: Synthetic oligonucleotide
ctgcactggaggttgtgtcagagccattc

SEQ ID NO: 137592 - DNA, 29 bp, Artificial Sequence
  Description of Artificial Sequence: Synthetic oligonucleotide
tgcactggaggttgtgtcagagccattcc

SEQ ID NO: 137593 - DNA, 28 bp, Artificial Sequence
  Description of Artificial Sequence: Synthetic oligonucleotide
gcactggaggttgtgtcagagccattcc

SEQ ID NO: 137594 - DNA, 28 bp, Artificial Sequence
  Description of Artificial Sequence: Synthetic oligonucleotide
cactggaggttgtgtcagagccattccg

SEQ ID NO: 137595 - DNA, 28 bp, Artificial Sequence
  Description of Artificial Sequence: Synthetic oligonucleotide
actggaggttgtgtcagagccattccgc

SEQ ID NO: 137596 - DNA, 27 bp, Artificial Sequence
  Description of Artificial Sequence: Synthetic oligonucleotide
ctggaggttgtgtcagagccattccgc

SEQ ID NO: 137597 - DNA, 28 bp, Artificial Sequence
  Description of Artificial Sequence: Synthetic oligonucleotide
tggaggttgtgtcagagccattccgcag

SEQ ID NO: 137598 - DNA, 27 bp, Artificial Sequence
  Description of Artificial Sequence: Synthetic oligonucleotide
ggaggttgtgtcagagccattccgcag

SEQ ID NO: 137599 - DNA, 31 bp, Artificial Sequence
  Description of Artificial Sequence: Synthetic oligonucleotide
gaggttgtgtcagagccattccgcagttttg

SEQ ID NO: 137600 - DNA, 31 bp, Artificial Sequence
  Description of Artificial Sequence: Synthetic oligonucleotide
aggttgtgtcagagccattccgcagttttgc

SEQ ID NO: 137601 - DNA, 30 bp, Artificial Sequence
  Description of Artificial Sequence: Synthetic oligonucleotide
ggttgtgtcagagccattccgcagttttgc

SEQ ID NO: 137602 - DNA, 30 bp, Artificial Sequence
  Description of Artificial Sequence: Synthetic oligonucleotide
gttgtgtcagagccattccgcagttttgcc

SEQ ID NO: 137603 - DNA, 32 bp, Artificial Sequence
  Description of Artificial Sequence: Synthetic oligonucleotide
ttgtgtcagagccattccgcagttttgccaac

SEQ ID NO: 137604 - DNA, 31 bp, Artificial Sequence
  Description of Artificial Sequence: Synthetic oligonucleotide
tgtgtcagagccattccgcagttttgccaac

SEQ ID NO: 137605 - DNA, 30 bp, Artificial Sequence
  Description of Artificial Sequence: Synthetic oligonucleotide
gtgtcagagccattccgcagttttgccaac

SEQ ID NO: 137606 - DNA, 31 bp, Artificial Sequence
  Description of Artificial Sequence: Synthetic oligonucleotide
tgtcagagccattccgcagttttgccaacac

SEQ ID NO: 137607 - DNA, 30 bp, Artificial Sequence
  Description of Artificial Sequence: Synthetic oligonucleotide
gtcagagccattccgcagttttgccaacac

SEQ ID NO: 137608 - DNA, 31 bp, Artificial Sequence
  Description of Artificial Sequence: Synthetic oligonucleotide
tcagagccattccgcagttttgccaacacac

SEQ ID NO: 137609 - DNA, 30 bp, Artificial Sequence
  Description of Artificial Sequence: Synthetic oligonucleotide
cagagccattccgcagttttgccaacacac

SEQ ID NO: 137610 - DNA, 31 bp, Artificial Sequence
  Description of Artificial Sequence: Synthetic oligonucleotide
agagccattccgcagttttgccaacacactg

SEQ ID NO: 137611 - DNA, 30 bp, Artificial Sequence
  Description of Artificial Sequence: Synthetic oligonucleotide
gagccattccgcagttttgccaacacactg

SEQ ID NO: 137612 - DNA, 30 bp, Artificial Sequence
  Description of Artificial Sequence: Synthetic oligonucleotide
agccattccgcagttttgccaacacactgg

SEQ ID NO: 137613 - DNA, 29 bp, Artificial Sequence
  Description of Artificial Sequence: Synthetic oligonucleotide
gccattccgcagttttgccaacacactgg

SEQ ID NO: 137614 - DNA, 30 bp, Artificial Sequence
  Description of Artificial Sequence: Synthetic oligonucleotide
ccattccgcagttttgccaacacactggtg

SEQ ID NO: 137615 - DNA, 30 bp, Artificial Sequence
  Description of Artificial Sequence: Synthetic oligonucleotide
cattccgcagttttgccaacacactggtgg

SEQ ID NO: 137616 - DNA, 32 bp, Artificial Sequence
  Description of Artificial Sequence: Synthetic oligonucleotide
attccgcagttttgccaacacactggtggatg

SEQ ID NO: 137617 - DNA, 31 bp, Artificial Sequence
  Description of Artificial Sequence: Synthetic oligonucleotide
ttccgcagttttgccaacacactggtggatg

SEQ ID NO: 137618 - DNA, 30 bp, Artificial Sequence
  Description of Artificial Sequence: Synthetic oligonucleotide
tccgcagttttgccaacacactggtggatg

SEQ ID NO: 137619 - DNA, 29 bp, Artificial Sequence
  Description of Artificial Sequence: Synthetic oligonucleotide
ccgcagttttgccaacacactggtggatg

SEQ ID NO: 137620 - DNA, 30 bp, Artificial Sequence
  Description of Artificial Sequence: Synthetic oligonucleotide
cgcagttttgccaacacactggtggatgtg

SEQ ID NO: 137621 - DNA, 31 bp, Artificial Sequence
  Description of Artificial Sequence: Synthetic oligonucleotide
gcagttttgccaacacactggtggatgtgtg

SEQ ID NO: 137622 - DNA, 32 bp, Artificial Sequence
  Description of Artificial Sequence: Synthetic oligonucleotide
cagttttgccaacacactggtggatgtgtgtg

SEQ ID NO: 137623 - DNA, 32 bp, Artificial Sequence
  Description of Artificial Sequence: Synthetic oligonucleotide
agttttgccaacacactggtggatgtgtgtgc

SEQ ID NO: 137624 - DNA, 31 bp, Artificial Sequence
  Description of Artificial Sequence: Synthetic oligonucleotide
gttttgccaacacactggtggatgtgtgtgc

SEQ ID NO: 137625 - DNA, 35 bp, Artificial Sequence
  Description of Artificial Sequence: Synthetic oligonucleotide
ttttgccaacacactggtggatgtgtgtgcatatg

SEQ ID NO: 137626 - DNA, 34 bp, Artificial Sequence
  Description of Artificial Sequence: Synthetic oligonucleotide
tttgccaacacactggtggatgtgtgtgcatatg

SEQ ID NO: 137627 - DNA, 33 bp, Artificial Sequence
  Description of Artificial Sequence: Synthetic oligonucleotide
ttgccaacacactggtggatgtgtgtgcatatg

SEQ ID NO: 137628 - DNA, 32 bp, Artificial Sequence
  Description of Artificial Sequence: Synthetic oligonucleotide
tgccaacacactggtggatgtgtgtgcatatg

SEQ ID NO: 137629 - DNA, 31 bp, Artificial Sequence
  Description of Artificial Sequence: Synthetic oligonucleotide
gccaacacactggtggatgtgtgtgcatatg

SEQ ID NO: 137630 - DNA, 31 bp, Artificial Sequence
  Description of Artificial Sequence: Synthetic oligonucleotide
ccaacacactggtggatgtgtgtgcatatgc

SEQ ID NO: 137631 - DNA, 32 bp, Artificial Sequence
  Description of Artificial Sequence: Synthetic oligonucleotide
caacacactggtggatgtgtgtgcatatgcag

SEQ ID NO: 137632 - DNA, 32 bp, Artificial Sequence
  Description of Artificial Sequence: Synthetic oligonucleotide
aacacactggtggatgtgtgtgcatatgcagg

SEQ ID NO: 137633 - DNA, 31 bp, Artificial Sequence
  Description of Artificial Sequence: Synthetic oligonucleotide
acacactggtggatgtgtgtgcatatgcagg

SEQ ID NO: 137634 - DNA, 30 bp, Artificial Sequence
  Description of Artificial Sequence: Synthetic oligonucleotide
cacactggtggatgtgtgtgcatatgcagg

SEQ ID NO: 137635 - DNA, 30 bp, Artificial Sequence
  Description of Artificial Sequence: Synthetic oligonucleotide
acactggtggatgtgtgtgcatatgcaggc

SEQ ID NO: 137636 - DNA, 29 bp, Artificial Sequence
  Description of Artificial Sequence: Synthetic oligonucleotide
cactggtggatgtgtgtgcatatgcaggc

SEQ ID NO: 137637 - DNA, 30 bp, Artificial Sequence
  Description of Artificial Sequence: Synthetic oligonucleotide
actggtggatgtgtgtgcatatgcaggctc

SEQ ID NO: 137638 - DNA, 29 bp, Artificial Sequence
  Description of Artificial Sequence: Synthetic oligonucleotide
ctggtggatgtgtgtgcatatgcaggctc

SEQ ID NO: 137639 - DNA, 30 bp, Artificial Sequence
  Description of Artificial Sequence: Synthetic oligonucleotide
tggtggatgtgtgtgcatatgcaggctctg

SEQ ID NO: 137640 - DNA, 29 bp, Artificial Sequence
  Description of Artificial Sequence: Synthetic oligonucleotide
ggtggatgtgtgtgcatatgcaggctctg

SEQ ID NO: 137641 - DNA, 29 bp, Artificial Sequence
  Description of Artificial Sequence: Synthetic oligonucleotide
gtggatgtgtgtgcatatgcaggctctgg

SEQ ID NO: 137642 - DNA, 29 bp, Artificial Sequence
  Description of Artificial Sequence: Synthetic oligonucleotide
tggatgtgtgtgcatatgcaggctctggg

SEQ ID NO: 137643 - DNA, 28 bp, Artificial Sequence
  Description of Artificial Sequence: Synthetic oligonucleotide
ggatgtgtgtgcatatgcaggctctggg

SEQ ID NO: 137644 - DNA, 31 bp, Artificial Sequence
  Description of Artificial Sequence: Synthetic oligonucleotide
gatgtgtgtgcatatgcaggctctgggaatg

SEQ ID NO: 137645 - DNA, 32 bp, Artificial Sequence
  Description of Artificial Sequence: Synthetic oligonucleotide
atgtgtgtgcatatgcaggctctgggaatgtg

SEQ ID NO: 137646 - DNA, 31 bp, Artificial Sequence
  Description of Artificial Sequence: Synthetic oligonucleotide
tgtgtgtgcatatgcaggctctgggaatgtg

SEQ ID NO: 137647 - DNA, 30 bp, Artificial Sequence
  Description of Artificial Sequence: Synthetic oligonucleotide
gtgtgtgcatatgcaggctctgggaatgtg

SEQ ID NO: 137648 - DNA, 30 bp, Artificial Sequence
  Description of Artificial Sequence: Synthetic oligonucleotide
tgtgtgcatatgcaggctctgggaatgtgc

SEQ ID NO: 137649 - DNA, 29 bp, Artificial Sequence
  Description of Artificial Sequence: Synthetic oligonucleotide
gtgtgcatatgcaggctctgggaatgtgc

SEQ ID NO: 137650 - DNA, 30 bp, Artificial Sequence
  Description of Artificial Sequence: Synthetic oligonucleotide
tgtgcatatgcaggctctgggaatgtgctg

SEQ ID NO: 137651 - DNA, 29 bp, Artificial Sequence
  Description of Artificial Sequence: Synthetic oligonucleotide
gtgcatatgcaggctctgggaatgtgctg

SEQ ID NO: 137652 - DNA, 31 bp, Artificial Sequence
  Description of Artificial Sequence: Synthetic oligonucleotide
tgcatatgcaggctctgggaatgtgctgaag

SEQ ID NO: 137653 - DNA, 30 bp, Artificial Sequence
  Description of Artificial Sequence: Synthetic oligonucleotide
gcatatgcaggctctgggaatgtgctgaag

SEQ ID NO: 137654 - DNA, 30 bp, Artificial Sequence
  Description of Artificial Sequence: Synthetic oligonucleotide
catatgcaggctctgggaatgtgctgaagg

SEQ ID NO: 137655 - DNA, 31 bp, Artificial Sequence
  Description of Artificial Sequence: Synthetic oligonucleotide
atatgcaggctctgggaatgtgctgaaggtg

SEQ ID NO: 137656 - DNA, 30 bp, Artificial Sequence
  Description of Artificial Sequence: Synthetic oligonucleotide
tatgcaggctctgggaatgtgctgaaggtg

SEQ ID NO: 137657 - DNA, 29 bp, Artificial Sequence
  Description of Artificial Sequence: Synthetic oligonucleotide
atgcaggctctgggaatgtgctgaaggtg

SEQ ID NO: 137658 - DNA, 28 bp, Artificial Sequence
  Description of Artificial Sequence: Synthetic oligonucleotide
tgcaggctctgggaatgtgctgaaggtg

SEQ ID NO: 137659 - DNA, 27 bp, Artificial Sequence
  Description of Artificial Sequence: Synthetic oligonucleotide
gcaggctctgggaatgtgctgaaggtg

SEQ ID NO: 137660 - DNA, 27 bp, Artificial Sequence
  Description of Artificial Sequence: Synthetic oligonucleotide
caggctctgggaatgtgctgaaggtgc

SEQ ID NO: 137661 - DNA, 28 bp, Artificial Sequence
  Description of Artificial Sequence: Synthetic oligonucleotide
aggctctgggaatgtgctgaaggtgcag

SEQ ID NO: 137662 - DNA, 27 bp, Artificial Sequence
  Description of Artificial Sequence: Synthetic oligonucleotide
ggctctgggaatgtgctgaaggtgcag

SEQ ID NO: 137663 - DNA, 27 bp, Artificial Sequence
  Description of Artificial Sequence: Synthetic oligonucleotide
gctctgggaatgtgctgaaggtgcagc

SEQ ID NO: 137664 - DNA, 28 bp, Artificial Sequence
  Description of Artificial Sequence: Synthetic oligonucleotide
ctctgggaatgtgctgaaggtgcagcag

SEQ ID NO: 137665 - DNA, 28 bp, Artificial Sequence
  Description of Artificial Sequence: Synthetic oligonucleotide
tctgggaatgtgctgaaggtgcagcagc

SEQ ID NO: 137666 - DNA, 27 bp, Artificial Sequence
  Description of Artificial Sequence: Synthetic oligonucleotide
ctgggaatgtgctgaaggtgcagcagc

SEQ ID NO: 137667 - DNA, 28 bp, Artificial Sequence
  Description of Artificial Sequence: Synthetic oligonucleotide
tgggaatgtgctgaaggtgcagcagctg

SEQ ID NO: 137668 - DNA, 27 bp, Artificial Sequence
  Description of Artificial Sequence: Synthetic oligonucleotide
gggaatgtgctgaaggtgcagcagctg

SEQ ID NO: 137669 - DNA, 27 bp, Artificial Sequence
  Description of Artificial Sequence: Synthetic oligonucleotide
ggaatgtgctgaaggtgcagcagctgc

SEQ ID NO: 137670 - DNA, 28 bp, Artificial Sequence
  Description of Artificial Sequence: Synthetic oligonucleotide
gaatgtgctgaaggtgcagcagctgctc

SEQ ID NO: 137671 - DNA, 28 bp, Artificial Sequence
  Description of Artificial Sequence: Synthetic oligonucleotide
aatgtgctgaaggtgcagcagctgctcc

SEQ ID NO: 137672 - DNA, 27 bp, Artificial Sequence
  Description of Artificial Sequence: Synthetic oligonucleotide
atgtgctgaaggtgcagcagctgctcc

SEQ ID NO: 137673 - DNA, 27 bp, Artificial Sequence
  Description of Artificial Sequence: Synthetic oligonucleotide
tgtgctgaaggtgcagcagctgctcca

SEQ ID NO: 137674 - DNA, 26 bp, Artificial Sequence
  Description of Artificial Sequence: Synthetic oligonucleotide
gtgctgaaggtgcagcagctgctcca

SEQ ID NO: 137675 - DNA, 27 bp, Artificial Sequence
  Description of Artificial Sequence: Synthetic oligonucleotide
tgctgaaggtgcagcagctgctccaca

SEQ ID NO: 137676 - DNA, 27 bp, Artificial Sequence
  Description of Artificial Sequence: Synthetic oligonucleotide
gctgaaggtgcagcagctgctccacat

SEQ ID NO: 137677 - DNA, 29 bp, Artificial Sequence
  Description of Artificial Sequence: Synthetic oligonucleotide
ctgaaggtgcagcagctgctccacatttg

SEQ ID NO: 137678 - DNA, 31 bp, Artificial Sequence
  Description of Artificial Sequence: Synthetic oligonucleotide
tgaaggtgcagcagctgctccacatttgtag

SEQ ID NO: 137679 - DNA, 30 bp, Artificial Sequence
  Description of Artificial Sequence: Synthetic oligonucleotide
gaaggtgcagcagctgctccacatttgtag

SEQ ID NO: 137680 - DNA, 30 bp, Artificial Sequence
  Description of Artificial Sequence: Synthetic oligonucleotide
aaggtgcagcagctgctccacatttgtagc

SEQ ID NO: 137681 - DNA, 29 bp, Artificial Sequence
  Description of Artificial Sequence: Synthetic oligonucleotide
aggtgcagcagctgctccacatttgtagc

SEQ ID NO: 137682 - DNA, 28 bp, Artificial Sequence
  Description of Artificial Sequence: Synthetic oligonucleotide
ggtgcagcagctgctccacatttgtagc

SEQ ID NO: 137683 - DNA, 28 bp, Artificial Sequence
  Description of Artificial Sequence: Synthetic oligonucleotide
gtgcagcagctgctccacatttgtagcg

SEQ ID NO: 137684 - DNA, 30 bp, Artificial Sequence
  Description of Artificial Sequence: Synthetic oligonucleotide
tgcagcagctgctccacatttgtagcgaac

SEQ ID NO: 137685 - DNA, 29 bp, Artificial Sequence
  Description of Artificial Sequence: Synthetic oligonucleotide
gcagcagctgctccacatttgtagcgaac

SEQ ID NO: 137686 - DNA, 30 bp, Artificial Sequence
  Description of Artificial Sequence: Synthetic oligonucleotide
cagcagctgctccacatttgtagcgaacac

SEQ ID NO: 137687 - DNA, 33 bp, Artificial Sequence
  Description of Artificial Sequence: Synthetic oligonucleotide
agcagctgctccacatttgtagcgaacactttg

SEQ ID NO: 137688 - DNA, 32 bp, Artificial Sequence
  Description of Artificial Sequence: Synthetic oligonucleotide
gcagctgctccacatttgtagcgaacactttg

SEQ ID NO: 137689 - DNA, 33 bp, Artificial Sequence
  Description of Artificial Sequence: Synthetic oligonucleotide
cagctgctccacatttgtagcgaacactttgac

SEQ ID NO: 137690 - DNA, 34 bp, Artificial Sequence
  Description of Artificial Sequence: Synthetic oligonucleotide
agctgctccacatttgtagcgaacactttgactc

SEQ ID NO: 137691 - DNA, 33 bp, Artificial Sequence
  Description of Artificial Sequence: Synthetic oligonucleotide
gctgctccacatttgtagcgaacactttgactc

SEQ ID NO: 137692 - DNA, 33 bp, Artificial Sequence
  Description of Artificial Sequence: Synthetic oligonucleotide
ctgctccacatttgtagcgaacactttgactcc

SEQ ID NO: 137693 - DNA, 36 bp, Artificial Sequence
  Description of Artificial Sequence: Synthetic oligonucleotide
tgctccacatttgtagcgaacactttgactccaaag

SEQ ID NO: 137694 - DNA, 35 bp, Artificial Sequence
  Description of Artificial Sequence: Synthetic oligonucleotide
gctccacatttgtagcgaacactttgactccaaag

SEQ ID NO: 137695 - DNA, 36 bp, Artificial Sequence
  Description of Artificial Sequence: Synthetic oligonucleotide
ctccacatttgtagcgaacactttgactccaaagag

SEQ ID NO: 137696 - DNA, 38 bp, Artificial Sequence
  Description of Artificial Sequence: Synthetic oligonucleotide
tccacatttgtagcgaacactttgactccaaagagaag

SEQ ID NO: 137697 - DNA, 37 bp, Artificial Sequence
  Description of Artificial Sequence: Synthetic oligonucleotide
ccacatttgtagcgaacactttgactccaaagagaag

SEQ ID NO: 137698 - DNA, 37 bp, Artificial Sequence
  Description of Artificial Sequence: Synthetic oligonucleotide
cacatttgtagcgaacactttgactccaaagagaagg

SEQ ID NO: 137699 - DNA, 38 bp, Artificial Sequence
  Description of Artificial Sequence: Synthetic oligonucleotide
acatttgtagcgaacactttgactccaaagagaaggag

SEQ ID NO: 137700 - DNA, 37 bp, Artificial Sequence
  Description of Artificial Sequence: Synthetic oligonucleotide
catttgtagcgaacactttgactccaaagagaaggag

SEQ ID NO: 137701 - DNA, 37 bp, Artificial Sequence
  Description of Artificial Sequence: Synthetic oligonucleotide
atttgtagcgaacactttgactccaaagagaaggagg

SEQ ID NO: 137702 - DNA, 36 bp, Artificial Sequence
  Description of Artificial Sequence: Synthetic oligonucleotide
tttgtagcgaacactttgactccaaagagaaggagg

SEQ ID NO: 137703 - DNA, 35 bp, Artificial Sequence
  Description of Artificial Sequence: Synthetic oligonucleotide
ttgtagcgaacactttgactccaaagagaaggagg

SEQ ID NO: 137704 - DNA, 34 bp, Artificial Sequence
  Description of Artificial Sequence: Synthetic oligonucleotide
tgtagcgaacactttgactccaaagagaaggagg

SEQ ID NO: 137705 - DNA, 33 bp, Artificial Sequence
  Description of Artificial Sequence: Synthetic oligonucleotide
gtagcgaacactttgactccaaagagaaggagg

SEQ ID NO: 137706 - DNA, 35 bp, Artificial Sequence
  Description of Artificial Sequence: Synthetic oligonucleotide
tagcgaacactttgactccaaagagaaggaggaag

SEQ ID NO: 137707 - DNA, 34 bp, Artificial Sequence
  Description of Artificial Sequence: Synthetic oligonucleotide
agcgaacactttgactccaaagagaaggaggaag

SEQ ID NO: 137708 - DNA, 33 bp, Artificial Sequence
  Description of Artificial Sequence: Synthetic oligonucleotide
gcgaacactttgactccaaagagaaggaggaag

SEQ ID NO: 137709 - DNA, 34 bp, Artificial Sequence
  Description of Artificial Sequence: Synthetic oligonucleotide
cgaacactttgactccaaagagaaggaggaagac

SEQ ID NO: 137710 - DNA, 37 bp, Artificial Sequence
  Description of Artificial Sequence: Synthetic oligonucleotide
gaacactttgactccaaagagaaggaggaagacaaag

SEQ ID NO: 137711 - DNA, 38 bp, Artificial Sequence
  Description of Artificial Sequence: Synthetic oligonucleotide
aacactttgactccaaagagaaggaggaagacaaagac

SEQ ID NO: 137712 - DNA, 37 bp, Artificial Sequence
  Description of Artificial Sequence: Synthetic oligonucleotide
acactttgactccaaagagaaggaggaagacaaagac

SEQ ID NO: 137713 - DNA, 36 bp, Artificial Sequence
  Description of Artificial Sequence: Synthetic oligonucleotide
cactttgactccaaagagaaggaggaagacaaagac

SEQ ID NO: 137714 - DNA, 38 bp, Artificial Sequence
  Description of Artificial Sequence: Synthetic oligonucleotide
actttgactccaaagagaaggaggaagacaaagacaag

SEQ ID NO: 137715 - DNA, 37 bp, Artificial Sequence
  Description of Artificial Sequence: Synthetic oligonucleotide
ctttgactccaaagagaaggaggaagacaaagacaag

SEQ ID NO: 137716 - DNA, 39 bp, Artificial Sequence
  Description of Artificial Sequence: Synthetic oligonucleotide
tttgactccaaagagaaggaggaagacaaagacaagaag

SEQ ID NO: 137717 - DNA, 38 bp, Artificial Sequence
  Description of Artificial Sequence: Synthetic oligonucleotide
ttgactccaaagagaaggaggaagacaaagacaagaag

SEQ ID NO: 137718 - DNA, 37 bp, Artificial Sequence
  Description of Artificial Sequence: Synthetic oligonucleotide
tgactccaaagagaaggaggaagacaaagacaagaag

SEQ ID NO: 137719 - DNA, 36 bp, Artificial Sequence
  Description of Artificial Sequence: Synthetic oligonucleotide
gactccaaagagaaggaggaagacaaagacaagaag

SEQ ID NO: 137720 - DNA, 36 bp, Artificial Sequence
  Description of Artificial Sequence: Synthetic oligonucleotide
actccaaagagaaggaggaagacaaagacaagaagg

SEQ ID NO: 137721 - DNA, 35 bp, Artificial Sequence
  Description of Artificial Sequence: Synthetic oligonucleotide
ctccaaagagaaggaggaagacaaagacaagaagg

SEQ ID NO: 137722 - DNA, 39 bp, Artificial Sequence
  Description of Artificial Sequence: Synthetic oligonucleotide
tccaaagagaaggaggaagacaaagacaagaaggaaaag

SEQ ID NO: 137723 - DNA, 38 bp, Artificial Sequence
  Description of Artificial Sequence: Synthetic oligonucleotide
ccaaagagaaggaggaagacaaagacaagaaggaaaag

SEQ ID NO: 137724 - DNA, 41 bp, Artificial Sequence
  Description of Artificial Sequence: Synthetic oligonucleotide
caaagagaaggaggaagacaaagacaagaaggaaaagaaag

SEQ ID NO: 137725 - DNA, 42 bp, Artificial Sequence
  Description of Artificial Sequence: Synthetic oligonucleotide
aaagagaaggaggaagacaaagacaagaaggaaaagaaagac

SEQ ID NO: 137726 - DNA, 41 bp, Artificial Sequence
  Description of Artificial Sequence: Synthetic oligonucleotide
aagagaaggaggaagacaaagacaagaaggaaaagaaagac

SEQ ID NO: 137727 - DNA, 40 bp, Artificial Sequence
  Description of Artificial Sequence: Synthetic oligonucleotide
agagaaggaggaagacaaagacaagaaggaaaagaaagac

SEQ ID NO: 137728 - DNA, 39 bp, Artificial Sequence
  Description of Artificial Sequence: Synthetic oligonucleotide
gagaaggaggaagacaaagacaagaaggaaaagaaagac

SEQ ID NO: 137729 - DNA, 41 bp, Artificial Sequence
  Description of Artificial Sequence: Synthetic oligonucleotide
agaaggaggaagacaaagacaagaaggaaaagaaagacaag

SEQ ID NO: 137730 - DNA, 40 bp, Artificial Sequence
  Description of Artificial Sequence: Synthetic oligonucleotide
gaaggaggaagacaaagacaagaaggaaaagaaagacaag

SEQ ID NO: 137731 - DNA, 40 bp, Artificial Sequence
  Description of Artificial Sequence: Synthetic oligonucleotide
aaggaggaagacaaagacaagaaggaaaagaaagacaagg

SEQ ID NO: 137732 - DNA, 39 bp, Artificial Sequence
  Description of Artificial Sequence: Synthetic oligonucleotide
aggaggaagacaaagacaagaaggaaaagaaagacaagg

SEQ ID NO: 137733 - DNA, 38 bp, Artificial Sequence
  Description of Artificial Sequence: Synthetic oligonucleotide
ggaggaagacaaagacaagaaggaaaagaaagacaagg

SEQ ID NO: 137734 - DNA, 39 bp, Artificial Sequence
  Description of Artificial Sequence: Synthetic oligonucleotide
gaggaagacaaagacaagaaggaaaagaaagacaaggac

SEQ ID NO: 137735 - DNA, 41 bp, Artificial Sequence
  Description of Artificial Sequence: Synthetic oligonucleotide
aggaagacaaagacaagaaggaaaagaaagacaaggacaag

SEQ ID NO: 137736 - DNA, 40 bp, Artificial Sequence
  Description of Artificial Sequence: Synthetic oligonucleotide
ggaagacaaagacaagaaggaaaagaaagacaaggacaag

SEQ ID NO: 137737 - DNA, 42 bp, Artificial Sequence
  Description of Artificial Sequence: Synthetic oligonucleotide
gaagacaaagacaagaaggaaaagaaagacaaggacaagaag

SEQ ID NO: 137738 - DNA, 42 bp, Artificial Sequence
  Description of Artificial Sequence: Synthetic oligonucleotide
aagacaaagacaagaaggaaaagaaagacaaggacaagaagg

SEQ ID NO: 137739 - DNA, 41 bp, Artificial Sequence
  Description of Artificial Sequence: Synthetic oligonucleotide
agacaaagacaagaaggaaaagaaagacaaggacaagaagg

SEQ ID NO: 137740 - DNA, 40 bp, Artificial Sequence
  Description of Artificial Sequence: Synthetic oligonucleotide
gacaaagacaagaaggaaaagaaagacaaggacaagaagg

SEQ ID NO: 137741 - DNA, 42 bp, Artificial Sequence
  Description of Artificial Sequence: Synthetic oligonucleotide
acaaagacaagaaggaaaagaaagacaaggacaagaaggaag

SEQ ID NO: 137742 - DNA, 41 bp, Artificial Sequence
  Description of Artificial Sequence: Synthetic oligonucleotide
caaagacaagaaggaaaagaaagacaaggacaagaaggaag

SEQ ID NO: 137743 - DNA, 41 bp, Artificial Sequence
  Description of Artificial Sequence: Synthetic oligonucleotide
aaagacaagaaggaaaagaaagacaaggacaagaaggaagc

SEQ ID NO: 137744 - DNA, 40 bp, Artificial Sequence
  Description of Artificial Sequence: Synthetic oligonucleotide
aagacaagaaggaaaagaaagacaaggacaagaaggaagc

SEQ ID NO: 137745 - DNA, 39 bp, Artificial Sequence
  Description of Artificial Sequence: Synthetic oligonucleotide
agacaagaaggaaaagaaagacaaggacaagaaggaagc

SEQ ID NO: 137746 - DNA, 38 bp, Artificial Sequence
  Description of Artificial Sequence: Synthetic oligonucleotide
gacaagaaggaaaagaaagacaaggacaagaaggaagc

SEQ ID NO: 137747 - DNA, 38 bp, Artificial Sequence
  Description of Artificial Sequence: Synthetic oligonucleotide
acaagaaggaaaagaaagacaaggacaagaaggaagcc

SEQ ID NO: 137748 - DNA, 37 bp, Artificial Sequence
  Description of Artificial Sequence: Synthetic oligonucleotide
caagaaggaaaagaaagacaaggacaagaaggaagcc

SEQ ID NO: 137749 - DNA, 37 bp, Artificial Sequence
  Description of Artificial Sequence: Synthetic oligonucleotide
aagaaggaaaagaaagacaaggacaagaaggaagccc

SEQ ID NO: 137750 - DNA, 36 bp, Artificial Sequence
  Description of Artificial Sequence: Synthetic oligonucleotide
agaaggaaaagaaagacaaggacaagaaggaagccc

SEQ ID NO: 137751 - DNA, 35 bp, Artificial Sequence
  Description of Artificial Sequence: Synthetic oligonucleotide
gaaggaaaagaaagacaaggacaagaaggaagccc

SEQ ID NO: 137752 - DNA, 35 bp, Artificial Sequence
  Description of Artificial Sequence: Synthetic oligonucleotide
aaggaaaagaaagacaaggacaagaaggaagcccc

SEQ ID NO: 137753 - DNA, 34 bp, Artificial Sequence
  Description of Artificial Sequence: Synthetic oligonucleotide
aggaaaagaaagacaaggacaagaaggaagcccc

SEQ ID NO: 137754 - DNA, 33 bp, Artificial Sequence
  Description of Artificial Sequence: Synthetic oligonucleotide
ggaaaagaaagacaaggacaagaaggaagcccc

SEQ ID NO: 137755 - DNA, 34 bp, Artificial Sequence
  Description of Artificial Sequence: Synthetic oligonucleotide
gaaaagaaagacaaggacaagaaggaagcccctg

SEQ ID NO: 137756 - DNA, 34 bp, Artificial Sequence
  Description of Artificial Sequence: Synthetic oligonucleotide
aaaagaaagacaaggacaagaaggaagcccctgc

SEQ ID NO: 137757 - DNA, 33 bp, Artificial Sequence
  Description of Artificial Sequence: Synthetic oligonucleotide
aaagaaagacaaggacaagaaggaagcccctgc

SEQ ID NO: 137758 - DNA, 32 bp, Artificial Sequence
  Description of Artificial Sequence: Synthetic oligonucleotide
aagaaagacaaggacaagaaggaagcccctgc

SEQ ID NO: 137759 - DNA, 31 bp, Artificial Sequence
  Description of Artificial Sequence: Synthetic oligonucleotide
agaaagacaaggacaagaaggaagcccctgc

SEQ ID NO: 137760 - DNA, 30 bp, Artificial Sequence
  Description of Artificial Sequence: Synthetic oligonucleotide
gaaagacaaggacaagaaggaagcccctgc

SEQ ID NO: 137761 - DNA, 31 bp, Artificial Sequence
  Description of Artificial Sequence: Synthetic oligonucleotide
aaagacaaggacaagaaggaagcccctgctg

SEQ ID NO: 137762 - DNA, 30 bp, Artificial Sequence
  Description of Artificial Sequence: Synthetic oligonucleotide
aagacaaggacaagaaggaagcccctgctg

SEQ ID NO: 137763 - DNA, 29 bp, Artificial Sequence
  Description of Artificial Sequence: Synthetic oligonucleotide
agacaaggacaagaaggaagcccctgctg

SEQ ID NO: 137764 - DNA, 28 bp, Artificial Sequence
  Description of Artificial Sequence: Synthetic oligonucleotide
gacaaggacaagaaggaagcccctgctg

SEQ ID NO: 137765 - DNA, 29 bp, Artificial Sequence
  Description of Artificial Sequence: Synthetic oligonucleotide
acaaggacaagaaggaagcccctgctgac

SEQ ID NO: 137766 - DNA, 28 bp, Artificial Sequence
  Description of Artificial Sequence: Synthetic oligonucleotide
caaggacaagaaggaagcccctgctgac

SEQ ID NO: 137767 - DNA, 30 bp, Artificial Sequence
  Description of Artificial Sequence: Synthetic oligonucleotide
aaggacaagaaggaagcccctgctgacatg

SEQ ID NO: 137768 - DNA, 29 bp, Artificial Sequence
  Description of Artificial Sequence: Synthetic oligonucleotide
aggacaagaaggaagcccctgctgacatg

SEQ ID NO: 137769 - DNA, 28 bp, Artificial Sequence
  Description of Artificial Sequence: Synthetic oligonucleotide
ggacaagaaggaagcccctgctgacatg

SEQ ID NO: 137770 - DNA, 28 bp, Artificial Sequence
  Description of Artificial Sequence: Synthetic oligonucleotide
gacaagaaggaagcccctgctgacatgg

SEQ ID NO: 137771 - DNA, 28 bp, Artificial Sequence
  Description of Artificial Sequence: Synthetic oligonucleotide
acaagaaggaagcccctgctgacatggg

SEQ ID NO: 137772 - DNA, 27 bp, Artificial Sequence
  Description of Artificial Sequence: Synthetic oligonucleotide
caagaaggaagcccctgctgacatggg

SEQ ID NO: 137773 - DNA, 28 bp, Artificial Sequence
  Description of Artificial Sequence: Synthetic oligonucleotide
aagaaggaagcccctgctgacatgggag

SEQ ID NO: 137774 - DNA, 27 bp, Artificial Sequence
  Description of Artificial Sequence: Synthetic oligonucleotide
agaaggaagcccctgctgacatgggag

SEQ ID NO: 137775 - DNA, 26 bp, Artificial Sequence
  Description of Artificial Sequence: Synthetic oligonucleotide
gaaggaagcccctgctgacatgggag

SEQ ID NO: 137776 - DNA, 27 bp, Artificial Sequence
  Description of Artificial Sequence: Synthetic oligonucleotide
aaggaagcccctgctgacatgggagca

SEQ ID NO: 137777 - DNA, 26 bp, Artificial Sequence
  Description of Artificial Sequence: Synthetic oligonucleotide
aggaagcccctgctgacatgggagca

SEQ ID NO: 137778 - DNA, 25 bp, Artificial Sequence
  Description of Artificial Sequence: Synthetic oligonucleotide
ggaagcccctgctgacatgggagca

SEQ ID NO: 137779 - DNA, 27 bp, Artificial Sequence
  Description of Artificial Sequence: Synthetic oligonucleotide
gaagcccctgctgacatgggagcacat

SEQ ID NO: 137780 - DNA, 27 bp, Artificial Sequence
  Description of Artificial Sequence: Synthetic oligonucleotide
aagcccctgctgacatgggagcacatc

SEQ ID NO: 137781 - DNA, 27 bp, Artificial Sequence
  Description of Artificial Sequence: Synthetic oligonucleotide
agcccctgctgacatgggagcacatca

SEQ ID NO: 137782 - DNA, 26 bp, Artificial Sequence
  Description of Artificial Sequence: Synthetic oligonucleotide
gcccctgctgacatgggagcacatca

SEQ ID NO: 137783 - DNA, 26 bp, Artificial Sequence
  Description of Artificial Sequence: Synthetic oligonucleotide
cccctgctgacatgggagcacatcag

SEQ ID NO: 137784 - DNA, 26 bp, Artificial Sequence
  Description of Artificial Sequence: Synthetic oligonucleotide
ccctgctgacatgggagcacatcagg

SEQ ID NO: 137785 - DNA, 27 bp, Artificial Sequence
  Description of Artificial Sequence: Synthetic oligonucleotide
cctgctgacatgggagcacatcaggga

SEQ ID NO: 137786 - DNA, 27 bp, Artificial Sequence
  Description of Artificial Sequence: Synthetic oligonucleotide
ctgctgacatgggagcacatcagggag

SEQ ID NO: 137787 - DNA, 28 bp, Artificial Sequence
  Description of Artificial Sequence: Synthetic oligonucleotide
tgctgacatgggagcacatcagggagtg

SEQ ID NO: 137788 - DNA, 27 bp, Artificial Sequence
  Description of Artificial Sequence: Synthetic oligonucleotide
gctgacatgggagcacatcagggagtg

SEQ ID NO: 137789 - DNA, 27 bp, Artificial Sequence
  Description of Artificial Sequence: Synthetic oligonucleotide
ctgacatgggagcacatcagggagtgg

SEQ ID NO: 137790 - DNA, 27 bp, Artificial Sequence
  Description of Artificial Sequence: Synthetic oligonucleotide
tgacatgggagcacatcagggagtggc

SEQ ID NO: 137791 - DNA, 27 bp, Artificial Sequence
  Description of Artificial Sequence: Synthetic oligonucleotide
gacatgggagcacatcagggagtggct

SEQ ID NO: 137792 - DNA, 27 bp, Artificial Sequence
  Description of Artificial Sequence: Synthetic oligonucleotide
acatgggagcacatcagggagtggctg

SEQ ID NO: 137793 - DNA, 27 bp, Artificial Sequence
  Description of Artificial Sequence: Synthetic oligonucleotide
catgggagcacatcagggagtggctgt

SEQ ID NO: 137794 - DNA, 28 bp, Artificial Sequence
  Description of Artificial Sequence: Synthetic oligonucleotide
atgggagcacatcagggagtggctgttc

SEQ ID NO: 137795 - DNA, 27 bp, Artificial Sequence
  Description of Artificial Sequence: Synthetic oligonucleotide
tgggagcacatcagggagtggctgttc

SEQ ID NO: 137796 - DNA, 27 bp, Artificial Sequence
  Description of Artificial Sequence: Synthetic oligonucleotide
gggagcacatcagggagtggctgttct

SEQ ID NO: 137797 - DNA, 27 bp, Artificial Sequence
  Description of Artificial Sequence: Synthetic oligonucleotide
ggagcacatcagggagtggctgttctg

SEQ ID NO: 137798 - DNA, 27 bp, Artificial Sequence
  Description of Artificial Sequence: Synthetic oligonucleotide
gagcacatcagggagtggctgttctgg

SEQ ID NO: 137799 - DNA, 27 bp, Artificial Sequence
  Description of Artificial Sequence: Synthetic oligonucleotide
agcacatcagggagtggctgttctggg

SEQ ID NO: 137800 - DNA, 26 bp, Artificial Sequence
  Description of Artificial Sequence: Synthetic oligonucleotide
gcacatcagggagtggctgttctggg

SEQ ID NO: 137801 - DNA, 27 bp, Artificial Sequence
  Description of Artificial Sequence: Synthetic oligonucleotide
cacatcagggagtggctgttctgggga

SEQ ID NO: 137802 - DNA, 29 bp, Artificial Sequence
  Description of Artificial Sequence: Synthetic oligonucleotide
acatcagggagtggctgttctggggattg

SEQ ID NO: 137803 - DNA, 28 bp, Artificial Sequence
  Description of Artificial Sequence: Synthetic oligonucleotide
catcagggagtggctgttctggggattg

SEQ ID NO: 137804 - DNA, 28 bp, Artificial Sequence
  Description of Artificial Sequence: Synthetic oligonucleotide
atcagggagtggctgttctggggattgc

SEQ ID NO: 137805 - DNA, 27 bp, Artificial Sequence
  Description of Artificial Sequence: Synthetic oligonucleotide
tcagggagtggctgttctggggattgc

SEQ ID NO: 137806 - DNA, 26 bp, Artificial Sequence
  Description of Artificial Sequence: Synthetic oligonucleotide
cagggagtggctgttctggggattgc

SEQ ID NO: 137807 - DNA, 26 bp, Artificial Sequence
  Description of Artificial Sequence: Synthetic oligonucleotide
agggagtggctgttctggggattgcc

SEQ ID NO: 137808 - DNA, 25 bp, Artificial Sequence
  Description of Artificial Sequence: Synthetic oligonucleotide
gggagtggctgttctggggattgcc

SEQ ID NO: 137809 - DNA, 27 bp, Artificial Sequence
  Description of Artificial Sequence: Synthetic oligonucleotide
ggagtggctgttctggggattgccctt

SEQ ID NO: 137810 - DNA, 30 bp, Artificial Sequence
  Description of Artificial Sequence: Synthetic oligonucleotide
gagtggctgttctggggattgcccttattg

SEQ ID NO: 137811 - DNA, 30 bp, Artificial Sequence
  Description of Artificial Sequence: Synthetic oligonucleotide
agtggctgttctggggattgcccttattgc

SEQ ID NO: 137812 - DNA, 29 bp, Artificial Sequence
  Description of Artificial Sequence: Synthetic oligonucleotide
gtggctgttctggggattgcccttattgc

SEQ ID NO: 137813 - DNA, 32 bp, Artificial Sequence
  Description of Artificial Sequence: Synthetic oligonucleotide
tggctgttctggggattgcccttattgctatg

SEQ ID NO: 137814 - DNA, 31 bp, Artificial Sequence
  Description of Artificial Sequence: Synthetic oligonucleotide
ggctgttctggggattgcccttattgctatg

SEQ ID NO: 137815 - DNA, 31 bp, Artificial Sequence
  Description of Artificial Sequence: Synthetic oligonucleotide
gctgttctggggattgcccttattgctatgg

SEQ ID NO: 137816 - DNA, 31 bp, Artificial Sequence
  Description of Artificial Sequence: Synthetic oligonucleotide
ctgttctggggattgcccttattgctatggg

SEQ ID NO: 137817 - DNA, 31 bp, Artificial Sequence
  Description of Artificial Sequence: Synthetic oligonucleotide
tgttctggggattgcccttattgctatgggg

SEQ ID NO: 137818 - DNA, 30 bp, Artificial Sequence
  Description of Artificial Sequence: Synthetic oligonucleotide
gttctggggattgcccttattgctatgggg

SEQ ID NO: 137819 - DNA, 30 bp, Artificial Sequence
  Description of Artificial Sequence: Synthetic oligonucleotide
ttctggggattgcccttattgctatggggg

SEQ ID NO: 137820 - DNA, 29 bp, Artificial Sequence
  Description of Artificial Sequence: Synthetic oligonucleotide
tctggggattgcccttattgctatggggg

SEQ ID NO: 137821 - DNA, 28 bp, Artificial Sequence
  Description of Artificial Sequence: Synthetic oligonucleotide
ctggggattgcccttattgctatggggg

SEQ ID NO: 137822 - DNA, 29 bp, Artificial Sequence
  Description of Artificial Sequence: Synthetic oligonucleotide
tggggattgcccttattgctatgggggag

SEQ ID NO: 137823 - DNA, 28 bp, Artificial Sequence
  Description of Artificial Sequence: Synthetic oligonucleotide
ggggattgcccttattgctatgggggag

SEQ ID NO: 137824 - DNA, 28 bp, Artificial Sequence
  Description of Artificial Sequence: Synthetic oligonucleotide
gggattgcccttattgctatgggggagg

SEQ ID NO: 137825 - DNA, 29 bp, Artificial Sequence
  Description of Artificial Sequence: Synthetic oligonucleotide
ggattgcccttattgctatgggggaggag

SEQ ID NO: 137826 - DNA, 32 bp, Artificial Sequence
  Description of Artificial Sequence: Synthetic oligonucleotide
gattgcccttattgctatgggggaggagattg

SEQ ID NO: 137827 - DNA, 32 bp, Artificial Sequence
  Description of Artificial Sequence: Synthetic oligonucleotide
attgcccttattgctatgggggaggagattgg

SEQ ID NO: 137828 - DNA, 31 bp, Artificial Sequence
  Description of Artificial Sequence: Synthetic oligonucleotide
ttgcccttattgctatgggggaggagattgg

SEQ ID NO: 137829 - DNA, 30 bp, Artificial Sequence
  Description of Artificial Sequence: Synthetic oligonucleotide
tgcccttattgctatgggggaggagattgg

SEQ ID NO: 137830 - DNA, 29 bp, Artificial Sequence
  Description of Artificial Sequence: Synthetic oligonucleotide
gcccttattgctatgggggaggagattgg

SEQ ID NO: 137831 - DNA, 30 bp, Artificial Sequence
  Description of Artificial Sequence: Synthetic oligonucleotide
cccttattgctatgggggaggagattggtg

SEQ ID NO: 137832 - DNA, 30 bp, Artificial Sequence
  Description of Artificial Sequence: Synthetic oligonucleotide
ccttattgctatgggggaggagattggtgc

SEQ ID NO: 137833 - DNA, 31 bp, Artificial Sequence
  Description of Artificial Sequence: Synthetic oligonucleotide
cttattgctatgggggaggagattggtgcag

SEQ ID NO: 137834 - DNA, 32 bp, Artificial Sequence
  Description of Artificial Sequence: Synthetic oligonucleotide
ttattgctatgggggaggagattggtgcagag

SEQ ID NO: 137835 - DNA, 31 bp, Artificial Sequence
  Description of Artificial Sequence: Synthetic oligonucleotide
tattgctatgggggaggagattggtgcagag

SEQ ID NO: 137836 - DNA, 30 bp, Artificial Sequence
  Description of Artificial Sequence: Synthetic oligonucleotide
attgctatgggggaggagattggtgcagag

SEQ ID NO: 137837 - DNA, 29 bp, Artificial Sequence
  Description of Artificial Sequence: Synthetic oligonucleotide
ttgctatgggggaggagattggtgcagag

SEQ ID NO: 137838 - DNA, 28 bp, Artificial Sequence
  Description of Artificial Sequence: Synthetic oligonucleotide
tgctatgggggaggagattggtgcagag

SEQ ID NO: 137839 - DNA, 27 bp, Artificial Sequence
  Description of Artificial Sequence: Synthetic oligonucleotide
gctatgggggaggagattggtgcagag

SEQ ID NO: 137840 - DNA, 29 bp, Artificial Sequence
  Description of Artificial Sequence: Synthetic oligonucleotide
ctatgggggaggagattggtgcagagatg

SEQ ID NO: 137841 - DNA, 29 bp, Artificial Sequence
  Description of Artificial Sequence: Synthetic oligonucleotide
tatgggggaggagattggtgcagagatgg

SEQ ID NO: 137842 - DNA, 28 bp, Artificial Sequence
  Description of Artificial Sequence: Synthetic oligonucleotide
atgggggaggagattggtgcagagatgg

SEQ ID NO: 137843 - DNA, 27 bp, Artificial Sequence
  Description of Artificial Sequence: Synthetic oligonucleotide
tgggggaggagattggtgcagagatgg

SEQ ID NO: 137844 - DNA, 26 bp, Artificial Sequence
  Description of Artificial Sequence: Synthetic oligonucleotide
gggggaggagattggtgcagagatgg

SEQ ID NO: 137845 - DNA, 27 bp, Artificial Sequence
  Description of Artificial Sequence: Synthetic oligonucleotide
ggggaggagattggtgcagagatggca

SEQ ID NO: 137846 - DNA, 30 bp, Artificial Sequence
  Description of Artificial Sequence: Synthetic oligonucleotide
gggaggagattggtgcagagatggcattac

SEQ ID NO: 137847 - DNA, 30 bp, Artificial Sequence
  Description of Artificial Sequence: Synthetic oligonucleotide
ggaggagattggtgcagagatggcattacg

SEQ ID NO: 137848 - DNA, 32 bp, Artificial Sequence
  Description of Artificial Sequence: Synthetic oligonucleotide
gaggagattggtgcagagatggcattacgaac

SEQ ID NO: 137849 - DNA, 32 bp, Artificial Sequence
  Description of Artificial Sequence: Synthetic oligonucleotide
aggagattggtgcagagatggcattacgaacc

SEQ ID NO: 137850 - DNA, 31 bp, Artificial Sequence
  Description of Artificial Sequence: Synthetic oligonucleotide
ggagattggtgcagagatggcattacgaacc

SEQ ID NO: 137851 - DNA, 34 bp, Artificial Sequence
  Description of Artificial Sequence: Synthetic oligonucleotide
gagattggtgcagagatggcattacgaacctttg

SEQ ID NO: 137852 - DNA, 34 bp, Artificial Sequence
  Description of Artificial Sequence: Synthetic oligonucleotide
agattggtgcagagatggcattacgaacctttgg

SEQ ID NO: 137853 - DNA, 33 bp, Artificial Sequence
  Description of Artificial Sequence: Synthetic oligonucleotide
gattggtgcagagatggcattacgaacctttgg

SEQ ID NO: 137854 - DNA, 33 bp, Artificial Sequence
  Description of Artificial Sequence: Synthetic oligonucleotide
attggtgcagagatggcattacgaacctttggc

SEQ ID NO: 137855 - DNA, 32 bp, Artificial Sequence
  Description of Artificial Sequence: Synthetic oligonucleotide
ttggtgcagagatggcattacgaacctttggc

SEQ ID NO: 137856 - DNA, 31 bp, Artificial Sequence
  Description of Artificial Sequence: Synthetic oligonucleotide
tggtgcagagatggcattacgaacctttggc

SEQ ID NO: 137857 - DNA, 30 bp, Artificial Sequence
  Description of Artificial Sequence: Synthetic oligonucleotide
ggtgcagagatggcattacgaacctttggc

SEQ ID NO: 137858 - DNA, 30 bp, Artificial Sequence
  Description of Artificial Sequence: Synthetic oligonucleotide
gtgcagagatggcattacgaacctttggcc

SEQ ID NO: 137859 - DNA, 31 bp, Artificial Sequence
  Description of Artificial Sequence: Synthetic oligonucleotide
tgcagagatggcattacgaacctttggccac

SEQ ID NO: 137860 - DNA, 30 bp, Artificial Sequence
  Description of Artificial Sequence: Synthetic oligonucleotide
gcagagatggcattacgaacctttggccac

SEQ ID NO: 137861 - DNA, 32 bp, Artificial Sequence
  Description of Artificial Sequence: Synthetic oligonucleotide
cagagatggcattacgaacctttggccacttg

SEQ ID NO: 137862 - DNA, 32 bp, Artificial Sequence
  Description of Artificial Sequence: Synthetic oligonucleotide
agagatggcattacgaacctttggccacttgc

SEQ ID NO: 137863 - DNA, 31 bp, Artificial Sequence
  Description of Artificial Sequence: Synthetic oligonucleotide
gagatggcattacgaacctttggccacttgc

SEQ ID NO: 137864 - DNA, 32 bp, Artificial Sequence
  Description of Artificial Sequence: Synthetic oligonucleotide
agatggcattacgaacctttggccacttgctg

SEQ ID NO: 137865 - DNA, 31 bp, Artificial Sequence
  Description of Artificial Sequence: Synthetic oligonucleotide
gatggcattacgaacctttggccacttgctg

SEQ ID NO: 137866 - DNA, 32 bp, Artificial Sequence
  Description of Artificial Sequence: Synthetic oligonucleotide
atggcattacgaacctttggccacttgctgag

SEQ ID NO: 137867 - DNA, 31 bp, Artificial Sequence
  Description of Artificial Sequence: Synthetic oligonucleotide
tggcattacgaacctttggccacttgctgag

SEQ ID NO: 137868 - DNA, 30 bp, Artificial Sequence
  Description of Artificial Sequence: Synthetic oligonucleotide
ggcattacgaacctttggccacttgctgag

SEQ ID NO: 137869 - DNA, 34 bp, Artificial Sequence
  Description of Artificial Sequence: Synthetic oligonucleotide
gcattacgaacctttggccacttgctgagatatg

SEQ ID NO: 137870 - DNA, 34 bp, Artificial Sequence
  Description of Artificial Sequence: Synthetic oligonucleotide
cattacgaacctttggccacttgctgagatatgg

SEQ ID NO: 137871 - DNA, 34 bp, Artificial Sequence
  Description of Artificial Sequence: Synthetic oligonucleotide
attacgaacctttggccacttgctgagatatggg

SEQ ID NO: 137872 - DNA, 33 bp, Artificial Sequence
  Description of Artificial Sequence: Synthetic oligonucleotide
ttacgaacctttggccacttgctgagatatggg

SEQ ID NO: 137873 - DNA, 32 bp, Artificial Sequence
  Description of Artificial Sequence: Synthetic oligonucleotide
tacgaacctttggccacttgctgagatatggg

SEQ ID NO: 137874 - DNA, 31 bp, Artificial Sequence
  Description of Artificial Sequence: Synthetic oligonucleotide
acgaacctttggccacttgctgagatatggg

SEQ ID NO: 137875 - DNA, 30 bp, Artificial Sequence
  Description of Artificial Sequence: Synthetic oligonucleotide
cgaacctttggccacttgctgagatatggg

SEQ ID NO: 137876 - DNA, 30 bp, Artificial Sequence
  Description of Artificial Sequence: Synthetic oligonucleotide
gaacctttggccacttgctgagatatgggg

SEQ ID NO: 137877 - DNA, 31 bp, Artificial Sequence
  Description of Artificial Sequence: Synthetic oligonucleotide
aacctttggccacttgctgagatatggggag

SEQ ID NO: 137878 - DNA, 30 bp, Artificial Sequence
  Description of Artificial Sequence: Synthetic oligonucleotide
acctttggccacttgctgagatatggggag

SEQ ID NO: 137879 - DNA, 29 bp, Artificial Sequence
  Description of Artificial Sequence: Synthetic oligonucleotide
cctttggccacttgctgagatatggggag

SEQ ID NO: 137880 - DNA, 29 bp, Artificial Sequence
  Description of Artificial Sequence: Synthetic oligonucleotide
ctttggccacttgctgagatatggggagc

SEQ ID NO: 137881 - DNA, 29 bp, Artificial Sequence
  Description of Artificial Sequence: Synthetic oligonucleotide
tttggccacttgctgagatatggggagcc

SEQ ID NO: 137882 - DNA, 28 bp, Artificial Sequence
  Description of Artificial Sequence: Synthetic oligonucleotide
ttggccacttgctgagatatggggagcc

SEQ ID NO: 137883 - DNA, 27 bp, Artificial Sequence
  Description of Artificial Sequence: Synthetic oligonucleotide
tggccacttgctgagatatggggagcc

SEQ ID NO: 137884 - DNA, 27 bp, Artificial Sequence
  Description of Artificial Sequence: Synthetic oligonucleotide
ggccacttgctgagatatggggagcct

SEQ ID NO: 137885 - DNA, 28 bp, Artificial Sequence
  Description of Artificial Sequence: Synthetic oligonucleotide
gccacttgctgagatatggggagcctac

SEQ ID NO: 137886 - DNA, 29 bp, Artificial Sequence
  Description of Artificial Sequence: Synthetic oligonucleotide
ccacttgctgagatatggggagcctacac

SEQ ID NO: 137887 - DNA, 30 bp, Artificial Sequence
  Description of Artificial Sequence: Synthetic oligonucleotide
cacttgctgagatatggggagcctacactc

SEQ ID NO: 137888 - DNA, 30 bp, Artificial Sequence
  Description of Artificial Sequence: Synthetic oligonucleotide
acttgctgagatatggggagcctacactcc

SEQ ID NO: 137889 - DNA, 29 bp, Artificial Sequence
  Description of Artificial Sequence: Synthetic oligonucleotide
cttgctgagatatggggagcctacactcc

SEQ ID NO: 137890 - DNA, 29 bp, Artificial Sequence
  Description of Artificial Sequence: Synthetic oligonucleotide
ttgctgagatatggggagcctacactccg

SEQ ID NO: 137891 - DNA, 28 bp, Artificial Sequence
  Description of Artificial Sequence: Synthetic oligonucleotide
tgctgagatatggggagcctacactccg

SEQ ID NO: 137892 - DNA, 27 bp, Artificial Sequence
  Description of Artificial Sequence: Synthetic oligonucleotide
gctgagatatggggagcctacactccg

SEQ ID NO: 137893 - DNA, 27 bp, Artificial Sequence
  Description of Artificial Sequence: Synthetic oligonucleotide
ctgagatatggggagcctacactccgg

SEQ ID NO: 137894 - DNA, 28 bp, Artificial Sequence
  Description of Artificial Sequence: Synthetic oligonucleotide
tgagatatggggagcctacactccggag

SEQ ID NO: 137895 - DNA, 27 bp, Artificial Sequence
  Description of Artificial Sequence: Synthetic oligonucleotide
gagatatggggagcctacactccggag

SEQ ID NO: 137896 - DNA, 27 bp, Artificial Sequence
  Description of Artificial Sequence: Synthetic oligonucleotide
agatatggggagcctacactccggagg

SEQ ID NO: 137897 - DNA, 26 bp, Artificial Sequence
  Description of Artificial Sequence: Synthetic oligonucleotide
gatatggggagcctacactccggagg

SEQ ID NO: 137898 - DNA, 26 bp, Artificial Sequence
  Description of Artificial Sequence: Synthetic oligonucleotide
atatggggagcctacactccggaggg

SEQ ID NO: 137899 - DNA, 25 bp, Artificial Sequence
  Description of Artificial Sequence: Synthetic oligonucleotide
tatggggagcctacactccggaggg

SEQ ID NO: 137900 - DNA, 24 bp, Artificial Sequence
  Description of Artificial Sequence: Synthetic oligonucleotide
atggggagcctacactccggaggg

SEQ ID NO: 137901 - DNA, 23 bp, Artificial Sequence
  Description of Artificial Sequence: Synthetic oligonucleotide
tggggagcctacactccggaggg

SEQ ID NO: 137902 - DNA, 22 bp, Artificial Sequence
  Description of Artificial Sequence: Synthetic oligonucleotide
ggggagcctacactccggaggg

SEQ ID NO: 137903 - DNA, 23 bp, Artificial Sequence
  Description of Artificial Sequence: Synthetic oligonucleotide
gggagcctacactccggagggct

SEQ ID NO: 137904 - DNA, 25 bp, Artificial Sequence
  Description of Artificial Sequence: Synthetic oligonucleotide
ggagcctacactccggagggctgta

SEQ ID NO: 137905 - DNA, 25 bp, Artificial Sequence
  Description of Artificial Sequence: Synthetic oligonucleotide
gagcctacactccggagggctgtac

SEQ ID NO: 137906 - DNA, 27 bp, Artificial Sequence
  Description of Artificial Sequence: Synthetic oligonucleotide
agcctacactccggagggctgtacctt

SEQ ID NO: 137907 - DNA, 27 bp, Artificial Sequence
  Description of Artificial Sequence: Synthetic oligonucleotide
gcctacactccggagggctgtaccttt

SEQ ID NO: 137908 - DNA, 28 bp, Artificial Sequence
  Description of Artificial Sequence: Synthetic oligonucleotide
cctacactccggagggctgtacctttag

SEQ ID NO: 137909 - DNA, 28 bp, Artificial Sequence
  Description of Artificial Sequence: Synthetic oligonucleotide
ctacactccggagggctgtacctttagc

SEQ ID NO: 137910 - DNA, 29 bp, Artificial Sequence
  Description of Artificial Sequence: Synthetic oligonucleotide
tacactccggagggctgtacctttagcac

SEQ ID NO: 137911 - DNA, 28 bp, Artificial Sequence
  Description of Artificial Sequence: Synthetic oligonucleotide
acactccggagggctgtacctttagcac

SEQ ID NO: 137912 - DNA, 27 bp, Artificial Sequence
  Description of Artificial Sequence: Synthetic oligonucleotide
cactccggagggctgtacctttagcac

SEQ ID NO: 137913 - DNA, 28 bp, Artificial Sequence
  Description of Artificial Sequence: Synthetic oligonucleotide
actccggagggctgtacctttagcactg

SEQ ID NO: 137914 - DNA, 27 bp, Artificial Sequence
  Description of Artificial Sequence: Synthetic oligonucleotide
ctccggagggctgtacctttagcactg

SEQ ID NO: 137915 - DNA, 27 bp, Artificial Sequence
  Description of Artificial Sequence: Synthetic oligonucleotide
tccggagggctgtacctttagcactgg

SEQ ID NO: 137916 - DNA, 26 bp, Artificial Sequence
  Description of Artificial Sequence: Synthetic oligonucleotide
ccggagggctgtacctttagcactgg

SEQ ID NO: 137917 - DNA, 26 bp, Artificial Sequence
  Description of Artificial Sequence: Synthetic oligonucleotide
cggagggctgtacctttagcactggc

SEQ ID NO: 137918 - DNA, 26 bp, Artificial Sequence
  Description of Artificial Sequence: Synthetic oligonucleotide
ggagggctgtacctttagcactggcc

SEQ ID NO: 137919 - DNA, 27 bp, Artificial Sequence
  Description of Artificial Sequence: Synthetic oligonucleotide
gagggctgtacctttagcactggccct

SEQ ID NO: 137920 - DNA, 27 bp, Artificial Sequence
  Description of Artificial Sequence: Synthetic oligonucleotide
agggctgtacctttagcactggccctc

SEQ ID NO: 137921 - DNA, 27 bp, Artificial Sequence
  Description of Artificial Sequence: Synthetic oligonucleotide
gggctgtacctttagcactggccctca

SEQ ID NO: 137922 - DNA, 28 bp, Artificial Sequence
  Description of Artificial Sequence: Synthetic oligonucleotide
ggctgtacctttagcactggccctcatc

SEQ ID NO: 137923 - DNA, 29 bp, Artificial Sequence
  Description of Artificial Sequence: Synthetic oligonucleotide
gctgtacctttagcactggccctcatctc

SEQ ID NO: 137924 - DNA, 30 bp, Artificial Sequence
  Description of Artificial Sequence: Synthetic oligonucleotide
ctgtacctttagcactggccctcatctctg

SEQ ID NO: 137925 - DNA, 33 bp, Artificial Sequence
  Description of Artificial Sequence: Synthetic oligonucleotide
tgtacctttagcactggccctcatctctgtttc

SEQ ID NO: 137926 - DNA, 32 bp, Artificial Sequence
  Description of Artificial Sequence: Synthetic oligonucleotide
gtacctttagcactggccctcatctctgtttc

SEQ ID NO: 137927 - DNA, 36 bp, Artificial Sequence
  Description of Artificial Sequence: Synthetic oligonucleotide
tacctttagcactggccctcatctctgtttcaaatc

SEQ ID NO: 137928 - DNA, 35 bp, Artificial Sequence
  Description of Artificial Sequence: Synthetic oligonucleotide
acctttagcactggccctcatctctgtttcaaatc

SEQ ID NO: 137929 - DNA, 34 bp, Artificial Sequence
  Description of Artificial Sequence: Synthetic oligonucleotide
cctttagcactggccctcatctctgtttcaaatc

SEQ ID NO: 137930 - DNA, 34 bp, Artificial Sequence
  Description of Artificial Sequence: Synthetic oligonucleotide
ctttagcactggccctcatctctgtttcaaatcc

SEQ ID NO: 137931 - DNA, 35 bp, Artificial Sequence
  Description of Artificial Sequence: Synthetic oligonucleotide
tttagcactggccctcatctctgtttcaaatccac

SEQ ID NO: 137932 - DNA, 34 bp, Artificial Sequence
  Description of Artificial Sequence: Synthetic oligonucleotide
ttagcactggccctcatctctgtttcaaatccac

SEQ ID NO: 137933 - DNA, 33 bp, Artificial Sequence
  Description of Artificial Sequence: Synthetic oligonucleotide
tagcactggccctcatctctgtttcaaatccac

SEQ ID NO: 137934 - DNA, 32 bp, Artificial Sequence
  Description of Artificial Sequence: Synthetic oligonucleotide
agcactggccctcatctctgtttcaaatccac

SEQ ID NO: 137935 - DNA, 31 bp, Artificial Sequence
  Description of Artificial Sequence: Synthetic oligonucleotide
gcactggccctcatctctgtttcaaatccac

SEQ ID NO: 137936 - DNA, 31 bp, Artificial Sequence
  Description of Artificial Sequence: Synthetic oligonucleotide
cactggccctcatctctgtttcaaatccacg

SEQ ID NO: 137937 - DNA, 32 bp, Artificial Sequence
  Description of Artificial Sequence: Synthetic oligonucleotide
actggccctcatctctgtttcaaatccacgac

SEQ ID NO: 137938 - DNA, 31 bp, Artificial Sequence
  Description of Artificial Sequence: Synthetic oligonucleotide
ctggccctcatctctgtttcaaatccacgac

SEQ ID NO: 137939 - DNA, 32 bp, Artificial Sequence
  Description of Artificial Sequence: Synthetic oligonucleotide
tggccctcatctctgtttcaaatccacgactc

SEQ ID NO: 137940 - DNA, 31 bp, Artificial Sequence
  Description of Artificial Sequence: Synthetic oligonucleotide
ggccctcatctctgtttcaaatccacgactc

SEQ ID NO: 137941 - DNA, 33 bp, Artificial Sequence
  Description of Artificial Sequence: Synthetic oligonucleotide
gccctcatctctgtttcaaatccacgactcaac

SEQ ID NO: 137942 - DNA, 35 bp, Artificial Sequence
  Description of Artificial Sequence: Synthetic oligonucleotide
ccctcatctctgtttcaaatccacgactcaacatc

SEQ ID NO: 137943 - DNA, 35 bp, Artificial Sequence
  Description of Artificial Sequence: Synthetic oligonucleotide
cctcatctctgtttcaaatccacgactcaacatcc

SEQ ID NO: 137944 - DNA, 36 bp, Artificial Sequence
  Description of Artificial Sequence: Synthetic oligonucleotide
ctcatctctgtttcaaatccacgactcaacatcctg

SEQ ID NO: 137945 - DNA, 36 bp, Artificial Sequence
  Description of Artificial Sequence: Synthetic oligonucleotide
tcatctctgtttcaaatccacgactcaacatcctgg

SEQ ID NO: 137946 - DNA, 35 bp, Artificial Sequence
  Description of Artificial Sequence: Synthetic oligonucleotide
catctctgtttcaaatccacgactcaacatcctgg

SEQ ID NO: 137947 - DNA, 38 bp, Artificial Sequence
  Description of Artificial Sequence: Synthetic oligonucleotide
atctctgtttcaaatccacgactcaacatcctggatac

SEQ ID NO: 137948 - DNA, 37 bp, Artificial Sequence
  Description of Artificial Sequence: Synthetic oligonucleotide
tctctgtttcaaatccacgactcaacatcctggatac

SEQ ID NO: 137949 - DNA, 36 bp, Artificial Sequence
  Description of Artificial Sequence: Synthetic oligonucleotide
ctctgtttcaaatccacgactcaacatcctggatac

SEQ ID NO: 137950 - DNA, 36 bp, Artificial Sequence
  Description of Artificial Sequence: Synthetic oligonucleotide
tctgtttcaaatccacgactcaacatcctggatacc

SEQ ID NO: 137951 - DNA, 35 bp, Artificial Sequence
  Description of Artificial Sequence: Synthetic oligonucleotide
ctgtttcaaatccacgactcaacatcctggatacc

SEQ ID NO: 137952 - DNA, 35 bp, Artificial Sequence
  Description of Artificial Sequence: Synthetic oligonucleotide
tgtttcaaatccacgactcaacatcctggataccc

SEQ ID NO: 137953 - DNA, 34 bp, Artificial Sequence
  Description of Artificial Sequence: Synthetic oligonucleotide
gtttcaaatccacgactcaacatcctggataccc

SEQ ID NO: 137954 - DNA, 37 bp, Artificial Sequence
  Description of Artificial Sequence: Synthetic oligonucleotide
tttcaaatccacgactcaacatcctggataccctaag

SEQ ID NO: 137955 - DNA, 36 bp, Artificial Sequence
  Description of Artificial Sequence: Synthetic oligonucleotide
ttcaaatccacgactcaacatcctggataccctaag

SEQ ID NO: 137956 - DNA, 35 bp, Artificial Sequence
  Description of Artificial Sequence: Synthetic oligonucleotide
tcaaatccacgactcaacatcctggataccctaag

SEQ ID NO: 137957 - DNA, 34 bp, Artificial Sequence
  Description of Artificial Sequence: Synthetic oligonucleotide
caaatccacgactcaacatcctggataccctaag

SEQ ID NO: 137958 - DNA, 34 bp, Artificial Sequence
  Description of Artificial Sequence: Synthetic oligonucleotide
aaatccacgactcaacatcctggataccctaagc

SEQ ID NO: 137959 - DNA, 33 bp, Artificial Sequence
  Description of Artificial Sequence: Synthetic oligonucleotide
aatccacgactcaacatcctggataccctaagc

SEQ ID NO: 137960 - DNA, 32 bp, Artificial Sequence
  Description of Artificial Sequence: Synthetic oligonucleotide
atccacgactcaacatcctggataccctaagc

SEQ ID NO: 137961 - DNA, 31 bp, Artificial Sequence
  Description of Artificial Sequence: Synthetic oligonucleotide
tccacgactcaacatcctggataccctaagc

SEQ ID NO: 137962 - DNA, 30 bp, Artificial Sequence
  Description of Artificial Sequence: Synthetic oligonucleotide
ccacgactcaacatcctggataccctaagc

SEQ ID NO: 137963 - DNA, 35 bp, Artificial Sequence
  Description of Artificial Sequence: Synthetic oligonucleotide
cacgactcaacatcctggataccctaagcaaattc

SEQ ID NO: 137964 - DNA, 36 bp, Artificial Sequence
  Description of Artificial Sequence: Synthetic oligonucleotide
acgactcaacatcctggataccctaagcaaattctc

SEQ ID NO: 137965 - DNA, 35 bp, Artificial Sequence
  Description of Artificial Sequence: Synthetic oligonucleotide
cgactcaacatcctggataccctaagcaaattctc

SEQ ID NO: 137966 - DNA, 36 bp, Artificial Sequence
  Description of Artificial Sequence: Synthetic oligonucleotide
gactcaacatcctggataccctaagcaaattctctc

SEQ ID NO: 137967 - DNA, 38 bp, Artificial Sequence
  Description of Artificial Sequence: Synthetic oligonucleotide
actcaacatcctggataccctaagcaaattctctcatg

SEQ ID NO: 137968 - DNA, 37 bp, Artificial Sequence
  Description of Artificial Sequence: Synthetic oligonucleotide
ctcaacatcctggataccctaagcaaattctctcatg

SEQ ID NO: 137969 - DNA, 39 bp, Artificial Sequence
  Description of Artificial Sequence: Synthetic oligonucleotide
tcaacatcctggataccctaagcaaattctctcatgatg

SEQ ID NO: 137970 - DNA, 38 bp, Artificial Sequence
  Description of Artificial Sequence: Synthetic oligonucleotide
caacatcctggataccctaagcaaattctctcatgatg

SEQ ID NO: 137971 - DNA, 38 bp, Artificial Sequence
  Description of Artificial Sequence: Synthetic oligonucleotide
aacatcctggataccctaagcaaattctctcatgatgc

SEQ ID NO: 137972 - DNA, 37 bp, Artificial Sequence
  Description of Artificial Sequence: Synthetic oligonucleotide
acatcctggataccctaagcaaattctctcatgatgc

SEQ ID NO: 137973 - DNA, 36 bp, Artificial Sequence
  Description of Artificial Sequence: Synthetic oligonucleotide
catcctggataccctaagcaaattctctcatgatgc

SEQ ID NO: 137974 - DNA, 37 bp, Artificial Sequence
  Description of Artificial Sequence: Synthetic oligonucleotide
atcctggataccctaagcaaattctctcatgatgctg

SEQ ID NO: 137975 - DNA, 36 bp, Artificial Sequence
  Description of Artificial Sequence: Synthetic oligonucleotide
tcctggataccctaagcaaattctctcatgatgctg

SEQ ID NO: 137976 - DNA, 35 bp, Artificial Sequence
  Description of Artificial Sequence: Synthetic oligonucleotide
cctggataccctaagcaaattctctcatgatgctg

SEQ ID NO: 137977 - DNA, 37 bp, Artificial Sequence
  Description of Artificial Sequence: Synthetic oligonucleotide
ctggataccctaagcaaattctctcatgatgctgatc

SEQ ID NO: 137978 - DNA, 37 bp, Artificial Sequence
  Description of Artificial Sequence: Synthetic oligonucleotide
tggataccctaagcaaattctctcatgatgctgatcc

SEQ ID NO: 137979 - DNA, 36 bp, Artificial Sequence
  Description of Artificial Sequence: Synthetic oligonucleotide
ggataccctaagcaaattctctcatgatgctgatcc

SEQ ID NO: 137980 - DNA, 37 bp, Artificial Sequence
  Description of Artificial Sequence: Synthetic oligonucleotide
gataccctaagcaaattctctcatgatgctgatccag

SEQ ID NO: 137981 - DNA, 39 bp, Artificial Sequence
  Description of Artificial Sequence: Synthetic oligonucleotide
ataccctaagcaaattctctcatgatgctgatccagaag

SEQ ID NO: 137982 - DNA, 38 bp, Artificial Sequence
  Description of Artificial Sequence: Synthetic oligonucleotide
taccctaagcaaattctctcatgatgctgatccagaag

SEQ ID NO: 137983 - DNA, 37 bp, Artificial Sequence
  Description of Artificial Sequence: Synthetic oligonucleotide
accctaagcaaattctctcatgatgctgatccagaag

SEQ ID NO: 137984 - DNA, 36 bp, Artificial Sequence
  Description of Artificial Sequence: Synthetic oligonucleotide
ccctaagcaaattctctcatgatgctgatccagaag

SEQ ID NO: 137985 - DNA, 39 bp, Artificial Sequence
  Description of Artificial Sequence: Synthetic oligonucleotide
cctaagcaaattctctcatgatgctgatccagaagtttc

SEQ ID NO: 137986 - DNA, 39 bp, Artificial Sequence
  Description of Artificial Sequence: Synthetic oligonucleotide
ctaagcaaattctctcatgatgctgatccagaagtttcc

SEQ ID NO: 137987 - DNA, 44 bp, Artificial Sequence
  Description of Artificial Sequence: Synthetic oligonucleotide
taagcaaattctctcatgatgctgatccagaagtttcctataac

SEQ ID NO: 137988 - DNA, 43 bp, Artificial Sequence
  Description of Artificial Sequence: Synthetic oligonucleotide
aagcaaattctctcatgatgctgatccagaagtttcctataac

SEQ ID NO: 137989 - DNA, 42 bp, Artificial Sequence
  Description of Artificial Sequence: Synthetic oligonucleotide
agcaaattctctcatgatgctgatccagaagtttcctataac

SEQ ID NO: 137990 - DNA, 41 bp, Artificial Sequence
  Description of Artificial Sequence: Synthetic oligonucleotide
gcaaattctctcatgatgctgatccagaagtttcctataac

SEQ ID NO: 137991 - DNA, 42 bp, Artificial Sequence
  Description of Artificial Sequence: Synthetic oligonucleotide
caaattctctcatgatgctgatccagaagtttcctataactc

SEQ ID NO: 137992 - DNA, 42 bp, Artificial Sequence
  Description of Artificial Sequence: Synthetic oligonucleotide
aaattctctcatgatgctgatccagaagtttcctataactcc

SEQ ID NO: 137993 - DNA, 41 bp, Artificial Sequence
  Description of Artificial Sequence: Synthetic oligonucleotide
aattctctcatgatgctgatccagaagtttcctataactcc

SEQ ID NO: 137994 - DNA, 40 bp, Artificial Sequence
  Description of Artificial Sequence: Synthetic oligonucleotide
attctctcatgatgctgatccagaagtttcctataactcc

SEQ ID NO: 137995 - DNA, 39 bp, Artificial Sequence
  Description of Artificial Sequence: Synthetic oligonucleotide
ttctctcatgatgctgatccagaagtttcctataactcc

SEQ ID NO: 137996 - DNA, 38 bp, Artificial Sequence
  Description of Artificial Sequence: Synthetic oligonucleotide
tctctcatgatgctgatccagaagtttcctataactcc

SEQ ID NO: 137997 - DNA, 37 bp, Artificial Sequence
  Description of Artificial Sequence: Synthetic oligonucleotide
ctctcatgatgctgatccagaagtttcctataactcc

SEQ ID NO: 137998 - DNA, 43 bp, Artificial Sequence
  Description of Artificial Sequence: Synthetic oligonucleotide
tctcatgatgctgatccagaagtttcctataactccatttttg

SEQ ID NO: 137999 - DNA, 42 bp, Artificial Sequence
  Description of Artificial Sequence: Synthetic oligonucleotide
ctcatgatgctgatccagaagtttcctataactccatttttg

SEQ ID NO: 138000 - DNA, 42 bp, Artificial Sequence
  Description of Artificial Sequence: Synthetic oligonucleotide
tcatgatgctgatccagaagtttcctataactccatttttgc

SEQ ID NO: 138001 - DNA, 41 bp, Artificial Sequence
  Description of Artificial Sequence: Synthetic oligonucleotide
catgatgctgatccagaagtttcctataactccatttttgc

SEQ ID NO: 138002 - DNA, 41 bp, Artificial Sequence
  Description of Artificial Sequence: Synthetic oligonucleotide
atgatgctgatccagaagtttcctataactccatttttgcc

SEQ ID NO: 138003 - DNA, 40 bp, Artificial Sequence
  Description of Artificial Sequence: Synthetic oligonucleotide
tgatgctgatccagaagtttcctataactccatttttgcc

SEQ ID NO: 138004 - DNA, 39 bp, Artificial Sequence
  Description of Artificial Sequence: Synthetic oligonucleotide
gatgctgatccagaagtttcctataactccatttttgcc

SEQ ID NO: 138005 - DNA, 41 bp, Artificial Sequence
  Description of Artificial Sequence: Synthetic oligonucleotide
atgctgatccagaagtttcctataactccatttttgccatg

SEQ ID NO: 138006 - DNA, 40 bp, Artificial Sequence
  Description of Artificial Sequence: Synthetic oligonucleotide
tgctgatccagaagtttcctataactccatttttgccatg

SEQ ID NO: 138007 - DNA, 39 bp, Artificial Sequence
  Description of Artificial Sequence: Synthetic oligonucleotide
gctgatccagaagtttcctataactccatttttgccatg

SEQ ID NO: 138008 - DNA, 39 bp, Artificial Sequence
  Description of Artificial Sequence: Synthetic oligonucleotide
ctgatccagaagtttcctataactccatttttgccatgg

SEQ ID NO: 138009 - DNA, 39 bp, Artificial Sequence
  Description of Artificial Sequence: Synthetic oligonucleotide
tgatccagaagtttcctataactccatttttgccatggg

SEQ ID NO: 138010 - DNA, 38 bp, Artificial Sequence
  Description of Artificial Sequence: Synthetic oligonucleotide
gatccagaagtttcctataactccatttttgccatggg

SEQ ID NO: 138011 - DNA, 38 bp, Artificial Sequence
  Description of Artificial Sequence: Synthetic oligonucleotide
atccagaagtttcctataactccatttttgccatgggc

SEQ ID NO: 138012 - DNA, 37 bp, Artificial Sequence
  Description of Artificial Sequence: Synthetic oligonucleotide
tccagaagtttcctataactccatttttgccatgggc

SEQ ID NO: 138013 - DNA, 36 bp, Artificial Sequence
  Description of Artificial Sequence: Synthetic oligonucleotide
ccagaagtttcctataactccatttttgccatgggc

SEQ ID NO: 138014 - DNA, 38 bp, Artificial Sequence
  Description of Artificial Sequence: Synthetic oligonucleotide
cagaagtttcctataactccatttttgccatgggcatg

SEQ ID NO: 138015 - DNA, 38 bp, Artificial Sequence
  Description of Artificial Sequence: Synthetic oligonucleotide
agaagtttcctataactccatttttgccatgggcatgg

SEQ ID NO: 138016 - DNA, 37 bp, Artificial Sequence
  Description of Artificial Sequence: Synthetic oligonucleotide
gaagtttcctataactccatttttgccatgggcatgg

SEQ ID NO: 138017 - DNA, 38 bp, Artificial Sequence
  Description of Artificial Sequence: Synthetic oligonucleotide
aagtttcctataactccatttttgccatgggcatggtg

SEQ ID NO: 138018 - DNA, 37 bp, Artificial Sequence
  Description of Artificial Sequence: Synthetic oligonucleotide
agtttcctataactccatttttgccatgggcatggtg

SEQ ID NO: 138019 - DNA, 36 bp, Artificial Sequence
  Description of Artificial Sequence: Synthetic oligonucleotide
gtttcctataactccatttttgccatgggcatggtg

SEQ ID NO: 138020 - DNA, 36 bp, Artificial Sequence
  Description of Artificial Sequence: Synthetic oligonucleotide
tttcctataactccatttttgccatgggcatggtgg

SEQ ID NO: 138021 - DNA, 35 bp, Artificial Sequence
  Description of Artificial Sequence: Synthetic oligonucleotide
ttcctataactccatttttgccatgggcatggtgg

SEQ ID NO: 138022 - DNA, 34 bp, Artificial Sequence
  Description of Artificial Sequence: Synthetic oligonucleotide
tcctataactccatttttgccatgggcatggtgg

SEQ ID NO: 138023 - DNA, 33 bp, Artificial Sequence
  Description of Artificial Sequence: Synthetic oligonucleotide
cctataactccatttttgccatgggcatggtgg

SEQ ID NO: 138024 - DNA, 33 bp, Artificial Sequence
  Description of Artificial Sequence: Synthetic oligonucleotide
ctataactccatttttgccatgggcatggtggg

SEQ ID NO: 138025 - DNA, 33 bp, Artificial Sequence
  Description of Artificial Sequence: Synthetic oligonucleotide
tataactccatttttgccatgggcatggtgggc

SEQ ID NO: 138026 - DNA, 32 bp, Artificial Sequence
  Description of Artificial Sequence: Synthetic oligonucleotide
ataactccatttttgccatgggcatggtgggc

SEQ ID NO: 138027 - DNA, 31 bp, Artificial Sequence
  Description of Artificial Sequence: Synthetic oligonucleotide
taactccatttttgccatgggcatggtgggc

SEQ ID NO: 138028 - DNA, 30 bp, Artificial Sequence
  Description of Artificial Sequence: Synthetic oligonucleotide
aactccatttttgccatgggcatggtgggc

SEQ ID NO: 138029 - DNA, 29 bp, Artificial Sequence
  Description of Artificial Sequence: Synthetic oligonucleotide
actccatttttgccatgggcatggtgggc

SEQ ID NO: 138030 - DNA, 28 bp, Artificial Sequence
  Description of Artificial Sequence: Synthetic oligonucleotide
ctccatttttgccatgggcatggtgggc

SEQ ID NO: 138031 - DNA, 29 bp, Artificial Sequence
  Description of Artificial Sequence: Synthetic oligonucleotide
tccatttttgccatgggcatggtgggcag

SEQ ID NO: 138032 - DNA, 28 bp, Artificial Sequence
  Description of Artificial Sequence: Synthetic oligonucleotide
ccatttttgccatgggcatggtgggcag

SEQ ID NO: 138033 - DNA, 29 bp, Artificial Sequence
  Description of Artificial Sequence: Synthetic oligonucleotide
catttttgccatgggcatggtgggcagtg

SEQ ID NO: 138034 - DNA, 29 bp, Artificial Sequence
  Description of Artificial Sequence: Synthetic oligonucleotide
atttttgccatgggcatggtgggcagtgg

SEQ ID NO: 138035 - DNA, 28 bp, Artificial Sequence
  Description of Artificial Sequence: Synthetic oligonucleotide
tttttgccatgggcatggtgggcagtgg

SEQ ID NO: 138036 - DNA, 27 bp, Artificial Sequence
  Description of Artificial Sequence: Synthetic oligonucleotide
ttttgccatgggcatggtgggcagtgg

SEQ ID NO: 138037 - DNA, 27 bp, Artificial Sequence
  Description of Artificial Sequence: Synthetic oligonucleotide
tttgccatgggcatggtgggcagtggt

SEQ ID NO: 138038 - DNA, 27 bp, Artificial Sequence
  Description of Artificial Sequence: Synthetic oligonucleotide
ttgccatgggcatggtgggcagtggta

SEQ ID NO: 138039 - DNA, 26 bp, Artificial Sequence
  Description of Artificial Sequence: Synthetic oligonucleotide
tgccatgggcatggtgggcagtggta

SEQ ID NO: 138040 - DNA, 25 bp, Artificial Sequence
  Description of Artificial Sequence: Synthetic oligonucleotide
gccatgggcatggtgggcagtggta

SEQ ID NO: 138041 - DNA, 25 bp, Artificial Sequence
  Description of Artificial Sequence: Synthetic oligonucleotide
ccatgggcatggtgggcagtggtac

SEQ ID NO: 138042 - DNA, 27 bp, Artificial Sequence
  Description of Artificial Sequence: Synthetic oligonucleotide
catgggcatggtgggcagtggtaccaa

SEQ ID NO: 138043 - DNA, 31 bp, Artificial Sequence
  Description of Artificial Sequence: Synthetic oligonucleotide
atgggcatggtgggcagtggtaccaataatg

SEQ ID NO: 138044 - DNA, 30 bp, Artificial Sequence
  Description of Artificial Sequence: Synthetic oligonucleotide
tgggcatggtgggcagtggtaccaataatg

SEQ ID NO: 138045 - DNA, 29 bp, Artificial Sequence
  Description of Artificial Sequence: Synthetic oligonucleotide
gggcatggtgggcagtggtaccaataatg

SEQ ID NO: 138046 - DNA, 29 bp, Artificial Sequence
  Description of Artificial Sequence: Synthetic oligonucleotide
ggcatggtgggcagtggtaccaataatgc

SEQ ID NO: 138047 - DNA, 29 bp, Artificial Sequence
  Description of Artificial Sequence: Synthetic oligonucleotide
gcatggtgggcagtggtaccaataatgcc

SEQ ID NO: 138048 - DNA, 29 bp, Artificial Sequence
  Description of Artificial Sequence: Synthetic oligonucleotide
catggtgggcagtggtaccaataatgccc

SEQ ID NO: 138049 - DNA, 29 bp, Artificial Sequence
  Description of Artificial Sequence: Synthetic oligonucleotide
atggtgggcagtggtaccaataatgcccg

SEQ ID NO: 138050 - DNA, 28 bp, Artificial Sequence
  Description of Artificial Sequence: Synthetic oligonucleotide
tggtgggcagtggtaccaataatgcccg

SEQ ID NO: 138051 - DNA, 27 bp, Artificial Sequence
  Description of Artificial Sequence: Synthetic oligonucleotide
ggtgggcagtggtaccaataatgcccg

SEQ ID NO: 138052 - DNA, 28 bp, Artificial Sequence
  Description of Artificial Sequence: Synthetic oligonucleotide
gtgggcagtggtaccaataatgcccgtc

SEQ ID NO: 138053 - DNA, 29 bp, Artificial Sequence
  Description of Artificial Sequence: Synthetic oligonucleotide
tgggcagtggtaccaataatgcccgtctg

SEQ ID NO: 138054 - DNA, 28 bp, Artificial Sequence
  Description of Artificial Sequence: Synthetic oligonucleotide
gggcagtggtaccaataatgcccgtctg

SEQ ID NO: 138055 - DNA, 28 bp, Artificial Sequence
  Description of Artificial Sequence: Synthetic oligonucleotide
ggcagtggtaccaataatgcccgtctgg

SEQ ID NO: 138056 - DNA, 28 bp, Artificial Sequence
  Description of Artificial Sequence: Synthetic oligonucleotide
gcagtggtaccaataatgcccgtctggc

SEQ ID NO: 138057 - DNA, 29 bp, Artificial Sequence
  Description of Artificial Sequence: Synthetic oligonucleotide
cagtggtaccaataatgcccgtctggctg

SEQ ID NO: 138058 - DNA, 29 bp, Artificial Sequence
  Description of Artificial Sequence: Synthetic oligonucleotide
agtggtaccaataatgcccgtctggctgc

SEQ ID NO: 138059 - DNA, 28 bp, Artificial Sequence
  Description of Artificial Sequence: Synthetic oligonucleotide
gtggtaccaataatgcccgtctggctgc

SEQ ID NO: 138060 - DNA, 31 bp, Artificial Sequence
  Description of Artificial Sequence: Synthetic oligonucleotide
tggtaccaataatgcccgtctggctgcaatg

SEQ ID NO: 138061 - DNA, 30 bp, Artificial Sequence
  Description of Artificial Sequence: Synthetic oligonucleotide
ggtaccaataatgcccgtctggctgcaatg

SEQ ID NO: 138062 - DNA, 30 bp, Artificial Sequence
  Description of Artificial Sequence: Synthetic oligonucleotide
gtaccaataatgcccgtctggctgcaatgc

SEQ ID NO: 138063 - DNA, 31 bp, Artificial Sequence
  Description of Artificial Sequence: Synthetic oligonucleotide
taccaataatgcccgtctggctgcaatgctg

SEQ ID NO: 138064 - DNA, 30 bp, Artificial Sequence
  Description of Artificial Sequence: Synthetic oligonucleotide
accaataatgcccgtctggctgcaatgctg

SEQ ID NO: 138065 - DNA, 29 bp, Artificial Sequence
  Description of Artificial Sequence: Synthetic oligonucleotide
ccaataatgcccgtctggctgcaatgctg

SEQ ID NO: 138066 - DNA, 29 bp, Artificial Sequence
  Description of Artificial Sequence: Synthetic oligonucleotide
caataatgcccgtctggctgcaatgctgc

SEQ ID NO: 138067 - DNA, 29 bp, Artificial Sequence
  Description of Artificial Sequence: Synthetic oligonucleotide
aataatgcccgtctggctgcaatgctgcg

SEQ ID NO: 138068 - DNA, 28 bp, Artificial Sequence
  Description of Artificial Sequence: Synthetic oligonucleotide
ataatgcccgtctggctgcaatgctgcg

SEQ ID NO: 138069 - DNA, 27 bp, Artificial Sequence
  Description of Artificial Sequence: Synthetic oligonucleotide
taatgcccgtctggctgcaatgctgcg

SEQ ID NO: 138070 - DNA, 26 bp, Artificial Sequence
  Description of Artificial Sequence: Synthetic oligonucleotide
aatgcccgtctggctgcaatgctgcg

SEQ ID NO: 138071 - DNA, 25 bp, Artificial Sequence
  Description of Artificial Sequence: Synthetic oligonucleotide
atgcccgtctggctgcaatgctgcg

SEQ ID NO: 138072 - DNA, 24 bp, Artificial Sequence
  Description of Artificial Sequence: Synthetic oligonucleotide
tgcccgtctggctgcaatgctgcg

SEQ ID NO: 138073 - DNA, 23 bp, Artificial Sequence
  Description of Artificial Sequence: Synthetic oligonucleotide
gcccgtctggctgcaatgctgcg

SEQ ID NO: 138074 - DNA, 23 bp, Artificial Sequence
  Description of Artificial Sequence: Synthetic oligonucleotide
cccgtctggctgcaatgctgcgc

SEQ ID NO: 138075 - DNA, 24 bp, Artificial Sequence
  Description of Artificial Sequence: Synthetic oligonucleotide
ccgtctggctgcaatgctgcgcca

SEQ ID NO: 138076 - DNA, 27 bp, Artificial Sequence
  Description of Artificial Sequence: Synthetic oligonucleotide
cgtctggctgcaatgctgcgccagtta

SEQ ID NO: 138077 - DNA, 27 bp, Artificial Sequence
  Description of Artificial Sequence: Synthetic oligonucleotide
gtctggctgcaatgctgcgccagttag

SEQ ID NO: 138078 - DNA, 27 bp, Artificial Sequence
  Description of Artificial Sequence: Synthetic oligonucleotide
tctggctgcaatgctgcgccagttagc

SEQ ID NO: 138079 - DNA, 27 bp, Artificial Sequence
  Description of Artificial Sequence: Synthetic oligonucleotide
ctggctgcaatgctgcgccagttagct

SEQ ID NO: 138080 - DNA, 27 bp, Artificial Sequence
  Description of Artificial Sequence: Synthetic oligonucleotide
tggctgcaatgctgcgccagttagctc

SEQ ID NO: 138081 - DNA, 27 bp, Artificial Sequence
  Description of Artificial Sequence: Synthetic oligonucleotide
ggctgcaatgctgcgccagttagctca

SEQ ID NO: 138082 - DNA, 31 bp, Artificial Sequence
  Description of Artificial Sequence: Synthetic oligonucleotide
gctgcaatgctgcgccagttagctcaatatc

SEQ ID NO: 138083 - DNA, 33 bp, Artificial Sequence
  Description of Artificial Sequence: Synthetic oligonucleotide
ctgcaatgctgcgccagttagctcaatatcatg

SEQ ID NO: 138084 - DNA, 33 bp, Artificial Sequence
  Description of Artificial Sequence: Synthetic oligonucleotide
tgcaatgctgcgccagttagctcaatatcatgc

SEQ ID NO: 138085 - DNA, 32 bp, Artificial Sequence
  Description of Artificial Sequence: Synthetic oligonucleotide
gcaatgctgcgccagttagctcaatatcatgc

SEQ ID NO: 138086 - DNA, 32 bp, Artificial Sequence
  Description of Artificial Sequence: Synthetic oligonucleotide
caatgctgcgccagttagctcaatatcatgcc

SEQ ID NO: 138087 - DNA, 34 bp, Artificial Sequence
  Description of Artificial Sequence: Synthetic oligonucleotide
aatgctgcgccagttagctcaatatcatgccaag

SEQ ID NO: 138088 - DNA, 33 bp, Artificial Sequence
  Description of Artificial Sequence: Synthetic oligonucleotide
atgctgcgccagttagctcaatatcatgccaag

SEQ ID NO: 138089 - DNA, 32 bp, Artificial Sequence
  Description of Artificial Sequence: Synthetic oligonucleotide
tgctgcgccagttagctcaatatcatgccaag

SEQ ID NO: 138090 - DNA, 31 bp, Artificial Sequence
  Description of Artificial Sequence: Synthetic oligonucleotide
gctgcgccagttagctcaatatcatgccaag

SEQ ID NO: 138091 - DNA, 31 bp, Artificial Sequence
  Description of Artificial Sequence: Synthetic oligonucleotide
ctgcgccagttagctcaatatcatgccaagg

SEQ ID NO: 138092 - DNA, 32 bp, Artificial Sequence
  Description of Artificial Sequence: Synthetic oligonucleotide
tgcgccagttagctcaatatcatgccaaggac

SEQ ID NO: 138093 - DNA, 31 bp, Artificial Sequence
  Description of Artificial Sequence: Synthetic oligonucleotide
gcgccagttagctcaatatcatgccaaggac

SEQ ID NO: 138094 - DNA, 31 bp, Artificial Sequence
  Description of Artificial Sequence: Synthetic oligonucleotide
cgccagttagctcaatatcatgccaaggacc

SEQ ID NO: 138095 - DNA, 31 bp, Artificial Sequence
  Description of Artificial Sequence: Synthetic oligonucleotide
gccagttagctcaatatcatgccaaggaccc

SEQ ID NO: 138096 - DNA, 34 bp, Artificial Sequence
  Description of Artificial Sequence: Synthetic oligonucleotide
ccagttagctcaatatcatgccaaggacccaaac

SEQ ID NO: 138097 - DNA, 36 bp, Artificial Sequence
  Description of Artificial Sequence: Synthetic oligonucleotide
cagttagctcaatatcatgccaaggacccaaacaac

SEQ ID NO: 138098 - DNA, 36 bp, Artificial Sequence
  Description of Artificial Sequence: Synthetic oligonucleotide
agttagctcaatatcatgccaaggacccaaacaacc

SEQ ID NO: 138099 - DNA, 35 bp, Artificial Sequence
  Description of Artificial Sequence: Synthetic oligonucleotide
gttagctcaatatcatgccaaggacccaaacaacc

SEQ ID NO: 138100 - DNA, 36 bp, Artificial Sequence
  Description of Artificial Sequence: Synthetic oligonucleotide
ttagctcaatatcatgccaaggacccaaacaacctc

SEQ ID NO: 138101 - DNA, 35 bp, Artificial Sequence
  Description of Artificial Sequence: Synthetic oligonucleotide
tagctcaatatcatgccaaggacccaaacaacctc

SEQ ID NO: 138102 - DNA, 34 bp, Artificial Sequence
  Description of Artificial Sequence: Synthetic oligonucleotide
agctcaatatcatgccaaggacccaaacaacctc

SEQ ID NO: 138103 - DNA, 33 bp, Artificial Sequence
  Description of Artificial Sequence: Synthetic oligonucleotide
gctcaatatcatgccaaggacccaaacaacctc

SEQ ID NO: 138104 - DNA, 35 bp, Artificial Sequence
  Description of Artificial Sequence: Synthetic oligonucleotide
ctcaatatcatgccaaggacccaaacaacctcttc

SEQ ID NO: 138105 - DNA, 37 bp, Artificial Sequence
  Description of Artificial Sequence: Synthetic oligonucleotide
tcaatatcatgccaaggacccaaacaacctcttcatg

SEQ ID NO: 138106 - DNA, 36 bp, Artificial Sequence
  Description of Artificial Sequence: Synthetic oligonucleotide
caatatcatgccaaggacccaaacaacctcttcatg

SEQ ID NO: 138107 - DNA, 36 bp, Artificial Sequence
  Description of Artificial Sequence: Synthetic oligonucleotide
aatatcatgccaaggacccaaacaacctcttcatgg

SEQ ID NO: 138108 - DNA, 35 bp, Artificial Sequence
  Description of Artificial Sequence: Synthetic oligonucleotide
atatcatgccaaggacccaaacaacctcttcatgg

SEQ ID NO: 138109 - DNA, 34 bp, Artificial Sequence
  Description of Artificial Sequence: Synthetic oligonucleotide
tatcatgccaaggacccaaacaacctcttcatgg

SEQ ID NO: 138110 - DNA, 33 bp, Artificial Sequence
  Description of Artificial Sequence: Synthetic oligonucleotide
atcatgccaaggacccaaacaacctcttcatgg

SEQ ID NO: 138111 - DNA, 32 bp, Artificial Sequence
  Description of Artificial Sequence: Synthetic oligonucleotide
tcatgccaaggacccaaacaacctcttcatgg

SEQ ID NO: 138112 - DNA, 31 bp, Artificial Sequence
  Description of Artificial Sequence: Synthetic oligonucleotide
catgccaaggacccaaacaacctcttcatgg

SEQ ID NO: 138113 - DNA, 32 bp, Artificial Sequence
  Description of Artificial Sequence: Synthetic oligonucleotide
atgccaaggacccaaacaacctcttcatggtg

SEQ ID NO: 138114 - DNA, 31 bp, Artificial Sequence
  Description of Artificial Sequence: Synthetic oligonucleotide
tgccaaggacccaaacaacctcttcatggtg

SEQ ID NO: 138115 - DNA, 30 bp, Artificial Sequence
  Description of Artificial Sequence: Synthetic oligonucleotide
gccaaggacccaaacaacctcttcatggtg

SEQ ID NO: 138116 - DNA, 30 bp, Artificial Sequence
  Description of Artificial Sequence: Synthetic oligonucleotide
ccaaggacccaaacaacctcttcatggtgc

SEQ ID NO: 138117 - DNA, 30 bp, Artificial Sequence
  Description of Artificial Sequence: Synthetic oligonucleotide
caaggacccaaacaacctcttcatggtgcg

SEQ ID NO: 138118 - DNA, 30 bp, Artificial Sequence
  Description of Artificial Sequence: Synthetic oligonucleotide
aaggacccaaacaacctcttcatggtgcgc

SEQ ID NO: 138119 - DNA, 29 bp, Artificial Sequence
  Description of Artificial Sequence: Synthetic oligonucleotide
aggacccaaacaacctcttcatggtgcgc

SEQ ID NO: 138120 - DNA, 28 bp, Artificial Sequence
  Description of Artificial Sequence: Synthetic oligonucleotide
ggacccaaacaacctcttcatggtgcgc

SEQ ID NO: 138121 - DNA, 30 bp, Artificial Sequence
  Description of Artificial Sequence: Synthetic oligonucleotide
gacccaaacaacctcttcatggtgcgcttg

SEQ ID NO: 138122 - DNA, 30 bp, Artificial Sequence
  Description of Artificial Sequence: Synthetic oligonucleotide
acccaaacaacctcttcatggtgcgcttgg

SEQ ID NO: 138123 - DNA, 29 bp, Artificial Sequence
  Description of Artificial Sequence: Synthetic oligonucleotide
cccaaacaacctcttcatggtgcgcttgg

SEQ ID NO: 138124 - DNA, 29 bp, Artificial Sequence
  Description of Artificial Sequence: Synthetic oligonucleotide
ccaaacaacctcttcatggtgcgcttggc

SEQ ID NO: 138125 - DNA, 30 bp, Artificial Sequence
  Description of Artificial Sequence: Synthetic oligonucleotide
caaacaacctcttcatggtgcgcttggcac

SEQ ID NO: 138126 - DNA, 31 bp, Artificial Sequence
  Description of Artificial Sequence: Synthetic oligonucleotide
aaacaacctcttcatggtgcgcttggcacag

SEQ ID NO: 138127 - DNA, 30 bp, Artificial Sequence
  Description of Artificial Sequence: Synthetic oligonucleotide
aacaacctcttcatggtgcgcttggcacag

SEQ ID NO: 138128 - DNA, 29 bp, Artificial Sequence
  Description of Artificial Sequence: Synthetic oligonucleotide
acaacctcttcatggtgcgcttggcacag

SEQ ID NO: 138129 - DNA, 28 bp, Artificial Sequence
  Description of Artificial Sequence: Synthetic oligonucleotide
caacctcttcatggtgcgcttggcacag

SEQ ID NO: 138130 - DNA, 28 bp, Artificial Sequence
  Description of Artificial Sequence: Synthetic oligonucleotide
aacctcttcatggtgcgcttggcacagg

SEQ ID NO: 138131 - DNA, 27 bp, Artificial Sequence
  Description of Artificial Sequence: Synthetic oligonucleotide
acctcttcatggtgcgcttggcacagg

SEQ ID NO: 138132 - DNA, 26 bp, Artificial Sequence
  Description of Artificial Sequence: Synthetic oligonucleotide
cctcttcatggtgcgcttggcacagg

SEQ ID NO: 138133 - DNA, 26 bp, Artificial Sequence
  Description of Artificial Sequence: Synthetic oligonucleotide
ctcttcatggtgcgcttggcacaggg

SEQ ID NO: 138134 - DNA, 26 bp, Artificial Sequence
  Description of Artificial Sequence: Synthetic oligonucleotide
tcttcatggtgcgcttggcacagggc

SEQ ID NO: 138135 - DNA, 25 bp, Artificial Sequence
  Description of Artificial Sequence: Synthetic oligonucleotide
cttcatggtgcgcttggcacagggc

SEQ ID NO: 138136 - DNA, 26 bp, Artificial Sequence
  Description of Artificial Sequence: Synthetic oligonucleotide
ttcatggtgcgcttggcacagggcct

SEQ ID NO: 138137 - DNA, 25 bp, Artificial Sequence
  Description of Artificial Sequence: Synthetic oligonucleotide
tcatggtgcgcttggcacagggcct

SEQ ID NO: 138138 - DNA, 24 bp, Artificial Sequence
  Description of Artificial Sequence: Synthetic oligonucleotide
catggtgcgcttggcacagggcct

SEQ ID NO: 138139 - DNA, 25 bp, Artificial Sequence
  Description of Artificial Sequence: Synthetic oligonucleotide
atggtgcgcttggcacagggcctga

SEQ ID NO: 138140 - DNA, 24 bp, Artificial Sequence
  Description of Artificial Sequence: Synthetic oligonucleotide
tggtgcgcttggcacagggcctga

SEQ ID NO: 138141 - DNA, 23 bp, Artificial Sequence
  Description of Artificial Sequence: Synthetic oligonucleotide
ggtgcgcttggcacagggcctga

SEQ ID NO: 138142 - DNA, 24 bp, Artificial Sequence
  Description of Artificial Sequence: Synthetic oligonucleotide
gtgcgcttggcacagggcctgaca

SEQ ID NO: 138143 - DNA, 27 bp, Artificial Sequence
  Description of Artificial Sequence: Synthetic oligonucleotide
tgcgcttggcacagggcctgacacatt

SEQ ID NO: 138144 - DNA, 27 bp, Artificial Sequence
  Description of Artificial Sequence: Synthetic oligonucleotide
gcgcttggcacagggcctgacacattt

SEQ ID NO: 138145 - DNA, 28 bp, Artificial Sequence
  Description of Artificial Sequence: Synthetic oligonucleotide
cgcttggcacagggcctgacacatttag

SEQ ID NO: 138146 - DNA, 28 bp, Artificial Sequence
  Description of Artificial Sequence: Synthetic oligonucleotide
gcttggcacagggcctgacacatttagg

SEQ ID NO: 138147 - DNA, 28 bp, Artificial Sequence
  Description of Artificial Sequence: Synthetic oligonucleotide
cttggcacagggcctgacacatttaggg

SEQ ID NO: 138148 - DNA, 30 bp, Artificial Sequence
  Description of Artificial Sequence: Synthetic oligonucleotide
ttggcacagggcctgacacatttagggaag

SEQ ID NO: 138149 - DNA, 29 bp, Artificial Sequence
  Description of Artificial Sequence: Synthetic oligonucleotide
tggcacagggcctgacacatttagggaag

SEQ ID NO: 138150 - DNA, 28 bp, Artificial Sequence
  Description of Artificial Sequence: Synthetic oligonucleotide
ggcacagggcctgacacatttagggaag

SEQ ID NO: 138151 - DNA, 28 bp, Artificial Sequence
  Description of Artificial Sequence: Synthetic oligonucleotide
gcacagggcctgacacatttagggaagg

SEQ ID NO: 138152 - DNA, 28 bp, Artificial Sequence
  Description of Artificial Sequence: Synthetic oligonucleotide
cacagggcctgacacatttagggaaggg

SEQ ID NO: 138153 - DNA, 28 bp, Artificial Sequence
  Description of Artificial Sequence: Synthetic oligonucleotide
acagggcctgacacatttagggaagggc

SEQ ID NO: 138154 - DNA, 27 bp, Artificial Sequence
  Description of Artificial Sequence: Synthetic oligonucleotide
cagggcctgacacatttagggaagggc

SEQ ID NO: 138155 - DNA, 28 bp, Artificial Sequence
  Description of Artificial Sequence: Synthetic oligonucleotide
agggcctgacacatttagggaagggcac

SEQ ID NO: 138156 - DNA, 27 bp, Artificial Sequence
  Description of Artificial Sequence: Synthetic oligonucleotide
gggcctgacacatttagggaagggcac

SEQ ID NO: 138157 - DNA, 27 bp, Artificial Sequence
  Description of Artificial Sequence: Synthetic oligonucleotide
ggcctgacacatttagggaagggcacc

SEQ ID NO: 138158 - DNA, 27 bp, Artificial Sequence
  Description of Artificial Sequence: Synthetic oligonucleotide
gcctgacacatttagggaagggcaccc

SEQ ID NO: 138159 - DNA, 30 bp, Artificial Sequence
  Description of Artificial Sequence: Synthetic oligonucleotide
cctgacacatttagggaagggcacccttac

SEQ ID NO: 138160 - DNA, 30 bp, Artificial Sequence
  Description of Artificial Sequence: Synthetic oligonucleotide
ctgacacatttagggaagggcacccttacc

SEQ ID NO: 138161 - DNA, 30 bp, Artificial Sequence
  Description of Artificial Sequence: Synthetic oligonucleotide
tgacacatttagggaagggcacccttaccc

SEQ ID NO: 138162 - DNA, 29 bp, Artificial Sequence
  Description of Artificial Sequence: Synthetic oligonucleotide
gacacatttagggaagggcacccttaccc

SEQ ID NO: 138163 - DNA, 30 bp, Artificial Sequence
  Description of Artificial Sequence: Synthetic oligonucleotide
acacatttagggaagggcacccttaccctc

SEQ ID NO: 138164 - DNA, 29 bp, Artificial Sequence
  Description of Artificial Sequence: Synthetic oligonucleotide
cacatttagggaagggcacccttaccctc

SEQ ID NO: 138165 - DNA, 30 bp, Artificial Sequence
  Description of Artificial Sequence: Synthetic oligonucleotide
acatttagggaagggcacccttaccctctg

SEQ ID NO: 138166 - DNA, 29 bp, Artificial Sequence
  Description of Artificial Sequence: Synthetic oligonucleotide
catttagggaagggcacccttaccctctg

SEQ ID NO: 138167 - DNA, 29 bp, Artificial Sequence
  Description of Artificial Sequence: Synthetic oligonucleotide
atttagggaagggcacccttaccctctgc

SEQ ID NO: 138168 - DNA, 28 bp, Artificial Sequence
  Description of Artificial Sequence: Synthetic oligonucleotide
tttagggaagggcacccttaccctctgc

SEQ ID NO: 138169 - DNA, 27 bp, Artificial Sequence
  Description of Artificial Sequence: Synthetic oligonucleotide
ttagggaagggcacccttaccctctgc

SEQ ID NO: 138170 - DNA, 26 bp, Artificial Sequence
  Description of Artificial Sequence: Synthetic oligonucleotide
tagggaagggcacccttaccctctgc

SEQ ID NO: 138171 - DNA, 25 bp, Artificial Sequence
  Description of Artificial Sequence: Synthetic oligonucleotide
agggaagggcacccttaccctctgc

SEQ ID NO: 138172 - DNA, 24 bp, Artificial Sequence
  Description of Artificial Sequence: Synthetic oligonucleotide
gggaagggcacccttaccctctgc

SEQ ID NO: 138173 - DNA, 24 bp, Artificial Sequence
  Description of Artificial Sequence: Synthetic oligonucleotide
ggaagggcacccttaccctctgcc

SEQ ID NO: 138174 - DNA, 24 bp, Artificial Sequence
  Description of Artificial Sequence: Synthetic oligonucleotide
gaagggcacccttaccctctgccc

SEQ ID NO: 138175 - DNA, 26 bp, Artificial Sequence
  Description of Artificial Sequence: Synthetic oligonucleotide
aagggcacccttaccctctgccccta

SEQ ID NO: 138176 - DNA, 25 bp, Artificial Sequence
  Description of Artificial Sequence: Synthetic oligonucleotide
agggcacccttaccctctgccccta

SEQ ID NO: 138177 - DNA, 24 bp, Artificial Sequence
  Description of Artificial Sequence: Synthetic oligonucleotide
gggcacccttaccctctgccccta

SEQ ID NO: 138178 - DNA, 24 bp, Artificial Sequence
  Description of Artificial Sequence: Synthetic oligonucleotide
ggcacccttaccctctgcccctac

SEQ ID NO: 138179 - DNA, 25 bp, Artificial Sequence
  Description of Artificial Sequence: Synthetic oligonucleotide
gcacccttaccctctgcccctacca

SEQ ID NO: 138180 - DNA, 26 bp, Artificial Sequence
  Description of Artificial Sequence: Synthetic oligonucleotide
cacccttaccctctgcccctaccaca

SEQ ID NO: 138181 - DNA, 26 bp, Artificial Sequence
  Description of Artificial Sequence: Synthetic oligonucleotide
acccttaccctctgcccctaccacag

SEQ ID NO: 138182 - DNA, 25 bp, Artificial Sequence
  Description of Artificial Sequence: Synthetic oligonucleotide
cccttaccctctgcccctaccacag

SEQ ID NO: 138183 - DNA, 25 bp, Artificial Sequence
  Description of Artificial Sequence: Synthetic oligonucleotide
ccttaccctctgcccctaccacagc

SEQ ID NO: 138184 - DNA, 26 bp, Artificial Sequence
  Description of Artificial Sequence: Synthetic oligonucleotide
cttaccctctgcccctaccacagcga

SEQ ID NO: 138185 - DNA, 26 bp, Artificial Sequence
  Description of Artificial Sequence: Synthetic oligonucleotide
ttaccctctgcccctaccacagcgac

SEQ ID NO: 138186 - DNA, 25 bp, Artificial Sequence
  Description of Artificial Sequence: Synthetic oligonucleotide
taccctctgcccctaccacagcgac

SEQ ID NO: 138187 - DNA, 24 bp, Artificial Sequence
  Description of Artificial Sequence: Synthetic oligonucleotide
accctctgcccctaccacagcgac

SEQ ID NO: 138188 - DNA, 23 bp, Artificial Sequence
  Description of Artificial Sequence: Synthetic oligonucleotide
ccctctgcccctaccacagcgac

SEQ ID NO: 138189 - DNA, 23 bp, Artificial Sequence
  Description of Artificial Sequence: Synthetic oligonucleotide
cctctgcccctaccacagcgacc

SEQ ID NO: 138190 - DNA, 23 bp, Artificial Sequence
  Description of Artificial Sequence: Synthetic oligonucleotide
ctctgcccctaccacagcgaccg

SEQ ID NO: 138191 - DNA, 23 bp, Artificial Sequence
  Description of Artificial Sequence: Synthetic oligonucleotide
tctgcccctaccacagcgaccgg

SEQ ID NO: 138192 - DNA, 22 bp, Artificial Sequence
  Description of Artificial Sequence: Synthetic oligonucleotide
ctgcccctaccacagcgaccgg

SEQ ID NO: 138193 - DNA, 23 bp, Artificial Sequence
  Description of Artificial Sequence: Synthetic oligonucleotide
tgcccctaccacagcgaccggca

SEQ ID NO: 138194 - DNA, 22 bp, Artificial Sequence
  Description of Artificial Sequence: Synthetic oligonucleotide
gcccctaccacagcgaccggca

SEQ ID NO: 138195 - DNA, 22 bp, Artificial Sequence
  Description of Artificial Sequence: Synthetic oligonucleotide
cccctaccacagcgaccggcag

SEQ ID NO: 138196 - DNA, 26 bp, Artificial Sequence
  Description of Artificial Sequence: Synthetic oligonucleotide
ccctaccacagcgaccggcagcttat

SEQ ID NO: 138197 - DNA, 27 bp, Artificial Sequence
  Description of Artificial Sequence: Synthetic oligonucleotide
cctaccacagcgaccggcagcttatga

SEQ ID NO: 138198 - DNA, 27 bp, Artificial Sequence
  Description of Artificial Sequence: Synthetic oligonucleotide
ctaccacagcgaccggcagcttatgag

SEQ ID NO: 138199 - DNA, 27 bp, Artificial Sequence
  Description of Artificial Sequence: Synthetic oligonucleotide
taccacagcgaccggcagcttatgagc

SEQ ID NO: 138200 - DNA, 26 bp, Artificial Sequence
  Description of Artificial Sequence: Synthetic oligonucleotide
accacagcgaccggcagcttatgagc

SEQ ID NO: 138201 - DNA, 25 bp, Artificial Sequence
  Description of Artificial Sequence: Synthetic oligonucleotide
ccacagcgaccggcagcttatgagc

SEQ ID NO: 138202 - DNA, 26 bp, Artificial Sequence
  Description of Artificial Sequence: Synthetic oligonucleotide
cacagcgaccggcagcttatgagcca

SEQ ID NO: 138203 - DNA, 26 bp, Artificial Sequence
  Description of Artificial Sequence: Synthetic oligonucleotide
acagcgaccggcagcttatgagccag

SEQ ID NO: 138204 - DNA, 25 bp, Artificial Sequence
  Description of Artificial Sequence: Synthetic oligonucleotide
cagcgaccggcagcttatgagccag

SEQ ID NO: 138205 - DNA, 26 bp, Artificial Sequence
  Description of Artificial Sequence: Synthetic oligonucleotide
agcgaccggcagcttatgagccaggt

SEQ ID NO: 138206 - DNA, 25 bp, Artificial Sequence
  Description of Artificial Sequence: Synthetic oligonucleotide
gcgaccggcagcttatgagccaggt

SEQ ID NO: 138207 - DNA, 25 bp, Artificial Sequence
  Description of Artificial Sequence: Synthetic oligonucleotide
cgaccggcagcttatgagccaggtg

SEQ ID NO: 138208 - DNA, 25 bp, Artificial Sequence
  Description of Artificial Sequence: Synthetic oligonucleotide
gaccggcagcttatgagccaggtgg

SEQ ID NO: 138209 - DNA, 25 bp, Artificial Sequence
  Description of Artificial Sequence: Synthetic oligonucleotide
accggcagcttatgagccaggtggc

SEQ ID NO: 138210 - DNA, 24 bp, Artificial Sequence
  Description of Artificial Sequence: Synthetic oligonucleotide
ccggcagcttatgagccaggtggc

SEQ ID NO: 138211 - DNA, 24 bp, Artificial Sequence
  Description of Artificial Sequence: Synthetic oligonucleotide
cggcagcttatgagccaggtggcc

SEQ ID NO: 138212 - DNA, 25 bp, Artificial Sequence
  Description of Artificial Sequence: Synthetic oligonucleotide
ggcagcttatgagccaggtggccgt

SEQ ID NO: 138213 - DNA, 25 bp, Artificial Sequence
  Description of Artificial Sequence: Synthetic oligonucleotide
gcagcttatgagccaggtggccgtg

SEQ ID NO: 138214 - DNA, 25 bp, Artificial Sequence
  Description of Artificial Sequence: Synthetic oligonucleotide
cagcttatgagccaggtggccgtgg

SEQ ID NO: 138215 - DNA, 26 bp, Artificial Sequence
  Description of Artificial Sequence: Synthetic oligonucleotide
agcttatgagccaggtggccgtggct

SEQ ID NO: 138216 - DNA, 25 bp, Artificial Sequence
  Description of Artificial Sequence: Synthetic oligonucleotide
gcttatgagccaggtggccgtggct

SEQ ID NO: 138217 - DNA, 25 bp, Artificial Sequence
  Description of Artificial Sequence: Synthetic oligonucleotide
cttatgagccaggtggccgtggctg

SEQ ID NO: 138218 - DNA, 26 bp, Artificial Sequence
  Description of Artificial Sequence: Synthetic oligonucleotide
ttatgagccaggtggccgtggctgga

SEQ ID NO: 138219 - DNA, 25 bp, Artificial Sequence
  Description of Artificial Sequence: Synthetic oligonucleotide
tatgagccaggtggccgtggctgga

SEQ ID NO: 138220 - DNA, 24 bp, Artificial Sequence
  Description of Artificial Sequence: Synthetic oligonucleotide
atgagccaggtggccgtggctgga

SEQ ID NO: 138221 - DNA, 23 bp, Artificial Sequence
  Description of Artificial Sequence: Synthetic oligonucleotide
tgagccaggtggccgtggctgga

SEQ ID NO: 138222 - DNA, 22 bp, Artificial Sequence
  Description of Artificial Sequence: Synthetic oligonucleotide
gagccaggtggccgtggctgga

SEQ ID NO: 138223 - DNA, 23 bp, Artificial Sequence
  Description of Artificial Sequence: Synthetic oligonucleotide
agccaggtggccgtggctggact

SEQ ID NO: 138224 - DNA, 22 bp, Artificial Sequence
  Description of Artificial Sequence: Synthetic oligonucleotide
gccaggtggccgtggctggact

SEQ ID NO: 138225 - DNA, 22 bp, Artificial Sequence
  Description of Artificial Sequence: Synthetic oligonucleotide
ccaggtggccgtggctggactg

SEQ ID NO: 138226 - DNA, 23 bp, Artificial Sequence
  Description of Artificial Sequence: Synthetic oligonucleotide
caggtggccgtggctggactgct

SEQ ID NO: 138227 - DNA, 24 bp, Artificial Sequence
  Description of Artificial Sequence: Synthetic oligonucleotide
aggtggccgtggctggactgctca

SEQ ID NO: 138228 - DNA, 23 bp, Artificial Sequence
  Description of Artificial Sequence: Synthetic oligonucleotide
ggtggccgtggctggactgctca

SEQ ID NO: 138229 - DNA, 24 bp, Artificial Sequence
  Description of Artificial Sequence: Synthetic oligonucleotide
gtggccgtggctggactgctcact

SEQ ID NO: 138230 - DNA, 25 bp, Artificial Sequence
  Description of Artificial Sequence: Synthetic oligonucleotide
tggccgtggctggactgctcactgt

SEQ ID NO: 138231 - DNA, 24 bp, Artificial Sequence
  Description of Artificial Sequence: Synthetic oligonucleotide
ggccgtggctggactgctcactgt

SEQ ID NO: 138232 - DNA, 24 bp, Artificial Sequence
  Description of Artificial Sequence: Synthetic oligonucleotide
gccgtggctggactgctcactgtg

SEQ ID NO: 138233 - DNA, 26 bp, Artificial Sequence
  Description of Artificial Sequence: Synthetic oligonucleotide
ccgtggctggactgctcactgtgctt

SEQ ID NO: 138234 - DNA, 27 bp, Artificial Sequence
  Description of Artificial Sequence: Synthetic oligonucleotide
cgtggctggactgctcactgtgcttgt

SEQ ID NO: 138235 - DNA, 27 bp, Artificial Sequence
  Description of Artificial Sequence: Synthetic oligonucleotide
gtggctggactgctcactgtgcttgtc

SEQ ID NO: 138236 - DNA, 28 bp, Artificial Sequence
  Description of Artificial Sequence: Synthetic oligonucleotide
tggctggactgctcactgtgcttgtctc

SEQ ID NO: 138237 - DNA, 27 bp, Artificial Sequence
  Description of Artificial Sequence: Synthetic oligonucleotide
ggctggactgctcactgtgcttgtctc

SEQ ID NO: 138238 - DNA, 30 bp, Artificial Sequence
  Description of Artificial Sequence: Synthetic oligonucleotide
gctggactgctcactgtgcttgtctctttc

SEQ ID NO: 138239 - DNA, 30 bp, Artificial Sequence
  Description of Artificial Sequence: Synthetic oligonucleotide
ctggactgctcactgtgcttgtctctttcc

SEQ ID NO: 138240 - DNA, 31 bp, Artificial Sequence
  Description of Artificial Sequence: Synthetic oligonucleotide
tggactgctcactgtgcttgtctctttcctg

SEQ ID NO: 138241 - DNA, 30 bp, Artificial Sequence
  Description of Artificial Sequence: Synthetic oligonucleotide
ggactgctcactgtgcttgtctctttcctg

SEQ ID NO: 138242 - DNA, 30 bp, Artificial Sequence
  Description of Artificial Sequence: Synthetic oligonucleotide
gactgctcactgtgcttgtctctttcctgg

SEQ ID NO: 138243 - DNA, 32 bp, Artificial Sequence
  Description of Artificial Sequence: Synthetic oligonucleotide
actgctcactgtgcttgtctctttcctggatg

SEQ ID NO: 138244 - DNA, 31 bp, Artificial Sequence
  Description of Artificial Sequence: Synthetic oligonucleotide
ctgctcactgtgcttgtctctttcctggatg

SEQ ID NO: 138245 - DNA, 33 bp, Artificial Sequence
  Description of Artificial Sequence: Synthetic oligonucleotide
tgctcactgtgcttgtctctttcctggatgttc

SEQ ID NO: 138246 - DNA, 32 bp, Artificial Sequence
  Description of Artificial Sequence: Synthetic oligonucleotide
gctcactgtgcttgtctctttcctggatgttc

SEQ ID NO: 138247 - DNA, 32 bp, Artificial Sequence
  Description of Artificial Sequence: Synthetic oligonucleotide
ctcactgtgcttgtctctttcctggatgttcg

SEQ ID NO: 138248 - DNA, 35 bp, Artificial Sequence
  Description of Artificial Sequence: Synthetic oligonucleotide
tcactgtgcttgtctctttcctggatgttcgaaac

SEQ ID NO: 138249 - DNA, 34 bp, Artificial Sequence
  Description of Artificial Sequence: Synthetic oligonucleotide
cactgtgcttgtctctttcctggatgttcgaaac

SEQ ID NO: 138250 - DNA, 40 bp, Artificial Sequence
  Description of Artificial Sequence: Synthetic oligonucleotide
actgtgcttgtctctttcctggatgttcgaaacattattc

SEQ ID NO: 138251 - DNA, 39 bp, Artificial Sequence
  Description of Artificial Sequence: Synthetic oligonucleotide
ctgtgcttgtctctttcctggatgttcgaaacattattc

SEQ ID NO: 138252 - DNA, 41 bp, Artificial Sequence
  Description of Artificial Sequence: Synthetic oligonucleotide
tgtgcttgtctctttcctggatgttcgaaacattattctag

SEQ ID NO: 138253 - DNA, 40 bp, Artificial Sequence
  Description of Artificial Sequence: Synthetic oligonucleotide
gtgcttgtctctttcctggatgttcgaaacattattctag

SEQ ID NO: 138254 - DNA, 40 bp, Artificial Sequence
  Description of Artificial Sequence: Synthetic oligonucleotide
tgcttgtctctttcctggatgttcgaaacattattctagg

SEQ ID NO: 138255 - DNA, 39 bp, Artificial Sequence
  Description of Artificial Sequence: Synthetic oligonucleotide
gcttgtctctttcctggatgttcgaaacattattctagg

SEQ ID NO: 138256 - DNA, 39 bp, Artificial Sequence
  Description of Artificial Sequence: Synthetic oligonucleotide
cttgtctctttcctggatgttcgaaacattattctaggc

SEQ ID NO: 138257 - DNA, 43 bp, Artificial Sequence
  Description of Artificial Sequence: Synthetic oligonucleotide
ttgtctctttcctggatgttcgaaacattattctaggcaaatc

SEQ ID NO: 138258 - DNA, 42 bp, Artificial Sequence
  Description of Artificial Sequence: Synthetic oligonucleotide
tgtctctttcctggatgttcgaaacattattctaggcaaatc

SEQ ID NO: 138259 - DNA, 41 bp, Artificial Sequence
  Description of Artificial Sequence: Synthetic oligonucleotide
gtctctttcctggatgttcgaaacattattctaggcaaatc

SEQ ID NO: 138260 - DNA, 42 bp, Artificial Sequence
  Description of Artificial Sequence: Synthetic oligonucleotide
tctctttcctggatgttcgaaacattattctaggcaaatcac

SEQ ID NO: 138261 - DNA, 41 bp, Artificial Sequence
  Description of Artificial Sequence: Synthetic oligonucleotide
ctctttcctggatgttcgaaacattattctaggcaaatcac

SEQ ID NO: 138262 - DNA, 42 bp, Artificial Sequence
  Description of Artificial Sequence: Synthetic oligonucleotide
tctttcctggatgttcgaaacattattctaggcaaatcacac

SEQ ID NO: 138263 - DNA, 41 bp, Artificial Sequence
  Description of Artificial Sequence: Synthetic oligonucleotide
ctttcctggatgttcgaaacattattctaggcaaatcacac

SEQ ID NO: 138264 - DNA, 44 bp, Artificial Sequence
  Description of Artificial Sequence: Synthetic oligonucleotide
tttcctggatgttcgaaacattattctaggcaaatcacactatg

SEQ ID NO: 138265 - DNA, 43 bp, Artificial Sequence
  Description of Artificial Sequence: Synthetic oligonucleotide
ttcctggatgttcgaaacattattctaggcaaatcacactatg

SEQ ID NO: 138266 - DNA, 42 bp, Artificial Sequence
  Description of Artificial Sequence: Synthetic oligonucleotide
tcctggatgttcgaaacattattctaggcaaatcacactatg

SEQ ID NO: 138267 - DNA, 41 bp, Artificial Sequence
  Description of Artificial Sequence: Synthetic oligonucleotide
cctggatgttcgaaacattattctaggcaaatcacactatg

SEQ ID NO: 138268 - DNA, 45 bp, Artificial Sequence
  Description of Artificial Sequence: Synthetic oligonucleotide
ctggatgttcgaaacattattctaggcaaatcacactatgtattg

SEQ ID NO: 138269 - DNA, 48 bp, Artificial Sequence
  Description of Artificial Sequence: Synthetic oligonucleotide
tggatgttcgaaacattattctaggcaaatcacactatgtattgtatg

SEQ ID NO: 138270 - DNA, 47 bp, Artificial Sequence
  Description of Artificial Sequence: Synthetic oligonucleotide
ggatgttcgaaacattattctaggcaaatcacactatgtattgtatg

SEQ ID NO: 138271 - DNA, 47 bp, Artificial Sequence
  Description of Artificial Sequence: Synthetic oligonucleotide
gatgttcgaaacattattctaggcaaatcacactatgtattgtatgg

SEQ ID NO: 138272 - DNA, 47 bp, Artificial Sequence
  Description of Artificial Sequence: Synthetic oligonucleotide
atgttcgaaacattattctaggcaaatcacactatgtattgtatggg

SEQ ID NO: 138273 - DNA, 46 bp, Artificial Sequence
  Description of Artificial Sequence: Synthetic oligonucleotide
tgttcgaaacattattctaggcaaatcacactatgtattgtatggg

SEQ ID NO: 138274 - DNA, 45 bp, Artificial Sequence
  Description of Artificial Sequence: Synthetic oligonucleotide
gttcgaaacattattctaggcaaatcacactatgtattgtatggg

SEQ ID NO: 138275 - DNA, 45 bp, Artificial Sequence
  Description of Artificial Sequence: Synthetic oligonucleotide
ttcgaaacattattctaggcaaatcacactatgtattgtatgggc

SEQ ID NO: 138276 - DNA, 44 bp, Artificial Sequence
  Description of Artificial Sequence: Synthetic oligonucleotide
tcgaaacattattctaggcaaatcacactatgtattgtatgggc

SEQ ID NO: 138277 - DNA, 43 bp, Artificial Sequence
  Description of Artificial Sequence: Synthetic oligonucleotide
cgaaacattattctaggcaaatcacactatgtattgtatgggc

SEQ ID NO: 138278 - DNA, 44 bp, Artificial Sequence
  Description of Artificial Sequence: Synthetic oligonucleotide
gaaacattattctaggcaaatcacactatgtattgtatgggctg

SEQ ID NO: 138279 - DNA, 44 bp, Artificial Sequence
  Description of Artificial Sequence: Synthetic oligonucleotide
aaacattattctaggcaaatcacactatgtattgtatgggctgg

SEQ ID NO: 138280 - DNA, 43 bp, Artificial Sequence
  Description of Artificial Sequence: Synthetic oligonucleotide
aacattattctaggcaaatcacactatgtattgtatgggctgg

SEQ ID NO: 138281 - DNA, 42 bp, Artificial Sequence
  Description of Artificial Sequence: Synthetic oligonucleotide
acattattctaggcaaatcacactatgtattgtatgggctgg

SEQ ID NO: 138282 - DNA, 41 bp, Artificial Sequence
  Description of Artificial Sequence: Synthetic oligonucleotide
cattattctaggcaaatcacactatgtattgtatgggctgg

SEQ ID NO: 138283 - DNA, 42 bp, Artificial Sequence
  Description of Artificial Sequence: Synthetic oligonucleotide
attattctaggcaaatcacactatgtattgtatgggctggtg

SEQ ID NO: 138284 - DNA, 41 bp, Artificial Sequence
  Description of Artificial Sequence: Synthetic oligonucleotide
ttattctaggcaaatcacactatgtattgtatgggctggtg

SEQ ID NO: 138285 - DNA, 40 bp, Artificial Sequence
  Description of Artificial Sequence: Synthetic oligonucleotide
tattctaggcaaatcacactatgtattgtatgggctggtg

SEQ ID NO: 138286 - DNA, 39 bp, Artificial Sequence
  Description of Artificial Sequence: Synthetic oligonucleotide
attctaggcaaatcacactatgtattgtatgggctggtg

SEQ ID NO: 138287 - DNA, 38 bp, Artificial Sequence
  Description of Artificial Sequence: Synthetic oligonucleotide
ttctaggcaaatcacactatgtattgtatgggctggtg

SEQ ID NO: 138288 - DNA, 37 bp, Artificial Sequence
  Description of Artificial Sequence: Synthetic oligonucleotide
tctaggcaaatcacactatgtattgtatgggctggtg

SEQ ID NO: 138289 - DNA, 36 bp, Artificial Sequence
  Description of Artificial Sequence: Synthetic oligonucleotide
ctaggcaaatcacactatgtattgtatgggctggtg

SEQ ID NO: 138290 - DNA, 36 bp, Artificial Sequence
  Description of Artificial Sequence: Synthetic oligonucleotide
taggcaaatcacactatgtattgtatgggctggtgg

SEQ ID NO: 138291 - DNA, 35 bp, Artificial Sequence
  Description of Artificial Sequence: Synthetic oligonucleotide
aggcaaatcacactatgtattgtatgggctggtgg

SEQ ID NO: 138292 - DNA, 34 bp, Artificial Sequence
  Description of Artificial Sequence: Synthetic oligonucleotide
ggcaaatcacactatgtattgtatgggctggtgg

SEQ ID NO: 138293 - DNA, 34 bp, Artificial Sequence
  Description of Artificial Sequence: Synthetic oligonucleotide
gcaaatcacactatgtattgtatgggctggtggc

SEQ ID NO: 138294 - DNA, 35 bp, Artificial Sequence
  Description of Artificial Sequence: Synthetic oligonucleotide
caaatcacactatgtattgtatgggctggtggctg

SEQ ID NO: 138295 - DNA, 35 bp, Artificial Sequence
  Description of Artificial Sequence: Synthetic oligonucleotide
aaatcacactatgtattgtatgggctggtggctgc

SEQ ID NO: 138296 - DNA, 34 bp, Artificial Sequence
  Description of Artificial Sequence: Synthetic oligonucleotide
aatcacactatgtattgtatgggctggtggctgc

SEQ ID NO: 138297 - DNA, 33 bp, Artificial Sequence
  Description of Artificial Sequence: Synthetic oligonucleotide
atcacactatgtattgtatgggctggtggctgc

SEQ ID NO: 138298 - DNA, 32 bp, Artificial Sequence
  Description of Artificial Sequence: Synthetic oligonucleotide
tcacactatgtattgtatgggctggtggctgc

SEQ ID NO: 138299 - DNA, 31 bp, Artificial Sequence
  Description of Artificial Sequence: Synthetic oligonucleotide
cacactatgtattgtatgggctggtggctgc

SEQ ID NO: 138300 - DNA, 31 bp, Artificial Sequence
  Description of Artificial Sequence: Synthetic oligonucleotide
acactatgtattgtatgggctggtggctgcc

SEQ ID NO: 138301 - DNA, 30 bp, Artificial Sequence
  Description of Artificial Sequence: Synthetic oligonucleotide
cactatgtattgtatgggctggtggctgcc

SEQ ID NO: 138302 - DNA, 32 bp, Artificial Sequence
  Description of Artificial Sequence: Synthetic oligonucleotide
actatgtattgtatgggctggtggctgccatg

SEQ ID NO: 138303 - DNA, 31 bp, Artificial Sequence
  Description of Artificial Sequence: Synthetic oligonucleotide
ctatgtattgtatgggctggtggctgccatg

SEQ ID NO: 138304 - DNA, 31 bp, Artificial Sequence
  Description of Artificial Sequence: Synthetic oligonucleotide
tatgtattgtatgggctggtggctgccatgc

SEQ ID NO: 138305 - DNA, 30 bp, Artificial Sequence
  Description of Artificial Sequence: Synthetic oligonucleotide
atgtattgtatgggctggtggctgccatgc

SEQ ID NO: 138306 - DNA, 29 bp, Artificial Sequence
  Description of Artificial Sequence: Synthetic oligonucleotide
tgtattgtatgggctggtggctgccatgc

SEQ ID NO: 138307 - DNA, 28 bp, Artificial Sequence
  Description of Artificial Sequence: Synthetic oligonucleotide
gtattgtatgggctggtggctgccatgc

SEQ ID NO: 138308 - DNA, 29 bp, Artificial Sequence
  Description of Artificial Sequence: Synthetic oligonucleotide
tattgtatgggctggtggctgccatgcag

SEQ ID NO: 138309 - DNA, 28 bp, Artificial Sequence
  Description of Artificial Sequence: Synthetic oligonucleotide
attgtatgggctggtggctgccatgcag

SEQ ID NO: 138310 - DNA, 27 bp, Artificial Sequence
  Description of Artificial Sequence: Synthetic oligonucleotide
ttgtatgggctggtggctgccatgcag

SEQ ID NO: 138311 - DNA, 26 bp, Artificial Sequence
  Description of Artificial Sequence: Synthetic oligonucleotide
tgtatgggctggtggctgccatgcag

SEQ ID NO: 138312 - DNA, 25 bp, Artificial Sequence
  Description of Artificial Sequence: Synthetic oligonucleotide
gtatgggctggtggctgccatgcag

SEQ ID NO: 138313 - DNA, 25 bp, Artificial Sequence
  Description of Artificial Sequence: Synthetic oligonucleotide
tatgggctggtggctgccatgcagc

SEQ ID NO: 138314 - DNA, 24 bp, Artificial Sequence
  Description of Artificial Sequence: Synthetic oligonucleotide
atgggctggtggctgccatgcagc

SEQ ID NO: 138315 - DNA, 23 bp, Artificial Sequence
  Description of Artificial Sequence: Synthetic oligonucleotide
tgggctggtggctgccatgcagc

SEQ ID NO: 138316 - DNA, 22 bp, Artificial Sequence
  Description of Artificial Sequence: Synthetic oligonucleotide
gggctggtggctgccatgcagc

SEQ ID NO: 138317 - DNA, 22 bp, Artificial Sequence
  Description of Artificial Sequence: Synthetic oligonucleotide
ggctggtggctgccatgcagcc

SEQ ID NO: 138318 - DNA, 22 bp, Artificial Sequence
  Description of Artificial Sequence: Synthetic oligonucleotide
gctggtggctgccatgcagccc

SEQ ID NO: 138319 - DNA, 22 bp, Artificial Sequence
  Description of Artificial Sequence: Synthetic oligonucleotide
ctggtggctgccatgcagcccc

SEQ ID NO: 138320 - DNA, 25 bp, Artificial Sequence
  Description of Artificial Sequence: Synthetic oligonucleotide
tggtggctgccatgcagccccgaat

SEQ ID NO: 138321 - DNA, 24 bp, Artificial Sequence
  Description of Artificial Sequence: Synthetic oligonucleotide
ggtggctgccatgcagccccgaat

SEQ ID NO: 138322 - DNA, 24 bp, Artificial Sequence
  Description of Artificial Sequence: Synthetic oligonucleotide
gtggctgccatgcagccccgaatg

SEQ ID NO: 138323 - DNA, 25 bp, Artificial Sequence
  Description of Artificial Sequence: Synthetic oligonucleotide
tggctgccatgcagccccgaatgct

SEQ ID NO: 138324 - DNA, 24 bp, Artificial Sequence
  Description of Artificial Sequence: Synthetic oligonucleotide
ggctgccatgcagccccgaatgct

SEQ ID NO: 138325 - DNA, 24 bp, Artificial Sequence
  Description of Artificial Sequence: Synthetic oligonucleotide
gctgccatgcagccccgaatgctg

SEQ ID NO: 138326 - DNA, 27 bp, Artificial Sequence
  Description of Artificial Sequence: Synthetic oligonucleotide
ctgccatgcagccccgaatgctggtta

SEQ ID NO: 138327 - DNA, 27 bp, Artificial Sequence
  Description of Artificial Sequence: Synthetic oligonucleotide
tgccatgcagccccgaatgctggttac

SEQ ID NO: 138328 - DNA, 26 bp, Artificial Sequence
  Description of Artificial Sequence: Synthetic oligonucleotide
gccatgcagccccgaatgctggttac

SEQ ID NO: 138329 - DNA, 27 bp, Artificial Sequence
  Description of Artificial Sequence: Synthetic oligonucleotide
ccatgcagccccgaatgctggttacgt

SEQ ID NO: 138330 - DNA, 29 bp, Artificial Sequence
  Description of Artificial Sequence: Synthetic oligonucleotide
catgcagccccgaatgctggttacgtttg

SEQ ID NO: 138331 - DNA, 31 bp, Artificial Sequence
  Description of Artificial Sequence: Synthetic oligonucleotide
atgcagccccgaatgctggttacgtttgatg

SEQ ID NO: 138332 - DNA, 30 bp, Artificial Sequence
  Description of Artificial Sequence: Synthetic oligonucleotide
tgcagccccgaatgctggttacgtttgatg

SEQ ID NO: 138333 - DNA, 29 bp, Artificial Sequence
  Description of Artificial Sequence: Synthetic oligonucleotide
gcagccccgaatgctggttacgtttgatg

SEQ ID NO: 138334 - DNA, 30 bp, Artificial Sequence
  Description of Artificial Sequence: Synthetic oligonucleotide
cagccccgaatgctggttacgtttgatgag

SEQ ID NO: 138335 - DNA, 30 bp, Artificial Sequence
  Description of Artificial Sequence: Synthetic oligonucleotide
agccccgaatgctggttacgtttgatgagg

SEQ ID NO: 138336 - DNA, 29 bp, Artificial Sequence
  Description of Artificial Sequence: Synthetic oligonucleotide
gccccgaatgctggttacgtttgatgagg

SEQ ID NO: 138337 - DNA, 30 bp, Artificial Sequence
  Description of Artificial Sequence: Synthetic oligonucleotide
ccccgaatgctggttacgtttgatgaggag

SEQ ID NO: 138338 - DNA, 30 bp, Artificial Sequence
  Description of Artificial Sequence: Synthetic oligonucleotide
cccgaatgctggttacgtttgatgaggagc

SEQ ID NO: 138339 - DNA, 31 bp, Artificial Sequence
  Description of Artificial Sequence: Synthetic oligonucleotide
ccgaatgctggttacgtttgatgaggagctg

SEQ ID NO: 138340 - DNA, 31 bp, Artificial Sequence
  Description of Artificial Sequence: Synthetic oligonucleotide
cgaatgctggttacgtttgatgaggagctgc

SEQ ID NO: 138341 - DNA, 31 bp, Artificial Sequence
  Description of Artificial Sequence: Synthetic oligonucleotide
gaatgctggttacgtttgatgaggagctgcg

SEQ ID NO: 138342 - DNA, 31 bp, Artificial Sequence
  Description of Artificial Sequence: Synthetic oligonucleotide
aatgctggttacgtttgatgaggagctgcgg

SEQ ID NO: 138343 - DNA, 30 bp, Artificial Sequence
  Description of Artificial Sequence: Synthetic oligonucleotide
atgctggttacgtttgatgaggagctgcgg

SEQ ID NO: 138344 - DNA, 29 bp, Artificial Sequence
  Description of Artificial Sequence: Synthetic oligonucleotide
tgctggttacgtttgatgaggagctgcgg

SEQ ID NO: 138345 - DNA, 28 bp, Artificial Sequence
  Description of Artificial Sequence: Synthetic oligonucleotide
gctggttacgtttgatgaggagctgcgg

SEQ ID NO: 138346 - DNA, 28 bp, Artificial Sequence
  Description of Artificial Sequence: Synthetic oligonucleotide
ctggttacgtttgatgaggagctgcggc

SEQ ID NO: 138347 - DNA, 28 bp, Artificial Sequence
  Description of Artificial Sequence: Synthetic oligonucleotide
tggttacgtttgatgaggagctgcggcc

SEQ ID NO: 138348 - DNA, 27 bp, Artificial Sequence
  Description of Artificial Sequence: Synthetic oligonucleotide
ggttacgtttgatgaggagctgcggcc

SEQ ID NO: 138349 - DNA, 30 bp, Artificial Sequence
  Description of Artificial Sequence: Synthetic oligonucleotide
gttacgtttgatgaggagctgcggccattg

SEQ ID NO: 138350 - DNA, 30 bp, Artificial Sequence
  Description of Artificial Sequence: Synthetic oligonucleotide
ttacgtttgatgaggagctgcggccattgc

SEQ ID NO: 138351 - DNA, 29 bp, Artificial Sequence
  Description of Artificial Sequence: Synthetic oligonucleotide
tacgtttgatgaggagctgcggccattgc

SEQ ID NO: 138352 - DNA, 28 bp, Artificial Sequence
  Description of Artificial Sequence: Synthetic oligonucleotide
acgtttgatgaggagctgcggccattgc

SEQ ID NO: 138353 - DNA, 27 bp, Artificial Sequence
  Description of Artificial Sequence: Synthetic oligonucleotide
cgtttgatgaggagctgcggccattgc

SEQ ID NO: 138354 - DNA, 27 bp, Artificial Sequence
  Description of Artificial Sequence: Synthetic oligonucleotide
gtttgatgaggagctgcggccattgcc

SEQ ID NO: 138355 - DNA, 28 bp, Artificial Sequence
  Description of Artificial Sequence: Synthetic oligonucleotide
tttgatgaggagctgcggccattgccag

SEQ ID NO: 138356 - DNA, 27 bp, Artificial Sequence
  Description of Artificial Sequence: Synthetic oligonucleotide
ttgatgaggagctgcggccattgccag

SEQ ID NO: 138357 - DNA, 27 bp, Artificial Sequence
  Description of Artificial Sequence: Synthetic oligonucleotide
tgatgaggagctgcggccattgccagt

SEQ ID NO: 138358 - DNA, 26 bp, Artificial Sequence
  Description of Artificial Sequence: Synthetic oligonucleotide
gatgaggagctgcggccattgccagt

SEQ ID NO: 138359 - DNA, 27 bp, Artificial Sequence
  Description of Artificial Sequence: Synthetic oligonucleotide
atgaggagctgcggccattgccagtgt

SEQ ID NO: 138360 - DNA, 26 bp, Artificial Sequence
  Description of Artificial Sequence: Synthetic oligonucleotide
tgaggagctgcggccattgccagtgt

SEQ ID NO: 138361 - DNA, 25 bp, Artificial Sequence
  Description of Artificial Sequence: Synthetic oligonucleotide
gaggagctgcggccattgccagtgt

SEQ ID NO: 138362 - DNA, 26 bp, Artificial Sequence
  Description of Artificial Sequence: Synthetic oligonucleotide
aggagctgcggccattgccagtgtct

SEQ ID NO: 138363 - DNA, 25 bp, Artificial Sequence
  Description of Artificial Sequence: Synthetic oligonucleotide
ggagctgcggccattgccagtgtct

SEQ ID NO: 138364 - DNA, 26 bp, Artificial Sequence
  Description of Artificial Sequence: Synthetic oligonucleotide
gagctgcggccattgccagtgtctgt

SEQ ID NO: 138365 - DNA, 26 bp, Artificial Sequence
  Description of Artificial Sequence: Synthetic oligonucleotide
agctgcggccattgccagtgtctgtc

SEQ ID NO: 138366 - DNA, 25 bp, Artificial Sequence
  Description of Artificial Sequence: Synthetic oligonucleotide
gctgcggccattgccagtgtctgtc

SEQ ID NO: 138367 - DNA, 25 bp, Artificial Sequence
  Description of Artificial Sequence: Synthetic oligonucleotide
ctgcggccattgccagtgtctgtcc

SEQ ID NO: 138368 - DNA, 26 bp, Artificial Sequence
  Description of Artificial Sequence: Synthetic oligonucleotide
tgcggccattgccagtgtctgtccgt

SEQ ID NO: 138369 - DNA, 25 bp, Artificial Sequence
  Description of Artificial Sequence: Synthetic oligonucleotide
gcggccattgccagtgtctgtccgt

SEQ ID NO: 138370 - DNA, 26 bp, Artificial Sequence
  Description of Artificial Sequence: Synthetic oligonucleotide
cggccattgccagtgtctgtccgtgt

SEQ ID NO: 138371 - DNA, 26 bp, Artificial Sequence
  Description of Artificial Sequence: Synthetic oligonucleotide
ggccattgccagtgtctgtccgtgtg

SEQ ID NO: 138372 - DNA, 26 bp, Artificial Sequence
  Description of Artificial Sequence: Synthetic oligonucleotide
gccattgccagtgtctgtccgtgtgg

SEQ ID NO: 138373 - DNA, 26 bp, Artificial Sequence
  Description of Artificial Sequence: Synthetic oligonucleotide
ccattgccagtgtctgtccgtgtggg

SEQ ID NO: 138374 - DNA, 26 bp, Artificial Sequence
  Description of Artificial Sequence: Synthetic oligonucleotide
cattgccagtgtctgtccgtgtgggc

SEQ ID NO: 138375 - DNA, 27 bp, Artificial Sequence
  Description of Artificial Sequence: Synthetic oligonucleotide
attgccagtgtctgtccgtgtgggcca

SEQ ID NO: 138376 - DNA, 26 bp, Artificial Sequence
  Description of Artificial Sequence: Synthetic oligonucleotide
ttgccagtgtctgtccgtgtgggcca

SEQ ID NO: 138377 - DNA, 25 bp, Artificial Sequence
  Description of Artificial Sequence: Synthetic oligonucleotide
tgccagtgtctgtccgtgtgggcca

SEQ ID NO: 138378 - DNA, 24 bp, Artificial Sequence
  Description of Artificial Sequence: Synthetic oligonucleotide
gccagtgtctgtccgtgtgggcca

SEQ ID NO: 138379 - DNA, 24 bp, Artificial Sequence
  Description of Artificial Sequence: Synthetic oligonucleotide
ccagtgtctgtccgtgtgggccag

SEQ ID NO: 138380 - DNA, 24 bp, Artificial Sequence
  Description of Artificial Sequence: Synthetic oligonucleotide
cagtgtctgtccgtgtgggccagg

SEQ ID NO: 138381 - DNA, 25 bp, Artificial Sequence
  Description of Artificial Sequence: Synthetic oligonucleotide
agtgtctgtccgtgtgggccaggca

SEQ ID NO: 138382 - DNA, 24 bp, Artificial Sequence
  Description of Artificial Sequence: Synthetic oligonucleotide
gtgtctgtccgtgtgggccaggca

SEQ ID NO: 138383 - DNA, 25 bp, Artificial Sequence
  Description of Artificial Sequence: Synthetic oligonucleotide
tgtctgtccgtgtgggccaggcagt

SEQ ID NO: 138384 - DNA, 24 bp, Artificial Sequence
  Description of Artificial Sequence: Synthetic oligonucleotide
gtctgtccgtgtgggccaggcagt

SEQ ID NO: 138385 - DNA, 24 bp, Artificial Sequence
  Description of Artificial Sequence: Synthetic oligonucleotide
tctgtccgtgtgggccaggcagtg

SEQ ID NO: 138386 - DNA, 23 bp, Artificial Sequence
  Description of Artificial Sequence: Synthetic oligonucleotide
ctgtccgtgtgggccaggcagtg

SEQ ID NO: 138387 - DNA, 25 bp, Artificial Sequence
  Description of Artificial Sequence: Synthetic oligonucleotide
tgtccgtgtgggccaggcagtggat

SEQ ID NO: 138388 - DNA, 24 bp, Artificial Sequence
  Description of Artificial Sequence: Synthetic oligonucleotide
gtccgtgtgggccaggcagtggat

SEQ ID NO: 138389 - DNA, 25 bp, Artificial Sequence
  Description of Artificial Sequence: Synthetic oligonucleotide
tccgtgtgggccaggcagtggatgt

SEQ ID NO: 138390 - DNA, 24 bp, Artificial Sequence
  Description of Artificial Sequence: Synthetic oligonucleotide
ccgtgtgggccaggcagtggatgt

SEQ ID NO: 138391 - DNA, 24 bp, Artificial Sequence
  Description of Artificial Sequence: Synthetic oligonucleotide
cgtgtgggccaggcagtggatgtg

SEQ ID NO: 138392 - DNA, 25 bp, Artificial Sequence
  Description of Artificial Sequence: Synthetic oligonucleotide
gtgtgggccaggcagtggatgtggt

SEQ ID NO: 138393 - DNA, 25 bp, Artificial Sequence
  Description of Artificial Sequence: Synthetic oligonucleotide
tgtgggccaggcagtggatgtggtg

SEQ ID NO: 138394 - DNA, 24 bp, Artificial Sequence
  Description of Artificial Sequence: Synthetic oligonucleotide
gtgggccaggcagtggatgtggtg

SEQ ID NO: 138395 - DNA, 24 bp, Artificial Sequence
  Description of Artificial Sequence: Synthetic oligonucleotide
tgggccaggcagtggatgtggtgg

SEQ ID NO: 138396 - DNA, 23 bp, Artificial Sequence
  Description of Artificial Sequence: Synthetic oligonucleotide
gggccaggcagtggatgtggtgg

SEQ ID NO: 138397 - DNA, 23 bp, Artificial Sequence
  Description of Artificial Sequence: Synthetic oligonucleotide
ggccaggcagtggatgtggtggg

SEQ ID NO: 138398 - DNA, 23 bp, Artificial Sequence
  Description of Artificial Sequence: Synthetic oligonucleotide
gccaggcagtggatgtggtgggc

SEQ ID NO: 138399 - DNA, 24 bp, Artificial Sequence
  Description of Artificial Sequence: Synthetic oligonucleotide
ccaggcagtggatgtggtgggcca

SEQ ID NO: 138400 - DNA, 24 bp, Artificial Sequence
  Description of Artificial Sequence: Synthetic oligonucleotide
caggcagtggatgtggtgggccag

SEQ ID NO: 138401 - DNA, 24 bp, Artificial Sequence
  Description of Artificial Sequence: Synthetic oligonucleotide
aggcagtggatgtggtgggccagg

SEQ ID NO: 138402 - DNA, 23 bp, Artificial Sequence
  Description of Artificial Sequence: Synthetic oligonucleotide
ggcagtggatgtggtgggccagg

SEQ ID NO: 138403 - DNA, 24 bp, Artificial Sequence
  Description of Artificial Sequence: Synthetic oligonucleotide
gcagtggatgtggtgggccaggct

SEQ ID NO: 138404 - DNA, 24 bp, Artificial Sequence
  Description of Artificial Sequence: Synthetic oligonucleotide
cagtggatgtggtgggccaggctg

SEQ ID NO: 138405 - DNA, 24 bp, Artificial Sequence
  Description of Artificial Sequence: Synthetic oligonucleotide
agtggatgtggtgggccaggctgg

SEQ ID NO: 138406 - DNA, 23 bp, Artificial Sequence
  Description of Artificial Sequence: Synthetic oligonucleotide
gtggatgtggtgggccaggctgg

SEQ ID NO: 138407 - DNA, 25 bp, Artificial Sequence
  Description of Artificial Sequence: Synthetic oligonucleotide
tggatgtggtgggccaggctggcaa

SEQ ID NO: 138408 - DNA, 24 bp, Artificial Sequence
  Description of Artificial Sequence: Synthetic oligonucleotide
ggatgtggtgggccaggctggcaa

SEQ ID NO: 138409 - DNA, 24 bp, Artificial Sequence
  Description of Artificial Sequence: Synthetic oligonucleotide
gatgtggtgggccaggctggcaag

SEQ ID NO: 138410 - DNA, 24 bp, Artificial Sequence
  Description of Artificial Sequence: Synthetic oligonucleotide
atgtggtgggccaggctggcaagc

SEQ ID NO: 138411 - DNA, 23 bp, Artificial Sequence
  Description of Artificial Sequence: Synthetic oligonucleotide
tgtggtgggccaggctggcaagc

SEQ ID NO: 138412 - DNA, 22 bp, Artificial Sequence
  Description of Artificial Sequence: Synthetic oligonucleotide
gtggtgggccaggctggcaagc

SEQ ID NO: 138413 - DNA, 22 bp, Artificial Sequence
  Description of Artificial Sequence: Synthetic oligonucleotide
tggtgggccaggctggcaagcc

SEQ ID NO: 138414 - DNA, 21 bp, Artificial Sequence
  Description of Artificial Sequence: Synthetic oligonucleotide
ggtgggccaggctggcaagcc

SEQ ID NO: 138415 - DNA, 23 bp, Artificial Sequence
  Description of Artificial Sequence: Synthetic oligonucleotide
gtgggccaggctggcaagccgaa

SEQ ID NO: 138416 - DNA, 24 bp, Artificial Sequence
  Description of Artificial Sequence: Synthetic oligonucleotide
tgggccaggctggcaagccgaaga

SEQ ID NO: 138417 - DNA, 23 bp, Artificial Sequence
  Description of Artificial Sequence: Synthetic oligonucleotide
gggccaggctggcaagccgaaga

SEQ ID NO: 138418 - DNA, 26 bp, Artificial Sequence
  Description of Artificial Sequence: Synthetic oligonucleotide
ggccaggctggcaagccgaagactat

SEQ ID NO: 138419 - DNA, 27 bp, Artificial Sequence
  Description of Artificial Sequence: Synthetic oligonucleotide
gccaggctggcaagccgaagactatca

SEQ ID NO: 138420 - DNA, 27 bp, Artificial Sequence
  Description of Artificial Sequence: Synthetic oligonucleotide
ccaggctggcaagccgaagactatcac

SEQ ID NO: 138421 - DNA, 28 bp, Artificial Sequence
  Description of Artificial Sequence: Synthetic oligonucleotide
caggctggcaagccgaagactatcacag

SEQ ID NO: 138422 - DNA, 28 bp, Artificial Sequence
  Description of Artificial Sequence: Synthetic oligonucleotide
aggctggcaagccgaagactatcacagg

SEQ ID NO: 138423 - DNA, 27 bp, Artificial Sequence
  Description of Artificial Sequence: Synthetic oligonucleotide
ggctggcaagccgaagactatcacagg

SEQ ID NO: 138424 - DNA, 27 bp, Artificial Sequence
  Description of Artificial Sequence: Synthetic oligonucleotide
gctggcaagccgaagactatcacaggg

SEQ ID NO: 138425 - DNA, 29 bp, Artificial Sequence
  Description of Artificial Sequence: Synthetic oligonucleotide
ctggcaagccgaagactatcacagggttc

SEQ ID NO: 138426 - DNA, 29 bp, Artificial Sequence
  Description of Artificial Sequence: Synthetic oligonucleotide
tggcaagccgaagactatcacagggttcc

SEQ ID NO: 138427 - DNA, 28 bp, Artificial Sequence
  Description of Artificial Sequence: Synthetic oligonucleotide
ggcaagccgaagactatcacagggttcc

SEQ ID NO: 138428 - DNA, 29 bp, Artificial Sequence
  Description of Artificial Sequence: Synthetic oligonucleotide
gcaagccgaagactatcacagggttccag

SEQ ID NO: 138429 - DNA, 30 bp, Artificial Sequence
  Description of Artificial Sequence: Synthetic oligonucleotide
caagccgaagactatcacagggttccagac

SEQ ID NO: 138430 - DNA, 30 bp, Artificial Sequence
  Description of Artificial Sequence: Synthetic oligonucleotide
aagccgaagactatcacagggttccagacg

SEQ ID NO: 138431 - DNA, 29 bp, Artificial Sequence
  Description of Artificial Sequence: Synthetic oligonucleotide
agccgaagactatcacagggttccagacg

SEQ ID NO: 138432 - DNA, 28 bp, Artificial Sequence
  Description of Artificial Sequence: Synthetic oligonucleotide
gccgaagactatcacagggttccagacg

SEQ ID NO: 138433 - DNA, 28 bp, Artificial Sequence
  Description of Artificial Sequence: Synthetic oligonucleotide
ccgaagactatcacagggttccagacgc

SEQ ID NO: 138434 - DNA, 31 bp, Artificial Sequence
  Description of Artificial Sequence: Synthetic oligonucleotide
cgaagactatcacagggttccagacgcatac

SEQ ID NO: 138435 - DNA, 33 bp, Artificial Sequence
  Description of Artificial Sequence: Synthetic oligonucleotide
gaagactatcacagggttccagacgcatacaac

SEQ ID NO: 138436 - DNA, 33 bp, Artificial Sequence
  Description of Artificial Sequence: Synthetic oligonucleotide
aagactatcacagggttccagacgcatacaacc

SEQ ID NO: 138437 - DNA, 32 bp, Artificial Sequence
  Description of Artificial Sequence: Synthetic oligonucleotide
agactatcacagggttccagacgcatacaacc

SEQ ID NO: 138438 - DNA, 31 bp, Artificial Sequence
  Description of Artificial Sequence: Synthetic oligonucleotide
gactatcacagggttccagacgcatacaacc

SEQ ID NO: 138439 - DNA, 31 bp, Artificial Sequence
  Description of Artificial Sequence: Synthetic oligonucleotide
actatcacagggttccagacgcatacaaccc

SEQ ID NO: 138440 - DNA, 30 bp, Artificial Sequence
  Description of Artificial Sequence: Synthetic oligonucleotide
ctatcacagggttccagacgcatacaaccc

SEQ ID NO: 138441 - DNA, 30 bp, Artificial Sequence
  Description of Artificial Sequence: Synthetic oligonucleotide
tatcacagggttccagacgcatacaacccc

SEQ ID NO: 138442 - DNA, 29 bp, Artificial Sequence
  Description of Artificial Sequence: Synthetic oligonucleotide
atcacagggttccagacgcatacaacccc

SEQ ID NO: 138443 - DNA, 28 bp, Artificial Sequence
  Description of Artificial Sequence: Synthetic oligonucleotide
tcacagggttccagacgcatacaacccc

SEQ ID NO: 138444 - DNA, 27 bp, Artificial Sequence
  Description of Artificial Sequence: Synthetic oligonucleotide
cacagggttccagacgcatacaacccc

SEQ ID NO: 138445 - DNA, 28 bp, Artificial Sequence
  Description of Artificial Sequence: Synthetic oligonucleotide
acagggttccagacgcatacaaccccag

SEQ ID NO: 138446 - DNA, 27 bp, Artificial Sequence
  Description of Artificial Sequence: Synthetic oligonucleotide
cagggttccagacgcatacaaccccag

SEQ ID NO: 138447 - DNA, 28 bp, Artificial Sequence
  Description of Artificial Sequence: Synthetic oligonucleotide
agggttccagacgcatacaaccccagtg

SEQ ID NO: 138448 - DNA, 27 bp, Artificial Sequence
  Description of Artificial Sequence: Synthetic oligonucleotide
gggttccagacgcatacaaccccagtg

SEQ ID NO: 138449 - DNA, 29 bp, Artificial Sequence
  Description of Artificial Sequence: Synthetic oligonucleotide
ggttccagacgcatacaaccccagtgttg

SEQ ID NO: 138450 - DNA, 31 bp, Artificial Sequence
  Description of Artificial Sequence: Synthetic oligonucleotide
gttccagacgcatacaaccccagtgttgttg

SEQ ID NO: 138451 - DNA, 31 bp, Artificial Sequence
  Description of Artificial Sequence: Synthetic oligonucleotide
ttccagacgcatacaaccccagtgttgttgg

SEQ ID NO: 138452 - DNA, 30 bp, Artificial Sequence
  Description of Artificial Sequence: Synthetic oligonucleotide
tccagacgcatacaaccccagtgttgttgg

SEQ ID NO: 138453 - DNA, 29 bp, Artificial Sequence
  Description of Artificial Sequence: Synthetic oligonucleotide
ccagacgcatacaaccccagtgttgttgg

SEQ ID NO: 138454 - DNA, 29 bp, Artificial Sequence
  Description of Artificial Sequence: Synthetic oligonucleotide
cagacgcatacaaccccagtgttgttggc

SEQ ID NO: 138455 - DNA, 29 bp, Artificial Sequence
  Description of Artificial Sequence: Synthetic oligonucleotide
agacgcatacaaccccagtgttgttggcc

SEQ ID NO: 138456 - DNA, 28 bp, Artificial Sequence
  Description of Artificial Sequence: Synthetic oligonucleotide
gacgcatacaaccccagtgttgttggcc

SEQ ID NO: 138457 - DNA, 28 bp, Artificial Sequence
  Description of Artificial Sequence: Synthetic oligonucleotide
acgcatacaaccccagtgttgttggccc

SEQ ID NO: 138458 - DNA, 27 bp, Artificial Sequence
  Description of Artificial Sequence: Synthetic oligonucleotide
cgcatacaaccccagtgttgttggccc

SEQ ID NO: 138459 - DNA, 28 bp, Artificial Sequence
  Description of Artificial Sequence: Synthetic oligonucleotide
gcatacaaccccagtgttgttggcccac

SEQ ID NO: 138460 - DNA, 28 bp, Artificial Sequence
  Description of Artificial Sequence: Synthetic oligonucleotide
catacaaccccagtgttgttggcccacg

SEQ ID NO: 138461 - DNA, 28 bp, Artificial Sequence
  Description of Artificial Sequence: Synthetic oligonucleotide
atacaaccccagtgttgttggcccacgg

SEQ ID NO: 138462 - DNA, 27 bp, Artificial Sequence
  Description of Artificial Sequence: Synthetic oligonucleotide
tacaaccccagtgttgttggcccacgg

SEQ ID NO: 138463 - DNA, 26 bp, Artificial Sequence
  Description of Artificial Sequence: Synthetic oligonucleotide
acaaccccagtgttgttggcccacgg

SEQ ID NO: 138464 - DNA, 25 bp, Artificial Sequence
  Description of Artificial Sequence: Synthetic oligonucleotide
caaccccagtgttgttggcccacgg

SEQ ID NO: 138465 - DNA, 25 bp, Artificial Sequence
  Description of Artificial Sequence: Synthetic oligonucleotide
aaccccagtgttgttggcccacggg

SEQ ID NO: 138466 - DNA, 24 bp, Artificial Sequence
  Description of Artificial Sequence: Synthetic oligonucleotide
accccagtgttgttggcccacggg

SEQ ID NO: 138467 - DNA, 23 bp, Artificial Sequence
  Description of Artificial Sequence: Synthetic oligonucleotide
ccccagtgttgttggcccacggg

SEQ ID NO: 138468 - DNA, 25 bp, Artificial Sequence
  Description of Artificial Sequence: Synthetic oligonucleotide
cccagtgttgttggcccacggggaa

SEQ ID NO: 138469 - DNA, 25 bp, Artificial Sequence
  Description of Artificial Sequence: Synthetic oligonucleotide
ccagtgttgttggcccacggggaac

SEQ ID NO: 138470 - DNA, 25 bp, Artificial Sequence
  Description of Artificial Sequence: Synthetic oligonucleotide
cagtgttgttggcccacggggaacg

SEQ ID NO: 138471 - DNA, 25 bp, Artificial Sequence
  Description of Artificial Sequence: Synthetic oligonucleotide
agtgttgttggcccacggggaacgg

SEQ ID NO: 138472 - DNA, 24 bp, Artificial Sequence
  Description of Artificial Sequence: Synthetic oligonucleotide
gtgttgttggcccacggggaacgg

SEQ ID NO: 138473 - DNA, 24 bp, Artificial Sequence
  Description of Artificial Sequence: Synthetic oligonucleotide
tgttgttggcccacggggaacggg

SEQ ID NO: 138474 - DNA, 23 bp, Artificial Sequence
  Description of Artificial Sequence: Synthetic oligonucleotide
gttgttggcccacggggaacggg

SEQ ID NO: 138475 - DNA, 24 bp, Artificial Sequence
  Description of Artificial Sequence: Synthetic oligonucleotide
ttgttggcccacggggaacgggca

SEQ ID NO: 138476 - DNA, 23 bp, Artificial Sequence
  Description of Artificial Sequence: Synthetic oligonucleotide
tgttggcccacggggaacgggca

SEQ ID NO: 138477 - DNA, 22 bp, Artificial Sequence
  Description of Artificial Sequence: Synthetic oligonucleotide
gttggcccacggggaacgggca

SEQ ID NO: 138478 - DNA, 26 bp, Artificial Sequence
  Description of Artificial Sequence: Synthetic oligonucleotide
ttggcccacggggaacgggcagaatt

SEQ ID NO: 138479 - DNA, 25 bp, Artificial Sequence
  Description of Artificial Sequence: Synthetic oligonucleotide
tggcccacggggaacgggcagaatt

SEQ ID NO: 138480 - DNA, 24 bp, Artificial Sequence
  Description of Artificial Sequence: Synthetic oligonucleotide
ggcccacggggaacgggcagaatt

SEQ ID NO: 138481 - DNA, 24 bp, Artificial Sequence
  Description of Artificial Sequence: Synthetic oligonucleotide
gcccacggggaacgggcagaattg

SEQ ID NO: 138482 - DNA, 24 bp, Artificial Sequence
  Description of Artificial Sequence: Synthetic oligonucleotide
cccacggggaacgggcagaattgg

SEQ ID NO: 138483 - DNA, 24 bp, Artificial Sequence
  Description of Artificial Sequence: Synthetic oligonucleotide
ccacggggaacgggcagaattggc

SEQ ID NO: 138484 - DNA, 25 bp, Artificial Sequence
  Description of Artificial Sequence: Synthetic oligonucleotide
cacggggaacgggcagaattggcca

SEQ ID NO: 138485 - DNA, 26 bp, Artificial Sequence
  Description of Artificial Sequence: Synthetic oligonucleotide
acggggaacgggcagaattggccact

SEQ ID NO: 138486 - DNA, 25 bp, Artificial Sequence
  Description of Artificial Sequence: Synthetic oligonucleotide
cggggaacgggcagaattggccact

SEQ ID NO: 138487 - DNA, 26 bp, Artificial Sequence
  Description of Artificial Sequence: Synthetic oligonucleotide
ggggaacgggcagaattggccactga

SEQ ID NO: 138488 - DNA, 26 bp, Artificial Sequence
  Description of Artificial Sequence: Synthetic oligonucleotide
gggaacgggcagaattggccactgag

SEQ ID NO: 138489 - DNA, 27 bp, Artificial Sequence
  Description of Artificial Sequence: Synthetic oligonucleotide
ggaacgggcagaattggccactgagga

SEQ ID NO: 138490 - DNA, 27 bp, Artificial Sequence
  Description of Artificial Sequence: Synthetic oligonucleotide
gaacgggcagaattggccactgaggag

SEQ ID NO: 138491 - DNA, 30 bp, Artificial Sequence
  Description of Artificial Sequence: Synthetic oligonucleotide
aacgggcagaattggccactgaggagtttc

SEQ ID NO: 138492 - DNA, 29 bp, Artificial Sequence
  Description of Artificial Sequence: Synthetic oligonucleotide
acgggcagaattggccactgaggagtttc

SEQ ID NO: 138493 - DNA, 28 bp, Artificial Sequence
  Description of Artificial Sequence: Synthetic oligonucleotide
cgggcagaattggccactgaggagtttc

SEQ ID NO: 138494 - DNA, 30 bp, Artificial Sequence
  Description of Artificial Sequence: Synthetic oligonucleotide
gggcagaattggccactgaggagtttcttc

SEQ ID NO: 138495 - DNA, 30 bp, Artificial Sequence
  Description of Artificial Sequence: Synthetic oligonucleotide
ggcagaattggccactgaggagtttcttcc

SEQ ID NO: 138496 - DNA, 31 bp, Artificial Sequence
  Description of Artificial Sequence: Synthetic oligonucleotide
gcagaattggccactgaggagtttcttcctg

SEQ ID NO: 138497 - DNA, 34 bp, Artificial Sequence
  Description of Artificial Sequence: Synthetic oligonucleotide
cagaattggccactgaggagtttcttcctgttac

SEQ ID NO: 138498 - DNA, 34 bp, Artificial Sequence
  Description of Artificial Sequence: Synthetic oligonucleotide
agaattggccactgaggagtttcttcctgttacc

SEQ ID NO: 138499 - DNA, 33 bp, Artificial Sequence
  Description of Artificial Sequence: Synthetic oligonucleotide
gaattggccactgaggagtttcttcctgttacc

SEQ ID NO: 138500 - DNA, 33 bp, Artificial Sequence
  Description of Artificial Sequence: Synthetic oligonucleotide
aattggccactgaggagtttcttcctgttaccc

SEQ ID NO: 138501 - DNA, 32 bp, Artificial Sequence
  Description of Artificial Sequence: Synthetic oligonucleotide
attggccactgaggagtttcttcctgttaccc

SEQ ID NO: 138502 - DNA, 31 bp, Artificial Sequence
  Description of Artificial Sequence: Synthetic oligonucleotide
ttggccactgaggagtttcttcctgttaccc

SEQ ID NO: 138503 - DNA, 30 bp, Artificial Sequence
  Description of Artificial Sequence: Synthetic oligonucleotide
tggccactgaggagtttcttcctgttaccc

SEQ ID NO: 138504 - DNA, 29 bp, Artificial Sequence
  Description of Artificial Sequence: Synthetic oligonucleotide
ggccactgaggagtttcttcctgttaccc

SEQ ID NO: 138505 - DNA, 29 bp, Artificial Sequence
  Description of Artificial Sequence: Synthetic oligonucleotide
gccactgaggagtttcttcctgttacccc

SEQ ID NO: 138506 - DNA, 29 bp, Artificial Sequence
  Description of Artificial Sequence: Synthetic oligonucleotide
ccactgaggagtttcttcctgttaccccc

SEQ ID NO: 138507 - DNA, 32 bp, Artificial Sequence
  Description of Artificial Sequence: Synthetic oligonucleotide
cactgaggagtttcttcctgttacccccattc

SEQ ID NO: 138508 - DNA, 33 bp, Artificial Sequence
  Description of Artificial Sequence: Synthetic oligonucleotide
actgaggagtttcttcctgttacccccattctg

SEQ ID NO: 138509 - DNA, 32 bp, Artificial Sequence
  Description of Artificial Sequence: Synthetic oligonucleotide
ctgaggagtttcttcctgttacccccattctg

SEQ ID NO: 138510 - DNA, 32 bp, Artificial Sequence
  Description of Artificial Sequence: Synthetic oligonucleotide
tgaggagtttcttcctgttacccccattctgg

SEQ ID NO: 138511 - DNA, 31 bp, Artificial Sequence
  Description of Artificial Sequence: Synthetic oligonucleotide
gaggagtttcttcctgttacccccattctgg

SEQ ID NO: 138512 - DNA, 33 bp, Artificial Sequence
  Description of Artificial Sequence: Synthetic oligonucleotide
aggagtttcttcctgttacccccattctggaag

SEQ ID NO: 138513 - DNA, 32 bp, Artificial Sequence
  Description of Artificial Sequence: Synthetic oligonucleotide
ggagtttcttcctgttacccccattctggaag

SEQ ID NO: 138514 - DNA, 32 bp, Artificial Sequence
  Description of Artificial Sequence: Synthetic oligonucleotide
gagtttcttcctgttacccccattctggaagg

SEQ ID NO: 138515 - DNA, 36 bp, Artificial Sequence
  Description of Artificial Sequence: Synthetic oligonucleotide
agtttcttcctgttacccccattctggaaggttttg

SEQ ID NO: 138516 - DNA, 35 bp, Artificial Sequence
  Description of Artificial Sequence: Synthetic oligonucleotide
gtttcttcctgttacccccattctggaaggttttg

SEQ ID NO: 138517 - DNA, 39 bp, Artificial Sequence
  Description of Artificial Sequence: Synthetic oligonucleotide
tttcttcctgttacccccattctggaaggttttgttatc

SEQ ID NO: 138518 - DNA, 38 bp, Artificial Sequence
  Description of Artificial Sequence: Synthetic oligonucleotide
ttcttcctgttacccccattctggaaggttttgttatc

SEQ ID NO: 138519 - DNA, 37 bp, Artificial Sequence
  Description of Artificial Sequence: Synthetic oligonucleotide
tcttcctgttacccccattctggaaggttttgttatc

SEQ ID NO: 138520 - DNA, 36 bp, Artificial Sequence
  Description of Artificial Sequence: Synthetic oligonucleotide
cttcctgttacccccattctggaaggttttgttatc

SEQ ID NO: 138521 - DNA, 36 bp, Artificial Sequence
  Description of Artificial Sequence: Synthetic oligonucleotide
ttcctgttacccccattctggaaggttttgttatcc

SEQ ID NO: 138522 - DNA, 35 bp, Artificial Sequence
  Description of Artificial Sequence: Synthetic oligonucleotide
tcctgttacccccattctggaaggttttgttatcc

SEQ ID NO: 138523 - DNA, 34 bp, Artificial Sequence
  Description of Artificial Sequence: Synthetic oligonucleotide
cctgttacccccattctggaaggttttgttatcc

SEQ ID NO: 138524 - DNA, 36 bp, Artificial Sequence
  Description of Artificial Sequence: Synthetic oligonucleotide
ctgttacccccattctggaaggttttgttatccttc

SEQ ID NO: 138525 - DNA, 36 bp, Artificial Sequence
  Description of Artificial Sequence: Synthetic oligonucleotide
tgttacccccattctggaaggttttgttatccttcg

SEQ ID NO: 138526 - DNA, 35 bp, Artificial Sequence
  Description of Artificial Sequence: Synthetic oligonucleotide
gttacccccattctggaaggttttgttatccttcg

SEQ ID NO: 138527 - DNA, 35 bp, Artificial Sequence
  Description of Artificial Sequence: Synthetic oligonucleotide
ttacccccattctggaaggttttgttatccttcgg

SEQ ID NO: 138528 - DNA, 34 bp, Artificial Sequence
  Description of Artificial Sequence: Synthetic oligonucleotide
tacccccattctggaaggttttgttatccttcgg

SEQ ID NO: 138529 - DNA, 33 bp, Artificial Sequence
  Description of Artificial Sequence: Synthetic oligonucleotide
acccccattctggaaggttttgttatccttcgg

SEQ ID NO: 138530 - DNA, 32 bp, Artificial Sequence
  Description of Artificial Sequence: Synthetic oligonucleotide
cccccattctggaaggttttgttatccttcgg

SEQ ID NO: 138531 - DNA, 34 bp, Artificial Sequence
  Description of Artificial Sequence: Synthetic oligonucleotide
ccccattctggaaggttttgttatccttcggaag

SEQ ID NO: 138532 - DNA, 36 bp, Artificial Sequence
  Description of Artificial Sequence: Synthetic oligonucleotide
cccattctggaaggttttgttatccttcggaagaac

SEQ ID NO: 138533 - DNA, 36 bp, Artificial Sequence
  Description of Artificial Sequence: Synthetic oligonucleotide
ccattctggaaggttttgttatccttcggaagaacc

SEQ ID NO: 138534 - DNA, 36 bp, Artificial Sequence
  Description of Artificial Sequence: Synthetic oligonucleotide
cattctggaaggttttgttatccttcggaagaaccc

SEQ ID NO: 138535 - DNA, 36 bp, Artificial Sequence
  Description of Artificial Sequence: Synthetic oligonucleotide
attctggaaggttttgttatccttcggaagaacccc

SEQ ID NO: 138536 - DNA, 35 bp, Artificial Sequence
  Description of Artificial Sequence: Synthetic oligonucleotide
ttctggaaggttttgttatccttcggaagaacccc

SEQ ID NO: 138537 - DNA, 34 bp, Artificial Sequence
  Description of Artificial Sequence: Synthetic oligonucleotide
tctggaaggttttgttatccttcggaagaacccc

SEQ ID NO: 138538 - DNA, 33 bp, Artificial Sequence
  Description of Artificial Sequence: Synthetic oligonucleotide
ctggaaggttttgttatccttcggaagaacccc

SEQ ID NO: 138539 - DNA, 39 bp, Artificial Sequence
  Description of Artificial Sequence: Synthetic oligonucleotide
tggaaggttttgttatccttcggaagaaccccaattatg

SEQ ID NO: 138540 - DNA, 38 bp, Artificial Sequence
  Description of Artificial Sequence: Synthetic oligonucleotide
ggaaggttttgttatccttcggaagaaccccaattatg

SEQ ID NO: 138541 - DNA, 40 bp, Artificial Sequence
  Description of Artificial Sequence: Synthetic oligonucleotide
gaaggttttgttatccttcggaagaaccccaattatgatc

SEQ ID NO: 138542 - DNA, 41 bp, Artificial Sequence
  Description of Artificial Sequence: Synthetic oligonucleotide
aaggttttgttatccttcggaagaaccccaattatgatctc

SEQ ID NO: 138543 - DNA, 40 bp, Artificial Sequence
  Description of Artificial Sequence: Synthetic oligonucleotide
aggttttgttatccttcggaagaaccccaattatgatctc

SEQ ID NO: 138544 - DNA, 39 bp, Artificial Sequence
  Description of Artificial Sequence: Synthetic oligonucleotide
ggttttgttatccttcggaagaaccccaattatgatctc

SEQ ID NO: 138545 - DNA, 23 bp, Artificial Sequence
  Description of Artificial Sequence: Synthetic oligonucleotide
atgaagcaggagggctcggcgcg

SEQ ID NO: 138546 - DNA, 22 bp, Artificial Sequence
  Description of Artificial Sequence: Synthetic oligonucleotide
tgaagcaggagggctcggcgcg

SEQ ID NO: 138547 - DNA, 21 bp, Artificial Sequence
  Description of Artificial Sequence: Synthetic oligonucleotide
gaagcaggagggctcggcgcg

SEQ ID NO: 138548 - DNA, 21 bp, Artificial Sequence
  Description of Artificial Sequence: Synthetic oligonucleotide
aagcaggagggctcggcgcgg

SEQ ID NO: 138549 - DNA, 20 bp, Artificial Sequence
  Description of Artificial Sequence: Synthetic oligonucleotide
agcaggagggctcggcgcgg

SEQ ID NO: 138550 - DNA, 20 bp, Artificial Sequence
  Description of Artificial Sequence: Synthetic oligonucleotide
gcaggagggctcggcgcggt

SEQ ID NO: 138551 - DNA, 20 bp, Artificial Sequence
  Description of Artificial Sequence: Synthetic oligonucleotide
caggagggctcggcgcggct

SEQ ID NO: 138552 - DNA, 20 bp, Artificial Sequence
  Description of Artificial Sequence: Synthetic oligonucleotide
aggagggctcggcgcggcgt

SEQ ID NO: 138553 - DNA, 20 bp, Artificial Sequence
  Description of Artificial Sequence: Synthetic oligonucleotide
ggagggctcggcgcggcgtt

SEQ ID NO: 138554 - DNA, 20 bp, Artificial Sequence
  Description of Artificial Sequence: Synthetic oligonucleotide
gagggctcggcgcggcgctt

SEQ ID NO: 138555 - DNA, 20 bp, Artificial Sequence
  Description of Artificial Sequence: Synthetic oligonucleotide
agggctcggcgcggcgcctt

SEQ ID NO: 138556 - DNA, 20 bp, Artificial Sequence
  Description of Artificial Sequence: Synthetic oligonucleotide
gggctcggcgcggcgccttt

SEQ ID NO: 138557 - DNA, 20 bp, Artificial Sequence
  Description of Artificial Sequence: Synthetic oligonucleotide
ggctcggcgcggcgccgttt

SEQ ID NO: 138558 - DNA, 20 bp, Artificial Sequence
  Description of Artificial Sequence: Synthetic oligonucleotide
gctcggcgcggcgccgcttt

SEQ ID NO: 138559 - DNA, 20 bp, Artificial Sequence
  Description of Artificial Sequence: Synthetic oligonucleotide
ctcggcgcggcgccgcgttt

SEQ ID NO: 138560 - DNA, 20 bp, Artificial Sequence
  Description of Artificial Sequence: Synthetic oligonucleotide
tcggcgcggcgccgcggttt

SEQ ID NO: 138561 - DNA, 20 bp, Artificial Sequence
  Description of Artificial Sequence: Synthetic oligonucleotide
cggcgcggcgccgcggtttt

SEQ ID NO: 138562 - DNA, 20 bp, Artificial Sequence
  Description of Artificial Sequence: Synthetic oligonucleotide
ggcgcggcgccgcggctttt

SEQ ID NO: 138563 - DNA, 20 bp, Artificial Sequence
  Description of Artificial Sequence: Synthetic oligonucleotide
gcgcggcgccgcggcgtttt

SEQ ID NO: 138564 - DNA, 20 bp, Artificial Sequence
  Description of Artificial Sequence: Synthetic oligonucleotide
cgcggcgccgcggcgctttt

SEQ ID NO: 138565 - DNA, 20 bp, Artificial Sequence
  Description of Artificial Sequence: Synthetic oligonucleotide
gcggcgccgcggcgcgtttt

SEQ ID NO: 138566 - DNA, 20 bp, Artificial Sequence
  Description of Artificial Sequence: Synthetic oligonucleotide
cggcgccgcggcgcggattt

SEQ ID NO: 138567 - DNA, 20 bp, Artificial Sequence
  Description of Artificial Sequence: Synthetic oligonucleotide
ggcgccgcggcgcggacaat

SEQ ID NO: 138568 - DNA, 20 bp, Artificial Sequence
  Description of Artificial Sequence: Synthetic oligonucleotide
gcgccgcggcgcggacaagt

SEQ ID NO: 138569 - DNA, 20 bp, Artificial Sequence
  Description of Artificial Sequence: Synthetic oligonucleotide
cgccgcggcgcggacaaggt

SEQ ID NO: 138570 - DNA, 20 bp, Artificial Sequence
  Description of Artificial Sequence: Synthetic oligonucleotide
gccgcggcgcggacaaggct

SEQ ID NO: 138571 - DNA, 22 bp, Artificial Sequence
  Description of Artificial Sequence: Synthetic oligonucleotide
ccgcggcgcggacaaggcgaaa

SEQ ID NO: 138572 - DNA, 22 bp, Artificial Sequence
  Description of Artificial Sequence: Synthetic oligonucleotide
cgcggcgcggacaaggcgaaac

SEQ ID NO: 138573 - DNA, 22 bp, Artificial Sequence
  Description of Artificial Sequence: Synthetic oligonucleotide
gcggcgcggacaaggcgaaacc

SEQ ID NO: 138574 - DNA, 22 bp, Artificial Sequence
  Description of Artificial Sequence: Synthetic oligonucleotide
cggcgcggacaaggcgaaaccg

SEQ ID NO: 138575 - DNA, 22 bp, Artificial Sequence
  Description of Artificial Sequence: Synthetic oligonucleotide
ggcgcggacaaggcgaaaccgc

SEQ ID NO: 138576 - DNA, 22 bp, Artificial Sequence
  Description of Artificial Sequence: Synthetic oligonucleotide
gcgcggacaaggcgaaaccgcc

SEQ ID NO: 138577 - DNA, 22 bp, Artificial Sequence
  Description of Artificial Sequence: Synthetic oligonucleotide
cgcggacaaggcgaaaccgccg

SEQ ID NO: 138578 - DNA, 22 bp, Artificial Sequence
  Description of Artificial Sequence: Synthetic oligonucleotide
gcggacaaggcgaaaccgccgc

SEQ ID NO: 138579 - DNA, 22 bp, Artificial Sequence
  Description of Artificial Sequence: Synthetic oligonucleotide
cggacaaggcgaaaccgccgcc

SEQ ID NO: 138580 - DNA, 22 bp, Artificial Sequence
  Description of Artificial Sequence: Synthetic oligonucleotide
ggacaaggcgaaaccgccgccc

SEQ ID NO: 138581 - DNA, 22 bp, Artificial Sequence
  Description of Artificial Sequence: Synthetic oligonucleotide
gacaaggcgaaaccgccgcccg

SEQ ID NO: 138582 - DNA, 22 bp, Artificial Sequence
  Description of Artificial Sequence: Synthetic oligonucleotide
acaaggcgaaaccgccgcccgg

SEQ ID NO: 138583 - DNA, 21 bp, Artificial Sequence
  Description of Artificial Sequence: Synthetic oligonucleotide
caaggcgaaaccgccgcccgg

SEQ ID NO: 138584 - DNA, 21 bp, Artificial Sequence
  Description of Artificial Sequence: Synthetic oligonucleotide
aaggcgaaaccgccgcccggc

SEQ ID NO: 138585 - DNA, 20 bp, Artificial Sequence
  Description of Artificial Sequence: Synthetic oligonucleotide
aggcgaaaccgccgcccggc

SEQ ID NO: 138586 - DNA, 20 bp, Artificial Sequence
  Description of Artificial Sequence: Synthetic oligonucleotide
ggcgaaaccgccgcccggct

SEQ ID NO: 138587 - DNA, 20 bp, Artificial Sequence
  Description of Artificial Sequence: Synthetic oligonucleotide
gcgaaaccgccgcccggcgt

SEQ ID NO: 138588 - DNA, 20 bp, Artificial Sequence
  Description of Artificial Sequence: Synthetic oligonucleotide
cgaaaccgccgcccggcgga

SEQ ID NO: 138589 - DNA, 20 bp, Artificial Sequence
  Description of Artificial Sequence: Synthetic oligonucleotide
gaaaccgccgcccggcggag

SEQ ID NO: 138590 - DNA, 21 bp, Artificial Sequence
  Description of Artificial Sequence: Synthetic oligonucleotide
aaaccgccgcccggcggagga

SEQ ID NO: 138591 - DNA, 20 bp, Artificial Sequence
  Description of Artificial Sequence: Synthetic oligonucleotide
aaccgccgcccggcggagga

SEQ ID NO: 138592 - DNA, 20 bp, Artificial Sequence
  Description of Artificial Sequence: Synthetic oligonucleotide
accgccgcccggcggaggat

SEQ ID NO: 138593 - DNA, 20 bp, Artificial Sequence
  Description of Artificial Sequence: Synthetic oligonucleotide
ccgccgcccggcggaggatt

SEQ ID NO: 138594 - DNA, 20 bp, Artificial Sequence
  Description of Artificial Sequence: Synthetic oligonucleotide
cgccgcccggcggaggagaa

SEQ ID NO: 138595 - DNA, 22 bp, Artificial Sequence
  Description of Artificial Sequence: Synthetic oligonucleotide
gccgcccggcggaggagaacaa

SEQ ID NO: 138596 - DNA, 24 bp, Artificial Sequence
  Description of Artificial Sequence: Synthetic oligonucleotide
ccgcccggcggaggagaacaagaa

SEQ ID NO: 138597 - DNA, 24 bp, Artificial Sequence
  Description of Artificial Sequence: Synthetic oligonucleotide
cgcccggcggaggagaacaagaac

SEQ ID NO: 138598 - DNA, 24 bp, Artificial Sequence
  Description of Artificial Sequence: Synthetic oligonucleotide
gcccggcggaggagaacaagaacc

SEQ ID NO: 138599 - DNA, 24 bp, Artificial Sequence
  Description of Artificial Sequence: Synthetic oligonucleotide
cccggcggaggagaacaagaaccc

SEQ ID NO: 138600 - DNA, 24 bp, Artificial Sequence
  Description of Artificial Sequence: Synthetic oligonucleotide
ccggcggaggagaacaagaacccc

SEQ ID NO: 138601 - DNA, 25 bp, Artificial Sequence
  Description of Artificial Sequence: Synthetic oligonucleotide
cggcggaggagaacaagaaccccca

SEQ ID NO: 138602 - DNA, 25 bp, Artificial Sequence
  Description of Artificial Sequence: Synthetic oligonucleotide
ggcggaggagaacaagaacccccac

SEQ ID NO: 138603 - DNA, 25 bp, Artificial Sequence
  Description of Artificial Sequence: Synthetic oligonucleotide
gcggaggagaacaagaacccccacc

SEQ ID NO: 138604 - DNA, 25 bp, Artificial Sequence
  Description of Artificial Sequence: Synthetic oligonucleotide
cggaggagaacaagaacccccaccg

SEQ ID NO: 138605 - DNA, 25 bp, Artificial Sequence
  Description of Artificial Sequence: Synthetic oligonucleotide
ggaggagaacaagaacccccaccgc

SEQ ID NO: 138606 - DNA, 25 bp, Artificial Sequence
  Description of Artificial Sequence: Synthetic oligonucleotide
gaggagaacaagaacccccaccgcc

SEQ ID NO: 138607 - DNA, 25 bp, Artificial Sequence
  Description of Artificial Sequence: Synthetic oligonucleotide
aggagaacaagaacccccaccgccg

SEQ ID NO: 138608 - DNA, 24 bp, Artificial Sequence
  Description of Artificial Sequence: Synthetic oligonucleotide
ggagaacaagaacccccaccgccg

SEQ ID NO: 138609 - DNA, 24 bp, Artificial Sequence
  Description of Artificial Sequence: Synthetic oligonucleotide
gagaacaagaacccccaccgccgc

SEQ ID NO: 138610 - DNA, 24 bp, Artificial Sequence
  Description of Artificial Sequence: Synthetic oligonucleotide
agaacaagaacccccaccgccgcc

SEQ ID NO: 138611 - DNA, 23 bp, Artificial Sequence
  Description of Artificial Sequence: Synthetic oligonucleotide
gaacaagaacccccaccgccgcc

SEQ ID NO: 138612 - DNA, 23 bp, Artificial Sequence
  Description of Artificial Sequence: Synthetic oligonucleotide
aacaagaacccccaccgccgccg

SEQ ID NO: 138613 - DNA, 22 bp, Artificial Sequence
  Description of Artificial Sequence: Synthetic oligonucleotide
acaagaacccccaccgccgccg

SEQ ID NO: 138614 - DNA, 21 bp, Artificial Sequence
  Description of Artificial Sequence: Synthetic oligonucleotide
caagaacccccaccgccgccg

SEQ ID NO: 138615 - DNA, 21 bp, Artificial Sequence
  Description of Artificial Sequence: Synthetic oligonucleotide
aagaacccccaccgccgccgg

SEQ ID NO: 138616 - DNA, 20 bp, Artificial Sequence
  Description of Artificial Sequence: Synthetic oligonucleotide
agaacccccaccgccgccgg

SEQ ID NO: 138617 - DNA, 20 bp, Artificial Sequence
  Description of Artificial Sequence: Synthetic oligonucleotide
gaacccccaccgccgccggt

SEQ ID NO: 138618 - DNA, 20 bp, Artificial Sequence
  Description of Artificial Sequence: Synthetic oligonucleotide
aacccccaccgccgccggct

SEQ ID NO: 138619 - DNA, 20 bp, Artificial Sequence
  Description of Artificial Sequence: Synthetic oligonucleotide
acccccaccgccgccggctt

SEQ ID NO: 138620 - DNA, 20 bp, Artificial Sequence
  Description of Artificial Sequence: Synthetic oligonucleotide
cccccaccgccgccggcttt

SEQ ID NO: 138621 - DNA, 20 bp, Artificial Sequence
  Description of Artificial Sequence: Synthetic oligonucleotide
ccccaccgccgccggccttt

SEQ ID NO: 138622 - DNA, 20 bp, Artificial Sequence
  Description of Artificial Sequence: Synthetic oligonucleotide
cccaccgccgccggcccttt

SEQ ID NO: 138623 - DNA, 20 bp, Artificial Sequence
  Description of Artificial Sequence: Synthetic oligonucleotide
ccaccgccgccggccccttt

SEQ ID NO: 138624 - DNA, 20 bp, Artificial Sequence
  Description of Artificial Sequence: Synthetic oligonucleotide
caccgccgccggcccccttt

SEQ ID NO: 138625 - DNA, 20 bp, Artificial Sequence
  Description of Artificial Sequence: Synthetic oligonucleotide
accgccgccggccccccatt

SEQ ID NO: 138626 - DNA, 20 bp, Artificial Sequence
  Description of Artificial Sequence: Synthetic oligonucleotide
ccgccgccggccccccattt

SEQ ID NO: 138627 - DNA, 20 bp, Artificial Sequence
  Description of Artificial Sequence: Synthetic oligonucleotide
cgccgccggccccccagttt

SEQ ID NO: 138628 - DNA, 20 bp, Artificial Sequence
  Description of Artificial Sequence: Synthetic oligonucleotide
gccgccggccccccaggatt

SEQ ID NO: 138629 - DNA, 20 bp, Artificial Sequence
  Description of Artificial Sequence: Synthetic oligonucleotide
ccgccggccccccaggatgt

SEQ ID NO: 138630 - DNA, 20 bp, Artificial Sequence
  Description of Artificial Sequence: Synthetic oligonucleotide
cgccggccccccaggatgtg

SEQ ID NO: 138631 - DNA, 21 bp, Artificial Sequence
  Description of Artificial Sequence: Synthetic oligonucleotide
gccggccccccaggatgtgga

SEQ ID NO: 138632 - DNA, 23 bp, Artificial Sequence
  Description of Artificial Sequence: Synthetic oligonucleotide
ccggccccccaggatgtggagat

SEQ ID NO: 138633 - DNA, 26 bp, Artificial Sequence
  Description of Artificial Sequence: Synthetic oligonucleotide
cggccccccaggatgtggagatgaaa

SEQ ID NO: 138634 - DNA, 27 bp, Artificial Sequence
  Description of Artificial Sequence: Synthetic oligonucleotide
ggccccccaggatgtggagatgaaaga

SEQ ID NO: 138635 - DNA, 27 bp, Artificial Sequence
  Description of Artificial Sequence: Synthetic oligonucleotide
gccccccaggatgtggagatgaaagag

SEQ ID NO: 138636 - DNA, 27 bp, Artificial Sequence
  Description of Artificial Sequence: Synthetic oligonucleotide
ccccccaggatgtggagatgaaagagg

SEQ ID NO: 138637 - DNA, 28 bp, Artificial Sequence
  Description of Artificial Sequence: Synthetic oligonucleotide
cccccaggatgtggagatgaaagaggag

SEQ ID NO: 138638 - DNA, 28 bp, Artificial Sequence
  Description of Artificial Sequence: Synthetic oligonucleotide
ccccaggatgtggagatgaaagaggagg

SEQ ID NO: 138639 - DNA, 28 bp, Artificial Sequence
  Description of Artificial Sequence: Synthetic oligonucleotide
cccaggatgtggagatgaaagaggaggc

SEQ ID NO: 138640 - DNA, 29 bp, Artificial Sequence
  Description of Artificial Sequence: Synthetic oligonucleotide
ccaggatgtggagatgaaagaggaggcag

SEQ ID NO: 138641 - DNA, 29 bp, Artificial Sequence
  Description of Artificial Sequence: Synthetic oligonucleotide
caggatgtggagatgaaagaggaggcagc

SEQ ID NO: 138642 - DNA, 29 bp, Artificial Sequence
  Description of Artificial Sequence: Synthetic oligonucleotide
aggatgtggagatgaaagaggaggcagcg

SEQ ID NO: 138643 - DNA, 28 bp, Artificial Sequence
  Description of Artificial Sequence: Synthetic oligonucleotide
ggatgtggagatgaaagaggaggcagcg

SEQ ID NO: 138644 - DNA, 29 bp, Artificial Sequence
  Description of Artificial Sequence: Synthetic oligonucleotide
gatgtggagatgaaagaggaggcagcgac

SEQ ID NO: 138645 - DNA, 29 bp, Artificial Sequence
  Description of Artificial Sequence: Synthetic oligonucleotide
atgtggagatgaaagaggaggcagcgacg

SEQ ID NO: 138646 - DNA, 28 bp, Artificial Sequence
  Description of Artificial Sequence: Synthetic oligonucleotide
tgtggagatgaaagaggaggcagcgacg

SEQ ID NO: 138647 - DNA, 27 bp, Artificial Sequence
  Description of Artificial Sequence: Synthetic oligonucleotide
gtggagatgaaagaggaggcagcgacg

SEQ ID NO: 138648 - DNA, 27 bp, Artificial Sequence
  Description of Artificial Sequence: Synthetic oligonucleotide
tggagatgaaagaggaggcagcgacgg

SEQ ID NO: 138649 - DNA, 26 bp, Artificial Sequence
  Description of Artificial Sequence: Synthetic oligonucleotide
ggagatgaaagaggaggcagcgacgg

SEQ ID NO: 138650 - DNA, 27 bp, Artificial Sequence
  Description of Artificial Sequence: Synthetic oligonucleotide
gagatgaaagaggaggcagcgacgggt

SEQ ID NO: 138651 - DNA, 27 bp, Artificial Sequence
  Description of Artificial Sequence: Synthetic oligonucleotide
agatgaaagaggaggcagcgacgggtg

SEQ ID NO: 138652 - DNA, 26 bp, Artificial Sequence
  Description of Artificial Sequence: Synthetic oligonucleotide
gatgaaagaggaggcagcgacgggtg

SEQ ID NO: 138653 - DNA, 26 bp, Artificial Sequence
  Description of Artificial Sequence: Synthetic oligonucleotide
atgaaagaggaggcagcgacgggtgg

SEQ ID NO: 138654 - DNA, 25 bp, Artificial Sequence
  Description of Artificial Sequence: Synthetic oligonucleotide
tgaaagaggaggcagcgacgggtgg

SEQ ID NO: 138655 - DNA, 24 bp, Artificial Sequence
  Description of Artificial Sequence: Synthetic oligonucleotide
gaaagaggaggcagcgacgggtgg

SEQ ID NO: 138656 - DNA, 24 bp, Artificial Sequence
  Description of Artificial Sequence: Synthetic oligonucleotide
aaagaggaggcagcgacgggtggc

SEQ ID NO: 138657 - DNA, 23 bp, Artificial Sequence
  Description of Artificial Sequence: Synthetic oligonucleotide
aagaggaggcagcgacgggtggc

SEQ ID NO: 138658 - DNA, 22 bp, Artificial Sequence
  Description of Artificial Sequence: Synthetic oligonucleotide
agaggaggcagcgacgggtggc

SEQ ID NO: 138659 - DNA, 21 bp, Artificial Sequence
  Description of Artificial Sequence: Synthetic oligonucleotide
gaggaggcagcgacgggtggc

SEQ ID NO: 138660 - DNA, 21 bp, Artificial Sequence
  Description of Artificial Sequence: Synthetic oligonucleotide
aggaggcagcgacgggtggcg

SEQ ID NO: 138661 - DNA, 20 bp, Artificial Sequence
  Description of Artificial Sequence: Synthetic oligonucleotide
ggaggcagcgacgggtggcg

SEQ ID NO: 138662 - DNA, 20 bp, Artificial Sequence
  Description of Artificial Sequence: Synthetic oligonucleotide
gaggcagcgacgggtggcgg

SEQ ID NO: 138663 - DNA, 21 bp, Artificial Sequence
  Description of Artificial Sequence: Synthetic oligonucleotide
aggcagcgacgggtggcgggt

SEQ ID NO: 138664 - DNA, 20 bp, Artificial Sequence
  Description of Artificial Sequence: Synthetic oligonucleotide
ggcagcgacgggtggcgggt

SEQ ID NO: 138665 - DNA, 20 bp, Artificial Sequence
  Description of Artificial Sequence: Synthetic oligonucleotide
gcagcgacgggtggcgggtc

SEQ ID NO: 138666 - DNA, 21 bp, Artificial Sequence
  Description of Artificial Sequence: Synthetic oligonucleotide
cagcgacgggtggcgggtcga

SEQ ID NO: 138667 - DNA, 21 bp, Artificial Sequence
  Description of Artificial Sequence: Synthetic oligonucleotide
agcgacgggtggcgggtcgac

SEQ ID NO: 138668 - DNA, 20 bp, Artificial Sequence
  Description of Artificial Sequence: Synthetic oligonucleotide
gcgacgggtggcgggtcgac

SEQ ID NO: 138669 - DNA, 20 bp, Artificial Sequence
  Description of Artificial Sequence: Synthetic oligonucleotide
cgacgggtggcgggtcgacg

SEQ ID NO: 138670 - DNA, 20 bp, Artificial Sequence
  Description of Artificial Sequence: Synthetic oligonucleotide
gacgggtggcgggtcgacgg

SEQ ID NO: 138671 - DNA, 20 bp, Artificial Sequence
  Description of Artificial Sequence: Synthetic oligonucleotide
acgggtggcgggtcgacggg

SEQ ID NO: 138672 - DNA, 20 bp, Artificial Sequence
  Description of Artificial Sequence: Synthetic oligonucleotide
cgggtggcgggtcgacgggt

SEQ ID NO: 138673 - DNA, 20 bp, Artificial Sequence
  Description of Artificial Sequence: Synthetic oligonucleotide
gggtggcgggtcgacggggt

SEQ ID NO: 138674 - DNA, 20 bp, Artificial Sequence
  Description of Artificial Sequence: Synthetic oligonucleotide
ggtggcgggtcgacggggga

SEQ ID NO: 138675 - DNA, 20 bp, Artificial Sequence
  Description of Artificial Sequence: Synthetic oligonucleotide
gtggcgggtcgacgggggag

SEQ ID NO: 138676 - DNA, 20 bp, Artificial Sequence
  Description of Artificial Sequence: Synthetic oligonucleotide
tggcgggtcgacgggggagg

SEQ ID NO: 138677 - DNA, 20 bp, Artificial Sequence
  Description of Artificial Sequence: Synthetic oligonucleotide
ggcgggtcgacgggggaggt

SEQ ID NO: 138678 - DNA, 20 bp, Artificial Sequence
  Description of Artificial Sequence: Synthetic oligonucleotide
gcgggtcgacgggggaggca

SEQ ID NO: 138679 - DNA, 21 bp, Artificial Sequence
  Description of Artificial Sequence: Synthetic oligonucleotide
cgggtcgacgggggaggcaga

SEQ ID NO: 138680 - DNA, 21 bp, Artificial Sequence
  Description of Artificial Sequence: Synthetic oligonucleotide
gggtcgacgggggaggcagac

SEQ ID NO: 138681 - DNA, 21 bp, Artificial Sequence
  Description of Artificial Sequence: Synthetic oligonucleotide
ggtcgacgggggaggcagacg

SEQ ID NO: 138682 - DNA, 21 bp, Artificial Sequence
  Description of Artificial Sequence: Synthetic oligonucleotide
gtcgacgggggaggcagacgg

SEQ ID NO: 138683 - DNA, 23 bp, Artificial Sequence
  Description of Artificial Sequence: Synthetic oligonucleotide
tcgacgggggaggcagacggcaa

SEQ ID NO: 138684 - DNA, 22 bp, Artificial Sequence
  Description of Artificial Sequence: Synthetic oligonucleotide
cgacgggggaggcagacggcaa

SEQ ID NO: 138685 - DNA, 23 bp, Artificial Sequence
  Description of Artificial Sequence: Synthetic oligonucleotide
gacgggggaggcagacggcaaga

SEQ ID NO: 138686 - DNA, 23 bp, Artificial Sequence
  Description of Artificial Sequence: Synthetic oligonucleotide
acgggggaggcagacggcaagac

SEQ ID NO: 138687 - DNA, 22 bp, Artificial Sequence
  Description of Artificial Sequence: Synthetic oligonucleotide
cgggggaggcagacggcaagac

SEQ ID NO: 138688 - DNA, 22 bp, Artificial Sequence
  Description of Artificial Sequence: Synthetic oligonucleotide
gggggaggcagacggcaagacg

SEQ ID NO: 138689 - DNA, 22 bp, Artificial Sequence
  Description of Artificial Sequence: Synthetic oligonucleotide
ggggaggcagacggcaagacgg

SEQ ID NO: 138690 - DNA, 22 bp, Artificial Sequence
  Description of Artificial Sequence: Synthetic oligonucleotide
gggaggcagacggcaagacggc

SEQ ID NO: 138691 - DNA, 22 bp, Artificial Sequence
  Description of Artificial Sequence: Synthetic oligonucleotide
ggaggcagacggcaagacggcg

SEQ ID NO: 138692 - DNA, 22 bp, Artificial Sequence
  Description of Artificial Sequence: Synthetic oligonucleotide
gaggcagacggcaagacggcgg

SEQ ID NO: 138693 - DNA, 22 bp, Artificial Sequence
  Description of Artificial Sequence: Synthetic oligonucleotide
aggcagacggcaagacggcggc

SEQ ID NO: 138694 - DNA, 21 bp, Artificial Sequence
  Description of Artificial Sequence: Synthetic oligonucleotide
ggcagacggcaagacggcggc

SEQ ID NO: 138695 - DNA, 21 bp, Artificial Sequence
  Description of Artificial Sequence: Synthetic oligonucleotide
gcagacggcaagacggcggcg

SEQ ID NO: 138696 - DNA, 21 bp, Artificial Sequence
  Description of Artificial Sequence: Synthetic oligonucleotide
cagacggcaagacggcggcgg

SEQ ID NO: 138697 - DNA, 22 bp, Artificial Sequence
  Description of Artificial Sequence: Synthetic oligonucleotide
agacggcaagacggcggcggca

SEQ ID NO: 138698 - DNA, 21 bp, Artificial Sequence
  Description of Artificial Sequence: Synthetic oligonucleotide
gacggcaagacggcggcggca

SEQ ID NO: 138699 - DNA, 21 bp, Artificial Sequence
  Description of Artificial Sequence: Synthetic oligonucleotide
acggcaagacggcggcggcag

SEQ ID NO: 138700 - DNA, 20 bp, Artificial Sequence
  Description of Artificial Sequence: Synthetic oligonucleotide
cggcaagacggcggcggcag

SEQ ID NO: 138701 - DNA, 20 bp, Artificial Sequence
  Description of Artificial Sequence: Synthetic oligonucleotide
ggcaagacggcggcggcagc

SEQ ID NO: 138702 - DNA, 20 bp, Artificial Sequence
  Description of Artificial Sequence: Synthetic oligonucleotide
gcaagacggcggcggcagcg

SEQ ID NO: 138703 - DNA, 20 bp, Artificial Sequence
  Description of Artificial Sequence: Synthetic oligonucleotide
caagacggcggcggcagcgg

SEQ ID NO: 138704 - DNA, 21 bp, Artificial Sequence
  Description of Artificial Sequence: Synthetic oligonucleotide
aagacggcggcggcagcggct

SEQ ID NO: 138705 - DNA, 20 bp, Artificial Sequence
  Description of Artificial Sequence: Synthetic oligonucleotide
agacggcggcggcagcggct

SEQ ID NO: 138706 - DNA, 20 bp, Artificial Sequence
  Description of Artificial Sequence: Synthetic oligonucleotide
gacggcggcggcagcggctt

SEQ ID NO: 138707 - DNA, 20 bp, Artificial Sequence
  Description of Artificial Sequence: Synthetic oligonucleotide
acggcggcggcagcggctga

SEQ ID NO: 138708 - DNA, 20 bp, Artificial Sequence
  Description of Artificial Sequence: Synthetic oligonucleotide
cggcggcggcagcggctgat

SEQ ID NO: 138709 - DNA, 20 bp, Artificial Sequence
  Description of Artificial Sequence: Synthetic oligonucleotide
ggcggcggcagcggctgagt

SEQ ID NO: 138710 - DNA, 20 bp, Artificial Sequence
  Description of Artificial Sequence: Synthetic oligonucleotide
gcggcggcagcggctgagca

SEQ ID NO: 138711 - DNA, 21 bp, Artificial Sequence
  Description of Artificial Sequence: Synthetic oligonucleotide
cggcggcagcggctgagcact

SEQ ID NO: 138712 - DNA, 21 bp, Artificial Sequence
  Description of Artificial Sequence: Synthetic oligonucleotide
ggcggcagcggctgagcactc

SEQ ID NO: 138713 - DNA, 21 bp, Artificial Sequence
  Description of Artificial Sequence: Synthetic oligonucleotide
gcggcagcggctgagcactcc

SEQ ID NO: 138714 - DNA, 22 bp, Artificial Sequence
  Description of Artificial Sequence: Synthetic oligonucleotide
cggcagcggctgagcactccca

SEQ ID NO: 138715 - DNA, 22 bp, Artificial Sequence
  Description of Artificial Sequence: Synthetic oligonucleotide
ggcagcggctgagcactcccag

SEQ ID NO: 138716 - DNA, 22 bp, Artificial Sequence
  Description of Artificial Sequence: Synthetic oligonucleotide
gcagcggctgagcactcccagc

SEQ ID NO: 138717 - DNA, 23 bp, Artificial Sequence
  Description of Artificial Sequence: Synthetic oligonucleotide
cagcggctgagcactcccagcga

SEQ ID NO: 138718 - DNA, 24 bp, Artificial Sequence
  Description of Artificial Sequence: Synthetic oligonucleotide
agcggctgagcactcccagcgaga

SEQ ID NO: 138719 - DNA, 23 bp, Artificial Sequence
  Description of Artificial Sequence: Synthetic oligonucleotide
gcggctgagcactcccagcgaga

SEQ ID NO: 138720 - DNA, 23 bp, Artificial Sequence
  Description of Artificial Sequence: Synthetic oligonucleotide
cggctgagcactcccagcgagag

SEQ ID NO: 138721 - DNA, 24 bp, Artificial Sequence
  Description of Artificial Sequence: Synthetic oligonucleotide
ggctgagcactcccagcgagagct

SEQ ID NO: 138722 - DNA, 24 bp, Artificial Sequence
  Description of Artificial Sequence: Synthetic oligonucleotide
gctgagcactcccagcgagagctg

SEQ ID NO: 138723 - DNA, 25 bp, Artificial Sequence
  Description of Artificial Sequence: Synthetic oligonucleotide
ctgagcactcccagcgagagctgga

SEQ ID NO: 138724 - DNA, 26 bp, Artificial Sequence
  Description of Artificial Sequence: Synthetic oligonucleotide
tgagcactcccagcgagagctggaca

SEQ ID NO: 138725 - DNA, 25 bp, Artificial Sequence
  Description of Artificial Sequence: Synthetic oligonucleotide
gagcactcccagcgagagctggaca

SEQ ID NO: 138726 - DNA, 26 bp, Artificial Sequence
  Description of Artificial Sequence: Synthetic oligonucleotide
agcactcccagcgagagctggacaca

SEQ ID NO: 138727 - DNA, 25 bp, Artificial Sequence
  Description of Artificial Sequence: Synthetic oligonucleotide
gcactcccagcgagagctggacaca

SEQ ID NO: 138728 - DNA, 26 bp, Artificial Sequence
  Description of Artificial Sequence: Synthetic oligonucleotide
cactcccagcgagagctggacacagt

SEQ ID NO: 138729 - DNA, 27 bp, Artificial Sequence
  Description of Artificial Sequence: Synthetic oligonucleotide
actcccagcgagagctggacacagtca

SEQ ID NO: 138730 - DNA, 26 bp, Artificial Sequence
  Description of Artificial Sequence: Synthetic oligonucleotide
ctcccagcgagagctggacacagtca

SEQ ID NO: 138731 - DNA, 26 bp, Artificial Sequence
  Description of Artificial Sequence: Synthetic oligonucleotide
tcccagcgagagctggacacagtcac

SEQ ID NO: 138732 - DNA, 25 bp, Artificial Sequence
  Description of Artificial Sequence: Synthetic oligonucleotide
cccagcgagagctggacacagtcac

SEQ ID NO: 138733 - DNA, 27 bp, Artificial Sequence
  Description of Artificial Sequence: Synthetic oligonucleotide
ccagcgagagctggacacagtcacctt

SEQ ID NO: 138734 - DNA, 27 bp, Artificial Sequence
  Description of Artificial Sequence: Synthetic oligonucleotide
cagcgagagctggacacagtcaccttg

SEQ ID NO: 138735 - DNA, 27 bp, Artificial Sequence
  Description of Artificial Sequence: Synthetic oligonucleotide
agcgagagctggacacagtcaccttgg

SEQ ID NO: 138736 - DNA, 27 bp, Artificial Sequence
  Description of Artificial Sequence: Synthetic oligonucleotide
gcgagagctggacacagtcaccttgga

SEQ ID NO: 138737 - DNA, 27 bp, Artificial Sequence
  Description of Artificial Sequence: Synthetic oligonucleotide
cgagagctggacacagtcaccttggag

SEQ ID NO: 138738 - DNA, 27 bp, Artificial Sequence
  Description of Artificial Sequence: Synthetic oligonucleotide
gagagctggacacagtcaccttggagg

SEQ ID NO: 138739 - DNA, 28 bp, Artificial Sequence
  Description of Artificial Sequence: Synthetic oligonucleotide
agagctggacacagtcaccttggaggac

SEQ ID NO: 138740 - DNA, 27 bp, Artificial Sequence
  Description of Artificial Sequence: Synthetic oligonucleotide
gagctggacacagtcaccttggaggac

SEQ ID NO: 138741 - DNA, 29 bp, Artificial Sequence
  Description of Artificial Sequence: Synthetic oligonucleotide
agctggacacagtcaccttggaggacatc

SEQ ID NO: 138742 - DNA, 28 bp, Artificial Sequence
  Description of Artificial Sequence: Synthetic oligonucleotide
gctggacacagtcaccttggaggacatc

SEQ ID NO: 138743 - DNA, 30 bp, Artificial Sequence
  Description of Artificial Sequence: Synthetic oligonucleotide
ctggacacagtcaccttggaggacatcaag

SEQ ID NO: 138744 - DNA, 30 bp, Artificial Sequence
  Description of Artificial Sequence: Synthetic oligonucleotide
tggacacagtcaccttggaggacatcaagg

SEQ ID NO: 138745 - DNA, 29 bp, Artificial Sequence
  Description of Artificial Sequence: Synthetic oligonucleotide
ggacacagtcaccttggaggacatcaagg

SEQ ID NO: 138746 - DNA, 30 bp, Artificial Sequence
  Description of Artificial Sequence: Synthetic oligonucleotide
gacacagtcaccttggaggacatcaaggag

SEQ ID NO: 138747 - DNA, 30 bp, Artificial Sequence
  Description of Artificial Sequence: Synthetic oligonucleotide
acacagtcaccttggaggacatcaaggagc

SEQ ID NO: 138748 - DNA, 29 bp, Artificial Sequence
  Description of Artificial Sequence: Synthetic oligonucleotide
cacagtcaccttggaggacatcaaggagc

SEQ ID NO: 138749 - DNA, 30 bp, Artificial Sequence
  Description of Artificial Sequence: Synthetic oligonucleotide
acagtcaccttggaggacatcaaggagcac

SEQ ID NO: 138750 - DNA, 29 bp, Artificial Sequence
  Description of Artificial Sequence: Synthetic oligonucleotide
cagtcaccttggaggacatcaaggagcac

SEQ ID NO: 138751 - DNA, 29 bp, Artificial Sequence
  Description of Artificial Sequence: Synthetic oligonucleotide
agtcaccttggaggacatcaaggagcacg

SEQ ID NO: 138752 - DNA, 28 bp, Artificial Sequence
  Description of Artificial Sequence: Synthetic oligonucleotide
gtcaccttggaggacatcaaggagcacg

SEQ ID NO: 138753 - DNA, 29 bp, Artificial Sequence
  Description of Artificial Sequence: Synthetic oligonucleotide
tcaccttggaggacatcaaggagcacgtg

SEQ ID NO: 138754 - DNA, 28 bp, Artificial Sequence
  Description of Artificial Sequence: Synthetic oligonucleotide
caccttggaggacatcaaggagcacgtg

SEQ ID NO: 138755 - DNA, 31 bp, Artificial Sequence
  Description of Artificial Sequence: Synthetic oligonucleotide
accttggaggacatcaaggagcacgtgaaac

SEQ ID NO: 138756 - DNA, 30 bp, Artificial Sequence
  Description of Artificial Sequence: Synthetic oligonucleotide
ccttggaggacatcaaggagcacgtgaaac

SEQ ID NO: 138757 - DNA, 31 bp, Artificial Sequence
  Description of Artificial Sequence: Synthetic oligonucleotide
cttggaggacatcaaggagcacgtgaaacag

SEQ ID NO: 138758 - DNA, 31 bp, Artificial Sequence
  Description of Artificial Sequence: Synthetic oligonucleotide
ttggaggacatcaaggagcacgtgaaacagc

SEQ ID NO: 138759 - DNA, 30 bp, Artificial Sequence
  Description of Artificial Sequence: Synthetic oligonucleotide
tggaggacatcaaggagcacgtgaaacagc

SEQ ID NO: 138760 - DNA, 29 bp, Artificial Sequence
  Description of Artificial Sequence: Synthetic oligonucleotide
ggaggacatcaaggagcacgtgaaacagc

SEQ ID NO: 138761 - DNA, 31 bp, Artificial Sequence
  Description of Artificial Sequence: Synthetic oligonucleotide
gaggacatcaaggagcacgtgaaacagctag

SEQ ID NO: 138762 - DNA, 32 bp, Artificial Sequence
  Description of Artificial Sequence: Synthetic oligonucleotide
aggacatcaaggagcacgtgaaacagctagag

SEQ ID NO: 138763 - DNA, 31 bp, Artificial Sequence
  Description of Artificial Sequence: Synthetic oligonucleotide
ggacatcaaggagcacgtgaaacagctagag

SEQ ID NO: 138764 - DNA, 34 bp, Artificial Sequence
  Description of Artificial Sequence: Synthetic oligonucleotide
gacatcaaggagcacgtgaaacagctagagaaag

SEQ ID NO: 138765 - DNA, 34 bp, Artificial Sequence
  Description of Artificial Sequence: Synthetic oligonucleotide
acatcaaggagcacgtgaaacagctagagaaagc

SEQ ID NO: 138766 - DNA, 33 bp, Artificial Sequence
  Description of Artificial Sequence: Synthetic oligonucleotide
catcaaggagcacgtgaaacagctagagaaagc

SEQ ID NO: 138767 - DNA, 33 bp, Artificial Sequence
  Description of Artificial Sequence: Synthetic oligonucleotide
atcaaggagcacgtgaaacagctagagaaagcg

SEQ ID NO: 138768 - DNA, 32 bp, Artificial Sequence
  Description of Artificial Sequence: Synthetic oligonucleotide
tcaaggagcacgtgaaacagctagagaaagcg

SEQ ID NO: 138769 - DNA, 31 bp, Artificial Sequence
  Description of Artificial Sequence: Synthetic oligonucleotide
caaggagcacgtgaaacagctagagaaagcg

SEQ ID NO: 138770 - DNA, 31 bp, Artificial Sequence
  Description of Artificial Sequence: Synthetic oligonucleotide
aaggagcacgtgaaacagctagagaaagcgg

SEQ ID NO: 138771 - DNA, 30 bp, Artificial Sequence
  Description of Artificial Sequence: Synthetic oligonucleotide
aggagcacgtgaaacagctagagaaagcgg

SEQ ID NO: 138772 - DNA, 29 bp, Artificial Sequence
  Description of Artificial Sequence: Synthetic oligonucleotide
ggagcacgtgaaacagctagagaaagcgg

SEQ ID NO: 138773 - DNA, 32 bp, Artificial Sequence
  Description of Artificial Sequence: Synthetic oligonucleotide
gagcacgtgaaacagctagagaaagcggtttc

SEQ ID NO: 138774 - DNA, 33 bp, Artificial Sequence
  Description of Artificial Sequence: Synthetic oligonucleotide
agcacgtgaaacagctagagaaagcggtttcag

SEQ ID NO: 138775 - DNA, 32 bp, Artificial Sequence
  Description of Artificial Sequence: Synthetic oligonucleotide
gcacgtgaaacagctagagaaagcggtttcag

SEQ ID NO: 138776 - DNA, 32 bp, Artificial Sequence
  Description of Artificial Sequence: Synthetic oligonucleotide
cacgtgaaacagctagagaaagcggtttcagg

SEQ ID NO: 138777 - DNA, 32 bp, Artificial Sequence
  Description of Artificial Sequence: Synthetic oligonucleotide
acgtgaaacagctagagaaagcggtttcaggc

SEQ ID NO: 138778 - DNA, 31 bp, Artificial Sequence
  Description of Artificial Sequence: Synthetic oligonucleotide
cgtgaaacagctagagaaagcggtttcaggc

SEQ ID NO: 138779 - DNA, 33 bp, Artificial Sequence
  Description of Artificial Sequence: Synthetic oligonucleotide
gtgaaacagctagagaaagcggtttcaggcaag

SEQ ID NO: 138780 - DNA, 33 bp, Artificial Sequence
  Description of Artificial Sequence: Synthetic oligonucleotide
tgaaacagctagagaaagcggtttcaggcaagg

SEQ ID NO: 138781 - DNA, 32 bp, Artificial Sequence
  Description of Artificial Sequence: Synthetic oligonucleotide
gaaacagctagagaaagcggtttcaggcaagg

SEQ ID NO: 138782 - DNA, 33 bp, Artificial Sequence
  Description of Artificial Sequence: Synthetic oligonucleotide
aaacagctagagaaagcggtttcaggcaaggag

SEQ ID NO: 138783 - DNA, 32 bp, Artificial Sequence
  Description of Artificial Sequence: Synthetic oligonucleotide
aacagctagagaaagcggtttcaggcaaggag

SEQ ID NO: 138784 - DNA, 31 bp, Artificial Sequence
  Description of Artificial Sequence: Synthetic oligonucleotide
acagctagagaaagcggtttcaggcaaggag

SEQ ID NO: 138785 - DNA, 30 bp, Artificial Sequence
  Description of Artificial Sequence: Synthetic oligonucleotide
cagctagagaaagcggtttcaggcaaggag

SEQ ID NO: 138786 - DNA, 30 bp, Artificial Sequence
  Description of Artificial Sequence: Synthetic oligonucleotide
agctagagaaagcggtttcaggcaaggagc

SEQ ID NO: 138787 - DNA, 29 bp, Artificial Sequence
  Description of Artificial Sequence: Synthetic oligonucleotide
gctagagaaagcggtttcaggcaaggagc

SEQ ID NO: 138788 - DNA, 29 bp, Artificial Sequence
  Description of Artificial Sequence: Synthetic oligonucleotide
ctagagaaagcggtttcaggcaaggagcc

SEQ ID NO: 138789 - DNA, 29 bp, Artificial Sequence
  Description of Artificial Sequence: Synthetic oligonucleotide
tagagaaagcggtttcaggcaaggagccg

SEQ ID NO: 138790 - DNA, 28 bp, Artificial Sequence
  Description of Artificial Sequence: Synthetic oligonucleotide
agagaaagcggtttcaggcaaggagccg

SEQ ID NO: 138791 - DNA, 27 bp, Artificial Sequence
  Description of Artificial Sequence: Synthetic oligonucleotide
gagaaagcggtttcaggcaaggagccg

SEQ ID NO: 138792 - DNA, 28 bp, Artificial Sequence
  Description of Artificial Sequence: Synthetic oligonucleotide
agaaagcggtttcaggcaaggagccgag

SEQ ID NO: 138793 - DNA, 27 bp, Artificial Sequence
  Description of Artificial Sequence: Synthetic oligonucleotide
gaaagcggtttcaggcaaggagccgag

SEQ ID NO: 138794 - DNA, 30 bp, Artificial Sequence
  Description of Artificial Sequence: Synthetic oligonucleotide
aaagcggtttcaggcaaggagccgagattc

SEQ ID NO: 138795 - DNA, 29 bp, Artificial Sequence
  Description of Artificial Sequence: Synthetic oligonucleotide
aagcggtttcaggcaaggagccgagattc

SEQ ID NO: 138796 - DNA, 28 bp, Artificial Sequence
  Description of Artificial Sequence: Synthetic oligonucleotide
agcggtttcaggcaaggagccgagattc

SEQ ID NO: 138797 - DNA, 27 bp, Artificial Sequence
  Description of Artificial Sequence: Synthetic oligonucleotide
gcggtttcaggcaaggagccgagattc

SEQ ID NO: 138798 - DNA, 27 bp, Artificial Sequence
  Description of Artificial Sequence: Synthetic oligonucleotide
cggtttcaggcaaggagccgagattcg

SEQ ID NO: 138799 - DNA, 28 bp, Artificial Sequence
  Description of Artificial Sequence: Synthetic oligonucleotide
ggtttcaggcaaggagccgagattcgtg

SEQ ID NO: 138800 - DNA, 28 bp, Artificial Sequence
  Description of Artificial Sequence: Synthetic oligonucleotide
gtttcaggcaaggagccgagattcgtgc

SEQ ID NO: 138801 - DNA, 29 bp, Artificial Sequence
  Description of Artificial Sequence: Synthetic oligonucleotide
tttcaggcaaggagccgagattcgtgctg

SEQ ID NO: 138802 - DNA, 28 bp, Artificial Sequence
  Description of Artificial Sequence: Synthetic oligonucleotide
ttcaggcaaggagccgagattcgtgctg

SEQ ID NO: 138803 - DNA, 27 bp, Artificial Sequence
  Description of Artificial Sequence: Synthetic oligonucleotide
tcaggcaaggagccgagattcgtgctg

SEQ ID NO: 138804 - DNA, 26 bp, Artificial Sequence
  Description of Artificial Sequence: Synthetic oligonucleotide
caggcaaggagccgagattcgtgctg

SEQ ID NO: 138805 - DNA, 26 bp, Artificial Sequence
  Description of Artificial Sequence: Synthetic oligonucleotide
aggcaaggagccgagattcgtgctgc

SEQ ID NO: 138806 - DNA, 25 bp, Artificial Sequence
  Description of Artificial Sequence: Synthetic oligonucleotide
ggcaaggagccgagattcgtgctgc

SEQ ID NO: 138807 - DNA, 25 bp, Artificial Sequence
  Description of Artificial Sequence: Synthetic oligonucleotide
gcaaggagccgagattcgtgctgcg

SEQ ID NO: 138808 - DNA, 25 bp, Artificial Sequence
  Description of Artificial Sequence: Synthetic oligonucleotide
caaggagccgagattcgtgctgcgg

SEQ ID NO: 138809 - DNA, 25 bp, Artificial Sequence
  Description of Artificial Sequence: Synthetic oligonucleotide
aaggagccgagattcgtgctgcggg

SEQ ID NO: 138810 - DNA, 24 bp, Artificial Sequence
  Description of Artificial Sequence: Synthetic oligonucleotide
aggagccgagattcgtgctgcggg

SEQ ID NO: 138811 - DNA, 23 bp, Artificial Sequence
  Description of Artificial Sequence: Synthetic oligonucleotide
ggagccgagattcgtgctgcggg

SEQ ID NO: 138812 - DNA, 23 bp, Artificial Sequence
  Description of Artificial Sequence: Synthetic oligonucleotide
gagccgagattcgtgctgcgggc

SEQ ID NO: 138813 - DNA, 23 bp, Artificial Sequence
  Description of Artificial Sequence: Synthetic oligonucleotide
agccgagattcgtgctgcgggcc

SEQ ID NO: 138814 - DNA, 22 bp, Artificial Sequence
  Description of Artificial Sequence: Synthetic oligonucleotide
gccgagattcgtgctgcgggcc

SEQ ID NO: 138815 - DNA, 23 bp, Artificial Sequence
  Description of Artificial Sequence: Synthetic oligonucleotide
ccgagattcgtgctgcgggccct

SEQ ID NO: 138816 - DNA, 23 bp, Artificial Sequence
  Description of Artificial Sequence: Synthetic oligonucleotide
cgagattcgtgctgcgggccctg

SEQ ID NO: 138817 - DNA, 23 bp, Artificial Sequence
  Description of Artificial Sequence: Synthetic oligonucleotide
gagattcgtgctgcgggccctgc

SEQ ID NO: 138818 - DNA, 23 bp, Artificial Sequence
  Description of Artificial Sequence: Synthetic oligonucleotide
agattcgtgctgcgggccctgcg

SEQ ID NO: 138819 - DNA, 22 bp, Artificial Sequence
  Description of Artificial Sequence: Synthetic oligonucleotide
gattcgtgctgcgggccctgcg

SEQ ID NO: 138820 - DNA, 24 bp, Artificial Sequence
  Description of Artificial Sequence: Synthetic oligonucleotide
attcgtgctgcgggccctgcggat

SEQ ID NO: 138821 - DNA, 23 bp, Artificial Sequence
  Description of Artificial Sequence: Synthetic oligonucleotide
ttcgtgctgcgggccctgcggat

SEQ ID NO: 138822 - DNA, 22 bp, Artificial Sequence
  Description of Artificial Sequence: Synthetic oligonucleotide
tcgtgctgcgggccctgcggat

SEQ ID NO: 138823 - DNA, 21 bp, Artificial Sequence
  Description of Artificial Sequence: Synthetic oligonucleotide
cgtgctgcgggccctgcggat

SEQ ID NO: 138824 - DNA, 21 bp, Artificial Sequence
  Description of Artificial Sequence: Synthetic oligonucleotide
gtgctgcgggccctgcggatg

SEQ ID NO: 138825 - DNA, 22 bp, Artificial Sequence
  Description of Artificial Sequence: Synthetic oligonucleotide
tgctgcgggccctgcggatgct

SEQ ID NO: 138826 - DNA, 21 bp, Artificial Sequence
  Description of Artificial Sequence: Synthetic oligonucleotide
gctgcgggccctgcggatgct

SEQ ID NO: 138827 - DNA, 21 bp, Artificial Sequence
  Description of Artificial Sequence: Synthetic oligonucleotide
ctgcgggccctgcggatgctg

SEQ ID NO: 138828 - DNA, 21 bp, Artificial Sequence
  Description of Artificial Sequence: Synthetic oligonucleotide
tgcgggccctgcggatgctgc

SEQ ID NO: 138829 - DNA, 20 bp, Artificial Sequence
  Description of Artificial Sequence: Synthetic oligonucleotide
gcgggccctgcggatgctgc

SEQ ID NO: 138830 - DNA, 22 bp, Artificial Sequence
  Description of Artificial Sequence: Synthetic oligonucleotide
cgggccctgcggatgctgcctt

SEQ ID NO: 138831 - DNA, 22 bp, Artificial Sequence
  Description of Artificial Sequence: Synthetic oligonucleotide
gggccctgcggatgctgccttc

SEQ ID NO: 138832 - DNA, 23 bp, Artificial Sequence
  Description of Artificial Sequence: Synthetic oligonucleotide
ggccctgcggatgctgccttcca

SEQ ID NO: 138833 - DNA, 25 bp, Artificial Sequence
  Description of Artificial Sequence: Synthetic oligonucleotide
gccctgcggatgctgccttccacat

SEQ ID NO: 138834 - DNA, 26 bp, Artificial Sequence
  Description of Artificial Sequence: Synthetic oligonucleotide
ccctgcggatgctgccttccacatca

SEQ ID NO: 138835 - DNA, 26 bp, Artificial Sequence
  Description of Artificial Sequence: Synthetic oligonucleotide
cctgcggatgctgccttccacatcac

SEQ ID NO: 138836 - DNA, 26 bp, Artificial Sequence
  Description of Artificial Sequence: Synthetic oligonucleotide
ctgcggatgctgccttccacatcacg

SEQ ID NO: 138837 - DNA, 26 bp, Artificial Sequence
  Description of Artificial Sequence: Synthetic oligonucleotide
tgcggatgctgccttccacatcacgc

SEQ ID NO: 138838 - DNA, 25 bp, Artificial Sequence
  Description of Artificial Sequence: Synthetic oligonucleotide
gcggatgctgccttccacatcacgc

SEQ ID NO: 138839 - DNA, 25 bp, Artificial Sequence
  Description of Artificial Sequence: Synthetic oligonucleotide
cggatgctgccttccacatcacgcc

SEQ ID NO: 138840 - DNA, 25 bp, Artificial Sequence
  Description of Artificial Sequence: Synthetic oligonucleotide
ggatgctgccttccacatcacgccg

SEQ ID NO: 138841 - DNA, 25 bp, Artificial Sequence
  Description of Artificial Sequence: Synthetic oligonucleotide
gatgctgccttccacatcacgccgc

SEQ ID NO: 138842 - DNA, 26 bp, Artificial Sequence
  Description of Artificial Sequence: Synthetic oligonucleotide
atgctgccttccacatcacgccgcct

SEQ ID NO: 138843 - DNA, 25 bp, Artificial Sequence
  Description of Artificial Sequence: Synthetic oligonucleotide
tgctgccttccacatcacgccgcct

SEQ ID NO: 138844 - DNA, 24 bp, Artificial Sequence
  Description of Artificial Sequence: Synthetic oligonucleotide
gctgccttccacatcacgccgcct

SEQ ID NO: 138845 - DNA, 26 bp, Artificial Sequence
  Description of Artificial Sequence: Synthetic oligonucleotide
ctgccttccacatcacgccgcctcaa

SEQ ID NO: 138846 - DNA, 26 bp, Artificial Sequence
  Description of Artificial Sequence: Synthetic oligonucleotide
tgccttccacatcacgccgcctcaac

SEQ ID NO: 138847 - DNA, 25 bp, Artificial Sequence
  Description of Artificial Sequence: Synthetic oligonucleotide
gccttccacatcacgccgcctcaac

SEQ ID NO: 138848 - DNA, 26 bp, Artificial Sequence
  Description of Artificial Sequence: Synthetic oligonucleotide
ccttccacatcacgccgcctcaacca

SEQ ID NO: 138849 - DNA, 27 bp, Artificial Sequence
  Description of Artificial Sequence: Synthetic oligonucleotide
cttccacatcacgccgcctcaaccact

SEQ ID NO: 138850 - DNA, 29 bp, Artificial Sequence
  Description of Artificial Sequence: Synthetic oligonucleotide
ttccacatcacgccgcctcaaccactatg

SEQ ID NO: 138851 - DNA, 28 bp, Artificial Sequence
  Description of Artificial Sequence: Synthetic oligonucleotide
tccacatcacgccgcctcaaccactatg

SEQ ID NO: 138852 - DNA, 27 bp, Artificial Sequence
  Description of Artificial Sequence: Synthetic oligonucleotide
ccacatcacgccgcctcaaccactatg

SEQ ID NO: 138853 - DNA, 29 bp, Artificial Sequence
  Description of Artificial Sequence: Synthetic oligonucleotide
cacatcacgccgcctcaaccactatgttc

SEQ ID NO: 138854 - DNA, 30 bp, Artificial Sequence
  Description of Artificial Sequence: Synthetic oligonucleotide
acatcacgccgcctcaaccactatgttctg

SEQ ID NO: 138855 - DNA, 29 bp, Artificial Sequence
  Description of Artificial Sequence: Synthetic oligonucleotide
catcacgccgcctcaaccactatgttctg

SEQ ID NO: 138856 - DNA, 34 bp, Artificial Sequence
  Description of Artificial Sequence: Synthetic oligonucleotide
atcacgccgcctcaaccactatgttctgtataag

SEQ ID NO: 138857 - DNA, 33 bp, Artificial Sequence
  Description of Artificial Sequence: Synthetic oligonucleotide
tcacgccgcctcaaccactatgttctgtataag

SEQ ID NO: 138858 - DNA, 32 bp, Artificial Sequence
  Description of Artificial Sequence: Synthetic oligonucleotide
cacgccgcctcaaccactatgttctgtataag

SEQ ID NO: 138859 - DNA, 32 bp, Artificial Sequence
  Description of Artificial Sequence: Synthetic oligonucleotide
acgccgcctcaaccactatgttctgtataagg

SEQ ID NO: 138860 - DNA, 31 bp, Artificial Sequence
  Description of Artificial Sequence: Synthetic oligonucleotide
cgccgcctcaaccactatgttctgtataagg

SEQ ID NO: 138861 - DNA, 31 bp, Artificial Sequence
  Description of Artificial Sequence: Synthetic oligonucleotide
gccgcctcaaccactatgttctgtataaggc

SEQ ID NO: 138862 - DNA, 32 bp, Artificial Sequence
  Description of Artificial Sequence: Synthetic oligonucleotide
ccgcctcaaccactatgttctgtataaggctg

SEQ ID NO: 138863 - DNA, 33 bp, Artificial Sequence
  Description of Artificial Sequence: Synthetic oligonucleotide
cgcctcaaccactatgttctgtataaggctgtg

SEQ ID NO: 138864 - DNA, 33 bp, Artificial Sequence
  Description of Artificial Sequence: Synthetic oligonucleotide
gcctcaaccactatgttctgtataaggctgtgc

SEQ ID NO: 138865 - DNA, 34 bp, Artificial Sequence
  Description of Artificial Sequence: Synthetic oligonucleotide
cctcaaccactatgttctgtataaggctgtgcag

SEQ ID NO: 138866 - DNA, 34 bp, Artificial Sequence
  Description of Artificial Sequence: Synthetic oligonucleotide
ctcaaccactatgttctgtataaggctgtgcagg

SEQ ID NO: 138867 - DNA, 34 bp, Artificial Sequence
  Description of Artificial Sequence: Synthetic oligonucleotide
tcaaccactatgttctgtataaggctgtgcaggg

SEQ ID NO: 138868 - DNA, 33 bp, Artificial Sequence
  Description of Artificial Sequence: Synthetic oligonucleotide
caaccactatgttctgtataaggctgtgcaggg

SEQ ID NO: 138869 - DNA, 33 bp, Artificial Sequence
  Description of Artificial Sequence: Synthetic oligonucleotide
aaccactatgttctgtataaggctgtgcagggc

SEQ ID NO: 138870 - DNA, 32 bp, Artificial Sequence
  Description of Artificial Sequence: Synthetic oligonucleotide
accactatgttctgtataaggctgtgcagggc

SEQ ID NO: 138871 - DNA, 31 bp, Artificial Sequence
  Description of Artificial Sequence: Synthetic oligonucleotide
ccactatgttctgtataaggctgtgcagggc

SEQ ID NO: 138872 - DNA, 33 bp, Artificial Sequence
  Description of Artificial Sequence: Synthetic oligonucleotide
cactatgttctgtataaggctgtgcagggcttc

SEQ ID NO: 138873 - DNA, 35 bp, Artificial Sequence
  Description of Artificial Sequence: Synthetic oligonucleotide
actatgttctgtataaggctgtgcagggcttcttc

SEQ ID NO: 138874 - DNA, 34 bp, Artificial Sequence
  Description of Artificial Sequence: Synthetic oligonucleotide
ctatgttctgtataaggctgtgcagggcttcttc

SEQ ID NO: 138875 - DNA, 35 bp, Artificial Sequence
  Description of Artificial Sequence: Synthetic oligonucleotide
tatgttctgtataaggctgtgcagggcttcttcac

SEQ ID NO: 138876 - DNA, 34 bp, Artificial Sequence
  Description of Artificial Sequence: Synthetic oligonucleotide
atgttctgtataaggctgtgcagggcttcttcac

SEQ ID NO: 138877 - DNA, 33 bp, Artificial Sequence
  Description of Artificial Sequence: Synthetic oligonucleotide
tgttctgtataaggctgtgcagggcttcttcac

SEQ ID NO: 138878 - DNA, 32 bp, Artificial Sequence
  Description of Artificial Sequence: Synthetic oligonucleotide
gttctgtataaggctgtgcagggcttcttcac

SEQ ID NO: 138879 - DNA, 34 bp, Artificial Sequence
  Description of Artificial Sequence: Synthetic oligonucleotide
ttctgtataaggctgtgcagggcttcttcacttc

SEQ ID NO: 138880 - DNA, 33 bp, Artificial Sequence
  Description of Artificial Sequence: Synthetic oligonucleotide
tctgtataaggctgtgcagggcttcttcacttc

SEQ ID NO: 138881 - DNA, 32 bp, Artificial Sequence
  Description of Artificial Sequence: Synthetic oligonucleotide
ctgtataaggctgtgcagggcttcttcacttc

SEQ ID NO: 138882 - DNA, 39 bp, Artificial Sequence
  Description of Artificial Sequence: Synthetic oligonucleotide
tgtataaggctgtgcagggcttcttcacttcaaataatg

SEQ ID NO: 138883 - DNA, 38 bp, Artificial Sequence
  Description of Artificial Sequence: Synthetic oligonucleotide
gtataaggctgtgcagggcttcttcacttcaaataatg

SEQ ID NO: 138884 - DNA, 38 bp, Artificial Sequence
  Description of Artificial Sequence: Synthetic oligonucleotide
tataaggctgtgcagggcttcttcacttcaaataatgc

SEQ ID NO: 138885 - DNA, 37 bp, Artificial Sequence
  Description of Artificial Sequence: Synthetic oligonucleotide
ataaggctgtgcagggcttcttcacttcaaataatgc

SEQ ID NO: 138886 - DNA, 36 bp, Artificial Sequence
  Description of Artificial Sequence: Synthetic oligonucleotide
taaggctgtgcagggcttcttcacttcaaataatgc

SEQ ID NO: 138887 - DNA, 35 bp, Artificial Sequence
  Description of Artificial Sequence: Synthetic oligonucleotide
aaggctgtgcagggcttcttcacttcaaataatgc

SEQ ID NO: 138888 - DNA, 34 bp, Artificial Sequence
  Description of Artificial Sequence: Synthetic oligonucleotide
aggctgtgcagggcttcttcacttcaaataatgc

SEQ ID NO: 138889 - DNA, 33 bp, Artificial Sequence
  Description of Artificial Sequence: Synthetic oligonucleotide
ggctgtgcagggcttcttcacttcaaataatgc

SEQ ID NO: 138890 - DNA, 33 bp, Artificial Sequence
  Description of Artificial Sequence: Synthetic oligonucleotide
gctgtgcagggcttcttcacttcaaataatgcc

SEQ ID NO: 138891 - DNA, 34 bp, Artificial Sequence
  Description of Artificial Sequence: Synthetic oligonucleotide
ctgtgcagggcttcttcacttcaaataatgccac

SEQ ID NO: 138892 - DNA, 35 bp, Artificial Sequence
  Description of Artificial Sequence: Synthetic oligonucleotide
tgtgcagggcttcttcacttcaaataatgccactc

SEQ ID NO: 138893 - DNA, 34 bp, Artificial Sequence
  Description of Artificial Sequence: Synthetic oligonucleotide
gtgcagggcttcttcacttcaaataatgccactc

SEQ ID NO: 138894 - DNA, 34 bp, Artificial Sequence
  Description of Artificial Sequence: Synthetic oligonucleotide
tgcagggcttcttcacttcaaataatgccactcg

SEQ ID NO: 138895 - DNA, 33 bp, Artificial Sequence
  Description of Artificial Sequence: Synthetic oligonucleotide
gcagggcttcttcacttcaaataatgccactcg

SEQ ID NO: 138896 - DNA, 34 bp, Artificial Sequence
  Description of Artificial Sequence: Synthetic oligonucleotide
cagggcttcttcacttcaaataatgccactcgag

SEQ ID NO: 138897 - DNA, 35 bp, Artificial Sequence
  Description of Artificial Sequence: Synthetic oligonucleotide
agggcttcttcacttcaaataatgccactcgagac

SEQ ID NO: 138898 - DNA, 34 bp, Artificial Sequence
  Description of Artificial Sequence: Synthetic oligonucleotide
gggcttcttcacttcaaataatgccactcgagac

SEQ ID NO: 138899 - DNA, 39 bp, Artificial Sequence
  Description of Artificial Sequence: Synthetic oligonucleotide
ggcttcttcacttcaaataatgccactcgagactttttg

SEQ ID NO: 138900 - DNA, 39 bp, Artificial Sequence
  Description of Artificial Sequence: Synthetic oligonucleotide
gcttcttcacttcaaataatgccactcgagactttttgc

SEQ ID NO: 138901 - DNA, 40 bp, Artificial Sequence
  Description of Artificial Sequence: Synthetic oligonucleotide
cttcttcacttcaaataatgccactcgagactttttgctc

SEQ ID NO: 138902 - DNA, 40 bp, Artificial Sequence
  Description of Artificial Sequence: Synthetic oligonucleotide
ttcttcacttcaaataatgccactcgagactttttgctcc

SEQ ID NO: 138903 - DNA, 39 bp, Artificial Sequence
  Description of Artificial Sequence: Synthetic oligonucleotide
tcttcacttcaaataatgccactcgagactttttgctcc

SEQ ID NO: 138904 - DNA, 38 bp, Artificial Sequence
  Description of Artificial Sequence: Synthetic oligonucleotide
cttcacttcaaataatgccactcgagactttttgctcc

SEQ ID NO: 138905 - DNA, 38 bp, Artificial Sequence
  Description of Artificial Sequence: Synthetic oligonucleotide
ttcacttcaaataatgccactcgagactttttgctccc

SEQ ID NO: 138906 - DNA, 37 bp, Artificial Sequence
  Description of Artificial Sequence: Synthetic oligonucleotide
tcacttcaaataatgccactcgagactttttgctccc

SEQ ID NO: 138907 - DNA, 36 bp, Artificial Sequence
  Description of Artificial Sequence: Synthetic oligonucleotide
cacttcaaataatgccactcgagactttttgctccc

SEQ ID NO: 138908 - DNA, 36 bp, Artificial Sequence
  Description of Artificial Sequence: Synthetic oligonucleotide
acttcaaataatgccactcgagactttttgctcccc

SEQ ID NO: 138909 - DNA, 35 bp, Artificial Sequence
  Description of Artificial Sequence: Synthetic oligonucleotide
cttcaaataatgccactcgagactttttgctcccc

SEQ ID NO: 138910 - DNA, 37 bp, Artificial Sequence
  Description of Artificial Sequence: Synthetic oligonucleotide
ttcaaataatgccactcgagactttttgctccccttc

SEQ ID NO: 138911 - DNA, 36 bp, Artificial Sequence
  Description of Artificial Sequence: Synthetic oligonucleotide
tcaaataatgccactcgagactttttgctccccttc

SEQ ID NO: 138912 - DNA, 35 bp, Artificial Sequence
  Description of Artificial Sequence: Synthetic oligonucleotide
caaataatgccactcgagactttttgctccccttc

SEQ ID NO: 138913 - DNA, 35 bp, Artificial Sequence
  Description of Artificial Sequence: Synthetic oligonucleotide
aaataatgccactcgagactttttgctccccttcc

SEQ ID NO: 138914 - DNA, 34 bp, Artificial Sequence
  Description of Artificial Sequence: Synthetic oligonucleotide
aataatgccactcgagactttttgctccccttcc

SEQ ID NO: 138915 - DNA, 33 bp, Artificial Sequence
  Description of Artificial Sequence: Synthetic oligonucleotide
ataatgccactcgagactttttgctccccttcc

SEQ ID NO: 138916 - DNA, 32 bp, Artificial Sequence
  Description of Artificial Sequence: Synthetic oligonucleotide
taatgccactcgagactttttgctccccttcc

SEQ ID NO: 138917 - DNA, 31 bp, Artificial Sequence
  Description of Artificial Sequence: Synthetic oligonucleotide
aatgccactcgagactttttgctccccttcc

SEQ ID NO: 138918 - DNA, 30 bp, Artificial Sequence
  Description of Artificial Sequence: Synthetic oligonucleotide
atgccactcgagactttttgctccccttcc

SEQ ID NO: 138919 - DNA, 29 bp, Artificial Sequence
  Description of Artificial Sequence: Synthetic oligonucleotide
tgccactcgagactttttgctccccttcc

SEQ ID NO: 138920 - DNA, 28 bp, Artificial Sequence
  Description of Artificial Sequence: Synthetic oligonucleotide
gccactcgagactttttgctccccttcc

SEQ ID NO: 138921 - DNA, 29 bp, Artificial Sequence
  Description of Artificial Sequence: Synthetic oligonucleotide
ccactcgagactttttgctccccttcctg

SEQ ID NO: 138922 - DNA, 29 bp, Artificial Sequence
  Description of Artificial Sequence: Synthetic oligonucleotide
cactcgagactttttgctccccttcctgg

SEQ ID NO: 138923 - DNA, 31 bp, Artificial Sequence
  Description of Artificial Sequence: Synthetic oligonucleotide
actcgagactttttgctccccttcctggaag

SEQ ID NO: 138924 - DNA, 30 bp, Artificial Sequence
  Description of Artificial Sequence: Synthetic oligonucleotide
ctcgagactttttgctccccttcctggaag

SEQ ID NO: 138925 - DNA, 31 bp, Artificial Sequence
  Description of Artificial Sequence: Synthetic oligonucleotide
tcgagactttttgctccccttcctggaagag

SEQ ID NO: 138926 - DNA, 30 bp, Artificial Sequence
  Description of Artificial Sequence: Synthetic oligonucleotide
cgagactttttgctccccttcctggaagag

SEQ ID NO: 138927 - DNA, 30 bp, Artificial Sequence
  Description of Artificial Sequence: Synthetic oligonucleotide
gagactttttgctccccttcctggaagagc

SEQ ID NO: 138928 - DNA, 30 bp, Artificial Sequence
  Description of Artificial Sequence: Synthetic oligonucleotide
agactttttgctccccttcctggaagagcc

SEQ ID NO: 138929 - DNA, 29 bp, Artificial Sequence
  Description of Artificial Sequence: Synthetic oligonucleotide
gactttttgctccccttcctggaagagcc

SEQ ID NO: 138930 - DNA, 29 bp, Artificial Sequence
  Description of Artificial Sequence: Synthetic oligonucleotide
actttttgctccccttcctggaagagccc

SEQ ID NO: 138931 - DNA, 28 bp, Artificial Sequence
  Description of Artificial Sequence: Synthetic oligonucleotide
ctttttgctccccttcctggaagagccc

SEQ ID NO: 138932 - DNA, 30 bp, Artificial Sequence
  Description of Artificial Sequence: Synthetic oligonucleotide
tttttgctccccttcctggaagagcccatg

SEQ ID NO: 138933 - DNA, 29 bp, Artificial Sequence
  Description of Artificial Sequence: Synthetic oligonucleotide
ttttgctccccttcctggaagagcccatg

SEQ ID NO: 138934 - DNA, 28 bp, Artificial Sequence
  Description of Artificial Sequence: Synthetic oligonucleotide
tttgctccccttcctggaagagcccatg

SEQ ID NO: 138935 - DNA, 27 bp, Artificial Sequence
  Description of Artificial Sequence: Synthetic oligonucleotide
ttgctccccttcctggaagagcccatg

SEQ ID NO: 138936 - DNA, 26 bp, Artificial Sequence
  Description of Artificial Sequence: Synthetic oligonucleotide
tgctccccttcctggaagagcccatg

SEQ ID NO: 138937 - DNA, 25 bp, Artificial Sequence
  Description of Artificial Sequence: Synthetic oligonucleotide
gctccccttcctggaagagcccatg

SEQ ID NO: 138938 - DNA, 26 bp, Artificial Sequence
  Description of Artificial Sequence: Synthetic oligonucleotide
ctccccttcctggaagagcccatgga

SEQ ID NO: 138939 - DNA, 27 bp, Artificial Sequence
  Description of Artificial Sequence: Synthetic oligonucleotide
tccccttcctggaagagcccatggaca

SEQ ID NO: 138940 - DNA, 26 bp, Artificial Sequence
  Description of Artificial Sequence: Synthetic oligonucleotide
ccccttcctggaagagcccatggaca

SEQ ID NO: 138941 - DNA, 27 bp, Artificial Sequence
  Description of Artificial Sequence: Synthetic oligonucleotide
cccttcctggaagagcccatggacaca

SEQ ID NO: 138942 - DNA, 27 bp, Artificial Sequence
  Description of Artificial Sequence: Synthetic oligonucleotide
ccttcctggaagagcccatggacacag

SEQ ID NO: 138943 - DNA, 28 bp, Artificial Sequence
  Description of Artificial Sequence: Synthetic oligonucleotide
cttcctggaagagcccatggacacagag

SEQ ID NO: 138944 - DNA, 28 bp, Artificial Sequence
  Description of Artificial Sequence: Synthetic oligonucleotide
ttcctggaagagcccatggacacagagg

SEQ ID NO: 138945 - DNA, 27 bp, Artificial Sequence
  Description of Artificial Sequence: Synthetic oligonucleotide
tcctggaagagcccatggacacagagg

SEQ ID NO: 138946 - DNA, 26 bp, Artificial Sequence
  Description of Artificial Sequence: Synthetic oligonucleotide
cctggaagagcccatggacacagagg

SEQ ID NO: 138947 - DNA, 27 bp, Artificial Sequence
  Description of Artificial Sequence: Synthetic oligonucleotide
ctggaagagcccatggacacagaggct

SEQ ID NO: 138948 - DNA, 27 bp, Artificial Sequence
  Description of Artificial Sequence: Synthetic oligonucleotide
tggaagagcccatggacacagaggctg

SEQ ID NO: 138949 - DNA, 27 bp, Artificial Sequence
  Description of Artificial Sequence: Synthetic oligonucleotide
ggaagagcccatggacacagaggctga

SEQ ID NO: 138950 - DNA, 31 bp, Artificial Sequence
  Description of Artificial Sequence: Synthetic oligonucleotide
gaagagcccatggacacagaggctgatttac

SEQ ID NO: 138951 - DNA, 32 bp, Artificial Sequence
  Description of Artificial Sequence: Synthetic oligonucleotide
aagagcccatggacacagaggctgatttacag

SEQ ID NO: 138952 - DNA, 31 bp, Artificial Sequence
  Description of Artificial Sequence: Synthetic oligonucleotide
agagcccatggacacagaggctgatttacag

SEQ ID NO: 138953 - DNA, 30 bp, Artificial Sequence
  Description of Artificial Sequence: Synthetic oligonucleotide
gagcccatggacacagaggctgatttacag

SEQ ID NO: 138954 - DNA, 32 bp, Artificial Sequence
  Description of Artificial Sequence: Synthetic oligonucleotide
agcccatggacacagaggctgatttacagttc

SEQ ID NO: 138955 - DNA, 31 bp, Artificial Sequence
  Description of Artificial Sequence: Synthetic oligonucleotide
gcccatggacacagaggctgatttacagttc

SEQ ID NO: 138956 - DNA, 31 bp, Artificial Sequence
  Description of Artificial Sequence: Synthetic oligonucleotide
cccatggacacagaggctgatttacagttcc

SEQ ID NO: 138957 - DNA, 31 bp, Artificial Sequence
  Description of Artificial Sequence: Synthetic oligonucleotide
ccatggacacagaggctgatttacagttccg

SEQ ID NO: 138958 - DNA, 32 bp, Artificial Sequence
  Description of Artificial Sequence: Synthetic oligonucleotide
catggacacagaggctgatttacagttccgtc

SEQ ID NO: 138959 - DNA, 32 bp, Artificial Sequence
  Description of Artificial Sequence: Synthetic oligonucleotide
atggacacagaggctgatttacagttccgtcc

SEQ ID NO: 138960 - DNA, 31 bp, Artificial Sequence
  Description of Artificial Sequence: Synthetic oligonucleotide
tggacacagaggctgatttacagttccgtcc

SEQ ID NO: 138961 - DNA, 30 bp, Artificial Sequence
  Description of Artificial Sequence: Synthetic oligonucleotide
ggacacagaggctgatttacagttccgtcc

SEQ ID NO: 138962 - DNA, 30 bp, Artificial Sequence
  Description of Artificial Sequence: Synthetic oligonucleotide
gacacagaggctgatttacagttccgtccc

SEQ ID NO: 138963 - DNA, 30 bp, Artificial Sequence
  Description of Artificial Sequence: Synthetic oligonucleotide
acacagaggctgatttacagttccgtcccc

SEQ ID NO: 138964 - DNA, 29 bp, Artificial Sequence
  Description of Artificial Sequence: Synthetic oligonucleotide
cacagaggctgatttacagttccgtcccc

SEQ ID NO: 138965 - DNA, 29 bp, Artificial Sequence
  Description of Artificial Sequence: Synthetic oligonucleotide
acagaggctgatttacagttccgtccccg

SEQ ID NO: 138966 - DNA, 28 bp, Artificial Sequence
  Description of Artificial Sequence: Synthetic oligonucleotide
cagaggctgatttacagttccgtccccg

SEQ ID NO: 138967 - DNA, 28 bp, Artificial Sequence
  Description of Artificial Sequence: Synthetic oligonucleotide
agaggctgatttacagttccgtccccgc

SEQ ID NO: 138968 - DNA, 27 bp, Artificial Sequence
  Description of Artificial Sequence: Synthetic oligonucleotide
gaggctgatttacagttccgtccccgc

SEQ ID NO: 138969 - DNA, 28 bp, Artificial Sequence
  Description of Artificial Sequence: Synthetic oligonucleotide
aggctgatttacagttccgtccccgcac

SEQ ID NO: 138970 - DNA, 27 bp, Artificial Sequence
  Description of Artificial Sequence: Synthetic oligonucleotide
ggctgatttacagttccgtccccgcac

SEQ ID NO: 138971 - DNA, 27 bp, Artificial Sequence
  Description of Artificial Sequence: Synthetic oligonucleotide
gctgatttacagttccgtccccgcacg

SEQ ID NO: 138972 - DNA, 27 bp, Artificial Sequence
  Description of Artificial Sequence: Synthetic oligonucleotide
ctgatttacagttccgtccccgcacgg

SEQ ID NO: 138973 - DNA, 27 bp, Artificial Sequence
  Description of Artificial Sequence: Synthetic oligonucleotide
tgatttacagttccgtccccgcacggg

SEQ ID NO: 138974 - DNA, 27 bp, Artificial Sequence
  Description of Artificial Sequence: Synthetic oligonucleotide
gatttacagttccgtccccgcacggga

SEQ ID NO: 138975 - DNA, 30 bp, Artificial Sequence
  Description of Artificial Sequence: Synthetic oligonucleotide
atttacagttccgtccccgcacgggaaaag

SEQ ID NO: 138976 - DNA, 29 bp, Artificial Sequence
  Description of Artificial Sequence: Synthetic oligonucleotide
tttacagttccgtccccgcacgggaaaag

SEQ ID NO: 138977 - DNA, 28 bp, Artificial Sequence
  Description of Artificial Sequence: Synthetic oligonucleotide
ttacagttccgtccccgcacgggaaaag

SEQ ID NO: 138978 - DNA, 27 bp, Artificial Sequence
  Description of Artificial Sequence: Synthetic oligonucleotide
tacagttccgtccccgcacgggaaaag

SEQ ID NO: 138979 - DNA, 26 bp, Artificial Sequence
  Description of Artificial Sequence: Synthetic oligonucleotide
acagttccgtccccgcacgggaaaag

SEQ ID NO: 138980 - DNA, 25 bp, Artificial Sequence
  Description of Artificial Sequence: Synthetic oligonucleotide
cagttccgtccccgcacgggaaaag

SEQ ID NO: 138981 - DNA, 26 bp, Artificial Sequence
  Description of Artificial Sequence: Synthetic oligonucleotide
agttccgtccccgcacgggaaaagct

SEQ ID NO: 138982 - DNA, 25 bp, Artificial Sequence
  Description of Artificial Sequence: Synthetic oligonucleotide
gttccgtccccgcacgggaaaagct

SEQ ID NO: 138983 - DNA, 25 bp, Artificial Sequence
  Description of Artificial Sequence: Synthetic oligonucleotide
ttccgtccccgcacgggaaaagctg

SEQ ID NO: 138984 - DNA, 24 bp, Artificial Sequence
  Description of Artificial Sequence: Synthetic oligonucleotide
tccgtccccgcacgggaaaagctg

SEQ ID NO: 138985 - DNA, 23 bp, Artificial Sequence
  Description of Artificial Sequence: Synthetic oligonucleotide
ccgtccccgcacgggaaaagctg

SEQ ID NO: 138986 - DNA, 23 bp, Artificial Sequence
  Description of Artificial Sequence: Synthetic oligonucleotide
cgtccccgcacgggaaaagctgc

SEQ ID NO: 138987 - DNA, 24 bp, Artificial Sequence
  Description of Artificial Sequence: Synthetic oligonucleotide
gtccccgcacgggaaaagctgcgt

SEQ ID NO: 138988 - DNA, 24 bp, Artificial Sequence
  Description of Artificial Sequence: Synthetic oligonucleotide
tccccgcacgggaaaagctgcgtc

SEQ ID NO: 138989 - DNA, 23 bp, Artificial Sequence
  Description of Artificial Sequence: Synthetic oligonucleotide
ccccgcacgggaaaagctgcgtc

SEQ ID NO: 138990 - DNA, 24 bp, Artificial Sequence
  Description of Artificial Sequence: Synthetic oligonucleotide
cccgcacgggaaaagctgcgtcga

SEQ ID NO: 138991 - DNA, 25 bp, Artificial Sequence
  Description of Artificial Sequence: Synthetic oligonucleotide
ccgcacgggaaaagctgcgtcgaca

SEQ ID NO: 138992 - DNA, 25 bp, Artificial Sequence
  Description of Artificial Sequence: Synthetic oligonucleotide
cgcacgggaaaagctgcgtcgacac

SEQ ID NO: 138993 - DNA, 25 bp, Artificial Sequence
  Description of Artificial Sequence: Synthetic oligonucleotide
gcacgggaaaagctgcgtcgacacc

SEQ ID NO: 138994 - DNA, 25 bp, Artificial Sequence
  Description of Artificial Sequence: Synthetic oligonucleotide
cacgggaaaagctgcgtcgacaccc

SEQ ID NO: 138995 - DNA, 26 bp, Artificial Sequence
  Description of Artificial Sequence: Synthetic oligonucleotide
acgggaaaagctgcgtcgacacccct

SEQ ID NO: 138996 - DNA, 25 bp, Artificial Sequence
  Description of Artificial Sequence: Synthetic oligonucleotide
cgggaaaagctgcgtcgacacccct

SEQ ID NO: 138997 - DNA, 25 bp, Artificial Sequence
  Description of Artificial Sequence: Synthetic oligonucleotide
gggaaaagctgcgtcgacacccctc

SEQ ID NO: 138998 - DNA, 26 bp, Artificial Sequence
  Description of Artificial Sequence: Synthetic oligonucleotide
ggaaaagctgcgtcgacacccctcct

SEQ ID NO: 138999 - DNA, 26 bp, Artificial Sequence
  Description of Artificial Sequence: Synthetic oligonucleotide
gaaaagctgcgtcgacacccctcctg

SEQ ID NO: 139000 - DNA, 26 bp, Artificial Sequence
  Description of Artificial Sequence: Synthetic oligonucleotide
aaaagctgcgtcgacacccctcctgc

SEQ ID NO: 139001 - DNA, 25 bp, Artificial Sequence
  Description of Artificial Sequence: Synthetic oligonucleotide
aaagctgcgtcgacacccctcctgc

SEQ ID NO: 139002 - DNA, 24 bp, Artificial Sequence
  Description of Artificial Sequence: Synthetic oligonucleotide
aagctgcgtcgacacccctcctgc

SEQ ID NO: 139003 - DNA, 23 bp, Artificial Sequence
  Description of Artificial Sequence: Synthetic oligonucleotide
agctgcgtcgacacccctcctgc

SEQ ID NO: 139004 - DNA, 22 bp, Artificial Sequence
  Description of Artificial Sequence: Synthetic oligonucleotide
gctgcgtcgacacccctcctgc

SEQ ID NO: 139005 - DNA, 23 bp, Artificial Sequence
  Description of Artificial Sequence: Synthetic oligonucleotide
ctgcgtcgacacccctcctgcct

SEQ ID NO: 139006 - DNA, 25 bp, Artificial Sequence
  Description of Artificial Sequence: Synthetic oligonucleotide
tgcgtcgacacccctcctgcctgaa

SEQ ID NO: 139007 - DNA, 24 bp, Artificial Sequence
  Description of Artificial Sequence: Synthetic oligonucleotide
gcgtcgacacccctcctgcctgaa

SEQ ID NO: 139008 - DNA, 25 bp, Artificial Sequence
  Description of Artificial Sequence: Synthetic oligonucleotide
cgtcgacacccctcctgcctgaagt

SEQ ID NO: 139009 - DNA, 25 bp, Artificial Sequence
  Description of Artificial Sequence: Synthetic oligonucleotide
gtcgacacccctcctgcctgaagtg

SEQ ID NO: 139010 - DNA, 27 bp, Artificial Sequence
  Description of Artificial Sequence: Synthetic oligonucleotide
tcgacacccctcctgcctgaagtggaa

SEQ ID NO: 139011 - DNA, 26 bp, Artificial Sequence
  Description of Artificial Sequence: Synthetic oligonucleotide
cgacacccctcctgcctgaagtggaa

SEQ ID NO: 139012 - DNA, 26 bp, Artificial Sequence
  Description of Artificial Sequence: Synthetic oligonucleotide
gacacccctcctgcctgaagtggaag

SEQ ID NO: 139013 - DNA, 26 bp, Artificial Sequence
  Description of Artificial Sequence: Synthetic oligonucleotide
acacccctcctgcctgaagtggaagc

SEQ ID NO: 139014 - DNA, 25 bp, Artificial Sequence
  Description of Artificial Sequence: Synthetic oligonucleotide
cacccctcctgcctgaagtggaagc

SEQ ID NO: 139015 - DNA, 27 bp, Artificial Sequence
  Description of Artificial Sequence: Synthetic oligonucleotide
acccctcctgcctgaagtggaagccta

SEQ ID NO: 139016 - DNA, 27 bp, Artificial Sequence
  Description of Artificial Sequence: Synthetic oligonucleotide
cccctcctgcctgaagtggaagcctat

SEQ ID NO: 139017 - DNA, 27 bp, Artificial Sequence
  Description of Artificial Sequence: Synthetic oligonucleotide
ccctcctgcctgaagtggaagcctatc

SEQ ID NO: 139018 - DNA, 28 bp, Artificial Sequence
  Description of Artificial Sequence: Synthetic oligonucleotide
cctcctgcctgaagtggaagcctatctc

SEQ ID NO: 139019 - DNA, 28 bp, Artificial Sequence
  Description of Artificial Sequence: Synthetic oligonucleotide
ctcctgcctgaagtggaagcctatctcc

SEQ ID NO: 139020 - DNA, 30 bp, Artificial Sequence
  Description of Artificial Sequence: Synthetic oligonucleotide
tcctgcctgaagtggaagcctatctccaac

SEQ ID NO: 139021 - DNA, 29 bp, Artificial Sequence
  Description of Artificial Sequence: Synthetic oligonucleotide
cctgcctgaagtggaagcctatctccaac

SEQ ID NO: 139022 - DNA, 30 bp, Artificial Sequence
  Description of Artificial Sequence: Synthetic oligonucleotide
ctgcctgaagtggaagcctatctccaactc

SEQ ID NO: 139023 - DNA, 30 bp, Artificial Sequence
  Description of Artificial Sequence: Synthetic oligonucleotide
tgcctgaagtggaagcctatctccaactcc

SEQ ID NO: 139024 - DNA, 29 bp, Artificial Sequence
  Description of Artificial Sequence: Synthetic oligonucleotide
gcctgaagtggaagcctatctccaactcc

SEQ ID NO: 139025 - DNA, 30 bp, Artificial Sequence
  Description of Artificial Sequence: Synthetic oligonucleotide
cctgaagtggaagcctatctccaactcctc

SEQ ID NO: 139026 - DNA, 30 bp, Artificial Sequence
  Description of Artificial Sequence: Synthetic oligonucleotide
ctgaagtggaagcctatctccaactcctcg

SEQ ID NO: 139027 - DNA, 31 bp, Artificial Sequence
  Description of Artificial Sequence: Synthetic oligonucleotide
tgaagtggaagcctatctccaactcctcgtg

SEQ ID NO: 139028 - DNA, 30 bp, Artificial Sequence
  Description of Artificial Sequence: Synthetic oligonucleotide
gaagtggaagcctatctccaactcctcgtg

SEQ ID NO: 139029 - DNA, 30 bp, Artificial Sequence
  Description of Artificial Sequence: Synthetic oligonucleotide
aagtggaagcctatctccaactcctcgtgg

SEQ ID NO: 139030 - DNA, 29 bp, Artificial Sequence
  Description of Artificial Sequence: Synthetic oligonucleotide
agtggaagcctatctccaactcctcgtgg

SEQ ID NO: 139031 - DNA, 28 bp, Artificial Sequence
  Description of Artificial Sequence: Synthetic oligonucleotide
gtggaagcctatctccaactcctcgtgg

SEQ ID NO: 139032 - DNA, 29 bp, Artificial Sequence
  Description of Artificial Sequence: Synthetic oligonucleotide
tggaagcctatctccaactcctcgtggtc

SEQ ID NO: 139033 - DNA, 28 bp, Artificial Sequence
  Description of Artificial Sequence: Synthetic oligonucleotide
ggaagcctatctccaactcctcgtggtc

SEQ ID NO: 139034 - DNA, 30 bp, Artificial Sequence
  Description of Artificial Sequence: Synthetic oligonucleotide
gaagcctatctccaactcctcgtggtcatc

SEQ ID NO: 139035 - DNA, 32 bp, Artificial Sequence
  Description of Artificial Sequence: Synthetic oligonucleotide
aagcctatctccaactcctcgtggtcatcttc

SEQ ID NO: 139036 - DNA, 31 bp, Artificial Sequence
  Description of Artificial Sequence: Synthetic oligonucleotide
agcctatctccaactcctcgtggtcatcttc

SEQ ID NO: 139037 - DNA, 30 bp, Artificial Sequence
  Description of Artificial Sequence: Synthetic oligonucleotide
gcctatctccaactcctcgtggtcatcttc

SEQ ID NO: 139038 - DNA, 32 bp, Artificial Sequence
  Description of Artificial Sequence: Synthetic oligonucleotide
cctatctccaactcctcgtggtcatcttcatg

SEQ ID NO: 139039 - DNA, 34 bp, Artificial Sequence
  Description of Artificial Sequence: Synthetic oligonucleotide
ctatctccaactcctcgtggtcatcttcatgatg

SEQ ID NO: 139040 - DNA, 36 bp, Artificial Sequence
  Description of Artificial Sequence: Synthetic oligonucleotide
tatctccaactcctcgtggtcatcttcatgatgaac

SEQ ID NO: 139041 - DNA, 35 bp, Artificial Sequence
  Description of Artificial Sequence: Synthetic oligonucleotide
atctccaactcctcgtggtcatcttcatgatgaac

SEQ ID NO: 139042 - DNA, 34 bp, Artificial Sequence
  Description of Artificial Sequence: Synthetic oligonucleotide
tctccaactcctcgtggtcatcttcatgatgaac

SEQ ID NO: 139043 - DNA, 33 bp, Artificial Sequence
  Description of Artificial Sequence: Synthetic oligonucleotide
ctccaactcctcgtggtcatcttcatgatgaac

SEQ ID NO: 139044 - DNA, 34 bp, Artificial Sequence
  Description of Artificial Sequence: Synthetic oligonucleotide
tccaactcctcgtggtcatcttcatgatgaacag

SEQ ID NO: 139045 - DNA, 33 bp, Artificial Sequence
  Description of Artificial Sequence: Synthetic oligonucleotide
ccaactcctcgtggtcatcttcatgatgaacag

SEQ ID NO: 139046 - DNA, 33 bp, Artificial Sequence
  Description of Artificial Sequence: Synthetic oligonucleotide
caactcctcgtggtcatcttcatgatgaacagc

SEQ ID NO: 139047 - DNA, 35 bp, Artificial Sequence
  Description of Artificial Sequence: Synthetic oligonucleotide
aactcctcgtggtcatcttcatgatgaacagcaag

SEQ ID NO: 139048 - DNA, 34 bp, Artificial Sequence
  Description of Artificial Sequence: Synthetic oligonucleotide
actcctcgtggtcatcttcatgatgaacagcaag

SEQ ID NO: 139049 - DNA, 33 bp, Artificial Sequence
  Description of Artificial Sequence: Synthetic oligonucleotide
ctcctcgtggtcatcttcatgatgaacagcaag

SEQ ID NO: 139050 - DNA, 33 bp, Artificial Sequence
  Description of Artificial Sequence: Synthetic oligonucleotide
tcctcgtggtcatcttcatgatgaacagcaagc

SEQ ID NO: 139051 - DNA, 32 bp, Artificial Sequence
  Description of Artificial Sequence: Synthetic oligonucleotide
cctcgtggtcatcttcatgatgaacagcaagc

SEQ ID NO: 139052 - DNA, 32 bp, Artificial Sequence
  Description of Artificial Sequence: Synthetic oligonucleotide
ctcgtggtcatcttcatgatgaacagcaagcg

SEQ ID NO: 139053 - DNA, 32 bp, Artificial Sequence
  Description of Artificial Sequence: Synthetic oligonucleotide
tcgtggtcatcttcatgatgaacagcaagcgc

SEQ ID NO: 139054 - DNA, 31 bp, Artificial Sequence
  Description of Artificial Sequence: Synthetic oligonucleotide
cgtggtcatcttcatgatgaacagcaagcgc

SEQ ID NO: 139055 - DNA, 33 bp, Artificial Sequence
  Description of Artificial Sequence: Synthetic oligonucleotide
gtggtcatcttcatgatgaacagcaagcgctac

SEQ ID NO: 139056 - DNA, 36 bp, Artificial Sequence
  Description of Artificial Sequence: Synthetic oligonucleotide
tggtcatcttcatgatgaacagcaagcgctacaaag

SEQ ID NO: 139057 - DNA, 35 bp, Artificial Sequence
  Description of Artificial Sequence: Synthetic oligonucleotide
ggtcatcttcatgatgaacagcaagcgctacaaag

SEQ ID NO: 139058 - DNA, 36 bp, Artificial Sequence
  Description of Artificial Sequence: Synthetic oligonucleotide
gtcatcttcatgatgaacagcaagcgctacaaagag

SEQ ID NO: 139059 - DNA, 36 bp, Artificial Sequence
  Description of Artificial Sequence: Synthetic oligonucleotide
tcatcttcatgatgaacagcaagcgctacaaagagg

SEQ ID NO: 139060 - DNA, 35 bp, Artificial Sequence
  Description of Artificial Sequence: Synthetic oligonucleotide
catcttcatgatgaacagcaagcgctacaaagagg

SEQ ID NO: 139061 - DNA, 35 bp, Artificial Sequence
  Description of Artificial Sequence: Synthetic oligonucleotide
atcttcatgatgaacagcaagcgctacaaagaggc

SEQ ID NO: 139062 - DNA, 34 bp, Artificial Sequence
  Description of Artificial Sequence: Synthetic oligonucleotide
tcttcatgatgaacagcaagcgctacaaagaggc

SEQ ID NO: 139063 - DNA, 33 bp, Artificial Sequence
  Description of Artificial Sequence: Synthetic oligonucleotide
cttcatgatgaacagcaagcgctacaaagaggc

SEQ ID NO: 139064 - DNA, 34 bp, Artificial Sequence
  Description of Artificial Sequence: Synthetic oligonucleotide
ttcatgatgaacagcaagcgctacaaagaggcac

SEQ ID NO: 139065 - DNA, 33 bp, Artificial Sequence
  Description of Artificial Sequence: Synthetic oligonucleotide
tcatgatgaacagcaagcgctacaaagaggcac

SEQ ID NO: 139066 - DNA, 32 bp, Artificial Sequence
  Description of Artificial Sequence: Synthetic oligonucleotide
catgatgaacagcaagcgctacaaagaggcac

SEQ ID NO: 139067 - DNA, 33 bp, Artificial Sequence
  Description of Artificial Sequence: Synthetic oligonucleotide
atgatgaacagcaagcgctacaaagaggcacag

SEQ ID NO: 139068 - DNA, 32 bp, Artificial Sequence
  Description of Artificial Sequence: Synthetic oligonucleotide
tgatgaacagcaagcgctacaaagaggcacag

SEQ ID NO: 139069 - DNA, 31 bp, Artificial Sequence
  Description of Artificial Sequence: Synthetic oligonucleotide
gatgaacagcaagcgctacaaagaggcacag

SEQ ID NO: 139070 - DNA, 33 bp, Artificial Sequence
  Description of Artificial Sequence: Synthetic oligonucleotide
atgaacagcaagcgctacaaagaggcacagaag

SEQ ID NO: 139071 - DNA, 32 bp, Artificial Sequence
  Description of Artificial Sequence: Synthetic oligonucleotide
tgaacagcaagcgctacaaagaggcacagaag

SEQ ID NO: 139072 - DNA, 31 bp, Artificial Sequence
  Description of Artificial Sequence: Synthetic oligonucleotide
gaacagcaagcgctacaaagaggcacagaag

SEQ ID NO: 139073 - DNA, 33 bp, Artificial Sequence
  Description of Artificial Sequence: Synthetic oligonucleotide
aacagcaagcgctacaaagaggcacagaagatc

SEQ ID NO: 139074 - DNA, 32 bp, Artificial Sequence
  Description of Artificial Sequence: Synthetic oligonucleotide
acagcaagcgctacaaagaggcacagaagatc

SEQ ID NO: 139075 - DNA, 31 bp, Artificial Sequence
  Description of Artificial Sequence: Synthetic oligonucleotide
cagcaagcgctacaaagaggcacagaagatc

SEQ ID NO: 139076 - DNA, 32 bp, Artificial Sequence
  Description of Artificial Sequence: Synthetic oligonucleotide
agcaagcgctacaaagaggcacagaagatctc

SEQ ID NO: 139077 - DNA, 31 bp, Artificial Sequence
  Description of Artificial Sequence: Synthetic oligonucleotide
gcaagcgctacaaagaggcacagaagatctc

SEQ ID NO: 139078 - DNA, 32 bp, Artificial Sequence
  Description of Artificial Sequence: Synthetic oligonucleotide
caagcgctacaaagaggcacagaagatctctg

SEQ ID NO: 139079 - DNA, 34 bp, Artificial Sequence
  Description of Artificial Sequence: Synthetic oligonucleotide
aagcgctacaaagaggcacagaagatctctgatg

SEQ ID NO: 139080 - DNA, 33 bp, Artificial Sequence
  Description of Artificial Sequence: Synthetic oligonucleotide
agcgctacaaagaggcacagaagatctctgatg

SEQ ID NO: 139081 - DNA, 32 bp, Artificial Sequence
  Description of Artificial Sequence: Synthetic oligonucleotide
gcgctacaaagaggcacagaagatctctgatg

SEQ ID NO: 139082 - DNA, 34 bp, Artificial Sequence
  Description of Artificial Sequence: Synthetic oligonucleotide
cgctacaaagaggcacagaagatctctgatgatc

SEQ ID NO: 139083 - DNA, 35 bp, Artificial Sequence
  Description of Artificial Sequence: Synthetic oligonucleotide
gctacaaagaggcacagaagatctctgatgatctg

SEQ ID NO: 139084 - DNA, 37 bp, Artificial Sequence
  Description of Artificial Sequence: Synthetic oligonucleotide
ctacaaagaggcacagaagatctctgatgatctgatg

SEQ ID NO: 139085 - DNA, 37 bp, Artificial Sequence
  Description of Artificial Sequence: Synthetic oligonucleotide
tacaaagaggcacagaagatctctgatgatctgatgc

SEQ ID NO: 139086 - DNA, 36 bp, Artificial Sequence
  Description of Artificial Sequence: Synthetic oligonucleotide
acaaagaggcacagaagatctctgatgatctgatgc

SEQ ID NO: 139087 - DNA, 35 bp, Artificial Sequence
  Description of Artificial Sequence: Synthetic oligonucleotide
caaagaggcacagaagatctctgatgatctgatgc

SEQ ID NO: 139088 - DNA, 36 bp, Artificial Sequence
  Description of Artificial Sequence: Synthetic oligonucleotide
aaagaggcacagaagatctctgatgatctgatgcag

SEQ ID NO: 139089 - DNA, 35 bp, Artificial Sequence
  Description of Artificial Sequence: Synthetic oligonucleotide
aagaggcacagaagatctctgatgatctgatgcag

SEQ ID NO: 139090 - DNA, 34 bp, Artificial Sequence
  Description of Artificial Sequence: Synthetic oligonucleotide
agaggcacagaagatctctgatgatctgatgcag

SEQ ID NO: 139091 - DNA, 33 bp, Artificial Sequence
  Description of Artificial Sequence: Synthetic oligonucleotide
gaggcacagaagatctctgatgatctgatgcag

SEQ ID NO: 139092 - DNA, 35 bp, Artificial Sequence
  Description of Artificial Sequence: Synthetic oligonucleotide
aggcacagaagatctctgatgatctgatgcagaag

SEQ ID NO: 139093 - DNA, 34 bp, Artificial Sequence
  Description of Artificial Sequence: Synthetic oligonucleotide
ggcacagaagatctctgatgatctgatgcagaag

SEQ ID NO: 139094 - DNA, 36 bp, Artificial Sequence
  Description of Artificial Sequence: Synthetic oligonucleotide
gcacagaagatctctgatgatctgatgcagaagatc

SEQ ID NO: 139095 - DNA, 37 bp, Artificial Sequence
  Description of Artificial Sequence: Synthetic oligonucleotide
cacagaagatctctgatgatctgatgcagaagatcag

SEQ ID NO: 139096 - DNA, 39 bp, Artificial Sequence
  Description of Artificial Sequence: Synthetic oligonucleotide
acagaagatctctgatgatctgatgcagaagatcagtac

SEQ ID NO: 139097 - DNA, 38 bp, Artificial Sequence
  Description of Artificial Sequence: Synthetic oligonucleotide
cagaagatctctgatgatctgatgcagaagatcagtac

SEQ ID NO: 139098 - DNA, 39 bp, Artificial Sequence
  Description of Artificial Sequence: Synthetic oligonucleotide
agaagatctctgatgatctgatgcagaagatcagtactc

SEQ ID NO: 139099 - DNA, 38 bp, Artificial Sequence
  Description of Artificial Sequence: Synthetic oligonucleotide
gaagatctctgatgatctgatgcagaagatcagtactc

SEQ ID NO: 139100 - DNA, 39 bp, Artificial Sequence
  Description of Artificial Sequence: Synthetic oligonucleotide
aagatctctgatgatctgatgcagaagatcagtactcag

SEQ ID NO: 139101 - DNA, 38 bp, Artificial Sequence
  Description of Artificial Sequence: Synthetic oligonucleotide
agatctctgatgatctgatgcagaagatcagtactcag

SEQ ID NO: 139102 - DNA, 37 bp, Artificial Sequence
  Description of Artificial Sequence: Synthetic oligonucleotide
gatctctgatgatctgatgcagaagatcagtactcag

SEQ ID NO: 139103 - DNA, 39 bp, Artificial Sequence
  Description of Artificial Sequence: Synthetic oligonucleotide
atctctgatgatctgatgcagaagatcagtactcagaac

SEQ ID NO: 139104 - DNA, 38 bp, Artificial Sequence
  Description of Artificial Sequence: Synthetic oligonucleotide
tctctgatgatctgatgcagaagatcagtactcagaac

SEQ ID NO: 139105 - DNA, 37 bp, Artificial Sequence
  Description of Artificial Sequence: Synthetic oligonucleotide
ctctgatgatctgatgcagaagatcagtactcagaac

SEQ ID NO: 139106 - DNA, 37 bp, Artificial Sequence
  Description of Artificial Sequence: Synthetic oligonucleotide
tctgatgatctgatgcagaagatcagtactcagaacc

SEQ ID NO: 139107 - DNA, 36 bp, Artificial Sequence
  Description of Artificial Sequence: Synthetic oligonucleotide
ctgatgatctgatgcagaagatcagtactcagaacc

SEQ ID NO: 139108 - DNA, 36 bp, Artificial Sequence
  Description of Artificial Sequence: Synthetic oligonucleotide
tgatgatctgatgcagaagatcagtactcagaaccg

SEQ ID NO: 139109 - DNA, 35 bp, Artificial Sequence
  Description of Artificial Sequence: Synthetic oligonucleotide
gatgatctgatgcagaagatcagtactcagaaccg

SEQ ID NO: 139110 - DNA, 35 bp, Artificial Sequence
  Description of Artificial Sequence: Synthetic oligonucleotide
atgatctgatgcagaagatcagtactcagaaccgc

SEQ ID NO: 139111 - DNA, 34 bp, Artificial Sequence
  Description of Artificial Sequence: Synthetic oligonucleotide
tgatctgatgcagaagatcagtactcagaaccgc

SEQ ID NO: 139112 - DNA, 33 bp, Artificial Sequence
  Description of Artificial Sequence: Synthetic oligonucleotide
gatctgatgcagaagatcagtactcagaaccgc

SEQ ID NO: 139113 - DNA, 33 bp, Artificial Sequence
  Description of Artificial Sequence: Synthetic oligonucleotide
atctgatgcagaagatcagtactcagaaccgcc

SEQ ID NO: 139114 - DNA, 32 bp, Artificial Sequence
  Description of Artificial Sequence: Synthetic oligonucleotide
tctgatgcagaagatcagtactcagaaccgcc

SEQ ID NO: 139115 - DNA, 31 bp, Artificial Sequence
  Description of Artificial Sequence: Synthetic oligonucleotide
ctgatgcagaagatcagtactcagaaccgcc

SEQ ID NO: 139116 - DNA, 31 bp, Artificial Sequence
  Description of Artificial Sequence: Synthetic oligonucleotide
tgatgcagaagatcagtactcagaaccgccg

SEQ ID NO: 139117 - DNA, 30 bp, Artificial Sequence
  Description of Artificial Sequence: Synthetic oligonucleotide
gatgcagaagatcagtactcagaaccgccg

SEQ ID NO: 139118 - DNA, 30 bp, Artificial Sequence
  Description of Artificial Sequence: Synthetic oligonucleotide
atgcagaagatcagtactcagaaccgccgg

SEQ ID NO: 139119 - DNA, 29 bp, Artificial Sequence
  Description of Artificial Sequence: Synthetic oligonucleotide
tgcagaagatcagtactcagaaccgccgg

SEQ ID NO: 139120 - DNA, 28 bp, Artificial Sequence
  Description of Artificial Sequence: Synthetic oligonucleotide
gcagaagatcagtactcagaaccgccgg

SEQ ID NO: 139121 - DNA, 28 bp, Artificial Sequence
  Description of Artificial Sequence: Synthetic oligonucleotide
cagaagatcagtactcagaaccgccggg

SEQ ID NO: 139122 - DNA, 28 bp, Artificial Sequence
  Description of Artificial Sequence: Synthetic oligonucleotide
agaagatcagtactcagaaccgccgggc

SEQ ID NO: 139123 - DNA, 27 bp, Artificial Sequence
  Description of Artificial Sequence: Synthetic oligonucleotide
gaagatcagtactcagaaccgccgggc

SEQ ID NO: 139124 - DNA, 27 bp, Artificial Sequence
  Description of Artificial Sequence: Synthetic oligonucleotide
aagatcagtactcagaaccgccgggcc

SEQ ID NO: 139125 - DNA, 26 bp, Artificial Sequence
  Description of Artificial Sequence: Synthetic oligonucleotide
agatcagtactcagaaccgccgggcc

SEQ ID NO: 139126 - DNA, 25 bp, Artificial Sequence
  Description of Artificial Sequence: Synthetic oligonucleotide
gatcagtactcagaaccgccgggcc

SEQ ID NO: 139127 - DNA, 27 bp, Artificial Sequence
  Description of Artificial Sequence: Synthetic oligonucleotide
atcagtactcagaaccgccgggcccta

SEQ ID NO: 139128 - DNA, 26 bp, Artificial Sequence
  Description of Artificial Sequence: Synthetic oligonucleotide
tcagtactcagaaccgccgggcccta

SEQ ID NO: 139129 - DNA, 25 bp, Artificial Sequence
  Description of Artificial Sequence: Synthetic oligonucleotide
cagtactcagaaccgccgggcccta

SEQ ID NO: 139130 - DNA, 26 bp, Artificial Sequence
  Description of Artificial Sequence: Synthetic oligonucleotide
agtactcagaaccgccgggccctaga

SEQ ID NO: 139131 - DNA, 25 bp, Artificial Sequence
  Description of Artificial Sequence: Synthetic oligonucleotide
gtactcagaaccgccgggccctaga

SEQ ID NO: 139132 - DNA, 25 bp, Artificial Sequence
  Description of Artificial Sequence: Synthetic oligonucleotide
tactcagaaccgccgggccctagac

SEQ ID NO: 139133 - DNA, 24 bp, Artificial Sequence
  Description of Artificial Sequence: Synthetic oligonucleotide
actcagaaccgccgggccctagac

SEQ ID NO: 139134 - DNA, 23 bp, Artificial Sequence
  Description of Artificial Sequence: Synthetic oligonucleotide
ctcagaaccgccgggccctagac

SEQ ID NO: 139135 - DNA, 25 bp, Artificial Sequence
  Description of Artificial Sequence: Synthetic oligonucleotide
tcagaaccgccgggccctagacctt

SEQ ID NO: 139136 - DNA, 24 bp, Artificial Sequence
  Description of Artificial Sequence: Synthetic oligonucleotide
cagaaccgccgggccctagacctt

SEQ ID NO: 139137 - DNA, 26 bp, Artificial Sequence
  Description of Artificial Sequence: Synthetic oligonucleotide
agaaccgccgggccctagaccttgta

SEQ ID NO: 139138 - DNA, 25 bp, Artificial Sequence
  Description of Artificial Sequence: Synthetic oligonucleotide
gaaccgccgggccctagaccttgta

SEQ ID NO: 139139 - DNA, 25 bp, Artificial Sequence
  Description of Artificial Sequence: Synthetic oligonucleotide
aaccgccgggccctagaccttgtag

SEQ ID NO: 139140 - DNA, 24 bp, Artificial Sequence
  Description of Artificial Sequence: Synthetic oligonucleotide
accgccgggccctagaccttgtag

SEQ ID NO: 139141 - DNA, 23 bp, Artificial Sequence
  Description of Artificial Sequence: Synthetic oligonucleotide
ccgccgggccctagaccttgtag

SEQ ID NO: 139142 - DNA, 23 bp, Artificial Sequence
  Description of Artificial Sequence: Synthetic oligonucleotide
cgccgggccctagaccttgtagc

SEQ ID NO: 139143 - DNA, 23 bp, Artificial Sequence
  Description of Artificial Sequence: Synthetic oligonucleotide
gccgggccctagaccttgtagcc

SEQ ID NO: 139144 - DNA, 23 bp, Artificial Sequence
  Description of Artificial Sequence: Synthetic oligonucleotide
ccgggccctagaccttgtagccg

SEQ ID NO: 139145 - DNA, 26 bp, Artificial Sequence
  Description of Artificial Sequence: Synthetic oligonucleotide
cgggccctagaccttgtagccgcaaa

SEQ ID NO: 139146 - DNA, 27 bp, Artificial Sequence
  Description of Artificial Sequence: Synthetic oligonucleotide
gggccctagaccttgtagccgcaaagt

SEQ ID NO: 139147 - DNA, 27 bp, Artificial Sequence
  Description of Artificial Sequence: Synthetic oligonucleotide
ggccctagaccttgtagccgcaaagtg

SEQ ID NO: 139148 - DNA, 30 bp, Artificial Sequence
  Description of Artificial Sequence: Synthetic oligonucleotide
gccctagaccttgtagccgcaaagtgttac

SEQ ID NO: 139149 - DNA, 36 bp, Artificial Sequence
  Description of Artificial Sequence: Synthetic oligonucleotide
ccctagaccttgtagccgcaaagtgttactattatc

SEQ ID NO: 139150 - DNA, 37 bp, Artificial Sequence
  Description of Artificial Sequence: Synthetic oligonucleotide
cctagaccttgtagccgcaaagtgttactattatcac

SEQ ID NO: 139151 - DNA, 37 bp, Artificial Sequence
  Description of Artificial Sequence: Synthetic oligonucleotide
ctagaccttgtagccgcaaagtgttactattatcacg

SEQ ID NO: 139152 - DNA, 37 bp, Artificial Sequence
  Description of Artificial Sequence: Synthetic oligonucleotide
tagaccttgtagccgcaaagtgttactattatcacgc

SEQ ID NO: 139153 - DNA, 36 bp, Artificial Sequence
  Description of Artificial Sequence: Synthetic oligonucleotide
agaccttgtagccgcaaagtgttactattatcacgc

SEQ ID NO: 139154 - DNA, 35 bp, Artificial Sequence
  Description of Artificial Sequence: Synthetic oligonucleotide
gaccttgtagccgcaaagtgttactattatcacgc

SEQ ID NO: 139155 - DNA, 35 bp, Artificial Sequence
  Description of Artificial Sequence: Synthetic oligonucleotide
accttgtagccgcaaagtgttactattatcacgcc

SEQ ID NO: 139156 - DNA, 34 bp, Artificial Sequence
  Description of Artificial Sequence: Synthetic oligonucleotide
ccttgtagccgcaaagtgttactattatcacgcc

SEQ ID NO: 139157 - DNA, 34 bp, Artificial Sequence
  Description of Artificial Sequence: Synthetic oligonucleotide
cttgtagccgcaaagtgttactattatcacgccc

SEQ ID NO: 139158 - DNA, 34 bp, Artificial Sequence
  Description of Artificial Sequence: Synthetic oligonucleotide
ttgtagccgcaaagtgttactattatcacgcccg

SEQ ID NO: 139159 - DNA, 33 bp, Artificial Sequence
  Description of Artificial Sequence: Synthetic oligonucleotide
tgtagccgcaaagtgttactattatcacgcccg

SEQ ID NO: 139160 - DNA, 32 bp, Artificial Sequence
  Description of Artificial Sequence: Synthetic oligonucleotide
gtagccgcaaagtgttactattatcacgcccg

SEQ ID NO: 139161 - DNA, 32 bp, Artificial Sequence
  Description of Artificial Sequence: Synthetic oligonucleotide
tagccgcaaagtgttactattatcacgcccgg

SEQ ID NO: 139162 - DNA, 31 bp, Artificial Sequence
  Description of Artificial Sequence: Synthetic oligonucleotide
agccgcaaagtgttactattatcacgcccgg

SEQ ID NO: 139163 - DNA, 30 bp, Artificial Sequence
  Description of Artificial Sequence: Synthetic oligonucleotide
gccgcaaagtgttactattatcacgcccgg

SEQ ID NO: 139164 - DNA, 30 bp, Artificial Sequence
  Description of Artificial Sequence: Synthetic oligonucleotide
ccgcaaagtgttactattatcacgcccggg

SEQ ID NO: 139165 - DNA, 31 bp, Artificial Sequence
  Description of Artificial Sequence: Synthetic oligonucleotide
cgcaaagtgttactattatcacgcccgggtc

SEQ ID NO: 139166 - DNA, 34 bp, Artificial Sequence
  Description of Artificial Sequence: Synthetic oligonucleotide
gcaaagtgttactattatcacgcccgggtctatg

SEQ ID NO: 139167 - DNA, 35 bp, Artificial Sequence
  Description of Artificial Sequence: Synthetic oligonucleotide
caaagtgttactattatcacgcccgggtctatgag

SEQ ID NO: 139168 - DNA, 37 bp, Artificial Sequence
  Description of Artificial Sequence: Synthetic oligonucleotide
aaagtgttactattatcacgcccgggtctatgagttc

SEQ ID NO: 139169 - DNA, 36 bp, Artificial Sequence
  Description of Artificial Sequence: Synthetic oligonucleotide
aagtgttactattatcacgcccgggtctatgagttc

SEQ ID NO: 139170 - DNA, 35 bp, Artificial Sequence
  Description of Artificial Sequence: Synthetic oligonucleotide
agtgttactattatcacgcccgggtctatgagttc

SEQ ID NO: 139171 - DNA, 34 bp, Artificial Sequence
  Description of Artificial Sequence: Synthetic oligonucleotide
gtgttactattatcacgcccgggtctatgagttc

SEQ ID NO: 139172 - DNA, 34 bp, Artificial Sequence
  Description of Artificial Sequence: Synthetic oligonucleotide
tgttactattatcacgcccgggtctatgagttcc

SEQ ID NO: 139173 - DNA, 33 bp, Artificial Sequence
  Description of Artificial Sequence: Synthetic oligonucleotide
gttactattatcacgcccgggtctatgagttcc

SEQ ID NO: 139174 - DNA, 34 bp, Artificial Sequence
  Description of Artificial Sequence: Synthetic oligonucleotide
ttactattatcacgcccgggtctatgagttcctg

SEQ ID NO: 139175 - DNA, 33 bp, Artificial Sequence
  Description of Artificial Sequence: Synthetic oligonucleotide
tactattatcacgcccgggtctatgagttcctg

SEQ ID NO: 139176 - DNA, 32 bp, Artificial Sequence
  Description of Artificial Sequence: Synthetic oligonucleotide
actattatcacgcccgggtctatgagttcctg

SEQ ID NO: 139177 - DNA, 31 bp, Artificial Sequence
  Description of Artificial Sequence: Synthetic oligonucleotide
ctattatcacgcccgggtctatgagttcctg

SEQ ID NO: 139178 - DNA, 31 bp, Artificial Sequence
  Description of Artificial Sequence: Synthetic oligonucleotide
tattatcacgcccgggtctatgagttcctgg

SEQ ID NO: 139179 - DNA, 30 bp, Artificial Sequence
  Description of Artificial Sequence: Synthetic oligonucleotide
attatcacgcccgggtctatgagttcctgg

SEQ ID NO: 139180 - DNA, 29 bp, Artificial Sequence
  Description of Artificial Sequence: Synthetic oligonucleotide
ttatcacgcccgggtctatgagttcctgg

SEQ ID NO: 139181 - DNA, 28 bp, Artificial Sequence
  Description of Artificial Sequence: Synthetic oligonucleotide
tatcacgcccgggtctatgagttcctgg

SEQ ID NO: 139182 - DNA, 27 bp, Artificial Sequence
  Description of Artificial Sequence: Synthetic oligonucleotide
atcacgcccgggtctatgagttcctgg

SEQ ID NO: 139183 - DNA, 27 bp, Artificial Sequence
  Description of Artificial Sequence: Synthetic oligonucleotide
tcacgcccgggtctatgagttcctgga

SEQ ID NO: 139184 - DNA, 26 bp, Artificial Sequence
  Description of Artificial Sequence: Synthetic oligonucleotide
cacgcccgggtctatgagttcctgga

SEQ ID NO: 139185 - DNA, 27 bp, Artificial Sequence
  Description of Artificial Sequence: Synthetic oligonucleotide
acgcccgggtctatgagttcctggaca

SEQ ID NO: 139186 - DNA, 27 bp, Artificial Sequence
  Description of Artificial Sequence: Synthetic oligonucleotide
cgcccgggtctatgagttcctggacaa

SEQ ID NO: 139187 - DNA, 27 bp, Artificial Sequence
  Description of Artificial Sequence: Synthetic oligonucleotide
gcccgggtctatgagttcctggacaag

SEQ ID NO: 139188 - DNA, 27 bp, Artificial Sequence
  Description of Artificial Sequence: Synthetic oligonucleotide
cccgggtctatgagttcctggacaagc

SEQ ID NO: 139189 - DNA, 28 bp, Artificial Sequence
  Description of Artificial Sequence: Synthetic oligonucleotide
ccgggtctatgagttcctggacaagctg

SEQ ID NO: 139190 - DNA, 28 bp, Artificial Sequence
  Description of Artificial Sequence: Synthetic oligonucleotide
cgggtctatgagttcctggacaagctgg

SEQ ID NO: 139191 - DNA, 30 bp, Artificial Sequence
  Description of Artificial Sequence: Synthetic oligonucleotide
gggtctatgagttcctggacaagctggatg

SEQ ID NO: 139192 - DNA, 31 bp, Artificial Sequence
  Description of Artificial Sequence: Synthetic oligonucleotide
ggtctatgagttcctggacaagctggatgtg

SEQ ID NO: 139193 - DNA, 31 bp, Artificial Sequence
  Description of Artificial Sequence: Synthetic oligonucleotide
gtctatgagttcctggacaagctggatgtgg

SEQ ID NO: 139194 - DNA, 32 bp, Artificial Sequence
  Description of Artificial Sequence: Synthetic oligonucleotide
tctatgagttcctggacaagctggatgtggtg

SEQ ID NO: 139195 - DNA, 31 bp, Artificial Sequence
  Description of Artificial Sequence: Synthetic oligonucleotide
ctatgagttcctggacaagctggatgtggtg

SEQ ID NO: 139196 - DNA, 31 bp, Artificial Sequence
  Description of Artificial Sequence: Synthetic oligonucleotide
tatgagttcctggacaagctggatgtggtgc

SEQ ID NO: 139197 - DNA, 30 bp, Artificial Sequence
  Description of Artificial Sequence: Synthetic oligonucleotide
atgagttcctggacaagctggatgtggtgc

SEQ ID NO: 139198 - DNA, 29 bp, Artificial Sequence
  Description of Artificial Sequence: Synthetic oligonucleotide
tgagttcctggacaagctggatgtggtgc

SEQ ID NO: 139199 - DNA, 28 bp, Artificial Sequence
  Description of Artificial Sequence: Synthetic oligonucleotide
gagttcctggacaagctggatgtggtgc

SEQ ID NO: 139200 - DNA, 28 bp, Artificial Sequence
  Description of Artificial Sequence: Synthetic oligonucleotide
agttcctggacaagctggatgtggtgcg

SEQ ID NO: 139201 - DNA, 27 bp, Artificial Sequence
  Description of Artificial Sequence: Synthetic oligonucleotide
gttcctggacaagctggatgtggtgcg

SEQ ID NO: 139202 - DNA, 27 bp, Artificial Sequence
  Description of Artificial Sequence: Synthetic oligonucleotide
ttcctggacaagctggatgtggtgcgc

SEQ ID NO: 139203 - DNA, 27 bp, Artificial Sequence
  Description of Artificial Sequence: Synthetic oligonucleotide
tcctggacaagctggatgtggtgcgca

SEQ ID NO: 139204 - DNA, 26 bp, Artificial Sequence
  Description of Artificial Sequence: Synthetic oligonucleotide
cctggacaagctggatgtggtgcgca

SEQ ID NO: 139205 - DNA, 26 bp, Artificial Sequence
  Description of Artificial Sequence: Synthetic oligonucleotide
ctggacaagctggatgtggtgcgcag

SEQ ID NO: 139206 - DNA, 27 bp, Artificial Sequence
  Description of Artificial Sequence: Synthetic oligonucleotide
tggacaagctggatgtggtgcgcagct

SEQ ID NO: 139207 - DNA, 27 bp, Artificial Sequence
  Description of Artificial Sequence: Synthetic oligonucleotide
ggacaagctggatgtggtgcgcagctt

SEQ ID NO: 139208 - DNA, 27 bp, Artificial Sequence
  Description of Artificial Sequence: Synthetic oligonucleotide
gacaagctggatgtggtgcgcagcttc

SEQ ID NO: 139209 - DNA, 29 bp, Artificial Sequence
  Description of Artificial Sequence: Synthetic oligonucleotide
acaagctggatgtggtgcgcagcttcttg

SEQ ID NO: 139210 - DNA, 28 bp, Artificial Sequence
  Description of Artificial Sequence: Synthetic oligonucleotide
caagctggatgtggtgcgcagcttcttg

SEQ ID NO: 139211 - DNA, 28 bp, Artificial Sequence
  Description of Artificial Sequence: Synthetic oligonucleotide
aagctggatgtggtgcgcagcttcttgc

SEQ ID NO: 139212 - DNA, 27 bp, Artificial Sequence
  Description of Artificial Sequence: Synthetic oligonucleotide
agctggatgtggtgcgcagcttcttgc

SEQ ID NO: 139213 - DNA, 27 bp, Artificial Sequence
  Description of Artificial Sequence: Synthetic oligonucleotide
gctggatgtggtgcgcagcttcttgca

SEQ ID NO: 139214 - DNA, 28 bp, Artificial Sequence
  Description of Artificial Sequence: Synthetic oligonucleotide
ctggatgtggtgcgcagcttcttgcatg

SEQ ID NO: 139215 - DNA, 28 bp, Artificial Sequence
  Description of Artificial Sequence: Synthetic oligonucleotide
tggatgtggtgcgcagcttcttgcatgc

SEQ ID NO: 139216 - DNA, 27 bp, Artificial Sequence
  Description of Artificial Sequence: Synthetic oligonucleotide
ggatgtggtgcgcagcttcttgcatgc

SEQ ID NO: 139217 - DNA, 28 bp, Artificial Sequence
  Description of Artificial Sequence: Synthetic oligonucleotide
gatgtggtgcgcagcttcttgcatgctc

SEQ ID NO: 139218 - DNA, 28 bp, Artificial Sequence
  Description of Artificial Sequence: Synthetic oligonucleotide
atgtggtgcgcagcttcttgcatgctcg

SEQ ID NO: 139219 - DNA, 27 bp, Artificial Sequence
  Description of Artificial Sequence: Synthetic oligonucleotide
tgtggtgcgcagcttcttgcatgctcg

SEQ ID NO: 139220 - DNA, 26 bp, Artificial Sequence
  Description of Artificial Sequence: Synthetic oligonucleotide
gtggtgcgcagcttcttgcatgctcg

SEQ ID NO: 139221 - DNA, 26 bp, Artificial Sequence
  Description of Artificial Sequence: Synthetic oligonucleotide
tggtgcgcagcttcttgcatgctcgg

SEQ ID NO: 139222 - DNA, 25 bp, Artificial Sequence
  Description of Artificial Sequence: Synthetic oligonucleotide
ggtgcgcagcttcttgcatgctcgg

SEQ ID NO: 139223 - DNA, 26 bp, Artificial Sequence
  Description of Artificial Sequence: Synthetic oligonucleotide
gtgcgcagcttcttgcatgctcggct

SEQ ID NO: 139224 - DNA, 26 bp, Artificial Sequence
  Description of Artificial Sequence: Synthetic oligonucleotide
tgcgcagcttcttgcatgctcggctc

SEQ ID NO: 139225 - DNA, 25 bp, Artificial Sequence
  Description of Artificial Sequence: Synthetic oligonucleotide
gcgcagcttcttgcatgctcggctc

SEQ ID NO: 139226 - DNA, 25 bp, Artificial Sequence
  Description of Artificial Sequence: Synthetic oligonucleotide
cgcagcttcttgcatgctcggctcc

SEQ ID NO: 139227 - DNA, 25 bp, Artificial Sequence
  Description of Artificial Sequence: Synthetic oligonucleotide
gcagcttcttgcatgctcggctccg

SEQ ID NO: 139228 - DNA, 26 bp, Artificial Sequence
  Description of Artificial Sequence: Synthetic oligonucleotide
cagcttcttgcatgctcggctccgga

SEQ ID NO: 139229 - DNA, 27 bp, Artificial Sequence
  Description of Artificial Sequence: Synthetic oligonucleotide
agcttcttgcatgctcggctccggaca

SEQ ID NO: 139230 - DNA, 26 bp, Artificial Sequence
  Description of Artificial Sequence: Synthetic oligonucleotide
gcttcttgcatgctcggctccggaca

SEQ ID NO: 139231 - DNA, 26 bp, Artificial Sequence
  Description of Artificial Sequence: Synthetic oligonucleotide
cttcttgcatgctcggctccggacag

SEQ ID NO: 139232 - DNA, 27 bp, Artificial Sequence
  Description of Artificial Sequence: Synthetic oligonucleotide
ttcttgcatgctcggctccggacagct

SEQ ID NO: 139233 - DNA, 27 bp, Artificial Sequence
  Description of Artificial Sequence: Synthetic oligonucleotide
tcttgcatgctcggctccggacagcta

SEQ ID NO: 139234 - DNA, 26 bp, Artificial Sequence
  Description of Artificial Sequence: Synthetic oligonucleotide
cttgcatgctcggctccggacagcta

SEQ ID NO: 139235 - DNA, 26 bp, Artificial Sequence
  Description of Artificial Sequence: Synthetic oligonucleotide
ttgcatgctcggctccggacagctac

SEQ ID NO: 139236 - DNA, 25 bp, Artificial Sequence
  Description of Artificial Sequence: Synthetic oligonucleotide
tgcatgctcggctccggacagctac

SEQ ID NO: 139237 - DNA, 24 bp, Artificial Sequence
  Description of Artificial Sequence: Synthetic oligonucleotide
gcatgctcggctccggacagctac

SEQ ID NO: 139238 - DNA, 24 bp, Artificial Sequence
  Description of Artificial Sequence: Synthetic oligonucleotide
catgctcggctccggacagctacg

SEQ ID NO: 139239 - DNA, 26 bp, Artificial Sequence
  Description of Artificial Sequence: Synthetic oligonucleotide
atgctcggctccggacagctacgctt

SEQ ID NO: 139240 - DNA, 25 bp, Artificial Sequence
  Description of Artificial Sequence: Synthetic oligonucleotide
tgctcggctccggacagctacgctt

SEQ ID NO: 139241 - DNA, 24 bp, Artificial Sequence
  Description of Artificial Sequence: Synthetic oligonucleotide
gctcggctccggacagctacgctt

SEQ ID NO: 139242 - DNA, 24 bp, Artificial Sequence
  Description of Artificial Sequence: Synthetic oligonucleotide
ctcggctccggacagctacgcttc

SEQ ID NO: 139243 - DNA, 24 bp, Artificial Sequence
  Description of Artificial Sequence: Synthetic oligonucleotide
tcggctccggacagctacgcttcg

SEQ ID NO: 139244 - DNA, 23 bp, Artificial Sequence
  Description of Artificial Sequence: Synthetic oligonucleotide
cggctccggacagctacgcttcg

SEQ ID NO: 139245 - DNA, 23 bp, Artificial Sequence
  Description of Artificial Sequence: Synthetic oligonucleotide
ggctccggacagctacgcttcgg

SEQ ID NO: 139246 - DNA, 25 bp, Artificial Sequence
  Description of Artificial Sequence: Synthetic oligonucleotide
gctccggacagctacgcttcggcat

SEQ ID NO: 139247 - DNA, 26 bp, Artificial Sequence
  Description of Artificial Sequence: Synthetic oligonucleotide
ctccggacagctacgcttcggcatga

SEQ ID NO: 139248 - DNA, 26 bp, Artificial Sequence
  Description of Artificial Sequence: Synthetic oligonucleotide
tccggacagctacgcttcggcatgac

SEQ ID NO: 139249 - DNA, 25 bp, Artificial Sequence
  Description of Artificial Sequence: Synthetic oligonucleotide
ccggacagctacgcttcggcatgac

SEQ ID NO: 139250 - DNA, 25 bp, Artificial Sequence
  Description of Artificial Sequence: Synthetic oligonucleotide
cggacagctacgcttcggcatgacg

SEQ ID NO: 139251 - DNA, 26 bp, Artificial Sequence
  Description of Artificial Sequence: Synthetic oligonucleotide
ggacagctacgcttcggcatgacgca

SEQ ID NO: 139252 - DNA, 27 bp, Artificial Sequence
  Description of Artificial Sequence: Synthetic oligonucleotide
gacagctacgcttcggcatgacgcaga

SEQ ID NO: 139253 - DNA, 27 bp, Artificial Sequence
  Description of Artificial Sequence: Synthetic oligonucleotide
acagctacgcttcggcatgacgcagac

SEQ ID NO: 139254 - DNA, 26 bp, Artificial Sequence
  Description of Artificial Sequence: Synthetic oligonucleotide
cagctacgcttcggcatgacgcagac

SEQ ID NO: 139255 - DNA, 26 bp, Artificial Sequence
  Description of Artificial Sequence: Synthetic oligonucleotide
agctacgcttcggcatgacgcagacg

SEQ ID NO: 139256 - DNA, 25 bp, Artificial Sequence
  Description of Artificial Sequence: Synthetic oligonucleotide
gctacgcttcggcatgacgcagacg

SEQ ID NO: 139257 - DNA, 25 bp, Artificial Sequence
  Description of Artificial Sequence: Synthetic oligonucleotide
ctacgcttcggcatgacgcagacgg

SEQ ID NO: 139258 - DNA, 25 bp, Artificial Sequence
  Description of Artificial Sequence: Synthetic oligonucleotide
tacgcttcggcatgacgcagacggg

SEQ ID NO: 139259 - DNA, 24 bp, Artificial Sequence
  Description of Artificial Sequence: Synthetic oligonucleotide
acgcttcggcatgacgcagacggg

SEQ ID NO: 139260 - DNA, 23 bp, Artificial Sequence
  Description of Artificial Sequence: Synthetic oligonucleotide
cgcttcggcatgacgcagacggg

SEQ ID NO: 139261 - DNA, 24 bp, Artificial Sequence
  Description of Artificial Sequence: Synthetic oligonucleotide
gcttcggcatgacgcagacgggca

SEQ ID NO: 139262 - DNA, 24 bp, Artificial Sequence
  Description of Artificial Sequence: Synthetic oligonucleotide
cttcggcatgacgcagacgggcag

SEQ ID NO: 139263 - DNA, 24 bp, Artificial Sequence
  Description of Artificial Sequence: Synthetic oligonucleotide
ttcggcatgacgcagacgggcagg

SEQ ID NO: 139264 - DNA, 23 bp, Artificial Sequence
  Description of Artificial Sequence: Synthetic oligonucleotide
tcggcatgacgcagacgggcagg

SEQ ID NO: 139265 - DNA, 22 bp, Artificial Sequence
  Description of Artificial Sequence: Synthetic oligonucleotide
cggcatgacgcagacgggcagg

SEQ ID NO: 139266 - DNA, 22 bp, Artificial Sequence
  Description of Artificial Sequence: Synthetic oligonucleotide
ggcatgacgcagacgggcaggc

SEQ ID NO: 139267 - DNA, 23 bp, Artificial Sequence
  Description of Artificial Sequence: Synthetic oligonucleotide
gcatgacgcagacgggcaggcca

SEQ ID NO: 139268 - DNA, 23 bp, Artificial Sequence
  Description of Artificial Sequence: Synthetic oligonucleotide
catgacgcagacgggcaggccac

SEQ ID NO: 139269 - DNA, 23 bp, Artificial Sequence
  Description of Artificial Sequence: Synthetic oligonucleotide
atgacgcagacgggcaggccacc

SEQ ID NO: 139270 - DNA, 22 bp, Artificial Sequence
  Description of Artificial Sequence: Synthetic oligonucleotide
tgacgcagacgggcaggccacc

SEQ ID NO: 139271 - DNA, 21 bp, Artificial Sequence
  Description of Artificial Sequence: Synthetic oligonucleotide
gacgcagacgggcaggccacc

SEQ ID NO: 139272 - DNA, 22 bp, Artificial Sequence
  Description of Artificial Sequence: Synthetic oligonucleotide
acgcagacgggcaggccaccct

SEQ ID NO: 139273 - DNA, 21 bp, Artificial Sequence
  Description of Artificial Sequence: Synthetic oligonucleotide
cgcagacgggcaggccaccct

SEQ ID NO: 139274 - DNA, 23 bp, Artificial Sequence
  Description of Artificial Sequence: Synthetic oligonucleotide
gcagacgggcaggccaccctgtt

SEQ ID NO: 139275 - DNA, 25 bp, Artificial Sequence
  Description of Artificial Sequence: Synthetic oligonucleotide
cagacgggcaggccaccctgttgaa

SEQ ID NO: 139276 - DNA, 25 bp, Artificial Sequence
  Description of Artificial Sequence: Synthetic oligonucleotide
agacgggcaggccaccctgttgaac

SEQ ID NO: 139277 - DNA, 24 bp, Artificial Sequence
  Description of Artificial Sequence: Synthetic oligonucleotide
gacgggcaggccaccctgttgaac

SEQ ID NO: 139278 - DNA, 25 bp, Artificial Sequence
  Description of Artificial Sequence: Synthetic oligonucleotide
acgggcaggccaccctgttgaacct

SEQ ID NO: 139279 - DNA, 24 bp, Artificial Sequence
  Description of Artificial Sequence: Synthetic oligonucleotide
cgggcaggccaccctgttgaacct

SEQ ID NO: 139280 - DNA, 24 bp, Artificial Sequence
  Description of Artificial Sequence: Synthetic oligonucleotide
gggcaggccaccctgttgaacctc

SEQ ID NO: 139281 - DNA, 25 bp, Artificial Sequence
  Description of Artificial Sequence: Synthetic oligonucleotide
ggcaggccaccctgttgaacctcct

SEQ ID NO: 139282 - DNA, 25 bp, Artificial Sequence
  Description of Artificial Sequence: Synthetic oligonucleotide
gcaggccaccctgttgaacctcctg

SEQ ID NO: 139283 - DNA, 26 bp, Artificial Sequence
  Description of Artificial Sequence: Synthetic oligonucleotide
caggccaccctgttgaacctcctgct

SEQ ID NO: 139284 - DNA, 26 bp, Artificial Sequence
  Description of Artificial Sequence: Synthetic oligonucleotide
aggccaccctgttgaacctcctgctg

SEQ ID NO: 139285 - DNA, 25 bp, Artificial Sequence
  Description of Artificial Sequence: Synthetic oligonucleotide
ggccaccctgttgaacctcctgctg

SEQ ID NO: 139286 - DNA, 25 bp, Artificial Sequence
  Description of Artificial Sequence: Synthetic oligonucleotide
gccaccctgttgaacctcctgctgc

SEQ ID NO: 139287 - DNA, 25 bp, Artificial Sequence
  Description of Artificial Sequence: Synthetic oligonucleotide
ccaccctgttgaacctcctgctgcg

SEQ ID NO: 139288 - DNA, 27 bp, Artificial Sequence
  Description of Artificial Sequence: Synthetic oligonucleotide
caccctgttgaacctcctgctgcggaa

SEQ ID NO: 139289 - DNA, 30 bp, Artificial Sequence
  Description of Artificial Sequence: Synthetic oligonucleotide
accctgttgaacctcctgctgcggaattac

SEQ ID NO: 139290 - DNA, 29 bp, Artificial Sequence
  Description of Artificial Sequence: Synthetic oligonucleotide
ccctgttgaacctcctgctgcggaattac

SEQ ID NO: 139291 - DNA, 29 bp, Artificial Sequence
  Description of Artificial Sequence: Synthetic oligonucleotide
cctgttgaacctcctgctgcggaattacc

SEQ ID NO: 139292 - DNA, 31 bp, Artificial Sequence
  Description of Artificial Sequence: Synthetic oligonucleotide
ctgttgaacctcctgctgcggaattacctac

SEQ ID NO: 139293 - DNA, 32 bp, Artificial Sequence
  Description of Artificial Sequence: Synthetic oligonucleotide
tgttgaacctcctgctgcggaattacctacac

SEQ ID NO: 139294 - DNA, 31 bp, Artificial Sequence
  Description of Artificial Sequence: Synthetic oligonucleotide
gttgaacctcctgctgcggaattacctacac

SEQ ID NO: 139295 - DNA, 33 bp, Artificial Sequence
  Description of Artificial Sequence: Synthetic oligonucleotide
ttgaacctcctgctgcggaattacctacactac

SEQ ID NO: 139296 - DNA, 32 bp, Artificial Sequence
  Description of Artificial Sequence: Synthetic oligonucleotide
tgaacctcctgctgcggaattacctacactac

SEQ ID NO: 139297 - DNA, 31 bp, Artificial Sequence
  Description of Artificial Sequence: Synthetic oligonucleotide
gaacctcctgctgcggaattacctacactac

SEQ ID NO: 139298 - DNA, 32 bp, Artificial Sequence
  Description of Artificial Sequence: Synthetic oligonucleotide
aacctcctgctgcggaattacctacactacag

SEQ ID NO: 139299 - DNA, 31 bp, Artificial Sequence
  Description of Artificial Sequence: Synthetic oligonucleotide
acctcctgctgcggaattacctacactacag

SEQ ID NO: 139300 - DNA, 30 bp, Artificial Sequence
  Description of Artificial Sequence: Synthetic oligonucleotide
cctcctgctgcggaattacctacactacag

SEQ ID NO: 139301 - DNA, 30 bp, Artificial Sequence
  Description of Artificial Sequence: Synthetic oligonucleotide
ctcctgctgcggaattacctacactacagc

SEQ ID NO: 139302 - DNA, 32 bp, Artificial Sequence
  Description of Artificial Sequence: Synthetic oligonucleotide
tcctgctgcggaattacctacactacagcttg

SEQ ID NO: 139303 - DNA, 31 bp, Artificial Sequence
  Description of Artificial Sequence: Synthetic oligonucleotide
cctgctgcggaattacctacactacagcttg

SEQ ID NO: 139304 - DNA, 33 bp, Artificial Sequence
  Description of Artificial Sequence: Synthetic oligonucleotide
ctgctgcggaattacctacactacagcttgtac

SEQ ID NO: 139305 - DNA, 33 bp, Artificial Sequence
  Description of Artificial Sequence: Synthetic oligonucleotide
tgctgcggaattacctacactacagcttgtacg

SEQ ID NO: 139306 - DNA, 32 bp, Artificial Sequence
  Description of Artificial Sequence: Synthetic oligonucleotide
gctgcggaattacctacactacagcttgtacg

SEQ ID NO: 139307 - DNA, 33 bp, Artificial Sequence
  Description of Artificial Sequence: Synthetic oligonucleotide
ctgcggaattacctacactacagcttgtacgac

SEQ ID NO: 139308 - DNA, 33 bp, Artificial Sequence
  Description of Artificial Sequence: Synthetic oligonucleotide
tgcggaattacctacactacagcttgtacgacc

SEQ ID NO: 139309 - DNA, 32 bp, Artificial Sequence
  Description of Artificial Sequence: Synthetic oligonucleotide
gcggaattacctacactacagcttgtacgacc

SEQ ID NO: 139310 - DNA, 33 bp, Artificial Sequence
  Description of Artificial Sequence: Synthetic oligonucleotide
cggaattacctacactacagcttgtacgaccag

SEQ ID NO: 139311 - DNA, 33 bp, Artificial Sequence
  Description of Artificial Sequence: Synthetic oligonucleotide
ggaattacctacactacagcttgtacgaccagg

SEQ ID NO: 139312 - DNA, 33 bp, Artificial Sequence
  Description of Artificial Sequence: Synthetic oligonucleotide
gaattacctacactacagcttgtacgaccaggc

SEQ ID NO: 139313 - DNA, 34 bp, Artificial Sequence
  Description of Artificial Sequence: Synthetic oligonucleotide
aattacctacactacagcttgtacgaccaggctg

SEQ ID NO: 139314 - DNA, 33 bp, Artificial Sequence
  Description of Artificial Sequence: Synthetic oligonucleotide
attacctacactacagcttgtacgaccaggctg

SEQ ID NO: 139315 - DNA, 32 bp, Artificial Sequence
  Description of Artificial Sequence: Synthetic oligonucleotide
ttacctacactacagcttgtacgaccaggctg

SEQ ID NO: 139316 - DNA, 31 bp, Artificial Sequence
  Description of Artificial Sequence: Synthetic oligonucleotide
tacctacactacagcttgtacgaccaggctg

SEQ ID NO: 139317 - DNA, 30 bp, Artificial Sequence
  Description of Artificial Sequence: Synthetic oligonucleotide
acctacactacagcttgtacgaccaggctg

SEQ ID NO: 139318 - DNA, 29 bp, Artificial Sequence
  Description of Artificial Sequence: Synthetic oligonucleotide
cctacactacagcttgtacgaccaggctg

SEQ ID NO: 139319 - DNA, 30 bp, Artificial Sequence
  Description of Artificial Sequence: Synthetic oligonucleotide
ctacactacagcttgtacgaccaggctgag

SEQ ID NO: 139320 - DNA, 32 bp, Artificial Sequence
  Description of Artificial Sequence: Synthetic oligonucleotide
tacactacagcttgtacgaccaggctgagaag

SEQ ID NO: 139321 - DNA, 31 bp, Artificial Sequence
  Description of Artificial Sequence: Synthetic oligonucleotide
acactacagcttgtacgaccaggctgagaag

SEQ ID NO: 139322 - DNA, 30 bp, Artificial Sequence
  Description of Artificial Sequence: Synthetic oligonucleotide
cactacagcttgtacgaccaggctgagaag

SEQ ID NO: 139323 - DNA, 30 bp, Artificial Sequence
  Description of Artificial Sequence: Synthetic oligonucleotide
actacagcttgtacgaccaggctgagaagc

SEQ ID NO: 139324 - DNA, 29 bp, Artificial Sequence
  Description of Artificial Sequence: Synthetic oligonucleotide
ctacagcttgtacgaccaggctgagaagc

SEQ ID NO: 139325 - DNA, 30 bp, Artificial Sequence
  Description of Artificial Sequence: Synthetic oligonucleotide
tacagcttgtacgaccaggctgagaagctg

SEQ ID NO: 139326 - DNA, 29 bp, Artificial Sequence
  Description of Artificial Sequence: Synthetic oligonucleotide
acagcttgtacgaccaggctgagaagctg

SEQ ID NO: 139327 - DNA, 28 bp, Artificial Sequence
  Description of Artificial Sequence: Synthetic oligonucleotide
cagcttgtacgaccaggctgagaagctg

SEQ ID NO: 139328 - DNA, 28 bp, Artificial Sequence
  Description of Artificial Sequence: Synthetic oligonucleotide
agcttgtacgaccaggctgagaagctgg

SEQ ID NO: 139329 - DNA, 27 bp, Artificial Sequence
  Description of Artificial Sequence: Synthetic oligonucleotide
gcttgtacgaccaggctgagaagctgg

SEQ ID NO: 139330 - DNA, 28 bp, Artificial Sequence
  Description of Artificial Sequence: Synthetic oligonucleotide
cttgtacgaccaggctgagaagctggtg

SEQ ID NO: 139331 - DNA, 29 bp, Artificial Sequence
  Description of Artificial Sequence: Synthetic oligonucleotide
ttgtacgaccaggctgagaagctggtgtc

SEQ ID NO: 139332 - DNA, 28 bp, Artificial Sequence
  Description of Artificial Sequence: Synthetic oligonucleotide
tgtacgaccaggctgagaagctggtgtc

SEQ ID NO: 139333 - DNA, 27 bp, Artificial Sequence
  Description of Artificial Sequence: Synthetic oligonucleotide
gtacgaccaggctgagaagctggtgtc

SEQ ID NO: 139334 - DNA, 27 bp, Artificial Sequence
  Description of Artificial Sequence: Synthetic oligonucleotide
tacgaccaggctgagaagctggtgtcc

SEQ ID NO: 139335 - DNA, 27 bp, Artificial Sequence
  Description of Artificial Sequence: Synthetic oligonucleotide
acgaccaggctgagaagctggtgtcca

SEQ ID NO: 139336 - DNA, 27 bp, Artificial Sequence
  Description of Artificial Sequence: Synthetic oligonucleotide
cgaccaggctgagaagctggtgtccaa

SEQ ID NO: 139337 - DNA, 27 bp, Artificial Sequence
  Description of Artificial Sequence: Synthetic oligonucleotide
gaccaggctgagaagctggtgtccaag

SEQ ID NO: 139338 - DNA, 28 bp, Artificial Sequence
  Description of Artificial Sequence: Synthetic oligonucleotide
accaggctgagaagctggtgtccaagtc

SEQ ID NO: 139339 - DNA, 27 bp, Artificial Sequence
  Description of Artificial Sequence: Synthetic oligonucleotide
ccaggctgagaagctggtgtccaagtc

SEQ ID NO: 139340 - DNA, 28 bp, Artificial Sequence
  Description of Artificial Sequence: Synthetic oligonucleotide
caggctgagaagctggtgtccaagtctg

SEQ ID NO: 139341 - DNA, 29 bp, Artificial Sequence
  Description of Artificial Sequence: Synthetic oligonucleotide
aggctgagaagctggtgtccaagtctgtg

SEQ ID NO: 139342 - DNA, 28 bp, Artificial Sequence
  Description of Artificial Sequence: Synthetic oligonucleotide
ggctgagaagctggtgtccaagtctgtg

SEQ ID NO: 139343 - DNA, 30 bp, Artificial Sequence
  Description of Artificial Sequence: Synthetic oligonucleotide
gctgagaagctggtgtccaagtctgtgttc

SEQ ID NO: 139344 - DNA, 30 bp, Artificial Sequence
  Description of Artificial Sequence: Synthetic oligonucleotide
ctgagaagctggtgtccaagtctgtgttcc

SEQ ID NO: 139345 - DNA, 30 bp, Artificial Sequence
  Description of Artificial Sequence: Synthetic oligonucleotide
tgagaagctggtgtccaagtctgtgttccc

SEQ ID NO: 139346 - DNA, 29 bp, Artificial Sequence
  Description of Artificial Sequence: Synthetic oligonucleotide
gagaagctggtgtccaagtctgtgttccc

SEQ ID NO: 139347 - DNA, 30 bp, Artificial Sequence
  Description of Artificial Sequence: Synthetic oligonucleotide
agaagctggtgtccaagtctgtgttcccag

SEQ ID NO: 139348 - DNA, 29 bp, Artificial Sequence
  Description of Artificial Sequence: Synthetic oligonucleotide
gaagctggtgtccaagtctgtgttcccag

SEQ ID NO: 139349 - DNA, 30 bp, Artificial Sequence
  Description of Artificial Sequence: Synthetic oligonucleotide
aagctggtgtccaagtctgtgttcccagag

SEQ ID NO: 139350 - DNA, 29 bp, Artificial Sequence
  Description of Artificial Sequence: Synthetic oligonucleotide
agctggtgtccaagtctgtgttcccagag

SEQ ID NO: 139351 - DNA, 28 bp, Artificial Sequence
  Description of Artificial Sequence: Synthetic oligonucleotide
gctggtgtccaagtctgtgttcccagag

SEQ ID NO: 139352 - DNA, 28 bp, Artificial Sequence
  Description of Artificial Sequence: Synthetic oligonucleotide
ctggtgtccaagtctgtgttcccagagc

SEQ ID NO: 139353 - DNA, 29 bp, Artificial Sequence
  Description of Artificial Sequence: Synthetic oligonucleotide
tggtgtccaagtctgtgttcccagagcag

SEQ ID NO: 139354 - DNA, 28 bp, Artificial Sequence
  Description of Artificial Sequence: Synthetic oligonucleotide
ggtgtccaagtctgtgttcccagagcag

SEQ ID NO: 139355 - DNA, 28 bp, Artificial Sequence
  Description of Artificial Sequence: Synthetic oligonucleotide
gtgtccaagtctgtgttcccagagcagg

SEQ ID NO: 139356 - DNA, 28 bp, Artificial Sequence
  Description of Artificial Sequence: Synthetic oligonucleotide
tgtccaagtctgtgttcccagagcaggc

SEQ ID NO: 139357 - DNA, 27 bp, Artificial Sequence
  Description of Artificial Sequence: Synthetic oligonucleotide
gtccaagtctgtgttcccagagcaggc

SEQ ID NO: 139358 - DNA, 27 bp, Artificial Sequence
  Description of Artificial Sequence: Synthetic oligonucleotide
tccaagtctgtgttcccagagcaggcc

SEQ ID NO: 139359 - DNA, 27 bp, Artificial Sequence
  Description of Artificial Sequence: Synthetic oligonucleotide
ccaagtctgtgttcccagagcaggcca

SEQ ID NO: 139360 - DNA, 28 bp, Artificial Sequence
  Description of Artificial Sequence: Synthetic oligonucleotide
caagtctgtgttcccagagcaggccaac

SEQ ID NO: 139361 - DNA, 30 bp, Artificial Sequence
  Description of Artificial Sequence: Synthetic oligonucleotide
aagtctgtgttcccagagcaggccaacaac

SEQ ID NO: 139362 - DNA, 29 bp, Artificial Sequence
  Description of Artificial Sequence: Synthetic oligonucleotide
agtctgtgttcccagagcaggccaacaac

SEQ ID NO: 139363 - DNA, 28 bp, Artificial Sequence
  Description of Artificial Sequence: Synthetic oligonucleotide
gtctgtgttcccagagcaggccaacaac

SEQ ID NO: 139364 - DNA, 31 bp, Artificial Sequence
  Description of Artificial Sequence: Synthetic oligonucleotide
tctgtgttcccagagcaggccaacaacaatg

SEQ ID NO: 139365 - DNA, 30 bp, Artificial Sequence
  Description of Artificial Sequence: Synthetic oligonucleotide
ctgtgttcccagagcaggccaacaacaatg

SEQ ID NO: 139366 - DNA, 31 bp, Artificial Sequence
  Description of Artificial Sequence: Synthetic oligonucleotide
tgtgttcccagagcaggccaacaacaatgag

SEQ ID NO: 139367 - DNA, 30 bp, Artificial Sequence
  Description of Artificial Sequence: Synthetic oligonucleotide
gtgttcccagagcaggccaacaacaatgag

SEQ ID NO: 139368 - DNA, 31 bp, Artificial Sequence
  Description of Artificial Sequence: Synthetic oligonucleotide
tgttcccagagcaggccaacaacaatgagtg

SEQ ID NO: 139369 - DNA, 30 bp, Artificial Sequence
  Description of Artificial Sequence: Synthetic oligonucleotide
gttcccagagcaggccaacaacaatgagtg

SEQ ID NO: 139370 - DNA, 30 bp, Artificial Sequence
  Description of Artificial Sequence: Synthetic oligonucleotide
ttcccagagcaggccaacaacaatgagtgg

SEQ ID NO: 139371 - DNA, 29 bp, Artificial Sequence
  Description of Artificial Sequence: Synthetic oligonucleotide
tcccagagcaggccaacaacaatgagtgg

SEQ ID NO: 139372 - DNA, 28 bp, Artificial Sequence
  Description of Artificial Sequence: Synthetic oligonucleotide
cccagagcaggccaacaacaatgagtgg

SEQ ID NO: 139373 - DNA, 28 bp, Artificial Sequence
  Description of Artificial Sequence: Synthetic oligonucleotide
ccagagcaggccaacaacaatgagtggg

SEQ ID NO: 139374 - DNA, 28 bp, Artificial Sequence
  Description of Artificial Sequence: Synthetic oligonucleotide
cagagcaggccaacaacaatgagtgggc

SEQ ID NO: 139375 - DNA, 28 bp, Artificial Sequence
  Description of Artificial Sequence: Synthetic oligonucleotide
agagcaggccaacaacaatgagtgggcc

SEQ ID NO: 139376 - DNA, 27 bp, Artificial Sequence
  Description of Artificial Sequence: Synthetic oligonucleotide
gagcaggccaacaacaatgagtgggcc

SEQ ID NO: 139377 - DNA, 28 bp, Artificial Sequence
  Description of Artificial Sequence: Synthetic oligonucleotide
agcaggccaacaacaatgagtgggccag

SEQ ID NO: 139378 - DNA, 27 bp, Artificial Sequence
  Description of Artificial Sequence: Synthetic oligonucleotide
gcaggccaacaacaatgagtgggccag

SEQ ID NO: 139379 - DNA, 27 bp, Artificial Sequence
  Description of Artificial Sequence: Synthetic oligonucleotide
caggccaacaacaatgagtgggccagg

SEQ ID NO: 139380 - DNA, 29 bp, Artificial Sequence
  Description of Artificial Sequence: Synthetic oligonucleotide
aggccaacaacaatgagtgggccaggtac

SEQ ID NO: 139381 - DNA, 28 bp, Artificial Sequence
  Description of Artificial Sequence: Synthetic oligonucleotide
ggccaacaacaatgagtgggccaggtac

SEQ ID NO: 139382 - DNA, 28 bp, Artificial Sequence
  Description of Artificial Sequence: Synthetic oligonucleotide
gccaacaacaatgagtgggccaggtacc

SEQ ID NO: 139383 - DNA, 29 bp, Artificial Sequence
  Description of Artificial Sequence: Synthetic oligonucleotide
ccaacaacaatgagtgggccaggtacctc

SEQ ID NO: 139384 - DNA, 31 bp, Artificial Sequence
  Description of Artificial Sequence: Synthetic oligonucleotide
caacaacaatgagtgggccaggtacctctac

SEQ ID NO: 139385 - DNA, 33 bp, Artificial Sequence
  Description of Artificial Sequence: Synthetic oligonucleotide
aacaacaatgagtgggccaggtacctctactac

SEQ ID NO: 139386 - DNA, 32 bp, Artificial Sequence
  Description of Artificial Sequence: Synthetic oligonucleotide
acaacaatgagtgggccaggtacctctactac

SEQ ID NO: 139387 - DNA, 31 bp, Artificial Sequence
  Description of Artificial Sequence: Synthetic oligonucleotide
caacaatgagtgggccaggtacctctactac

SEQ ID NO: 139388 - DNA, 32 bp, Artificial Sequence
  Description of Artificial Sequence: Synthetic oligonucleotide
aacaatgagtgggccaggtacctctactacac

SEQ ID NO: 139389 - DNA, 31 bp, Artificial Sequence
  Description of Artificial Sequence: Synthetic oligonucleotide
acaatgagtgggccaggtacctctactacac

SEQ ID NO: 139390 - DNA, 30 bp, Artificial Sequence
  Description of Artificial Sequence: Synthetic oligonucleotide
caatgagtgggccaggtacctctactacac

SEQ ID NO: 139391 - DNA, 31 bp, Artificial Sequence
  Description of Artificial Sequence: Synthetic oligonucleotide
aatgagtgggccaggtacctctactacacag

SEQ ID NO: 139392 - DNA, 30 bp, Artificial Sequence
  Description of Artificial Sequence: Synthetic oligonucleotide
atgagtgggccaggtacctctactacacag

SEQ ID NO: 139393 - DNA, 29 bp, Artificial Sequence
  Description of Artificial Sequence: Synthetic oligonucleotide
tgagtgggccaggtacctctactacacag

SEQ ID NO: 139394 - DNA, 28 bp, Artificial Sequence
  Description of Artificial Sequence: Synthetic oligonucleotide
gagtgggccaggtacctctactacacag

SEQ ID NO: 139395 - DNA, 28 bp, Artificial Sequence
  Description of Artificial Sequence: Synthetic oligonucleotide
agtgggccaggtacctctactacacagg

SEQ ID NO: 139396 - DNA, 27 bp, Artificial Sequence
  Description of Artificial Sequence: Synthetic oligonucleotide
gtgggccaggtacctctactacacagg

SEQ ID NO: 139397 - DNA, 27 bp, Artificial Sequence
  Description of Artificial Sequence: Synthetic oligonucleotide
tgggccaggtacctctactacacaggg

SEQ ID NO: 139398 - DNA, 26 bp, Artificial Sequence
  Description of Artificial Sequence: Synthetic oligonucleotide
gggccaggtacctctactacacaggg

SEQ ID NO: 139399 - DNA, 26 bp, Artificial Sequence
  Description of Artificial Sequence: Synthetic oligonucleotide
ggccaggtacctctactacacagggc

SEQ ID NO: 139400 - DNA, 27 bp, Artificial Sequence
  Description of Artificial Sequence: Synthetic oligonucleotide
gccaggtacctctactacacagggcga

SEQ ID NO: 139401 - DNA, 29 bp, Artificial Sequence
  Description of Artificial Sequence: Synthetic oligonucleotide
ccaggtacctctactacacagggcgaatc

SEQ ID NO: 139402 - DNA, 32 bp, Artificial Sequence
  Description of Artificial Sequence: Synthetic oligonucleotide
caggtacctctactacacagggcgaatcaaag

SEQ ID NO: 139403 - DNA, 32 bp, Artificial Sequence
  Description of Artificial Sequence: Synthetic oligonucleotide
aggtacctctactacacagggcgaatcaaagc

SEQ ID NO: 139404 - DNA, 31 bp, Artificial Sequence
  Description of Artificial Sequence: Synthetic oligonucleotide
ggtacctctactacacagggcgaatcaaagc

SEQ ID NO: 139405 - DNA, 31 bp, Artificial Sequence
  Description of Artificial Sequence: Synthetic oligonucleotide
gtacctctactacacagggcgaatcaaagcc

SEQ ID NO: 139406 - DNA, 33 bp, Artificial Sequence
  Description of Artificial Sequence: Synthetic oligonucleotide
tacctctactacacagggcgaatcaaagccatc

SEQ ID NO: 139407 - DNA, 32 bp, Artificial Sequence
  Description of Artificial Sequence: Synthetic oligonucleotide
acctctactacacagggcgaatcaaagccatc

SEQ ID NO: 139408 - DNA, 31 bp, Artificial Sequence
  Description of Artificial Sequence: Synthetic oligonucleotide
cctctactacacagggcgaatcaaagccatc

SEQ ID NO: 139409 - DNA, 31 bp, Artificial Sequence
  Description of Artificial Sequence: Synthetic oligonucleotide
ctctactacacagggcgaatcaaagccatcc

SEQ ID NO: 139410 - DNA, 32 bp, Artificial Sequence
  Description of Artificial Sequence: Synthetic oligonucleotide
tctactacacagggcgaatcaaagccatccag

SEQ ID NO: 139411 - DNA, 31 bp, Artificial Sequence
  Description of Artificial Sequence: Synthetic oligonucleotide
ctactacacagggcgaatcaaagccatccag

SEQ ID NO: 139412 - DNA, 31 bp, Artificial Sequence
  Description of Artificial Sequence: Synthetic oligonucleotide
tactacacagggcgaatcaaagccatccagc

SEQ ID NO: 139413 - DNA, 30 bp, Artificial Sequence
  Description of Artificial Sequence: Synthetic oligonucleotide
actacacagggcgaatcaaagccatccagc

SEQ ID NO: 139414 - DNA, 29 bp, Artificial Sequence
  Description of Artificial Sequence: Synthetic oligonucleotide
ctacacagggcgaatcaaagccatccagc

SEQ ID NO: 139415 - DNA, 30 bp, Artificial Sequence
  Description of Artificial Sequence: Synthetic oligonucleotide
tacacagggcgaatcaaagccatccagctg

SEQ ID NO: 139416 - DNA, 29 bp, Artificial Sequence
  Description of Artificial Sequence: Synthetic oligonucleotide
acacagggcgaatcaaagccatccagctg

SEQ ID NO: 139417 - DNA, 28 bp, Artificial Sequence
  Description of Artificial Sequence: Synthetic oligonucleotide
cacagggcgaatcaaagccatccagctg

SEQ ID NO: 139418 - DNA, 28 bp, Artificial Sequence
  Description of Artificial Sequence: Synthetic oligonucleotide
acagggcgaatcaaagccatccagctgg

SEQ ID NO: 139419 - DNA, 27 bp, Artificial Sequence
  Description of Artificial Sequence: Synthetic oligonucleotide
cagggcgaatcaaagccatccagctgg

SEQ ID NO: 139420 - DNA, 28 bp, Artificial Sequence
  Description of Artificial Sequence: Synthetic oligonucleotide
agggcgaatcaaagccatccagctggag

SEQ ID NO: 139421 - DNA, 27 bp, Artificial Sequence
  Description of Artificial Sequence: Synthetic oligonucleotide
gggcgaatcaaagccatccagctggag

SEQ ID NO: 139422 - DNA, 29 bp, Artificial Sequence
  Description of Artificial Sequence: Synthetic oligonucleotide
ggcgaatcaaagccatccagctggagtac

SEQ ID NO: 139423 - DNA, 30 bp, Artificial Sequence
  Description of Artificial Sequence: Synthetic oligonucleotide
gcgaatcaaagccatccagctggagtactc

SEQ ID NO: 139424 - DNA, 31 bp, Artificial Sequence
  Description of Artificial Sequence: Synthetic oligonucleotide
cgaatcaaagccatccagctggagtactcag

SEQ ID NO: 139425 - DNA, 32 bp, Artificial Sequence
  Description of Artificial Sequence: Synthetic oligonucleotide
gaatcaaagccatccagctggagtactcagag

SEQ ID NO: 139426 - DNA, 32 bp, Artificial Sequence
  Description of Artificial Sequence: Synthetic oligonucleotide
aatcaaagccatccagctggagtactcagagg

SEQ ID NO: 139427 - DNA, 31 bp, Artificial Sequence
  Description of Artificial Sequence: Synthetic oligonucleotide
atcaaagccatccagctggagtactcagagg

SEQ ID NO: 139428 - DNA, 30 bp, Artificial Sequence
  Description of Artificial Sequence: Synthetic oligonucleotide
tcaaagccatccagctggagtactcagagg

SEQ ID NO: 139429 - DNA, 29 bp, Artificial Sequence
  Description of Artificial Sequence: Synthetic oligonucleotide
caaagccatccagctggagtactcagagg

SEQ ID NO: 139430 - DNA, 29 bp, Artificial Sequence
  Description of Artificial Sequence: Synthetic oligonucleotide
aaagccatccagctggagtactcagaggc

SEQ ID NO: 139431 - DNA, 28 bp, Artificial Sequence
  Description of Artificial Sequence: Synthetic oligonucleotide
aagccatccagctggagtactcagaggc

SEQ ID NO: 139432 - DNA, 27 bp, Artificial Sequence
  Description of Artificial Sequence: Synthetic oligonucleotide
agccatccagctggagtactcagaggc

SEQ ID NO: 139433 - DNA, 26 bp, Artificial Sequence
  Description of Artificial Sequence: Synthetic oligonucleotide
gccatccagctggagtactcagaggc

SEQ ID NO: 139434 - DNA, 26 bp, Artificial Sequence
  Description of Artificial Sequence: Synthetic oligonucleotide
ccatccagctggagtactcagaggcc

SEQ ID NO: 139435 - DNA, 26 bp, Artificial Sequence
  Description of Artificial Sequence: Synthetic oligonucleotide
catccagctggagtactcagaggccc

SEQ ID NO: 139436 - DNA, 26 bp, Artificial Sequence
  Description of Artificial Sequence: Synthetic oligonucleotide
atccagctggagtactcagaggcccg

SEQ ID NO: 139437 - DNA, 25 bp, Artificial Sequence
  Description of Artificial Sequence: Synthetic oligonucleotide
tccagctggagtactcagaggcccg

SEQ ID NO: 139438 - DNA, 24 bp, Artificial Sequence
  Description of Artificial Sequence: Synthetic oligonucleotide
ccagctggagtactcagaggcccg

SEQ ID NO: 139439 - DNA, 25 bp, Artificial Sequence
  Description of Artificial Sequence: Synthetic oligonucleotide
cagctggagtactcagaggcccgga

SEQ ID NO: 139440 - DNA, 27 bp, Artificial Sequence
  Description of Artificial Sequence: Synthetic oligonucleotide
agctggagtactcagaggcccggagaa

SEQ ID NO: 139441 - DNA, 26 bp, Artificial Sequence
  Description of Artificial Sequence: Synthetic oligonucleotide
gctggagtactcagaggcccggagaa

SEQ ID NO: 139442 - DNA, 26 bp, Artificial Sequence
  Description of Artificial Sequence: Synthetic oligonucleotide
ctggagtactcagaggcccggagaac

SEQ ID NO: 139443 - DNA, 27 bp, Artificial Sequence
  Description of Artificial Sequence: Synthetic oligonucleotide
tggagtactcagaggcccggagaacga

SEQ ID NO: 139444 - DNA, 27 bp, Artificial Sequence
  Description of Artificial Sequence: Synthetic oligonucleotide
ggagtactcagaggcccggagaacgat

SEQ ID NO: 139445 - DNA, 27 bp, Artificial Sequence
  Description of Artificial Sequence: Synthetic oligonucleotide
gagtactcagaggcccggagaacgatg

SEQ ID NO: 139446 - DNA, 28 bp, Artificial Sequence
  Description of Artificial Sequence: Synthetic oligonucleotide
agtactcagaggcccggagaacgatgac

SEQ ID NO: 139447 - DNA, 27 bp, Artificial Sequence
  Description of Artificial Sequence: Synthetic oligonucleotide
gtactcagaggcccggagaacgatgac

SEQ ID NO: 139448 - DNA, 27 bp, Artificial Sequence
  Description of Artificial Sequence: Synthetic oligonucleotide
tactcagaggcccggagaacgatgacc

SEQ ID NO: 139449 - DNA, 27 bp, Artificial Sequence
  Description of Artificial Sequence: Synthetic oligonucleotide
actcagaggcccggagaacgatgacca

SEQ ID NO: 139450 - DNA, 27 bp, Artificial Sequence
  Description of Artificial Sequence: Synthetic oligonucleotide
ctcagaggcccggagaacgatgaccaa

SEQ ID NO: 139451 - DNA, 27 bp, Artificial Sequence
  Description of Artificial Sequence: Synthetic oligonucleotide
tcagaggcccggagaacgatgaccaac

SEQ ID NO: 139452 - DNA, 26 bp, Artificial Sequence
  Description of Artificial Sequence: Synthetic oligonucleotide
cagaggcccggagaacgatgaccaac

SEQ ID NO: 139453 - DNA, 26 bp, Artificial Sequence
  Description of Artificial Sequence: Synthetic oligonucleotide
agaggcccggagaacgatgaccaacg

SEQ ID NO: 139454 - DNA, 25 bp, Artificial Sequence
  Description of Artificial Sequence: Synthetic oligonucleotide
gaggcccggagaacgatgaccaacg

SEQ ID NO: 139455 - DNA, 25 bp, Artificial Sequence
  Description of Artificial Sequence: Synthetic oligonucleotide
aggcccggagaacgatgaccaacgc

SEQ ID NO: 139456 - DNA, 24 bp, Artificial Sequence
  Description of Artificial Sequence: Synthetic oligonucleotide
ggcccggagaacgatgaccaacgc

SEQ ID NO: 139457 - DNA, 24 bp, Artificial Sequence
  Description of Artificial Sequence: Synthetic oligonucleotide
gcccggagaacgatgaccaacgcc

SEQ ID NO: 139458 - DNA, 26 bp, Artificial Sequence
  Description of Artificial Sequence: Synthetic oligonucleotide
cccggagaacgatgaccaacgccctt

SEQ ID NO: 139459 - DNA, 26 bp, Artificial Sequence
  Description of Artificial Sequence: Synthetic oligonucleotide
ccggagaacgatgaccaacgcccttc

SEQ ID NO: 139460 - DNA, 26 bp, Artificial Sequence
  Description of Artificial Sequence: Synthetic oligonucleotide
cggagaacgatgaccaacgcccttcg

SEQ ID NO: 139461 - DNA, 27 bp, Artificial Sequence
  Description of Artificial Sequence: Synthetic oligonucleotide
ggagaacgatgaccaacgcccttcgca

SEQ ID NO: 139462 - DNA, 28 bp, Artificial Sequence
  Description of Artificial Sequence: Synthetic oligonucleotide
gagaacgatgaccaacgcccttcgcaag

SEQ ID NO: 139463 - DNA, 28 bp, Artificial Sequence
  Description of Artificial Sequence: Synthetic oligonucleotide
agaacgatgaccaacgcccttcgcaagg

SEQ ID NO: 139464 - DNA, 27 bp, Artificial Sequence
  Description of Artificial Sequence: Synthetic oligonucleotide
gaacgatgaccaacgcccttcgcaagg

SEQ ID NO: 139465 - DNA, 27 bp, Artificial Sequence
  Description of Artificial Sequence: Synthetic oligonucleotide
aacgatgaccaacgcccttcgcaaggc

SEQ ID NO: 139466 - DNA, 26 bp, Artificial Sequence
  Description of Artificial Sequence: Synthetic oligonucleotide
acgatgaccaacgcccttcgcaaggc

SEQ ID NO: 139467 - DNA, 25 bp, Artificial Sequence
  Description of Artificial Sequence: Synthetic oligonucleotide
cgatgaccaacgcccttcgcaaggc

SEQ ID NO: 139468 - DNA, 25 bp, Artificial Sequence
  Description of Artificial Sequence: Synthetic oligonucleotide
gatgaccaacgcccttcgcaaggcc

SEQ ID NO: 139469 - DNA, 25 bp, Artificial Sequence
  Description of Artificial Sequence: Synthetic oligonucleotide
atgaccaacgcccttcgcaaggccc

SEQ ID NO: 139470 - DNA, 24 bp, Artificial Sequence
  Description of Artificial Sequence: Synthetic oligonucleotide
tgaccaacgcccttcgcaaggccc

SEQ ID NO: 139471 - DNA, 23 bp, Artificial Sequence
  Description of Artificial Sequence: Synthetic oligonucleotide
gaccaacgcccttcgcaaggccc

SEQ ID NO: 139472 - DNA, 24 bp, Artificial Sequence
  Description of Artificial Sequence: Synthetic oligonucleotide
accaacgcccttcgcaaggcccct

SEQ ID NO: 139473 - DNA, 23 bp, Artificial Sequence
  Description of Artificial Sequence: Synthetic oligonucleotide
ccaacgcccttcgcaaggcccct

SEQ ID NO: 139474 - DNA, 24 bp, Artificial Sequence
  Description of Artificial Sequence: Synthetic oligonucleotide
caacgcccttcgcaaggcccctca

SEQ ID NO: 139475 - DNA, 24 bp, Artificial Sequence
  Description of Artificial Sequence: Synthetic oligonucleotide
aacgcccttcgcaaggcccctcag

SEQ ID NO: 139476 - DNA, 23 bp, Artificial Sequence
  Description of Artificial Sequence: Synthetic oligonucleotide
acgcccttcgcaaggcccctcag

SEQ ID NO: 139477 - DNA, 22 bp, Artificial Sequence
  Description of Artificial Sequence: Synthetic oligonucleotide
cgcccttcgcaaggcccctcag

SEQ ID NO: 139478 - DNA, 23 bp, Artificial Sequence
  Description of Artificial Sequence: Synthetic oligonucleotide
gcccttcgcaaggcccctcagca

SEQ ID NO: 139479 - DNA, 24 bp, Artificial Sequence
  Description of Artificial Sequence: Synthetic oligonucleotide
cccttcgcaaggcccctcagcaca

SEQ ID NO: 139480 - DNA, 25 bp, Artificial Sequence
  Description of Artificial Sequence: Synthetic oligonucleotide
ccttcgcaaggcccctcagcacaca

SEQ ID NO: 139481 - DNA, 25 bp, Artificial Sequence
  Description of Artificial Sequence: Synthetic oligonucleotide
cttcgcaaggcccctcagcacacag

SEQ ID NO: 139482 - DNA, 26 bp, Artificial Sequence
  Description of Artificial Sequence: Synthetic oligonucleotide
ttcgcaaggcccctcagcacacagct

SEQ ID NO: 139483 - DNA, 25 bp, Artificial Sequence
  Description of Artificial Sequence: Synthetic oligonucleotide
tcgcaaggcccctcagcacacagct

SEQ ID NO: 139484 - DNA, 24 bp, Artificial Sequence
  Description of Artificial Sequence: Synthetic oligonucleotide
cgcaaggcccctcagcacacagct

SEQ ID NO: 139485 - DNA, 25 bp, Artificial Sequence
  Description of Artificial Sequence: Synthetic oligonucleotide
gcaaggcccctcagcacacagctgt

SEQ ID NO: 139486 - DNA, 25 bp, Artificial Sequence
  Description of Artificial Sequence: Synthetic oligonucleotide
caaggcccctcagcacacagctgtc

SEQ ID NO: 139487 - DNA, 25 bp, Artificial Sequence
  Description of Artificial Sequence: Synthetic oligonucleotide
aaggcccctcagcacacagctgtcg

SEQ ID NO: 139488 - DNA, 24 bp, Artificial Sequence
  Description of Artificial Sequence: Synthetic oligonucleotide
aggcccctcagcacacagctgtcg

SEQ ID NO: 139489 - DNA, 23 bp, Artificial Sequence
  Description of Artificial Sequence: Synthetic oligonucleotide
ggcccctcagcacacagctgtcg

SEQ ID NO: 139490 - DNA, 23 bp, Artificial Sequence
  Description of Artificial Sequence: Synthetic oligonucleotide
gcccctcagcacacagctgtcgg

SEQ ID NO: 139491 - DNA, 25 bp, Artificial Sequence
  Description of Artificial Sequence: Synthetic oligonucleotide
cccctcagcacacagctgtcggctt

SEQ ID NO: 139492 - DNA, 27 bp, Artificial Sequence
  Description of Artificial Sequence: Synthetic oligonucleotide
ccctcagcacacagctgtcggcttcaa

SEQ ID NO: 139493 - DNA, 28 bp, Artificial Sequence
  Description of Artificial Sequence: Synthetic oligonucleotide
cctcagcacacagctgtcggcttcaaac

SEQ ID NO: 139494 - DNA, 29 bp, Artificial Sequence
  Description of Artificial Sequence: Synthetic oligonucleotide
ctcagcacacagctgtcggcttcaaacag

SEQ ID NO: 139495 - DNA, 30 bp, Artificial Sequence
  Description of Artificial Sequence: Synthetic oligonucleotide
tcagcacacagctgtcggcttcaaacagac

SEQ ID NO: 139496 - DNA, 29 bp, Artificial Sequence
  Description of Artificial Sequence: Synthetic oligonucleotide
cagcacacagctgtcggcttcaaacagac

SEQ ID NO: 139497 - DNA, 29 bp, Artificial Sequence
  Description of Artificial Sequence: Synthetic oligonucleotide
agcacacagctgtcggcttcaaacagacg

SEQ ID NO: 139498 - DNA, 28 bp, Artificial Sequence
  Description of Artificial Sequence: Synthetic oligonucleotide
gcacacagctgtcggcttcaaacagacg

SEQ ID NO: 139499 - DNA, 28 bp, Artificial Sequence
  Description of Artificial Sequence: Synthetic oligonucleotide
cacacagctgtcggcttcaaacagacgg

SEQ ID NO: 139500 - DNA, 29 bp, Artificial Sequence
  Description of Artificial Sequence: Synthetic oligonucleotide
acacagctgtcggcttcaaacagacggtg

SEQ ID NO: 139501 - DNA, 28 bp, Artificial Sequence
  Description of Artificial Sequence: Synthetic oligonucleotide
cacagctgtcggcttcaaacagacggtg

SEQ ID NO: 139502 - DNA, 28 bp, Artificial Sequence
  Description of Artificial Sequence: Synthetic oligonucleotide
acagctgtcggcttcaaacagacggtgc

SEQ ID NO: 139503 - DNA, 27 bp, Artificial Sequence
  Description of Artificial Sequence: Synthetic oligonucleotide
cagctgtcggcttcaaacagacggtgc

SEQ ID NO: 139504 - DNA, 28 bp, Artificial Sequence
  Description of Artificial Sequence: Synthetic oligonucleotide
agctgtcggcttcaaacagacggtgcac

SEQ ID NO: 139505 - DNA, 27 bp, Artificial Sequence
  Description of Artificial Sequence: Synthetic oligonucleotide
gctgtcggcttcaaacagacggtgcac

SEQ ID NO: 139506 - DNA, 29 bp, Artificial Sequence
  Description of Artificial Sequence: Synthetic oligonucleotide
ctgtcggcttcaaacagacggtgcacaag

SEQ ID NO: 139507 - DNA, 29 bp, Artificial Sequence
  Description of Artificial Sequence: Synthetic oligonucleotide
tgtcggcttcaaacagacggtgcacaagc

SEQ ID NO: 139508 - DNA, 28 bp, Artificial Sequence
  Description of Artificial Sequence: Synthetic oligonucleotide
gtcggcttcaaacagacggtgcacaagc

SEQ ID NO: 139509 - DNA, 30 bp, Artificial Sequence
  Description of Artificial Sequence: Synthetic oligonucleotide
tcggcttcaaacagacggtgcacaagcttc

SEQ ID NO: 139510 - DNA, 29 bp, Artificial Sequence
  Description of Artificial Sequence: Synthetic oligonucleotide
cggcttcaaacagacggtgcacaagcttc

SEQ ID NO: 139511 - DNA, 30 bp, Artificial Sequence
  Description of Artificial Sequence: Synthetic oligonucleotide
ggcttcaaacagacggtgcacaagcttctc

SEQ ID NO: 139512 - DNA, 32 bp, Artificial Sequence
  Description of Artificial Sequence: Synthetic oligonucleotide
gcttcaaacagacggtgcacaagcttctcatc

SEQ ID NO: 139513 - DNA, 32 bp, Artificial Sequence
  Description of Artificial Sequence: Synthetic oligonucleotide
cttcaaacagacggtgcacaagcttctcatcg

SEQ ID NO: 139514 - DNA, 33 bp, Artificial Sequence
  Description of Artificial Sequence: Synthetic oligonucleotide
ttcaaacagacggtgcacaagcttctcatcgtg

SEQ ID NO: 139515 - DNA, 32 bp, Artificial Sequence
  Description of Artificial Sequence: Synthetic oligonucleotide
tcaaacagacggtgcacaagcttctcatcgtg

SEQ ID NO: 139516 - DNA, 31 bp, Artificial Sequence
  Description of Artificial Sequence: Synthetic oligonucleotide
caaacagacggtgcacaagcttctcatcgtg

SEQ ID NO: 139517 - DNA, 31 bp, Artificial Sequence
  Description of Artificial Sequence: Synthetic oligonucleotide
aaacagacggtgcacaagcttctcatcgtgg

SEQ ID NO: 139518 - DNA, 30 bp, Artificial Sequence
  Description of Artificial Sequence: Synthetic oligonucleotide
aacagacggtgcacaagcttctcatcgtgg

SEQ ID NO: 139519 - DNA, 29 bp, Artificial Sequence
  Description of Artificial Sequence: Synthetic oligonucleotide
acagacggtgcacaagcttctcatcgtgg

SEQ ID NO: 139520 - DNA, 28 bp, Artificial Sequence
  Description of Artificial Sequence: Synthetic oligonucleotide
cagacggtgcacaagcttctcatcgtgg

SEQ ID NO: 139521 - DNA, 29 bp, Artificial Sequence
  Description of Artificial Sequence: Synthetic oligonucleotide
agacggtgcacaagcttctcatcgtggtg

SEQ ID NO: 139522 - DNA, 28 bp, Artificial Sequence
  Description of Artificial Sequence: Synthetic oligonucleotide
gacggtgcacaagcttctcatcgtggtg

SEQ ID NO: 139523 - DNA, 28 bp, Artificial Sequence
  Description of Artificial Sequence: Synthetic oligonucleotide
acggtgcacaagcttctcatcgtggtgg

SEQ ID NO: 139524 - DNA, 27 bp, Artificial Sequence
  Description of Artificial Sequence: Synthetic oligonucleotide
cggtgcacaagcttctcatcgtggtgg

SEQ ID NO: 139525 - DNA, 28 bp, Artificial Sequence
  Description of Artificial Sequence: Synthetic oligonucleotide
ggtgcacaagcttctcatcgtggtggag

SEQ ID NO: 139526 - DNA, 28 bp, Artificial Sequence
  Description of Artificial Sequence: Synthetic oligonucleotide
gtgcacaagcttctcatcgtggtggagc

SEQ ID NO: 139527 - DNA, 29 bp, Artificial Sequence
  Description of Artificial Sequence: Synthetic oligonucleotide
tgcacaagcttctcatcgtggtggagctg

SEQ ID NO: 139528 - DNA, 28 bp, Artificial Sequence
  Description of Artificial Sequence: Synthetic oligonucleotide
gcacaagcttctcatcgtggtggagctg

SEQ ID NO: 139529 - DNA, 30 bp, Artificial Sequence
  Description of Artificial Sequence: Synthetic oligonucleotide
cacaagcttctcatcgtggtggagctgttg

SEQ ID NO: 139530 - DNA, 30 bp, Artificial Sequence
  Description of Artificial Sequence: Synthetic oligonucleotide
acaagcttctcatcgtggtggagctgttgc

SEQ ID NO: 139531 - DNA, 29 bp, Artificial Sequence
  Description of Artificial Sequence: Synthetic oligonucleotide
caagcttctcatcgtggtggagctgttgc

SEQ ID NO: 139532 - DNA, 30 bp, Artificial Sequence
  Description of Artificial Sequence: Synthetic oligonucleotide
aagcttctcatcgtggtggagctgttgctg

SEQ ID NO: 139533 - DNA, 29 bp, Artificial Sequence
  Description of Artificial Sequence: Synthetic oligonucleotide
agcttctcatcgtggtggagctgttgctg

SEQ ID NO: 139534 - DNA, 28 bp, Artificial Sequence
  Description of Artificial Sequence: Synthetic oligonucleotide
gcttctcatcgtggtggagctgttgctg

SEQ ID NO: 139535 - DNA, 28 bp, Artificial Sequence
  Description of Artificial Sequence: Synthetic oligonucleotide
cttctcatcgtggtggagctgttgctgg

SEQ ID NO: 139536 - DNA, 28 bp, Artificial Sequence
  Description of Artificial Sequence: Synthetic oligonucleotide
ttctcatcgtggtggagctgttgctggg

SEQ ID NO: 139537 - DNA, 27 bp, Artificial Sequence
  Description of Artificial Sequence: Synthetic oligonucleotide
tctcatcgtggtggagctgttgctggg

SEQ ID NO: 139538 - DNA, 26 bp, Artificial Sequence
  Description of Artificial Sequence: Synthetic oligonucleotide
ctcatcgtggtggagctgttgctggg

SEQ ID NO: 139539 - DNA, 26 bp, Artificial Sequence
  Description of Artificial Sequence: Synthetic oligonucleotide
tcatcgtggtggagctgttgctgggg

SEQ ID NO: 139540 - DNA, 25 bp, Artificial Sequence
  Description of Artificial Sequence: Synthetic oligonucleotide
catcgtggtggagctgttgctgggg

SEQ ID NO: 139541 - DNA, 26 bp, Artificial Sequence
  Description of Artificial Sequence: Synthetic oligonucleotide
atcgtggtggagctgttgctggggga

SEQ ID NO: 139542 - DNA, 25 bp, Artificial Sequence
  Description of Artificial Sequence: Synthetic oligonucleotide
tcgtggtggagctgttgctggggga

SEQ ID NO: 139543 - DNA, 24 bp, Artificial Sequence
  Description of Artificial Sequence: Synthetic oligonucleotide
cgtggtggagctgttgctggggga

SEQ ID NO: 139544 - DNA, 26 bp, Artificial Sequence
  Description of Artificial Sequence: Synthetic oligonucleotide
gtggtggagctgttgctgggggagat

SEQ ID NO: 139545 - DNA, 26 bp, Artificial Sequence
  Description of Artificial Sequence: Synthetic oligonucleotide
tggtggagctgttgctgggggagatc

SEQ ID NO: 139546 - DNA, 25 bp, Artificial Sequence
  Description of Artificial Sequence: Synthetic oligonucleotide
ggtggagctgttgctgggggagatc

SEQ ID NO: 139547 - DNA, 25 bp, Artificial Sequence
  Description of Artificial Sequence: Synthetic oligonucleotide
gtggagctgttgctgggggagatcc

SEQ ID NO: 139548 - DNA, 26 bp, Artificial Sequence
  Description of Artificial Sequence: Synthetic oligonucleotide
tggagctgttgctgggggagatccct

SEQ ID NO: 139549 - DNA, 25 bp, Artificial Sequence
  Description of Artificial Sequence: Synthetic oligonucleotide
ggagctgttgctgggggagatccct

SEQ ID NO: 139550 - DNA, 26 bp, Artificial Sequence
  Description of Artificial Sequence: Synthetic oligonucleotide
gagctgttgctgggggagatccctga

SEQ ID NO: 139551 - DNA, 26 bp, Artificial Sequence
  Description of Artificial Sequence: Synthetic oligonucleotide
agctgttgctgggggagatccctgac

SEQ ID NO: 139552 - DNA, 25 bp, Artificial Sequence
  Description of Artificial Sequence: Synthetic oligonucleotide
gctgttgctgggggagatccctgac

SEQ ID NO: 139553 - DNA, 25 bp, Artificial Sequence
  Description of Artificial Sequence: Synthetic oligonucleotide
ctgttgctgggggagatccctgacc

SEQ ID NO: 139554 - DNA, 25 bp, Artificial Sequence
  Description of Artificial Sequence: Synthetic oligonucleotide
tgttgctgggggagatccctgaccg

SEQ ID NO: 139555 - DNA, 24 bp, Artificial Sequence
  Description of Artificial Sequence: Synthetic oligonucleotide
gttgctgggggagatccctgaccg

SEQ ID NO: 139556 - DNA, 24 bp, Artificial Sequence
  Description of Artificial Sequence: Synthetic oligonucleotide
ttgctgggggagatccctgaccgg

SEQ ID NO: 139557 - DNA, 23 bp, Artificial Sequence
  Description of Artificial Sequence: Synthetic oligonucleotide
tgctgggggagatccctgaccgg

SEQ ID NO: 139558 - DNA, 22 bp, Artificial Sequence
  Description of Artificial Sequence: Synthetic oligonucleotide
gctgggggagatccctgaccgg

SEQ ID NO: 139559 - DNA, 23 bp, Artificial Sequence
  Description of Artificial Sequence: Synthetic oligonucleotide
ctgggggagatccctgaccggct

SEQ ID NO: 139560 - DNA, 23 bp, Artificial Sequence
  Description of Artificial Sequence: Synthetic oligonucleotide
tgggggagatccctgaccggctg

SEQ ID NO: 139561 - DNA, 22 bp, Artificial Sequence
  Description of Artificial Sequence: Synthetic oligonucleotide
gggggagatccctgaccggctg

SEQ ID NO: 139562 - DNA, 23 bp, Artificial Sequence
  Description of Artificial Sequence: Synthetic oligonucleotide
ggggagatccctgaccggctgca

SEQ ID NO: 139563 - DNA, 25 bp, Artificial Sequence
  Description of Artificial Sequence: Synthetic oligonucleotide
gggagatccctgaccggctgcagtt

SEQ ID NO: 139564 - DNA, 25 bp, Artificial Sequence
  Description of Artificial Sequence: Synthetic oligonucleotide
ggagatccctgaccggctgcagttc

SEQ ID NO: 139565 - DNA, 25 bp, Artificial Sequence
  Description of Artificial Sequence: Synthetic oligonucleotide
gagatccctgaccggctgcagttcc

SEQ ID NO: 139566 - DNA, 25 bp, Artificial Sequence
  Description of Artificial Sequence: Synthetic oligonucleotide
agatccctgaccggctgcagttccg

SEQ ID NO: 139567 - DNA, 24 bp, Artificial Sequence
  Description of Artificial Sequence: Synthetic oligonucleotide
gatccctgaccggctgcagttccg

SEQ ID NO: 139568 - DNA, 24 bp, Artificial Sequence
  Description of Artificial Sequence: Synthetic oligonucleotide
atccctgaccggctgcagttccgc

SEQ ID NO: 139569 - DNA, 23 bp, Artificial Sequence
  Description of Artificial Sequence: Synthetic oligonucleotide
tccctgaccggctgcagttccgc

SEQ ID NO: 139570 - DNA, 22 bp, Artificial Sequence
  Description of Artificial Sequence: Synthetic oligonucleotide
ccctgaccggctgcagttccgc

SEQ ID NO: 139571 - DNA, 23 bp, Artificial Sequence
  Description of Artificial Sequence: Synthetic oligonucleotide
cctgaccggctgcagttccgcca

SEQ ID NO: 139572 - DNA, 23 bp, Artificial Sequence
  Description of Artificial Sequence: Synthetic oligonucleotide
ctgaccggctgcagttccgccag

SEQ ID NO: 139573 - DNA, 23 bp, Artificial Sequence
  Description of Artificial Sequence: Synthetic oligonucleotide
tgaccggctgcagttccgccagc

SEQ ID NO: 139574 - DNA, 22 bp, Artificial Sequence
  Description of Artificial Sequence: Synthetic oligonucleotide
gaccggctgcagttccgccagc

SEQ ID NO: 139575 - DNA, 22 bp, Artificial Sequence
  Description of Artificial Sequence: Synthetic oligonucleotide
accggctgcagttccgccagcc

SEQ ID NO: 139576 - DNA, 21 bp, Artificial Sequence
  Description of Artificial Sequence: Synthetic oligonucleotide
ccggctgcagttccgccagcc

SEQ ID NO: 139577 - DNA, 22 bp, Artificial Sequence
  Description of Artificial Sequence: Synthetic oligonucleotide
cggctgcagttccgccagccct

SEQ ID NO: 139578 - DNA, 22 bp, Artificial Sequence
  Description of Artificial Sequence: Synthetic oligonucleotide
ggctgcagttccgccagccctc

SEQ ID NO: 139579 - DNA, 22 bp, Artificial Sequence
  Description of Artificial Sequence: Synthetic oligonucleotide
gctgcagttccgccagccctcc

SEQ ID NO: 139580 - DNA, 23 bp, Artificial Sequence
  Description of Artificial Sequence: Synthetic oligonucleotide
ctgcagttccgccagccctccct

SEQ ID NO: 139581 - DNA, 25 bp, Artificial Sequence
  Description of Artificial Sequence: Synthetic oligonucleotide
tgcagttccgccagccctccctcaa

SEQ ID NO: 139582 - DNA, 24 bp, Artificial Sequence
  Description of Artificial Sequence: Synthetic oligonucleotide
gcagttccgccagccctccctcaa

SEQ ID NO: 139583 - DNA, 24 bp, Artificial Sequence
  Description of Artificial Sequence: Synthetic oligonucleotide
cagttccgccagccctccctcaag

SEQ ID NO: 139584 - DNA, 24 bp, Artificial Sequence
  Description of Artificial Sequence: Synthetic oligonucleotide
agttccgccagccctccctcaagc

SEQ ID NO: 139585 - DNA, 23 bp, Artificial Sequence
  Description of Artificial Sequence: Synthetic oligonucleotide
gttccgccagccctccctcaagc

SEQ ID NO: 139586 - DNA, 23 bp, Artificial Sequence
  Description of Artificial Sequence: Synthetic oligonucleotide
ttccgccagccctccctcaagcg

SEQ ID NO: 139587 - DNA, 22 bp, Artificial Sequence
  Description of Artificial Sequence: Synthetic oligonucleotide
tccgccagccctccctcaagcg

SEQ ID NO: 139588 - DNA, 21 bp, Artificial Sequence
  Description of Artificial Sequence: Synthetic oligonucleotide
ccgccagccctccctcaagcg

SEQ ID NO: 139589 - DNA, 22 bp, Artificial Sequence
  Description of Artificial Sequence: Synthetic oligonucleotide
cgccagccctccctcaagcgct

SEQ ID NO: 139590 - DNA, 23 bp, Artificial Sequence
  Description of Artificial Sequence: Synthetic oligonucleotide
gccagccctccctcaagcgctca

SEQ ID NO: 139591 - DNA, 24 bp, Artificial Sequence
  Description of Artificial Sequence: Synthetic oligonucleotide
ccagccctccctcaagcgctcact

SEQ ID NO: 139592 - DNA, 26 bp, Artificial Sequence
  Description of Artificial Sequence: Synthetic oligonucleotide
cagccctccctcaagcgctcactcat

SEQ ID NO: 139593 - DNA, 26 bp, Artificial Sequence
  Description of Artificial Sequence: Synthetic oligonucleotide
agccctccctcaagcgctcactcatg

SEQ ID NO: 139594 - DNA, 25 bp, Artificial Sequence
  Description of Artificial Sequence: Synthetic oligonucleotide
gccctccctcaagcgctcactcatg

SEQ ID NO: 139595 - DNA, 25 bp, Artificial Sequence
  Description of Artificial Sequence: Synthetic oligonucleotide
ccctccctcaagcgctcactcatgc

SEQ ID NO: 139596 - DNA, 25 bp, Artificial Sequence
  Description of Artificial Sequence: Synthetic oligonucleotide
cctccctcaagcgctcactcatgcc

SEQ ID NO: 139597 - DNA, 27 bp, Artificial Sequence
  Description of Artificial Sequence: Synthetic oligonucleotide
ctccctcaagcgctcactcatgcccta

SEQ ID NO: 139598 - DNA, 30 bp, Artificial Sequence
  Description of Artificial Sequence: Synthetic oligonucleotide
tccctcaagcgctcactcatgccctatttc

SEQ ID NO: 139599 - DNA, 29 bp, Artificial Sequence
  Description of Artificial Sequence: Synthetic oligonucleotide
ccctcaagcgctcactcatgccctatttc

SEQ ID NO: 139600 - DNA, 29 bp, Artificial Sequence
  Description of Artificial Sequence: Synthetic oligonucleotide
cctcaagcgctcactcatgccctatttcc

SEQ ID NO: 139601 - DNA, 31 bp, Artificial Sequence
  Description of Artificial Sequence: Synthetic oligonucleotide
ctcaagcgctcactcatgccctatttccttc

SEQ ID NO: 139602 - DNA, 32 bp, Artificial Sequence
  Description of Artificial Sequence: Synthetic oligonucleotide
tcaagcgctcactcatgccctatttccttctg

SEQ ID NO: 139603 - DNA, 31 bp, Artificial Sequence
  Description of Artificial Sequence: Synthetic oligonucleotide
caagcgctcactcatgccctatttccttctg

SEQ ID NO: 139604 - DNA, 32 bp, Artificial Sequence
  Description of Artificial Sequence: Synthetic oligonucleotide
aagcgctcactcatgccctatttccttctgac

SEQ ID NO: 139605 - DNA, 31 bp, Artificial Sequence
  Description of Artificial Sequence: Synthetic oligonucleotide
agcgctcactcatgccctatttccttctgac

SEQ ID NO: 139606 - DNA, 30 bp, Artificial Sequence
  Description of Artificial Sequence: Synthetic oligonucleotide
gcgctcactcatgccctatttccttctgac

SEQ ID NO: 139607 - DNA, 31 bp, Artificial Sequence
  Description of Artificial Sequence: Synthetic oligonucleotide
cgctcactcatgccctatttccttctgactc

SEQ ID NO: 139608 - DNA, 33 bp, Artificial Sequence
  Description of Artificial Sequence: Synthetic oligonucleotide
gctcactcatgccctatttccttctgactcaag

SEQ ID NO: 139609 - DNA, 33 bp, Artificial Sequence
  Description of Artificial Sequence: Synthetic oligonucleotide
ctcactcatgccctatttccttctgactcaagc

SEQ ID NO: 139610 - DNA, 34 bp, Artificial Sequence
  Description of Artificial Sequence: Synthetic oligonucleotide
tcactcatgccctatttccttctgactcaagctg

SEQ ID NO: 139611 - DNA, 33 bp, Artificial Sequence
  Description of Artificial Sequence: Synthetic oligonucleotide
cactcatgccctatttccttctgactcaagctg

SEQ ID NO: 139612 - DNA, 34 bp, Artificial Sequence
  Description of Artificial Sequence: Synthetic oligonucleotide
actcatgccctatttccttctgactcaagctgtc

SEQ ID NO: 139613 - DNA, 33 bp, Artificial Sequence
  Description of Artificial Sequence: Synthetic oligonucleotide
ctcatgccctatttccttctgactcaagctgtc

SEQ ID NO: 139614 - DNA, 34 bp, Artificial Sequence
  Description of Artificial Sequence: Synthetic oligonucleotide
tcatgccctatttccttctgactcaagctgtcag

SEQ ID NO: 139615 - DNA, 33 bp, Artificial Sequence
  Description of Artificial Sequence: Synthetic oligonucleotide
catgccctatttccttctgactcaagctgtcag

SEQ ID NO: 139616 - DNA, 33 bp, Artificial Sequence
  Description of Artificial Sequence: Synthetic oligonucleotide
atgccctatttccttctgactcaagctgtcagg

SEQ ID NO: 139617 - DNA, 32 bp, Artificial Sequence
  Description of Artificial Sequence: Synthetic oligonucleotide
tgccctatttccttctgactcaagctgtcagg

SEQ ID NO: 139618 - DNA, 31 bp, Artificial Sequence
  Description of Artificial Sequence: Synthetic oligonucleotide
gccctatttccttctgactcaagctgtcagg

SEQ ID NO: 139619 - DNA, 32 bp, Artificial Sequence
  Description of Artificial Sequence: Synthetic oligonucleotide
ccctatttccttctgactcaagctgtcaggac

SEQ ID NO: 139620 - DNA, 33 bp, Artificial Sequence
  Description of Artificial Sequence: Synthetic oligonucleotide
cctatttccttctgactcaagctgtcaggacag

SEQ ID NO: 139621 - DNA, 33 bp, Artificial Sequence
  Description of Artificial Sequence: Synthetic oligonucleotide
ctatttccttctgactcaagctgtcaggacagg

SEQ ID NO: 139622 - DNA, 36 bp, Artificial Sequence
  Description of Artificial Sequence: Synthetic oligonucleotide
tatttccttctgactcaagctgtcaggacaggaaac

SEQ ID NO: 139623 - DNA, 35 bp, Artificial Sequence
  Description of Artificial Sequence: Synthetic oligonucleotide
atttccttctgactcaagctgtcaggacaggaaac

SEQ ID NO: 139624 - DNA, 34 bp, Artificial Sequence
  Description of Artificial Sequence: Synthetic oligonucleotide
tttccttctgactcaagctgtcaggacaggaaac

SEQ ID NO: 139625 - DNA, 33 bp, Artificial Sequence
  Description of Artificial Sequence: Synthetic oligonucleotide
ttccttctgactcaagctgtcaggacaggaaac

SEQ ID NO: 139626 - DNA, 32 bp, Artificial Sequence
  Description of Artificial Sequence: Synthetic oligonucleotide
tccttctgactcaagctgtcaggacaggaaac

SEQ ID NO: 139627 - DNA, 31 bp, Artificial Sequence
  Description of Artificial Sequence: Synthetic oligonucleotide
ccttctgactcaagctgtcaggacaggaaac

SEQ ID NO: 139628 - DNA, 31 bp, Artificial Sequence
  Description of Artificial Sequence: Synthetic oligonucleotide
cttctgactcaagctgtcaggacaggaaacc

SEQ ID NO: 139629 - DNA, 33 bp, Artificial Sequence
  Description of Artificial Sequence: Synthetic oligonucleotide
ttctgactcaagctgtcaggacaggaaacctag

SEQ ID NO: 139630 - DNA, 32 bp, Artificial Sequence
  Description of Artificial Sequence: Synthetic oligonucleotide
tctgactcaagctgtcaggacaggaaacctag

SEQ ID NO: 139631 - DNA, 31 bp, Artificial Sequence
  Description of Artificial Sequence: Synthetic oligonucleotide
ctgactcaagctgtcaggacaggaaacctag

SEQ ID NO: 139632 - DNA, 31 bp, Artificial Sequence
  Description of Artificial Sequence: Synthetic oligonucleotide
tgactcaagctgtcaggacaggaaacctagc

SEQ ID NO: 139633 - DNA, 30 bp, Artificial Sequence
  Description of Artificial Sequence: Synthetic oligonucleotide
gactcaagctgtcaggacaggaaacctagc

SEQ ID NO: 139634 - DNA, 30 bp, Artificial Sequence
  Description of Artificial Sequence: Synthetic oligonucleotide
actcaagctgtcaggacaggaaacctagcc

SEQ ID NO: 139635 - DNA, 29 bp, Artificial Sequence
  Description of Artificial Sequence: Synthetic oligonucleotide
ctcaagctgtcaggacaggaaacctagcc

SEQ ID NO: 139636 - DNA, 31 bp, Artificial Sequence
  Description of Artificial Sequence: Synthetic oligonucleotide
tcaagctgtcaggacaggaaacctagccaag

SEQ ID NO: 139637 - DNA, 30 bp, Artificial Sequence
  Description of Artificial Sequence: Synthetic oligonucleotide
caagctgtcaggacaggaaacctagccaag

SEQ ID NO: 139638 - DNA, 32 bp, Artificial Sequence
  Description of Artificial Sequence: Synthetic oligonucleotide
aagctgtcaggacaggaaacctagccaagttc

SEQ ID NO: 139639 - DNA, 31 bp, Artificial Sequence
  Description of Artificial Sequence: Synthetic oligonucleotide
agctgtcaggacaggaaacctagccaagttc

SEQ ID NO: 139640 - DNA, 30 bp, Artificial Sequence
  Description of Artificial Sequence: Synthetic oligonucleotide
gctgtcaggacaggaaacctagccaagttc

SEQ ID NO: 139641 - DNA, 32 bp, Artificial Sequence
  Description of Artificial Sequence: Synthetic oligonucleotide
ctgtcaggacaggaaacctagccaagttcaac

SEQ ID NO: 139642 - DNA, 32 bp, Artificial Sequence
  Description of Artificial Sequence: Synthetic oligonucleotide
tgtcaggacaggaaacctagccaagttcaacc

SEQ ID NO: 139643 - DNA, 31 bp, Artificial Sequence
  Description of Artificial Sequence: Synthetic oligonucleotide
gtcaggacaggaaacctagccaagttcaacc

SEQ ID NO: 139644 - DNA, 32 bp, Artificial Sequence
  Description of Artificial Sequence: Synthetic oligonucleotide
tcaggacaggaaacctagccaagttcaaccag

SEQ ID NO: 139645 - DNA, 31 bp, Artificial Sequence
  Description of Artificial Sequence: Synthetic oligonucleotide
caggacaggaaacctagccaagttcaaccag

SEQ ID NO: 139646 - DNA, 31 bp, Artificial Sequence
  Description of Artificial Sequence: Synthetic oligonucleotide
aggacaggaaacctagccaagttcaaccagg

SEQ ID NO: 139647 - DNA, 30 bp, Artificial Sequence
  Description of Artificial Sequence: Synthetic oligonucleotide
ggacaggaaacctagccaagttcaaccagg

SEQ ID NO: 139648 - DNA, 31 bp, Artificial Sequence
  Description of Artificial Sequence: Synthetic oligonucleotide
gacaggaaacctagccaagttcaaccaggtc

SEQ ID NO: 139649 - DNA, 31 bp, Artificial Sequence
  Description of Artificial Sequence: Synthetic oligonucleotide
acaggaaacctagccaagttcaaccaggtcc

SEQ ID NO: 139650 - DNA, 30 bp, Artificial Sequence
  Description of Artificial Sequence: Synthetic oligonucleotide
caggaaacctagccaagttcaaccaggtcc

SEQ ID NO: 139651 - DNA, 31 bp, Artificial Sequence
  Description of Artificial Sequence: Synthetic oligonucleotide
aggaaacctagccaagttcaaccaggtcctg

SEQ ID NO: 139652 - DNA, 30 bp, Artificial Sequence
  Description of Artificial Sequence: Synthetic oligonucleotide
ggaaacctagccaagttcaaccaggtcctg

SEQ ID NO: 139653 - DNA, 30 bp, Artificial Sequence
  Description of Artificial Sequence: Synthetic oligonucleotide
gaaacctagccaagttcaaccaggtcctgg

SEQ ID NO: 139654 - DNA, 32 bp, Artificial Sequence
  Description of Artificial Sequence: Synthetic oligonucleotide
aaacctagccaagttcaaccaggtcctggatc

SEQ ID NO: 139655 - DNA, 31 bp, Artificial Sequence
  Description of Artificial Sequence: Synthetic oligonucleotide
aacctagccaagttcaaccaggtcctggatc

SEQ ID NO: 139656 - DNA, 30 bp, Artificial Sequence
  Description of Artificial Sequence: Synthetic oligonucleotide
acctagccaagttcaaccaggtcctggatc

SEQ ID NO: 139657 - DNA, 29 bp, Artificial Sequence
  Description of Artificial Sequence: Synthetic oligonucleotide
cctagccaagttcaaccaggtcctggatc

SEQ ID NO: 139658 - DNA, 30 bp, Artificial Sequence
  Description of Artificial Sequence: Synthetic oligonucleotide
ctagccaagttcaaccaggtcctggatcag

SEQ ID NO: 139659 - DNA, 33 bp, Artificial Sequence
  Description of Artificial Sequence: Synthetic oligonucleotide
tagccaagttcaaccaggtcctggatcagtttg

SEQ ID NO: 139660 - DNA, 32 bp, Artificial Sequence
  Description of Artificial Sequence: Synthetic oligonucleotide
agccaagttcaaccaggtcctggatcagtttg

SEQ ID NO: 139661 - DNA, 31 bp, Artificial Sequence
  Description of Artificial Sequence: Synthetic oligonucleotide
gccaagttcaaccaggtcctggatcagtttg

SEQ ID NO: 139662 - DNA, 31 bp, Artificial Sequence
  Description of Artificial Sequence: Synthetic oligonucleotide
ccaagttcaaccaggtcctggatcagtttgg

SEQ ID NO: 139663 - DNA, 31 bp, Artificial Sequence
  Description of Artificial Sequence: Synthetic oligonucleotide
caagttcaaccaggtcctggatcagtttggg

SEQ ID NO: 139664 - DNA, 31 bp, Artificial Sequence
  Description of Artificial Sequence: Synthetic oligonucleotide
aagttcaaccaggtcctggatcagtttgggg

SEQ ID NO: 139665 - DNA, 30 bp, Artificial Sequence
  Description of Artificial Sequence: Synthetic oligonucleotide
agttcaaccaggtcctggatcagtttgggg

SEQ ID NO: 139666 - DNA, 29 bp, Artificial Sequence
  Description of Artificial Sequence: Synthetic oligonucleotide
gttcaaccaggtcctggatcagtttgggg

SEQ ID NO: 139667 - DNA, 30 bp, Artificial Sequence
  Description of Artificial Sequence: Synthetic oligonucleotide
ttcaaccaggtcctggatcagtttggggag

SEQ ID NO: 139668 - DNA, 29 bp, Artificial Sequence
  Description of Artificial Sequence: Synthetic oligonucleotide
tcaaccaggtcctggatcagtttggggag

SEQ ID NO: 139669 - DNA, 28 bp, Artificial Sequence
  Description of Artificial Sequence: Synthetic oligonucleotide
caaccaggtcctggatcagtttggggag

SEQ ID NO: 139670 - DNA, 30 bp, Artificial Sequence
  Description of Artificial Sequence: Synthetic oligonucleotide
aaccaggtcctggatcagtttggggagaag

SEQ ID NO: 139671 - DNA, 29 bp, Artificial Sequence
  Description of Artificial Sequence: Synthetic oligonucleotide
accaggtcctggatcagtttggggagaag

SEQ ID NO: 139672 - DNA, 28 bp, Artificial Sequence
  Description of Artificial Sequence: Synthetic oligonucleotide
ccaggtcctggatcagtttggggagaag

SEQ ID NO: 139673 - DNA, 31 bp, Artificial Sequence
  Description of Artificial Sequence: Synthetic oligonucleotide
caggtcctggatcagtttggggagaagtttc

SEQ ID NO: 139674 - DNA, 33 bp, Artificial Sequence
  Description of Artificial Sequence: Synthetic oligonucleotide
aggtcctggatcagtttggggagaagtttcaag

SEQ ID NO: 139675 - DNA, 32 bp, Artificial Sequence
  Description of Artificial Sequence: Synthetic oligonucleotide
ggtcctggatcagtttggggagaagtttcaag

SEQ ID NO: 139676 - DNA, 32 bp, Artificial Sequence
  Description of Artificial Sequence: Synthetic oligonucleotide
gtcctggatcagtttggggagaagtttcaagc

SEQ ID NO: 139677 - DNA, 33 bp, Artificial Sequence
  Description of Artificial Sequence: Synthetic oligonucleotide
tcctggatcagtttggggagaagtttcaagcag

SEQ ID NO: 139678 - DNA, 32 bp, Artificial Sequence
  Description of Artificial Sequence: Synthetic oligonucleotide
cctggatcagtttggggagaagtttcaagcag

SEQ ID NO: 139679 - DNA, 34 bp, Artificial Sequence
  Description of Artificial Sequence: Synthetic oligonucleotide
ctggatcagtttggggagaagtttcaagcagatg

SEQ ID NO: 139680 - DNA, 34 bp, Artificial Sequence
  Description of Artificial Sequence: Synthetic oligonucleotide
tggatcagtttggggagaagtttcaagcagatgg

SEQ ID NO: 139681 - DNA, 33 bp, Artificial Sequence
  Description of Artificial Sequence: Synthetic oligonucleotide
ggatcagtttggggagaagtttcaagcagatgg

SEQ ID NO: 139682 - DNA, 33 bp, Artificial Sequence
  Description of Artificial Sequence: Synthetic oligonucleotide
gatcagtttggggagaagtttcaagcagatggg

SEQ ID NO: 139683 - DNA, 34 bp, Artificial Sequence
  Description of Artificial Sequence: Synthetic oligonucleotide
atcagtttggggagaagtttcaagcagatgggac

SEQ ID NO: 139684 - DNA, 33 bp, Artificial Sequence
  Description of Artificial Sequence: Synthetic oligonucleotide
tcagtttggggagaagtttcaagcagatgggac

SEQ ID NO: 139685 - DNA, 32 bp, Artificial Sequence
  Description of Artificial Sequence: Synthetic oligonucleotide
cagtttggggagaagtttcaagcagatgggac

SEQ ID NO: 139686 - DNA, 32 bp, Artificial Sequence
  Description of Artificial Sequence: Synthetic oligonucleotide
agtttggggagaagtttcaagcagatgggacc

SEQ ID NO: 139687 - DNA, 31 bp, Artificial Sequence
  Description of Artificial Sequence: Synthetic oligonucleotide
gtttggggagaagtttcaagcagatgggacc

SEQ ID NO: 139688 - DNA, 33 bp, Artificial Sequence
  Description of Artificial Sequence: Synthetic oligonucleotide
tttggggagaagtttcaagcagatgggacctac

SEQ ID NO: 139689 - DNA, 32 bp, Artificial Sequence
  Description of Artificial Sequence: Synthetic oligonucleotide
ttggggagaagtttcaagcagatgggacctac

SEQ ID NO: 139690 - DNA, 31 bp, Artificial Sequence
  Description of Artificial Sequence: Synthetic oligonucleotide
tggggagaagtttcaagcagatgggacctac

SEQ ID NO: 139691 - DNA, 30 bp, Artificial Sequence
  Description of Artificial Sequence: Synthetic oligonucleotide
ggggagaagtttcaagcagatgggacctac

SEQ ID NO: 139692 - DNA, 31 bp, Artificial Sequence
  Description of Artificial Sequence: Synthetic oligonucleotide
gggagaagtttcaagcagatgggacctacac

SEQ ID NO: 139693 - DNA, 31 bp, Artificial Sequence
  Description of Artificial Sequence: Synthetic oligonucleotide
ggagaagtttcaagcagatgggacctacacc

SEQ ID NO: 139694 - DNA, 31 bp, Artificial Sequence
  Description of Artificial Sequence: Synthetic oligonucleotide
gagaagtttcaagcagatgggacctacaccc

SEQ ID NO: 139695 - DNA, 38 bp, Artificial Sequence
  Description of Artificial Sequence: Synthetic oligonucleotide
agaagtttcaagcagatgggacctacaccctaattatc

SEQ ID NO: 139696 - DNA, 37 bp, Artificial Sequence
  Description of Artificial Sequence: Synthetic oligonucleotide
gaagtttcaagcagatgggacctacaccctaattatc

SEQ ID NO: 139697 - DNA, 37 bp, Artificial Sequence
  Description of Artificial Sequence: Synthetic oligonucleotide
aagtttcaagcagatgggacctacaccctaattatcc

SEQ ID NO: 139698 - DNA, 36 bp, Artificial Sequence
  Description of Artificial Sequence: Synthetic oligonucleotide
agtttcaagcagatgggacctacaccctaattatcc

SEQ ID NO: 139699 - DNA, 35 bp, Artificial Sequence
  Description of Artificial Sequence: Synthetic oligonucleotide
gtttcaagcagatgggacctacaccctaattatcc

SEQ ID NO: 139700 - DNA, 35 bp, Artificial Sequence
  Description of Artificial Sequence: Synthetic oligonucleotide
tttcaagcagatgggacctacaccctaattatccg

SEQ ID NO: 139701 - DNA, 34 bp, Artificial Sequence
  Description of Artificial Sequence: Synthetic oligonucleotide
ttcaagcagatgggacctacaccctaattatccg

SEQ ID NO: 139702 - DNA, 33 bp, Artificial Sequence
  Description of Artificial Sequence: Synthetic oligonucleotide
tcaagcagatgggacctacaccctaattatccg

SEQ ID NO: 139703 - DNA, 32 bp, Artificial Sequence
  Description of Artificial Sequence: Synthetic oligonucleotide
caagcagatgggacctacaccctaattatccg

SEQ ID NO: 139704 - DNA, 32 bp, Artificial Sequence
  Description of Artificial Sequence: Synthetic oligonucleotide
aagcagatgggacctacaccctaattatccgg

SEQ ID NO: 139705 - DNA, 31 bp, Artificial Sequence
  Description of Artificial Sequence: Synthetic oligonucleotide
agcagatgggacctacaccctaattatccgg

SEQ ID NO: 139706 - DNA, 30 bp, Artificial Sequence
  Description of Artificial Sequence: Synthetic oligonucleotide
gcagatgggacctacaccctaattatccgg

SEQ ID NO: 139707 - DNA, 30 bp, Artificial Sequence
  Description of Artificial Sequence: Synthetic oligonucleotide
cagatgggacctacaccctaattatccggc

SEQ ID NO: 139708 - DNA, 31 bp, Artificial Sequence
  Description of Artificial Sequence: Synthetic oligonucleotide
agatgggacctacaccctaattatccggctg

SEQ ID NO: 139709 - DNA, 30 bp, Artificial Sequence
  Description of Artificial Sequence: Synthetic oligonucleotide
gatgggacctacaccctaattatccggctg

SEQ ID NO: 139710 - DNA, 30 bp, Artificial Sequence
  Description of Artificial Sequence: Synthetic oligonucleotide
atgggacctacaccctaattatccggctgc

SEQ ID NO: 139711 - DNA, 29 bp, Artificial Sequence
  Description of Artificial Sequence: Synthetic oligonucleotide
tgggacctacaccctaattatccggctgc

SEQ ID NO: 139712 - DNA, 28 bp, Artificial Sequence
  Description of Artificial Sequence: Synthetic oligonucleotide
gggacctacaccctaattatccggctgc

SEQ ID NO: 139713 - DNA, 28 bp, Artificial Sequence
  Description of Artificial Sequence: Synthetic oligonucleotide
ggacctacaccctaattatccggctgcg

SEQ ID NO: 139714 - DNA, 28 bp, Artificial Sequence
  Description of Artificial Sequence: Synthetic oligonucleotide
gacctacaccctaattatccggctgcgg

SEQ ID NO: 139715 - DNA, 28 bp, Artificial Sequence
  Description of Artificial Sequence: Synthetic oligonucleotide
acctacaccctaattatccggctgcggc

SEQ ID NO: 139716 - DNA, 27 bp, Artificial Sequence
  Description of Artificial Sequence: Synthetic oligonucleotide
cctacaccctaattatccggctgcggc

SEQ ID NO: 139717 - DNA, 28 bp, Artificial Sequence
  Description of Artificial Sequence: Synthetic oligonucleotide
ctacaccctaattatccggctgcggcac

SEQ ID NO: 139718 - DNA, 30 bp, Artificial Sequence
  Description of Artificial Sequence: Synthetic oligonucleotide
tacaccctaattatccggctgcggcacaac

SEQ ID NO: 139719 - DNA, 29 bp, Artificial Sequence
  Description of Artificial Sequence: Synthetic oligonucleotide
acaccctaattatccggctgcggcacaac

SEQ ID NO: 139720 - DNA, 28 bp, Artificial Sequence
  Description of Artificial Sequence: Synthetic oligonucleotide
caccctaattatccggctgcggcacaac

SEQ ID NO: 139721 - DNA, 28 bp, Artificial Sequence
  Description of Artificial Sequence: Synthetic oligonucleotide
accctaattatccggctgcggcacaacg

SEQ ID NO: 139722 - DNA, 27 bp, Artificial Sequence
  Description of Artificial Sequence: Synthetic oligonucleotide
ccctaattatccggctgcggcacaacg

SEQ ID NO: 139723 - DNA, 28 bp, Artificial Sequence
  Description of Artificial Sequence: Synthetic oligonucleotide
cctaattatccggctgcggcacaacgtg

SEQ ID NO: 139724 - DNA, 33 bp, Artificial Sequence
  Description of Artificial Sequence: Synthetic oligonucleotide
ctaattatccggctgcggcacaacgtgattaag

SEQ ID NO: 139725 - DNA, 34 bp, Artificial Sequence
  Description of Artificial Sequence: Synthetic oligonucleotide
taattatccggctgcggcacaacgtgattaagac

SEQ ID NO: 139726 - DNA, 33 bp, Artificial Sequence
  Description of Artificial Sequence: Synthetic oligonucleotide
aattatccggctgcggcacaacgtgattaagac

SEQ ID NO: 139727 - DNA, 32 bp, Artificial Sequence
  Description of Artificial Sequence: Synthetic oligonucleotide
attatccggctgcggcacaacgtgattaagac

SEQ ID NO: 139728 - DNA, 31 bp, Artificial Sequence
  Description of Artificial Sequence: Synthetic oligonucleotide
ttatccggctgcggcacaacgtgattaagac

SEQ ID NO: 139729 - DNA, 30 bp, Artificial Sequence
  Description of Artificial Sequence: Synthetic oligonucleotide
tatccggctgcggcacaacgtgattaagac

SEQ ID NO: 139730 - DNA, 29 bp, Artificial Sequence
  Description of Artificial Sequence: Synthetic oligonucleotide
atccggctgcggcacaacgtgattaagac

SEQ ID NO: 139731 - DNA, 28 bp, Artificial Sequence
  Description of Artificial Sequence: Synthetic oligonucleotide
tccggctgcggcacaacgtgattaagac

SEQ ID NO: 139732 - DNA, 27 bp, Artificial Sequence
  Description of Artificial Sequence: Synthetic oligonucleotide
ccggctgcggcacaacgtgattaagac

SEQ ID NO: 139733 - DNA, 28 bp, Artificial Sequence
  Description of Artificial Sequence: Synthetic oligonucleotide
cggctgcggcacaacgtgattaagacag

SEQ ID NO: 139734 - DNA, 28 bp, Artificial Sequence
  Description of Artificial Sequence: Synthetic oligonucleotide
ggctgcggcacaacgtgattaagacagg

SEQ ID NO: 139735 - DNA, 29 bp, Artificial Sequence
  Description of Artificial Sequence: Synthetic oligonucleotide
gctgcggcacaacgtgattaagacaggtg

SEQ ID NO: 139736 - DNA, 31 bp, Artificial Sequence
  Description of Artificial Sequence: Synthetic oligonucleotide
ctgcggcacaacgtgattaagacaggtgtac

SEQ ID NO: 139737 - DNA, 31 bp, Artificial Sequence
  Description of Artificial Sequence: Synthetic oligonucleotide
tgcggcacaacgtgattaagacaggtgtacg

SEQ ID NO: 139738 - DNA, 30 bp, Artificial Sequence
  Description of Artificial Sequence: Synthetic oligonucleotide
gcggcacaacgtgattaagacaggtgtacg

SEQ ID NO: 139739 - DNA, 30 bp, Artificial Sequence
  Description of Artificial Sequence: Synthetic oligonucleotide
cggcacaacgtgattaagacaggtgtacgc

SEQ ID NO: 139740 - DNA, 32 bp, Artificial Sequence
  Description of Artificial Sequence: Synthetic oligonucleotide
ggcacaacgtgattaagacaggtgtacgcatg

SEQ ID NO: 139741 - DNA, 34 bp, Artificial Sequence
  Description of Artificial Sequence: Synthetic oligonucleotide
gcacaacgtgattaagacaggtgtacgcatgatc

SEQ ID NO: 139742 - DNA, 35 bp, Artificial Sequence
  Description of Artificial Sequence: Synthetic oligonucleotide
cacaacgtgattaagacaggtgtacgcatgatcag

SEQ ID NO: 139743 - DNA, 35 bp, Artificial Sequence
  Description of Artificial Sequence: Synthetic oligonucleotide
acaacgtgattaagacaggtgtacgcatgatcagc

SEQ ID NO: 139744 - DNA, 34 bp, Artificial Sequence
  Description of Artificial Sequence: Synthetic oligonucleotide
caacgtgattaagacaggtgtacgcatgatcagc

SEQ ID NO: 139745 - DNA, 34 bp, Artificial Sequence
  Description of Artificial Sequence: Synthetic oligonucleotide
aacgtgattaagacaggtgtacgcatgatcagcc

SEQ ID NO: 139746 - DNA, 33 bp, Artificial Sequence
  Description of Artificial Sequence: Synthetic oligonucleotide
acgtgattaagacaggtgtacgcatgatcagcc

SEQ ID NO: 139747 - DNA, 32 bp, Artificial Sequence
  Description of Artificial Sequence: Synthetic oligonucleotide
cgtgattaagacaggtgtacgcatgatcagcc

SEQ ID NO: 139748 - DNA, 33 bp, Artificial Sequence
  Description of Artificial Sequence: Synthetic oligonucleotide
gtgattaagacaggtgtacgcatgatcagcctc

SEQ ID NO: 139749 - DNA, 34 bp, Artificial Sequence
  Description of Artificial Sequence: Synthetic oligonucleotide
tgattaagacaggtgtacgcatgatcagcctctc

SEQ ID NO: 139750 - DNA, 33 bp, Artificial Sequence
  Description of Artificial Sequence: Synthetic oligonucleotide
gattaagacaggtgtacgcatgatcagcctctc

SEQ ID NO: 139751 - DNA, 33 bp, Artificial Sequence
  Description of Artificial Sequence: Synthetic oligonucleotide
attaagacaggtgtacgcatgatcagcctctcc

SEQ ID NO: 139752 - DNA, 32 bp, Artificial Sequence
  Description of Artificial Sequence: Synthetic oligonucleotide
ttaagacaggtgtacgcatgatcagcctctcc

SEQ ID NO: 139753 - DNA, 31 bp, Artificial Sequence
  Description of Artificial Sequence: Synthetic oligonucleotide
taagacaggtgtacgcatgatcagcctctcc

SEQ ID NO: 139754 - DNA, 30 bp, Artificial Sequence
  Description of Artificial Sequence: Synthetic oligonucleotide
aagacaggtgtacgcatgatcagcctctcc

SEQ ID NO: 139755 - DNA, 29 bp, Artificial Sequence
  Description of Artificial Sequence: Synthetic oligonucleotide
agacaggtgtacgcatgatcagcctctcc

SEQ ID NO: 139756 - DNA, 28 bp, Artificial Sequence
  Description of Artificial Sequence: Synthetic oligonucleotide
gacaggtgtacgcatgatcagcctctcc

SEQ ID NO: 139757 - DNA, 32 bp, Artificial Sequence
  Description of Artificial Sequence: Synthetic oligonucleotide
acaggtgtacgcatgatcagcctctcctattc

SEQ ID NO: 139758 - DNA, 31 bp, Artificial Sequence
  Description of Artificial Sequence: Synthetic oligonucleotide
caggtgtacgcatgatcagcctctcctattc

SEQ ID NO: 139759 - DNA, 31 bp, Artificial Sequence
  Description of Artificial Sequence: Synthetic oligonucleotide
aggtgtacgcatgatcagcctctcctattcc

SEQ ID NO: 139760 - DNA, 30 bp, Artificial Sequence
  Description of Artificial Sequence: Synthetic oligonucleotide
ggtgtacgcatgatcagcctctcctattcc

SEQ ID NO: 139761 - DNA, 30 bp, Artificial Sequence
  Description of Artificial Sequence: Synthetic oligonucleotide
gtgtacgcatgatcagcctctcctattccc

SEQ ID NO: 139762 - DNA, 30 bp, Artificial Sequence
  Description of Artificial Sequence: Synthetic oligonucleotide
tgtacgcatgatcagcctctcctattcccg

SEQ ID NO: 139763 - DNA, 29 bp, Artificial Sequence
  Description of Artificial Sequence: Synthetic oligonucleotide
gtacgcatgatcagcctctcctattcccg

SEQ ID NO: 139764 - DNA, 32 bp, Artificial Sequence
  Description of Artificial Sequence: Synthetic oligonucleotide
tacgcatgatcagcctctcctattcccgaatc

SEQ ID NO: 139765 - DNA, 31 bp, Artificial Sequence
  Description of Artificial Sequence: Synthetic oligonucleotide
acgcatgatcagcctctcctattcccgaatc

SEQ ID NO: 139766 - DNA, 30 bp, Artificial Sequence
  Description of Artificial Sequence: Synthetic oligonucleotide
cgcatgatcagcctctcctattcccgaatc

SEQ ID NO: 139767 - DNA, 31 bp, Artificial Sequence
  Description of Artificial Sequence: Synthetic oligonucleotide
gcatgatcagcctctcctattcccgaatctc

SEQ ID NO: 139768 - DNA, 31 bp, Artificial Sequence
  Description of Artificial Sequence: Synthetic oligonucleotide
catgatcagcctctcctattcccgaatctcc

SEQ ID NO: 139769 - DNA, 33 bp, Artificial Sequence
  Description of Artificial Sequence: Synthetic oligonucleotide
atgatcagcctctcctattcccgaatctccttg

SEQ ID NO: 139770 - DNA, 32 bp, Artificial Sequence
  Description of Artificial Sequence: Synthetic oligonucleotide
tgatcagcctctcctattcccgaatctccttg

SEQ ID NO: 139771 - DNA, 31 bp, Artificial Sequence
  Description of Artificial Sequence: Synthetic oligonucleotide
gatcagcctctcctattcccgaatctccttg

SEQ ID NO: 139772 - DNA, 31 bp, Artificial Sequence
  Description of Artificial Sequence: Synthetic oligonucleotide
atcagcctctcctattcccgaatctccttgg

SEQ ID NO: 139773 - DNA, 30 bp, Artificial Sequence
  Description of Artificial Sequence: Synthetic oligonucleotide
tcagcctctcctattcccgaatctccttgg

SEQ ID NO: 139774 - DNA, 29 bp, Artificial Sequence
  Description of Artificial Sequence: Synthetic oligonucleotide
cagcctctcctattcccgaatctccttgg

SEQ ID NO: 139775 - DNA, 29 bp, Artificial Sequence
  Description of Artificial Sequence: Synthetic oligonucleotide
agcctctcctattcccgaatctccttggc

SEQ ID NO: 139776 - DNA, 28 bp, Artificial Sequence
  Description of Artificial Sequence: Synthetic oligonucleotide
gcctctcctattcccgaatctccttggc

SEQ ID NO: 139777 - DNA, 29 bp, Artificial Sequence
  Description of Artificial Sequence: Synthetic oligonucleotide
cctctcctattcccgaatctccttggctg

SEQ ID NO: 139778 - DNA, 30 bp, Artificial Sequence
  Description of Artificial Sequence: Synthetic oligonucleotide
ctctcctattcccgaatctccttggctgac

SEQ ID NO: 139779 - DNA, 32 bp, Artificial Sequence
  Description of Artificial Sequence: Synthetic oligonucleotide
tctcctattcccgaatctccttggctgacatc

SEQ ID NO: 139780 - DNA, 31 bp, Artificial Sequence
  Description of Artificial Sequence: Synthetic oligonucleotide
ctcctattcccgaatctccttggctgacatc

SEQ ID NO: 139781 - DNA, 31 bp, Artificial Sequence
  Description of Artificial Sequence: Synthetic oligonucleotide
tcctattcccgaatctccttggctgacatcg

SEQ ID NO: 139782 - DNA, 30 bp, Artificial Sequence
  Description of Artificial Sequence: Synthetic oligonucleotide
cctattcccgaatctccttggctgacatcg

SEQ ID NO: 139783 - DNA, 30 bp, Artificial Sequence
  Description of Artificial Sequence: Synthetic oligonucleotide
ctattcccgaatctccttggctgacatcgc

SEQ ID NO: 139784 - DNA, 30 bp, Artificial Sequence
  Description of Artificial Sequence: Synthetic oligonucleotide
tattcccgaatctccttggctgacatcgcc

SEQ ID NO: 139785 - DNA, 29 bp, Artificial Sequence
  Description of Artificial Sequence: Synthetic oligonucleotide
attcccgaatctccttggctgacatcgcc

SEQ ID NO: 139786 - DNA, 28 bp, Artificial Sequence
  Description of Artificial Sequence: Synthetic oligonucleotide
ttcccgaatctccttggctgacatcgcc

SEQ ID NO: 139787 - DNA, 27 bp, Artificial Sequence
  Description of Artificial Sequence: Synthetic oligonucleotide
tcccgaatctccttggctgacatcgcc

SEQ ID NO: 139788 - DNA, 26 bp, Artificial Sequence
  Description of Artificial Sequence: Synthetic oligonucleotide
cccgaatctccttggctgacatcgcc

SEQ ID NO: 139789 - DNA, 27 bp, Artificial Sequence
  Description of Artificial Sequence: Synthetic oligonucleotide
ccgaatctccttggctgacatcgccca

SEQ ID NO: 139790 - DNA, 27 bp, Artificial Sequence
  Description of Artificial Sequence: Synthetic oligonucleotide
cgaatctccttggctgacatcgcccag

SEQ ID NO: 139791 - DNA, 29 bp, Artificial Sequence
  Description of Artificial Sequence: Synthetic oligonucleotide
gaatctccttggctgacatcgcccagaag

SEQ ID NO: 139792 - DNA, 29 bp, Artificial Sequence
  Description of Artificial Sequence: Synthetic oligonucleotide
aatctccttggctgacatcgcccagaagc

SEQ ID NO: 139793 - DNA, 28 bp, Artificial Sequence
  Description of Artificial Sequence: Synthetic oligonucleotide
atctccttggctgacatcgcccagaagc

SEQ ID NO: 139794 - DNA, 27 bp, Artificial Sequence
  Description of Artificial Sequence: Synthetic oligonucleotide
tctccttggctgacatcgcccagaagc

SEQ ID NO: 139795 - DNA, 27 bp, Artificial Sequence
  Description of Artificial Sequence: Synthetic oligonucleotide
ctccttggctgacatcgcccagaagct

SEQ ID NO: 139796 - DNA, 27 bp, Artificial Sequence
  Description of Artificial Sequence: Synthetic oligonucleotide
tccttggctgacatcgcccagaagctg

SEQ ID NO: 139797 - DNA, 26 bp, Artificial Sequence
  Description of Artificial Sequence: Synthetic oligonucleotide
ccttggctgacatcgcccagaagctg

SEQ ID NO: 139798 - DNA, 27 bp, Artificial Sequence
  Description of Artificial Sequence: Synthetic oligonucleotide
cttggctgacatcgcccagaagctgca

SEQ ID NO: 139799 - DNA, 27 bp, Artificial Sequence
  Description of Artificial Sequence: Synthetic oligonucleotide
ttggctgacatcgcccagaagctgcag

SEQ ID NO: 139800 - DNA, 27 bp, Artificial Sequence
  Description of Artificial Sequence: Synthetic oligonucleotide
tggctgacatcgcccagaagctgcagt

SEQ ID NO: 139801 - DNA, 27 bp, Artificial Sequence
  Description of Artificial Sequence: Synthetic oligonucleotide
ggctgacatcgcccagaagctgcagtt

SEQ ID NO: 139802 - DNA, 27 bp, Artificial Sequence
  Description of Artificial Sequence: Synthetic oligonucleotide
gctgacatcgcccagaagctgcagttg

SEQ ID NO: 139803 - DNA, 27 bp, Artificial Sequence
  Description of Artificial Sequence: Synthetic oligonucleotide
ctgacatcgcccagaagctgcagttgg

SEQ ID NO: 139804 - DNA, 30 bp, Artificial Sequence
  Description of Artificial Sequence: Synthetic oligonucleotide
tgacatcgcccagaagctgcagttggatag

SEQ ID NO: 139805 - DNA, 29 bp, Artificial Sequence
  Description of Artificial Sequence: Synthetic oligonucleotide
gacatcgcccagaagctgcagttggatag

SEQ ID NO: 139806 - DNA, 29 bp, Artificial Sequence
  Description of Artificial Sequence: Synthetic oligonucleotide
acatcgcccagaagctgcagttggatagc

SEQ ID NO: 139807 - DNA, 28 bp, Artificial Sequence
  Description of Artificial Sequence: Synthetic oligonucleotide
catcgcccagaagctgcagttggatagc

SEQ ID NO: 139808 - DNA, 28 bp, Artificial Sequence
  Description of Artificial Sequence: Synthetic oligonucleotide
atcgcccagaagctgcagttggatagcc

SEQ ID NO: 139809 - DNA, 27 bp, Artificial Sequence
  Description of Artificial Sequence: Synthetic oligonucleotide
tcgcccagaagctgcagttggatagcc

SEQ ID NO: 139810 - DNA, 26 bp, Artificial Sequence
  Description of Artificial Sequence: Synthetic oligonucleotide
cgcccagaagctgcagttggatagcc

SEQ ID NO: 139811 - DNA, 26 bp, Artificial Sequence
  Description of Artificial Sequence: Synthetic oligonucleotide
gcccagaagctgcagttggatagccc

SEQ ID NO: 139812 - DNA, 26 bp, Artificial Sequence
  Description of Artificial Sequence: Synthetic oligonucleotide
cccagaagctgcagttggatagcccc

SEQ ID NO: 139813 - DNA, 27 bp, Artificial Sequence
  Description of Artificial Sequence: Synthetic oligonucleotide
ccagaagctgcagttggatagccccga

SEQ ID NO: 139814 - DNA, 28 bp, Artificial Sequence
  Description of Artificial Sequence: Synthetic oligonucleotide
cagaagctgcagttggatagccccgaag

SEQ ID NO: 139815 - DNA, 30 bp, Artificial Sequence
  Description of Artificial Sequence: Synthetic oligonucleotide
agaagctgcagttggatagccccgaagatg

SEQ ID NO: 139816 - DNA, 29 bp, Artificial Sequence
  Description of Artificial Sequence: Synthetic oligonucleotide
gaagctgcagttggatagccccgaagatg

SEQ ID NO: 139817 - DNA, 29 bp, Artificial Sequence
  Description of Artificial Sequence: Synthetic oligonucleotide
aagctgcagttggatagccccgaagatgc

SEQ ID NO: 139818 - DNA, 28 bp, Artificial Sequence
  Description of Artificial Sequence: Synthetic oligonucleotide
agctgcagttggatagccccgaagatgc

SEQ ID NO: 139819 - DNA, 27 bp, Artificial Sequence
  Description of Artificial Sequence: Synthetic oligonucleotide
gctgcagttggatagccccgaagatgc

SEQ ID NO: 139820 - DNA, 28 bp, Artificial Sequence
  Description of Artificial Sequence: Synthetic oligonucleotide
ctgcagttggatagccccgaagatgcag

SEQ ID NO: 139821 - DNA, 29 bp, Artificial Sequence
  Description of Artificial Sequence: Synthetic oligonucleotide
tgcagttggatagccccgaagatgcagag

SEQ ID NO: 139822 - DNA, 28 bp, Artificial Sequence
  Description of Artificial Sequence: Synthetic oligonucleotide
gcagttggatagccccgaagatgcagag

SEQ ID NO: 139823 - DNA, 30 bp, Artificial Sequence
  Description of Artificial Sequence: Synthetic oligonucleotide
cagttggatagccccgaagatgcagagttc

SEQ ID NO: 139824 - DNA, 33 bp, Artificial Sequence
  Description of Artificial Sequence: Synthetic oligonucleotide
agttggatagccccgaagatgcagagttcattg

SEQ ID NO: 139825 - DNA, 32 bp, Artificial Sequence
  Description of Artificial Sequence: Synthetic oligonucleotide
gttggatagccccgaagatgcagagttcattg

SEQ ID NO: 139826 - DNA, 34 bp, Artificial Sequence
  Description of Artificial Sequence: Synthetic oligonucleotide
ttggatagccccgaagatgcagagttcattgttg

SEQ ID NO: 139827 - DNA, 33 bp, Artificial Sequence
  Description of Artificial Sequence: Synthetic oligonucleotide
tggatagccccgaagatgcagagttcattgttg

SEQ ID NO: 139828 - DNA, 32 bp, Artificial Sequence
  Description of Artificial Sequence: Synthetic oligonucleotide
ggatagccccgaagatgcagagttcattgttg

SEQ ID NO: 139829 - DNA, 32 bp, Artificial Sequence
  Description of Artificial Sequence: Synthetic oligonucleotide
gatagccccgaagatgcagagttcattgttgc

SEQ ID NO: 139830 - DNA, 32 bp, Artificial Sequence
  Description of Artificial Sequence: Synthetic oligonucleotide
atagccccgaagatgcagagttcattgttgcc

SEQ ID NO: 139831 - DNA, 31 bp, Artificial Sequence
  Description of Artificial Sequence: Synthetic oligonucleotide
tagccccgaagatgcagagttcattgttgcc

SEQ ID NO: 139832 - DNA, 30 bp, Artificial Sequence
  Description of Artificial Sequence: Synthetic oligonucleotide
agccccgaagatgcagagttcattgttgcc

SEQ ID NO: 139833 - DNA, 29 bp, Artificial Sequence
  Description of Artificial Sequence: Synthetic oligonucleotide
gccccgaagatgcagagttcattgttgcc

SEQ ID NO: 139834 - DNA, 31 bp, Artificial Sequence
  Description of Artificial Sequence: Synthetic oligonucleotide
ccccgaagatgcagagttcattgttgccaag

SEQ ID NO: 139835 - DNA, 31 bp, Artificial Sequence
  Description of Artificial Sequence: Synthetic oligonucleotide
cccgaagatgcagagttcattgttgccaagg

SEQ ID NO: 139836 - DNA, 31 bp, Artificial Sequence
  Description of Artificial Sequence: Synthetic oligonucleotide
ccgaagatgcagagttcattgttgccaaggc

SEQ ID NO: 139837 - DNA, 31 bp, Artificial Sequence
  Description of Artificial Sequence: Synthetic oligonucleotide
cgaagatgcagagttcattgttgccaaggcc

SEQ ID NO: 139838 - DNA, 33 bp, Artificial Sequence
  Description of Artificial Sequence: Synthetic oligonucleotide
gaagatgcagagttcattgttgccaaggccatc

SEQ ID NO: 139839 - DNA, 33 bp, Artificial Sequence
  Description of Artificial Sequence: Synthetic oligonucleotide
aagatgcagagttcattgttgccaaggccatcc

SEQ ID NO: 139840 - DNA, 32 bp, Artificial Sequence
  Description of Artificial Sequence: Synthetic oligonucleotide
agatgcagagttcattgttgccaaggccatcc

SEQ ID NO: 139841 - DNA, 31 bp, Artificial Sequence
  Description of Artificial Sequence: Synthetic oligonucleotide
gatgcagagttcattgttgccaaggccatcc

SEQ ID NO: 139842 - DNA, 31 bp, Artificial Sequence
  Description of Artificial Sequence: Synthetic oligonucleotide
atgcagagttcattgttgccaaggccatccg

SEQ ID NO: 139843 - DNA, 30 bp, Artificial Sequence
  Description of Artificial Sequence: Synthetic oligonucleotide
tgcagagttcattgttgccaaggccatccg

SEQ ID NO: 139844 - DNA, 29 bp, Artificial Sequence
  Description of Artificial Sequence: Synthetic oligonucleotide
gcagagttcattgttgccaaggccatccg

SEQ ID NO: 139845 - DNA, 29 bp, Artificial Sequence
  Description of Artificial Sequence: Synthetic oligonucleotide
cagagttcattgttgccaaggccatccgg

SEQ ID NO: 139846 - DNA, 29 bp, Artificial Sequence
  Description of Artificial Sequence: Synthetic oligonucleotide
agagttcattgttgccaaggccatccggg

SEQ ID NO: 139847 - DNA, 28 bp, Artificial Sequence
  Description of Artificial Sequence: Synthetic oligonucleotide
gagttcattgttgccaaggccatccggg

SEQ ID NO: 139848 - DNA, 30 bp, Artificial Sequence
  Description of Artificial Sequence: Synthetic oligonucleotide
agttcattgttgccaaggccatccgggatg

SEQ ID NO: 139849 - DNA, 29 bp, Artificial Sequence
  Description of Artificial Sequence: Synthetic oligonucleotide
gttcattgttgccaaggccatccgggatg

SEQ ID NO: 139850 - DNA, 29 bp, Artificial Sequence
  Description of Artificial Sequence: Synthetic oligonucleotide
ttcattgttgccaaggccatccgggatgg

SEQ ID NO: 139851 - DNA, 28 bp, Artificial Sequence
  Description of Artificial Sequence: Synthetic oligonucleotide
tcattgttgccaaggccatccgggatgg

SEQ ID NO: 139852 - DNA, 27 bp, Artificial Sequence
  Description of Artificial Sequence: Synthetic oligonucleotide
cattgttgccaaggccatccgggatgg

SEQ ID NO: 139853 - DNA, 28 bp, Artificial Sequence
  Description of Artificial Sequence: Synthetic oligonucleotide
attgttgccaaggccatccgggatggtg

SEQ ID NO: 139854 - DNA, 27 bp, Artificial Sequence
  Description of Artificial Sequence: Synthetic oligonucleotide
ttgttgccaaggccatccgggatggtg

SEQ ID NO: 139855 - DNA, 27 bp, Artificial Sequence
  Description of Artificial Sequence: Synthetic oligonucleotide
tgttgccaaggccatccgggatggtgt

SEQ ID NO: 139856 - DNA, 26 bp, Artificial Sequence
  Description of Artificial Sequence: Synthetic oligonucleotide
gttgccaaggccatccgggatggtgt

SEQ ID NO: 139857 - DNA, 27 bp, Artificial Sequence
  Description of Artificial Sequence: Synthetic oligonucleotide
ttgccaaggccatccgggatggtgtca

SEQ ID NO: 139858 - DNA, 27 bp, Artificial Sequence
  Description of Artificial Sequence: Synthetic oligonucleotide
tgccaaggccatccgggatggtgtcat

SEQ ID NO: 139859 - DNA, 27 bp, Artificial Sequence
  Description of Artificial Sequence: Synthetic oligonucleotide
gccaaggccatccgggatggtgtcatt

SEQ ID NO: 139860 - DNA, 27 bp, Artificial Sequence
  Description of Artificial Sequence: Synthetic oligonucleotide
ccaaggccatccgggatggtgtcattg

SEQ ID NO: 139861 - DNA, 28 bp, Artificial Sequence
  Description of Artificial Sequence: Synthetic oligonucleotide
caaggccatccgggatggtgtcattgag

SEQ ID NO: 139862 - DNA, 28 bp, Artificial Sequence
  Description of Artificial Sequence: Synthetic oligonucleotide
aaggccatccgggatggtgtcattgagg

SEQ ID NO: 139863 - DNA, 27 bp, Artificial Sequence
  Description of Artificial Sequence: Synthetic oligonucleotide
aggccatccgggatggtgtcattgagg

SEQ ID NO: 139864 - DNA, 26 bp, Artificial Sequence
  Description of Artificial Sequence: Synthetic oligonucleotide
ggccatccgggatggtgtcattgagg

SEQ ID NO: 139865 - DNA, 26 bp, Artificial Sequence
  Description of Artificial Sequence: Synthetic oligonucleotide
gccatccgggatggtgtcattgaggc

SEQ ID NO: 139866 - DNA, 27 bp, Artificial Sequence
  Description of Artificial Sequence: Synthetic oligonucleotide
ccatccgggatggtgtcattgaggcca

SEQ ID NO: 139867 - DNA, 27 bp, Artificial Sequence
  Description of Artificial Sequence: Synthetic oligonucleotide
catccgggatggtgtcattgaggccag

SEQ ID NO: 139868 - DNA, 27 bp, Artificial Sequence
  Description of Artificial Sequence: Synthetic oligonucleotide
atccgggatggtgtcattgaggccagc

SEQ ID NO: 139869 - DNA, 27 bp, Artificial Sequence
  Description of Artificial Sequence: Synthetic oligonucleotide
tccgggatggtgtcattgaggccagca

SEQ ID NO: 139870 - DNA, 27 bp, Artificial Sequence
  Description of Artificial Sequence: Synthetic oligonucleotide
ccgggatggtgtcattgaggccagcat

SEQ ID NO: 139871 - DNA, 27 bp, Artificial Sequence
  Description of Artificial Sequence: Synthetic oligonucleotide
cgggatggtgtcattgaggccagcatc

SEQ ID NO: 139872 - DNA, 29 bp, Artificial Sequence
  Description of Artificial Sequence: Synthetic oligonucleotide
gggatggtgtcattgaggccagcatcaac

SEQ ID NO: 139873 - DNA, 29 bp, Artificial Sequence
  Description of Artificial Sequence: Synthetic oligonucleotide
ggatggtgtcattgaggccagcatcaacc

SEQ ID NO: 139874 - DNA, 30 bp, Artificial Sequence
  Description of Artificial Sequence: Synthetic oligonucleotide
gatggtgtcattgaggccagcatcaaccac

SEQ ID NO: 139875 - DNA, 30 bp, Artificial Sequence
  Description of Artificial Sequence: Synthetic oligonucleotide
atggtgtcattgaggccagcatcaaccacg

SEQ ID NO: 139876 - DNA, 29 bp, Artificial Sequence
  Description of Artificial Sequence: Synthetic oligonucleotide
tggtgtcattgaggccagcatcaaccacg

SEQ ID NO: 139877 - DNA, 28 bp, Artificial Sequence
  Description of Artificial Sequence: Synthetic oligonucleotide
ggtgtcattgaggccagcatcaaccacg

SEQ ID NO: 139878 - DNA, 29 bp, Artificial Sequence
  Description of Artificial Sequence: Synthetic oligonucleotide
gtgtcattgaggccagcatcaaccacgag

SEQ ID NO: 139879 - DNA, 31 bp, Artificial Sequence
  Description of Artificial Sequence: Synthetic oligonucleotide
tgtcattgaggccagcatcaaccacgagaag

SEQ ID NO: 139880 - DNA, 30 bp, Artificial Sequence
  Description of Artificial Sequence: Synthetic oligonucleotide
gtcattgaggccagcatcaaccacgagaag

SEQ ID NO: 139881 - DNA, 30 bp, Artificial Sequence
  Description of Artificial Sequence: Synthetic oligonucleotide
tcattgaggccagcatcaaccacgagaagg

SEQ ID NO: 139882 - DNA, 29 bp, Artificial Sequence
  Description of Artificial Sequence: Synthetic oligonucleotide
cattgaggccagcatcaaccacgagaagg

SEQ ID NO: 139883 - DNA, 29 bp, Artificial Sequence
  Description of Artificial Sequence: Synthetic oligonucleotide
attgaggccagcatcaaccacgagaaggg

SEQ ID NO: 139884 - DNA, 28 bp, Artificial Sequence
  Description of Artificial Sequence: Synthetic oligonucleotide
ttgaggccagcatcaaccacgagaaggg

SEQ ID NO: 139885 - DNA, 27 bp, Artificial Sequence
  Description of Artificial Sequence: Synthetic oligonucleotide
tgaggccagcatcaaccacgagaaggg

SEQ ID NO: 139886 - DNA, 26 bp, Artificial Sequence
  Description of Artificial Sequence: Synthetic oligonucleotide
gaggccagcatcaaccacgagaaggg

SEQ ID NO: 139887 - DNA, 27 bp, Artificial Sequence
  Description of Artificial Sequence: Synthetic oligonucleotide
aggccagcatcaaccacgagaagggct

SEQ ID NO: 139888 - DNA, 27 bp, Artificial Sequence
  Description of Artificial Sequence: Synthetic oligonucleotide
ggccagcatcaaccacgagaagggcta

SEQ ID NO: 139889 - DNA, 28 bp, Artificial Sequence
  Description of Artificial Sequence: Synthetic oligonucleotide
gccagcatcaaccacgagaagggctatg

SEQ ID NO: 139890 - DNA, 29 bp, Artificial Sequence
  Description of Artificial Sequence: Synthetic oligonucleotide
ccagcatcaaccacgagaagggctatgtc

SEQ ID NO: 139891 - DNA, 29 bp, Artificial Sequence
  Description of Artificial Sequence: Synthetic oligonucleotide
cagcatcaaccacgagaagggctatgtcc

SEQ ID NO: 139892 - DNA, 32 bp, Artificial Sequence
  Description of Artificial Sequence: Synthetic oligonucleotide
agcatcaaccacgagaagggctatgtccaatc

SEQ ID NO: 139893 - DNA, 31 bp, Artificial Sequence
  Description of Artificial Sequence: Synthetic oligonucleotide
gcatcaaccacgagaagggctatgtccaatc

SEQ ID NO: 139894 - DNA, 31 bp, Artificial Sequence
  Description of Artificial Sequence: Synthetic oligonucleotide
catcaaccacgagaagggctatgtccaatcc

SEQ ID NO: 139895 - DNA, 33 bp, Artificial Sequence
  Description of Artificial Sequence: Synthetic oligonucleotide
atcaaccacgagaagggctatgtccaatccaag

SEQ ID NO: 139896 - DNA, 32 bp, Artificial Sequence
  Description of Artificial Sequence: Synthetic oligonucleotide
tcaaccacgagaagggctatgtccaatccaag

SEQ ID NO: 139897 - DNA, 31 bp, Artificial Sequence
  Description of Artificial Sequence: Synthetic oligonucleotide
caaccacgagaagggctatgtccaatccaag

SEQ ID NO: 139898 - DNA, 31 bp, Artificial Sequence
  Description of Artificial Sequence: Synthetic oligonucleotide
aaccacgagaagggctatgtccaatccaagg

SEQ ID NO: 139899 - DNA, 30 bp, Artificial Sequence
  Description of Artificial Sequence: Synthetic oligonucleotide
accacgagaagggctatgtccaatccaagg

SEQ ID NO: 139900 - DNA, 29 bp, Artificial Sequence
  Description of Artificial Sequence: Synthetic oligonucleotide
ccacgagaagggctatgtccaatccaagg

SEQ ID NO: 139901 - DNA, 30 bp, Artificial Sequence
  Description of Artificial Sequence: Synthetic oligonucleotide
cacgagaagggctatgtccaatccaaggag

SEQ ID NO: 139902 - DNA, 32 bp, Artificial Sequence
  Description of Artificial Sequence: Synthetic oligonucleotide
acgagaagggctatgtccaatccaaggagatg

SEQ ID NO: 139903 - DNA, 31 bp, Artificial Sequence
  Description of Artificial Sequence: Synthetic oligonucleotide
cgagaagggctatgtccaatccaaggagatg

SEQ ID NO: 139904 - DNA, 34 bp, Artificial Sequence
  Description of Artificial Sequence: Synthetic oligonucleotide
gagaagggctatgtccaatccaaggagatgattg

SEQ ID NO: 139905 - DNA, 35 bp, Artificial Sequence
  Description of Artificial Sequence: Synthetic oligonucleotide
agaagggctatgtccaatccaaggagatgattgac

SEQ ID NO: 139906 - DNA, 34 bp, Artificial Sequence
  Description of Artificial Sequence: Synthetic oligonucleotide
gaagggctatgtccaatccaaggagatgattgac

SEQ ID NO: 139907 - DNA, 36 bp, Artificial Sequence
  Description of Artificial Sequence: Synthetic oligonucleotide
aagggctatgtccaatccaaggagatgattgacatc

SEQ ID NO: 139908 - DNA, 35 bp, Artificial Sequence
  Description of Artificial Sequence: Synthetic oligonucleotide
agggctatgtccaatccaaggagatgattgacatc

SEQ ID NO: 139909 - DNA, 34 bp, Artificial Sequence
  Description of Artificial Sequence: Synthetic oligonucleotide
gggctatgtccaatccaaggagatgattgacatc

SEQ ID NO: 139910 - DNA, 38 bp, Artificial Sequence
  Description of Artificial Sequence: Synthetic oligonucleotide
ggctatgtccaatccaaggagatgattgacatctattc

SEQ ID NO: 139911 - DNA, 38 bp, Artificial Sequence
  Description of Artificial Sequence: Synthetic oligonucleotide
gctatgtccaatccaaggagatgattgacatctattcc

SEQ ID NO: 139912 - DNA, 39 bp, Artificial Sequence
  Description of Artificial Sequence: Synthetic oligonucleotide
ctatgtccaatccaaggagatgattgacatctattccac

SEQ ID NO: 139913 - DNA, 39 bp, Artificial Sequence
  Description of Artificial Sequence: Synthetic oligonucleotide
tatgtccaatccaaggagatgattgacatctattccacc

SEQ ID NO: 139914 - DNA, 38 bp, Artificial Sequence
  Description of Artificial Sequence: Synthetic oligonucleotide
atgtccaatccaaggagatgattgacatctattccacc

SEQ ID NO: 139915 - DNA, 37 bp, Artificial Sequence
  Description of Artificial Sequence: Synthetic oligonucleotide
tgtccaatccaaggagatgattgacatctattccacc

SEQ ID NO: 139916 - DNA, 36 bp, Artificial Sequence
  Description of Artificial Sequence: Synthetic oligonucleotide
gtccaatccaaggagatgattgacatctattccacc

SEQ ID NO: 139917 - DNA, 36 bp, Artificial Sequence
  Description of Artificial Sequence: Synthetic oligonucleotide
tccaatccaaggagatgattgacatctattccaccc

SEQ ID NO: 139918 - DNA, 35 bp, Artificial Sequence
  Description of Artificial Sequence: Synthetic oligonucleotide
ccaatccaaggagatgattgacatctattccaccc

SEQ ID NO: 139919 - DNA, 35 bp, Artificial Sequence
  Description of Artificial Sequence: Synthetic oligonucleotide
caatccaaggagatgattgacatctattccacccg

SEQ ID NO: 139920 - DNA, 36 bp, Artificial Sequence
  Description of Artificial Sequence: Synthetic oligonucleotide
aatccaaggagatgattgacatctattccacccgag

SEQ ID NO: 139921 - DNA, 35 bp, Artificial Sequence
  Description of Artificial Sequence: Synthetic oligonucleotide
atccaaggagatgattgacatctattccacccgag

SEQ ID NO: 139922 - DNA, 34 bp, Artificial Sequence
  Description of Artificial Sequence: Synthetic oligonucleotide
tccaaggagatgattgacatctattccacccgag

SEQ ID NO: 139923 - DNA, 33 bp, Artificial Sequence
  Description of Artificial Sequence: Synthetic oligonucleotide
ccaaggagatgattgacatctattccacccgag

SEQ ID NO: 139924 - DNA, 34 bp, Artificial Sequence
  Description of Artificial Sequence: Synthetic oligonucleotide
caaggagatgattgacatctattccacccgagag

SEQ ID NO: 139925 - DNA, 34 bp, Artificial Sequence
  Description of Artificial Sequence: Synthetic oligonucleotide
aaggagatgattgacatctattccacccgagagc

SEQ ID NO: 139926 - DNA, 33 bp, Artificial Sequence
  Description of Artificial Sequence: Synthetic oligonucleotide
aggagatgattgacatctattccacccgagagc

SEQ ID NO: 139927 - DNA, 32 bp, Artificial Sequence
  Description of Artificial Sequence: Synthetic oligonucleotide
ggagatgattgacatctattccacccgagagc

SEQ ID NO: 139928 - DNA, 32 bp, Artificial Sequence
  Description of Artificial Sequence: Synthetic oligonucleotide
gagatgattgacatctattccacccgagagcc

SEQ ID NO: 139929 - DNA, 32 bp, Artificial Sequence
  Description of Artificial Sequence: Synthetic oligonucleotide
agatgattgacatctattccacccgagagccc

SEQ ID NO: 139930 - DNA, 31 bp, Artificial Sequence
  Description of Artificial Sequence: Synthetic oligonucleotide
gatgattgacatctattccacccgagagccc

SEQ ID NO: 139931 - DNA, 31 bp, Artificial Sequence
  Description of Artificial Sequence: Synthetic oligonucleotide
atgattgacatctattccacccgagagcccc

SEQ ID NO: 139932 - DNA, 30 bp, Artificial Sequence
  Description of Artificial Sequence: Synthetic oligonucleotide
tgattgacatctattccacccgagagcccc

SEQ ID NO: 139933 - DNA, 29 bp, Artificial Sequence
  Description of Artificial Sequence: Synthetic oligonucleotide
gattgacatctattccacccgagagcccc

SEQ ID NO: 139934 - DNA, 30 bp, Artificial Sequence
  Description of Artificial Sequence: Synthetic oligonucleotide
attgacatctattccacccgagagccccag

SEQ ID NO: 139935 - DNA, 29 bp, Artificial Sequence
  Description of Artificial Sequence: Synthetic oligonucleotide
ttgacatctattccacccgagagccccag

SEQ ID NO: 139936 - DNA, 28 bp, Artificial Sequence
  Description of Artificial Sequence: Synthetic oligonucleotide
tgacatctattccacccgagagccccag

SEQ ID NO: 139937 - DNA, 27 bp, Artificial Sequence
  Description of Artificial Sequence: Synthetic oligonucleotide
gacatctattccacccgagagccccag

SEQ ID NO: 139938 - DNA, 27 bp, Artificial Sequence
  Description of Artificial Sequence: Synthetic oligonucleotide
acatctattccacccgagagccccagc

SEQ ID NO: 139939 - DNA, 27 bp, Artificial Sequence
  Description of Artificial Sequence: Synthetic oligonucleotide
catctattccacccgagagccccagct

SEQ ID NO: 139940 - DNA, 28 bp, Artificial Sequence
  Description of Artificial Sequence: Synthetic oligonucleotide
atctattccacccgagagccccagctag

SEQ ID NO: 139941 - DNA, 27 bp, Artificial Sequence
  Description of Artificial Sequence: Synthetic oligonucleotide
tctattccacccgagagccccagctag

SEQ ID NO: 139942 - DNA, 26 bp, Artificial Sequence
  Description of Artificial Sequence: Synthetic oligonucleotide
ctattccacccgagagccccagctag

SEQ ID NO: 139943 - DNA, 26 bp, Artificial Sequence
  Description of Artificial Sequence: Synthetic oligonucleotide
tattccacccgagagccccagctagc

SEQ ID NO: 139944 - DNA, 25 bp, Artificial Sequence
  Description of Artificial Sequence: Synthetic oligonucleotide
attccacccgagagccccagctagc

SEQ ID NO: 139945 - DNA, 24 bp, Artificial Sequence
  Description of Artificial Sequence: Synthetic oligonucleotide
ttccacccgagagccccagctagc

SEQ ID NO: 139946 - DNA, 23 bp, Artificial Sequence
  Description of Artificial Sequence: Synthetic oligonucleotide
tccacccgagagccccagctagc

SEQ ID NO: 139947 - DNA, 22 bp, Artificial Sequence
  Description of Artificial Sequence: Synthetic oligonucleotide
ccacccgagagccccagctagc

SEQ ID NO: 139948 - DNA, 24 bp, Artificial Sequence
  Description of Artificial Sequence: Synthetic oligonucleotide
cacccgagagccccagctagcctt

SEQ ID NO: 139949 - DNA, 24 bp, Artificial Sequence
  Description of Artificial Sequence: Synthetic oligonucleotide
acccgagagccccagctagccttc

SEQ ID NO: 139950 - DNA, 23 bp, Artificial Sequence
  Description of Artificial Sequence: Synthetic oligonucleotide
cccgagagccccagctagccttc

SEQ ID NO: 139951 - DNA, 24 bp, Artificial Sequence
  Description of Artificial Sequence: Synthetic oligonucleotide
ccgagagccccagctagccttcca

SEQ ID NO: 139952 - DNA, 24 bp, Artificial Sequence
  Description of Artificial Sequence: Synthetic oligonucleotide
cgagagccccagctagccttccac

SEQ ID NO: 139953 - DNA, 25 bp, Artificial Sequence
  Description of Artificial Sequence: Synthetic oligonucleotide
gagagccccagctagccttccacca

SEQ ID NO: 139954 - DNA, 25 bp, Artificial Sequence
  Description of Artificial Sequence: Synthetic oligonucleotide
agagccccagctagccttccaccag

SEQ ID NO: 139955 - DNA, 24 bp, Artificial Sequence
  Description of Artificial Sequence: Synthetic oligonucleotide
gagccccagctagccttccaccag

SEQ ID NO: 139956 - DNA, 24 bp, Artificial Sequence
  Description of Artificial Sequence: Synthetic oligonucleotide
agccccagctagccttccaccagc

SEQ ID NO: 139957 - DNA, 23 bp, Artificial Sequence
  Description of Artificial Sequence: Synthetic oligonucleotide
gccccagctagccttccaccagc

SEQ ID NO: 139958 - DNA, 23 bp, Artificial Sequence
  Description of Artificial Sequence: Synthetic oligonucleotide
ccccagctagccttccaccagcg

SEQ ID NO: 139959 - DNA, 25 bp, Artificial Sequence
  Description of Artificial Sequence: Synthetic oligonucleotide
cccagctagccttccaccagcgcat

SEQ ID NO: 139960 - DNA, 26 bp, Artificial Sequence
  Description of Artificial Sequence: Synthetic oligonucleotide
ccagctagccttccaccagcgcatct

SEQ ID NO: 139961 - DNA, 26 bp, Artificial Sequence
  Description of Artificial Sequence: Synthetic oligonucleotide
cagctagccttccaccagcgcatctc

SEQ ID NO: 139962 - DNA, 27 bp, Artificial Sequence
  Description of Artificial Sequence: Synthetic oligonucleotide
agctagccttccaccagcgcatctcct

SEQ ID NO: 139963 - DNA, 27 bp, Artificial Sequence
  Description of Artificial Sequence: Synthetic oligonucleotide
gctagccttccaccagcgcatctcctt

SEQ ID NO: 139964 - DNA, 27 bp, Artificial Sequence
  Description of Artificial Sequence: Synthetic oligonucleotide
ctagccttccaccagcgcatctccttc

SEQ ID NO: 139965 - DNA, 28 bp, Artificial Sequence
  Description of Artificial Sequence: Synthetic oligonucleotide
tagccttccaccagcgcatctccttctg

SEQ ID NO: 139966 - DNA, 27 bp, Artificial Sequence
  Description of Artificial Sequence: Synthetic oligonucleotide
agccttccaccagcgcatctccttctg

SEQ ID NO: 139967 - DNA, 26 bp, Artificial Sequence
  Description of Artificial Sequence: Synthetic oligonucleotide
gccttccaccagcgcatctccttctg

SEQ ID NO: 139968 - DNA, 26 bp, Artificial Sequence
  Description of Artificial Sequence: Synthetic oligonucleotide
ccttccaccagcgcatctccttctgc

SEQ ID NO: 139969 - DNA, 27 bp, Artificial Sequence
  Description of Artificial Sequence: Synthetic oligonucleotide
cttccaccagcgcatctccttctgcct

SEQ ID NO: 139970 - DNA, 28 bp, Artificial Sequence
  Description of Artificial Sequence: Synthetic oligonucleotide
ttccaccagcgcatctccttctgcctag

SEQ ID NO: 139971 - DNA, 27 bp, Artificial Sequence
  Description of Artificial Sequence: Synthetic oligonucleotide
tccaccagcgcatctccttctgcctag

SEQ ID NO: 139972 - DNA, 27 bp, Artificial Sequence
  Description of Artificial Sequence: Synthetic oligonucleotide
ccaccagcgcatctccttctgcctaga

SEQ ID NO: 139973 - DNA, 30 bp, Artificial Sequence
  Description of Artificial Sequence: Synthetic oligonucleotide
caccagcgcatctccttctgcctagatatc

SEQ ID NO: 139974 - DNA, 30 bp, Artificial Sequence
  Description of Artificial Sequence: Synthetic oligonucleotide
accagcgcatctccttctgcctagatatcc

SEQ ID NO: 139975 - DNA, 29 bp, Artificial Sequence
  Description of Artificial Sequence: Synthetic oligonucleotide
ccagcgcatctccttctgcctagatatcc

SEQ ID NO: 139976 - DNA, 30 bp, Artificial Sequence
  Description of Artificial Sequence: Synthetic oligonucleotide
cagcgcatctccttctgcctagatatccac

SEQ ID NO: 139977 - DNA, 32 bp, Artificial Sequence
  Description of Artificial Sequence: Synthetic oligonucleotide
agcgcatctccttctgcctagatatccacaac

SEQ ID NO: 139978 - DNA, 31 bp, Artificial Sequence
  Description of Artificial Sequence: Synthetic oligonucleotide
gcgcatctccttctgcctagatatccacaac

SEQ ID NO: 139979 - DNA, 33 bp, Artificial Sequence
  Description of Artificial Sequence: Synthetic oligonucleotide
cgcatctccttctgcctagatatccacaacatg

SEQ ID NO: 139980 - DNA, 34 bp, Artificial Sequence
  Description of Artificial Sequence: Synthetic oligonucleotide
gcatctccttctgcctagatatccacaacatgtc

SEQ ID NO: 139981 - DNA, 35 bp, Artificial Sequence
  Description of Artificial Sequence: Synthetic oligonucleotide
catctccttctgcctagatatccacaacatgtctg

SEQ ID NO: 139982 - DNA, 36 bp, Artificial Sequence
  Description of Artificial Sequence: Synthetic oligonucleotide
atctccttctgcctagatatccacaacatgtctgtc

SEQ ID NO: 139983 - DNA, 35 bp, Artificial Sequence
  Description of Artificial Sequence: Synthetic oligonucleotide
tctccttctgcctagatatccacaacatgtctgtc

SEQ ID NO: 139984 - DNA, 34 bp, Artificial Sequence
  Description of Artificial Sequence: Synthetic oligonucleotide
ctccttctgcctagatatccacaacatgtctgtc

SEQ ID NO: 139985 - DNA, 36 bp, Artificial Sequence
  Description of Artificial Sequence: Synthetic oligonucleotide
tccttctgcctagatatccacaacatgtctgtcaag

SEQ ID NO: 139986 - DNA, 35 bp, Artificial Sequence
  Description of Artificial Sequence: Synthetic oligonucleotide
ccttctgcctagatatccacaacatgtctgtcaag

SEQ ID NO: 139987 - DNA, 35 bp, Artificial Sequence
  Description of Artificial Sequence: Synthetic oligonucleotide
cttctgcctagatatccacaacatgtctgtcaagg

SEQ ID NO: 139988 - DNA, 35 bp, Artificial Sequence
  Description of Artificial Sequence: Synthetic oligonucleotide
ttctgcctagatatccacaacatgtctgtcaaggc

SEQ ID NO: 139989 - DNA, 34 bp, Artificial Sequence
  Description of Artificial Sequence: Synthetic oligonucleotide
tctgcctagatatccacaacatgtctgtcaaggc

SEQ ID NO: 139990 - DNA, 33 bp, Artificial Sequence
  Description of Artificial Sequence: Synthetic oligonucleotide
ctgcctagatatccacaacatgtctgtcaaggc

SEQ ID NO: 139991 - DNA, 33 bp, Artificial Sequence
  Description of Artificial Sequence: Synthetic oligonucleotide
tgcctagatatccacaacatgtctgtcaaggcc

SEQ ID NO: 139992 - DNA, 32 bp, Artificial Sequence
  Description of Artificial Sequence: Synthetic oligonucleotide
gcctagatatccacaacatgtctgtcaaggcc

SEQ ID NO: 139993 - DNA, 34 bp, Artificial Sequence
  Description of Artificial Sequence: Synthetic oligonucleotide
cctagatatccacaacatgtctgtcaaggccatg

SEQ ID NO: 139994 - DNA, 35 bp, Artificial Sequence
  Description of Artificial Sequence: Synthetic oligonucleotide
ctagatatccacaacatgtctgtcaaggccatgag

SEQ ID NO: 139995 - DNA, 35 bp, Artificial Sequence
  Description of Artificial Sequence: Synthetic oligonucleotide
tagatatccacaacatgtctgtcaaggccatgagg

SEQ ID NO: 139996 - DNA, 34 bp, Artificial Sequence
  Description of Artificial Sequence: Synthetic oligonucleotide
agatatccacaacatgtctgtcaaggccatgagg

SEQ ID NO: 139997 - DNA, 33 bp, Artificial Sequence
  Description of Artificial Sequence: Synthetic oligonucleotide
gatatccacaacatgtctgtcaaggccatgagg

SEQ ID NO: 139998 - DNA, 36 bp, Artificial Sequence
  Description of Artificial Sequence: Synthetic oligonucleotide
atatccacaacatgtctgtcaaggccatgaggtttc

SEQ ID NO: 139999 - DNA, 35 bp, Artificial Sequence
  Description of Artificial Sequence: Synthetic oligonucleotide
tatccacaacatgtctgtcaaggccatgaggtttc

SEQ ID NO: 140000 - DNA, 34 bp, Artificial Sequence
  Description of Artificial Sequence: Synthetic oligonucleotide
atccacaacatgtctgtcaaggccatgaggtttc

SEQ ID NO: 140001 - DNA, 33 bp, Artificial Sequence
  Description of Artificial Sequence: Synthetic oligonucleotide
tccacaacatgtctgtcaaggccatgaggtttc

SEQ ID NO: 140002 - DNA, 32 bp, Artificial Sequence
  Description of Artificial Sequence: Synthetic oligonucleotide
ccacaacatgtctgtcaaggccatgaggtttc

SEQ ID NO: 140003 - DNA, 32 bp, Artificial Sequence
  Description of Artificial Sequence: Synthetic oligonucleotide
cacaacatgtctgtcaaggccatgaggtttcc

SEQ ID NO: 140004 - DNA, 33 bp, Artificial Sequence
  Description of Artificial Sequence: Synthetic oligonucleotide
acaacatgtctgtcaaggccatgaggtttcctc

SEQ ID NO: 140005 - DNA, 32 bp, Artificial Sequence
  Description of Artificial Sequence: Synthetic oligonucleotide
caacatgtctgtcaaggccatgaggtttcctc

SEQ ID NO: 140006 - DNA, 32 bp, Artificial Sequence
  Description of Artificial Sequence: Synthetic oligonucleotide
aacatgtctgtcaaggccatgaggtttcctcc

SEQ ID NO: 140007 - DNA, 31 bp, Artificial Sequence
  Description of Artificial Sequence: Synthetic oligonucleotide
acatgtctgtcaaggccatgaggtttcctcc

SEQ ID NO: 140008 - DNA, 30 bp, Artificial Sequence
  Description of Artificial Sequence: Synthetic oligonucleotide
catgtctgtcaaggccatgaggtttcctcc

SEQ ID NO: 140009 - DNA, 30 bp, Artificial Sequence
  Description of Artificial Sequence: Synthetic oligonucleotide
atgtctgtcaaggccatgaggtttcctccc

SEQ ID NO: 140010 - DNA, 29 bp, Artificial Sequence
  Description of Artificial Sequence: Synthetic oligonucleotide
tgtctgtcaaggccatgaggtttcctccc

SEQ ID NO: 140011 - DNA, 28 bp, Artificial Sequence
  Description of Artificial Sequence: Synthetic oligonucleotide
gtctgtcaaggccatgaggtttcctccc

SEQ ID NO: 140012 - DNA, 32 bp, Artificial Sequence
  Description of Artificial Sequence: Synthetic oligonucleotide
tctgtcaaggccatgaggtttcctcccaaatc

SEQ ID NO: 140013 - DNA, 31 bp, Artificial Sequence
  Description of Artificial Sequence: Synthetic oligonucleotide
ctgtcaaggccatgaggtttcctcccaaatc

SEQ ID NO: 140014 - DNA, 31 bp, Artificial Sequence
  Description of Artificial Sequence: Synthetic oligonucleotide
tgtcaaggccatgaggtttcctcccaaatcg

SEQ ID NO: 140015 - DNA, 30 bp, Artificial Sequence
  Description of Artificial Sequence: Synthetic oligonucleotide
gtcaaggccatgaggtttcctcccaaatcg

SEQ ID NO: 140016 - DNA, 32 bp, Artificial Sequence
  Description of Artificial Sequence: Synthetic oligonucleotide
tcaaggccatgaggtttcctcccaaatcgtac

SEQ ID NO: 140017 - DNA, 31 bp, Artificial Sequence
  Description of Artificial Sequence: Synthetic oligonucleotide
caaggccatgaggtttcctcccaaatcgtac

SEQ ID NO: 140018 - DNA, 33 bp, Artificial Sequence
  Description of Artificial Sequence: Synthetic oligonucleotide
aaggccatgaggtttcctcccaaatcgtacaac

SEQ ID NO: 140019 - DNA, 32 bp, Artificial Sequence
  Description of Artificial Sequence: Synthetic oligonucleotide
aggccatgaggtttcctcccaaatcgtacaac

SEQ ID NO: 140020 - DNA, 31 bp, Artificial Sequence
  Description of Artificial Sequence: Synthetic oligonucleotide
ggccatgaggtttcctcccaaatcgtacaac

SEQ ID NO: 140021 - DNA, 33 bp, Artificial Sequence
  Description of Artificial Sequence: Synthetic oligonucleotide
gccatgaggtttcctcccaaatcgtacaacaag

SEQ ID NO: 140022 - DNA, 33 bp, Artificial Sequence
  Description of Artificial Sequence: Synthetic oligonucleotide
ccatgaggtttcctcccaaatcgtacaacaagg

SEQ ID NO: 140023 - DNA, 34 bp, Artificial Sequence
  Description of Artificial Sequence: Synthetic oligonucleotide
catgaggtttcctcccaaatcgtacaacaaggac

SEQ ID NO: 140024 - DNA, 36 bp, Artificial Sequence
  Description of Artificial Sequence: Synthetic oligonucleotide
atgaggtttcctcccaaatcgtacaacaaggacttg

SEQ ID NO: 140025 - DNA, 35 bp, Artificial Sequence
  Description of Artificial Sequence: Synthetic oligonucleotide
tgaggtttcctcccaaatcgtacaacaaggacttg

SEQ ID NO: 140026 - DNA, 34 bp, Artificial Sequence
  Description of Artificial Sequence: Synthetic oligonucleotide
gaggtttcctcccaaatcgtacaacaaggacttg

SEQ ID NO: 140027 - DNA, 34 bp, Artificial Sequence
  Description of Artificial Sequence: Synthetic oligonucleotide
aggtttcctcccaaatcgtacaacaaggacttgg

SEQ ID NO: 140028 - DNA, 33 bp, Artificial Sequence
  Description of Artificial Sequence: Synthetic oligonucleotide
ggtttcctcccaaatcgtacaacaaggacttgg

SEQ ID NO: 140029 - DNA, 34 bp, Artificial Sequence
  Description of Artificial Sequence: Synthetic oligonucleotide
gtttcctcccaaatcgtacaacaaggacttggag

SEQ ID NO: 140030 - DNA, 35 bp, Artificial Sequence
  Description of Artificial Sequence: Synthetic oligonucleotide
tttcctcccaaatcgtacaacaaggacttggagtc

SEQ ID NO: 140031 - DNA, 34 bp, Artificial Sequence
  Description of Artificial Sequence: Synthetic oligonucleotide
ttcctcccaaatcgtacaacaaggacttggagtc

SEQ ID NO: 140032 - DNA, 33 bp, Artificial Sequence
  Description of Artificial Sequence: Synthetic oligonucleotide
tcctcccaaatcgtacaacaaggacttggagtc

SEQ ID NO: 140033 - DNA, 32 bp, Artificial Sequence
  Description of Artificial Sequence: Synthetic oligonucleotide
cctcccaaatcgtacaacaaggacttggagtc

SEQ ID NO: 140034 - DNA, 33 bp, Artificial Sequence
  Description of Artificial Sequence: Synthetic oligonucleotide
ctcccaaatcgtacaacaaggacttggagtctg

SEQ ID NO: 140035 - DNA, 33 bp, Artificial Sequence
  Description of Artificial Sequence: Synthetic oligonucleotide
tcccaaatcgtacaacaaggacttggagtctgc

SEQ ID NO: 140036 - DNA, 32 bp, Artificial Sequence
  Description of Artificial Sequence: Synthetic oligonucleotide
cccaaatcgtacaacaaggacttggagtctgc

SEQ ID NO: 140037 - DNA, 33 bp, Artificial Sequence
  Description of Artificial Sequence: Synthetic oligonucleotide
ccaaatcgtacaacaaggacttggagtctgcag

SEQ ID NO: 140038 - DNA, 34 bp, Artificial Sequence
  Description of Artificial Sequence: Synthetic oligonucleotide
caaatcgtacaacaaggacttggagtctgcagag

SEQ ID NO: 140039 - DNA, 34 bp, Artificial Sequence
  Description of Artificial Sequence: Synthetic oligonucleotide
aaatcgtacaacaaggacttggagtctgcagagg

SEQ ID NO: 140040 - DNA, 33 bp, Artificial Sequence
  Description of Artificial Sequence: Synthetic oligonucleotide
aatcgtacaacaaggacttggagtctgcagagg

SEQ ID NO: 140041 - DNA, 32 bp, Artificial Sequence
  Description of Artificial Sequence: Synthetic oligonucleotide
atcgtacaacaaggacttggagtctgcagagg

SEQ ID NO: 140042 - DNA, 31 bp, Artificial Sequence
  Description of Artificial Sequence: Synthetic oligonucleotide
tcgtacaacaaggacttggagtctgcagagg

SEQ ID NO: 140043 - DNA, 30 bp, Artificial Sequence
  Description of Artificial Sequence: Synthetic oligonucleotide
cgtacaacaaggacttggagtctgcagagg

SEQ ID NO: 140044 - DNA, 32 bp, Artificial Sequence
  Description of Artificial Sequence: Synthetic oligonucleotide
gtacaacaaggacttggagtctgcagaggaac

SEQ ID NO: 140045 - DNA, 32 bp, Artificial Sequence
  Description of Artificial Sequence: Synthetic oligonucleotide
tacaacaaggacttggagtctgcagaggaacg

SEQ ID NO: 140046 - DNA, 31 bp, Artificial Sequence
  Description of Artificial Sequence: Synthetic oligonucleotide
acaacaaggacttggagtctgcagaggaacg

SEQ ID NO: 140047 - DNA, 30 bp, Artificial Sequence
  Description of Artificial Sequence: Synthetic oligonucleotide
caacaaggacttggagtctgcagaggaacg

SEQ ID NO: 140048 - DNA, 30 bp, Artificial Sequence
  Description of Artificial Sequence: Synthetic oligonucleotide
aacaaggacttggagtctgcagaggaacgg

SEQ ID NO: 140049 - DNA, 29 bp, Artificial Sequence
  Description of Artificial Sequence: Synthetic oligonucleotide
acaaggacttggagtctgcagaggaacgg

SEQ ID NO: 140050 - DNA, 28 bp, Artificial Sequence
  Description of Artificial Sequence: Synthetic oligonucleotide
caaggacttggagtctgcagaggaacgg

SEQ ID NO: 140051 - DNA, 28 bp, Artificial Sequence
  Description of Artificial Sequence: Synthetic oligonucleotide
aaggacttggagtctgcagaggaacggc

SEQ ID NO: 140052 - DNA, 27 bp, Artificial Sequence
  Description of Artificial Sequence: Synthetic oligonucleotide
aggacttggagtctgcagaggaacggc

SEQ ID NO: 140053 - DNA, 26 bp, Artificial Sequence
  Description of Artificial Sequence: Synthetic oligonucleotide
ggacttggagtctgcagaggaacggc

SEQ ID NO: 140054 - DNA, 27 bp, Artificial Sequence
  Description of Artificial Sequence: Synthetic oligonucleotide
gacttggagtctgcagaggaacggcgt

SEQ ID NO: 140055 - DNA, 27 bp, Artificial Sequence
  Description of Artificial Sequence: Synthetic oligonucleotide
acttggagtctgcagaggaacggcgtg

SEQ ID NO: 140056 - DNA, 27 bp, Artificial Sequence
  Description of Artificial Sequence: Synthetic oligonucleotide
cttggagtctgcagaggaacggcgtga

SEQ ID NO: 140057 - DNA, 27 bp, Artificial Sequence
  Description of Artificial Sequence: Synthetic oligonucleotide
ttggagtctgcagaggaacggcgtgag

SEQ ID NO: 140058 - DNA, 26 bp, Artificial Sequence
  Description of Artificial Sequence: Synthetic oligonucleotide
tggagtctgcagaggaacggcgtgag

SEQ ID NO: 140059 - DNA, 25 bp, Artificial Sequence
  Description of Artificial Sequence: Synthetic oligonucleotide
ggagtctgcagaggaacggcgtgag

SEQ ID NO: 140060 - DNA, 25 bp, Artificial Sequence
  Description of Artificial Sequence: Synthetic oligonucleotide
gagtctgcagaggaacggcgtgagc

SEQ ID NO: 140061 - DNA, 26 bp, Artificial Sequence
  Description of Artificial Sequence: Synthetic oligonucleotide
agtctgcagaggaacggcgtgagcga

SEQ ID NO: 140062 - DNA, 25 bp, Artificial Sequence
  Description of Artificial Sequence: Synthetic oligonucleotide
gtctgcagaggaacggcgtgagcga

SEQ ID NO: 140063 - DNA, 27 bp, Artificial Sequence
  Description of Artificial Sequence: Synthetic oligonucleotide
tctgcagaggaacggcgtgagcgagaa

SEQ ID NO: 140064 - DNA, 26 bp, Artificial Sequence
  Description of Artificial Sequence: Synthetic oligonucleotide
ctgcagaggaacggcgtgagcgagaa

SEQ ID NO: 140065 - DNA, 27 bp, Artificial Sequence
  Description of Artificial Sequence: Synthetic oligonucleotide
tgcagaggaacggcgtgagcgagaaca

SEQ ID NO: 140066 - DNA, 26 bp, Artificial Sequence
  Description of Artificial Sequence: Synthetic oligonucleotide
gcagaggaacggcgtgagcgagaaca

SEQ ID NO: 140067 - DNA, 26 bp, Artificial Sequence
  Description of Artificial Sequence: Synthetic oligonucleotide
cagaggaacggcgtgagcgagaacag

SEQ ID NO: 140068 - DNA, 27 bp, Artificial Sequence
  Description of Artificial Sequence: Synthetic oligonucleotide
agaggaacggcgtgagcgagaacagca

SEQ ID NO: 140069 - DNA, 26 bp, Artificial Sequence
  Description of Artificial Sequence: Synthetic oligonucleotide
gaggaacggcgtgagcgagaacagca

SEQ ID NO: 140070 - DNA, 26 bp, Artificial Sequence
  Description of Artificial Sequence: Synthetic oligonucleotide
aggaacggcgtgagcgagaacagcag

SEQ ID NO: 140071 - DNA, 25 bp, Artificial Sequence
  Description of Artificial Sequence: Synthetic oligonucleotide
ggaacggcgtgagcgagaacagcag

SEQ ID NO: 140072 - DNA, 26 bp, Artificial Sequence
  Description of Artificial Sequence: Synthetic oligonucleotide
gaacggcgtgagcgagaacagcagga

SEQ ID NO: 140073 - DNA, 27 bp, Artificial Sequence
  Description of Artificial Sequence: Synthetic oligonucleotide
aacggcgtgagcgagaacagcaggact

SEQ ID NO: 140074 - DNA, 27 bp, Artificial Sequence
  Description of Artificial Sequence: Synthetic oligonucleotide
acggcgtgagcgagaacagcaggactt

SEQ ID NO: 140075 - DNA, 26 bp, Artificial Sequence
  Description of Artificial Sequence: Synthetic oligonucleotide
cggcgtgagcgagaacagcaggactt

SEQ ID NO: 140076 - DNA, 26 bp, Artificial Sequence
  Description of Artificial Sequence: Synthetic oligonucleotide
ggcgtgagcgagaacagcaggacttg

SEQ ID NO: 140077 - DNA, 27 bp, Artificial Sequence
  Description of Artificial Sequence: Synthetic oligonucleotide
gcgtgagcgagaacagcaggacttgga

SEQ ID NO: 140078 - DNA, 27 bp, Artificial Sequence
  Description of Artificial Sequence: Synthetic oligonucleotide
cgtgagcgagaacagcaggacttggag

SEQ ID NO: 140079 - DNA, 30 bp, Artificial Sequence
  Description of Artificial Sequence: Synthetic oligonucleotide
gtgagcgagaacagcaggacttggagtttg

SEQ ID NO: 140080 - DNA, 30 bp, Artificial Sequence
  Description of Artificial Sequence: Synthetic oligonucleotide
tgagcgagaacagcaggacttggagtttgc

SEQ ID NO: 140081 - DNA, 29 bp, Artificial Sequence
  Description of Artificial Sequence: Synthetic oligonucleotide
gagcgagaacagcaggacttggagtttgc

SEQ ID NO: 140082 - DNA, 29 bp, Artificial Sequence
  Description of Artificial Sequence: Synthetic oligonucleotide
agcgagaacagcaggacttggagtttgcc

SEQ ID NO: 140083 - DNA, 28 bp, Artificial Sequence
  Description of Artificial Sequence: Synthetic oligonucleotide
gcgagaacagcaggacttggagtttgcc

SEQ ID NO: 140084 - DNA, 30 bp, Artificial Sequence
  Description of Artificial Sequence: Synthetic oligonucleotide
cgagaacagcaggacttggagtttgccaag

SEQ ID NO: 140085 - DNA, 30 bp, Artificial Sequence
  Description of Artificial Sequence: Synthetic oligonucleotide
gagaacagcaggacttggagtttgccaagg

SEQ ID NO: 140086 - DNA, 31 bp, Artificial Sequence
  Description of Artificial Sequence: Synthetic oligonucleotide
agaacagcaggacttggagtttgccaaggag

SEQ ID NO: 140087 - DNA, 30 bp, Artificial Sequence
  Description of Artificial Sequence: Synthetic oligonucleotide
gaacagcaggacttggagtttgccaaggag

SEQ ID NO: 140088 - DNA, 32 bp, Artificial Sequence
  Description of Artificial Sequence: Synthetic oligonucleotide
aacagcaggacttggagtttgccaaggagatg

SEQ ID NO: 140089 - DNA, 31 bp, Artificial Sequence
  Description of Artificial Sequence: Synthetic oligonucleotide
acagcaggacttggagtttgccaaggagatg

SEQ ID NO: 140090 - DNA, 30 bp, Artificial Sequence
  Description of Artificial Sequence: Synthetic oligonucleotide
cagcaggacttggagtttgccaaggagatg

SEQ ID NO: 140091 - DNA, 30 bp, Artificial Sequence
  Description of Artificial Sequence: Synthetic oligonucleotide
agcaggacttggagtttgccaaggagatgg

SEQ ID NO: 140092 - DNA, 29 bp, Artificial Sequence
  Description of Artificial Sequence: Synthetic oligonucleotide
gcaggacttggagtttgccaaggagatgg

SEQ ID NO: 140093 - DNA, 29 bp, Artificial Sequence
  Description of Artificial Sequence: Synthetic oligonucleotide
caggacttggagtttgccaaggagatggc

SEQ ID NO: 140094 - DNA, 30 bp, Artificial Sequence
  Description of Artificial Sequence: Synthetic oligonucleotide
aggacttggagtttgccaaggagatggcag

SEQ ID NO: 140095 - DNA, 29 bp, Artificial Sequence
  Description of Artificial Sequence: Synthetic oligonucleotide
ggacttggagtttgccaaggagatggcag

SEQ ID NO: 140096 - DNA, 31 bp, Artificial Sequence
  Description of Artificial Sequence: Synthetic oligonucleotide
gacttggagtttgccaaggagatggcagaag

SEQ ID NO: 140097 - DNA, 33 bp, Artificial Sequence
  Description of Artificial Sequence: Synthetic oligonucleotide
acttggagtttgccaaggagatggcagaagatg

SEQ ID NO: 140098 - DNA, 32 bp, Artificial Sequence
  Description of Artificial Sequence: Synthetic oligonucleotide
cttggagtttgccaaggagatggcagaagatg

SEQ ID NO: 140099 - DNA, 34 bp, Artificial Sequence
  Description of Artificial Sequence: Synthetic oligonucleotide
ttggagtttgccaaggagatggcagaagatgatg

SEQ ID NO: 140100 - DNA, 33 bp, Artificial Sequence
  Description of Artificial Sequence: Synthetic oligonucleotide
tggagtttgccaaggagatggcagaagatgatg

SEQ ID NO: 140101 - DNA, 32 bp, Artificial Sequence
  Description of Artificial Sequence: Synthetic oligonucleotide
ggagtttgccaaggagatggcagaagatgatg

SEQ ID NO: 140102 - DNA, 34 bp, Artificial Sequence
  Description of Artificial Sequence: Synthetic oligonucleotide
gagtttgccaaggagatggcagaagatgatgatg

SEQ ID NO: 140103 - DNA, 35 bp, Artificial Sequence
  Description of Artificial Sequence: Synthetic oligonucleotide
agtttgccaaggagatggcagaagatgatgatgac

SEQ ID NO: 140104 - DNA, 34 bp, Artificial Sequence
  Description of Artificial Sequence: Synthetic oligonucleotide
gtttgccaaggagatggcagaagatgatgatgac

SEQ ID NO: 140105 - DNA, 35 bp, Artificial Sequence
  Description of Artificial Sequence: Synthetic oligonucleotide
tttgccaaggagatggcagaagatgatgatgacag

SEQ ID NO: 140106 - DNA, 34 bp, Artificial Sequence
  Description of Artificial Sequence: Synthetic oligonucleotide
ttgccaaggagatggcagaagatgatgatgacag

SEQ ID NO: 140107 - DNA, 33 bp, Artificial Sequence
  Description of Artificial Sequence: Synthetic oligonucleotide
tgccaaggagatggcagaagatgatgatgacag

SEQ ID NO: 140108 - DNA, 32 bp, Artificial Sequence
  Description of Artificial Sequence: Synthetic oligonucleotide
gccaaggagatggcagaagatgatgatgacag

SEQ ID NO: 140109 - DNA, 32 bp, Artificial Sequence
  Description of Artificial Sequence: Synthetic oligonucleotide
ccaaggagatggcagaagatgatgatgacagc

SEQ ID NO: 140110 - DNA, 34 bp, Artificial Sequence
  Description of Artificial Sequence: Synthetic oligonucleotide
caaggagatggcagaagatgatgatgacagcttc

SEQ ID NO: 140111 - DNA, 34 bp, Artificial Sequence
  Description of Artificial Sequence: Synthetic oligonucleotide
aaggagatggcagaagatgatgatgacagcttcc

SEQ ID NO: 140112 - DNA, 33 bp, Artificial Sequence
  Description of Artificial Sequence: Synthetic oligonucleotide
aggagatggcagaagatgatgatgacagcttcc

SEQ ID NO: 140113 - DNA, 32 bp, Artificial Sequence
  Description of Artificial Sequence: Synthetic oligonucleotide
ggagatggcagaagatgatgatgacagcttcc

SEQ ID NO: 140114 - DNA, 32 bp, Artificial Sequence
  Description of Artificial Sequence: Synthetic oligonucleotide
gagatggcagaagatgatgatgacagcttccc

SEQ ID NO: 140115 - DNA, 34 bp, Artificial Sequence
  Description of Artificial Sequence: Synthetic oligonucleotide
agatggcagaagatgatgatgacagcttcccttg

SEQ ID NO: 140116 - DNA, 33 bp, Artificial Sequence
  Description of Artificial Sequence: Synthetic oligonucleotide
gatggcagaagatgatgatgacagcttcccttg

SEQ ID NO: 140117 - DNA, 33 bp, Artificial Sequence
  Description of Artificial Sequence: Synthetic oligonucleotide
atggtgttggaaagcactatggtgtgtgtggac

SEQ ID NO: 140118 - DNA, 32 bp, Artificial Sequence
  Description of Artificial Sequence: Synthetic oligonucleotide
tggtgttggaaagcactatggtgtgtgtggac

SEQ ID NO: 140119 - DNA, 31 bp, Artificial Sequence
  Description of Artificial Sequence: Synthetic oligonucleotide
ggtgttggaaagcactatggtgtgtgtggac

SEQ ID NO: 140120 - DNA, 33 bp, Artificial Sequence
  Description of Artificial Sequence: Synthetic oligonucleotide
gtgttggaaagcactatggtgtgtgtggacaac

SEQ ID NO: 140121 - DNA, 34 bp, Artificial Sequence
  Description of Artificial Sequence: Synthetic oligonucleotide
tgttggaaagcactatggtgtgtgtggacaacag

SEQ ID NO: 140122 - DNA, 33 bp, Artificial Sequence
  Description of Artificial Sequence: Synthetic oligonucleotide
gttggaaagcactatggtgtgtgtggacaacag

SEQ ID NO: 140123 - DNA, 34 bp, Artificial Sequence
  Description of Artificial Sequence: Synthetic oligonucleotide
ttggaaagcactatggtgtgtgtggacaacagtg

SEQ ID NO: 140124 - DNA, 33 bp, Artificial Sequence
  Description of Artificial Sequence: Synthetic oligonucleotide
tggaaagcactatggtgtgtgtggacaacagtg

SEQ ID NO: 140125 - DNA, 32 bp, Artificial Sequence
  Description of Artificial Sequence: Synthetic oligonucleotide
ggaaagcactatggtgtgtgtggacaacagtg

SEQ ID NO: 140126 - DNA, 33 bp, Artificial Sequence
  Description of Artificial Sequence: Synthetic oligonucleotide
gaaagcactatggtgtgtgtggacaacagtgag

SEQ ID NO: 140127 - DNA, 38 bp, Artificial Sequence
  Description of Artificial Sequence: Synthetic oligonucleotide
aaagcactatggtgtgtgtggacaacagtgagtatatg

SEQ ID NO: 140128 - DNA, 37 bp, Artificial Sequence
  Description of Artificial Sequence: Synthetic oligonucleotide
aagcactatggtgtgtgtggacaacagtgagtatatg

SEQ ID NO: 140129 - DNA, 36 bp, Artificial Sequence
  Description of Artificial Sequence: Synthetic oligonucleotide
agcactatggtgtgtgtggacaacagtgagtatatg

SEQ ID NO: 140130 - DNA, 35 bp, Artificial Sequence
  Description of Artificial Sequence: Synthetic oligonucleotide
gcactatggtgtgtgtggacaacagtgagtatatg

SEQ ID NO: 140131 - DNA, 35 bp, Artificial Sequence
  Description of Artificial Sequence: Synthetic oligonucleotide
cactatggtgtgtgtggacaacagtgagtatatgc

SEQ ID NO: 140132 - DNA, 35 bp, Artificial Sequence
  Description of Artificial Sequence: Synthetic oligonucleotide
actatggtgtgtgtggacaacagtgagtatatgcg

SEQ ID NO: 140133 - DNA, 34 bp, Artificial Sequence
  Description of Artificial Sequence: Synthetic oligonucleotide
ctatggtgtgtgtggacaacagtgagtatatgcg

SEQ ID NO: 140134 - DNA, 34 bp, Artificial Sequence
  Description of Artificial Sequence: Synthetic oligonucleotide
tatggtgtgtgtggacaacagtgagtatatgcgg

SEQ ID NO: 140135 - DNA, 33 bp, Artificial Sequence
  Description of Artificial Sequence: Synthetic oligonucleotide
atggtgtgtgtggacaacagtgagtatatgcgg

SEQ ID NO: 140136 - DNA, 32 bp, Artificial Sequence
  Description of Artificial Sequence: Synthetic oligonucleotide
tggtgtgtgtggacaacagtgagtatatgcgg

SEQ ID NO: 140137 - DNA, 31 bp, Artificial Sequence
  Description of Artificial Sequence: Synthetic oligonucleotide
ggtgtgtgtggacaacagtgagtatatgcgg

SEQ ID NO: 140138 - DNA, 34 bp, Artificial Sequence
  Description of Artificial Sequence: Synthetic oligonucleotide
gtgtgtgtggacaacagtgagtatatgcggaatg

SEQ ID NO: 140139 - DNA, 34 bp, Artificial Sequence
  Description of Artificial Sequence: Synthetic oligonucleotide
tgtgtgtggacaacagtgagtatatgcggaatgg

SEQ ID NO: 140140 - DNA, 33 bp, Artificial Sequence
  Description of Artificial Sequence: Synthetic oligonucleotide
gtgtgtggacaacagtgagtatatgcggaatgg

SEQ ID NO: 140141 - DNA, 34 bp, Artificial Sequence
  Description of Artificial Sequence: Synthetic oligonucleotide
tgtgtggacaacagtgagtatatgcggaatggag

SEQ ID NO: 140142 - DNA, 33 bp, Artificial Sequence
  Description of Artificial Sequence: Synthetic oligonucleotide
gtgtggacaacagtgagtatatgcggaatggag

SEQ ID NO: 140143 - DNA, 34 bp, Artificial Sequence
  Description of Artificial Sequence: Synthetic oligonucleotide
tgtggacaacagtgagtatatgcggaatggagac

SEQ ID NO: 140144 - DNA, 33 bp, Artificial Sequence
  Description of Artificial Sequence: Synthetic oligonucleotide
gtggacaacagtgagtatatgcggaatggagac

SEQ ID NO: 140145 - DNA, 35 bp, Artificial Sequence
  Description of Artificial Sequence: Synthetic oligonucleotide
tggacaacagtgagtatatgcggaatggagacttc

SEQ ID NO: 140146 - DNA, 34 bp, Artificial Sequence
  Description of Artificial Sequence: Synthetic oligonucleotide
ggacaacagtgagtatatgcggaatggagacttc

SEQ ID NO: 140147 - DNA, 37 bp, Artificial Sequence
  Description of Artificial Sequence: Synthetic oligonucleotide
gacaacagtgagtatatgcggaatggagacttcttac

SEQ ID NO: 140148 - DNA, 37 bp, Artificial Sequence
  Description of Artificial Sequence: Synthetic oligonucleotide
acaacagtgagtatatgcggaatggagacttcttacc

SEQ ID NO: 140149 - DNA, 36 bp, Artificial Sequence
  Description of Artificial Sequence: Synthetic oligonucleotide
caacagtgagtatatgcggaatggagacttcttacc

SEQ ID NO: 140150 - DNA, 36 bp, Artificial Sequence
  Description of Artificial Sequence: Synthetic oligonucleotide
aacagtgagtatatgcggaatggagacttcttaccc

SEQ ID NO: 140151 - DNA, 35 bp, Artificial Sequence
  Description of Artificial Sequence: Synthetic oligonucleotide
acagtgagtatatgcggaatggagacttcttaccc

SEQ ID NO: 140152 - DNA, 34 bp, Artificial Sequence
  Description of Artificial Sequence: Synthetic oligonucleotide
cagtgagtatatgcggaatggagacttcttaccc

SEQ ID NO: 140153 - DNA, 35 bp, Artificial Sequence
  Description of Artificial Sequence: Synthetic oligonucleotide
agtgagtatatgcggaatggagacttcttacccac

SEQ ID NO: 140154 - DNA, 34 bp, Artificial Sequence
  Description of Artificial Sequence: Synthetic oligonucleotide
gtgagtatatgcggaatggagacttcttacccac

SEQ ID NO: 140155 - DNA, 34 bp, Artificial Sequence
  Description of Artificial Sequence: Synthetic oligonucleotide
tgagtatatgcggaatggagacttcttacccacc

SEQ ID NO: 140156 - DNA, 33 bp, Artificial Sequence
  Description of Artificial Sequence: Synthetic oligonucleotide
gagtatatgcggaatggagacttcttacccacc

SEQ ID NO: 140157 - DNA, 34 bp, Artificial Sequence
  Description of Artificial Sequence: Synthetic oligonucleotide
agtatatgcggaatggagacttcttacccaccag

SEQ ID NO: 140158 - DNA, 33 bp, Artificial Sequence
  Description of Artificial Sequence: Synthetic oligonucleotide
gtatatgcggaatggagacttcttacccaccag

SEQ ID NO: 140159 - DNA, 33 bp, Artificial Sequence
  Description of Artificial Sequence: Synthetic oligonucleotide
tatatgcggaatggagacttcttacccaccagg

SEQ ID NO: 140160 - DNA, 32 bp, Artificial Sequence
  Description of Artificial Sequence: Synthetic oligonucleotide
atatgcggaatggagacttcttacccaccagg

SEQ ID NO: 140161 - DNA, 31 bp, Artificial Sequence
  Description of Artificial Sequence: Synthetic oligonucleotide
tatgcggaatggagacttcttacccaccagg

SEQ ID NO: 140162 - DNA, 30 bp, Artificial Sequence
  Description of Artificial Sequence: Synthetic oligonucleotide
atgcggaatggagacttcttacccaccagg

SEQ ID NO: 140163 - DNA, 29 bp, Artificial Sequence
  Description of Artificial Sequence: Synthetic oligonucleotide
tgcggaatggagacttcttacccaccagg

SEQ ID NO: 140164 - DNA, 28 bp, Artificial Sequence
  Description of Artificial Sequence: Synthetic oligonucleotide
gcggaatggagacttcttacccaccagg

SEQ ID NO: 140165 - DNA, 28 bp, Artificial Sequence
  Description of Artificial Sequence: Synthetic oligonucleotide
cggaatggagacttcttacccaccaggc

SEQ ID NO: 140166 - DNA, 29 bp, Artificial Sequence
  Description of Artificial Sequence: Synthetic oligonucleotide
ggaatggagacttcttacccaccaggctg

SEQ ID NO: 140167 - DNA, 29 bp, Artificial Sequence
  Description of Artificial Sequence: Synthetic oligonucleotide
gaatggagacttcttacccaccaggctgc

SEQ ID NO: 140168 - DNA, 30 bp, Artificial Sequence
  Description of Artificial Sequence: Synthetic oligonucleotide
aatggagacttcttacccaccaggctgcag

SEQ ID NO: 140169 - DNA, 29 bp, Artificial Sequence
  Description of Artificial Sequence: Synthetic oligonucleotide
atggagacttcttacccaccaggctgcag

SEQ ID NO: 140170 - DNA, 28 bp, Artificial Sequence
  Description of Artificial Sequence: Synthetic oligonucleotide
tggagacttcttacccaccaggctgcag

SEQ ID NO: 140171 - DNA, 27 bp, Artificial Sequence
  Description of Artificial Sequence: Synthetic oligonucleotide
ggagacttcttacccaccaggctgcag

SEQ ID NO: 140172 - DNA, 27 bp, Artificial Sequence
  Description of Artificial Sequence: Synthetic oligonucleotide
gagacttcttacccaccaggctgcagg

SEQ ID NO: 140173 - DNA, 27 bp, Artificial Sequence
  Description of Artificial Sequence: Synthetic oligonucleotide
agacttcttacccaccaggctgcaggc

SEQ ID NO: 140174 - DNA, 26 bp, Artificial Sequence
  Description of Artificial Sequence: Synthetic oligonucleotide
gacttcttacccaccaggctgcaggc

SEQ ID NO: 140175 - DNA, 26 bp, Artificial Sequence
  Description of Artificial Sequence: Synthetic oligonucleotide
acttcttacccaccaggctgcaggcc

SEQ ID NO: 140176 - DNA, 25 bp, Artificial Sequence
  Description of Artificial Sequence: Synthetic oligonucleotide
cttcttacccaccaggctgcaggcc

SEQ ID NO: 140177 - DNA, 26 bp, Artificial Sequence
  Description of Artificial Sequence: Synthetic oligonucleotide
ttcttacccaccaggctgcaggccca

SEQ ID NO: 140178 - DNA, 25 bp, Artificial Sequence
  Description of Artificial Sequence: Synthetic oligonucleotide
tcttacccaccaggctgcaggccca

SEQ ID NO: 140179 - DNA, 24 bp, Artificial Sequence
  Description of Artificial Sequence: Synthetic oligonucleotide
cttacccaccaggctgcaggccca

SEQ ID NO: 140180 - DNA, 24 bp, Artificial Sequence
  Description of Artificial Sequence: Synthetic oligonucleotide
ttacccaccaggctgcaggcccag

SEQ ID NO: 140181 - DNA, 23 bp, Artificial Sequence
  Description of Artificial Sequence: Synthetic oligonucleotide
tacccaccaggctgcaggcccag

SEQ ID NO: 140182 - DNA, 22 bp, Artificial Sequence
  Description of Artificial Sequence: Synthetic oligonucleotide
acccaccaggctgcaggcccag

SEQ ID NO: 140183 - DNA, 21 bp, Artificial Sequence
  Description of Artificial Sequence: Synthetic oligonucleotide
cccaccaggctgcaggcccag

SEQ ID NO: 140184 - DNA, 22 bp, Artificial Sequence
  Description of Artificial Sequence: Synthetic oligonucleotide
ccaccaggctgcaggcccagca

SEQ ID NO: 140185 - DNA, 22 bp, Artificial Sequence
  Description of Artificial Sequence: Synthetic oligonucleotide
caccaggctgcaggcccagcag

SEQ ID NO: 140186 - DNA, 24 bp, Artificial Sequence
  Description of Artificial Sequence: Synthetic oligonucleotide
accaggctgcaggcccagcaggat

SEQ ID NO: 140187 - DNA, 23 bp, Artificial Sequence
  Description of Artificial Sequence: Synthetic oligonucleotide
ccaggctgcaggcccagcaggat

SEQ ID NO: 140188 - DNA, 23 bp, Artificial Sequence
  Description of Artificial Sequence: Synthetic oligonucleotide
caggctgcaggcccagcaggatg

SEQ ID NO: 140189 - DNA, 24 bp, Artificial Sequence
  Description of Artificial Sequence: Synthetic oligonucleotide
aggctgcaggcccagcaggatgct

SEQ ID NO: 140190 - DNA, 23 bp, Artificial Sequence
  Description of Artificial Sequence: Synthetic oligonucleotide
ggctgcaggcccagcaggatgct

SEQ ID NO: 140191 - DNA, 24 bp, Artificial Sequence
  Description of Artificial Sequence: Synthetic oligonucleotide
gctgcaggcccagcaggatgctgt

SEQ ID NO: 140192 - DNA, 26 bp, Artificial Sequence
  Description of Artificial Sequence: Synthetic oligonucleotide
ctgcaggcccagcaggatgctgtcaa

SEQ ID NO: 140193 - DNA, 27 bp, Artificial Sequence
  Description of Artificial Sequence: Synthetic oligonucleotide
tgcaggcccagcaggatgctgtcaaca

SEQ ID NO: 140194 - DNA, 27 bp, Artificial Sequence
  Description of Artificial Sequence: Synthetic oligonucleotide
gcaggcccagcaggatgctgtcaacat

SEQ ID NO: 140195 - DNA, 28 bp, Artificial Sequence
  Description of Artificial Sequence: Synthetic oligonucleotide
caggcccagcaggatgctgtcaacatag

SEQ ID NO: 140196 - DNA, 31 bp, Artificial Sequence
  Description of Artificial Sequence: Synthetic oligonucleotide
aggcccagcaggatgctgtcaacatagtttg

SEQ ID NO: 140197 - DNA, 30 bp, Artificial Sequence
  Description of Artificial Sequence: Synthetic oligonucleotide
ggcccagcaggatgctgtcaacatagtttg

SEQ ID NO: 140198 - DNA, 31 bp, Artificial Sequence
  Description of Artificial Sequence: Synthetic oligonucleotide
gcccagcaggatgctgtcaacatagtttgtc

SEQ ID NO: 140199 - DNA, 34 bp, Artificial Sequence
  Description of Artificial Sequence: Synthetic oligonucleotide
cccagcaggatgctgtcaacatagtttgtcattc

SEQ ID NO: 140200 - DNA, 37 bp, Artificial Sequence
  Description of Artificial Sequence: Synthetic oligonucleotide
ccagcaggatgctgtcaacatagtttgtcattcaaag

SEQ ID NO: 140201 - DNA, 38 bp, Artificial Sequence
  Description of Artificial Sequence: Synthetic oligonucleotide
cagcaggatgctgtcaacatagtttgtcattcaaagac

SEQ ID NO: 140202 - DNA, 38 bp, Artificial Sequence
  Description of Artificial Sequence: Synthetic oligonucleotide
agcaggatgctgtcaacatagtttgtcattcaaagacc

SEQ ID NO: 140203 - DNA, 37 bp, Artificial Sequence
  Description of Artificial Sequence: Synthetic oligonucleotide
gcaggatgctgtcaacatagtttgtcattcaaagacc

SEQ ID NO: 140204 - DNA, 37 bp, Artificial Sequence
  Description of Artificial Sequence: Synthetic oligonucleotide
caggatgctgtcaacatagtttgtcattcaaagaccc

SEQ ID NO: 140205 - DNA, 37 bp, Artificial Sequence
  Description of Artificial Sequence: Synthetic oligonucleotide
aggatgctgtcaacatagtttgtcattcaaagacccg

SEQ ID NO: 140206 - DNA, 36 bp, Artificial Sequence
  Description of Artificial Sequence: Synthetic oligonucleotide
ggatgctgtcaacatagtttgtcattcaaagacccg

SEQ ID NO: 140207 - DNA, 36 bp, Artificial Sequence
  Description of Artificial Sequence: Synthetic oligonucleotide
gatgctgtcaacatagtttgtcattcaaagacccgc

SEQ ID NO: 140208 - DNA, 37 bp, Artificial Sequence
  Description of Artificial Sequence: Synthetic oligonucleotide
atgctgtcaacatagtttgtcattcaaagacccgcag

SEQ ID NO: 140209 - DNA, 36 bp, Artificial Sequence
  Description of Artificial Sequence: Synthetic oligonucleotide
tgctgtcaacatagtttgtcattcaaagacccgcag

SEQ ID NO: 140210 - DNA, 35 bp, Artificial Sequence
  Description of Artificial Sequence: Synthetic oligonucleotide
gctgtcaacatagtttgtcattcaaagacccgcag

SEQ ID NO: 140211 - DNA, 35 bp, Artificial Sequence
  Description of Artificial Sequence: Synthetic oligonucleotide
ctgtcaacatagtttgtcattcaaagacccgcagc

SEQ ID NO: 140212 - DNA, 37 bp, Artificial Sequence
  Description of Artificial Sequence: Synthetic oligonucleotide
tgtcaacatagtttgtcattcaaagacccgcagcaac

SEQ ID NO: 140213 - DNA, 36 bp, Artificial Sequence
  Description of Artificial Sequence: Synthetic oligonucleotide
gtcaacatagtttgtcattcaaagacccgcagcaac

SEQ ID NO: 140214 - DNA, 36 bp, Artificial Sequence
  Description of Artificial Sequence: Synthetic oligonucleotide
tcaacatagtttgtcattcaaagacccgcagcaacc

SEQ ID NO: 140215 - DNA, 35 bp, Artificial Sequence
  Description of Artificial Sequence: Synthetic oligonucleotide
caacatagtttgtcattcaaagacccgcagcaacc

SEQ ID NO: 140216 - DNA, 35 bp, Artificial Sequence
  Description of Artificial Sequence: Synthetic oligonucleotide
aacatagtttgtcattcaaagacccgcagcaaccc

SEQ ID NO: 140217 - DNA, 34 bp, Artificial Sequence
  Description of Artificial Sequence: Synthetic oligonucleotide
acatagtttgtcattcaaagacccgcagcaaccc

SEQ ID NO: 140218 - DNA, 33 bp, Artificial Sequence
  Description of Artificial Sequence: Synthetic oligonucleotide
catagtttgtcattcaaagacccgcagcaaccc

SEQ ID NO: 140219 - DNA, 34 bp, Artificial Sequence
  Description of Artificial Sequence: Synthetic oligonucleotide
atagtttgtcattcaaagacccgcagcaaccctg

SEQ ID NO: 140220 - DNA, 33 bp, Artificial Sequence
  Description of Artificial Sequence: Synthetic oligonucleotide
tagtttgtcattcaaagacccgcagcaaccctg

SEQ ID NO: 140221 - DNA, 32 bp, Artificial Sequence
  Description of Artificial Sequence: Synthetic oligonucleotide
agtttgtcattcaaagacccgcagcaaccctg

SEQ ID NO: 140222 - DNA, 31 bp, Artificial Sequence
  Description of Artificial Sequence: Synthetic oligonucleotide
gtttgtcattcaaagacccgcagcaaccctg

SEQ ID NO: 140223 - DNA, 32 bp, Artificial Sequence
  Description of Artificial Sequence: Synthetic oligonucleotide
tttgtcattcaaagacccgcagcaaccctgag

SEQ ID NO: 140224 - DNA, 31 bp, Artificial Sequence
  Description of Artificial Sequence: Synthetic oligonucleotide
ttgtcattcaaagacccgcagcaaccctgag

SEQ ID NO: 140225 - DNA, 30 bp, Artificial Sequence
  Description of Artificial Sequence: Synthetic oligonucleotide
tgtcattcaaagacccgcagcaaccctgag

SEQ ID NO: 140226 - DNA, 29 bp, Artificial Sequence
  Description of Artificial Sequence: Synthetic oligonucleotide
gtcattcaaagacccgcagcaaccctgag

SEQ ID NO: 140227 - DNA, 31 bp, Artificial Sequence
  Description of Artificial Sequence: Synthetic oligonucleotide
tcattcaaagacccgcagcaaccctgagaac

SEQ ID NO: 140228 - DNA, 30 bp, Artificial Sequence
  Description of Artificial Sequence: Synthetic oligonucleotide
cattcaaagacccgcagcaaccctgagaac

SEQ ID NO: 140229 - DNA, 32 bp, Artificial Sequence
  Description of Artificial Sequence: Synthetic oligonucleotide
attcaaagacccgcagcaaccctgagaacaac

SEQ ID NO: 140230 - DNA, 31 bp, Artificial Sequence
  Description of Artificial Sequence: Synthetic oligonucleotide
ttcaaagacccgcagcaaccctgagaacaac

SEQ ID NO: 140231 - DNA, 30 bp, Artificial Sequence
  Description of Artificial Sequence: Synthetic oligonucleotide
tcaaagacccgcagcaaccctgagaacaac

SEQ ID NO: 140232 - DNA, 29 bp, Artificial Sequence
  Description of Artificial Sequence: Synthetic oligonucleotide
caaagacccgcagcaaccctgagaacaac

SEQ ID NO: 140233 - DNA, 29 bp, Artificial Sequence
  Description of Artificial Sequence: Synthetic oligonucleotide
aaagacccgcagcaaccctgagaacaacg

SEQ ID NO: 140234 - DNA, 28 bp, Artificial Sequence
  Description of Artificial Sequence: Synthetic oligonucleotide
aagacccgcagcaaccctgagaacaacg

SEQ ID NO: 140235 - DNA, 27 bp, Artificial Sequence
  Description of Artificial Sequence: Synthetic oligonucleotide
agacccgcagcaaccctgagaacaacg

SEQ ID NO: 140236 - DNA, 27 bp, Artificial Sequence
  Description of Artificial Sequence: Synthetic oligonucleotide
gacccgcagcaaccctgagaacaacgt

SEQ ID NO: 140237 - DNA, 27 bp, Artificial Sequence
  Description of Artificial Sequence: Synthetic oligonucleotide
acccgcagcaaccctgagaacaacgtg

SEQ ID NO: 140238 - DNA, 26 bp, Artificial Sequence
  Description of Artificial Sequence: Synthetic oligonucleotide
cccgcagcaaccctgagaacaacgtg

SEQ ID NO: 140239 - DNA, 26 bp, Artificial Sequence
  Description of Artificial Sequence: Synthetic oligonucleotide
ccgcagcaaccctgagaacaacgtgg

SEQ ID NO: 140240 - DNA, 26 bp, Artificial Sequence
  Description of Artificial Sequence: Synthetic oligonucleotide
cgcagcaaccctgagaacaacgtggg

SEQ ID NO: 140241 - DNA, 26 bp, Artificial Sequence
  Description of Artificial Sequence: Synthetic oligonucleotide
gcagcaaccctgagaacaacgtgggc

SEQ ID NO: 140242 - DNA, 27 bp, Artificial Sequence
  Description of Artificial Sequence: Synthetic oligonucleotide
cagcaaccctgagaacaacgtgggcct

SEQ ID NO: 140243 - DNA, 30 bp, Artificial Sequence
  Description of Artificial Sequence: Synthetic oligonucleotide
agcaaccctgagaacaacgtgggccttatc

SEQ ID NO: 140244 - DNA, 29 bp, Artificial Sequence
  Description of Artificial Sequence: Synthetic oligonucleotide
gcaaccctgagaacaacgtgggccttatc

SEQ ID NO: 140245 - DNA, 30 bp, Artificial Sequence
  Description of Artificial Sequence: Synthetic oligonucleotide
caaccctgagaacaacgtgggccttatcac

SEQ ID NO: 140246 - DNA, 31 bp, Artificial Sequence
  Description of Artificial Sequence: Synthetic oligonucleotide
aaccctgagaacaacgtgggccttatcacac

SEQ ID NO: 140247 - DNA, 30 bp, Artificial Sequence
  Description of Artificial Sequence: Synthetic oligonucleotide
accctgagaacaacgtgggccttatcacac

SEQ ID NO: 140248 - DNA, 29 bp, Artificial Sequence
  Description of Artificial Sequence: Synthetic oligonucleotide
ccctgagaacaacgtgggccttatcacac

SEQ ID NO: 140249 - DNA, 30 bp, Artificial Sequence
  Description of Artificial Sequence: Synthetic oligonucleotide
cctgagaacaacgtgggccttatcacactg

SEQ ID NO: 140250 - DNA, 30 bp, Artificial Sequence
  Description of Artificial Sequence: Synthetic oligonucleotide
ctgagaacaacgtgggccttatcacactgg

SEQ ID NO: 140251 - DNA, 30 bp, Artificial Sequence
  Description of Artificial Sequence: Synthetic oligonucleotide
tgagaacaacgtgggccttatcacactggc

SEQ ID NO: 140252 - DNA, 29 bp, Artificial Sequence
  Description of Artificial Sequence: Synthetic oligonucleotide
gagaacaacgtgggccttatcacactggc

SEQ ID NO: 140253 - DNA, 33 bp, Artificial Sequence
  Description of Artificial Sequence: Synthetic oligonucleotide
agaacaacgtgggccttatcacactggctaatg

SEQ ID NO: 140254 - DNA, 32 bp, Artificial Sequence
  Description of Artificial Sequence: Synthetic oligonucleotide
gaacaacgtgggccttatcacactggctaatg

SEQ ID NO: 140255 - DNA, 33 bp, Artificial Sequence
  Description of Artificial Sequence: Synthetic oligonucleotide
aacaacgtgggccttatcacactggctaatgac

SEQ ID NO: 140256 - DNA, 32 bp, Artificial Sequence
  Description of Artificial Sequence: Synthetic oligonucleotide
acaacgtgggccttatcacactggctaatgac

SEQ ID NO: 140257 - DNA, 31 bp, Artificial Sequence
  Description of Artificial Sequence: Synthetic oligonucleotide
caacgtgggccttatcacactggctaatgac

SEQ ID NO: 140258 - DNA, 32 bp, Artificial Sequence
  Description of Artificial Sequence: Synthetic oligonucleotide
aacgtgggccttatcacactggctaatgactg

SEQ ID NO: 140259 - DNA, 31 bp, Artificial Sequence
  Description of Artificial Sequence: Synthetic oligonucleotide
acgtgggccttatcacactggctaatgactg

SEQ ID NO: 140260 - DNA, 30 bp, Artificial Sequence
  Description of Artificial Sequence: Synthetic oligonucleotide
cgtgggccttatcacactggctaatgactg

SEQ ID NO: 140261 - DNA, 31 bp, Artificial Sequence
  Description of Artificial Sequence: Synthetic oligonucleotide
gtgggccttatcacactggctaatgactgtg

SEQ ID NO: 140262 - DNA, 33 bp, Artificial Sequence
  Description of Artificial Sequence: Synthetic oligonucleotide
tgggccttatcacactggctaatgactgtgaag

SEQ ID NO: 140263 - DNA, 32 bp, Artificial Sequence
  Description of Artificial Sequence: Synthetic oligonucleotide
gggccttatcacactggctaatgactgtgaag

SEQ ID NO: 140264 - DNA, 33 bp, Artificial Sequence
  Description of Artificial Sequence: Synthetic oligonucleotide
ggccttatcacactggctaatgactgtgaagtg

SEQ ID NO: 140265 - DNA, 33 bp, Artificial Sequence
  Description of Artificial Sequence: Synthetic oligonucleotide
gccttatcacactggctaatgactgtgaagtgc

SEQ ID NO: 140266 - DNA, 34 bp, Artificial Sequence
  Description of Artificial Sequence: Synthetic oligonucleotide
ccttatcacactggctaatgactgtgaagtgctg

SEQ ID NO: 140267 - DNA, 35 bp, Artificial Sequence
  Description of Artificial Sequence: Synthetic oligonucleotide
cttatcacactggctaatgactgtgaagtgctgac

SEQ ID NO: 140268 - DNA, 35 bp, Artificial Sequence
  Description of Artificial Sequence: Synthetic oligonucleotide
ttatcacactggctaatgactgtgaagtgctgacc

SEQ ID NO: 140269 - DNA, 34 bp, Artificial Sequence
  Description of Artificial Sequence: Synthetic oligonucleotide
tatcacactggctaatgactgtgaagtgctgacc

SEQ ID NO: 140270 - DNA, 33 bp, Artificial Sequence
  Description of Artificial Sequence: Synthetic oligonucleotide
atcacactggctaatgactgtgaagtgctgacc

SEQ ID NO: 140271 - DNA, 32 bp, Artificial Sequence
  Description of Artificial Sequence: Synthetic oligonucleotide
tcacactggctaatgactgtgaagtgctgacc

SEQ ID NO: 140272 - DNA, 31 bp, Artificial Sequence
  Description of Artificial Sequence: Synthetic oligonucleotide
cacactggctaatgactgtgaagtgctgacc

SEQ ID NO: 140273 - DNA, 32 bp, Artificial Sequence
  Description of Artificial Sequence: Synthetic oligonucleotide
acactggctaatgactgtgaagtgctgaccac

SEQ ID NO: 140274 - DNA, 31 bp, Artificial Sequence
  Description of Artificial Sequence: Synthetic oligonucleotide
cactggctaatgactgtgaagtgctgaccac

SEQ ID NO: 140275 - DNA, 32 bp, Artificial Sequence
  Description of Artificial Sequence: Synthetic oligonucleotide
actggctaatgactgtgaagtgctgaccacac

SEQ ID NO: 140276 - DNA, 31 bp, Artificial Sequence
  Description of Artificial Sequence: Synthetic oligonucleotide
ctggctaatgactgtgaagtgctgaccacac

SEQ ID NO: 140277 - DNA, 32 bp, Artificial Sequence
  Description of Artificial Sequence: Synthetic oligonucleotide
tggctaatgactgtgaagtgctgaccacactc

SEQ ID NO: 140278 - DNA, 31 bp, Artificial Sequence
  Description of Artificial Sequence: Synthetic oligonucleotide
ggctaatgactgtgaagtgctgaccacactc

SEQ ID NO: 140279 - DNA, 32 bp, Artificial Sequence
  Description of Artificial Sequence: Synthetic oligonucleotide
gctaatgactgtgaagtgctgaccacactcac

SEQ ID NO: 140280 - DNA, 32 bp, Artificial Sequence
  Description of Artificial Sequence: Synthetic oligonucleotide
ctaatgactgtgaagtgctgaccacactcacc

SEQ ID NO: 140281 - DNA, 32 bp, Artificial Sequence
  Description of Artificial Sequence: Synthetic oligonucleotide
taatgactgtgaagtgctgaccacactcaccc

SEQ ID NO: 140282 - DNA, 31 bp, Artificial Sequence
  Description of Artificial Sequence: Synthetic oligonucleotide
aatgactgtgaagtgctgaccacactcaccc

SEQ ID NO: 140283 - DNA, 30 bp, Artificial Sequence
  Description of Artificial Sequence: Synthetic oligonucleotide
atgactgtgaagtgctgaccacactcaccc

SEQ ID NO: 140284 - DNA, 29 bp, Artificial Sequence
  Description of Artificial Sequence: Synthetic oligonucleotide
tgactgtgaagtgctgaccacactcaccc

SEQ ID NO: 140285 - DNA, 28 bp, Artificial Sequence
  Description of Artificial Sequence: Synthetic oligonucleotide
gactgtgaagtgctgaccacactcaccc

SEQ ID NO: 140286 - DNA, 28 bp, Artificial Sequence
  Description of Artificial Sequence: Synthetic oligonucleotide
actgtgaagtgctgaccacactcacccc

SEQ ID NO: 140287 - DNA, 27 bp, Artificial Sequence
  Description of Artificial Sequence: Synthetic oligonucleotide
ctgtgaagtgctgaccacactcacccc

SEQ ID NO: 140288 - DNA, 28 bp, Artificial Sequence
  Description of Artificial Sequence: Synthetic oligonucleotide
tgtgaagtgctgaccacactcaccccag

SEQ ID NO: 140289 - DNA, 27 bp, Artificial Sequence
  Description of Artificial Sequence: Synthetic oligonucleotide
gtgaagtgctgaccacactcaccccag

SEQ ID NO: 140290 - DNA, 28 bp, Artificial Sequence
  Description of Artificial Sequence: Synthetic oligonucleotide
tgaagtgctgaccacactcaccccagac

SEQ ID NO: 140291 - DNA, 27 bp, Artificial Sequence
  Description of Artificial Sequence: Synthetic oligonucleotide
gaagtgctgaccacactcaccccagac

SEQ ID NO: 140292 - DNA, 28 bp, Artificial Sequence
  Description of Artificial Sequence: Synthetic oligonucleotide
aagtgctgaccacactcaccccagacac

SEQ ID NO: 140293 - DNA, 27 bp, Artificial Sequence
  Description of Artificial Sequence: Synthetic oligonucleotide
agtgctgaccacactcaccccagacac

SEQ ID NO: 140294 - DNA, 27 bp, Artificial Sequence
  Description of Artificial Sequence: Synthetic oligonucleotide
gtgctgaccacactcaccccagacact

SEQ ID NO: 140295 - DNA, 27 bp, Artificial Sequence
  Description of Artificial Sequence: Synthetic oligonucleotide
tgctgaccacactcaccccagacactg

SEQ ID NO: 140296 - DNA, 26 bp, Artificial Sequence
  Description of Artificial Sequence: Synthetic oligonucleotide
gctgaccacactcaccccagacactg

SEQ ID NO: 140297 - DNA, 26 bp, Artificial Sequence
  Description of Artificial Sequence: Synthetic oligonucleotide
ctgaccacactcaccccagacactgg

SEQ ID NO: 140298 - DNA, 26 bp, Artificial Sequence
  Description of Artificial Sequence: Synthetic oligonucleotide
tgaccacactcaccccagacactggc

SEQ ID NO: 140299 - DNA, 25 bp, Artificial Sequence
  Description of Artificial Sequence: Synthetic oligonucleotide
gaccacactcaccccagacactggc

SEQ ID NO: 140300 - DNA, 25 bp, Artificial Sequence
  Description of Artificial Sequence: Synthetic oligonucleotide
accacactcaccccagacactggcc

SEQ ID NO: 140301 - DNA, 24 bp, Artificial Sequence
  Description of Artificial Sequence: Synthetic oligonucleotide
ccacactcaccccagacactggcc

SEQ ID NO: 140302 - DNA, 27 bp, Artificial Sequence
  Description of Artificial Sequence: Synthetic oligonucleotide
cacactcaccccagacactggccgtat

SEQ ID NO: 140303 - DNA, 27 bp, Artificial Sequence
  Description of Artificial Sequence: Synthetic oligonucleotide
acactcaccccagacactggccgtatc

SEQ ID NO: 140304 - DNA, 26 bp, Artificial Sequence
  Description of Artificial Sequence: Synthetic oligonucleotide
cactcaccccagacactggccgtatc

SEQ ID NO: 140305 - DNA, 27 bp, Artificial Sequence
  Description of Artificial Sequence: Synthetic oligonucleotide
actcaccccagacactggccgtatcct

SEQ ID NO: 140306 - DNA, 26 bp, Artificial Sequence
  Description of Artificial Sequence: Synthetic oligonucleotide
ctcaccccagacactggccgtatcct

SEQ ID NO: 140307 - DNA, 27 bp, Artificial Sequence
  Description of Artificial Sequence: Synthetic oligonucleotide
tcaccccagacactggccgtatcctgt

SEQ ID NO: 140308 - DNA, 26 bp, Artificial Sequence
  Description of Artificial Sequence: Synthetic oligonucleotide
caccccagacactggccgtatcctgt

SEQ ID NO: 140309 - DNA, 26 bp, Artificial Sequence
  Description of Artificial Sequence: Synthetic oligonucleotide
accccagacactggccgtatcctgtc

SEQ ID NO: 140310 - DNA, 25 bp, Artificial Sequence
  Description of Artificial Sequence: Synthetic oligonucleotide
ccccagacactggccgtatcctgtc

SEQ ID NO: 140311 - DNA, 27 bp, Artificial Sequence
  Description of Artificial Sequence: Synthetic oligonucleotide
cccagacactggccgtatcctgtccaa

SEQ ID NO: 140312 - DNA, 27 bp, Artificial Sequence
  Description of Artificial Sequence: Synthetic oligonucleotide
ccagacactggccgtatcctgtccaag

SEQ ID NO: 140313 - DNA, 27 bp, Artificial Sequence
  Description of Artificial Sequence: Synthetic oligonucleotide
cagacactggccgtatcctgtccaagc

SEQ ID NO: 140314 - DNA, 29 bp, Artificial Sequence
  Description of Artificial Sequence: Synthetic oligonucleotide
agacactggccgtatcctgtccaagctac

SEQ ID NO: 140315 - DNA, 28 bp, Artificial Sequence
  Description of Artificial Sequence: Synthetic oligonucleotide
gacactggccgtatcctgtccaagctac

SEQ ID NO: 140316 - DNA, 31 bp, Artificial Sequence
  Description of Artificial Sequence: Synthetic oligonucleotide
acactggccgtatcctgtccaagctacatac

SEQ ID NO: 140317 - DNA, 30 bp, Artificial Sequence
  Description of Artificial Sequence: Synthetic oligonucleotide
cactggccgtatcctgtccaagctacatac

SEQ ID NO: 140318 - DNA, 31 bp, Artificial Sequence
  Description of Artificial Sequence: Synthetic oligonucleotide
actggccgtatcctgtccaagctacatactg

SEQ ID NO: 140319 - DNA, 30 bp, Artificial Sequence
  Description of Artificial Sequence: Synthetic oligonucleotide
ctggccgtatcctgtccaagctacatactg

SEQ ID NO: 140320 - DNA, 31 bp, Artificial Sequence
  Description of Artificial Sequence: Synthetic oligonucleotide
tggccgtatcctgtccaagctacatactgtc

SEQ ID NO: 140321 - DNA, 30 bp, Artificial Sequence
  Description of Artificial Sequence: Synthetic oligonucleotide
ggccgtatcctgtccaagctacatactgtc

SEQ ID NO: 140322 - DNA, 30 bp, Artificial Sequence
  Description of Artificial Sequence: Synthetic oligonucleotide
gccgtatcctgtccaagctacatactgtcc

SEQ ID NO: 140323 - DNA, 32 bp, Artificial Sequence
  Description of Artificial Sequence: Synthetic oligonucleotide
ccgtatcctgtccaagctacatactgtccaac

SEQ ID NO: 140324 - DNA, 32 bp, Artificial Sequence
  Description of Artificial Sequence: Synthetic oligonucleotide
cgtatcctgtccaagctacatactgtccaacc

SEQ ID NO: 140325 - DNA, 32 bp, Artificial Sequence
  Description of Artificial Sequence: Synthetic oligonucleotide
gtatcctgtccaagctacatactgtccaaccc

SEQ ID NO: 140326 - DNA, 34 bp, Artificial Sequence
  Description of Artificial Sequence: Synthetic oligonucleotide
tatcctgtccaagctacatactgtccaacccaag

SEQ ID NO: 140327 - DNA, 33 bp, Artificial Sequence
  Description of Artificial Sequence: Synthetic oligonucleotide
atcctgtccaagctacatactgtccaacccaag

SEQ ID NO: 140328 - DNA, 32 bp, Artificial Sequence
  Description of Artificial Sequence: Synthetic oligonucleotide
tcctgtccaagctacatactgtccaacccaag

SEQ ID NO: 140329 - DNA, 31 bp, Artificial Sequence
  Description of Artificial Sequence: Synthetic oligonucleotide
cctgtccaagctacatactgtccaacccaag

SEQ ID NO: 140330 - DNA, 31 bp, Artificial Sequence
  Description of Artificial Sequence: Synthetic oligonucleotide
ctgtccaagctacatactgtccaacccaagg

SEQ ID NO: 140331 - DNA, 31 bp, Artificial Sequence
  Description of Artificial Sequence: Synthetic oligonucleotide
tgtccaagctacatactgtccaacccaaggg

SEQ ID NO: 140332 - DNA, 30 bp, Artificial Sequence
  Description of Artificial Sequence: Synthetic oligonucleotide
gtccaagctacatactgtccaacccaaggg

SEQ ID NO: 140333 - DNA, 30 bp, Artificial Sequence
  Description of Artificial Sequence: Synthetic oligonucleotide
tccaagctacatactgtccaacccaagggc

SEQ ID NO: 140334 - DNA, 29 bp, Artificial Sequence
  Description of Artificial Sequence: Synthetic oligonucleotide
ccaagctacatactgtccaacccaagggc

SEQ ID NO: 140335 - DNA, 31 bp, Artificial Sequence
  Description of Artificial Sequence: Synthetic oligonucleotide
caagctacatactgtccaacccaagggcaag

SEQ ID NO: 140336 - DNA, 33 bp, Artificial Sequence
  Description of Artificial Sequence: Synthetic oligonucleotide
aagctacatactgtccaacccaagggcaagatc

SEQ ID NO: 140337 - DNA, 32 bp, Artificial Sequence
  Description of Artificial Sequence: Synthetic oligonucleotide
agctacatactgtccaacccaagggcaagatc

SEQ ID NO: 140338 - DNA, 31 bp, Artificial Sequence
  Description of Artificial Sequence: Synthetic oligonucleotide
gctacatactgtccaacccaagggcaagatc

SEQ ID NO: 140339 - DNA, 32 bp, Artificial Sequence
  Description of Artificial Sequence: Synthetic oligonucleotide
ctacatactgtccaacccaagggcaagatcac

SEQ ID NO: 140340 - DNA, 32 bp, Artificial Sequence
  Description of Artificial Sequence: Synthetic oligonucleotide
tacatactgtccaacccaagggcaagatcacc

SEQ ID NO: 140341 - DNA, 31 bp, Artificial Sequence
  Description of Artificial Sequence: Synthetic oligonucleotide
acatactgtccaacccaagggcaagatcacc

SEQ ID NO: 140342 - DNA, 30 bp, Artificial Sequence
  Description of Artificial Sequence: Synthetic oligonucleotide
catactgtccaacccaagggcaagatcacc

SEQ ID NO: 140343 - DNA, 32 bp, Artificial Sequence
  Description of Artificial Sequence: Synthetic oligonucleotide
atactgtccaacccaagggcaagatcaccttc

SEQ ID NO: 140344 - DNA, 31 bp, Artificial Sequence
  Description of Artificial Sequence: Synthetic oligonucleotide
tactgtccaacccaagggcaagatcaccttc

SEQ ID NO: 140345 - DNA, 30 bp, Artificial Sequence
  Description of Artificial Sequence: Synthetic oligonucleotide
actgtccaacccaagggcaagatcaccttc

SEQ ID NO: 140346 - DNA, 29 bp, Artificial Sequence
  Description of Artificial Sequence: Synthetic oligonucleotide
ctgtccaacccaagggcaagatcaccttc

SEQ ID NO: 140347 - DNA, 30 bp, Artificial Sequence
  Description of Artificial Sequence: Synthetic oligonucleotide
tgtccaacccaagggcaagatcaccttctg

SEQ ID NO: 140348 - DNA, 29 bp, Artificial Sequence
  Description of Artificial Sequence: Synthetic oligonucleotide
gtccaacccaagggcaagatcaccttctg

SEQ ID NO: 140349 - DNA, 29 bp, Artificial Sequence
  Description of Artificial Sequence: Synthetic oligonucleotide
tccaacccaagggcaagatcaccttctgc

SEQ ID NO: 140350 - DNA, 28 bp, Artificial Sequence
  Description of Artificial Sequence: Synthetic oligonucleotide
ccaacccaagggcaagatcaccttctgc

SEQ ID NO: 140351 - DNA, 29 bp, Artificial Sequence
  Description of Artificial Sequence: Synthetic oligonucleotide
caacccaagggcaagatcaccttctgcac

SEQ ID NO: 140352 - DNA, 29 bp, Artificial Sequence
  Description of Artificial Sequence: Synthetic oligonucleotide
aacccaagggcaagatcaccttctgcacg

SEQ ID NO: 140353 - DNA, 28 bp, Artificial Sequence
  Description of Artificial Sequence: Synthetic oligonucleotide
acccaagggcaagatcaccttctgcacg

SEQ ID NO: 140354 - DNA, 27 bp, Artificial Sequence
  Description of Artificial Sequence: Synthetic oligonucleotide
cccaagggcaagatcaccttctgcacg

SEQ ID NO: 140355 - DNA, 27 bp, Artificial Sequence
  Description of Artificial Sequence: Synthetic oligonucleotide
ccaagggcaagatcaccttctgcacgg

SEQ ID NO: 140356 - DNA, 27 bp, Artificial Sequence
  Description of Artificial Sequence: Synthetic oligonucleotide
caagggcaagatcaccttctgcacggg

SEQ ID NO: 140357 - DNA, 27 bp, Artificial Sequence
  Description of Artificial Sequence: Synthetic oligonucleotide
aagggcaagatcaccttctgcacgggc

SEQ ID NO: 140358 - DNA, 27 bp, Artificial Sequence
  Description of Artificial Sequence: Synthetic oligonucleotide
agggcaagatcaccttctgcacgggca

SEQ ID NO: 140359 - DNA, 27 bp, Artificial Sequence
  Description of Artificial Sequence: Synthetic oligonucleotide
gggcaagatcaccttctgcacgggcat

SEQ ID NO: 140360 - DNA, 27 bp, Artificial Sequence
  Description of Artificial Sequence: Synthetic oligonucleotide
ggcaagatcaccttctgcacgggcatc

SEQ ID NO: 140361 - DNA, 27 bp, Artificial Sequence
  Description of Artificial Sequence: Synthetic oligonucleotide
gcaagatcaccttctgcacgggcatcc

SEQ ID NO: 140362 - DNA, 27 bp, Artificial Sequence
  Description of Artificial Sequence: Synthetic oligonucleotide
caagatcaccttctgcacgggcatccg

SEQ ID NO: 140363 - DNA, 27 bp, Artificial Sequence
  Description of Artificial Sequence: Synthetic oligonucleotide
aagatcaccttctgcacgggcatccgc

SEQ ID NO: 140364 - DNA, 26 bp, Artificial Sequence
  Description of Artificial Sequence: Synthetic oligonucleotide
agatcaccttctgcacgggcatccgc

SEQ ID NO: 140365 - DNA, 25 bp, Artificial Sequence
  Description of Artificial Sequence: Synthetic oligonucleotide
gatcaccttctgcacgggcatccgc

SEQ ID NO: 140366 - DNA, 26 bp, Artificial Sequence
  Description of Artificial Sequence: Synthetic oligonucleotide
atcaccttctgcacgggcatccgcgt

SEQ ID NO: 140367 - DNA, 25 bp, Artificial Sequence
  Description of Artificial Sequence: Synthetic oligonucleotide
tcaccttctgcacgggcatccgcgt

SEQ ID NO: 140368 - DNA, 24 bp, Artificial Sequence
  Description of Artificial Sequence: Synthetic oligonucleotide
caccttctgcacgggcatccgcgt

SEQ ID NO: 140369 - DNA, 24 bp, Artificial Sequence
  Description of Artificial Sequence: Synthetic oligonucleotide
accttctgcacgggcatccgcgtg

SEQ ID NO: 140370 - DNA, 23 bp, Artificial Sequence
  Description of Artificial Sequence: Synthetic oligonucleotide
ccttctgcacgggcatccgcgtg

SEQ ID NO: 140371 - DNA, 23 bp, Artificial Sequence
  Description of Artificial Sequence: Synthetic oligonucleotide
cttctgcacgggcatccgcgtgg

SEQ ID NO: 140372 - DNA, 23 bp, Artificial Sequence
  Description of Artificial Sequence: Synthetic oligonucleotide
ttctgcacgggcatccgcgtggc

SEQ ID NO: 140373 - DNA, 22 bp, Artificial Sequence
  Description of Artificial Sequence: Synthetic oligonucleotide
tctgcacgggcatccgcgtggc

SEQ ID NO: 140374 - DNA, 21 bp, Artificial Sequence
  Description of Artificial Sequence: Synthetic oligonucleotide
ctgcacgggcatccgcgtggc

SEQ ID NO: 140375 - DNA, 21 bp, Artificial Sequence
  Description of Artificial Sequence: Synthetic oligonucleotide
tgcacgggcatccgcgtggcc

SEQ ID NO: 140376 - DNA, 20 bp, Artificial Sequence
  Description of Artificial Sequence: Synthetic oligonucleotide
gcacgggcatccgcgtggcc

SEQ ID NO: 140377 - DNA, 22 bp, Artificial Sequence
  Description of Artificial Sequence: Synthetic oligonucleotide
cacgggcatccgcgtggcccat

SEQ ID NO: 140378 - DNA, 23 bp, Artificial Sequence
  Description of Artificial Sequence: Synthetic oligonucleotide
acgggcatccgcgtggcccatct

SEQ ID NO: 140379 - DNA, 22 bp, Artificial Sequence
  Description of Artificial Sequence: Synthetic oligonucleotide
cgggcatccgcgtggcccatct

SEQ ID NO: 140380 - DNA, 22 bp, Artificial Sequence
  Description of Artificial Sequence: Synthetic oligonucleotide
gggcatccgcgtggcccatctg

SEQ ID NO: 140381 - DNA, 22 bp, Artificial Sequence
  Description of Artificial Sequence: Synthetic oligonucleotide
ggcatccgcgtggcccatctgg

SEQ ID NO: 140382 - DNA, 23 bp, Artificial Sequence
  Description of Artificial Sequence: Synthetic oligonucleotide
gcatccgcgtggcccatctggct

SEQ ID NO: 140383 - DNA, 24 bp, Artificial Sequence
  Description of Artificial Sequence: Synthetic oligonucleotide
catccgcgtggcccatctggctct

SEQ ID NO: 140384 - DNA, 26 bp, Artificial Sequence
  Description of Artificial Sequence: Synthetic oligonucleotide
atccgcgtggcccatctggctctgaa

SEQ ID NO: 140385 - DNA, 25 bp, Artificial Sequence
  Description of Artificial Sequence: Synthetic oligonucleotide
tccgcgtggcccatctggctctgaa

SEQ ID NO: 140386 - DNA, 24 bp, Artificial Sequence
  Description of Artificial Sequence: Synthetic oligonucleotide
ccgcgtggcccatctggctctgaa

SEQ ID NO: 140387 - DNA, 24 bp, Artificial Sequence
  Description of Artificial Sequence: Synthetic oligonucleotide
cgcgtggcccatctggctctgaag

SEQ ID NO: 140388 - DNA, 25 bp, Artificial Sequence
  Description of Artificial Sequence: Synthetic oligonucleotide
gcgtggcccatctggctctgaagca

SEQ ID NO: 140389 - DNA, 25 bp, Artificial Sequence
  Description of Artificial Sequence: Synthetic oligonucleotide
cgtggcccatctggctctgaagcac

SEQ ID NO: 140390 - DNA, 25 bp, Artificial Sequence
  Description of Artificial Sequence: Synthetic oligonucleotide
gtggcccatctggctctgaagcacc

SEQ ID NO: 140391 - DNA, 26 bp, Artificial Sequence
  Description of Artificial Sequence: Synthetic oligonucleotide
tggcccatctggctctgaagcaccga

SEQ ID NO: 140392 - DNA, 25 bp, Artificial Sequence
  Description of Artificial Sequence: Synthetic oligonucleotide
ggcccatctggctctgaagcaccga

SEQ ID NO: 140393 - DNA, 27 bp, Artificial Sequence
  Description of Artificial Sequence: Synthetic oligonucleotide
gcccatctggctctgaagcaccgacaa

SEQ ID NO: 140394 - DNA, 27 bp, Artificial Sequence
  Description of Artificial Sequence: Synthetic oligonucleotide
cccatctggctctgaagcaccgacaag

SEQ ID NO: 140395 - DNA, 27 bp, Artificial Sequence
  Description of Artificial Sequence: Synthetic oligonucleotide
ccatctggctctgaagcaccgacaagg

SEQ ID NO: 140396 - DNA, 27 bp, Artificial Sequence
  Description of Artificial Sequence: Synthetic oligonucleotide
catctggctctgaagcaccgacaaggc

SEQ ID NO: 140397 - DNA, 29 bp, Artificial Sequence
  Description of Artificial Sequence: Synthetic oligonucleotide
atctggctctgaagcaccgacaaggcaag

SEQ ID NO: 140398 - DNA, 28 bp, Artificial Sequence
  Description of Artificial Sequence: Synthetic oligonucleotide
tctggctctgaagcaccgacaaggcaag

SEQ ID NO: 140399 - DNA, 27 bp, Artificial Sequence
  Description of Artificial Sequence: Synthetic oligonucleotide
ctggctctgaagcaccgacaaggcaag

SEQ ID NO: 140400 - DNA, 30 bp, Artificial Sequence
  Description of Artificial Sequence: Synthetic oligonucleotide
tggctctgaagcaccgacaaggcaagaatc

SEQ ID NO: 140401 - DNA, 29 bp, Artificial Sequence
  Description of Artificial Sequence: Synthetic oligonucleotide
ggctctgaagcaccgacaaggcaagaatc

SEQ ID NO: 140402 - DNA, 30 bp, Artificial Sequence
  Description of Artificial Sequence: Synthetic oligonucleotide
gctctgaagcaccgacaaggcaagaatcac

SEQ ID NO: 140403 - DNA, 32 bp, Artificial Sequence
  Description of Artificial Sequence: Synthetic oligonucleotide
ctctgaagcaccgacaaggcaagaatcacaag

SEQ ID NO: 140404 - DNA, 34 bp, Artificial Sequence
  Description of Artificial Sequence: Synthetic oligonucleotide
tctgaagcaccgacaaggcaagaatcacaagatg

SEQ ID NO: 140405 - DNA, 33 bp, Artificial Sequence
  Description of Artificial Sequence: Synthetic oligonucleotide
ctgaagcaccgacaaggcaagaatcacaagatg

SEQ ID NO: 140406 - DNA, 33 bp, Artificial Sequence
  Description of Artificial Sequence: Synthetic oligonucleotide
tgaagcaccgacaaggcaagaatcacaagatgc

SEQ ID NO: 140407 - DNA, 32 bp, Artificial Sequence
  Description of Artificial Sequence: Synthetic oligonucleotide
gaagcaccgacaaggcaagaatcacaagatgc

SEQ ID NO: 140408 - DNA, 32 bp, Artificial Sequence
  Description of Artificial Sequence: Synthetic oligonucleotide
aagcaccgacaaggcaagaatcacaagatgcg

SEQ ID NO: 140409 - DNA, 31 bp, Artificial Sequence
  Description of Artificial Sequence: Synthetic oligonucleotide
agcaccgacaaggcaagaatcacaagatgcg

SEQ ID NO: 140410 - DNA, 30 bp, Artificial Sequence
  Description of Artificial Sequence: Synthetic oligonucleotide
gcaccgacaaggcaagaatcacaagatgcg

SEQ ID NO: 140411 - DNA, 30 bp, Artificial Sequence
  Description of Artificial Sequence: Synthetic oligonucleotide
caccgacaaggcaagaatcacaagatgcgc

SEQ ID NO: 140412 - DNA, 32 bp, Artificial Sequence
  Description of Artificial Sequence: Synthetic oligonucleotide
accgacaaggcaagaatcacaagatgcgcatc

SEQ ID NO: 140413 - DNA, 31 bp, Artificial Sequence
  Description of Artificial Sequence: Synthetic oligonucleotide
ccgacaaggcaagaatcacaagatgcgcatc

SEQ ID NO: 140414 - DNA, 34 bp, Artificial Sequence
  Description of Artificial Sequence: Synthetic oligonucleotide
cgacaaggcaagaatcacaagatgcgcatcattg

SEQ ID NO: 140415 - DNA, 34 bp, Artificial Sequence
  Description of Artificial Sequence: Synthetic oligonucleotide
gacaaggcaagaatcacaagatgcgcatcattgc

SEQ ID NO: 140416 - DNA, 34 bp, Artificial Sequence
  Description of Artificial Sequence: Synthetic oligonucleotide
acaaggcaagaatcacaagatgcgcatcattgcc

SEQ ID NO: 140417 - DNA, 33 bp, Artificial Sequence
  Description of Artificial Sequence: Synthetic oligonucleotide
caaggcaagaatcacaagatgcgcatcattgcc

SEQ ID NO: 140418 - DNA, 36 bp, Artificial Sequence
  Description of Artificial Sequence: Synthetic oligonucleotide
aaggcaagaatcacaagatgcgcatcattgcctttg

SEQ ID NO: 140419 - DNA, 35 bp, Artificial Sequence
  Description of Artificial Sequence: Synthetic oligonucleotide
aggcaagaatcacaagatgcgcatcattgcctttg

SEQ ID NO: 140420 - DNA, 34 bp, Artificial Sequence
  Description of Artificial Sequence: Synthetic oligonucleotide
ggcaagaatcacaagatgcgcatcattgcctttg

SEQ ID NO: 140421 - DNA, 35 bp, Artificial Sequence
  Description of Artificial Sequence: Synthetic oligonucleotide
gcaagaatcacaagatgcgcatcattgcctttgtg

SEQ ID NO: 140422 - DNA, 35 bp, Artificial Sequence
  Description of Artificial Sequence: Synthetic oligonucleotide
caagaatcacaagatgcgcatcattgcctttgtgg

SEQ ID NO: 140423 - DNA, 35 bp, Artificial Sequence
  Description of Artificial Sequence: Synthetic oligonucleotide
aagaatcacaagatgcgcatcattgcctttgtggg

SEQ ID NO: 140424 - DNA, 34 bp, Artificial Sequence
  Description of Artificial Sequence: Synthetic oligonucleotide
agaatcacaagatgcgcatcattgcctttgtggg

SEQ ID NO: 140425 - DNA, 33 bp, Artificial Sequence
  Description of Artificial Sequence: Synthetic oligonucleotide
gaatcacaagatgcgcatcattgcctttgtggg

SEQ ID NO: 140426 - DNA, 35 bp, Artificial Sequence
  Description of Artificial Sequence: Synthetic oligonucleotide
aatcacaagatgcgcatcattgcctttgtgggaag

SEQ ID NO: 140427 - DNA, 34 bp, Artificial Sequence
  Description of Artificial Sequence: Synthetic oligonucleotide
atcacaagatgcgcatcattgcctttgtgggaag

SEQ ID NO: 140428 - DNA, 33 bp, Artificial Sequence
  Description of Artificial Sequence: Synthetic oligonucleotide
tcacaagatgcgcatcattgcctttgtgggaag

SEQ ID NO: 140429 - DNA, 32 bp, Artificial Sequence
  Description of Artificial Sequence: Synthetic oligonucleotide
cacaagatgcgcatcattgcctttgtgggaag

SEQ ID NO: 140430 - DNA, 32 bp, Artificial Sequence
  Description of Artificial Sequence: Synthetic oligonucleotide
acaagatgcgcatcattgcctttgtgggaagc

SEQ ID NO: 140431 - DNA, 31 bp, Artificial Sequence
  Description of Artificial Sequence: Synthetic oligonucleotide
caagatgcgcatcattgcctttgtgggaagc

SEQ ID NO: 140432 - DNA, 31 bp, Artificial Sequence
  Description of Artificial Sequence: Synthetic oligonucleotide
aagatgcgcatcattgcctttgtgggaagcc

SEQ ID NO: 140433 - DNA, 30 bp, Artificial Sequence
  Description of Artificial Sequence: Synthetic oligonucleotide
agatgcgcatcattgcctttgtgggaagcc

SEQ ID NO: 140434 - DNA, 29 bp, Artificial Sequence
  Description of Artificial Sequence: Synthetic oligonucleotide
gatgcgcatcattgcctttgtgggaagcc

SEQ ID NO: 140435 - DNA, 29 bp, Artificial Sequence
  Description of Artificial Sequence: Synthetic oligonucleotide
atgcgcatcattgcctttgtgggaagccc

SEQ ID NO: 140436 - DNA, 28 bp, Artificial Sequence
  Description of Artificial Sequence: Synthetic oligonucleotide
tgcgcatcattgcctttgtgggaagccc

SEQ ID NO: 140437 - DNA, 27 bp, Artificial Sequence
  Description of Artificial Sequence: Synthetic oligonucleotide
gcgcatcattgcctttgtgggaagccc

SEQ ID NO: 140438 - DNA, 28 bp, Artificial Sequence
  Description of Artificial Sequence: Synthetic oligonucleotide
cgcatcattgcctttgtgggaagcccag

SEQ ID NO: 140439 - DNA, 29 bp, Artificial Sequence
  Description of Artificial Sequence: Synthetic oligonucleotide
gcatcattgcctttgtgggaagcccagtg

SEQ ID NO: 140440 - DNA, 29 bp, Artificial Sequence
  Description of Artificial Sequence: Synthetic oligonucleotide
catcattgcctttgtgggaagcccagtgg

SEQ ID NO: 140441 - DNA, 30 bp, Artificial Sequence
  Description of Artificial Sequence: Synthetic oligonucleotide
atcattgcctttgtgggaagcccagtggag

SEQ ID NO: 140442 - DNA, 29 bp, Artificial Sequence
  Description of Artificial Sequence: Synthetic oligonucleotide
tcattgcctttgtgggaagcccagtggag

SEQ ID NO: 140443 - DNA, 28 bp, Artificial Sequence
  Description of Artificial Sequence: Synthetic oligonucleotide
cattgcctttgtgggaagcccagtggag

SEQ ID NO: 140444 - DNA, 28 bp, Artificial Sequence
  Description of Artificial Sequence: Synthetic oligonucleotide
attgcctttgtgggaagcccagtggagg

SEQ ID NO: 140445 - DNA, 27 bp, Artificial Sequence
  Description of Artificial Sequence: Synthetic oligonucleotide
ttgcctttgtgggaagcccagtggagg

SEQ ID NO: 140446 - DNA, 27 bp, Artificial Sequence
  Description of Artificial Sequence: Synthetic oligonucleotide
tgcctttgtgggaagcccagtggagga

SEQ ID NO: 140447 - DNA, 26 bp, Artificial Sequence
  Description of Artificial Sequence: Synthetic oligonucleotide
gcctttgtgggaagcccagtggagga

SEQ ID NO: 140448 - DNA, 27 bp, Artificial Sequence
  Description of Artificial Sequence: Synthetic oligonucleotide
cctttgtgggaagcccagtggaggaca

SEQ ID NO: 140449 - DNA, 29 bp, Artificial Sequence
  Description of Artificial Sequence: Synthetic oligonucleotide
ctttgtgggaagcccagtggaggacaatg

SEQ ID NO: 140450 - DNA, 30 bp, Artificial Sequence
  Description of Artificial Sequence: Synthetic oligonucleotide
tttgtgggaagcccagtggaggacaatgag

SEQ ID NO: 140451 - DNA, 29 bp, Artificial Sequence
  Description of Artificial Sequence: Synthetic oligonucleotide
ttgtgggaagcccagtggaggacaatgag

SEQ ID NO: 140452 - DNA, 28 bp, Artificial Sequence
  Description of Artificial Sequence: Synthetic oligonucleotide
tgtgggaagcccagtggaggacaatgag

SEQ ID NO: 140453 - DNA, 27 bp, Artificial Sequence
  Description of Artificial Sequence: Synthetic oligonucleotide
gtgggaagcccagtggaggacaatgag

SEQ ID NO: 140454 - DNA, 29 bp, Artificial Sequence
  Description of Artificial Sequence: Synthetic oligonucleotide
tgggaagcccagtggaggacaatgagaag

SEQ ID NO: 140455 - DNA, 28 bp, Artificial Sequence
  Description of Artificial Sequence: Synthetic oligonucleotide
gggaagcccagtggaggacaatgagaag

SEQ ID NO: 140456 - DNA, 28 bp, Artificial Sequence
  Description of Artificial Sequence: Synthetic oligonucleotide
ggaagcccagtggaggacaatgagaagg

SEQ ID NO: 140457 - DNA, 30 bp, Artificial Sequence
  Description of Artificial Sequence: Synthetic oligonucleotide
gaagcccagtggaggacaatgagaaggatc

SEQ ID NO: 140458 - DNA, 31 bp, Artificial Sequence
  Description of Artificial Sequence: Synthetic oligonucleotide
aagcccagtggaggacaatgagaaggatctg

SEQ ID NO: 140459 - DNA, 30 bp, Artificial Sequence
  Description of Artificial Sequence: Synthetic oligonucleotide
agcccagtggaggacaatgagaaggatctg

SEQ ID NO: 140460 - DNA, 29 bp, Artificial Sequence
  Description of Artificial Sequence: Synthetic oligonucleotide
gcccagtggaggacaatgagaaggatctg

SEQ ID NO: 140461 - DNA, 29 bp, Artificial Sequence
  Description of Artificial Sequence: Synthetic oligonucleotide
cccagtggaggacaatgagaaggatctgg

SEQ ID NO: 140462 - DNA, 30 bp, Artificial Sequence
  Description of Artificial Sequence: Synthetic oligonucleotide
ccagtggaggacaatgagaaggatctggtg

SEQ ID NO: 140463 - DNA, 33 bp, Artificial Sequence
  Description of Artificial Sequence: Synthetic oligonucleotide
cagtggaggacaatgagaaggatctggtgaaac

SEQ ID NO: 140464 - DNA, 34 bp, Artificial Sequence
  Description of Artificial Sequence: Synthetic oligonucleotide
agtggaggacaatgagaaggatctggtgaaactg

SEQ ID NO: 140465 - DNA, 33 bp, Artificial Sequence
  Description of Artificial Sequence: Synthetic oligonucleotide
gtggaggacaatgagaaggatctggtgaaactg

SEQ ID NO: 140466 - DNA, 33 bp, Artificial Sequence
  Description of Artificial Sequence: Synthetic oligonucleotide
tggaggacaatgagaaggatctggtgaaactgg

SEQ ID NO: 140467 - DNA, 32 bp, Artificial Sequence
  Description of Artificial Sequence: Synthetic oligonucleotide
ggaggacaatgagaaggatctggtgaaactgg

SEQ ID NO: 140468 - DNA, 32 bp, Artificial Sequence
  Description of Artificial Sequence: Synthetic oligonucleotide
gaggacaatgagaaggatctggtgaaactggc

SEQ ID NO: 140469 - DNA, 36 bp, Artificial Sequence
  Description of Artificial Sequence: Synthetic oligonucleotide
aggacaatgagaaggatctggtgaaactggctaaac

SEQ ID NO: 140470 - DNA, 35 bp, Artificial Sequence
  Description of Artificial Sequence: Synthetic oligonucleotide
ggacaatgagaaggatctggtgaaactggctaaac

SEQ ID NO: 140471 - DNA, 35 bp, Artificial Sequence
  Description of Artificial Sequence: Synthetic oligonucleotide
gacaatgagaaggatctggtgaaactggctaaacg

SEQ ID NO: 140472 - DNA, 35 bp, Artificial Sequence
  Description of Artificial Sequence: Synthetic oligonucleotide
acaatgagaaggatctggtgaaactggctaaacgc

SEQ ID NO: 140473 - DNA, 34 bp, Artificial Sequence
  Description of Artificial Sequence: Synthetic oligonucleotide
caatgagaaggatctggtgaaactggctaaacgc

SEQ ID NO: 140474 - DNA, 34 bp, Artificial Sequence
  Description of Artificial Sequence: Synthetic oligonucleotide
aatgagaaggatctggtgaaactggctaaacgcc

SEQ ID NO: 140475 - DNA, 33 bp, Artificial Sequence
  Description of Artificial Sequence: Synthetic oligonucleotide
atgagaaggatctggtgaaactggctaaacgcc

SEQ ID NO: 140476 - DNA, 32 bp, Artificial Sequence
  Description of Artificial Sequence: Synthetic oligonucleotide
tgagaaggatctggtgaaactggctaaacgcc

SEQ ID NO: 140477 - DNA, 31 bp, Artificial Sequence
  Description of Artificial Sequence: Synthetic oligonucleotide
gagaaggatctggtgaaactggctaaacgcc

SEQ ID NO: 140478 - DNA, 32 bp, Artificial Sequence
  Description of Artificial Sequence: Synthetic oligonucleotide
agaaggatctggtgaaactggctaaacgcctc

SEQ ID NO: 140479 - DNA, 31 bp, Artificial Sequence
  Description of Artificial Sequence: Synthetic oligonucleotide
gaaggatctggtgaaactggctaaacgcctc

SEQ ID NO: 140480 - DNA, 33 bp, Artificial Sequence
  Description of Artificial Sequence: Synthetic oligonucleotide
aaggatctggtgaaactggctaaacgcctcaag

SEQ ID NO: 140481 - DNA, 32 bp, Artificial Sequence
  Description of Artificial Sequence: Synthetic oligonucleotide
aggatctggtgaaactggctaaacgcctcaag

SEQ ID NO: 140482 - DNA, 31 bp, Artificial Sequence
  Description of Artificial Sequence: Synthetic oligonucleotide
ggatctggtgaaactggctaaacgcctcaag

SEQ ID NO: 140483 - DNA, 33 bp, Artificial Sequence
  Description of Artificial Sequence: Synthetic oligonucleotide
gatctggtgaaactggctaaacgcctcaagaag

SEQ ID NO: 140484 - DNA, 33 bp, Artificial Sequence
  Description of Artificial Sequence: Synthetic oligonucleotide
atctggtgaaactggctaaacgcctcaagaagg

SEQ ID NO: 140485 - DNA, 32 bp, Artificial Sequence
  Description of Artificial Sequence: Synthetic oligonucleotide
tctggtgaaactggctaaacgcctcaagaagg

SEQ ID NO: 140486 - DNA, 31 bp, Artificial Sequence
  Description of Artificial Sequence: Synthetic oligonucleotide
ctggtgaaactggctaaacgcctcaagaagg

SEQ ID NO: 140487 - DNA, 32 bp, Artificial Sequence
  Description of Artificial Sequence: Synthetic oligonucleotide
tggtgaaactggctaaacgcctcaagaaggag

SEQ ID NO: 140488 - DNA, 31 bp, Artificial Sequence
  Description of Artificial Sequence: Synthetic oligonucleotide
ggtgaaactggctaaacgcctcaagaaggag

SEQ ID NO: 140489 - DNA, 34 bp, Artificial Sequence
  Description of Artificial Sequence: Synthetic oligonucleotide
gtgaaactggctaaacgcctcaagaaggagaaag

SEQ ID NO: 140490 - DNA, 39 bp, Artificial Sequence
  Description of Artificial Sequence: Synthetic oligonucleotide
tgaaactggctaaacgcctcaagaaggagaaagtaaatg

SEQ ID NO: 140491 - DNA, 38 bp, Artificial Sequence
  Description of Artificial Sequence: Synthetic oligonucleotide
gaaactggctaaacgcctcaagaaggagaaagtaaatg

SEQ ID NO: 140492 - DNA, 40 bp, Artificial Sequence
  Description of Artificial Sequence: Synthetic oligonucleotide
aaactggctaaacgcctcaagaaggagaaagtaaatgttg

SEQ ID NO: 140493 - DNA, 39 bp, Artificial Sequence
  Description of Artificial Sequence: Synthetic oligonucleotide
aactggctaaacgcctcaagaaggagaaagtaaatgttg

SEQ ID NO: 140494 - DNA, 38 bp, Artificial Sequence
  Description of Artificial Sequence: Synthetic oligonucleotide
actggctaaacgcctcaagaaggagaaagtaaatgttg

SEQ ID NO: 140495 - DNA, 37 bp, Artificial Sequence
  Description of Artificial Sequence: Synthetic oligonucleotide
ctggctaaacgcctcaagaaggagaaagtaaatgttg

SEQ ID NO: 140496 - DNA, 38 bp, Artificial Sequence
  Description of Artificial Sequence: Synthetic oligonucleotide
tggctaaacgcctcaagaaggagaaagtaaatgttgac

SEQ ID NO: 140497 - DNA, 37 bp, Artificial Sequence
  Description of Artificial Sequence: Synthetic oligonucleotide
ggctaaacgcctcaagaaggagaaagtaaatgttgac

SEQ ID NO: 140498 - DNA, 42 bp, Artificial Sequence
  Description of Artificial Sequence: Synthetic oligonucleotide
gctaaacgcctcaagaaggagaaagtaaatgttgacattatc

SEQ ID NO: 140499 - DNA, 48 bp, Artificial Sequence
  Description of Artificial Sequence: Synthetic oligonucleotide
ctaaacgcctcaagaaggagaaagtaaatgttgacattatcaattttg

SEQ ID NO: 140500 - DNA, 48 bp, Artificial Sequence
  Description of Artificial Sequence: Synthetic oligonucleotide
taaacgcctcaagaaggagaaagtaaatgttgacattatcaattttgg

SEQ ID NO: 140501 - DNA, 47 bp, Artificial Sequence
  Description of Artificial Sequence: Synthetic oligonucleotide
aaacgcctcaagaaggagaaagtaaatgttgacattatcaattttgg

SEQ ID NO: 140502 - DNA, 46 bp, Artificial Sequence
  Description of Artificial Sequence: Synthetic oligonucleotide
aacgcctcaagaaggagaaagtaaatgttgacattatcaattttgg

SEQ ID NO: 140503 - DNA, 45 bp, Artificial Sequence
  Description of Artificial Sequence: Synthetic oligonucleotide
acgcctcaagaaggagaaagtaaatgttgacattatcaattttgg

SEQ ID NO: 140504 - DNA, 44 bp, Artificial Sequence
  Description of Artificial Sequence: Synthetic oligonucleotide
cgcctcaagaaggagaaagtaaatgttgacattatcaattttgg

SEQ ID NO: 140505 - DNA, 44 bp, Artificial Sequence
  Description of Artificial Sequence: Synthetic oligonucleotide
gcctcaagaaggagaaagtaaatgttgacattatcaattttggg

SEQ ID NO: 140506 - DNA, 44 bp, Artificial Sequence
  Description of Artificial Sequence: Synthetic oligonucleotide
cctcaagaaggagaaagtaaatgttgacattatcaattttgggg

SEQ ID NO: 140507 - DNA, 46 bp, Artificial Sequence
  Description of Artificial Sequence: Synthetic oligonucleotide
ctcaagaaggagaaagtaaatgttgacattatcaattttggggaag

SEQ ID NO: 140508 - DNA, 47 bp, Artificial Sequence
  Description of Artificial Sequence: Synthetic oligonucleotide
tcaagaaggagaaagtaaatgttgacattatcaattttggggaagag

SEQ ID NO: 140509 - DNA, 46 bp, Artificial Sequence
  Description of Artificial Sequence: Synthetic oligonucleotide
caagaaggagaaagtaaatgttgacattatcaattttggggaagag

SEQ ID NO: 140510 - DNA, 46 bp, Artificial Sequence
  Description of Artificial Sequence: Synthetic oligonucleotide
aagaaggagaaagtaaatgttgacattatcaattttggggaagagg

SEQ ID NO: 140511 - DNA, 45 bp, Artificial Sequence
  Description of Artificial Sequence: Synthetic oligonucleotide
agaaggagaaagtaaatgttgacattatcaattttggggaagagg

SEQ ID NO: 140512 - DNA, 44 bp, Artificial Sequence
  Description of Artificial Sequence: Synthetic oligonucleotide
gaaggagaaagtaaatgttgacattatcaattttggggaagagg

SEQ ID NO: 140513 - DNA, 45 bp, Artificial Sequence
  Description of Artificial Sequence: Synthetic oligonucleotide
aaggagaaagtaaatgttgacattatcaattttggggaagaggag

SEQ ID NO: 140514 - DNA, 44 bp, Artificial Sequence
  Description of Artificial Sequence: Synthetic oligonucleotide
aggagaaagtaaatgttgacattatcaattttggggaagaggag

SEQ ID NO: 140515 - DNA, 43 bp, Artificial Sequence
  Description of Artificial Sequence: Synthetic oligonucleotide
ggagaaagtaaatgttgacattatcaattttggggaagaggag

SEQ ID NO: 140516 - DNA, 43 bp, Artificial Sequence
  Description of Artificial Sequence: Synthetic oligonucleotide
gagaaagtaaatgttgacattatcaattttggggaagaggagg

SEQ ID NO: 140517 - DNA, 44 bp, Artificial Sequence
  Description of Artificial Sequence: Synthetic oligonucleotide
agaaagtaaatgttgacattatcaattttggggaagaggaggtg

SEQ ID NO: 140518 - DNA, 43 bp, Artificial Sequence
  Description of Artificial Sequence: Synthetic oligonucleotide
gaaagtaaatgttgacattatcaattttggggaagaggaggtg

SEQ ID NO: 140519 - DNA, 45 bp, Artificial Sequence
  Description of Artificial Sequence: Synthetic oligonucleotide
aaagtaaatgttgacattatcaattttggggaagaggaggtgaac

SEQ ID NO: 140520 - DNA, 44 bp, Artificial Sequence
  Description of Artificial Sequence: Synthetic oligonucleotide
aagtaaatgttgacattatcaattttggggaagaggaggtgaac

SEQ ID NO: 140521 - DNA, 43 bp, Artificial Sequence
  Description of Artificial Sequence: Synthetic oligonucleotide
agtaaatgttgacattatcaattttggggaagaggaggtgaac

SEQ ID NO: 140522 - DNA, 42 bp, Artificial Sequence
  Description of Artificial Sequence: Synthetic oligonucleotide
gtaaatgttgacattatcaattttggggaagaggaggtgaac

SEQ ID NO: 140523 - DNA, 43 bp, Artificial Sequence
  Description of Artificial Sequence: Synthetic oligonucleotide
taaatgttgacattatcaattttggggaagaggaggtgaacac

SEQ ID NO: 140524 - DNA, 42 bp, Artificial Sequence
  Description of Artificial Sequence: Synthetic oligonucleotide
aaatgttgacattatcaattttggggaagaggaggtgaacac

SEQ ID NO: 140525 - DNA, 41 bp, Artificial Sequence
  Description of Artificial Sequence: Synthetic oligonucleotide
aatgttgacattatcaattttggggaagaggaggtgaacac

SEQ ID NO: 140526 - DNA, 40 bp, Artificial Sequence
  Description of Artificial Sequence: Synthetic oligonucleotide
atgttgacattatcaattttggggaagaggaggtgaacac

SEQ ID NO: 140527 - DNA, 39 bp, Artificial Sequence
  Description of Artificial Sequence: Synthetic oligonucleotide
tgttgacattatcaattttggggaagaggaggtgaacac

SEQ ID NO: 140528 - DNA, 38 bp, Artificial Sequence
  Description of Artificial Sequence: Synthetic oligonucleotide
gttgacattatcaattttggggaagaggaggtgaacac

SEQ ID NO: 140529 - DNA, 39 bp, Artificial Sequence
  Description of Artificial Sequence: Synthetic oligonucleotide
ttgacattatcaattttggggaagaggaggtgaacacag

SEQ ID NO: 140530 - DNA, 38 bp, Artificial Sequence
  Description of Artificial Sequence: Synthetic oligonucleotide
tgacattatcaattttggggaagaggaggtgaacacag

SEQ ID NO: 140531 - DNA, 37 bp, Artificial Sequence
  Description of Artificial Sequence: Synthetic oligonucleotide
gacattatcaattttggggaagaggaggtgaacacag

SEQ ID NO: 140532 - DNA, 41 bp, Artificial Sequence
  Description of Artificial Sequence: Synthetic oligonucleotide
acattatcaattttggggaagaggaggtgaacacagaaaag

SEQ ID NO: 140533 - DNA, 40 bp, Artificial Sequence
  Description of Artificial Sequence: Synthetic oligonucleotide
cattatcaattttggggaagaggaggtgaacacagaaaag

SEQ ID NO: 140534 - DNA, 40 bp, Artificial Sequence
  Description of Artificial Sequence: Synthetic oligonucleotide
attatcaattttggggaagaggaggtgaacacagaaaagc

SEQ ID NO: 140535 - DNA, 39 bp, Artificial Sequence
  Description of Artificial Sequence: Synthetic oligonucleotide
ttatcaattttggggaagaggaggtgaacacagaaaagc

SEQ ID NO: 140536 - DNA, 38 bp, Artificial Sequence
  Description of Artificial Sequence: Synthetic oligonucleotide
tatcaattttggggaagaggaggtgaacacagaaaagc

SEQ ID NO: 140537 - DNA, 37 bp, Artificial Sequence
  Description of Artificial Sequence: Synthetic oligonucleotide
atcaattttggggaagaggaggtgaacacagaaaagc

SEQ ID NO: 140538 - DNA, 36 bp, Artificial Sequence
  Description of Artificial Sequence: Synthetic oligonucleotide
tcaattttggggaagaggaggtgaacacagaaaagc

SEQ ID NO: 140539 - DNA, 35 bp, Artificial Sequence
  Description of Artificial Sequence: Synthetic oligonucleotide
caattttggggaagaggaggtgaacacagaaaagc

SEQ ID NO: 140540 - DNA, 36 bp, Artificial Sequence
  Description of Artificial Sequence: Synthetic oligonucleotide
aattttggggaagaggaggtgaacacagaaaagctg

SEQ ID NO: 140541 - DNA, 35 bp, Artificial Sequence
  Description of Artificial Sequence: Synthetic oligonucleotide
attttggggaagaggaggtgaacacagaaaagctg

SEQ ID NO: 140542 - DNA, 34 bp, Artificial Sequence
  Description of Artificial Sequence: Synthetic oligonucleotide
ttttggggaagaggaggtgaacacagaaaagctg

SEQ ID NO: 140543 - DNA, 33 bp, Artificial Sequence
  Description of Artificial Sequence: Synthetic oligonucleotide
tttggggaagaggaggtgaacacagaaaagctg

SEQ ID NO: 140544 - DNA, 32 bp, Artificial Sequence
  Description of Artificial Sequence: Synthetic oligonucleotide
ttggggaagaggaggtgaacacagaaaagctg

SEQ ID NO: 140545 - DNA, 31 bp, Artificial Sequence
  Description of Artificial Sequence: Synthetic oligonucleotide
tggggaagaggaggtgaacacagaaaagctg

SEQ ID NO: 140546 - DNA, 30 bp, Artificial Sequence
  Description of Artificial Sequence: Synthetic oligonucleotide
ggggaagaggaggtgaacacagaaaagctg

SEQ ID NO: 140547 - DNA, 31 bp, Artificial Sequence
  Description of Artificial Sequence: Synthetic oligonucleotide
gggaagaggaggtgaacacagaaaagctgac

SEQ ID NO: 140548 - DNA, 32 bp, Artificial Sequence
  Description of Artificial Sequence: Synthetic oligonucleotide
ggaagaggaggtgaacacagaaaagctgacag

SEQ ID NO: 140549 - DNA, 32 bp, Artificial Sequence
  Description of Artificial Sequence: Synthetic oligonucleotide
gaagaggaggtgaacacagaaaagctgacagc

SEQ ID NO: 140550 - DNA, 32 bp, Artificial Sequence
  Description of Artificial Sequence: Synthetic oligonucleotide
aagaggaggtgaacacagaaaagctgacagcc

SEQ ID NO: 140551 - DNA, 31 bp, Artificial Sequence
  Description of Artificial Sequence: Synthetic oligonucleotide
agaggaggtgaacacagaaaagctgacagcc

SEQ ID NO: 140552 - DNA, 30 bp, Artificial Sequence
  Description of Artificial Sequence: Synthetic oligonucleotide
gaggaggtgaacacagaaaagctgacagcc

SEQ ID NO: 140553 - DNA, 33 bp, Artificial Sequence
  Description of Artificial Sequence: Synthetic oligonucleotide
aggaggtgaacacagaaaagctgacagcctttg

SEQ ID NO: 140554 - DNA, 32 bp, Artificial Sequence
  Description of Artificial Sequence: Synthetic oligonucleotide
ggaggtgaacacagaaaagctgacagcctttg

SEQ ID NO: 140555 - DNA, 36 bp, Artificial Sequence
  Description of Artificial Sequence: Synthetic oligonucleotide
gaggtgaacacagaaaagctgacagcctttgtaaac

SEQ ID NO: 140556 - DNA, 37 bp, Artificial Sequence
  Description of Artificial Sequence: Synthetic oligonucleotide
aggtgaacacagaaaagctgacagcctttgtaaacac

SEQ ID NO: 140557 - DNA, 36 bp, Artificial Sequence
  Description of Artificial Sequence: Synthetic oligonucleotide
ggtgaacacagaaaagctgacagcctttgtaaacac

SEQ ID NO: 140558 - DNA, 36 bp, Artificial Sequence
  Description of Artificial Sequence: Synthetic oligonucleotide
gtgaacacagaaaagctgacagcctttgtaaacacg

SEQ ID NO: 140559 - DNA, 38 bp, Artificial Sequence
  Description of Artificial Sequence: Synthetic oligonucleotide
tgaacacagaaaagctgacagcctttgtaaacacgttg

SEQ ID NO: 140560 - DNA, 37 bp, Artificial Sequence
  Description of Artificial Sequence: Synthetic oligonucleotide
gaacacagaaaagctgacagcctttgtaaacacgttg

SEQ ID NO: 140561 - DNA, 40 bp, Artificial Sequence
  Description of Artificial Sequence: Synthetic oligonucleotide
aacacagaaaagctgacagcctttgtaaacacgttgaatg

SEQ ID NO: 140562 - DNA, 39 bp, Artificial Sequence
  Description of Artificial Sequence: Synthetic oligonucleotide
acacagaaaagctgacagcctttgtaaacacgttgaatg

SEQ ID NO: 140563 - DNA, 38 bp, Artificial Sequence
  Description of Artificial Sequence: Synthetic oligonucleotide
cacagaaaagctgacagcctttgtaaacacgttgaatg

SEQ ID NO: 140564 - DNA, 38 bp, Artificial Sequence
  Description of Artificial Sequence: Synthetic oligonucleotide
acagaaaagctgacagcctttgtaaacacgttgaatgg

SEQ ID NO: 140565 - DNA, 37 bp, Artificial Sequence
  Description of Artificial Sequence: Synthetic oligonucleotide
cagaaaagctgacagcctttgtaaacacgttgaatgg

SEQ ID NO: 140566 - DNA, 37 bp, Artificial Sequence
  Description of Artificial Sequence: Synthetic oligonucleotide
agaaaagctgacagcctttgtaaacacgttgaatggc

SEQ ID NO: 140567 - DNA, 36 bp, Artificial Sequence
  Description of Artificial Sequence: Synthetic oligonucleotide
gaaaagctgacagcctttgtaaacacgttgaatggc

SEQ ID NO: 140568 - DNA, 39 bp, Artificial Sequence
  Description of Artificial Sequence: Synthetic oligonucleotide
aaaagctgacagcctttgtaaacacgttgaatggcaaag

SEQ ID NO: 140569 - DNA, 38 bp, Artificial Sequence
  Description of Artificial Sequence: Synthetic oligonucleotide
aaagctgacagcctttgtaaacacgttgaatggcaaag

SEQ ID NO: 140570 - DNA, 37 bp, Artificial Sequence
  Description of Artificial Sequence: Synthetic oligonucleotide
aagctgacagcctttgtaaacacgttgaatggcaaag

SEQ ID NO: 140571 - DNA, 36 bp, Artificial Sequence
  Description of Artificial Sequence: Synthetic oligonucleotide
agctgacagcctttgtaaacacgttgaatggcaaag

SEQ ID NO: 140572 - DNA, 35 bp, Artificial Sequence
  Description of Artificial Sequence: Synthetic oligonucleotide
gctgacagcctttgtaaacacgttgaatggcaaag

SEQ ID NO: 140573 - DNA, 37 bp, Artificial Sequence
  Description of Artificial Sequence: Synthetic oligonucleotide
ctgacagcctttgtaaacacgttgaatggcaaagatg

SEQ ID NO: 140574 - DNA, 37 bp, Artificial Sequence
  Description of Artificial Sequence: Synthetic oligonucleotide
tgacagcctttgtaaacacgttgaatggcaaagatgg

SEQ ID NO: 140575 - DNA, 36 bp, Artificial Sequence
  Description of Artificial Sequence: Synthetic oligonucleotide
gacagcctttgtaaacacgttgaatggcaaagatgg

SEQ ID NO: 140576 - DNA, 38 bp, Artificial Sequence
  Description of Artificial Sequence: Synthetic oligonucleotide
acagcctttgtaaacacgttgaatggcaaagatggaac

SEQ ID NO: 140577 - DNA, 37 bp, Artificial Sequence
  Description of Artificial Sequence: Synthetic oligonucleotide
cagcctttgtaaacacgttgaatggcaaagatggaac

SEQ ID NO: 140578 - DNA, 37 bp, Artificial Sequence
  Description of Artificial Sequence: Synthetic oligonucleotide
agcctttgtaaacacgttgaatggcaaagatggaacc

SEQ ID NO: 140579 - DNA, 36 bp, Artificial Sequence
  Description of Artificial Sequence: Synthetic oligonucleotide
gcctttgtaaacacgttgaatggcaaagatggaacc

SEQ ID NO: 140580 - DNA, 36 bp, Artificial Sequence
  Description of Artificial Sequence: Synthetic oligonucleotide
cctttgtaaacacgttgaatggcaaagatggaaccg

SEQ ID NO: 140581 - DNA, 36 bp, Artificial Sequence
  Description of Artificial Sequence: Synthetic oligonucleotide
ctttgtaaacacgttgaatggcaaagatggaaccgg

SEQ ID NO: 140582 - DNA, 38 bp, Artificial Sequence
  Description of Artificial Sequence: Synthetic oligonucleotide
tttgtaaacacgttgaatggcaaagatggaaccggttc

SEQ ID NO: 140583 - DNA, 37 bp, Artificial Sequence
  Description of Artificial Sequence: Synthetic oligonucleotide
ttgtaaacacgttgaatggcaaagatggaaccggttc

SEQ ID NO: 140584 - DNA, 36 bp, Artificial Sequence
  Description of Artificial Sequence: Synthetic oligonucleotide
tgtaaacacgttgaatggcaaagatggaaccggttc

SEQ ID NO: 140585 - DNA, 35 bp, Artificial Sequence
  Description of Artificial Sequence: Synthetic oligonucleotide
gtaaacacgttgaatggcaaagatggaaccggttc

SEQ ID NO: 140586 - DNA, 36 bp, Artificial Sequence
  Description of Artificial Sequence: Synthetic oligonucleotide
taaacacgttgaatggcaaagatggaaccggttctc

SEQ ID NO: 140587 - DNA, 35 bp, Artificial Sequence
  Description of Artificial Sequence: Synthetic oligonucleotide
aaacacgttgaatggcaaagatggaaccggttctc

SEQ ID NO: 140588 - DNA, 34 bp, Artificial Sequence
  Description of Artificial Sequence: Synthetic oligonucleotide
aacacgttgaatggcaaagatggaaccggttctc

SEQ ID NO: 140589 - DNA, 33 bp, Artificial Sequence
  Description of Artificial Sequence: Synthetic oligonucleotide
acacgttgaatggcaaagatggaaccggttctc

SEQ ID NO: 140590 - DNA, 32 bp, Artificial Sequence
  Description of Artificial Sequence: Synthetic oligonucleotide
cacgttgaatggcaaagatggaaccggttctc

SEQ ID NO: 140591 - DNA, 34 bp, Artificial Sequence
  Description of Artificial Sequence: Synthetic oligonucleotide
acgttgaatggcaaagatggaaccggttctcatc

SEQ ID NO: 140592 - DNA, 33 bp, Artificial Sequence
  Description of Artificial Sequence: Synthetic oligonucleotide
cgttgaatggcaaagatggaaccggttctcatc

SEQ ID NO: 140593 - DNA, 34 bp, Artificial Sequence
  Description of Artificial Sequence: Synthetic oligonucleotide
gttgaatggcaaagatggaaccggttctcatctg

SEQ ID NO: 140594 - DNA, 34 bp, Artificial Sequence
  Description of Artificial Sequence: Synthetic oligonucleotide
ttgaatggcaaagatggaaccggttctcatctgg

SEQ ID NO: 140595 - DNA, 33 bp, Artificial Sequence
  Description of Artificial Sequence: Synthetic oligonucleotide
tgaatggcaaagatggaaccggttctcatctgg

SEQ ID NO: 140596 - DNA, 32 bp, Artificial Sequence
  Description of Artificial Sequence: Synthetic oligonucleotide
gaatggcaaagatggaaccggttctcatctgg

SEQ ID NO: 140597 - DNA, 33 bp, Artificial Sequence
  Description of Artificial Sequence: Synthetic oligonucleotide
aatggcaaagatggaaccggttctcatctggtg

SEQ ID NO: 140598 - DNA, 32 bp, Artificial Sequence
  Description of Artificial Sequence: Synthetic oligonucleotide
atggcaaagatggaaccggttctcatctggtg

SEQ ID NO: 140599 - DNA, 31 bp, Artificial Sequence
  Description of Artificial Sequence: Synthetic oligonucleotide
tggcaaagatggaaccggttctcatctggtg

SEQ ID NO: 140600 - DNA, 30 bp, Artificial Sequence
  Description of Artificial Sequence: Synthetic oligonucleotide
ggcaaagatggaaccggttctcatctggtg

SEQ ID NO: 140601 - DNA, 31 bp, Artificial Sequence
  Description of Artificial Sequence: Synthetic oligonucleotide
gcaaagatggaaccggttctcatctggtgac

SEQ ID NO: 140602 - DNA, 32 bp, Artificial Sequence
  Description of Artificial Sequence: Synthetic oligonucleotide
caaagatggaaccggttctcatctggtgacag

SEQ ID NO: 140603 - DNA, 33 bp, Artificial Sequence
  Description of Artificial Sequence: Synthetic oligonucleotide
aaagatggaaccggttctcatctggtgacagtg

SEQ ID NO: 140604 - DNA, 32 bp, Artificial Sequence
  Description of Artificial Sequence: Synthetic oligonucleotide
aagatggaaccggttctcatctggtgacagtg

SEQ ID NO: 140605 - DNA, 31 bp, Artificial Sequence
  Description of Artificial Sequence: Synthetic oligonucleotide
agatggaaccggttctcatctggtgacagtg

SEQ ID NO: 140606 - DNA, 30 bp, Artificial Sequence
  Description of Artificial Sequence: Synthetic oligonucleotide
gatggaaccggttctcatctggtgacagtg

SEQ ID NO: 140607 - DNA, 30 bp, Artificial Sequence
  Description of Artificial Sequence: Synthetic oligonucleotide
atggaaccggttctcatctggtgacagtgc

SEQ ID NO: 140608 - DNA, 29 bp, Artificial Sequence
  Description of Artificial Sequence: Synthetic oligonucleotide
tggaaccggttctcatctggtgacagtgc

SEQ ID NO: 140609 - DNA, 28 bp, Artificial Sequence
  Description of Artificial Sequence: Synthetic oligonucleotide
ggaaccggttctcatctggtgacagtgc

SEQ ID NO: 140610 - DNA, 28 bp, Artificial Sequence
  Description of Artificial Sequence: Synthetic oligonucleotide
gaaccggttctcatctggtgacagtgcc

SEQ ID NO: 140611 - DNA, 29 bp, Artificial Sequence
  Description of Artificial Sequence: Synthetic oligonucleotide
aaccggttctcatctggtgacagtgcctc

SEQ ID NO: 140612 - DNA, 28 bp, Artificial Sequence
  Description of Artificial Sequence: Synthetic oligonucleotide
accggttctcatctggtgacagtgcctc

SEQ ID NO: 140613 - DNA, 27 bp, Artificial Sequence
  Description of Artificial Sequence: Synthetic oligonucleotide
ccggttctcatctggtgacagtgcctc

SEQ ID NO: 140614 - DNA, 27 bp, Artificial Sequence
  Description of Artificial Sequence: Synthetic oligonucleotide
cggttctcatctggtgacagtgcctcc

SEQ ID NO: 140615 - DNA, 28 bp, Artificial Sequence
  Description of Artificial Sequence: Synthetic oligonucleotide
ggttctcatctggtgacagtgcctcctg

SEQ ID NO: 140616 - DNA, 28 bp, Artificial Sequence
  Description of Artificial Sequence: Synthetic oligonucleotide
gttctcatctggtgacagtgcctcctgg

SEQ ID NO: 140617 - DNA, 28 bp, Artificial Sequence
  Description of Artificial Sequence: Synthetic oligonucleotide
ttctcatctggtgacagtgcctcctggg

SEQ ID NO: 140618 - DNA, 27 bp, Artificial Sequence
  Description of Artificial Sequence: Synthetic oligonucleotide
tctcatctggtgacagtgcctcctggg

SEQ ID NO: 140619 - DNA, 26 bp, Artificial Sequence
  Description of Artificial Sequence: Synthetic oligonucleotide
ctcatctggtgacagtgcctcctggg

SEQ ID NO: 140620 - DNA, 26 bp, Artificial Sequence
  Description of Artificial Sequence: Synthetic oligonucleotide
tcatctggtgacagtgcctcctgggc

SEQ ID NO: 140621 - DNA, 25 bp, Artificial Sequence
  Description of Artificial Sequence: Synthetic oligonucleotide
catctggtgacagtgcctcctgggc

SEQ ID NO: 140622 - DNA, 25 bp, Artificial Sequence
  Description of Artificial Sequence: Synthetic oligonucleotide
atctggtgacagtgcctcctgggcc

SEQ ID NO: 140623 - DNA, 24 bp, Artificial Sequence
  Description of Artificial Sequence: Synthetic oligonucleotide
tctggtgacagtgcctcctgggcc

SEQ ID NO: 140624 - DNA, 23 bp, Artificial Sequence
  Description of Artificial Sequence: Synthetic oligonucleotide
ctggtgacagtgcctcctgggcc

SEQ ID NO: 140625 - DNA, 24 bp, Artificial Sequence
  Description of Artificial Sequence: Synthetic oligonucleotide
tggtgacagtgcctcctgggccca

SEQ ID NO: 140626 - DNA, 23 bp, Artificial Sequence
  Description of Artificial Sequence: Synthetic oligonucleotide
ggtgacagtgcctcctgggccca

SEQ ID NO: 140627 - DNA, 26 bp, Artificial Sequence
  Description of Artificial Sequence: Synthetic oligonucleotide
gtgacagtgcctcctgggcccagttt

SEQ ID NO: 140628 - DNA, 26 bp, Artificial Sequence
  Description of Artificial Sequence: Synthetic oligonucleotide
tgacagtgcctcctgggcccagtttg

SEQ ID NO: 140629 - DNA, 25 bp, Artificial Sequence
  Description of Artificial Sequence: Synthetic oligonucleotide
gacagtgcctcctgggcccagtttg

SEQ ID NO: 140630 - DNA, 25 bp, Artificial Sequence
  Description of Artificial Sequence: Synthetic oligonucleotide
acagtgcctcctgggcccagtttgg

SEQ ID NO: 140631 - DNA, 24 bp, Artificial Sequence
  Description of Artificial Sequence: Synthetic oligonucleotide
cagtgcctcctgggcccagtttgg

SEQ ID NO: 140632 - DNA, 25 bp, Artificial Sequence
  Description of Artificial Sequence: Synthetic oligonucleotide
agtgcctcctgggcccagtttggct

SEQ ID NO: 140633 - DNA, 24 bp, Artificial Sequence
  Description of Artificial Sequence: Synthetic oligonucleotide
gtgcctcctgggcccagtttggct

SEQ ID NO: 140634 - DNA, 26 bp, Artificial Sequence
  Description of Artificial Sequence: Synthetic oligonucleotide
tgcctcctgggcccagtttggctgat

SEQ ID NO: 140635 - DNA, 25 bp, Artificial Sequence
  Description of Artificial Sequence: Synthetic oligonucleotide
gcctcctgggcccagtttggctgat

SEQ ID NO: 140636 - DNA, 25 bp, Artificial Sequence
  Description of Artificial Sequence: Synthetic oligonucleotide
cctcctgggcccagtttggctgatg

SEQ ID NO: 140637 - DNA, 26 bp, Artificial Sequence
  Description of Artificial Sequence: Synthetic oligonucleotide
ctcctgggcccagtttggctgatgct

SEQ ID NO: 140638 - DNA, 27 bp, Artificial Sequence
  Description of Artificial Sequence: Synthetic oligonucleotide
tcctgggcccagtttggctgatgctct

SEQ ID NO: 140639 - DNA, 26 bp, Artificial Sequence
  Description of Artificial Sequence: Synthetic oligonucleotide
cctgggcccagtttggctgatgctct

SEQ ID NO: 140640 - DNA, 27 bp, Artificial Sequence
  Description of Artificial Sequence: Synthetic oligonucleotide
ctgggcccagtttggctgatgctctca

SEQ ID NO: 140641 - DNA, 28 bp, Artificial Sequence
  Description of Artificial Sequence: Synthetic oligonucleotide
tgggcccagtttggctgatgctctcatc

SEQ ID NO: 140642 - DNA, 27 bp, Artificial Sequence
  Description of Artificial Sequence: Synthetic oligonucleotide
gggcccagtttggctgatgctctcatc

SEQ ID NO: 140643 - DNA, 28 bp, Artificial Sequence
  Description of Artificial Sequence: Synthetic oligonucleotide
ggcccagtttggctgatgctctcatcag

SEQ ID NO: 140644 - DNA, 30 bp, Artificial Sequence
  Description of Artificial Sequence: Synthetic oligonucleotide
gcccagtttggctgatgctctcatcagttc

SEQ ID NO: 140645 - DNA, 31 bp, Artificial Sequence
  Description of Artificial Sequence: Synthetic oligonucleotide
cccagtttggctgatgctctcatcagttctc

SEQ ID NO: 140646 - DNA, 31 bp, Artificial Sequence
  Description of Artificial Sequence: Synthetic oligonucleotide
ccagtttggctgatgctctcatcagttctcc

SEQ ID NO: 140647 - DNA, 31 bp, Artificial Sequence
  Description of Artificial Sequence: Synthetic oligonucleotide
cagtttggctgatgctctcatcagttctccg

SEQ ID NO: 140648 - DNA, 36 bp, Artificial Sequence
  Description of Artificial Sequence: Synthetic oligonucleotide
agtttggctgatgctctcatcagttctccgattttg

SEQ ID NO: 140649 - DNA, 35 bp, Artificial Sequence
  Description of Artificial Sequence: Synthetic oligonucleotide
gtttggctgatgctctcatcagttctccgattttg

SEQ ID NO: 140650 - DNA, 35 bp, Artificial Sequence
  Description of Artificial Sequence: Synthetic oligonucleotide
tttggctgatgctctcatcagttctccgattttgg

SEQ ID NO: 140651 - DNA, 34 bp, Artificial Sequence
  Description of Artificial Sequence: Synthetic oligonucleotide
ttggctgatgctctcatcagttctccgattttgg

SEQ ID NO: 140652 - DNA, 33 bp, Artificial Sequence
  Description of Artificial Sequence: Synthetic oligonucleotide
tggctgatgctctcatcagttctccgattttgg

SEQ ID NO: 140653 - DNA, 32 bp, Artificial Sequence
  Description of Artificial Sequence: Synthetic oligonucleotide
ggctgatgctctcatcagttctccgattttgg

SEQ ID NO: 140654 - DNA, 32 bp, Artificial Sequence
  Description of Artificial Sequence: Synthetic oligonucleotide
gctgatgctctcatcagttctccgattttggc

SEQ ID NO: 140655 - DNA, 33 bp, Artificial Sequence
  Description of Artificial Sequence: Synthetic oligonucleotide
ctgatgctctcatcagttctccgattttggctg

SEQ ID NO: 140656 - DNA, 33 bp, Artificial Sequence
  Description of Artificial Sequence: Synthetic oligonucleotide
tgatgctctcatcagttctccgattttggctgg

SEQ ID NO: 140657 - DNA, 32 bp, Artificial Sequence
  Description of Artificial Sequence: Synthetic oligonucleotide
gatgctctcatcagttctccgattttggctgg

SEQ ID NO: 140658 - DNA, 33 bp, Artificial Sequence
  Description of Artificial Sequence: Synthetic oligonucleotide
atgctctcatcagttctccgattttggctggtg

SEQ ID NO: 140659 - DNA, 32 bp, Artificial Sequence
  Description of Artificial Sequence: Synthetic oligonucleotide
tgctctcatcagttctccgattttggctggtg

SEQ ID NO: 140660 - DNA, 31 bp, Artificial Sequence
  Description of Artificial Sequence: Synthetic oligonucleotide
gctctcatcagttctccgattttggctggtg

SEQ ID NO: 140661 - DNA, 33 bp, Artificial Sequence
  Description of Artificial Sequence: Synthetic oligonucleotide
ctctcatcagttctccgattttggctggtgaag

SEQ ID NO: 140662 - DNA, 33 bp, Artificial Sequence
  Description of Artificial Sequence: Synthetic oligonucleotide
tctcatcagttctccgattttggctggtgaagg

SEQ ID NO: 140663 - DNA, 32 bp, Artificial Sequence
  Description of Artificial Sequence: Synthetic oligonucleotide
ctcatcagttctccgattttggctggtgaagg

SEQ ID NO: 140664 - DNA, 33 bp, Artificial Sequence
  Description of Artificial Sequence: Synthetic oligonucleotide
tcatcagttctccgattttggctggtgaaggtg

SEQ ID NO: 140665 - DNA, 32 bp, Artificial Sequence
  Description of Artificial Sequence: Synthetic oligonucleotide
catcagttctccgattttggctggtgaaggtg

SEQ ID NO: 140666 - DNA, 32 bp, Artificial Sequence
  Description of Artificial Sequence: Synthetic oligonucleotide
atcagttctccgattttggctggtgaaggtgg

SEQ ID NO: 140667 - DNA, 31 bp, Artificial Sequence
  Description of Artificial Sequence: Synthetic oligonucleotide
tcagttctccgattttggctggtgaaggtgg

SEQ ID NO: 140668 - DNA, 30 bp, Artificial Sequence
  Description of Artificial Sequence: Synthetic oligonucleotide
cagttctccgattttggctggtgaaggtgg

SEQ ID NO: 140669 - DNA, 31 bp, Artificial Sequence
  Description of Artificial Sequence: Synthetic oligonucleotide
agttctccgattttggctggtgaaggtggtg

SEQ ID NO: 140670 - DNA, 30 bp, Artificial Sequence
  Description of Artificial Sequence: Synthetic oligonucleotide
gttctccgattttggctggtgaaggtggtg

SEQ ID NO: 140671 - DNA, 30 bp, Artificial Sequence
  Description of Artificial Sequence: Synthetic oligonucleotide
ttctccgattttggctggtgaaggtggtgc

SEQ ID NO: 140672 - DNA, 29 bp, Artificial Sequence
  Description of Artificial Sequence: Synthetic oligonucleotide
tctccgattttggctggtgaaggtggtgc

SEQ ID NO: 140673 - DNA, 28 bp, Artificial Sequence
  Description of Artificial Sequence: Synthetic oligonucleotide
ctccgattttggctggtgaaggtggtgc

SEQ ID NO: 140674 - DNA, 28 bp, Artificial Sequence
  Description of Artificial Sequence: Synthetic oligonucleotide
tccgattttggctggtgaaggtggtgcc

SEQ ID NO: 140675 - DNA, 27 bp, Artificial Sequence
  Description of Artificial Sequence: Synthetic oligonucleotide
ccgattttggctggtgaaggtggtgcc

SEQ ID NO: 140676 - DNA, 29 bp, Artificial Sequence
  Description of Artificial Sequence: Synthetic oligonucleotide
cgattttggctggtgaaggtggtgccatg

SEQ ID NO: 140677 - DNA, 29 bp, Artificial Sequence
  Description of Artificial Sequence: Synthetic oligonucleotide
gattttggctggtgaaggtggtgccatgc

SEQ ID NO: 140678 - DNA, 30 bp, Artificial Sequence
  Description of Artificial Sequence: Synthetic oligonucleotide
attttggctggtgaaggtggtgccatgctg

SEQ ID NO: 140679 - DNA, 29 bp, Artificial Sequence
  Description of Artificial Sequence: Synthetic oligonucleotide
ttttggctggtgaaggtggtgccatgctg

SEQ ID NO: 140680 - DNA, 28 bp, Artificial Sequence
  Description of Artificial Sequence: Synthetic oligonucleotide
tttggctggtgaaggtggtgccatgctg

SEQ ID NO: 140681 - DNA, 27 bp, Artificial Sequence
  Description of Artificial Sequence: Synthetic oligonucleotide
ttggctggtgaaggtggtgccatgctg

SEQ ID NO: 140682 - DNA, 26 bp, Artificial Sequence
  Description of Artificial Sequence: Synthetic oligonucleotide
tggctggtgaaggtggtgccatgctg

SEQ ID NO: 140683 - DNA, 25 bp, Artificial Sequence
  Description of Artificial Sequence: Synthetic oligonucleotide
ggctggtgaaggtggtgccatgctg

SEQ ID NO: 140684 - DNA, 25 bp, Artificial Sequence
  Description of Artificial Sequence: Synthetic oligonucleotide
gctggtgaaggtggtgccatgctgg

SEQ ID NO: 140685 - DNA, 26 bp, Artificial Sequence
  Description of Artificial Sequence: Synthetic oligonucleotide
ctggtgaaggtggtgccatgctgggt

SEQ ID NO: 140686 - DNA, 27 bp, Artificial Sequence
  Description of Artificial Sequence: Synthetic oligonucleotide
tggtgaaggtggtgccatgctgggtct

SEQ ID NO: 140687 - DNA, 27 bp, Artificial Sequence
  Description of Artificial Sequence: Synthetic oligonucleotide
ggtgaaggtggtgccatgctgggtctt

SEQ ID NO: 140688 - DNA, 27 bp, Artificial Sequence
  Description of Artificial Sequence: Synthetic oligonucleotide
gtgaaggtggtgccatgctgggtcttg

SEQ ID NO: 140689 - DNA, 27 bp, Artificial Sequence
  Description of Artificial Sequence: Synthetic oligonucleotide
tgaaggtggtgccatgctgggtcttgg

SEQ ID NO: 140690 - DNA, 27 bp, Artificial Sequence
  Description of Artificial Sequence: Synthetic oligonucleotide
gaaggtggtgccatgctgggtcttggt

SEQ ID NO: 140691 - DNA, 27 bp, Artificial Sequence
  Description of Artificial Sequence: Synthetic oligonucleotide
aaggtggtgccatgctgggtcttggtg

SEQ ID NO: 140692 - DNA, 26 bp, Artificial Sequence
  Description of Artificial Sequence: Synthetic oligonucleotide
aggtggtgccatgctgggtcttggtg

SEQ ID NO: 140693 - DNA, 25 bp, Artificial Sequence
  Description of Artificial Sequence: Synthetic oligonucleotide
ggtggtgccatgctgggtcttggtg

SEQ ID NO: 140694 - DNA, 25 bp, Artificial Sequence
  Description of Artificial Sequence: Synthetic oligonucleotide
gtggtgccatgctgggtcttggtgc

SEQ ID NO: 140695 - DNA, 26 bp, Artificial Sequence
  Description of Artificial Sequence: Synthetic oligonucleotide
tggtgccatgctgggtcttggtgcca

SEQ ID NO: 140696 - DNA, 25 bp, Artificial Sequence
  Description of Artificial Sequence: Synthetic oligonucleotide
ggtgccatgctgggtcttggtgcca

SEQ ID NO: 140697 - DNA, 26 bp, Artificial Sequence
  Description of Artificial Sequence: Synthetic oligonucleotide
gtgccatgctgggtcttggtgccagt

SEQ ID NO: 140698 - DNA, 27 bp, Artificial Sequence
  Description of Artificial Sequence: Synthetic oligonucleotide
tgccatgctgggtcttggtgccagtga

SEQ ID NO: 140699 - DNA, 26 bp, Artificial Sequence
  Description of Artificial Sequence: Synthetic oligonucleotide
gccatgctgggtcttggtgccagtga

SEQ ID NO: 140700 - DNA, 27 bp, Artificial Sequence
  Description of Artificial Sequence: Synthetic oligonucleotide
ccatgctgggtcttggtgccagtgact

SEQ ID NO: 140701 - DNA, 29 bp, Artificial Sequence
  Description of Artificial Sequence: Synthetic oligonucleotide
catgctgggtcttggtgccagtgactttg

SEQ ID NO: 140702 - DNA, 34 bp, Artificial Sequence
  Description of Artificial Sequence: Synthetic oligonucleotide
atgctgggtcttggtgccagtgactttgaatttg

SEQ ID NO: 140703 - DNA, 33 bp, Artificial Sequence
  Description of Artificial Sequence: Synthetic oligonucleotide
tgctgggtcttggtgccagtgactttgaatttg

SEQ ID NO: 140704 - DNA, 32 bp, Artificial Sequence
  Description of Artificial Sequence: Synthetic oligonucleotide
gctgggtcttggtgccagtgactttgaatttg

SEQ ID NO: 140705 - DNA, 32 bp, Artificial Sequence
  Description of Artificial Sequence: Synthetic oligonucleotide
ctgggtcttggtgccagtgactttgaatttgg

SEQ ID NO: 140706 - DNA, 33 bp, Artificial Sequence
  Description of Artificial Sequence: Synthetic oligonucleotide
tgggtcttggtgccagtgactttgaatttggag

SEQ ID NO: 140707 - DNA, 32 bp, Artificial Sequence
  Description of Artificial Sequence: Synthetic oligonucleotide
gggtcttggtgccagtgactttgaatttggag

SEQ ID NO: 140708 - DNA, 34 bp, Artificial Sequence
  Description of Artificial Sequence: Synthetic oligonucleotide
ggtcttggtgccagtgactttgaatttggagtag

SEQ ID NO: 140709 - DNA, 36 bp, Artificial Sequence
  Description of Artificial Sequence: Synthetic oligonucleotide
gtcttggtgccagtgactttgaatttggagtagatc

SEQ ID NO: 140710 - DNA, 36 bp, Artificial Sequence
  Description of Artificial Sequence: Synthetic oligonucleotide
tcttggtgccagtgactttgaatttggagtagatcc

SEQ ID NO: 140711 - DNA, 35 bp, Artificial Sequence
  Description of Artificial Sequence: Synthetic oligonucleotide
cttggtgccagtgactttgaatttggagtagatcc

SEQ ID NO: 140712 - DNA, 35 bp, Artificial Sequence
  Description of Artificial Sequence: Synthetic oligonucleotide
ttggtgccagtgactttgaatttggagtagatccc

SEQ ID NO: 140713 - DNA, 34 bp, Artificial Sequence
  Description of Artificial Sequence: Synthetic oligonucleotide
tggtgccagtgactttgaatttggagtagatccc

SEQ ID NO: 140714 - DNA, 33 bp, Artificial Sequence
  Description of Artificial Sequence: Synthetic oligonucleotide
ggtgccagtgactttgaatttggagtagatccc

SEQ ID NO: 140715 - DNA, 34 bp, Artificial Sequence
  Description of Artificial Sequence: Synthetic oligonucleotide
gtgccagtgactttgaatttggagtagatcccag

SEQ ID NO: 140716 - DNA, 35 bp, Artificial Sequence
  Description of Artificial Sequence: Synthetic oligonucleotide
tgccagtgactttgaatttggagtagatcccagtg

SEQ ID NO: 140717 - DNA, 34 bp, Artificial Sequence
  Description of Artificial Sequence: Synthetic oligonucleotide
gccagtgactttgaatttggagtagatcccagtg

SEQ ID NO: 140718 - DNA, 34 bp, Artificial Sequence
  Description of Artificial Sequence: Synthetic oligonucleotide
ccagtgactttgaatttggagtagatcccagtgc

SEQ ID NO: 140719 - DNA, 35 bp, Artificial Sequence
  Description of Artificial Sequence: Synthetic oligonucleotide
cagtgactttgaatttggagtagatcccagtgctg

SEQ ID NO: 140720 - DNA, 37 bp, Artificial Sequence
  Description of Artificial Sequence: Synthetic oligonucleotide
agtgactttgaatttggagtagatcccagtgctgatc

SEQ ID NO: 140721 - DNA, 36 bp, Artificial Sequence
  Description of Artificial Sequence: Synthetic oligonucleotide
gtgactttgaatttggagtagatcccagtgctgatc

SEQ ID NO: 140722 - DNA, 36 bp, Artificial Sequence
  Description of Artificial Sequence: Synthetic oligonucleotide
tgactttgaatttggagtagatcccagtgctgatcc

SEQ ID NO: 140723 - DNA, 35 bp, Artificial Sequence
  Description of Artificial Sequence: Synthetic oligonucleotide
gactttgaatttggagtagatcccagtgctgatcc

SEQ ID NO: 140724 - DNA, 36 bp, Artificial Sequence
  Description of Artificial Sequence: Synthetic oligonucleotide
actttgaatttggagtagatcccagtgctgatcctg

SEQ ID NO: 140725 - DNA, 35 bp, Artificial Sequence
  Description of Artificial Sequence: Synthetic oligonucleotide
ctttgaatttggagtagatcccagtgctgatcctg

SEQ ID NO: 140726 - DNA, 36 bp, Artificial Sequence
  Description of Artificial Sequence: Synthetic oligonucleotide
tttgaatttggagtagatcccagtgctgatcctgag

SEQ ID NO: 140727 - DNA, 35 bp, Artificial Sequence
  Description of Artificial Sequence: Synthetic oligonucleotide
ttgaatttggagtagatcccagtgctgatcctgag

SEQ ID NO: 140728 - DNA, 34 bp, Artificial Sequence
  Description of Artificial Sequence: Synthetic oligonucleotide
tgaatttggagtagatcccagtgctgatcctgag

SEQ ID NO: 140729 - DNA, 33 bp, Artificial Sequence
  Description of Artificial Sequence: Synthetic oligonucleotide
gaatttggagtagatcccagtgctgatcctgag

SEQ ID NO: 140730 - DNA, 33 bp, Artificial Sequence
  Description of Artificial Sequence: Synthetic oligonucleotide
aatttggagtagatcccagtgctgatcctgagc

SEQ ID NO: 140731 - DNA, 32 bp, Artificial Sequence
  Description of Artificial Sequence: Synthetic oligonucleotide
atttggagtagatcccagtgctgatcctgagc

SEQ ID NO: 140732 - DNA, 31 bp, Artificial Sequence
  Description of Artificial Sequence: Synthetic oligonucleotide
tttggagtagatcccagtgctgatcctgagc

SEQ ID NO: 140733 - DNA, 30 bp, Artificial Sequence
  Description of Artificial Sequence: Synthetic oligonucleotide
ttggagtagatcccagtgctgatcctgagc

SEQ ID NO: 140734 - DNA, 29 bp, Artificial Sequence
  Description of Artificial Sequence: Synthetic oligonucleotide
tggagtagatcccagtgctgatcctgagc

SEQ ID NO: 140735 - DNA, 28 bp, Artificial Sequence
  Description of Artificial Sequence: Synthetic oligonucleotide
ggagtagatcccagtgctgatcctgagc

SEQ ID NO: 140736 - DNA, 29 bp, Artificial Sequence
  Description of Artificial Sequence: Synthetic oligonucleotide
gagtagatcccagtgctgatcctgagctg

SEQ ID NO: 140737 - DNA, 29 bp, Artificial Sequence
  Description of Artificial Sequence: Synthetic oligonucleotide
agtagatcccagtgctgatcctgagctgg

SEQ ID NO: 140738 - DNA, 28 bp, Artificial Sequence
  Description of Artificial Sequence: Synthetic oligonucleotide
gtagatcccagtgctgatcctgagctgg

SEQ ID NO: 140739 - DNA, 28 bp, Artificial Sequence
  Description of Artificial Sequence: Synthetic oligonucleotide
tagatcccagtgctgatcctgagctggc

SEQ ID NO: 140740 - DNA, 27 bp, Artificial Sequence
  Description of Artificial Sequence: Synthetic oligonucleotide
agatcccagtgctgatcctgagctggc

SEQ ID NO: 140741 - DNA, 26 bp, Artificial Sequence
  Description of Artificial Sequence: Synthetic oligonucleotide
gatcccagtgctgatcctgagctggc

SEQ ID NO: 140742 - DNA, 27 bp, Artificial Sequence
  Description of Artificial Sequence: Synthetic oligonucleotide
atcccagtgctgatcctgagctggcct

SEQ ID NO: 140743 - DNA, 27 bp, Artificial Sequence
  Description of Artificial Sequence: Synthetic oligonucleotide
tcccagtgctgatcctgagctggcctt

SEQ ID NO: 140744 - DNA, 26 bp, Artificial Sequence
  Description of Artificial Sequence: Synthetic oligonucleotide
cccagtgctgatcctgagctggcctt

SEQ ID NO: 140745 - DNA, 26 bp, Artificial Sequence
  Description of Artificial Sequence: Synthetic oligonucleotide
ccagtgctgatcctgagctggccttg

SEQ ID NO: 140746 - DNA, 26 bp, Artificial Sequence
  Description of Artificial Sequence: Synthetic oligonucleotide
cagtgctgatcctgagctggccttgg

SEQ ID NO: 140747 - DNA, 26 bp, Artificial Sequence
  Description of Artificial Sequence: Synthetic oligonucleotide
agtgctgatcctgagctggccttggc

SEQ ID NO: 140748 - DNA, 25 bp, Artificial Sequence
  Description of Artificial Sequence: Synthetic oligonucleotide
gtgctgatcctgagctggccttggc

SEQ ID NO: 140749 - DNA, 25 bp, Artificial Sequence
  Description of Artificial Sequence: Synthetic oligonucleotide
tgctgatcctgagctggccttggcc

SEQ ID NO: 140750 - DNA, 24 bp, Artificial Sequence
  Description of Artificial Sequence: Synthetic oligonucleotide
gctgatcctgagctggccttggcc

SEQ ID NO: 140751 - DNA, 26 bp, Artificial Sequence
  Description of Artificial Sequence: Synthetic oligonucleotide
ctgatcctgagctggccttggccctt

SEQ ID NO: 140752 - DNA, 26 bp, Artificial Sequence
  Description of Artificial Sequence: Synthetic oligonucleotide
tgatcctgagctggccttggcccttc

SEQ ID NO: 140753 - DNA, 25 bp, Artificial Sequence
  Description of Artificial Sequence: Synthetic oligonucleotide
gatcctgagctggccttggcccttc

SEQ ID NO: 140754 - DNA, 26 bp, Artificial Sequence
  Description of Artificial Sequence: Synthetic oligonucleotide
atcctgagctggccttggcccttcgt

SEQ ID NO: 140755 - DNA, 25 bp, Artificial Sequence
  Description of Artificial Sequence: Synthetic oligonucleotide
tcctgagctggccttggcccttcgt

SEQ ID NO: 140756 - DNA, 24 bp, Artificial Sequence
  Description of Artificial Sequence: Synthetic oligonucleotide
cctgagctggccttggcccttcgt

SEQ ID NO: 140757 - DNA, 27 bp, Artificial Sequence
  Description of Artificial Sequence: Synthetic oligonucleotide
ctgagctggccttggcccttcgtgtat

SEQ ID NO: 140758 - DNA, 27 bp, Artificial Sequence
  Description of Artificial Sequence: Synthetic oligonucleotide
tgagctggccttggcccttcgtgtatc

SEQ ID NO: 140759 - DNA, 27 bp, Artificial Sequence
  Description of Artificial Sequence: Synthetic oligonucleotide
gagctggccttggcccttcgtgtatct

SEQ ID NO: 140760 - DNA, 29 bp, Artificial Sequence
  Description of Artificial Sequence: Synthetic oligonucleotide
agctggccttggcccttcgtgtatctatg

SEQ ID NO: 140761 - DNA, 28 bp, Artificial Sequence
  Description of Artificial Sequence: Synthetic oligonucleotide
gctggccttggcccttcgtgtatctatg

SEQ ID NO: 140762 - DNA, 28 bp, Artificial Sequence
  Description of Artificial Sequence: Synthetic oligonucleotide
ctggccttggcccttcgtgtatctatgg

SEQ ID NO: 140763 - DNA, 30 bp, Artificial Sequence
  Description of Artificial Sequence: Synthetic oligonucleotide
tggccttggcccttcgtgtatctatggaag

SEQ ID NO: 140764 - DNA, 29 bp, Artificial Sequence
  Description of Artificial Sequence: Synthetic oligonucleotide
ggccttggcccttcgtgtatctatggaag

SEQ ID NO: 140765 - DNA, 30 bp, Artificial Sequence
  Description of Artificial Sequence: Synthetic oligonucleotide
gccttggcccttcgtgtatctatggaagag

SEQ ID NO: 140766 - DNA, 30 bp, Artificial Sequence
  Description of Artificial Sequence: Synthetic oligonucleotide
ccttggcccttcgtgtatctatggaagagc

SEQ ID NO: 140767 - DNA, 31 bp, Artificial Sequence
  Description of Artificial Sequence: Synthetic oligonucleotide
cttggcccttcgtgtatctatggaagagcag

SEQ ID NO: 140768 - DNA, 31 bp, Artificial Sequence
  Description of Artificial Sequence: Synthetic oligonucleotide
ttggcccttcgtgtatctatggaagagcagc

SEQ ID NO: 140769 - DNA, 30 bp, Artificial Sequence
  Description of Artificial Sequence: Synthetic oligonucleotide
tggcccttcgtgtatctatggaagagcagc

SEQ ID NO: 140770 - DNA, 29 bp, Artificial Sequence
  Description of Artificial Sequence: Synthetic oligonucleotide
ggcccttcgtgtatctatggaagagcagc

SEQ ID NO: 140771 - DNA, 29 bp, Artificial Sequence
  Description of Artificial Sequence: Synthetic oligonucleotide
gcccttcgtgtatctatggaagagcagcg

SEQ ID NO: 140772 - DNA, 29 bp, Artificial Sequence
  Description of Artificial Sequence: Synthetic oligonucleotide
cccttcgtgtatctatggaagagcagcgg

SEQ ID NO: 140773 - DNA, 29 bp, Artificial Sequence
  Description of Artificial Sequence: Synthetic oligonucleotide
ccttcgtgtatctatggaagagcagcggc

SEQ ID NO: 140774 - DNA, 30 bp, Artificial Sequence
  Description of Artificial Sequence: Synthetic oligonucleotide
cttcgtgtatctatggaagagcagcggcag

SEQ ID NO: 140775 - DNA, 30 bp, Artificial Sequence
  Description of Artificial Sequence: Synthetic oligonucleotide
ttcgtgtatctatggaagagcagcggcagc

SEQ ID NO: 140776 - DNA, 29 bp, Artificial Sequence
  Description of Artificial Sequence: Synthetic oligonucleotide
tcgtgtatctatggaagagcagcggcagc

SEQ ID NO: 140777 - DNA, 28 bp, Artificial Sequence
  Description of Artificial Sequence: Synthetic oligonucleotide
cgtgtatctatggaagagcagcggcagc

SEQ ID NO: 140778 - DNA, 28 bp, Artificial Sequence
  Description of Artificial Sequence: Synthetic oligonucleotide
gtgtatctatggaagagcagcggcagcg

SEQ ID NO: 140779 - DNA, 28 bp, Artificial Sequence
  Description of Artificial Sequence: Synthetic oligonucleotide
tgtatctatggaagagcagcggcagcgg

SEQ ID NO: 140780 - DNA, 27 bp, Artificial Sequence
  Description of Artificial Sequence: Synthetic oligonucleotide
gtatctatggaagagcagcggcagcgg

SEQ ID NO: 140781 - DNA, 27 bp, Artificial Sequence
  Description of Artificial Sequence: Synthetic oligonucleotide
tatctatggaagagcagcggcagcggc

SEQ ID NO: 140782 - DNA, 27 bp, Artificial Sequence
  Description of Artificial Sequence: Synthetic oligonucleotide
atctatggaagagcagcggcagcggca

SEQ ID NO: 140783 - DNA, 26 bp, Artificial Sequence
  Description of Artificial Sequence: Synthetic oligonucleotide
tctatggaagagcagcggcagcggca

SEQ ID NO: 140784 - DNA, 25 bp, Artificial Sequence
  Description of Artificial Sequence: Synthetic oligonucleotide
ctatggaagagcagcggcagcggca

SEQ ID NO: 140785 - DNA, 25 bp, Artificial Sequence
  Description of Artificial Sequence: Synthetic oligonucleotide
tatggaagagcagcggcagcggcag

SEQ ID NO: 140786 - DNA, 24 bp, Artificial Sequence
  Description of Artificial Sequence: Synthetic oligonucleotide
atggaagagcagcggcagcggcag

SEQ ID NO: 140787 - DNA, 23 bp, Artificial Sequence
  Description of Artificial Sequence: Synthetic oligonucleotide
tggaagagcagcggcagcggcag

SEQ ID NO: 140788 - DNA, 22 bp, Artificial Sequence
  Description of Artificial Sequence: Synthetic oligonucleotide
ggaagagcagcggcagcggcag

SEQ ID NO: 140789 - DNA, 23 bp, Artificial Sequence
  Description of Artificial Sequence: Synthetic oligonucleotide
gaagagcagcggcagcggcagga

SEQ ID NO: 140790 - DNA, 23 bp, Artificial Sequence
  Description of Artificial Sequence: Synthetic oligonucleotide
aagagcagcggcagcggcaggag

SEQ ID NO: 140791 - DNA, 22 bp, Artificial Sequence
  Description of Artificial Sequence: Synthetic oligonucleotide
agagcagcggcagcggcaggag

SEQ ID NO: 140792 - DNA, 21 bp, Artificial Sequence
  Description of Artificial Sequence: Synthetic oligonucleotide
gagcagcggcagcggcaggag

SEQ ID NO: 140793 - DNA, 22 bp, Artificial Sequence
  Description of Artificial Sequence: Synthetic oligonucleotide
agcagcggcagcggcaggagga

SEQ ID NO: 140794 - DNA, 21 bp, Artificial Sequence
  Description of Artificial Sequence: Synthetic oligonucleotide
gcagcggcagcggcaggagga

SEQ ID NO: 140795 - DNA, 21 bp, Artificial Sequence
  Description of Artificial Sequence: Synthetic oligonucleotide
cagcggcagcggcaggaggag

SEQ ID NO: 140796 - DNA, 22 bp, Artificial Sequence
  Description of Artificial Sequence: Synthetic oligonucleotide
agcggcagcggcaggaggagga

SEQ ID NO: 140797 - DNA, 21 bp, Artificial Sequence
  Description of Artificial Sequence: Synthetic oligonucleotide
gcggcagcggcaggaggagga

SEQ ID NO: 140798 - DNA, 21 bp, Artificial Sequence
  Description of Artificial Sequence: Synthetic oligonucleotide
cggcagcggcaggaggaggag

SEQ ID NO: 140799 - DNA, 21 bp, Artificial Sequence
  Description of Artificial Sequence: Synthetic oligonucleotide
ggcagcggcaggaggaggagg

SEQ ID NO: 140800 - DNA, 21 bp, Artificial Sequence
  Description of Artificial Sequence: Synthetic oligonucleotide
gcagcggcaggaggaggaggc

SEQ ID NO: 140801 - DNA, 21 bp, Artificial Sequence
  Description of Artificial Sequence: Synthetic oligonucleotide
cagcggcaggaggaggaggcc

SEQ ID NO: 140802 - DNA, 21 bp, Artificial Sequence
  Description of Artificial Sequence: Synthetic oligonucleotide
agcggcaggaggaggaggccc

SEQ ID NO: 140803 - DNA, 20 bp, Artificial Sequence
  Description of Artificial Sequence: Synthetic oligonucleotide
gcggcaggaggaggaggccc

SEQ ID NO: 140804 - DNA, 20 bp, Artificial Sequence
  Description of Artificial Sequence: Synthetic oligonucleotide
cggcaggaggaggaggcccg

SEQ ID NO: 140805 - DNA, 20 bp, Artificial Sequence
  Description of Artificial Sequence: Synthetic oligonucleotide
ggcaggaggaggaggcccgg

SEQ ID NO: 140806 - DNA, 20 bp, Artificial Sequence
  Description of Artificial Sequence: Synthetic oligonucleotide
gcaggaggaggaggcccggc

SEQ ID NO: 140807 - DNA, 20 bp, Artificial Sequence
  Description of Artificial Sequence: Synthetic oligonucleotide
caggaggaggaggcccggcg

SEQ ID NO: 140808 - DNA, 20 bp, Artificial Sequence
  Description of Artificial Sequence: Synthetic oligonucleotide
aggaggaggaggcccggcgg

SEQ ID NO: 140809 - DNA, 20 bp, Artificial Sequence
  Description of Artificial Sequence: Synthetic oligonucleotide
ggaggaggaggcccggcggt

SEQ ID NO: 140810 - DNA, 20 bp, Artificial Sequence
  Description of Artificial Sequence: Synthetic oligonucleotide
gaggaggaggcccggcgggt

SEQ ID NO: 140811 - DNA, 20 bp, Artificial Sequence
  Description of Artificial Sequence: Synthetic oligonucleotide
aggaggaggcccggcgggca

SEQ ID NO: 140812 - DNA, 20 bp, Artificial Sequence
  Description of Artificial Sequence: Synthetic oligonucleotide
ggaggaggcccggcgggcat

SEQ ID NO: 140813 - DNA, 20 bp, Artificial Sequence
  Description of Artificial Sequence: Synthetic oligonucleotide
gaggaggcccggcgggcagt

SEQ ID NO: 140814 - DNA, 20 bp, Artificial Sequence
  Description of Artificial Sequence: Synthetic oligonucleotide
aggaggcccggcgggcagct

SEQ ID NO: 140815 - DNA, 20 bp, Artificial Sequence
  Description of Artificial Sequence: Synthetic oligonucleotide
ggaggcccggcgggcagctt

SEQ ID NO: 140816 - DNA, 20 bp, Artificial Sequence
  Description of Artificial Sequence: Synthetic oligonucleotide
gaggcccggcgggcagctgt

SEQ ID NO: 140817 - DNA, 20 bp, Artificial Sequence
  Description of Artificial Sequence: Synthetic oligonucleotide
aggcccggcgggcagctgca

SEQ ID NO: 140818 - DNA, 20 bp, Artificial Sequence
  Description of Artificial Sequence: Synthetic oligonucleotide
ggcccggcgggcagctgcat

SEQ ID NO: 140819 - DNA, 20 bp, Artificial Sequence
  Description of Artificial Sequence: Synthetic oligonucleotide
gcccggcgggcagctgcagt

SEQ ID NO: 140820 - DNA, 21 bp, Artificial Sequence
  Description of Artificial Sequence: Synthetic oligonucleotide
cccggcgggcagctgcagctt

SEQ ID NO: 140821 - DNA, 22 bp, Artificial Sequence
  Description of Artificial Sequence: Synthetic oligonucleotide
ccggcgggcagctgcagcttct

SEQ ID NO: 140822 - DNA, 22 bp, Artificial Sequence
  Description of Artificial Sequence: Synthetic oligonucleotide
cggcgggcagctgcagcttctg

SEQ ID NO: 140823 - DNA, 23 bp, Artificial Sequence
  Description of Artificial Sequence: Synthetic oligonucleotide
ggcgggcagctgcagcttctgct

SEQ ID NO: 140824 - DNA, 23 bp, Artificial Sequence
  Description of Artificial Sequence: Synthetic oligonucleotide
gcgggcagctgcagcttctgctg

SEQ ID NO: 140825 - DNA, 24 bp, Artificial Sequence
  Description of Artificial Sequence: Synthetic oligonucleotide
cgggcagctgcagcttctgctgct

SEQ ID NO: 140826 - DNA, 25 bp, Artificial Sequence
  Description of Artificial Sequence: Synthetic oligonucleotide
gggcagctgcagcttctgctgctga

SEQ ID NO: 140827 - DNA, 25 bp, Artificial Sequence
  Description of Artificial Sequence: Synthetic oligonucleotide
ggcagctgcagcttctgctgctgag

SEQ ID NO: 140828 - DNA, 25 bp, Artificial Sequence
  Description of Artificial Sequence: Synthetic oligonucleotide
gcagctgcagcttctgctgctgagg

SEQ ID NO: 140829 - DNA, 25 bp, Artificial Sequence
  Description of Artificial Sequence: Synthetic oligonucleotide
cagctgcagcttctgctgctgaggc

SEQ ID NO: 140830 - DNA, 25 bp, Artificial Sequence
  Description of Artificial Sequence: Synthetic oligonucleotide
agctgcagcttctgctgctgaggcc

SEQ ID NO: 140831 - DNA, 24 bp, Artificial Sequence
  Description of Artificial Sequence: Synthetic oligonucleotide
gctgcagcttctgctgctgaggcc

SEQ ID NO: 140832 - DNA, 24 bp, Artificial Sequence
  Description of Artificial Sequence: Synthetic oligonucleotide
ctgcagcttctgctgctgaggccg

SEQ ID NO: 140833 - DNA, 24 bp, Artificial Sequence
  Description of Artificial Sequence: Synthetic oligonucleotide
tgcagcttctgctgctgaggccgg

SEQ ID NO: 140834 - DNA, 23 bp, Artificial Sequence
  Description of Artificial Sequence: Synthetic oligonucleotide
gcagcttctgctgctgaggccgg

SEQ ID NO: 140835 - DNA, 26 bp, Artificial Sequence
  Description of Artificial Sequence: Synthetic oligonucleotide
cagcttctgctgctgaggccgggatt

SEQ ID NO: 140836 - DNA, 26 bp, Artificial Sequence
  Description of Artificial Sequence: Synthetic oligonucleotide
agcttctgctgctgaggccgggattg

SEQ ID NO: 140837 - DNA, 25 bp, Artificial Sequence
  Description of Artificial Sequence: Synthetic oligonucleotide
gcttctgctgctgaggccgggattg

SEQ ID NO: 140838 - DNA, 27 bp, Artificial Sequence
  Description of Artificial Sequence: Synthetic oligonucleotide
cttctgctgctgaggccgggattgcta

SEQ ID NO: 140839 - DNA, 27 bp, Artificial Sequence
  Description of Artificial Sequence: Synthetic oligonucleotide
ttctgctgctgaggccgggattgctac

SEQ ID NO: 140840 - DNA, 26 bp, Artificial Sequence
  Description of Artificial Sequence: Synthetic oligonucleotide
tctgctgctgaggccgggattgctac

SEQ ID NO: 140841 - DNA, 25 bp, Artificial Sequence
  Description of Artificial Sequence: Synthetic oligonucleotide
ctgctgctgaggccgggattgctac

SEQ ID NO: 140842 - DNA, 26 bp, Artificial Sequence
  Description of Artificial Sequence: Synthetic oligonucleotide
tgctgctgaggccgggattgctacga

SEQ ID NO: 140843 - DNA, 25 bp, Artificial Sequence
  Description of Artificial Sequence: Synthetic oligonucleotide
gctgctgaggccgggattgctacga

SEQ ID NO: 140844 - DNA, 26 bp, Artificial Sequence
  Description of Artificial Sequence: Synthetic oligonucleotide
ctgctgaggccgggattgctacgact

SEQ ID NO: 140845 - DNA, 26 bp, Artificial Sequence
  Description of Artificial Sequence: Synthetic oligonucleotide
tgctgaggccgggattgctacgactg

SEQ ID NO: 140846 - DNA, 25 bp, Artificial Sequence
  Description of Artificial Sequence: Synthetic oligonucleotide
gctgaggccgggattgctacgactg

SEQ ID NO: 140847 - DNA, 25 bp, Artificial Sequence
  Description of Artificial Sequence: Synthetic oligonucleotide
ctgaggccgggattgctacgactgg

SEQ ID NO: 140848 - DNA, 26 bp, Artificial Sequence
  Description of Artificial Sequence: Synthetic oligonucleotide
tgaggccgggattgctacgactggga

SEQ ID NO: 140849 - DNA, 25 bp, Artificial Sequence
  Description of Artificial Sequence: Synthetic oligonucleotide
gaggccgggattgctacgactggga

SEQ ID NO: 140850 - DNA, 26 bp, Artificial Sequence
  Description of Artificial Sequence: Synthetic oligonucleotide
aggccgggattgctacgactgggact

SEQ ID NO: 140851 - DNA, 25 bp, Artificial Sequence
  Description of Artificial Sequence: Synthetic oligonucleotide
ggccgggattgctacgactgggact

SEQ ID NO: 140852 - DNA, 27 bp, Artificial Sequence
  Description of Artificial Sequence: Synthetic oligonucleotide
gccgggattgctacgactgggactgaa

SEQ ID NO: 140853 - DNA, 27 bp, Artificial Sequence
  Description of Artificial Sequence: Synthetic oligonucleotide
ccgggattgctacgactgggactgaag

SEQ ID NO: 140854 - DNA, 28 bp, Artificial Sequence
  Description of Artificial Sequence: Synthetic oligonucleotide
cgggattgctacgactgggactgaagac

SEQ ID NO: 140855 - DNA, 29 bp, Artificial Sequence
  Description of Artificial Sequence: Synthetic oligonucleotide
gggattgctacgactgggactgaagactc

SEQ ID NO: 140856 - DNA, 30 bp, Artificial Sequence
  Description of Artificial Sequence: Synthetic oligonucleotide
ggattgctacgactgggactgaagactcag

SEQ ID NO: 140857 - DNA, 31 bp, Artificial Sequence
  Description of Artificial Sequence: Synthetic oligonucleotide
gattgctacgactgggactgaagactcagac

SEQ ID NO: 140858 - DNA, 31 bp, Artificial Sequence
  Description of Artificial Sequence: Synthetic oligonucleotide
attgctacgactgggactgaagactcagacg

SEQ ID NO: 140859 - DNA, 30 bp, Artificial Sequence
  Description of Artificial Sequence: Synthetic oligonucleotide
ttgctacgactgggactgaagactcagacg

SEQ ID NO: 140860 - DNA, 29 bp, Artificial Sequence
  Description of Artificial Sequence: Synthetic oligonucleotide
tgctacgactgggactgaagactcagacg

SEQ ID NO: 140861 - DNA, 28 bp, Artificial Sequence
  Description of Artificial Sequence: Synthetic oligonucleotide
gctacgactgggactgaagactcagacg

SEQ ID NO: 140862 - DNA, 30 bp, Artificial Sequence
  Description of Artificial Sequence: Synthetic oligonucleotide
ctacgactgggactgaagactcagacgatg

SEQ ID NO: 140863 - DNA, 30 bp, Artificial Sequence
  Description of Artificial Sequence: Synthetic oligonucleotide
tacgactgggactgaagactcagacgatgc

SEQ ID NO: 140864 - DNA, 29 bp, Artificial Sequence
  Description of Artificial Sequence: Synthetic oligonucleotide
acgactgggactgaagactcagacgatgc

SEQ ID NO: 140865 - DNA, 28 bp, Artificial Sequence
  Description of Artificial Sequence: Synthetic oligonucleotide
cgactgggactgaagactcagacgatgc

SEQ ID NO: 140866 - DNA, 28 bp, Artificial Sequence
  Description of Artificial Sequence: Synthetic oligonucleotide
gactgggactgaagactcagacgatgcc

SEQ ID NO: 140867 - DNA, 28 bp, Artificial Sequence
  Description of Artificial Sequence: Synthetic oligonucleotide
actgggactgaagactcagacgatgccc

SEQ ID NO: 140868 - DNA, 27 bp, Artificial Sequence
  Description of Artificial Sequence: Synthetic oligonucleotide
ctgggactgaagactcagacgatgccc

SEQ ID NO: 140869 - DNA, 28 bp, Artificial Sequence
  Description of Artificial Sequence: Synthetic oligonucleotide
tgggactgaagactcagacgatgccctg

SEQ ID NO: 140870 - DNA, 27 bp, Artificial Sequence
  Description of Artificial Sequence: Synthetic oligonucleotide
gggactgaagactcagacgatgccctg

SEQ ID NO: 140871 - DNA, 27 bp, Artificial Sequence
  Description of Artificial Sequence: Synthetic oligonucleotide
ggactgaagactcagacgatgccctgc

SEQ ID NO: 140872 - DNA, 28 bp, Artificial Sequence
  Description of Artificial Sequence: Synthetic oligonucleotide
gactgaagactcagacgatgccctgctg

SEQ ID NO: 140873 - DNA, 30 bp, Artificial Sequence
  Description of Artificial Sequence: Synthetic oligonucleotide
actgaagactcagacgatgccctgctgaag

SEQ ID NO: 140874 - DNA, 29 bp, Artificial Sequence
  Description of Artificial Sequence: Synthetic oligonucleotide
ctgaagactcagacgatgccctgctgaag

SEQ ID NO: 140875 - DNA, 31 bp, Artificial Sequence
  Description of Artificial Sequence: Synthetic oligonucleotide
tgaagactcagacgatgccctgctgaagatg

SEQ ID NO: 140876 - DNA, 30 bp, Artificial Sequence
  Description of Artificial Sequence: Synthetic oligonucleotide
gaagactcagacgatgccctgctgaagatg

SEQ ID NO: 140877 - DNA, 31 bp, Artificial Sequence
  Description of Artificial Sequence: Synthetic oligonucleotide
aagactcagacgatgccctgctgaagatgac

SEQ ID NO: 140878 - DNA, 30 bp, Artificial Sequence
  Description of Artificial Sequence: Synthetic oligonucleotide
agactcagacgatgccctgctgaagatgac

SEQ ID NO: 140879 - DNA, 29 bp, Artificial Sequence
  Description of Artificial Sequence: Synthetic oligonucleotide
gactcagacgatgccctgctgaagatgac

SEQ ID NO: 140880 - DNA, 29 bp, Artificial Sequence
  Description of Artificial Sequence: Synthetic oligonucleotide
actcagacgatgccctgctgaagatgacc

SEQ ID NO: 140881 - DNA, 28 bp, Artificial Sequence
  Description of Artificial Sequence: Synthetic oligonucleotide
ctcagacgatgccctgctgaagatgacc

SEQ ID NO: 140882 - DNA, 30 bp, Artificial Sequence
  Description of Artificial Sequence: Synthetic oligonucleotide
tcagacgatgccctgctgaagatgaccatc

SEQ ID NO: 140883 - DNA, 29 bp, Artificial Sequence
  Description of Artificial Sequence: Synthetic oligonucleotide
cagacgatgccctgctgaagatgaccatc

SEQ ID NO: 140884 - DNA, 30 bp, Artificial Sequence
  Description of Artificial Sequence: Synthetic oligonucleotide
agacgatgccctgctgaagatgaccatcag

SEQ ID NO: 140885 - DNA, 29 bp, Artificial Sequence
  Description of Artificial Sequence: Synthetic oligonucleotide
gacgatgccctgctgaagatgaccatcag

SEQ ID NO: 140886 - DNA, 29 bp, Artificial Sequence
  Description of Artificial Sequence: Synthetic oligonucleotide
acgatgccctgctgaagatgaccatcagc

SEQ ID NO: 140887 - DNA, 28 bp, Artificial Sequence
  Description of Artificial Sequence: Synthetic oligonucleotide
cgatgccctgctgaagatgaccatcagc

SEQ ID NO: 140888 - DNA, 28 bp, Artificial Sequence
  Description of Artificial Sequence: Synthetic oligonucleotide
gatgccctgctgaagatgaccatcagcc

SEQ ID NO: 140889 - DNA, 29 bp, Artificial Sequence
  Description of Artificial Sequence: Synthetic oligonucleotide
atgccctgctgaagatgaccatcagccag

SEQ ID NO: 140890 - DNA, 28 bp, Artificial Sequence
  Description of Artificial Sequence: Synthetic oligonucleotide
tgccctgctgaagatgaccatcagccag

SEQ ID NO: 140891 - DNA, 27 bp, Artificial Sequence
  Description of Artificial Sequence: Synthetic oligonucleotide
gccctgctgaagatgaccatcagccag

SEQ ID NO: 140892 - DNA, 27 bp, Artificial Sequence
  Description of Artificial Sequence: Synthetic oligonucleotide
ccctgctgaagatgaccatcagccagc

SEQ ID NO: 140893 - DNA, 29 bp, Artificial Sequence
  Description of Artificial Sequence: Synthetic oligonucleotide
cctgctgaagatgaccatcagccagcaag

SEQ ID NO: 140894 - DNA, 30 bp, Artificial Sequence
  Description of Artificial Sequence: Synthetic oligonucleotide
ctgctgaagatgaccatcagccagcaagag

SEQ ID NO: 140895 - DNA, 33 bp, Artificial Sequence
  Description of Artificial Sequence: Synthetic oligonucleotide
tgctgaagatgaccatcagccagcaagagtttg

SEQ ID NO: 140896 - DNA, 32 bp, Artificial Sequence
  Description of Artificial Sequence: Synthetic oligonucleotide
gctgaagatgaccatcagccagcaagagtttg

SEQ ID NO: 140897 - DNA, 32 bp, Artificial Sequence
  Description of Artificial Sequence: Synthetic oligonucleotide
ctgaagatgaccatcagccagcaagagtttgg

SEQ ID NO: 140898 - DNA, 32 bp, Artificial Sequence
  Description of Artificial Sequence: Synthetic oligonucleotide
tgaagatgaccatcagccagcaagagtttggc

SEQ ID NO: 140899 - DNA, 31 bp, Artificial Sequence
  Description of Artificial Sequence: Synthetic oligonucleotide
gaagatgaccatcagccagcaagagtttggc

SEQ ID NO: 140900 - DNA, 31 bp, Artificial Sequence
  Description of Artificial Sequence: Synthetic oligonucleotide
aagatgaccatcagccagcaagagtttggcc

SEQ ID NO: 140901 - DNA, 30 bp, Artificial Sequence
  Description of Artificial Sequence: Synthetic oligonucleotide
agatgaccatcagccagcaagagtttggcc

SEQ ID NO: 140902 - DNA, 29 bp, Artificial Sequence
  Description of Artificial Sequence: Synthetic oligonucleotide
gatgaccatcagccagcaagagtttggcc

SEQ ID NO: 140903 - DNA, 29 bp, Artificial Sequence
  Description of Artificial Sequence: Synthetic oligonucleotide
atgaccatcagccagcaagagtttggccg

SEQ ID NO: 140904 - DNA, 28 bp, Artificial Sequence
  Description of Artificial Sequence: Synthetic oligonucleotide
tgaccatcagccagcaagagtttggccg

SEQ ID NO: 140905 - DNA, 27 bp, Artificial Sequence
  Description of Artificial Sequence: Synthetic oligonucleotide
gaccatcagccagcaagagtttggccg

SEQ ID NO: 140906 - DNA, 27 bp, Artificial Sequence
  Description of Artificial Sequence: Synthetic oligonucleotide
accatcagccagcaagagtttggccgc

SEQ ID NO: 140907 - DNA, 27 bp, Artificial Sequence
  Description of Artificial Sequence: Synthetic oligonucleotide
ccatcagccagcaagagtttggccgca

SEQ ID NO: 140908 - DNA, 27 bp, Artificial Sequence
  Description of Artificial Sequence: Synthetic oligonucleotide
catcagccagcaagagtttggccgcac

SEQ ID NO: 140909 - DNA, 28 bp, Artificial Sequence
  Description of Artificial Sequence: Synthetic oligonucleotide
atcagccagcaagagtttggccgcactg

SEQ ID NO: 140910 - DNA, 27 bp, Artificial Sequence
  Description of Artificial Sequence: Synthetic oligonucleotide
tcagccagcaagagtttggccgcactg

SEQ ID NO: 140911 - DNA, 26 bp, Artificial Sequence
  Description of Artificial Sequence: Synthetic oligonucleotide
cagccagcaagagtttggccgcactg

SEQ ID NO: 140912 - DNA, 26 bp, Artificial Sequence
  Description of Artificial Sequence: Synthetic oligonucleotide
agccagcaagagtttggccgcactgg

SEQ ID NO: 140913 - DNA, 25 bp, Artificial Sequence
  Description of Artificial Sequence: Synthetic oligonucleotide
gccagcaagagtttggccgcactgg

SEQ ID NO: 140914 - DNA, 25 bp, Artificial Sequence
  Description of Artificial Sequence: Synthetic oligonucleotide
ccagcaagagtttggccgcactggg

SEQ ID NO: 140915 - DNA, 27 bp, Artificial Sequence
  Description of Artificial Sequence: Synthetic oligonucleotide
cagcaagagtttggccgcactgggctt

SEQ ID NO: 140916 - DNA, 27 bp, Artificial Sequence
  Description of Artificial Sequence: Synthetic oligonucleotide
agcaagagtttggccgcactgggcttc

SEQ ID NO: 140917 - DNA, 26 bp, Artificial Sequence
  Description of Artificial Sequence: Synthetic oligonucleotide
gcaagagtttggccgcactgggcttc

SEQ ID NO: 140918 - DNA, 27 bp, Artificial Sequence
  Description of Artificial Sequence: Synthetic oligonucleotide
caagagtttggccgcactgggcttcct

SEQ ID NO: 140919 - DNA, 27 bp, Artificial Sequence
  Description of Artificial Sequence: Synthetic oligonucleotide
aagagtttggccgcactgggcttcctg

SEQ ID NO: 140920 - DNA, 27 bp, Artificial Sequence
  Description of Artificial Sequence: Synthetic oligonucleotide
agagtttggccgcactgggcttcctga

SEQ ID NO: 140921 - DNA, 26 bp, Artificial Sequence
  Description of Artificial Sequence: Synthetic oligonucleotide
gagtttggccgcactgggcttcctga

SEQ ID NO: 140922 - DNA, 26 bp, Artificial Sequence
  Description of Artificial Sequence: Synthetic oligonucleotide
agtttggccgcactgggcttcctgac

SEQ ID NO: 140923 - DNA, 25 bp, Artificial Sequence
  Description of Artificial Sequence: Synthetic oligonucleotide
gtttggccgcactgggcttcctgac

SEQ ID NO: 140924 - DNA, 27 bp, Artificial Sequence
  Description of Artificial Sequence: Synthetic oligonucleotide
tttggccgcactgggcttcctgaccta

SEQ ID NO: 140925 - DNA, 27 bp, Artificial Sequence
  Description of Artificial Sequence: Synthetic oligonucleotide
ttggccgcactgggcttcctgacctaa

SEQ ID NO: 140926 - DNA, 26 bp, Artificial Sequence
  Description of Artificial Sequence: Synthetic oligonucleotide
tggccgcactgggcttcctgacctaa

SEQ ID NO: 140927 - DNA, 25 bp, Artificial Sequence
  Description of Artificial Sequence: Synthetic oligonucleotide
ggccgcactgggcttcctgacctaa

SEQ ID NO: 140928 - DNA, 25 bp, Artificial Sequence
  Description of Artificial Sequence: Synthetic oligonucleotide
gccgcactgggcttcctgacctaag

SEQ ID NO: 140929 - DNA, 26 bp, Artificial Sequence
  Description of Artificial Sequence: Synthetic oligonucleotide
ccgcactgggcttcctgacctaagca

SEQ ID NO: 140930 - DNA, 27 bp, Artificial Sequence
  Description of Artificial Sequence: Synthetic oligonucleotide
cgcactgggcttcctgacctaagcagt

SEQ ID NO: 140931 - DNA, 29 bp, Artificial Sequence
  Description of Artificial Sequence: Synthetic oligonucleotide
gcactgggcttcctgacctaagcagtatg

SEQ ID NO: 140932 - DNA, 30 bp, Artificial Sequence
  Description of Artificial Sequence: Synthetic oligonucleotide
cactgggcttcctgacctaagcagtatgac

SEQ ID NO: 140933 - DNA, 31 bp, Artificial Sequence
  Description of Artificial Sequence: Synthetic oligonucleotide
actgggcttcctgacctaagcagtatgactg

SEQ ID NO: 140934 - DNA, 30 bp, Artificial Sequence
  Description of Artificial Sequence: Synthetic oligonucleotide
ctgggcttcctgacctaagcagtatgactg

SEQ ID NO: 140935 - DNA, 31 bp, Artificial Sequence
  Description of Artificial Sequence: Synthetic oligonucleotide
tgggcttcctgacctaagcagtatgactgag

SEQ ID NO: 140936 - DNA, 30 bp, Artificial Sequence
  Description of Artificial Sequence: Synthetic oligonucleotide
gggcttcctgacctaagcagtatgactgag

SEQ ID NO: 140937 - DNA, 30 bp, Artificial Sequence
  Description of Artificial Sequence: Synthetic oligonucleotide
ggcttcctgacctaagcagtatgactgagg

SEQ ID NO: 140938 - DNA, 32 bp, Artificial Sequence
  Description of Artificial Sequence: Synthetic oligonucleotide
gcttcctgacctaagcagtatgactgaggaag

SEQ ID NO: 140939 - DNA, 33 bp, Artificial Sequence
  Description of Artificial Sequence: Synthetic oligonucleotide
cttcctgacctaagcagtatgactgaggaagag

SEQ ID NO: 140940 - DNA, 33 bp, Artificial Sequence
  Description of Artificial Sequence: Synthetic oligonucleotide
ttcctgacctaagcagtatgactgaggaagagc

SEQ ID NO: 140941 - DNA, 32 bp, Artificial Sequence
  Description of Artificial Sequence: Synthetic oligonucleotide
tcctgacctaagcagtatgactgaggaagagc

SEQ ID NO: 140942 - DNA, 31 bp, Artificial Sequence
  Description of Artificial Sequence: Synthetic oligonucleotide
cctgacctaagcagtatgactgaggaagagc

SEQ ID NO: 140943 - DNA, 32 bp, Artificial Sequence
  Description of Artificial Sequence: Synthetic oligonucleotide
ctgacctaagcagtatgactgaggaagagcag

SEQ ID NO: 140944 - DNA, 35 bp, Artificial Sequence
  Description of Artificial Sequence: Synthetic oligonucleotide
tgacctaagcagtatgactgaggaagagcagattg

SEQ ID NO: 140945 - DNA, 34 bp, Artificial Sequence
  Description of Artificial Sequence: Synthetic oligonucleotide
gacctaagcagtatgactgaggaagagcagattg

SEQ ID NO: 140946 - DNA, 34 bp, Artificial Sequence
  Description of Artificial Sequence: Synthetic oligonucleotide
acctaagcagtatgactgaggaagagcagattgc

SEQ ID NO: 140947 - DNA, 33 bp, Artificial Sequence
  Description of Artificial Sequence: Synthetic oligonucleotide
cctaagcagtatgactgaggaagagcagattgc

SEQ ID NO: 140948 - DNA, 37 bp, Artificial Sequence
  Description of Artificial Sequence: Synthetic oligonucleotide
ctaagcagtatgactgaggaagagcagattgcttatg

SEQ ID NO: 140949 - DNA, 37 bp, Artificial Sequence
  Description of Artificial Sequence: Synthetic oligonucleotide
taagcagtatgactgaggaagagcagattgcttatgc

SEQ ID NO: 140950 - DNA, 36 bp, Artificial Sequence
  Description of Artificial Sequence: Synthetic oligonucleotide
aagcagtatgactgaggaagagcagattgcttatgc

SEQ ID NO: 140951 - DNA, 35 bp, Artificial Sequence
  Description of Artificial Sequence: Synthetic oligonucleotide
agcagtatgactgaggaagagcagattgcttatgc

SEQ ID NO: 140952 - DNA, 34 bp, Artificial Sequence
  Description of Artificial Sequence: Synthetic oligonucleotide
gcagtatgactgaggaagagcagattgcttatgc

SEQ ID NO: 140953 - DNA, 34 bp, Artificial Sequence
  Description of Artificial Sequence: Synthetic oligonucleotide
cagtatgactgaggaagagcagattgcttatgcc

SEQ ID NO: 140954 - DNA, 36 bp, Artificial Sequence
  Description of Artificial Sequence: Synthetic oligonucleotide
agtatgactgaggaagagcagattgcttatgccatg

SEQ ID NO: 140955 - DNA, 35 bp, Artificial Sequence
  Description of Artificial Sequence: Synthetic oligonucleotide
gtatgactgaggaagagcagattgcttatgccatg

SEQ ID NO: 140956 - DNA, 35 bp, Artificial Sequence
  Description of Artificial Sequence: Synthetic oligonucleotide
tatgactgaggaagagcagattgcttatgccatgc

SEQ ID NO: 140957 - DNA, 34 bp, Artificial Sequence
  Description of Artificial Sequence: Synthetic oligonucleotide
atgactgaggaagagcagattgcttatgccatgc

SEQ ID NO: 140958 - DNA, 33 bp, Artificial Sequence
  Description of Artificial Sequence: Synthetic oligonucleotide
tgactgaggaagagcagattgcttatgccatgc

SEQ ID NO: 140959 - DNA, 32 bp, Artificial Sequence
  Description of Artificial Sequence: Synthetic oligonucleotide
gactgaggaagagcagattgcttatgccatgc

SEQ ID NO: 140960 - DNA, 33 bp, Artificial Sequence
  Description of Artificial Sequence: Synthetic oligonucleotide
actgaggaagagcagattgcttatgccatgcag

SEQ ID NO: 140961 - DNA, 32 bp, Artificial Sequence
  Description of Artificial Sequence: Synthetic oligonucleotide
ctgaggaagagcagattgcttatgccatgcag

SEQ ID NO: 140962 - DNA, 34 bp, Artificial Sequence
  Description of Artificial Sequence: Synthetic oligonucleotide
tgaggaagagcagattgcttatgccatgcagatg

SEQ ID NO: 140963 - DNA, 33 bp, Artificial Sequence
  Description of Artificial Sequence: Synthetic oligonucleotide
gaggaagagcagattgcttatgccatgcagatg

SEQ ID NO: 140964 - DNA, 34 bp, Artificial Sequence
  Description of Artificial Sequence: Synthetic oligonucleotide
aggaagagcagattgcttatgccatgcagatgtc

SEQ ID NO: 140965 - DNA, 33 bp, Artificial Sequence
  Description of Artificial Sequence: Synthetic oligonucleotide
ggaagagcagattgcttatgccatgcagatgtc

SEQ ID NO: 140966 - DNA, 33 bp, Artificial Sequence
  Description of Artificial Sequence: Synthetic oligonucleotide
gaagagcagattgcttatgccatgcagatgtcc

SEQ ID NO: 140967 - DNA, 33 bp, Artificial Sequence
  Description of Artificial Sequence: Synthetic oligonucleotide
aagagcagattgcttatgccatgcagatgtccc

SEQ ID NO: 140968 - DNA, 32 bp, Artificial Sequence
  Description of Artificial Sequence: Synthetic oligonucleotide
agagcagattgcttatgccatgcagatgtccc

SEQ ID NO: 140969 - DNA, 31 bp, Artificial Sequence
  Description of Artificial Sequence: Synthetic oligonucleotide
gagcagattgcttatgccatgcagatgtccc

SEQ ID NO: 140970 - DNA, 32 bp, Artificial Sequence
  Description of Artificial Sequence: Synthetic oligonucleotide
agcagattgcttatgccatgcagatgtccctg

SEQ ID NO: 140971 - DNA, 31 bp, Artificial Sequence
  Description of Artificial Sequence: Synthetic oligonucleotide
gcagattgcttatgccatgcagatgtccctg

SEQ ID NO: 140972 - DNA, 31 bp, Artificial Sequence
  Description of Artificial Sequence: Synthetic oligonucleotide
cagattgcttatgccatgcagatgtccctgc

SEQ ID NO: 140973 - DNA, 32 bp, Artificial Sequence
  Description of Artificial Sequence: Synthetic oligonucleotide
agattgcttatgccatgcagatgtccctgcag

SEQ ID NO: 140974 - DNA, 31 bp, Artificial Sequence
  Description of Artificial Sequence: Synthetic oligonucleotide
gattgcttatgccatgcagatgtccctgcag

SEQ ID NO: 140975 - DNA, 31 bp, Artificial Sequence
  Description of Artificial Sequence: Synthetic oligonucleotide
attgcttatgccatgcagatgtccctgcagg

SEQ ID NO: 140976 - DNA, 30 bp, Artificial Sequence
  Description of Artificial Sequence: Synthetic oligonucleotide
ttgcttatgccatgcagatgtccctgcagg

SEQ ID NO: 140977 - DNA, 29 bp, Artificial Sequence
  Description of Artificial Sequence: Synthetic oligonucleotide
tgcttatgccatgcagatgtccctgcagg

SEQ ID NO: 140978 - DNA, 28 bp, Artificial Sequence
  Description of Artificial Sequence: Synthetic oligonucleotide
gcttatgccatgcagatgtccctgcagg

SEQ ID NO: 140979 - DNA, 28 bp, Artificial Sequence
  Description of Artificial Sequence: Synthetic oligonucleotide
cttatgccatgcagatgtccctgcaggg

SEQ ID NO: 140980 - DNA, 29 bp, Artificial Sequence
  Description of Artificial Sequence: Synthetic oligonucleotide
ttatgccatgcagatgtccctgcagggag

SEQ ID NO: 140981 - DNA, 28 bp, Artificial Sequence
  Description of Artificial Sequence: Synthetic oligonucleotide
tatgccatgcagatgtccctgcagggag

SEQ ID NO: 140982 - DNA, 27 bp, Artificial Sequence
  Description of Artificial Sequence: Synthetic oligonucleotide
atgccatgcagatgtccctgcagggag

SEQ ID NO: 140983 - DNA, 26 bp, Artificial Sequence
  Description of Artificial Sequence: Synthetic oligonucleotide
tgccatgcagatgtccctgcagggag

SEQ ID NO: 140984 - DNA, 25 bp, Artificial Sequence
  Description of Artificial Sequence: Synthetic oligonucleotide
gccatgcagatgtccctgcagggag

SEQ ID NO: 140985 - DNA, 26 bp, Artificial Sequence
  Description of Artificial Sequence: Synthetic oligonucleotide
ccatgcagatgtccctgcagggagca

SEQ ID NO: 140986 - DNA, 27 bp, Artificial Sequence
  Description of Artificial Sequence: Synthetic oligonucleotide
catgcagatgtccctgcagggagcaga

SEQ ID NO: 140987 - DNA, 27 bp, Artificial Sequence
  Description of Artificial Sequence: Synthetic oligonucleotide
atgcagatgtccctgcagggagcagag

SEQ ID NO: 140988 - DNA, 27 bp, Artificial Sequence
  Description of Artificial Sequence: Synthetic oligonucleotide
tgcagatgtccctgcagggagcagagt

SEQ ID NO: 140989 - DNA, 27 bp, Artificial Sequence
  Description of Artificial Sequence: Synthetic oligonucleotide
gcagatgtccctgcagggagcagagtt

SEQ ID NO: 140990 - DNA, 28 bp, Artificial Sequence
  Description of Artificial Sequence: Synthetic oligonucleotide
cagatgtccctgcagggagcagagtttg

SEQ ID NO: 140991 - DNA, 28 bp, Artificial Sequence
  Description of Artificial Sequence: Synthetic oligonucleotide
agatgtccctgcagggagcagagtttgg

SEQ ID NO: 140992 - DNA, 27 bp, Artificial Sequence
  Description of Artificial Sequence: Synthetic oligonucleotide
gatgtccctgcagggagcagagtttgg

SEQ ID NO: 140993 - DNA, 27 bp, Artificial Sequence
  Description of Artificial Sequence: Synthetic oligonucleotide
atgtccctgcagggagcagagtttggc

SEQ ID NO: 140994 - DNA, 26 bp, Artificial Sequence
  Description of Artificial Sequence: Synthetic oligonucleotide
tgtccctgcagggagcagagtttggc

SEQ ID NO: 140995 - DNA, 25 bp, Artificial Sequence
  Description of Artificial Sequence: Synthetic oligonucleotide
gtccctgcagggagcagagtttggc

SEQ ID NO: 140996 - DNA, 26 bp, Artificial Sequence
  Description of Artificial Sequence: Synthetic oligonucleotide
tccctgcagggagcagagtttggcca

SEQ ID NO: 140997 - DNA, 25 bp, Artificial Sequence
  Description of Artificial Sequence: Synthetic oligonucleotide
ccctgcagggagcagagtttggcca

SEQ ID NO: 140998 - DNA, 25 bp, Artificial Sequence
  Description of Artificial Sequence: Synthetic oligonucleotide
cctgcagggagcagagtttggccag

SEQ ID NO: 140999 - DNA, 25 bp, Artificial Sequence
  Description of Artificial Sequence: Synthetic oligonucleotide
ctgcagggagcagagtttggccagg

SEQ ID NO: 141000 - DNA, 25 bp, Artificial Sequence
  Description of Artificial Sequence: Synthetic oligonucleotide
tgcagggagcagagtttggccaggc

SEQ ID NO: 141001 - DNA, 24 bp, Artificial Sequence
  Description of Artificial Sequence: Synthetic oligonucleotide
gcagggagcagagtttggccaggc

SEQ ID NO: 141002 - DNA, 24 bp, Artificial Sequence
  Description of Artificial Sequence: Synthetic oligonucleotide
cagggagcagagtttggccaggcg

SEQ ID NO: 141003 - DNA, 27 bp, Artificial Sequence
  Description of Artificial Sequence: Synthetic oligonucleotide
agggagcagagtttggccaggcggaat

SEQ ID NO: 141004 - DNA, 26 bp, Artificial Sequence
  Description of Artificial Sequence: Synthetic oligonucleotide
gggagcagagtttggccaggcggaat

SEQ ID NO: 141005 - DNA, 27 bp, Artificial Sequence
  Description of Artificial Sequence: Synthetic oligonucleotide
ggagcagagtttggccaggcggaatca

SEQ ID NO: 141006 - DNA, 27 bp, Artificial Sequence
  Description of Artificial Sequence: Synthetic oligonucleotide
gagcagagtttggccaggcggaatcag

SEQ ID NO: 141007 - DNA, 27 bp, Artificial Sequence
  Description of Artificial Sequence: Synthetic oligonucleotide
agcagagtttggccaggcggaatcagc

SEQ ID NO: 141008 - DNA, 27 bp, Artificial Sequence
  Description of Artificial Sequence: Synthetic oligonucleotide
gcagagtttggccaggcggaatcagca

SEQ ID NO: 141009 - DNA, 27 bp, Artificial Sequence
  Description of Artificial Sequence: Synthetic oligonucleotide
cagagtttggccaggcggaatcagcag

SEQ ID NO: 141010 - DNA, 28 bp, Artificial Sequence
  Description of Artificial Sequence: Synthetic oligonucleotide
agagtttggccaggcggaatcagcagac

SEQ ID NO: 141011 - DNA, 27 bp, Artificial Sequence
  Description of Artificial Sequence: Synthetic oligonucleotide
gagtttggccaggcggaatcagcagac

SEQ ID NO: 141012 - DNA, 30 bp, Artificial Sequence
  Description of Artificial Sequence: Synthetic oligonucleotide
agtttggccaggcggaatcagcagacattg

SEQ ID NO: 141013 - DNA, 29 bp, Artificial Sequence
  Description of Artificial Sequence: Synthetic oligonucleotide
gtttggccaggcggaatcagcagacattg

SEQ ID NO: 141014 - DNA, 31 bp, Artificial Sequence
  Description of Artificial Sequence: Synthetic oligonucleotide
tttggccaggcggaatcagcagacattgatg

SEQ ID NO: 141015 - DNA, 30 bp, Artificial Sequence
  Description of Artificial Sequence: Synthetic oligonucleotide
ttggccaggcggaatcagcagacattgatg

SEQ ID NO: 141016 - DNA, 29 bp, Artificial Sequence
  Description of Artificial Sequence: Synthetic oligonucleotide
tggccaggcggaatcagcagacattgatg

SEQ ID NO: 141017 - DNA, 28 bp, Artificial Sequence
  Description of Artificial Sequence: Synthetic oligonucleotide
ggccaggcggaatcagcagacattgatg

SEQ ID NO: 141018 - DNA, 28 bp, Artificial Sequence
  Description of Artificial Sequence: Synthetic oligonucleotide
gccaggcggaatcagcagacattgatgc

SEQ ID NO: 141019 - DNA, 28 bp, Artificial Sequence
  Description of Artificial Sequence: Synthetic oligonucleotide
ccaggcggaatcagcagacattgatgcc

SEQ ID NO: 141020 - DNA, 29 bp, Artificial Sequence
  Description of Artificial Sequence: Synthetic oligonucleotide
caggcggaatcagcagacattgatgccag

SEQ ID NO: 141021 - DNA, 29 bp, Artificial Sequence
  Description of Artificial Sequence: Synthetic oligonucleotide
aggcggaatcagcagacattgatgccagc

SEQ ID NO: 141022 - DNA, 28 bp, Artificial Sequence
  Description of Artificial Sequence: Synthetic oligonucleotide
ggcggaatcagcagacattgatgccagc

SEQ ID NO: 141023 - DNA, 29 bp, Artificial Sequence
  Description of Artificial Sequence: Synthetic oligonucleotide
gcggaatcagcagacattgatgccagctc

SEQ ID NO: 141024 - DNA, 30 bp, Artificial Sequence
  Description of Artificial Sequence: Synthetic oligonucleotide
cggaatcagcagacattgatgccagctcag

SEQ ID NO: 141025 - DNA, 30 bp, Artificial Sequence
  Description of Artificial Sequence: Synthetic oligonucleotide
ggaatcagcagacattgatgccagctcagc

SEQ ID NO: 141026 - DNA, 33 bp, Artificial Sequence
  Description of Artificial Sequence: Synthetic oligonucleotide
gaatcagcagacattgatgccagctcagctatg

SEQ ID NO: 141027 - DNA, 33 bp, Artificial Sequence
  Description of Artificial Sequence: Synthetic oligonucleotide
aatcagcagacattgatgccagctcagctatgg

SEQ ID NO: 141028 - DNA, 32 bp, Artificial Sequence
  Description of Artificial Sequence: Synthetic oligonucleotide
atcagcagacattgatgccagctcagctatgg

SEQ ID NO: 141029 - DNA, 31 bp, Artificial Sequence
  Description of Artificial Sequence: Synthetic oligonucleotide
tcagcagacattgatgccagctcagctatgg

SEQ ID NO: 141030 - DNA, 30 bp, Artificial Sequence
  Description of Artificial Sequence: Synthetic oligonucleotide
cagcagacattgatgccagctcagctatgg

SEQ ID NO: 141031 - DNA, 31 bp, Artificial Sequence
  Description of Artificial Sequence: Synthetic oligonucleotide
agcagacattgatgccagctcagctatggac

SEQ ID NO: 141032 - DNA, 30 bp, Artificial Sequence
  Description of Artificial Sequence: Synthetic oligonucleotide
gcagacattgatgccagctcagctatggac

SEQ ID NO: 141033 - DNA, 31 bp, Artificial Sequence
  Description of Artificial Sequence: Synthetic oligonucleotide
cagacattgatgccagctcagctatggacac

SEQ ID NO: 141034 - DNA, 33 bp, Artificial Sequence
  Description of Artificial Sequence: Synthetic oligonucleotide
agacattgatgccagctcagctatggacacatc

SEQ ID NO: 141035 - DNA, 32 bp, Artificial Sequence
  Description of Artificial Sequence: Synthetic oligonucleotide
gacattgatgccagctcagctatggacacatc

SEQ ID NO: 141036 - DNA, 33 bp, Artificial Sequence
  Description of Artificial Sequence: Synthetic oligonucleotide
acattgatgccagctcagctatggacacatctg

SEQ ID NO: 141037 - DNA, 32 bp, Artificial Sequence
  Description of Artificial Sequence: Synthetic oligonucleotide
cattgatgccagctcagctatggacacatctg

SEQ ID NO: 141038 - DNA, 33 bp, Artificial Sequence
  Description of Artificial Sequence: Synthetic oligonucleotide
attgatgccagctcagctatggacacatctgag

SEQ ID NO: 141039 - DNA, 32 bp, Artificial Sequence
  Description of Artificial Sequence: Synthetic oligonucleotide
ttgatgccagctcagctatggacacatctgag

SEQ ID NO: 141040 - DNA, 31 bp, Artificial Sequence
  Description of Artificial Sequence: Synthetic oligonucleotide
tgatgccagctcagctatggacacatctgag

SEQ ID NO: 141041 - DNA, 30 bp, Artificial Sequence
  Description of Artificial Sequence: Synthetic oligonucleotide
gatgccagctcagctatggacacatctgag

SEQ ID NO: 141042 - DNA, 30 bp, Artificial Sequence
  Description of Artificial Sequence: Synthetic oligonucleotide
atgccagctcagctatggacacatctgagc

SEQ ID NO: 141043 - DNA, 29 bp, Artificial Sequence
  Description of Artificial Sequence: Synthetic oligonucleotide
tgccagctcagctatggacacatctgagc

SEQ ID NO: 141044 - DNA, 28 bp, Artificial Sequence
  Description of Artificial Sequence: Synthetic oligonucleotide
gccagctcagctatggacacatctgagc

SEQ ID NO: 141045 - DNA, 28 bp, Artificial Sequence
  Description of Artificial Sequence: Synthetic oligonucleotide
ccagctcagctatggacacatctgagcc

SEQ ID NO: 141046 - DNA, 29 bp, Artificial Sequence
  Description of Artificial Sequence: Synthetic oligonucleotide
cagctcagctatggacacatctgagccag

SEQ ID NO: 141047 - DNA, 29 bp, Artificial Sequence
  Description of Artificial Sequence: Synthetic oligonucleotide
agctcagctatggacacatctgagccagc

SEQ ID NO: 141048 - DNA, 28 bp, Artificial Sequence
  Description of Artificial Sequence: Synthetic oligonucleotide
gctcagctatggacacatctgagccagc

SEQ ID NO: 141049 - DNA, 28 bp, Artificial Sequence
  Description of Artificial Sequence: Synthetic oligonucleotide
ctcagctatggacacatctgagccagcc

SEQ ID NO: 141050 - DNA, 30 bp, Artificial Sequence
  Description of Artificial Sequence: Synthetic oligonucleotide
tcagctatggacacatctgagccagccaag

SEQ ID NO: 141051 - DNA, 29 bp, Artificial Sequence
  Description of Artificial Sequence: Synthetic oligonucleotide
cagctatggacacatctgagccagccaag

SEQ ID NO: 141052 - DNA, 29 bp, Artificial Sequence
  Description of Artificial Sequence: Synthetic oligonucleotide
agctatggacacatctgagccagccaagg

SEQ ID NO: 141053 - DNA, 28 bp, Artificial Sequence
  Description of Artificial Sequence: Synthetic oligonucleotide
gctatggacacatctgagccagccaagg

SEQ ID NO: 141054 - DNA, 29 bp, Artificial Sequence
  Description of Artificial Sequence: Synthetic oligonucleotide
ctatggacacatctgagccagccaaggag

SEQ ID NO: 141055 - DNA, 29 bp, Artificial Sequence
  Description of Artificial Sequence: Synthetic oligonucleotide
tatggacacatctgagccagccaaggagg

SEQ ID NO: 141056 - DNA, 28 bp, Artificial Sequence
  Description of Artificial Sequence: Synthetic oligonucleotide
atggacacatctgagccagccaaggagg

SEQ ID NO: 141057 - DNA, 27 bp, Artificial Sequence
  Description of Artificial Sequence: Synthetic oligonucleotide
tggacacatctgagccagccaaggagg

SEQ ID NO: 141058 - DNA, 27 bp, Artificial Sequence
  Description of Artificial Sequence: Synthetic oligonucleotide
ggacacatctgagccagccaaggagga

SEQ ID NO: 141059 - DNA, 27 bp, Artificial Sequence
  Description of Artificial Sequence: Synthetic oligonucleotide
gacacatctgagccagccaaggaggag

SEQ ID NO: 141060 - DNA, 27 bp, Artificial Sequence
  Description of Artificial Sequence: Synthetic oligonucleotide
acacatctgagccagccaaggaggagg

SEQ ID NO: 141061 - DNA, 27 bp, Artificial Sequence
  Description of Artificial Sequence: Synthetic oligonucleotide
cacatctgagccagccaaggaggagga

SEQ ID NO: 141062 - DNA, 28 bp, Artificial Sequence
  Description of Artificial Sequence: Synthetic oligonucleotide
acatctgagccagccaaggaggaggatg

SEQ ID NO: 141063 - DNA, 27 bp, Artificial Sequence
  Description of Artificial Sequence: Synthetic oligonucleotide
catctgagccagccaaggaggaggatg

SEQ ID NO: 141064 - DNA, 31 bp, Artificial Sequence
  Description of Artificial Sequence: Synthetic oligonucleotide
atctgagccagccaaggaggaggatgattac

SEQ ID NO: 141065 - DNA, 30 bp, Artificial Sequence
  Description of Artificial Sequence: Synthetic oligonucleotide
tctgagccagccaaggaggaggatgattac

SEQ ID NO: 141066 - DNA, 29 bp, Artificial Sequence
  Description of Artificial Sequence: Synthetic oligonucleotide
ctgagccagccaaggaggaggatgattac

SEQ ID NO: 141067 - DNA, 29 bp, Artificial Sequence
  Description of Artificial Sequence: Synthetic oligonucleotide
tgagccagccaaggaggaggatgattacg

SEQ ID NO: 141068 - DNA, 28 bp, Artificial Sequence
  Description of Artificial Sequence: Synthetic oligonucleotide
gagccagccaaggaggaggatgattacg

SEQ ID NO: 141069 - DNA, 29 bp, Artificial Sequence
  Description of Artificial Sequence: Synthetic oligonucleotide
agccagccaaggaggaggatgattacgac

SEQ ID NO: 141070 - DNA, 28 bp, Artificial Sequence
  Description of Artificial Sequence: Synthetic oligonucleotide
gccagccaaggaggaggatgattacgac

SEQ ID NO: 141071 - DNA, 28 bp, Artificial Sequence
  Description of Artificial Sequence: Synthetic oligonucleotide
ccagccaaggaggaggatgattacgacg

SEQ ID NO: 141072 - DNA, 29 bp, Artificial Sequence
  Description of Artificial Sequence: Synthetic oligonucleotide
cagccaaggaggaggatgattacgacgtg

SEQ ID NO: 141073 - DNA, 31 bp, Artificial Sequence
  Description of Artificial Sequence: Synthetic oligonucleotide
agccaaggaggaggatgattacgacgtgatg

SEQ ID NO: 141074 - DNA, 30 bp, Artificial Sequence
  Description of Artificial Sequence: Synthetic oligonucleotide
gccaaggaggaggatgattacgacgtgatg

SEQ ID NO: 141075 - DNA, 30 bp, Artificial Sequence
  Description of Artificial Sequence: Synthetic oligonucleotide
ccaaggaggaggatgattacgacgtgatgc

SEQ ID NO: 141076 - DNA, 31 bp, Artificial Sequence
  Description of Artificial Sequence: Synthetic oligonucleotide
caaggaggaggatgattacgacgtgatgcag

SEQ ID NO: 141077 - DNA, 31 bp, Artificial Sequence
  Description of Artificial Sequence: Synthetic oligonucleotide
aaggaggaggatgattacgacgtgatgcagg

SEQ ID NO: 141078 - DNA, 30 bp, Artificial Sequence
  Description of Artificial Sequence: Synthetic oligonucleotide
aggaggaggatgattacgacgtgatgcagg

SEQ ID NO: 141079 - DNA, 29 bp, Artificial Sequence
  Description of Artificial Sequence: Synthetic oligonucleotide
ggaggaggatgattacgacgtgatgcagg

SEQ ID NO: 141080 - DNA, 30 bp, Artificial Sequence
  Description of Artificial Sequence: Synthetic oligonucleotide
gaggaggatgattacgacgtgatgcaggac

SEQ ID NO: 141081 - DNA, 30 bp, Artificial Sequence
  Description of Artificial Sequence: Synthetic oligonucleotide
aggaggatgattacgacgtgatgcaggacc

SEQ ID NO: 141082 - DNA, 29 bp, Artificial Sequence
  Description of Artificial Sequence: Synthetic oligonucleotide
ggaggatgattacgacgtgatgcaggacc

SEQ ID NO: 141083 - DNA, 29 bp, Artificial Sequence
  Description of Artificial Sequence: Synthetic oligonucleotide
gaggatgattacgacgtgatgcaggaccc

SEQ ID NO: 141084 - DNA, 29 bp, Artificial Sequence
  Description of Artificial Sequence: Synthetic oligonucleotide
aggatgattacgacgtgatgcaggacccc

SEQ ID NO: 141085 - DNA, 28 bp, Artificial Sequence
  Description of Artificial Sequence: Synthetic oligonucleotide
ggatgattacgacgtgatgcaggacccc

SEQ ID NO: 141086 - DNA, 28 bp, Artificial Sequence
  Description of Artificial Sequence: Synthetic oligonucleotide
gatgattacgacgtgatgcaggaccccg

SEQ ID NO: 141087 - DNA, 29 bp, Artificial Sequence
  Description of Artificial Sequence: Synthetic oligonucleotide
atgattacgacgtgatgcaggaccccgag

SEQ ID NO: 141088 - DNA, 28 bp, Artificial Sequence
  Description of Artificial Sequence: Synthetic oligonucleotide
tgattacgacgtgatgcaggaccccgag

SEQ ID NO: 141089 - DNA, 27 bp, Artificial Sequence
  Description of Artificial Sequence: Synthetic oligonucleotide
gattacgacgtgatgcaggaccccgag

SEQ ID NO: 141090 - DNA, 29 bp, Artificial Sequence
  Description of Artificial Sequence: Synthetic oligonucleotide
attacgacgtgatgcaggaccccgagttc

SEQ ID NO: 141091 - DNA, 28 bp, Artificial Sequence
  Description of Artificial Sequence: Synthetic oligonucleotide
ttacgacgtgatgcaggaccccgagttc

SEQ ID NO: 141092 - DNA, 27 bp, Artificial Sequence
  Description of Artificial Sequence: Synthetic oligonucleotide
tacgacgtgatgcaggaccccgagttc

SEQ ID NO: 141093 - DNA, 26 bp, Artificial Sequence
  Description of Artificial Sequence: Synthetic oligonucleotide
acgacgtgatgcaggaccccgagttc

SEQ ID NO: 141094 - DNA, 25 bp, Artificial Sequence
  Description of Artificial Sequence: Synthetic oligonucleotide
cgacgtgatgcaggaccccgagttc

SEQ ID NO: 141095 - DNA, 27 bp, Artificial Sequence
  Description of Artificial Sequence: Synthetic oligonucleotide
gacgtgatgcaggaccccgagttcctt

SEQ ID NO: 141096 - DNA, 27 bp, Artificial Sequence
  Description of Artificial Sequence: Synthetic oligonucleotide
acgtgatgcaggaccccgagttccttc

SEQ ID NO: 141097 - DNA, 27 bp, Artificial Sequence
  Description of Artificial Sequence: Synthetic oligonucleotide
cgtgatgcaggaccccgagttccttca

SEQ ID NO: 141098 - DNA, 27 bp, Artificial Sequence
  Description of Artificial Sequence: Synthetic oligonucleotide
gtgatgcaggaccccgagttccttcag

SEQ ID NO: 141099 - DNA, 28 bp, Artificial Sequence
  Description of Artificial Sequence: Synthetic oligonucleotide
tgatgcaggaccccgagttccttcagag

SEQ ID NO: 141100 - DNA, 27 bp, Artificial Sequence
  Description of Artificial Sequence: Synthetic oligonucleotide
gatgcaggaccccgagttccttcagag

SEQ ID NO: 141101 - DNA, 28 bp, Artificial Sequence
  Description of Artificial Sequence: Synthetic oligonucleotide
atgcaggaccccgagttccttcagagtg

SEQ ID NO: 141102 - DNA, 27 bp, Artificial Sequence
  Description of Artificial Sequence: Synthetic oligonucleotide
tgcaggaccccgagttccttcagagtg

SEQ ID NO: 141103 - DNA, 27 bp, Artificial Sequence
  Description of Artificial Sequence: Synthetic oligonucleotide
gcaggaccccgagttccttcagagtgt

SEQ ID NO: 141104 - DNA, 27 bp, Artificial Sequence
  Description of Artificial Sequence: Synthetic oligonucleotide
caggaccccgagttccttcagagtgtc

SEQ ID NO: 141105 - DNA, 27 bp, Artificial Sequence
  Description of Artificial Sequence: Synthetic oligonucleotide
aggaccccgagttccttcagagtgtcc

SEQ ID NO: 141106 - DNA, 27 bp, Artificial Sequence
  Description of Artificial Sequence: Synthetic oligonucleotide
ggaccccgagttccttcagagtgtcct

SEQ ID NO: 141107 - DNA, 28 bp, Artificial Sequence
  Description of Artificial Sequence: Synthetic oligonucleotide
gaccccgagttccttcagagtgtcctag

SEQ ID NO: 141108 - DNA, 29 bp, Artificial Sequence
  Description of Artificial Sequence: Synthetic oligonucleotide
accccgagttccttcagagtgtcctagag

SEQ ID NO: 141109 - DNA, 28 bp, Artificial Sequence
  Description of Artificial Sequence: Synthetic oligonucleotide
ccccgagttccttcagagtgtcctagag

SEQ ID NO: 141110 - DNA, 30 bp, Artificial Sequence
  Description of Artificial Sequence: Synthetic oligonucleotide
cccgagttccttcagagtgtcctagagaac

SEQ ID NO: 141111 - DNA, 30 bp, Artificial Sequence
  Description of Artificial Sequence: Synthetic oligonucleotide
ccgagttccttcagagtgtcctagagaacc

SEQ ID NO: 141112 - DNA, 31 bp, Artificial Sequence
  Description of Artificial Sequence: Synthetic oligonucleotide
cgagttccttcagagtgtcctagagaacctc

SEQ ID NO: 141113 - DNA, 31 bp, Artificial Sequence
  Description of Artificial Sequence: Synthetic oligonucleotide
gagttccttcagagtgtcctagagaacctcc

SEQ ID NO: 141114 - DNA, 31 bp, Artificial Sequence
  Description of Artificial Sequence: Synthetic oligonucleotide
agttccttcagagtgtcctagagaacctccc

SEQ ID NO: 141115 - DNA, 30 bp, Artificial Sequence
  Description of Artificial Sequence: Synthetic oligonucleotide
gttccttcagagtgtcctagagaacctccc

SEQ ID NO: 141116 - DNA, 31 bp, Artificial Sequence
  Description of Artificial Sequence: Synthetic oligonucleotide
ttccttcagagtgtcctagagaacctcccag

SEQ ID NO: 141117 - DNA, 30 bp, Artificial Sequence
  Description of Artificial Sequence: Synthetic oligonucleotide
tccttcagagtgtcctagagaacctcccag

SEQ ID NO: 141118 - DNA, 29 bp, Artificial Sequence
  Description of Artificial Sequence: Synthetic oligonucleotide
ccttcagagtgtcctagagaacctcccag

SEQ ID NO: 141119 - DNA, 29 bp, Artificial Sequence
  Description of Artificial Sequence: Synthetic oligonucleotide
cttcagagtgtcctagagaacctcccagg

SEQ ID NO: 141120 - DNA, 30 bp, Artificial Sequence
  Description of Artificial Sequence: Synthetic oligonucleotide
ttcagagtgtcctagagaacctcccaggtg

SEQ ID NO: 141121 - DNA, 29 bp, Artificial Sequence
  Description of Artificial Sequence: Synthetic oligonucleotide
tcagagtgtcctagagaacctcccaggtg

SEQ ID NO: 141122 - DNA, 28 bp, Artificial Sequence
  Description of Artificial Sequence: Synthetic oligonucleotide
cagagtgtcctagagaacctcccaggtg

SEQ ID NO: 141123 - DNA, 29 bp, Artificial Sequence
  Description of Artificial Sequence: Synthetic oligonucleotide
agagtgtcctagagaacctcccaggtgtg

SEQ ID NO: 141124 - DNA, 28 bp, Artificial Sequence
  Description of Artificial Sequence: Synthetic oligonucleotide
gagtgtcctagagaacctcccaggtgtg

SEQ ID NO: 141125 - DNA, 28 bp, Artificial Sequence
  Description of Artificial Sequence: Synthetic oligonucleotide
agtgtcctagagaacctcccaggtgtgg

SEQ ID NO: 141126 - DNA, 27 bp, Artificial Sequence
  Description of Artificial Sequence: Synthetic oligonucleotide
gtgtcctagagaacctcccaggtgtgg

SEQ ID NO: 141127 - DNA, 29 bp, Artificial Sequence
  Description of Artificial Sequence: Synthetic oligonucleotide
tgtcctagagaacctcccaggtgtggatc

SEQ ID NO: 141128 - DNA, 28 bp, Artificial Sequence
  Description of Artificial Sequence: Synthetic oligonucleotide
gtcctagagaacctcccaggtgtggatc

SEQ ID NO: 141129 - DNA, 28 bp, Artificial Sequence
  Description of Artificial Sequence: Synthetic oligonucleotide
tcctagagaacctcccaggtgtggatcc

SEQ ID NO: 141130 - DNA, 27 bp, Artificial Sequence
  Description of Artificial Sequence: Synthetic oligonucleotide
cctagagaacctcccaggtgtggatcc

SEQ ID NO: 141131 - DNA, 27 bp, Artificial Sequence
  Description of Artificial Sequence: Synthetic oligonucleotide
ctagagaacctcccaggtgtggatccc

SEQ ID NO: 141132 - DNA, 29 bp, Artificial Sequence
  Description of Artificial Sequence: Synthetic oligonucleotide
tagagaacctcccaggtgtggatcccaac

SEQ ID NO: 141133 - DNA, 28 bp, Artificial Sequence
  Description of Artificial Sequence: Synthetic oligonucleotide
agagaacctcccaggtgtggatcccaac

SEQ ID NO: 141134 - DNA, 27 bp, Artificial Sequence
  Description of Artificial Sequence: Synthetic oligonucleotide
gagaacctcccaggtgtggatcccaac

SEQ ID NO: 141135 - DNA, 30 bp, Artificial Sequence
  Description of Artificial Sequence: Synthetic oligonucleotide
agaacctcccaggtgtggatcccaacaatg

SEQ ID NO: 141136 - DNA, 29 bp, Artificial Sequence
  Description of Artificial Sequence: Synthetic oligonucleotide
gaacctcccaggtgtggatcccaacaatg

SEQ ID NO: 141137 - DNA, 31 bp, Artificial Sequence
  Description of Artificial Sequence: Synthetic oligonucleotide
aacctcccaggtgtggatcccaacaatgaag

SEQ ID NO: 141138 - DNA, 30 bp, Artificial Sequence
  Description of Artificial Sequence: Synthetic oligonucleotide
acctcccaggtgtggatcccaacaatgaag

SEQ ID NO: 141139 - DNA, 29 bp, Artificial Sequence
  Description of Artificial Sequence: Synthetic oligonucleotide
cctcccaggtgtggatcccaacaatgaag

SEQ ID NO: 141140 - DNA, 29 bp, Artificial Sequence
  Description of Artificial Sequence: Synthetic oligonucleotide
ctcccaggtgtggatcccaacaatgaagc

SEQ ID NO: 141141 - DNA, 29 bp, Artificial Sequence
  Description of Artificial Sequence: Synthetic oligonucleotide
tcccaggtgtggatcccaacaatgaagcc

SEQ ID NO: 141142 - DNA, 28 bp, Artificial Sequence
  Description of Artificial Sequence: Synthetic oligonucleotide
cccaggtgtggatcccaacaatgaagcc

SEQ ID NO: 141143 - DNA, 31 bp, Artificial Sequence
  Description of Artificial Sequence: Synthetic oligonucleotide
ccaggtgtggatcccaacaatgaagccattc

SEQ ID NO: 141144 - DNA, 31 bp, Artificial Sequence
  Description of Artificial Sequence: Synthetic oligonucleotide
caggtgtggatcccaacaatgaagccattcg

SEQ ID NO: 141145 - DNA, 35 bp, Artificial Sequence
  Description of Artificial Sequence: Synthetic oligonucleotide
aggtgtggatcccaacaatgaagccattcgaaatg

SEQ ID NO: 141146 - DNA, 34 bp, Artificial Sequence
  Description of Artificial Sequence: Synthetic oligonucleotide
ggtgtggatcccaacaatgaagccattcgaaatg

SEQ ID NO: 141147 - DNA, 34 bp, Artificial Sequence
  Description of Artificial Sequence: Synthetic oligonucleotide
gtgtggatcccaacaatgaagccattcgaaatgc

SEQ ID NO: 141148 - DNA, 37 bp, Artificial Sequence
  Description of Artificial Sequence: Synthetic oligonucleotide
tgtggatcccaacaatgaagccattcgaaatgctatg

SEQ ID NO: 141149 - DNA, 36 bp, Artificial Sequence
  Description of Artificial Sequence: Synthetic oligonucleotide
gtggatcccaacaatgaagccattcgaaatgctatg

SEQ ID NO: 141150 - DNA, 36 bp, Artificial Sequence
  Description of Artificial Sequence: Synthetic oligonucleotide
tggatcccaacaatgaagccattcgaaatgctatgg

SEQ ID NO: 141151 - DNA, 35 bp, Artificial Sequence
  Description of Artificial Sequence: Synthetic oligonucleotide
ggatcccaacaatgaagccattcgaaatgctatgg

SEQ ID NO: 141152 - DNA, 35 bp, Artificial Sequence
  Description of Artificial Sequence: Synthetic oligonucleotide
gatcccaacaatgaagccattcgaaatgctatggg

SEQ ID NO: 141153 - DNA, 35 bp, Artificial Sequence
  Description of Artificial Sequence: Synthetic oligonucleotide
atcccaacaatgaagccattcgaaatgctatgggc

SEQ ID NO: 141154 - DNA, 34 bp, Artificial Sequence
  Description of Artificial Sequence: Synthetic oligonucleotide
tcccaacaatgaagccattcgaaatgctatgggc

SEQ ID NO: 141155 - DNA, 33 bp, Artificial Sequence
  Description of Artificial Sequence: Synthetic oligonucleotide
cccaacaatgaagccattcgaaatgctatgggc

SEQ ID NO: 141156 - DNA, 34 bp, Artificial Sequence
  Description of Artificial Sequence: Synthetic oligonucleotide
ccaacaatgaagccattcgaaatgctatgggctc

SEQ ID NO: 141157 - DNA, 34 bp, Artificial Sequence
  Description of Artificial Sequence: Synthetic oligonucleotide
caacaatgaagccattcgaaatgctatgggctcc

SEQ ID NO: 141158 - DNA, 34 bp, Artificial Sequence
  Description of Artificial Sequence: Synthetic oligonucleotide
aacaatgaagccattcgaaatgctatgggctccc

SEQ ID NO: 141159 - DNA, 33 bp, Artificial Sequence
  Description of Artificial Sequence: Synthetic oligonucleotide
acaatgaagccattcgaaatgctatgggctccc

SEQ ID NO: 141160 - DNA, 32 bp, Artificial Sequence
  Description of Artificial Sequence: Synthetic oligonucleotide
caatgaagccattcgaaatgctatgggctccc

SEQ ID NO: 141161 - DNA, 33 bp, Artificial Sequence
  Description of Artificial Sequence: Synthetic oligonucleotide
aatgaagccattcgaaatgctatgggctccctg

SEQ ID NO: 141162 - DNA, 32 bp, Artificial Sequence
  Description of Artificial Sequence: Synthetic oligonucleotide
atgaagccattcgaaatgctatgggctccctg

SEQ ID NO: 141163 - DNA, 31 bp, Artificial Sequence
  Description of Artificial Sequence: Synthetic oligonucleotide
tgaagccattcgaaatgctatgggctccctg

SEQ ID NO: 141164 - DNA, 30 bp, Artificial Sequence
  Description of Artificial Sequence: Synthetic oligonucleotide
gaagccattcgaaatgctatgggctccctg

SEQ ID NO: 141165 - DNA, 30 bp, Artificial Sequence
  Description of Artificial Sequence: Synthetic oligonucleotide
aagccattcgaaatgctatgggctccctgg

SEQ ID NO: 141166 - DNA, 29 bp, Artificial Sequence
  Description of Artificial Sequence: Synthetic oligonucleotide
agccattcgaaatgctatgggctccctgg

SEQ ID NO: 141167 - DNA, 28 bp, Artificial Sequence
  Description of Artificial Sequence: Synthetic oligonucleotide
gccattcgaaatgctatgggctccctgg

SEQ ID NO: 141168 - DNA, 28 bp, Artificial Sequence
  Description of Artificial Sequence: Synthetic oligonucleotide
ccattcgaaatgctatgggctccctggc

SEQ ID NO: 141169 - DNA, 28 bp, Artificial Sequence
  Description of Artificial Sequence: Synthetic oligonucleotide
cattcgaaatgctatgggctccctggcc

SEQ ID NO: 141170 - DNA, 29 bp, Artificial Sequence
  Description of Artificial Sequence: Synthetic oligonucleotide
attcgaaatgctatgggctccctggcctc

SEQ ID NO: 141171 - DNA, 28 bp, Artificial Sequence
  Description of Artificial Sequence: Synthetic oligonucleotide
ttcgaaatgctatgggctccctggcctc

SEQ ID NO: 141172 - DNA, 27 bp, Artificial Sequence
  Description of Artificial Sequence: Synthetic oligonucleotide
tcgaaatgctatgggctccctggcctc

SEQ ID NO: 141173 - DNA, 26 bp, Artificial Sequence
  Description of Artificial Sequence: Synthetic oligonucleotide
cgaaatgctatgggctccctggcctc

SEQ ID NO: 141174 - DNA, 26 bp, Artificial Sequence
  Description of Artificial Sequence: Synthetic oligonucleotide
gaaatgctatgggctccctggcctcc

SEQ ID NO: 141175 - DNA, 27 bp, Artificial Sequence
  Description of Artificial Sequence: Synthetic oligonucleotide
aaatgctatgggctccctggcctccca

SEQ ID NO: 141176 - DNA, 26 bp, Artificial Sequence
  Description of Artificial Sequence: Synthetic oligonucleotide
aatgctatgggctccctggcctccca

SEQ ID NO: 141177 - DNA, 25 bp, Artificial Sequence
  Description of Artificial Sequence: Synthetic oligonucleotide
atgctatgggctccctggcctccca

SEQ ID NO: 141178 - DNA, 24 bp, Artificial Sequence
  Description of Artificial Sequence: Synthetic oligonucleotide
tgctatgggctccctggcctccca

SEQ ID NO: 141179 - DNA, 23 bp, Artificial Sequence
  Description of Artificial Sequence: Synthetic oligonucleotide
gctatgggctccctggcctccca

SEQ ID NO: 141180 - DNA, 23 bp, Artificial Sequence
  Description of Artificial Sequence: Synthetic oligonucleotide
ctatgggctccctggcctcccag

SEQ ID NO: 141181 - DNA, 23 bp, Artificial Sequence
  Description of Artificial Sequence: Synthetic oligonucleotide
tatgggctccctggcctcccagg

SEQ ID NO: 141182 - DNA, 22 bp, Artificial Sequence
  Description of Artificial Sequence: Synthetic oligonucleotide
atgggctccctggcctcccagg

SEQ ID NO: 141183 - DNA, 21 bp, Artificial Sequence
  Description of Artificial Sequence: Synthetic oligonucleotide
tgggctccctggcctcccagg

SEQ ID NO: 141184 - DNA, 20 bp, Artificial Sequence
  Description of Artificial Sequence: Synthetic oligonucleotide
gggctccctggcctcccagg

SEQ ID NO: 141185 - DNA, 20 bp, Artificial Sequence
  Description of Artificial Sequence: Synthetic oligonucleotide
ggctccctggcctcccaggc

SEQ ID NO: 141186 - DNA, 21 bp, Artificial Sequence
  Description of Artificial Sequence: Synthetic oligonucleotide
gctccctggcctcccaggcca

SEQ ID NO: 141187 - DNA, 21 bp, Artificial Sequence
  Description of Artificial Sequence: Synthetic oligonucleotide
ctccctggcctcccaggccac

SEQ ID NO: 141188 - DNA, 23 bp, Artificial Sequence
  Description of Artificial Sequence: Synthetic oligonucleotide
tccctggcctcccaggccaccaa

SEQ ID NO: 141189 - DNA, 22 bp, Artificial Sequence
  Description of Artificial Sequence: Synthetic oligonucleotide
ccctggcctcccaggccaccaa

SEQ ID NO: 141190 - DNA, 22 bp, Artificial Sequence
  Description of Artificial Sequence: Synthetic oligonucleotide
cctggcctcccaggccaccaag

SEQ ID NO: 141191 - DNA, 23 bp, Artificial Sequence
  Description of Artificial Sequence: Synthetic oligonucleotide
ctggcctcccaggccaccaagga

SEQ ID NO: 141192 - DNA, 23 bp, Artificial Sequence
  Description of Artificial Sequence: Synthetic oligonucleotide
tggcctcccaggccaccaaggac

SEQ ID NO: 141193 - DNA, 22 bp, Artificial Sequence
  Description of Artificial Sequence: Synthetic oligonucleotide
ggcctcccaggccaccaaggac

SEQ ID NO: 141194 - DNA, 22 bp, Artificial Sequence
  Description of Artificial Sequence: Synthetic oligonucleotide
gcctcccaggccaccaaggacg

SEQ ID NO: 141195 - DNA, 22 bp, Artificial Sequence
  Description of Artificial Sequence: Synthetic oligonucleotide
cctcccaggccaccaaggacgg

SEQ ID NO: 141196 - DNA, 24 bp, Artificial Sequence
  Description of Artificial Sequence: Synthetic oligonucleotide
ctcccaggccaccaaggacggcaa

SEQ ID NO: 141197 - DNA, 26 bp, Artificial Sequence
  Description of Artificial Sequence: Synthetic oligonucleotide
tcccaggccaccaaggacggcaagaa

SEQ ID NO: 141198 - DNA, 25 bp, Artificial Sequence
  Description of Artificial Sequence: Synthetic oligonucleotide
cccaggccaccaaggacggcaagaa

SEQ ID NO: 141199 - DNA, 25 bp, Artificial Sequence
  Description of Artificial Sequence: Synthetic oligonucleotide
ccaggccaccaaggacggcaagaag

SEQ ID NO: 141200 - DNA, 26 bp, Artificial Sequence
  Description of Artificial Sequence: Synthetic oligonucleotide
caggccaccaaggacggcaagaagga

SEQ ID NO: 141201 - DNA, 27 bp, Artificial Sequence
  Description of Artificial Sequence: Synthetic oligonucleotide
aggccaccaaggacggcaagaaggaca

SEQ ID NO: 141202 - DNA, 27 bp, Artificial Sequence
  Description of Artificial Sequence: Synthetic oligonucleotide
ggccaccaaggacggcaagaaggacaa

SEQ ID NO: 141203 - DNA, 27 bp, Artificial Sequence
  Description of Artificial Sequence: Synthetic oligonucleotide
gccaccaaggacggcaagaaggacaag

SEQ ID NO: 141204 - DNA, 29 bp, Artificial Sequence
  Description of Artificial Sequence: Synthetic oligonucleotide
ccaccaaggacggcaagaaggacaagaag

SEQ ID NO: 141205 - DNA, 29 bp, Artificial Sequence
  Description of Artificial Sequence: Synthetic oligonucleotide
caccaaggacggcaagaaggacaagaagg

SEQ ID NO: 141206 - DNA, 30 bp, Artificial Sequence
  Description of Artificial Sequence: Synthetic oligonucleotide
accaaggacggcaagaaggacaagaaggag

SEQ ID NO: 141207 - DNA, 29 bp, Artificial Sequence
  Description of Artificial Sequence: Synthetic oligonucleotide
ccaaggacggcaagaaggacaagaaggag

SEQ ID NO: 141208 - DNA, 29 bp, Artificial Sequence
  Description of Artificial Sequence: Synthetic oligonucleotide
caaggacggcaagaaggacaagaaggagg

SEQ ID NO: 141209 - DNA, 31 bp, Artificial Sequence
  Description of Artificial Sequence: Synthetic oligonucleotide
aaggacggcaagaaggacaagaaggaggaag

SEQ ID NO: 141210 - DNA, 30 bp, Artificial Sequence
  Description of Artificial Sequence: Synthetic oligonucleotide
aggacggcaagaaggacaagaaggaggaag

SEQ ID NO: 141211 - DNA, 29 bp, Artificial Sequence
  Description of Artificial Sequence: Synthetic oligonucleotide
ggacggcaagaaggacaagaaggaggaag

SEQ ID NO: 141212 - DNA, 30 bp, Artificial Sequence
  Description of Artificial Sequence: Synthetic oligonucleotide
gacggcaagaaggacaagaaggaggaagac

SEQ ID NO: 141213 - DNA, 32 bp, Artificial Sequence
  Description of Artificial Sequence: Synthetic oligonucleotide
acggcaagaaggacaagaaggaggaagacaag

SEQ ID NO: 141214 - DNA, 31 bp, Artificial Sequence
  Description of Artificial Sequence: Synthetic oligonucleotide
cggcaagaaggacaagaaggaggaagacaag

SEQ ID NO: 141215 - DNA, 33 bp, Artificial Sequence
  Description of Artificial Sequence: Synthetic oligonucleotide
ggcaagaaggacaagaaggaggaagacaagaag

SEQ ID NO: 141216 - DNA, 34 bp, Artificial Sequence
  Description of Artificial Sequence: Synthetic oligonucleotide
gcaagaaggacaagaaggaggaagacaagaagtg

SEQ ID NO: 141217 - DNA, 24 bp, Artificial Sequence
  Description of Artificial Sequence: Synthetic oligonucleotide
atggcagcccaggctttggcgctg

SEQ ID NO: 141218 - DNA, 23 bp, Artificial Sequence
  Description of Artificial Sequence: Synthetic oligonucleotide
tggcagcccaggctttggcgctg

SEQ ID NO: 141219 - DNA, 22 bp, Artificial Sequence
  Description of Artificial Sequence: Synthetic oligonucleotide
ggcagcccaggctttggcgctg

SEQ ID NO: 141220 - DNA, 23 bp, Artificial Sequence
  Description of Artificial Sequence: Synthetic oligonucleotide
gcagcccaggctttggcgctgct

SEQ ID NO: 141221 - DNA, 24 bp, Artificial Sequence
  Description of Artificial Sequence: Synthetic oligonucleotide
cagcccaggctttggcgctgctga

SEQ ID NO: 141222 - DNA, 25 bp, Artificial Sequence
  Description of Artificial Sequence: Synthetic oligonucleotide
agcccaggctttggcgctgctgaga

SEQ ID NO: 141223 - DNA, 24 bp, Artificial Sequence
  Description of Artificial Sequence: Synthetic oligonucleotide
gcccaggctttggcgctgctgaga

SEQ ID NO: 141224 - DNA, 25 bp, Artificial Sequence
  Description of Artificial Sequence: Synthetic oligonucleotide
cccaggctttggcgctgctgagaga

SEQ ID NO: 141225 - DNA, 25 bp, Artificial Sequence
  Description of Artificial Sequence: Synthetic oligonucleotide
ccaggctttggcgctgctgagagag

SEQ ID NO: 141226 - DNA, 27 bp, Artificial Sequence
  Description of Artificial Sequence: Synthetic oligonucleotide
caggctttggcgctgctgagagaggta

SEQ ID NO: 141227 - DNA, 27 bp, Artificial Sequence
  Description of Artificial Sequence: Synthetic oligonucleotide
aggctttggcgctgctgagagaggtag

SEQ ID NO: 141228 - DNA, 26 bp, Artificial Sequence
  Description of Artificial Sequence: Synthetic oligonucleotide
ggctttggcgctgctgagagaggtag

SEQ ID NO: 141229 - DNA, 26 bp, Artificial Sequence
  Description of Artificial Sequence: Synthetic oligonucleotide
gctttggcgctgctgagagaggtagc

SEQ ID NO: 141230 - DNA, 27 bp, Artificial Sequence
  Description of Artificial Sequence: Synthetic oligonucleotide
ctttggcgctgctgagagaggtagcga

SEQ ID NO: 141231 - DNA, 27 bp, Artificial Sequence
  Description of Artificial Sequence: Synthetic oligonucleotide
tttggcgctgctgagagaggtagcgag

SEQ ID NO: 141232 - DNA, 26 bp, Artificial Sequence
  Description of Artificial Sequence: Synthetic oligonucleotide
ttggcgctgctgagagaggtagcgag

SEQ ID NO: 141233 - DNA, 25 bp, Artificial Sequence
  Description of Artificial Sequence: Synthetic oligonucleotide
tggcgctgctgagagaggtagcgag

SEQ ID NO: 141234 - DNA, 24 bp, Artificial Sequence
  Description of Artificial Sequence: Synthetic oligonucleotide
ggcgctgctgagagaggtagcgag

SEQ ID NO: 141235 - DNA, 24 bp, Artificial Sequence
  Description of Artificial Sequence: Synthetic oligonucleotide
gcgctgctgagagaggtagcgagg

SEQ ID NO: 141236 - DNA, 25 bp, Artificial Sequence
  Description of Artificial Sequence: Synthetic oligonucleotide
cgctgctgagagaggtagcgaggct

SEQ ID NO: 141237 - DNA, 25 bp, Artificial Sequence
  Description of Artificial Sequence: Synthetic oligonucleotide
gctgctgagagaggtagcgaggctg

SEQ ID NO: 141238 - DNA, 27 bp, Artificial Sequence
  Description of Artificial Sequence: Synthetic oligonucleotide
ctgctgagagaggtagcgaggctggaa

SEQ ID NO: 141239 - DNA, 27 bp, Artificial Sequence
  Description of Artificial Sequence: Synthetic oligonucleotide
tgctgagagaggtagcgaggctggaag

SEQ ID NO: 141240 - DNA, 26 bp, Artificial Sequence
  Description of Artificial Sequence: Synthetic oligonucleotide
gctgagagaggtagcgaggctggaag

SEQ ID NO: 141241 - DNA, 26 bp, Artificial Sequence
  Description of Artificial Sequence: Synthetic oligonucleotide
ctgagagaggtagcgaggctggaagc

SEQ ID NO: 141242 - DNA, 26 bp, Artificial Sequence
  Description of Artificial Sequence: Synthetic oligonucleotide
tgagagaggtagcgaggctggaagcg

SEQ ID NO: 141243 - DNA, 25 bp, Artificial Sequence
  Description of Artificial Sequence: Synthetic oligonucleotide
gagagaggtagcgaggctggaagcg

SEQ ID NO: 141244 - DNA, 25 bp, Artificial Sequence
  Description of Artificial Sequence: Synthetic oligonucleotide
agagaggtagcgaggctggaagcgc

SEQ ID NO: 141245 - DNA, 24 bp, Artificial Sequence
  Description of Artificial Sequence: Synthetic oligonucleotide
gagaggtagcgaggctggaagcgc

SEQ ID NO: 141246 - DNA, 24 bp, Artificial Sequence
  Description of Artificial Sequence: Synthetic oligonucleotide
agaggtagcgaggctggaagcgcc

SEQ ID NO: 141247 - DNA, 23 bp, Artificial Sequence
  Description of Artificial Sequence: Synthetic oligonucleotide
gaggtagcgaggctggaagcgcc

SEQ ID NO: 141248 - DNA, 23 bp, Artificial Sequence
  Description of Artificial Sequence: Synthetic oligonucleotide
aggtagcgaggctggaagcgccg

SEQ ID NO: 141249 - DNA, 22 bp, Artificial Sequence
  Description of Artificial Sequence: Synthetic oligonucleotide
ggtagcgaggctggaagcgccg

SEQ ID NO: 141250 - DNA, 23 bp, Artificial Sequence
  Description of Artificial Sequence: Synthetic oligonucleotide
gtagcgaggctggaagcgccgct

SEQ ID NO: 141251 - DNA, 23 bp, Artificial Sequence
  Description of Artificial Sequence: Synthetic oligonucleotide
tagcgaggctggaagcgccgctg

SEQ ID NO: 141252 - DNA, 22 bp, Artificial Sequence
  Description of Artificial Sequence: Synthetic oligonucleotide
agcgaggctggaagcgccgctg

SEQ ID NO: 141253 - DNA, 21 bp, Artificial Sequence
  Description of Artificial Sequence: Synthetic oligonucleotide
gcgaggctggaagcgccgctg

SEQ ID NO: 141254 - DNA, 22 bp, Artificial Sequence
  Description of Artificial Sequence: Synthetic oligonucleotide
cgaggctggaagcgccgctgga

SEQ ID NO: 141255 - DNA, 22 bp, Artificial Sequence
  Description of Artificial Sequence: Synthetic oligonucleotide
gaggctggaagcgccgctggag

SEQ ID NO: 141256 - DNA, 23 bp, Artificial Sequence
  Description of Artificial Sequence: Synthetic oligonucleotide
aggctggaagcgccgctggagga

SEQ ID NO: 141257 - DNA, 22 bp, Artificial Sequence
  Description of Artificial Sequence: Synthetic oligonucleotide
ggctggaagcgccgctggagga

SEQ ID NO: 141258 - DNA, 22 bp, Artificial Sequence
  Description of Artificial Sequence: Synthetic oligonucleotide
gctggaagcgccgctggaggag

SEQ ID NO: 141259 - DNA, 24 bp, Artificial Sequence
  Description of Artificial Sequence: Synthetic oligonucleotide
ctggaagcgccgctggaggagcta

SEQ ID NO: 141260 - DNA, 24 bp, Artificial Sequence
  Description of Artificial Sequence: Synthetic oligonucleotide
tggaagcgccgctggaggagctac

SEQ ID NO: 141261 - DNA, 23 bp, Artificial Sequence
  Description of Artificial Sequence: Synthetic oligonucleotide
ggaagcgccgctggaggagctac

SEQ ID NO: 141262 - DNA, 23 bp, Artificial Sequence
  Description of Artificial Sequence: Synthetic oligonucleotide
gaagcgccgctggaggagctacg

SEQ ID NO: 141263 - DNA, 23 bp, Artificial Sequence
  Description of Artificial Sequence: Synthetic oligonucleotide
aagcgccgctggaggagctacgc

SEQ ID NO: 141264 - DNA, 22 bp, Artificial Sequence
  Description of Artificial Sequence: Synthetic oligonucleotide
agcgccgctggaggagctacgc

SEQ ID NO: 141265 - DNA, 21 bp, Artificial Sequence
  Description of Artificial Sequence: Synthetic oligonucleotide
gcgccgctggaggagctacgc

SEQ ID NO: 141266 - DNA, 21 bp, Artificial Sequence
  Description of Artificial Sequence: Synthetic oligonucleotide
cgccgctggaggagctacgcg

SEQ ID NO: 141267 - DNA, 21 bp, Artificial Sequence
  Description of Artificial Sequence: Synthetic oligonucleotide
gccgctggaggagctacgcgc

SEQ ID NO: 141268 - DNA, 21 bp, Artificial Sequence
  Description of Artificial Sequence: Synthetic oligonucleotide
ccgctggaggagctacgcgcg

SEQ ID NO: 141269 - DNA, 23 bp, Artificial Sequence
  Description of Artificial Sequence: Synthetic oligonucleotide
cgctggaggagctacgcgcgctt

SEQ ID NO: 141270 - DNA, 24 bp, Artificial Sequence
  Description of Artificial Sequence: Synthetic oligonucleotide
gctggaggagctacgcgcgcttca

SEQ ID NO: 141271 - DNA, 25 bp, Artificial Sequence
  Description of Artificial Sequence: Synthetic oligonucleotide
ctggaggagctacgcgcgcttcact

SEQ ID NO: 141272 - DNA, 25 bp, Artificial Sequence
  Description of Artificial Sequence: Synthetic oligonucleotide
tggaggagctacgcgcgcttcactc

SEQ ID NO: 141273 - DNA, 24 bp, Artificial Sequence
  Description of Artificial Sequence: Synthetic oligonucleotide
ggaggagctacgcgcgcttcactc

SEQ ID NO: 141274 - DNA, 24 bp, Artificial Sequence
  Description of Artificial Sequence: Synthetic oligonucleotide
gaggagctacgcgcgcttcactcc

SEQ ID NO: 141275 - DNA, 25 bp, Artificial Sequence
  Description of Artificial Sequence: Synthetic oligonucleotide
aggagctacgcgcgcttcactccgt

SEQ ID NO: 141276 - DNA, 24 bp, Artificial Sequence
  Description of Artificial Sequence: Synthetic oligonucleotide
ggagctacgcgcgcttcactccgt

SEQ ID NO: 141277 - DNA, 24 bp, Artificial Sequence
  Description of Artificial Sequence: Synthetic oligonucleotide
gagctacgcgcgcttcactccgtg

SEQ ID NO: 141278 - DNA, 25 bp, Artificial Sequence
  Description of Artificial Sequence: Synthetic oligonucleotide
agctacgcgcgcttcactccgtgct

SEQ ID NO: 141279 - DNA, 24 bp, Artificial Sequence
  Description of Artificial Sequence: Synthetic oligonucleotide
gctacgcgcgcttcactccgtgct

SEQ ID NO: 141280 - DNA, 24 bp, Artificial Sequence
  Description of Artificial Sequence: Synthetic oligonucleotide
ctacgcgcgcttcactccgtgctg

SEQ ID NO: 141281 - DNA, 25 bp, Artificial Sequence
  Description of Artificial Sequence: Synthetic oligonucleotide
tacgcgcgcttcactccgtgctgca

SEQ ID NO: 141282 - DNA, 24 bp, Artificial Sequence
  Description of Artificial Sequence: Synthetic oligonucleotide
acgcgcgcttcactccgtgctgca

SEQ ID NO: 141283 - DNA, 23 bp, Artificial Sequence
  Description of Artificial Sequence: Synthetic oligonucleotide
cgcgcgcttcactccgtgctgca

SEQ ID NO: 141284 - DNA, 23 bp, Artificial Sequence
  Description of Artificial Sequence: Synthetic oligonucleotide
gcgcgcttcactccgtgctgcag

SEQ ID NO: 141285 - DNA, 23 bp, Artificial Sequence
  Description of Artificial Sequence: Synthetic oligonucleotide
cgcgcttcactccgtgctgcagg

SEQ ID NO: 141286 - DNA, 24 bp, Artificial Sequence
  Description of Artificial Sequence: Synthetic oligonucleotide
gcgcttcactccgtgctgcaggca

SEQ ID NO: 141287 - DNA, 25 bp, Artificial Sequence
  Description of Artificial Sequence: Synthetic oligonucleotide
cgcttcactccgtgctgcaggcagt

SEQ ID NO: 141288 - DNA, 25 bp, Artificial Sequence
  Description of Artificial Sequence: Synthetic oligonucleotide
gcttcactccgtgctgcaggcagtg

SEQ ID NO: 141289 - DNA, 25 bp, Artificial Sequence
  Description of Artificial Sequence: Synthetic oligonucleotide
cttcactccgtgctgcaggcagtgc

SEQ ID NO: 141290 - DNA, 25 bp, Artificial Sequence
  Description of Artificial Sequence: Synthetic oligonucleotide
ttcactccgtgctgcaggcagtgcc

SEQ ID NO: 141291 - DNA, 24 bp, Artificial Sequence
  Description of Artificial Sequence: Synthetic oligonucleotide
tcactccgtgctgcaggcagtgcc

SEQ ID NO: 141292 - DNA, 23 bp, Artificial Sequence
  Description of Artificial Sequence: Synthetic oligonucleotide
cactccgtgctgcaggcagtgcc

SEQ ID NO: 141293 - DNA, 23 bp, Artificial Sequence
  Description of Artificial Sequence: Synthetic oligonucleotide
actccgtgctgcaggcagtgccg

SEQ ID NO: 141294 - DNA, 22 bp, Artificial Sequence
  Description of Artificial Sequence: Synthetic oligonucleotide
ctccgtgctgcaggcagtgccg

SEQ ID NO: 141295 - DNA, 23 bp, Artificial Sequence
  Description of Artificial Sequence: Synthetic oligonucleotide
tccgtgctgcaggcagtgccgct

SEQ ID NO: 141296 - DNA, 22 bp, Artificial Sequence
  Description of Artificial Sequence: Synthetic oligonucleotide
ccgtgctgcaggcagtgccgct

SEQ ID NO: 141297 - DNA, 24 bp, Artificial Sequence
  Description of Artificial Sequence: Synthetic oligonucleotide
cgtgctgcaggcagtgccgctcaa

SEQ ID NO: 141298 - DNA, 24 bp, Artificial Sequence
  Description of Artificial Sequence: Synthetic oligonucleotide
gtgctgcaggcagtgccgctcaac

SEQ ID NO: 141299 - DNA, 25 bp, Artificial Sequence
  Description of Artificial Sequence: Synthetic oligonucleotide
tgctgcaggcagtgccgctcaacga

SEQ ID NO: 141300 - DNA, 24 bp, Artificial Sequence
  Description of Artificial Sequence: Synthetic oligonucleotide
gctgcaggcagtgccgctcaacga

SEQ ID NO: 141301 - DNA, 24 bp, Artificial Sequence
  Description of Artificial Sequence: Synthetic oligonucleotide
ctgcaggcagtgccgctcaacgag

SEQ ID NO: 141302 - DNA, 26 bp, Artificial Sequence
  Description of Artificial Sequence: Synthetic oligonucleotide
tgcaggcagtgccgctcaacgagctt

SEQ ID NO: 141303 - DNA, 25 bp, Artificial Sequence
  Description of Artificial Sequence: Synthetic oligonucleotide
gcaggcagtgccgctcaacgagctt

SEQ ID NO: 141304 - DNA, 25 bp, Artificial Sequence
  Description of Artificial Sequence: Synthetic oligonucleotide
caggcagtgccgctcaacgagcttc

SEQ ID NO: 141305 - DNA, 25 bp, Artificial Sequence
  Description of Artificial Sequence: Synthetic oligonucleotide
aggcagtgccgctcaacgagcttcg

SEQ ID NO: 141306 - DNA, 24 bp, Artificial Sequence
  Description of Artificial Sequence: Synthetic oligonucleotide
ggcagtgccgctcaacgagcttcg

SEQ ID NO: 141307 - DNA, 24 bp, Artificial Sequence
  Description of Artificial Sequence: Synthetic oligonucleotide
gcagtgccgctcaacgagcttcgc

SEQ ID NO: 141308 - DNA, 25 bp, Artificial Sequence
  Description of Artificial Sequence: Synthetic oligonucleotide
cagtgccgctcaacgagcttcgcca

SEQ ID NO: 141309 - DNA, 25 bp, Artificial Sequence
  Description of Artificial Sequence: Synthetic oligonucleotide
agtgccgctcaacgagcttcgccag

SEQ ID NO: 141310 - DNA, 24 bp, Artificial Sequence
  Description of Artificial Sequence: Synthetic oligonucleotide
gtgccgctcaacgagcttcgccag

SEQ ID NO: 141311 - DNA, 26 bp, Artificial Sequence
  Description of Artificial Sequence: Synthetic oligonucleotide
tgccgctcaacgagcttcgccagcaa

SEQ ID NO: 141312 - DNA, 25 bp, Artificial Sequence
  Description of Artificial Sequence: Synthetic oligonucleotide
gccgctcaacgagcttcgccagcaa

SEQ ID NO: 141313 - DNA, 25 bp, Artificial Sequence
  Description of Artificial Sequence: Synthetic oligonucleotide
ccgctcaacgagcttcgccagcaag

SEQ ID NO: 141314 - DNA, 25 bp, Artificial Sequence
  Description of Artificial Sequence: Synthetic oligonucleotide
cgctcaacgagcttcgccagcaagc

SEQ ID NO: 141315 - DNA, 25 bp, Artificial Sequence
  Description of Artificial Sequence: Synthetic oligonucleotide
gctcaacgagcttcgccagcaagcg

SEQ ID NO: 141316 - DNA, 25 bp, Artificial Sequence
  Description of Artificial Sequence: Synthetic oligonucleotide
ctcaacgagcttcgccagcaagcgg

SEQ ID NO: 141317 - DNA, 25 bp, Artificial Sequence
  Description of Artificial Sequence: Synthetic oligonucleotide
tcaacgagcttcgccagcaagcggc

SEQ ID NO: 141318 - DNA, 24 bp, Artificial Sequence
  Description of Artificial Sequence: Synthetic oligonucleotide
caacgagcttcgccagcaagcggc

SEQ ID NO: 141319 - DNA, 24 bp, Artificial Sequence
  Description of Artificial Sequence: Synthetic oligonucleotide
aacgagcttcgccagcaagcggcg

SEQ ID NO: 141320 - DNA, 23 bp, Artificial Sequence
  Description of Artificial Sequence: Synthetic oligonucleotide
acgagcttcgccagcaagcggcg

SEQ ID NO: 141321 - DNA, 22 bp, Artificial Sequence
  Description of Artificial Sequence: Synthetic oligonucleotide
cgagcttcgccagcaagcggcg

SEQ ID NO: 141322 - DNA, 23 bp, Artificial Sequence
  Description of Artificial Sequence: Synthetic oligonucleotide
gagcttcgccagcaagcggcgga

SEQ ID NO: 141323 - DNA, 23 bp, Artificial Sequence
  Description of Artificial Sequence: Synthetic oligonucleotide
agcttcgccagcaagcggcggag

SEQ ID NO: 141324 - DNA, 22 bp, Artificial Sequence
  Description of Artificial Sequence: Synthetic oligonucleotide
gcttcgccagcaagcggcggag

SEQ ID NO: 141325 - DNA, 23 bp, Artificial Sequence
  Description of Artificial Sequence: Synthetic oligonucleotide
cttcgccagcaagcggcggagct

SEQ ID NO: 141326 - DNA, 23 bp, Artificial Sequence
  Description of Artificial Sequence: Synthetic oligonucleotide
ttcgccagcaagcggcggagctg

SEQ ID NO: 141327 - DNA, 22 bp, Artificial Sequence
  Description of Artificial Sequence: Synthetic oligonucleotide
tcgccagcaagcggcggagctg

SEQ ID NO: 141328 - DNA, 21 bp, Artificial Sequence
  Description of Artificial Sequence: Synthetic oligonucleotide
cgccagcaagcggcggagctg

SEQ ID NO: 141329 - DNA, 21 bp, Artificial Sequence
  Description of Artificial Sequence: Synthetic oligonucleotide
gccagcaagcggcggagctgc

SEQ ID NO: 141330 - DNA, 21 bp, Artificial Sequence
  Description of Artificial Sequence: Synthetic oligonucleotide
ccagcaagcggcggagctgcg

SEQ ID NO: 141331 - DNA, 21 bp, Artificial Sequence
  Description of Artificial Sequence: Synthetic oligonucleotide
cagcaagcggcggagctgcgc

SEQ ID NO: 141332 - DNA, 22 bp, Artificial Sequence
  Description of Artificial Sequence: Synthetic oligonucleotide
agcaagcggcggagctgcgcct

SEQ ID NO: 141333 - DNA, 21 bp, Artificial Sequence
  Description of Artificial Sequence: Synthetic oligonucleotide
gcaagcggcggagctgcgcct

SEQ ID NO: 141334 - DNA, 21 bp, Artificial Sequence
  Description of Artificial Sequence: Synthetic oligonucleotide
caagcggcggagctgcgcctc

SEQ ID NO: 141335 - DNA, 21 bp, Artificial Sequence
  Description of Artificial Sequence: Synthetic oligonucleotide
aagcggcggagctgcgcctcg

SEQ ID NO: 141336 - DNA, 20 bp, Artificial Sequence
  Description of Artificial Sequence: Synthetic oligonucleotide
agcggcggagctgcgcctcg

SEQ ID NO: 141337 - DNA, 20 bp, Artificial Sequence
  Description of Artificial Sequence: Synthetic oligonucleotide
gcggcggagctgcgcctcgt

SEQ ID NO: 141338 - DNA, 20 bp, Artificial Sequence
  Description of Artificial Sequence: Synthetic oligonucleotide
cggcggagctgcgcctcggt

SEQ ID NO: 141339 - DNA, 20 bp, Artificial Sequence
  Description of Artificial Sequence: Synthetic oligonucleotide
ggcggagctgcgcctcggct

SEQ ID NO: 141340 - DNA, 20 bp, Artificial Sequence
  Description of Artificial Sequence: Synthetic oligonucleotide
gcggagctgcgcctcggcct

SEQ ID NO: 141341 - DNA, 20 bp, Artificial Sequence
  Description of Artificial Sequence: Synthetic oligonucleotide
cggagctgcgcctcggccct

SEQ ID NO: 141342 - DNA, 20 bp, Artificial Sequence
  Description of Artificial Sequence: Synthetic oligonucleotide
ggagctgcgcctcggcccgt

SEQ ID NO: 141343 - DNA, 20 bp, Artificial Sequence
  Description of Artificial Sequence: Synthetic oligonucleotide
gagctgcgcctcggcccgct

SEQ ID NO: 141344 - DNA, 22 bp, Artificial Sequence
  Description of Artificial Sequence: Synthetic oligonucleotide
agctgcgcctcggcccgctctt

SEQ ID NO: 141345 - DNA, 21 bp, Artificial Sequence
  Description of Artificial Sequence: Synthetic oligonucleotide
gctgcgcctcggcccgctctt

SEQ ID NO: 141346 - DNA, 22 bp, Artificial Sequence
  Description of Artificial Sequence: Synthetic oligonucleotide
ctgcgcctcggcccgctcttct

SEQ ID NO: 141347 - DNA, 22 bp, Artificial Sequence
  Description of Artificial Sequence: Synthetic oligonucleotide
tgcgcctcggcccgctcttctc

SEQ ID NO: 141348 - DNA, 21 bp, Artificial Sequence
  Description of Artificial Sequence: Synthetic oligonucleotide
gcgcctcggcccgctcttctc

SEQ ID NO: 141349 - DNA, 21 bp, Artificial Sequence
  Description of Artificial Sequence: Synthetic oligonucleotide
cgcctcggcccgctcttctcc

SEQ ID NO: 141350 - DNA, 22 bp, Artificial Sequence
  Description of Artificial Sequence: Synthetic oligonucleotide
gcctcggcccgctcttctccct

SEQ ID NO: 141351 - DNA, 22 bp, Artificial Sequence
  Description of Artificial Sequence: Synthetic oligonucleotide
cctcggcccgctcttctccctg

SEQ ID NO: 141352 - DNA, 26 bp, Artificial Sequence
  Description of Artificial Sequence: Synthetic oligonucleotide
ctcggcccgctcttctccctgcttaa

SEQ ID NO: 141353 - DNA, 26 bp, Artificial Sequence
  Description of Artificial Sequence: Synthetic oligonucleotide
tcggcccgctcttctccctgcttaac

SEQ ID NO: 141354 - DNA, 25 bp, Artificial Sequence
  Description of Artificial Sequence: Synthetic oligonucleotide
cggcccgctcttctccctgcttaac

SEQ ID NO: 141355 - DNA, 26 bp, Artificial Sequence
  Description of Artificial Sequence: Synthetic oligonucleotide
ggcccgctcttctccctgcttaacga

SEQ ID NO: 141356 - DNA, 27 bp, Artificial Sequence
  Description of Artificial Sequence: Synthetic oligonucleotide
gcccgctcttctccctgcttaacgaga

SEQ ID NO: 141357 - DNA, 28 bp, Artificial Sequence
  Description of Artificial Sequence: Synthetic oligonucleotide
cccgctcttctccctgcttaacgagaac

SEQ ID NO: 141358 - DNA, 28 bp, Artificial Sequence
  Description of Artificial Sequence: Synthetic oligonucleotide
ccgctcttctccctgcttaacgagaacc

SEQ ID NO: 141359 - DNA, 31 bp, Artificial Sequence
  Description of Artificial Sequence: Synthetic oligonucleotide
cgctcttctccctgcttaacgagaaccatag

SEQ ID NO: 141360 - DNA, 31 bp, Artificial Sequence
  Description of Artificial Sequence: Synthetic oligonucleotide
gctcttctccctgcttaacgagaaccatagg

SEQ ID NO: 141361 - DNA, 31 bp, Artificial Sequence
  Description of Artificial Sequence: Synthetic oligonucleotide
ctcttctccctgcttaacgagaaccataggg

SEQ ID NO: 141362 - DNA, 35 bp, Artificial Sequence
  Description of Artificial Sequence: Synthetic oligonucleotide
tcttctccctgcttaacgagaaccatagggaaaag

SEQ ID NO: 141363 - DNA, 34 bp, Artificial Sequence
  Description of Artificial Sequence: Synthetic oligonucleotide
cttctccctgcttaacgagaaccatagggaaaag

SEQ ID NO: 141364 - DNA, 35 bp, Artificial Sequence
  Description of Artificial Sequence: Synthetic oligonucleotide
ttctccctgcttaacgagaaccatagggaaaagac

SEQ ID NO: 141365 - DNA, 34 bp, Artificial Sequence
  Description of Artificial Sequence: Synthetic oligonucleotide
tctccctgcttaacgagaaccatagggaaaagac

SEQ ID NO: 141366 - DNA, 33 bp, Artificial Sequence
  Description of Artificial Sequence: Synthetic oligonucleotide
ctccctgcttaacgagaaccatagggaaaagac

SEQ ID NO: 141367 - DNA, 35 bp, Artificial Sequence
  Description of Artificial Sequence: Synthetic oligonucleotide
tccctgcttaacgagaaccatagggaaaagactac

SEQ ID NO: 141368 - DNA, 34 bp, Artificial Sequence
  Description of Artificial Sequence: Synthetic oligonucleotide
ccctgcttaacgagaaccatagggaaaagactac

SEQ ID NO: 141369 - DNA, 37 bp, Artificial Sequence
  Description of Artificial Sequence: Synthetic oligonucleotide
cctgcttaacgagaaccatagggaaaagactactttg

SEQ ID NO: 141370 - DNA, 38 bp, Artificial Sequence
  Description of Artificial Sequence: Synthetic oligonucleotide
ctgcttaacgagaaccatagggaaaagactactttgtg

SEQ ID NO: 141371 - DNA, 39 bp, Artificial Sequence
  Description of Artificial Sequence: Synthetic oligonucleotide
tgcttaacgagaaccatagggaaaagactactttgtgtg

SEQ ID NO: 141372 - DNA, 38 bp, Artificial Sequence
  Description of Artificial Sequence: Synthetic oligonucleotide
gcttaacgagaaccatagggaaaagactactttgtgtg

SEQ ID NO: 141373 - DNA, 41 bp, Artificial Sequence
  Description of Artificial Sequence: Synthetic oligonucleotide
cttaacgagaaccatagggaaaagactactttgtgtgtatc

SEQ ID NO: 141374 - DNA, 41 bp, Artificial Sequence
  Description of Artificial Sequence: Synthetic oligonucleotide
ttaacgagaaccatagggaaaagactactttgtgtgtatcc

SEQ ID NO: 141375 - DNA, 40 bp, Artificial Sequence
  Description of Artificial Sequence: Synthetic oligonucleotide
taacgagaaccatagggaaaagactactttgtgtgtatcc

SEQ ID NO: 141376 - DNA, 39 bp, Artificial Sequence
  Description of Artificial Sequence: Synthetic oligonucleotide
aacgagaaccatagggaaaagactactttgtgtgtatcc

SEQ ID NO: 141377 - DNA, 38 bp, Artificial Sequence
  Description of Artificial Sequence: Synthetic oligonucleotide
acgagaaccatagggaaaagactactttgtgtgtatcc

SEQ ID NO: 141378 - DNA, 37 bp, Artificial Sequence
  Description of Artificial Sequence: Synthetic oligonucleotide
cgagaaccatagggaaaagactactttgtgtgtatcc

SEQ ID NO: 141379 - DNA, 40 bp, Artificial Sequence
  Description of Artificial Sequence: Synthetic oligonucleotide
gagaaccatagggaaaagactactttgtgtgtatccattc

SEQ ID NO: 141380 - DNA, 41 bp, Artificial Sequence
  Description of Artificial Sequence: Synthetic oligonucleotide
agaaccatagggaaaagactactttgtgtgtatccattctg

SEQ ID NO: 141381 - DNA, 40 bp, Artificial Sequence
  Description of Artificial Sequence: Synthetic oligonucleotide
gaaccatagggaaaagactactttgtgtgtatccattctg

SEQ ID NO: 141382 - DNA, 40 bp, Artificial Sequence
  Description of Artificial Sequence: Synthetic oligonucleotide
aaccatagggaaaagactactttgtgtgtatccattctgg

SEQ ID NO: 141383 - DNA, 39 bp, Artificial Sequence
  Description of Artificial Sequence: Synthetic oligonucleotide
accatagggaaaagactactttgtgtgtatccattctgg

SEQ ID NO: 141384 - DNA, 38 bp, Artificial Sequence
  Description of Artificial Sequence: Synthetic oligonucleotide
ccatagggaaaagactactttgtgtgtatccattctgg

SEQ ID NO: 141385 - DNA, 39 bp, Artificial Sequence
  Description of Artificial Sequence: Synthetic oligonucleotide
catagggaaaagactactttgtgtgtatccattctggag

SEQ ID NO: 141386 - DNA, 40 bp, Artificial Sequence
  Description of Artificial Sequence: Synthetic oligonucleotide
atagggaaaagactactttgtgtgtatccattctggagag

SEQ ID NO: 141387 - DNA, 39 bp, Artificial Sequence
  Description of Artificial Sequence: Synthetic oligonucleotide
tagggaaaagactactttgtgtgtatccattctggagag

SEQ ID NO: 141388 - DNA, 38 bp, Artificial Sequence
  Description of Artificial Sequence: Synthetic oligonucleotide
agggaaaagactactttgtgtgtatccattctggagag

SEQ ID NO: 141389 - DNA, 37 bp, Artificial Sequence
  Description of Artificial Sequence: Synthetic oligonucleotide
gggaaaagactactttgtgtgtatccattctggagag

SEQ ID NO: 141390 - DNA, 40 bp, Artificial Sequence
  Description of Artificial Sequence: Synthetic oligonucleotide
ggaaaagactactttgtgtgtatccattctggagagattg

SEQ ID NO: 141391 - DNA, 40 bp, Artificial Sequence
  Description of Artificial Sequence: Synthetic oligonucleotide
gaaaagactactttgtgtgtatccattctggagagattgc

SEQ ID NO: 141392 - DNA, 41 bp, Artificial Sequence
  Description of Artificial Sequence: Synthetic oligonucleotide
aaaagactactttgtgtgtatccattctggagagattgctc

SEQ ID NO: 141393 - DNA, 40 bp, Artificial Sequence
  Description of Artificial Sequence: Synthetic oligonucleotide
aaagactactttgtgtgtatccattctggagagattgctc

SEQ ID NO: 141394 - DNA, 39 bp, Artificial Sequence
  Description of Artificial Sequence: Synthetic oligonucleotide
aagactactttgtgtgtatccattctggagagattgctc

SEQ ID NO: 141395 - DNA, 38 bp, Artificial Sequence
  Description of Artificial Sequence: Synthetic oligonucleotide
agactactttgtgtgtatccattctggagagattgctc

SEQ ID NO: 141396 - DNA, 37 bp, Artificial Sequence
  Description of Artificial Sequence: Synthetic oligonucleotide
gactactttgtgtgtatccattctggagagattgctc

SEQ ID NO: 141397 - DNA, 37 bp, Artificial Sequence
  Description of Artificial Sequence: Synthetic oligonucleotide
actactttgtgtgtatccattctggagagattgctcc

SEQ ID NO: 141398 - DNA, 36 bp, Artificial Sequence
  Description of Artificial Sequence: Synthetic oligonucleotide
ctactttgtgtgtatccattctggagagattgctcc

SEQ ID NO: 141399 - DNA, 38 bp, Artificial Sequence
  Description of Artificial Sequence: Synthetic oligonucleotide
tactttgtgtgtatccattctggagagattgctccaag

SEQ ID NO: 141400 - DNA, 37 bp, Artificial Sequence
  Description of Artificial Sequence: Synthetic oligonucleotide
actttgtgtgtatccattctggagagattgctccaag

SEQ ID NO: 141401 - DNA, 36 bp, Artificial Sequence
  Description of Artificial Sequence: Synthetic oligonucleotide
ctttgtgtgtatccattctggagagattgctccaag

SEQ ID NO: 141402 - DNA, 36 bp, Artificial Sequence
  Description of Artificial Sequence: Synthetic oligonucleotide
tttgtgtgtatccattctggagagattgctccaagc

SEQ ID NO: 141403 - DNA, 35 bp, Artificial Sequence
  Description of Artificial Sequence: Synthetic oligonucleotide
ttgtgtgtatccattctggagagattgctccaagc

SEQ ID NO: 141404 - DNA, 34 bp, Artificial Sequence
  Description of Artificial Sequence: Synthetic oligonucleotide
tgtgtgtatccattctggagagattgctccaagc

SEQ ID NO: 141405 - DNA, 33 bp, Artificial Sequence
  Description of Artificial Sequence: Synthetic oligonucleotide
gtgtgtatccattctggagagattgctccaagc

SEQ ID NO: 141406 - DNA, 36 bp, Artificial Sequence
  Description of Artificial Sequence: Synthetic oligonucleotide
tgtgtatccattctggagagattgctccaagctatg

SEQ ID NO: 141407 - DNA, 35 bp, Artificial Sequence
  Description of Artificial Sequence: Synthetic oligonucleotide
gtgtatccattctggagagattgctccaagctatg

SEQ ID NO: 141408 - DNA, 35 bp, Artificial Sequence
  Description of Artificial Sequence: Synthetic oligonucleotide
tgtatccattctggagagattgctccaagctatgg

SEQ ID NO: 141409 - DNA, 34 bp, Artificial Sequence
  Description of Artificial Sequence: Synthetic oligonucleotide
gtatccattctggagagattgctccaagctatgg

SEQ ID NO: 141410 - DNA, 36 bp, Artificial Sequence
  Description of Artificial Sequence: Synthetic oligonucleotide
tatccattctggagagattgctccaagctatggaac

SEQ ID NO: 141411 - DNA, 35 bp, Artificial Sequence
  Description of Artificial Sequence: Synthetic oligonucleotide
atccattctggagagattgctccaagctatggaac

SEQ ID NO: 141412 - DNA, 34 bp, Artificial Sequence
  Description of Artificial Sequence: Synthetic oligonucleotide
tccattctggagagattgctccaagctatggaac

SEQ ID NO: 141413 - DNA, 33 bp, Artificial Sequence
  Description of Artificial Sequence: Synthetic oligonucleotide
ccattctggagagattgctccaagctatggaac

SEQ ID NO: 141414 - DNA, 33 bp, Artificial Sequence
  Description of Artificial Sequence: Synthetic oligonucleotide
cattctggagagattgctccaagctatggaacc

SEQ ID NO: 141415 - DNA, 33 bp, Artificial Sequence
  Description of Artificial Sequence: Synthetic oligonucleotide
attctggagagattgctccaagctatggaaccg

SEQ ID NO: 141416 - DNA, 32 bp, Artificial Sequence
  Description of Artificial Sequence: Synthetic oligonucleotide
ttctggagagattgctccaagctatggaaccg

SEQ ID NO: 141417 - DNA, 31 bp, Artificial Sequence
  Description of Artificial Sequence: Synthetic oligonucleotide
tctggagagattgctccaagctatggaaccg

SEQ ID NO: 141418 - DNA, 30 bp, Artificial Sequence
  Description of Artificial Sequence: Synthetic oligonucleotide
ctggagagattgctccaagctatggaaccg

SEQ ID NO: 141419 - DNA, 30 bp, Artificial Sequence
  Description of Artificial Sequence: Synthetic oligonucleotide
tggagagattgctccaagctatggaaccgg

SEQ ID NO: 141420 - DNA, 29 bp, Artificial Sequence
  Description of Artificial Sequence: Synthetic oligonucleotide
ggagagattgctccaagctatggaaccgg

SEQ ID NO: 141421 - DNA, 31 bp, Artificial Sequence
  Description of Artificial Sequence: Synthetic oligonucleotide
gagagattgctccaagctatggaaccggttc

SEQ ID NO: 141422 - DNA, 32 bp, Artificial Sequence
  Description of Artificial Sequence: Synthetic oligonucleotide
agagattgctccaagctatggaaccggttcac

SEQ ID NO: 141423 - DNA, 31 bp, Artificial Sequence
  Description of Artificial Sequence: Synthetic oligonucleotide
gagattgctccaagctatggaaccggttcac

SEQ ID NO: 141424 - DNA, 31 bp, Artificial Sequence
  Description of Artificial Sequence: Synthetic oligonucleotide
agattgctccaagctatggaaccggttcacg

SEQ ID NO: 141425 - DNA, 30 bp, Artificial Sequence
  Description of Artificial Sequence: Synthetic oligonucleotide
gattgctccaagctatggaaccggttcacg

SEQ ID NO: 141426 - DNA, 31 bp, Artificial Sequence
  Description of Artificial Sequence: Synthetic oligonucleotide
attgctccaagctatggaaccggttcacgtg

SEQ ID NO: 141427 - DNA, 30 bp, Artificial Sequence
  Description of Artificial Sequence: Synthetic oligonucleotide
ttgctccaagctatggaaccggttcacgtg

SEQ ID NO: 141428 - DNA, 29 bp, Artificial Sequence
  Description of Artificial Sequence: Synthetic oligonucleotide
tgctccaagctatggaaccggttcacgtg

SEQ ID NO: 141429 - DNA, 28 bp, Artificial Sequence
  Description of Artificial Sequence: Synthetic oligonucleotide
gctccaagctatggaaccggttcacgtg

SEQ ID NO: 141430 - DNA, 28 bp, Artificial Sequence
  Description of Artificial Sequence: Synthetic oligonucleotide
ctccaagctatggaaccggttcacgtgg

SEQ ID NO: 141431 - DNA, 28 bp, Artificial Sequence
  Description of Artificial Sequence: Synthetic oligonucleotide
tccaagctatggaaccggttcacgtggc

SEQ ID NO: 141432 - DNA, 27 bp, Artificial Sequence
  Description of Artificial Sequence: Synthetic oligonucleotide
ccaagctatggaaccggttcacgtggc

SEQ ID NO: 141433 - DNA, 27 bp, Artificial Sequence
  Description of Artificial Sequence: Synthetic oligonucleotide
caagctatggaaccggttcacgtggcc

SEQ ID NO: 141434 - DNA, 27 bp, Artificial Sequence
  Description of Artificial Sequence: Synthetic oligonucleotide
aagctatggaaccggttcacgtggccc

SEQ ID NO: 141435 - DNA, 26 bp, Artificial Sequence
  Description of Artificial Sequence: Synthetic oligonucleotide
agctatggaaccggttcacgtggccc

SEQ ID NO: 141436 - DNA, 25 bp, Artificial Sequence
  Description of Artificial Sequence: Synthetic oligonucleotide
gctatggaaccggttcacgtggccc

SEQ ID NO: 141437 - DNA, 25 bp, Artificial Sequence
  Description of Artificial Sequence: Synthetic oligonucleotide
ctatggaaccggttcacgtggcccg

SEQ ID NO: 141438 - DNA, 27 bp, Artificial Sequence
  Description of Artificial Sequence: Synthetic oligonucleotide
tatggaaccggttcacgtggcccggaa

SEQ ID NO: 141439 - DNA, 26 bp, Artificial Sequence
  Description of Artificial Sequence: Synthetic oligonucleotide
atggaaccggttcacgtggcccggaa

SEQ ID NO: 141440 - DNA, 25 bp, Artificial Sequence
  Description of Artificial Sequence: Synthetic oligonucleotide
tggaaccggttcacgtggcccggaa

SEQ ID NO: 141441 - DNA, 24 bp, Artificial Sequence
  Description of Artificial Sequence: Synthetic oligonucleotide
ggaaccggttcacgtggcccggaa

SEQ ID NO: 141442 - DNA, 24 bp, Artificial Sequence
  Description of Artificial Sequence: Synthetic oligonucleotide
gaaccggttcacgtggcccggaac

SEQ ID NO: 141443 - DNA, 25 bp, Artificial Sequence
  Description of Artificial Sequence: Synthetic oligonucleotide
aaccggttcacgtggcccggaacct

SEQ ID NO: 141444 - DNA, 24 bp, Artificial Sequence
  Description of Artificial Sequence: Synthetic oligonucleotide
accggttcacgtggcccggaacct

SEQ ID NO: 141445 - DNA, 23 bp, Artificial Sequence
  Description of Artificial Sequence: Synthetic oligonucleotide
ccggttcacgtggcccggaacct

SEQ ID NO: 141446 - DNA, 24 bp, Artificial Sequence
  Description of Artificial Sequence: Synthetic oligonucleotide
cggttcacgtggcccggaacctca

SEQ ID NO: 141447 - DNA, 24 bp, Artificial Sequence
  Description of Artificial Sequence: Synthetic oligonucleotide
ggttcacgtggcccggaacctcag

SEQ ID NO: 141448 - DNA, 24 bp, Artificial Sequence
  Description of Artificial Sequence: Synthetic oligonucleotide
gttcacgtggcccggaacctcagg

SEQ ID NO: 141449 - DNA, 26 bp, Artificial Sequence
  Description of Artificial Sequence: Synthetic oligonucleotide
ttcacgtggcccggaacctcagggtt

SEQ ID NO: 141450 - DNA, 25 bp, Artificial Sequence
  Description of Artificial Sequence: Synthetic oligonucleotide
tcacgtggcccggaacctcagggtt

SEQ ID NO: 141451 - DNA, 24 bp, Artificial Sequence
  Description of Artificial Sequence: Synthetic oligonucleotide
cacgtggcccggaacctcagggtt

SEQ ID NO: 141452 - DNA, 25 bp, Artificial Sequence
  Description of Artificial Sequence: Synthetic oligonucleotide
acgtggcccggaacctcagggttga

SEQ ID NO: 141453 - DNA, 24 bp, Artificial Sequence
  Description of Artificial Sequence: Synthetic oligonucleotide
cgtggcccggaacctcagggttga

SEQ ID NO: 141454 - DNA, 24 bp, Artificial Sequence
  Description of Artificial Sequence: Synthetic oligonucleotide
gtggcccggaacctcagggttgac

SEQ ID NO: 141455 - DNA, 25 bp, Artificial Sequence
  Description of Artificial Sequence: Synthetic oligonucleotide
tggcccggaacctcagggttgacct

SEQ ID NO: 141456 - DNA, 24 bp, Artificial Sequence
  Description of Artificial Sequence: Synthetic oligonucleotide
ggcccggaacctcagggttgacct

SEQ ID NO: 141457 - DNA, 24 bp, Artificial Sequence
  Description of Artificial Sequence: Synthetic oligonucleotide
gcccggaacctcagggttgacctg

SEQ ID NO: 141458 - DNA, 25 bp, Artificial Sequence
  Description of Artificial Sequence: Synthetic oligonucleotide
cccggaacctcagggttgacctgca

SEQ ID NO: 141459 - DNA, 26 bp, Artificial Sequence
  Description of Artificial Sequence: Synthetic oligonucleotide
ccggaacctcagggttgacctgcaga

SEQ ID NO: 141460 - DNA, 26 bp, Artificial Sequence
  Description of Artificial Sequence: Synthetic oligonucleotide
cggaacctcagggttgacctgcagag

SEQ ID NO: 141461 - DNA, 26 bp, Artificial Sequence
  Description of Artificial Sequence: Synthetic oligonucleotide
ggaacctcagggttgacctgcagagg

SEQ ID NO: 141462 - DNA, 26 bp, Artificial Sequence
  Description of Artificial Sequence: Synthetic oligonucleotide
gaacctcagggttgacctgcagaggg

SEQ ID NO: 141463 - DNA, 27 bp, Artificial Sequence
  Description of Artificial Sequence: Synthetic oligonucleotide
aacctcagggttgacctgcagagggga

SEQ ID NO: 141464 - DNA, 26 bp, Artificial Sequence
  Description of Artificial Sequence: Synthetic oligonucleotide
acctcagggttgacctgcagagggga

SEQ ID NO: 141465 - DNA, 25 bp, Artificial Sequence
  Description of Artificial Sequence: Synthetic oligonucleotide
cctcagggttgacctgcagagggga

SEQ ID NO: 141466 - DNA, 27 bp, Artificial Sequence
  Description of Artificial Sequence: Synthetic oligonucleotide
ctcagggttgacctgcagaggggacta

SEQ ID NO: 141467 - DNA, 30 bp, Artificial Sequence
  Description of Artificial Sequence: Synthetic oligonucleotide
tcagggttgacctgcagaggggactaattc

SEQ ID NO: 141468 - DNA, 29 bp, Artificial Sequence
  Description of Artificial Sequence: Synthetic oligonucleotide
cagggttgacctgcagaggggactaattc

SEQ ID NO: 141469 - DNA, 30 bp, Artificial Sequence
  Description of Artificial Sequence: Synthetic oligonucleotide
agggttgacctgcagaggggactaattcac

SEQ ID NO: 141470 - DNA, 29 bp, Artificial Sequence
  Description of Artificial Sequence: Synthetic oligonucleotide
gggttgacctgcagaggggactaattcac

SEQ ID NO: 141471 - DNA, 29 bp, Artificial Sequence
  Description of Artificial Sequence: Synthetic oligonucleotide
ggttgacctgcagaggggactaattcacc

SEQ ID NO: 141472 - DNA, 29 bp, Artificial Sequence
  Description of Artificial Sequence: Synthetic oligonucleotide
gttgacctgcagaggggactaattcaccc

SEQ ID NO: 141473 - DNA, 30 bp, Artificial Sequence
  Description of Artificial Sequence: Synthetic oligonucleotide
ttgacctgcagaggggactaattcaccctg

SEQ ID NO: 141474 - DNA, 29 bp, Artificial Sequence
  Description of Artificial Sequence: Synthetic oligonucleotide
tgacctgcagaggggactaattcaccctg

SEQ ID NO: 141475 - DNA, 28 bp, Artificial Sequence
  Description of Artificial Sequence: Synthetic oligonucleotide
gacctgcagaggggactaattcaccctg

SEQ ID NO: 141476 - DNA, 30 bp, Artificial Sequence
  Description of Artificial Sequence: Synthetic oligonucleotide
acctgcagaggggactaattcaccctgatg

SEQ ID NO: 141477 - DNA, 29 bp, Artificial Sequence
  Description of Artificial Sequence: Synthetic oligonucleotide
cctgcagaggggactaattcaccctgatg

SEQ ID NO: 141478 - DNA, 32 bp, Artificial Sequence
  Description of Artificial Sequence: Synthetic oligonucleotide
ctgcagaggggactaattcaccctgatgattc

SEQ ID NO: 141479 - DNA, 33 bp, Artificial Sequence
  Description of Artificial Sequence: Synthetic oligonucleotide
tgcagaggggactaattcaccctgatgattctg

SEQ ID NO: 141480 - DNA, 32 bp, Artificial Sequence
  Description of Artificial Sequence: Synthetic oligonucleotide
gcagaggggactaattcaccctgatgattctg

SEQ ID NO: 141481 - DNA, 39 bp, Artificial Sequence
  Description of Artificial Sequence: Synthetic oligonucleotide
cagaggggactaattcaccctgatgattctgtaaaaatc

SEQ ID NO: 141482 - DNA, 39 bp, Artificial Sequence
  Description of Artificial Sequence: Synthetic oligonucleotide
agaggggactaattcaccctgatgattctgtaaaaatcc

SEQ ID NO: 141483 - DNA, 38 bp, Artificial Sequence
  Description of Artificial Sequence: Synthetic oligonucleotide
gaggggactaattcaccctgatgattctgtaaaaatcc

SEQ ID NO: 141484 - DNA, 39 bp, Artificial Sequence
  Description of Artificial Sequence: Synthetic oligonucleotide
aggggactaattcaccctgatgattctgtaaaaatcctc

SEQ ID NO: 141485 - DNA, 38 bp, Artificial Sequence
  Description of Artificial Sequence: Synthetic oligonucleotide
ggggactaattcaccctgatgattctgtaaaaatcctc

SEQ ID NO: 141486 - DNA, 39 bp, Artificial Sequence
  Description of Artificial Sequence: Synthetic oligonucleotide
gggactaattcaccctgatgattctgtaaaaatcctcac

SEQ ID NO: 141487 - DNA, 40 bp, Artificial Sequence
  Description of Artificial Sequence: Synthetic oligonucleotide
ggactaattcaccctgatgattctgtaaaaatcctcactc

SEQ ID NO: 141488 - DNA, 43 bp, Artificial Sequence
  Description of Artificial Sequence: Synthetic oligonucleotide
gactaattcaccctgatgattctgtaaaaatcctcactctttc

SEQ ID NO: 141489 - DNA, 43 bp, Artificial Sequence
  Description of Artificial Sequence: Synthetic oligonucleotide
actaattcaccctgatgattctgtaaaaatcctcactctttcc

SEQ ID NO: 141490 - DNA, 42 bp, Artificial Sequence
  Description of Artificial Sequence: Synthetic oligonucleotide
ctaattcaccctgatgattctgtaaaaatcctcactctttcc

SEQ ID NO: 141491 - DNA, 42 bp, Artificial Sequence
  Description of Artificial Sequence: Synthetic oligonucleotide
taattcaccctgatgattctgtaaaaatcctcactctttccc

SEQ ID NO: 141492 - DNA, 41 bp, Artificial Sequence
  Description of Artificial Sequence: Synthetic oligonucleotide
aattcaccctgatgattctgtaaaaatcctcactctttccc

SEQ ID NO: 141493 - DNA, 40 bp, Artificial Sequence
  Description of Artificial Sequence: Synthetic oligonucleotide
attcaccctgatgattctgtaaaaatcctcactctttccc

SEQ ID NO: 141494 - DNA, 39 bp, Artificial Sequence
  Description of Artificial Sequence: Synthetic oligonucleotide
ttcaccctgatgattctgtaaaaatcctcactctttccc

SEQ ID NO: 141495 - DNA, 38 bp, Artificial Sequence
  Description of Artificial Sequence: Synthetic oligonucleotide
tcaccctgatgattctgtaaaaatcctcactctttccc

SEQ ID NO: 141496 - DNA, 37 bp, Artificial Sequence
  Description of Artificial Sequence: Synthetic oligonucleotide
caccctgatgattctgtaaaaatcctcactctttccc

SEQ ID NO: 141497 - DNA, 38 bp, Artificial Sequence
  Description of Artificial Sequence: Synthetic oligonucleotide
accctgatgattctgtaaaaatcctcactctttcccag

SEQ ID NO: 141498 - DNA, 37 bp, Artificial Sequence
  Description of Artificial Sequence: Synthetic oligonucleotide
ccctgatgattctgtaaaaatcctcactctttcccag

SEQ ID NO: 141499 - DNA, 40 bp, Artificial Sequence
  Description of Artificial Sequence: Synthetic oligonucleotide
cctgatgattctgtaaaaatcctcactctttcccagattg

SEQ ID NO: 141500 - DNA, 40 bp, Artificial Sequence
  Description of Artificial Sequence: Synthetic oligonucleotide
ctgatgattctgtaaaaatcctcactctttcccagattgg

SEQ ID NO: 141501 - DNA, 42 bp, Artificial Sequence
  Description of Artificial Sequence: Synthetic oligonucleotide
tgatgattctgtaaaaatcctcactctttcccagattggaag

SEQ ID NO: 141502 - DNA, 41 bp, Artificial Sequence
  Description of Artificial Sequence: Synthetic oligonucleotide
gatgattctgtaaaaatcctcactctttcccagattggaag

SEQ ID NO: 141503 - DNA, 45 bp, Artificial Sequence
  Description of Artificial Sequence: Synthetic oligonucleotide
atgattctgtaaaaatcctcactctttcccagattggaagaattg

SEQ ID NO: 141504 - DNA, 44 bp, Artificial Sequence
  Description of Artificial Sequence: Synthetic oligonucleotide
tgattctgtaaaaatcctcactctttcccagattggaagaattg

SEQ ID NO: 141505 - DNA, 43 bp, Artificial Sequence
  Description of Artificial Sequence: Synthetic oligonucleotide
gattctgtaaaaatcctcactctttcccagattggaagaattg

SEQ ID NO: 141506 - DNA, 45 bp, Artificial Sequence
  Description of Artificial Sequence: Synthetic oligonucleotide
attctgtaaaaatcctcactctttcccagattggaagaattgttg

SEQ ID NO: 141507 - DNA, 44 bp, Artificial Sequence
  Description of Artificial Sequence: Synthetic oligonucleotide
ttctgtaaaaatcctcactctttcccagattggaagaattgttg

SEQ ID NO: 141508 - DNA, 43 bp, Artificial Sequence
  Description of Artificial Sequence: Synthetic oligonucleotide
tctgtaaaaatcctcactctttcccagattggaagaattgttg

SEQ ID NO: 141509 - DNA, 42 bp, Artificial Sequence
  Description of Artificial Sequence: Synthetic oligonucleotide
ctgtaaaaatcctcactctttcccagattggaagaattgttg

SEQ ID NO: 141510 - DNA, 48 bp, Artificial Sequence
  Description of Artificial Sequence: Synthetic oligonucleotide
tgtaaaaatcctcactctttcccagattggaagaattgttgaaaattc

SEQ ID NO: 141511 - DNA, 47 bp, Artificial Sequence
  Description of Artificial Sequence: Synthetic oligonucleotide
gtaaaaatcctcactctttcccagattggaagaattgttgaaaattc

SEQ ID NO: 141512 - DNA, 48 bp, Artificial Sequence
  Description of Artificial Sequence: Synthetic oligonucleotide
taaaaatcctcactctttcccagattggaagaattgttgaaaattctg

SEQ ID NO: 141513 - DNA, 47 bp, Artificial Sequence
  Description of Artificial Sequence: Synthetic oligonucleotide
aaaaatcctcactctttcccagattggaagaattgttgaaaattctg

SEQ ID NO: 141514 - DNA, 46 bp, Artificial Sequence
  Description of Artificial Sequence: Synthetic oligonucleotide
aaaatcctcactctttcccagattggaagaattgttgaaaattctg

SEQ ID NO: 141515 - DNA, 45 bp, Artificial Sequence
  Description of Artificial Sequence: Synthetic oligonucleotide
aaatcctcactctttcccagattggaagaattgttgaaaattctg

SEQ ID NO: 141516 - DNA, 44 bp, Artificial Sequence
  Description of Artificial Sequence: Synthetic oligonucleotide
aatcctcactctttcccagattggaagaattgttgaaaattctg

SEQ ID NO: 141517 - DNA, 43 bp, Artificial Sequence
  Description of Artificial Sequence: Synthetic oligonucleotide
atcctcactctttcccagattggaagaattgttgaaaattctg

SEQ ID NO: 141518 - DNA, 42 bp, Artificial Sequence
  Description of Artificial Sequence: Synthetic oligonucleotide
tcctcactctttcccagattggaagaattgttgaaaattctg

SEQ ID NO: 141519 - DNA, 41 bp, Artificial Sequence
  Description of Artificial Sequence: Synthetic oligonucleotide
cctcactctttcccagattggaagaattgttgaaaattctg

SEQ ID NO: 141520 - DNA, 43 bp, Artificial Sequence
  Description of Artificial Sequence: Synthetic oligonucleotide
ctcactctttcccagattggaagaattgttgaaaattctgatg

SEQ ID NO: 141521 - DNA, 43 bp, Artificial Sequence
  Description of Artificial Sequence: Synthetic oligonucleotide
tcactctttcccagattggaagaattgttgaaaattctgatgc

SEQ ID NO: 141522 - DNA, 42 bp, Artificial Sequence
  Description of Artificial Sequence: Synthetic oligonucleotide
cactctttcccagattggaagaattgttgaaaattctgatgc

SEQ ID NO: 141523 - DNA, 43 bp, Artificial Sequence
  Description of Artificial Sequence: Synthetic oligonucleotide
actctttcccagattggaagaattgttgaaaattctgatgctg

SEQ ID NO: 141524 - DNA, 42 bp, Artificial Sequence
  Description of Artificial Sequence: Synthetic oligonucleotide
ctctttcccagattggaagaattgttgaaaattctgatgctg

SEQ ID NO: 141525 - DNA, 45 bp, Artificial Sequence
  Description of Artificial Sequence: Synthetic oligonucleotide
tctttcccagattggaagaattgttgaaaattctgatgctgttac

SEQ ID NO: 141526 - DNA, 44 bp, Artificial Sequence
  Description of Artificial Sequence: Synthetic oligonucleotide
ctttcccagattggaagaattgttgaaaattctgatgctgttac

SEQ ID NO: 141527 - DNA, 45 bp, Artificial Sequence
  Description of Artificial Sequence: Synthetic oligonucleotide
tttcccagattggaagaattgttgaaaattctgatgctgttactg

SEQ ID NO: 141528 - DNA, 44 bp, Artificial Sequence
  Description of Artificial Sequence: Synthetic oligonucleotide
ttcccagattggaagaattgttgaaaattctgatgctgttactg

SEQ ID NO: 141529 - DNA, 43 bp, Artificial Sequence
  Description of Artificial Sequence: Synthetic oligonucleotide
tcccagattggaagaattgttgaaaattctgatgctgttactg

SEQ ID NO: 141530 - DNA, 42 bp, Artificial Sequence
  Description of Artificial Sequence: Synthetic oligonucleotide
cccagattggaagaattgttgaaaattctgatgctgttactg

SEQ ID NO: 141531 - DNA, 43 bp, Artificial Sequence
  Description of Artificial Sequence: Synthetic oligonucleotide
ccagattggaagaattgttgaaaattctgatgctgttactgag

SEQ ID NO: 141532 - DNA, 46 bp, Artificial Sequence
  Description of Artificial Sequence: Synthetic oligonucleotide
cagattggaagaattgttgaaaattctgatgctgttactgagattc

SEQ ID NO: 141533 - DNA, 54 bp, Artificial Sequence
  Description of Artificial Sequence: Synthetic oligonucleotide
agattggaagaattgttgaaaattctgatgctgttactgagattctaaataatg

SEQ ID NO: 141534 - DNA, 53 bp, Artificial Sequence
  Description of Artificial Sequence: Synthetic oligonucleotide
gattggaagaattgttgaaaattctgatgctgttactgagattctaaataatg

SEQ ID NO: 141535 - DNA, 53 bp, Artificial Sequence
  Description of Artificial Sequence: Synthetic oligonucleotide
attggaagaattgttgaaaattctgatgctgttactgagattctaaataatgc

SEQ ID NO: 141536 - DNA, 52 bp, Artificial Sequence
  Description of Artificial Sequence: Synthetic oligonucleotide
ttggaagaattgttgaaaattctgatgctgttactgagattctaaataatgc

SEQ ID NO: 141537 - DNA, 51 bp, Artificial Sequence
  Description of Artificial Sequence: Synthetic oligonucleotide
tggaagaattgttgaaaattctgatgctgttactgagattctaaataatgc

SEQ ID NO: 141538 - DNA, 50 bp, Artificial Sequence
  Description of Artificial Sequence: Synthetic oligonucleotide
ggaagaattgttgaaaattctgatgctgttactgagattctaaataatgc

SEQ ID NO: 141539 - DNA, 51 bp, Artificial Sequence
  Description of Artificial Sequence: Synthetic oligonucleotide
gaagaattgttgaaaattctgatgctgttactgagattctaaataatgctg

SEQ ID NO: 141540 - DNA, 56 bp, Artificial Sequence
  Description of Artificial Sequence: Synthetic oligonucleotide
aagaattgttgaaaattctgatgctgttactgagattctaaataatgctgaattac

SEQ ID NO: 141541 - DNA, 55 bp, Artificial Sequence
  Description of Artificial Sequence: Synthetic oligonucleotide
agaattgttgaaaattctgatgctgttactgagattctaaataatgctgaattac

SEQ ID NO: 141542 - DNA, 54 bp, Artificial Sequence
  Description of Artificial Sequence: Synthetic oligonucleotide
gaattgttgaaaattctgatgctgttactgagattctaaataatgctgaattac

SEQ ID NO: 141543 - DNA, 59 bp, Artificial Sequence
  Description of Artificial Sequence: Synthetic oligonucleotide
aattgttgaaaattctgatgctgttactgagattctaaataatgctgaattactaaaac

SEQ ID NO: 141544 - DNA, 58 bp, Artificial Sequence
  Description of Artificial Sequence: Synthetic oligonucleotide
attgttgaaaattctgatgctgttactgagattctaaataatgctgaattactaaaac

SEQ ID NO: 141545 - DNA, 57 bp, Artificial Sequence
  Description of Artificial Sequence: Synthetic oligonucleotide
ttgttgaaaattctgatgctgttactgagattctaaataatgctgaattactaaaac

SEQ ID NO: 141546 - DNA, 56 bp, Artificial Sequence
  Description of Artificial Sequence: Synthetic oligonucleotide
tgttgaaaattctgatgctgttactgagattctaaataatgctgaattactaaaac

SEQ ID NO: 141547 - DNA, 55 bp, Artificial Sequence
  Description of Artificial Sequence: Synthetic oligonucleotide
gttgaaaattctgatgctgttactgagattctaaataatgctgaattactaaaac

SEQ ID NO: 141548 - DNA, 60 bp, Artificial Sequence
  Description of Artificial Sequence: Synthetic oligonucleotide
ttgaaaattctgatgctgttactgagattctaaataatgctgaattactaaaacaaattg

SEQ ID NO: 141549 - DNA, 59 bp, Artificial Sequence
  Description of Artificial Sequence: Synthetic oligonucleotide
tgaaaattctgatgctgttactgagattctaaataatgctgaattactaaaacaaattg

SEQ ID NO: 141550 - DNA, 58 bp, Artificial Sequence
  Description of Artificial Sequence: Synthetic oligonucleotide
gaaaattctgatgctgttactgagattctaaataatgctgaattactaaaacaaattg

SEQ ID NO: 141551 - DNA, 60 bp, Artificial Sequence
  Description of Artificial Sequence: Synthetic oligonucleotide
aaaattctgatgctgttactgagattctaaataatgctgaattactaaaacaaattgttt

SEQ ID NO: 141552 - DNA, 60 bp, Artificial Sequence
  Description of Artificial Sequence: Synthetic oligonucleotide
aaattctgatgctgttactgagattctaaataatgctgaattactaaaacaaattgttta

SEQ ID NO: 141553 - DNA, 60 bp, Artificial Sequence
  Description of Artificial Sequence: Synthetic oligonucleotide
aattctgatgctgttactgagattctaaataatgctgaattactaaaacaaattgtttat

SEQ ID NO: 141554 - DNA, 60 bp, Artificial Sequence
  Description of Artificial Sequence: Synthetic oligonucleotide
attctgatgctgttactgagattctaaataatgctgaattactaaaacaaattgtttatt

SEQ ID NO: 141555 - DNA, 60 bp, Artificial Sequence
  Description of Artificial Sequence: Synthetic oligonucleotide
ttctgatgctgttactgagattctaaataatgctgaattactaaaacaaattgtttattg

SEQ ID NO: 141556 - DNA, 59 bp, Artificial Sequence
  Description of Artificial Sequence: Synthetic oligonucleotide
tctgatgctgttactgagattctaaataatgctgaattactaaaacaaattgtttattg

SEQ ID NO: 141557 - DNA, 58 bp, Artificial Sequence
  Description of Artificial Sequence: Synthetic oligonucleotide
ctgatgctgttactgagattctaaataatgctgaattactaaaacaaattgtttattg

SEQ ID NO: 141558 - DNA, 58 bp, Artificial Sequence
  Description of Artificial Sequence: Synthetic oligonucleotide
tgatgctgttactgagattctaaataatgctgaattactaaaacaaattgtttattgc

SEQ ID NO: 141559 - DNA, 57 bp, Artificial Sequence
  Description of Artificial Sequence: Synthetic oligonucleotide
gatgctgttactgagattctaaataatgctgaattactaaaacaaattgtttattgc

SEQ ID NO: 141560 - DNA, 60 bp, Artificial Sequence
  Description of Artificial Sequence: Synthetic oligonucleotide
atgctgttactgagattctaaataatgctgaattactaaaacaaattgtttattgcattg

SEQ ID NO: 141561 - DNA, 59 bp, Artificial Sequence
  Description of Artificial Sequence: Synthetic oligonucleotide
tgctgttactgagattctaaataatgctgaattactaaaacaaattgtttattgcattg

SEQ ID NO: 141562 - DNA, 58 bp, Artificial Sequence
  Description of Artificial Sequence: Synthetic oligonucleotide
gctgttactgagattctaaataatgctgaattactaaaacaaattgtttattgcattg

SEQ ID NO: 141563 - DNA, 58 bp, Artificial Sequence
  Description of Artificial Sequence: Synthetic oligonucleotide
ctgttactgagattctaaataatgctgaattactaaaacaaattgtttattgcattgg

SEQ ID NO: 141564 - DNA, 59 bp, Artificial Sequence
  Description of Artificial Sequence: Synthetic oligonucleotide
tgttactgagattctaaataatgctgaattactaaaacaaattgtttattgcattggtg

SEQ ID NO: 141565 - DNA, 58 bp, Artificial Sequence
  Description of Artificial Sequence: Synthetic oligonucleotide
gttactgagattctaaataatgctgaattactaaaacaaattgtttattgcattggtg

SEQ ID NO: 141566 - DNA, 58 bp, Artificial Sequence
  Description of Artificial Sequence: Synthetic oligonucleotide
ttactgagattctaaataatgctgaattactaaaacaaattgtttattgcattggtgg

SEQ ID NO: 141567 - DNA, 57 bp, Artificial Sequence
  Description of Artificial Sequence: Synthetic oligonucleotide
tactgagattctaaataatgctgaattactaaaacaaattgtttattgcattggtgg

SEQ ID NO: 141568 - DNA, 56 bp, Artificial Sequence
  Description of Artificial Sequence: Synthetic oligonucleotide
actgagattctaaataatgctgaattactaaaacaaattgtttattgcattggtgg

SEQ ID NO: 141569 - DNA, 55 bp, Artificial Sequence
  Description of Artificial Sequence: Synthetic oligonucleotide
ctgagattctaaataatgctgaattactaaaacaaattgtttattgcattggtgg

SEQ ID NO: 141570 - DNA, 56 bp, Artificial Sequence
  Description of Artificial Sequence: Synthetic oligonucleotide
tgagattctaaataatgctgaattactaaaacaaattgtttattgcattggtggag

SEQ ID NO: 141571 - DNA, 55 bp, Artificial Sequence
  Description of Artificial Sequence: Synthetic oligonucleotide
gagattctaaataatgctgaattactaaaacaaattgtttattgcattggtggag

SEQ ID NO: 141572 - DNA, 56 bp, Artificial Sequence
  Description of Artificial Sequence: Synthetic oligonucleotide
agattctaaataatgctgaattactaaaacaaattgtttattgcattggtggagag

SEQ ID NO: 141573 - DNA, 55 bp, Artificial Sequence
  Description of Artificial Sequence: Synthetic oligonucleotide
gattctaaataatgctgaattactaaaacaaattgtttattgcattggtggagag

SEQ ID NO: 141574 - DNA, 58 bp, Artificial Sequence
  Description of Artificial Sequence: Synthetic oligonucleotide
attctaaataatgctgaattactaaaacaaattgtttattgcattggtggagagaatc

SEQ ID NO: 141575 - DNA, 57 bp, Artificial Sequence
  Description of Artificial Sequence: Synthetic oligonucleotide
ttctaaataatgctgaattactaaaacaaattgtttattgcattggtggagagaatc

SEQ ID NO: 141576 - DNA, 56 bp, Artificial Sequence
  Description of Artificial Sequence: Synthetic oligonucleotide
tctaaataatgctgaattactaaaacaaattgtttattgcattggtggagagaatc

SEQ ID NO: 141577 - DNA, 55 bp, Artificial Sequence
  Description of Artificial Sequence: Synthetic oligonucleotide
ctaaataatgctgaattactaaaacaaattgtttattgcattggtggagagaatc

SEQ ID NO: 141578 - DNA, 58 bp, Artificial Sequence
  Description of Artificial Sequence: Synthetic oligonucleotide
taaataatgctgaattactaaaacaaattgtttattgcattggtggagagaatctatc

SEQ ID NO: 141579 - DNA, 57 bp, Artificial Sequence
  Description of Artificial Sequence: Synthetic oligonucleotide
aaataatgctgaattactaaaacaaattgtttattgcattggtggagagaatctatc

SEQ ID NO: 141580 - DNA, 56 bp, Artificial Sequence
  Description of Artificial Sequence: Synthetic oligonucleotide
aataatgctgaattactaaaacaaattgtttattgcattggtggagagaatctatc

SEQ ID NO: 141581 - DNA, 55 bp, Artificial Sequence
  Description of Artificial Sequence: Synthetic oligonucleotide
ataatgctgaattactaaaacaaattgtttattgcattggtggagagaatctatc

SEQ ID NO: 141582 - DNA, 54 bp, Artificial Sequence
  Description of Artificial Sequence: Synthetic oligonucleotide
taatgctgaattactaaaacaaattgtttattgcattggtggagagaatctatc

SEQ ID NO: 141583 - DNA, 53 bp, Artificial Sequence
  Description of Artificial Sequence: Synthetic oligonucleotide
aatgctgaattactaaaacaaattgtttattgcattggtggagagaatctatc

SEQ ID NO: 141584 - DNA, 52 bp, Artificial Sequence
  Description of Artificial Sequence: Synthetic oligonucleotide
atgctgaattactaaaacaaattgtttattgcattggtggagagaatctatc

SEQ ID NO: 141585 - DNA, 51 bp, Artificial Sequence
  Description of Artificial Sequence: Synthetic oligonucleotide
tgctgaattactaaaacaaattgtttattgcattggtggagagaatctatc

SEQ ID NO: 141586 - DNA, 50 bp, Artificial Sequence
  Description of Artificial Sequence: Synthetic oligonucleotide
gctgaattactaaaacaaattgtttattgcattggtggagagaatctatc

SEQ ID NO: 141587 - DNA, 51 bp, Artificial Sequence
  Description of Artificial Sequence: Synthetic oligonucleotide
ctgaattactaaaacaaattgtttattgcattggtggagagaatctatctg

SEQ ID NO: 141588 - DNA, 53 bp, Artificial Sequence
  Description of Artificial Sequence: Synthetic oligonucleotide
tgaattactaaaacaaattgtttattgcattggtggagagaatctatctgtag

SEQ ID NO: 141589 - DNA, 52 bp, Artificial Sequence
  Description of Artificial Sequence: Synthetic oligonucleotide
gaattactaaaacaaattgtttattgcattggtggagagaatctatctgtag

SEQ ID NO: 141590 - DNA, 52 bp, Artificial Sequence
  Description of Artificial Sequence: Synthetic oligonucleotide
aattactaaaacaaattgtttattgcattggtggagagaatctatctgtagc

SEQ ID NO: 141591 - DNA, 51 bp, Artificial Sequence
  Description of Artificial Sequence: Synthetic oligonucleotide
attactaaaacaaattgtttattgcattggtggagagaatctatctgtagc

SEQ ID NO: 141592 - DNA, 50 bp, Artificial Sequence
  Description of Artificial Sequence: Synthetic oligonucleotide
ttactaaaacaaattgtttattgcattggtggagagaatctatctgtagc

SEQ ID NO: 141593 - DNA, 49 bp, Artificial Sequence
  Description of Artificial Sequence: Synthetic oligonucleotide
tactaaaacaaattgtttattgcattggtggagagaatctatctgtagc

SEQ ID NO: 141594 - DNA, 48 bp, Artificial Sequence
  Description of Artificial Sequence: Synthetic oligonucleotide
actaaaacaaattgtttattgcattggtggagagaatctatctgtagc

SEQ ID NO: 141595 - DNA, 47 bp, Artificial Sequence
  Description of Artificial Sequence: Synthetic oligonucleotide
ctaaaacaaattgtttattgcattggtggagagaatctatctgtagc

SEQ ID NO: 141596 - DNA, 51 bp, Artificial Sequence
  Description of Artificial Sequence: Synthetic oligonucleotide
taaaacaaattgtttattgcattggtggagagaatctatctgtagcaaaag

SEQ ID NO: 141597 - DNA, 50 bp, Artificial Sequence
  Description of Artificial Sequence: Synthetic oligonucleotide
aaaacaaattgtttattgcattggtggagagaatctatctgtagcaaaag

SEQ ID NO: 141598 - DNA, 49 bp, Artificial Sequence
  Description of Artificial Sequence: Synthetic oligonucleotide
aaacaaattgtttattgcattggtggagagaatctatctgtagcaaaag

SEQ ID NO: 141599 - DNA, 48 bp, Artificial Sequence
  Description of Artificial Sequence: Synthetic oligonucleotide
aacaaattgtttattgcattggtggagagaatctatctgtagcaaaag

SEQ ID NO: 141600 - DNA, 47 bp, Artificial Sequence
  Description of Artificial Sequence: Synthetic oligonucleotide
acaaattgtttattgcattggtggagagaatctatctgtagcaaaag

SEQ ID NO: 141601 - DNA, 46 bp, Artificial Sequence
  Description of Artificial Sequence: Synthetic oligonucleotide
caaattgtttattgcattggtggagagaatctatctgtagcaaaag

SEQ ID NO: 141602 - DNA, 46 bp, Artificial Sequence
  Description of Artificial Sequence: Synthetic oligonucleotide
aaattgtttattgcattggtggagagaatctatctgtagcaaaagc

SEQ ID NO: 141603 - DNA, 45 bp, Artificial Sequence
  Description of Artificial Sequence: Synthetic oligonucleotide
aattgtttattgcattggtggagagaatctatctgtagcaaaagc

SEQ ID NO: 141604 - DNA, 44 bp, Artificial Sequence
  Description of Artificial Sequence: Synthetic oligonucleotide
attgtttattgcattggtggagagaatctatctgtagcaaaagc

SEQ ID NO: 141605 - DNA, 43 bp, Artificial Sequence
  Description of Artificial Sequence: Synthetic oligonucleotide
ttgtttattgcattggtggagagaatctatctgtagcaaaagc

SEQ ID NO: 141606 - DNA, 42 bp, Artificial Sequence
  Description of Artificial Sequence: Synthetic oligonucleotide
tgtttattgcattggtggagagaatctatctgtagcaaaagc

SEQ ID NO: 141607 - DNA, 41 bp, Artificial Sequence
  Description of Artificial Sequence: Synthetic oligonucleotide
gtttattgcattggtggagagaatctatctgtagcaaaagc

SEQ ID NO: 141608 - DNA, 41 bp, Artificial Sequence
  Description of Artificial Sequence: Synthetic oligonucleotide
tttattgcattggtggagagaatctatctgtagcaaaagcg

SEQ ID NO: 141609 - DNA, 40 bp, Artificial Sequence
  Description of Artificial Sequence: Synthetic oligonucleotide
ttattgcattggtggagagaatctatctgtagcaaaagcg

SEQ ID NO: 141610 - DNA, 39 bp, Artificial Sequence
  Description of Artificial Sequence: Synthetic oligonucleotide
tattgcattggtggagagaatctatctgtagcaaaagcg

SEQ ID NO: 141611 - DNA, 38 bp, Artificial Sequence
  Description of Artificial Sequence: Synthetic oligonucleotide
attgcattggtggagagaatctatctgtagcaaaagcg

SEQ ID NO: 141612 - DNA, 37 bp, Artificial Sequence
  Description of Artificial Sequence: Synthetic oligonucleotide
ttgcattggtggagagaatctatctgtagcaaaagcg

SEQ ID NO: 141613 - DNA, 36 bp, Artificial Sequence
  Description of Artificial Sequence: Synthetic oligonucleotide
tgcattggtggagagaatctatctgtagcaaaagcg

SEQ ID NO: 141614 - DNA, 35 bp, Artificial Sequence
  Description of Artificial Sequence: Synthetic oligonucleotide
gcattggtggagagaatctatctgtagcaaaagcg

SEQ ID NO: 141615 - DNA, 35 bp, Artificial Sequence
  Description of Artificial Sequence: Synthetic oligonucleotide
cattggtggagagaatctatctgtagcaaaagcgg

SEQ ID NO: 141616 - DNA, 35 bp, Artificial Sequence
  Description of Artificial Sequence: Synthetic oligonucleotide
attggtggagagaatctatctgtagcaaaagcggc

SEQ ID NO: 141617 - DNA, 34 bp, Artificial Sequence
  Description of Artificial Sequence: Synthetic oligonucleotide
ttggtggagagaatctatctgtagcaaaagcggc

SEQ ID NO: 141618 - DNA, 33 bp, Artificial Sequence
  Description of Artificial Sequence: Synthetic oligonucleotide
tggtggagagaatctatctgtagcaaaagcggc

SEQ ID NO: 141619 - DNA, 32 bp, Artificial Sequence
  Description of Artificial Sequence: Synthetic oligonucleotide
ggtggagagaatctatctgtagcaaaagcggc

SEQ ID NO: 141620 - DNA, 35 bp, Artificial Sequence
  Description of Artificial Sequence: Synthetic oligonucleotide
gtggagagaatctatctgtagcaaaagcggctatc

SEQ ID NO: 141621 - DNA, 39 bp, Artificial Sequence
  Description of Artificial Sequence: Synthetic oligonucleotide
tggagagaatctatctgtagcaaaagcggctatcaaatc

SEQ ID NO: 141622 - DNA, 38 bp, Artificial Sequence
  Description of Artificial Sequence: Synthetic oligonucleotide
ggagagaatctatctgtagcaaaagcggctatcaaatc

SEQ ID NO: 141623 - DNA, 38 bp, Artificial Sequence
  Description of Artificial Sequence: Synthetic oligonucleotide
gagagaatctatctgtagcaaaagcggctatcaaatcc

SEQ ID NO: 141624 - DNA, 38 bp, Artificial Sequence
  Description of Artificial Sequence: Synthetic oligonucleotide
agagaatctatctgtagcaaaagcggctatcaaatccc

SEQ ID NO: 141625 - DNA, 37 bp, Artificial Sequence
  Description of Artificial Sequence: Synthetic oligonucleotide
gagaatctatctgtagcaaaagcggctatcaaatccc

SEQ ID NO: 141626 - DNA, 38 bp, Artificial Sequence
  Description of Artificial Sequence: Synthetic oligonucleotide
agaatctatctgtagcaaaagcggctatcaaatccctg

SEQ ID NO: 141627 - DNA, 37 bp, Artificial Sequence
  Description of Artificial Sequence: Synthetic oligonucleotide
gaatctatctgtagcaaaagcggctatcaaatccctg

SEQ ID NO: 141628 - DNA, 38 bp, Artificial Sequence
  Description of Artificial Sequence: Synthetic oligonucleotide
aatctatctgtagcaaaagcggctatcaaatccctgtc

SEQ ID NO: 141629 - DNA, 37 bp, Artificial Sequence
  Description of Artificial Sequence: Synthetic oligonucleotide
atctatctgtagcaaaagcggctatcaaatccctgtc

SEQ ID NO: 141630 - DNA, 36 bp, Artificial Sequence
  Description of Artificial Sequence: Synthetic oligonucleotide
tctatctgtagcaaaagcggctatcaaatccctgtc

SEQ ID NO: 141631 - DNA, 35 bp, Artificial Sequence
  Description of Artificial Sequence: Synthetic oligonucleotide
ctatctgtagcaaaagcggctatcaaatccctgtc

SEQ ID NO: 141632 - DNA, 37 bp, Artificial Sequence
  Description of Artificial Sequence: Synthetic oligonucleotide
tatctgtagcaaaagcggctatcaaatccctgtcaag

SEQ ID NO: 141633 - DNA, 36 bp, Artificial Sequence
  Description of Artificial Sequence: Synthetic oligonucleotide
atctgtagcaaaagcggctatcaaatccctgtcaag

SEQ ID NO: 141634 - DNA, 35 bp, Artificial Sequence
  Description of Artificial Sequence: Synthetic oligonucleotide
tctgtagcaaaagcggctatcaaatccctgtcaag

SEQ ID NO: 141635 - DNA, 34 bp, Artificial Sequence
  Description of Artificial Sequence: Synthetic oligonucleotide
ctgtagcaaaagcggctatcaaatccctgtcaag

SEQ ID NO: 141636 - DNA, 39 bp, Artificial Sequence
  Description of Artificial Sequence: Synthetic oligonucleotide
tgtagcaaaagcggctatcaaatccctgtcaagaatatc

SEQ ID NO: 141637 - DNA, 38 bp, Artificial Sequence
  Description of Artificial Sequence: Synthetic oligonucleotide
gtagcaaaagcggctatcaaatccctgtcaagaatatc

SEQ ID NO: 141638 - DNA, 39 bp, Artificial Sequence
  Description of Artificial Sequence: Synthetic oligonucleotide
tagcaaaagcggctatcaaatccctgtcaagaatatcac

SEQ ID NO: 141639 - DNA, 38 bp, Artificial Sequence
  Description of Artificial Sequence: Synthetic oligonucleotide
agcaaaagcggctatcaaatccctgtcaagaatatcac

SEQ ID NO: 141640 - DNA, 37 bp, Artificial Sequence
  Description of Artificial Sequence: Synthetic oligonucleotide
gcaaaagcggctatcaaatccctgtcaagaatatcac

SEQ ID NO: 141641 - DNA, 40 bp, Artificial Sequence
  Description of Artificial Sequence: Synthetic oligonucleotide
caaaagcggctatcaaatccctgtcaagaatatcactaac

SEQ ID NO: 141642 - DNA, 40 bp, Artificial Sequence
  Description of Artificial Sequence: Synthetic oligonucleotide
aaaagcggctatcaaatccctgtcaagaatatcactaacc

SEQ ID NO: 141643 - DNA, 39 bp, Artificial Sequence
  Description of Artificial Sequence: Synthetic oligonucleotide
aaagcggctatcaaatccctgtcaagaatatcactaacc

SEQ ID NO: 141644 - DNA, 38 bp, Artificial Sequence
  Description of Artificial Sequence: Synthetic oligonucleotide
aagcggctatcaaatccctgtcaagaatatcactaacc

SEQ ID NO: 141645 - DNA, 37 bp, Artificial Sequence
  Description of Artificial Sequence: Synthetic oligonucleotide
agcggctatcaaatccctgtcaagaatatcactaacc

SEQ ID NO: 141646 - DNA, 36 bp, Artificial Sequence
  Description of Artificial Sequence: Synthetic oligonucleotide
gcggctatcaaatccctgtcaagaatatcactaacc

SEQ ID NO: 141647 - DNA, 36 bp, Artificial Sequence
  Description of Artificial Sequence: Synthetic oligonucleotide
cggctatcaaatccctgtcaagaatatcactaaccc

SEQ ID NO: 141648 - DNA, 38 bp, Artificial Sequence
  Description of Artificial Sequence: Synthetic oligonucleotide
ggctatcaaatccctgtcaagaatatcactaacccaag

SEQ ID NO: 141649 - DNA, 38 bp, Artificial Sequence
  Description of Artificial Sequence: Synthetic oligonucleotide
gctatcaaatccctgtcaagaatatcactaacccaagc

SEQ ID NO: 141650 - DNA, 39 bp, Artificial Sequence
  Description of Artificial Sequence: Synthetic oligonucleotide
ctatcaaatccctgtcaagaatatcactaacccaagctg

SEQ ID NO: 141651 - DNA, 39 bp, Artificial Sequence
  Description of Artificial Sequence: Synthetic oligonucleotide
tatcaaatccctgtcaagaatatcactaacccaagctgg

SEQ ID NO: 141652 - DNA, 38 bp, Artificial Sequence
  Description of Artificial Sequence: Synthetic oligonucleotide
atcaaatccctgtcaagaatatcactaacccaagctgg

SEQ ID NO: 141653 - DNA, 37 bp, Artificial Sequence
  Description of Artificial Sequence: Synthetic oligonucleotide
tcaaatccctgtcaagaatatcactaacccaagctgg

SEQ ID NO: 141654 - DNA, 36 bp, Artificial Sequence
  Description of Artificial Sequence: Synthetic oligonucleotide
caaatccctgtcaagaatatcactaacccaagctgg

SEQ ID NO: 141655 - DNA, 37 bp, Artificial Sequence
  Description of Artificial Sequence: Synthetic oligonucleotide
aaatccctgtcaagaatatcactaacccaagctggac

SEQ ID NO: 141656 - DNA, 36 bp, Artificial Sequence
  Description of Artificial Sequence: Synthetic oligonucleotide
aatccctgtcaagaatatcactaacccaagctggac

SEQ ID NO: 141657 - DNA, 35 bp, Artificial Sequence
  Description of Artificial Sequence: Synthetic oligonucleotide
atccctgtcaagaatatcactaacccaagctggac

SEQ ID NO: 141658 - DNA, 34 bp, Artificial Sequence
  Description of Artificial Sequence: Synthetic oligonucleotide
tccctgtcaagaatatcactaacccaagctggac

SEQ ID NO: 141659 - DNA, 33 bp, Artificial Sequence
  Description of Artificial Sequence: Synthetic oligonucleotide
ccctgtcaagaatatcactaacccaagctggac

SEQ ID NO: 141660 - DNA, 34 bp, Artificial Sequence
  Description of Artificial Sequence: Synthetic oligonucleotide
cctgtcaagaatatcactaacccaagctggactg

SEQ ID NO: 141661 - DNA, 34 bp, Artificial Sequence
  Description of Artificial Sequence: Synthetic oligonucleotide
ctgtcaagaatatcactaacccaagctggactgg

SEQ ID NO: 141662 - DNA, 35 bp, Artificial Sequence
  Description of Artificial Sequence: Synthetic oligonucleotide
tgtcaagaatatcactaacccaagctggactggag

SEQ ID NO: 141663 - DNA, 34 bp, Artificial Sequence
  Description of Artificial Sequence: Synthetic oligonucleotide
gtcaagaatatcactaacccaagctggactggag

SEQ ID NO: 141664 - DNA, 34 bp, Artificial Sequence
  Description of Artificial Sequence: Synthetic oligonucleotide
tcaagaatatcactaacccaagctggactggagg

SEQ ID NO: 141665 - DNA, 33 bp, Artificial Sequence
  Description of Artificial Sequence: Synthetic oligonucleotide
caagaatatcactaacccaagctggactggagg

SEQ ID NO: 141666 - DNA, 33 bp, Artificial Sequence
  Description of Artificial Sequence: Synthetic oligonucleotide
aagaatatcactaacccaagctggactggaggc

SEQ ID NO: 141667 - DNA, 32 bp, Artificial Sequence
  Description of Artificial Sequence: Synthetic oligonucleotide
agaatatcactaacccaagctggactggaggc

SEQ ID NO: 141668 - DNA, 31 bp, Artificial Sequence
  Description of Artificial Sequence: Synthetic oligonucleotide
gaatatcactaacccaagctggactggaggc

SEQ ID NO: 141669 - DNA, 38 bp, Artificial Sequence
  Description of Artificial Sequence: Synthetic oligonucleotide
aatatcactaacccaagctggactggaggctttatttg

SEQ ID NO: 141670 - DNA, 37 bp, Artificial Sequence
  Description of Artificial Sequence: Synthetic oligonucleotide
atatcactaacccaagctggactggaggctttatttg

SEQ ID NO: 141671 - DNA, 36 bp, Artificial Sequence
  Description of Artificial Sequence: Synthetic oligonucleotide
tatcactaacccaagctggactggaggctttatttg

SEQ ID NO: 141672 - DNA, 35 bp, Artificial Sequence
  Description of Artificial Sequence: Synthetic oligonucleotide
atcactaacccaagctggactggaggctttatttg

SEQ ID NO: 141673 - DNA, 34 bp, Artificial Sequence
  Description of Artificial Sequence: Synthetic oligonucleotide
tcactaacccaagctggactggaggctttatttg

SEQ ID NO: 141674 - DNA, 33 bp, Artificial Sequence
  Description of Artificial Sequence: Synthetic oligonucleotide
cactaacccaagctggactggaggctttatttg

SEQ ID NO: 141675 - DNA, 36 bp, Artificial Sequence
  Description of Artificial Sequence: Synthetic oligonucleotide
actaacccaagctggactggaggctttatttgaaag

SEQ ID NO: 141676 - DNA, 35 bp, Artificial Sequence
  Description of Artificial Sequence: Synthetic oligonucleotide
ctaacccaagctggactggaggctttatttgaaag

SEQ ID NO: 141677 - DNA, 35 bp, Artificial Sequence
  Description of Artificial Sequence: Synthetic oligonucleotide
taacccaagctggactggaggctttatttgaaagc

SEQ ID NO: 141678 - DNA, 34 bp, Artificial Sequence
  Description of Artificial Sequence: Synthetic oligonucleotide
aacccaagctggactggaggctttatttgaaagc

SEQ ID NO: 141679 - DNA, 33 bp, Artificial Sequence
  Description of Artificial Sequence: Synthetic oligonucleotide
acccaagctggactggaggctttatttgaaagc

SEQ ID NO: 141680 - DNA, 32 bp, Artificial Sequence
  Description of Artificial Sequence: Synthetic oligonucleotide
cccaagctggactggaggctttatttgaaagc

SEQ ID NO: 141681 - DNA, 35 bp, Artificial Sequence
  Description of Artificial Sequence: Synthetic oligonucleotide
ccaagctggactggaggctttatttgaaagcaatc

SEQ ID NO: 141682 - DNA, 36 bp, Artificial Sequence
  Description of Artificial Sequence: Synthetic oligonucleotide
caagctggactggaggctttatttgaaagcaatctg

SEQ ID NO: 141683 - DNA, 36 bp, Artificial Sequence
  Description of Artificial Sequence: Synthetic oligonucleotide
aagctggactggaggctttatttgaaagcaatctgc

SEQ ID NO: 141684 - DNA, 35 bp, Artificial Sequence
  Description of Artificial Sequence: Synthetic oligonucleotide
agctggactggaggctttatttgaaagcaatctgc

SEQ ID NO: 141685 - DNA, 34 bp, Artificial Sequence
  Description of Artificial Sequence: Synthetic oligonucleotide
gctggactggaggctttatttgaaagcaatctgc

SEQ ID NO: 141686 - DNA, 35 bp, Artificial Sequence
  Description of Artificial Sequence: Synthetic oligonucleotide
ctggactggaggctttatttgaaagcaatctgctg

SEQ ID NO: 141687 - DNA, 35 bp, Artificial Sequence
  Description of Artificial Sequence: Synthetic oligonucleotide
tggactggaggctttatttgaaagcaatctgctgg

SEQ ID NO: 141688 - DNA, 34 bp, Artificial Sequence
  Description of Artificial Sequence: Synthetic oligonucleotide
ggactggaggctttatttgaaagcaatctgctgg

SEQ ID NO: 141689 - DNA, 36 bp, Artificial Sequence
  Description of Artificial Sequence: Synthetic oligonucleotide
gactggaggctttatttgaaagcaatctgctggatg

SEQ ID NO: 141690 - DNA, 40 bp, Artificial Sequence
  Description of Artificial Sequence: Synthetic oligonucleotide
actggaggctttatttgaaagcaatctgctggatgatttg

SEQ ID NO: 141691 - DNA, 39 bp, Artificial Sequence
  Description of Artificial Sequence: Synthetic oligonucleotide
ctggaggctttatttgaaagcaatctgctggatgatttg

SEQ ID NO: 141692 - DNA, 43 bp, Artificial Sequence
  Description of Artificial Sequence: Synthetic oligonucleotide
tggaggctttatttgaaagcaatctgctggatgatttgaaaag

SEQ ID NO: 141693 - DNA, 42 bp, Artificial Sequence
  Description of Artificial Sequence: Synthetic oligonucleotide
ggaggctttatttgaaagcaatctgctggatgatttgaaaag

SEQ ID NO: 141694 - DNA, 43 bp, Artificial Sequence
  Description of Artificial Sequence: Synthetic oligonucleotide
gaggctttatttgaaagcaatctgctggatgatttgaaaagtg

SEQ ID NO: 141695 - DNA, 47 bp, Artificial Sequence
  Description of Artificial Sequence: Synthetic oligonucleotide
aggctttatttgaaagcaatctgctggatgatttgaaaagtgtaatg

SEQ ID NO: 141696 - DNA, 46 bp, Artificial Sequence
  Description of Artificial Sequence: Synthetic oligonucleotide
ggctttatttgaaagcaatctgctggatgatttgaaaagtgtaatg

SEQ ID NO: 141697 - DNA, 50 bp, Artificial Sequence
  Description of Artificial Sequence: Synthetic oligonucleotide
gctttatttgaaagcaatctgctggatgatttgaaaagtgtaatgaaaac

SEQ ID NO: 141698 - DNA, 54 bp, Artificial Sequence
  Description of Artificial Sequence: Synthetic oligonucleotide
ctttatttgaaagcaatctgctggatgatttgaaaagtgtaatgaaaacaaatg

SEQ ID NO: 141699 - DNA, 55 bp, Artificial Sequence
  Description of Artificial Sequence: Synthetic oligonucleotide
tttatttgaaagcaatctgctggatgatttgaaaagtgtaatgaaaacaaatgac

SEQ ID NO: 141700 - DNA, 54 bp, Artificial Sequence
  Description of Artificial Sequence: Synthetic oligonucleotide
ttatttgaaagcaatctgctggatgatttgaaaagtgtaatgaaaacaaatgac

SEQ ID NO: 141701 - DNA, 53 bp, Artificial Sequence
  Description of Artificial Sequence: Synthetic oligonucleotide
tatttgaaagcaatctgctggatgatttgaaaagtgtaatgaaaacaaatgac

SEQ ID NO: 141702 - DNA, 52 bp, Artificial Sequence
  Description of Artificial Sequence: Synthetic oligonucleotide
atttgaaagcaatctgctggatgatttgaaaagtgtaatgaaaacaaatgac

SEQ ID NO: 141703 - DNA, 51 bp, Artificial Sequence
  Description of Artificial Sequence: Synthetic oligonucleotide
tttgaaagcaatctgctggatgatttgaaaagtgtaatgaaaacaaatgac

SEQ ID NO: 141704 - DNA, 50 bp, Artificial Sequence
  Description of Artificial Sequence: Synthetic oligonucleotide
ttgaaagcaatctgctggatgatttgaaaagtgtaatgaaaacaaatgac

SEQ ID NO: 141705 - DNA, 49 bp, Artificial Sequence
  Description of Artificial Sequence: Synthetic oligonucleotide
tgaaagcaatctgctggatgatttgaaaagtgtaatgaaaacaaatgac

SEQ ID NO: 141706 - DNA, 48 bp, Artificial Sequence
  Description of Artificial Sequence: Synthetic oligonucleotide
gaaagcaatctgctggatgatttgaaaagtgtaatgaaaacaaatgac

SEQ ID NO: 141707 - DNA, 51 bp, Artificial Sequence
  Description of Artificial Sequence: Synthetic oligonucleotide
aaagcaatctgctggatgatttgaaaagtgtaatgaaaacaaatgacattg

SEQ ID NO: 141708 - DNA, 50 bp, Artificial Sequence
  Description of Artificial Sequence: Synthetic oligonucleotide
aagcaatctgctggatgatttgaaaagtgtaatgaaaacaaatgacattg

SEQ ID NO: 141709 - DNA, 49 bp, Artificial Sequence
  Description of Artificial Sequence: Synthetic oligonucleotide
agcaatctgctggatgatttgaaaagtgtaatgaaaacaaatgacattg

SEQ ID NO: 141710 - DNA, 48 bp, Artificial Sequence
  Description of Artificial Sequence: Synthetic oligonucleotide
gcaatctgctggatgatttgaaaagtgtaatgaaaacaaatgacattg

SEQ ID NO: 141711 - DNA, 50 bp, Artificial Sequence
  Description of Artificial Sequence: Synthetic oligonucleotide
caatctgctggatgatttgaaaagtgtaatgaaaacaaatgacattgttc

SEQ ID NO: 141712 - DNA, 50 bp, Artificial Sequence
  Description of Artificial Sequence: Synthetic oligonucleotide
aatctgctggatgatttgaaaagtgtaatgaaaacaaatgacattgttcg

SEQ ID NO: 141713 - DNA, 49 bp, Artificial Sequence
  Description of Artificial Sequence: Synthetic oligonucleotide
atctgctggatgatttgaaaagtgtaatgaaaacaaatgacattgttcg

SEQ ID NO: 141714 - DNA, 48 bp, Artificial Sequence
  Description of Artificial Sequence: Synthetic oligonucleotide
tctgctggatgatttgaaaagtgtaatgaaaacaaatgacattgttcg

SEQ ID NO: 141715 - DNA, 47 bp, Artificial Sequence
  Description of Artificial Sequence: Synthetic oligonucleotide
ctgctggatgatttgaaaagtgtaatgaaaacaaatgacattgttcg

SEQ ID NO: 141716 - DNA, 50 bp, Artificial Sequence
  Description of Artificial Sequence: Synthetic oligonucleotide
tgctggatgatttgaaaagtgtaatgaaaacaaatgacattgttcgatac

SEQ ID NO: 141717 - DNA, 49 bp, Artificial Sequence
  Description of Artificial Sequence: Synthetic oligonucleotide
gctggatgatttgaaaagtgtaatgaaaacaaatgacattgttcgatac

SEQ ID NO: 141718 - DNA, 50 bp, Artificial Sequence
  Description of Artificial Sequence: Synthetic oligonucleotide
ctggatgatttgaaaagtgtaatgaaaacaaatgacattgttcgatacag

SEQ ID NO: 141719 - DNA, 50 bp, Artificial Sequence
  Description of Artificial Sequence: Synthetic oligonucleotide
tggatgatttgaaaagtgtaatgaaaacaaatgacattgttcgatacagg

SEQ ID NO: 141720 - DNA, 49 bp, Artificial Sequence
  Description of Artificial Sequence: Synthetic oligonucleotide
ggatgatttgaaaagtgtaatgaaaacaaatgacattgttcgatacagg

SEQ ID NO: 141721 - DNA, 49 bp, Artificial Sequence
  Description of Artificial Sequence: Synthetic oligonucleotide
gatgatttgaaaagtgtaatgaaaacaaatgacattgttcgatacaggg

SEQ ID NO: 141722 - DNA, 50 bp, Artificial Sequence
  Description of Artificial Sequence: Synthetic oligonucleotide
atgatttgaaaagtgtaatgaaaacaaatgacattgttcgatacagggtg

SEQ ID NO: 141723 - DNA, 49 bp, Artificial Sequence
  Description of Artificial Sequence: Synthetic oligonucleotide
tgatttgaaaagtgtaatgaaaacaaatgacattgttcgatacagggtg

SEQ ID NO: 141724 - DNA, 48 bp, Artificial Sequence
  Description of Artificial Sequence: Synthetic oligonucleotide
gatttgaaaagtgtaatgaaaacaaatgacattgttcgatacagggtg

SEQ ID NO: 141725 - DNA, 51 bp, Artificial Sequence
  Description of Artificial Sequence: Synthetic oligonucleotide
atttgaaaagtgtaatgaaaacaaatgacattgttcgatacagggtgtatg

SEQ ID NO: 141726 - DNA, 50 bp, Artificial Sequence
  Description of Artificial Sequence: Synthetic oligonucleotide
tttgaaaagtgtaatgaaaacaaatgacattgttcgatacagggtgtatg

SEQ ID NO: 141727 - DNA, 49 bp, Artificial Sequence
  Description of Artificial Sequence: Synthetic oligonucleotide
ttgaaaagtgtaatgaaaacaaatgacattgttcgatacagggtgtatg

SEQ ID NO: 141728 - DNA, 48 bp, Artificial Sequence
  Description of Artificial Sequence: Synthetic oligonucleotide
tgaaaagtgtaatgaaaacaaatgacattgttcgatacagggtgtatg

SEQ ID NO: 141729 - DNA, 47 bp, Artificial Sequence
  Description of Artificial Sequence: Synthetic oligonucleotide
gaaaagtgtaatgaaaacaaatgacattgttcgatacagggtgtatg

SEQ ID NO: 141730 - DNA, 48 bp, Artificial Sequence
  Description of Artificial Sequence: Synthetic oligonucleotide
aaaagtgtaatgaaaacaaatgacattgttcgatacagggtgtatgag

SEQ ID NO: 141731 - DNA, 47 bp, Artificial Sequence
  Description of Artificial Sequence: Synthetic oligonucleotide
aaagtgtaatgaaaacaaatgacattgttcgatacagggtgtatgag

SEQ ID NO: 141732 - DNA, 46 bp, Artificial Sequence
  Description of Artificial Sequence: Synthetic oligonucleotide
aagtgtaatgaaaacaaatgacattgttcgatacagggtgtatgag

SEQ ID NO: 141733 - DNA, 45 bp, Artificial Sequence
  Description of Artificial Sequence: Synthetic oligonucleotide
agtgtaatgaaaacaaatgacattgttcgatacagggtgtatgag

SEQ ID NO: 141734 - DNA, 44 bp, Artificial Sequence
  Description of Artificial Sequence: Synthetic oligonucleotide
gtgtaatgaaaacaaatgacattgttcgatacagggtgtatgag

SEQ ID NO: 141735 - DNA, 44 bp, Artificial Sequence
  Description of Artificial Sequence: Synthetic oligonucleotide
tgtaatgaaaacaaatgacattgttcgatacagggtgtatgagc

SEQ ID NO: 141736 - DNA, 43 bp, Artificial Sequence
  Description of Artificial Sequence: Synthetic oligonucleotide
gtaatgaaaacaaatgacattgttcgatacagggtgtatgagc

SEQ ID NO: 141737 - DNA, 51 bp, Artificial Sequence
  Description of Artificial Sequence: Synthetic oligonucleotide
taatgaaaacaaatgacattgttcgatacagggtgtatgagctaattatag

SEQ ID NO: 141738 - DNA, 50 bp, Artificial Sequence
  Description of Artificial Sequence: Synthetic oligonucleotide
aatgaaaacaaatgacattgttcgatacagggtgtatgagctaattatag

SEQ ID NO: 141739 - DNA, 49 bp, Artificial Sequence
  Description of Artificial Sequence: Synthetic oligonucleotide
atgaaaacaaatgacattgttcgatacagggtgtatgagctaattatag

SEQ ID NO: 141740 - DNA, 48 bp, Artificial Sequence
  Description of Artificial Sequence: Synthetic oligonucleotide
tgaaaacaaatgacattgttcgatacagggtgtatgagctaattatag

SEQ ID NO: 141741 - DNA, 47 bp, Artificial Sequence
  Description of Artificial Sequence: Synthetic oligonucleotide
gaaaacaaatgacattgttcgatacagggtgtatgagctaattatag

SEQ ID NO: 141742 - DNA, 48 bp, Artificial Sequence
  Description of Artificial Sequence: Synthetic oligonucleotide
aaaacaaatgacattgttcgatacagggtgtatgagctaattatagag

SEQ ID NO: 141743 - DNA, 47 bp, Artificial Sequence
  Description of Artificial Sequence: Synthetic oligonucleotide
aaacaaatgacattgttcgatacagggtgtatgagctaattatagag

SEQ ID NO: 141744 - DNA, 46 bp, Artificial Sequence
  Description of Artificial Sequence: Synthetic oligonucleotide
aacaaatgacattgttcgatacagggtgtatgagctaattatagag

SEQ ID NO: 141745 - DNA, 45 bp, Artificial Sequence
  Description of Artificial Sequence: Synthetic oligonucleotide
acaaatgacattgttcgatacagggtgtatgagctaattatagag

SEQ ID NO: 141746 - DNA, 44 bp, Artificial Sequence
  Description of Artificial Sequence: Synthetic oligonucleotide
caaatgacattgttcgatacagggtgtatgagctaattatagag

SEQ ID NO: 141747 - DNA, 48 bp, Artificial Sequence
  Description of Artificial Sequence: Synthetic oligonucleotide
aaatgacattgttcgatacagggtgtatgagctaattatagagatttc

SEQ ID NO: 141748 - DNA, 47 bp, Artificial Sequence
  Description of Artificial Sequence: Synthetic oligonucleotide
aatgacattgttcgatacagggtgtatgagctaattatagagatttc

SEQ ID NO: 141749 - DNA, 46 bp, Artificial Sequence
  Description of Artificial Sequence: Synthetic oligonucleotide
atgacattgttcgatacagggtgtatgagctaattatagagatttc

SEQ ID NO: 141750 - DNA, 45 bp, Artificial Sequence
  Description of Artificial Sequence: Synthetic oligonucleotide
tgacattgttcgatacagggtgtatgagctaattatagagatttc

SEQ ID NO: 141751 - DNA, 44 bp, Artificial Sequence
  Description of Artificial Sequence: Synthetic oligonucleotide
gacattgttcgatacagggtgtatgagctaattatagagatttc

SEQ ID NO: 141752 - DNA, 46 bp, Artificial Sequence
  Description of Artificial Sequence: Synthetic oligonucleotide
acattgttcgatacagggtgtatgagctaattatagagatttcttc

SEQ ID NO: 141753 - DNA, 45 bp, Artificial Sequence
  Description of Artificial Sequence: Synthetic oligonucleotide
cattgttcgatacagggtgtatgagctaattatagagatttcttc

SEQ ID NO: 141754 - DNA, 45 bp, Artificial Sequence
  Description of Artificial Sequence: Synthetic oligonucleotide
attgttcgatacagggtgtatgagctaattatagagatttcttcc

SEQ ID NO: 141755 - DNA, 44 bp, Artificial Sequence
  Description of Artificial Sequence: Synthetic oligonucleotide
ttgttcgatacagggtgtatgagctaattatagagatttcttcc

SEQ ID NO: 141756 - DNA, 43 bp, Artificial Sequence
  Description of Artificial Sequence: Synthetic oligonucleotide
tgttcgatacagggtgtatgagctaattatagagatttcttcc

SEQ ID NO: 141757 - DNA, 42 bp, Artificial Sequence
  Description of Artificial Sequence: Synthetic oligonucleotide
gttcgatacagggtgtatgagctaattatagagatttcttcc

SEQ ID NO: 141758 - DNA, 42 bp, Artificial Sequence
  Description of Artificial Sequence: Synthetic oligonucleotide
ttcgatacagggtgtatgagctaattatagagatttcttccg

SEQ ID NO: 141759 - DNA, 41 bp, Artificial Sequence
  Description of Artificial Sequence: Synthetic oligonucleotide
tcgatacagggtgtatgagctaattatagagatttcttccg

SEQ ID NO: 141760 - DNA, 40 bp, Artificial Sequence
  Description of Artificial Sequence: Synthetic oligonucleotide
cgatacagggtgtatgagctaattatagagatttcttccg

SEQ ID NO: 141761 - DNA, 41 bp, Artificial Sequence
  Description of Artificial Sequence: Synthetic oligonucleotide
gatacagggtgtatgagctaattatagagatttcttccgtg

SEQ ID NO: 141762 - DNA, 42 bp, Artificial Sequence
  Description of Artificial Sequence: Synthetic oligonucleotide
atacagggtgtatgagctaattatagagatttcttccgtgtc

SEQ ID NO: 141763 - DNA, 41 bp, Artificial Sequence
  Description of Artificial Sequence: Synthetic oligonucleotide
tacagggtgtatgagctaattatagagatttcttccgtgtc

SEQ ID NO: 141764 - DNA, 40 bp, Artificial Sequence
  Description of Artificial Sequence: Synthetic oligonucleotide
acagggtgtatgagctaattatagagatttcttccgtgtc

SEQ ID NO: 141765 - DNA, 39 bp, Artificial Sequence
  Description of Artificial Sequence: Synthetic oligonucleotide
cagggtgtatgagctaattatagagatttcttccgtgtc

SEQ ID NO: 141766 - DNA, 40 bp, Artificial Sequence
  Description of Artificial Sequence: Synthetic oligonucleotide
agggtgtatgagctaattatagagatttcttccgtgtcac

SEQ ID NO: 141767 - DNA, 39 bp, Artificial Sequence
  Description of Artificial Sequence: Synthetic oligonucleotide
gggtgtatgagctaattatagagatttcttccgtgtcac

SEQ ID NO: 141768 - DNA, 39 bp, Artificial Sequence
  Description of Artificial Sequence: Synthetic oligonucleotide
ggtgtatgagctaattatagagatttcttccgtgtcacc

SEQ ID NO: 141769 - DNA, 40 bp, Artificial Sequence
  Description of Artificial Sequence: Synthetic oligonucleotide
gtgtatgagctaattatagagatttcttccgtgtcaccag

SEQ ID NO: 141770 - DNA, 43 bp, Artificial Sequence
  Description of Artificial Sequence: Synthetic oligonucleotide
tgtatgagctaattatagagatttcttccgtgtcaccagaatc

SEQ ID NO: 141771 - DNA, 42 bp, Artificial Sequence
  Description of Artificial Sequence: Synthetic oligonucleotide
gtatgagctaattatagagatttcttccgtgtcaccagaatc

SEQ ID NO: 141772 - DNA, 48 bp, Artificial Sequence
  Description of Artificial Sequence: Synthetic oligonucleotide
tatgagctaattatagagatttcttccgtgtcaccagaatctttaaac

SEQ ID NO: 141773 - DNA, 47 bp, Artificial Sequence
  Description of Artificial Sequence: Synthetic oligonucleotide
atgagctaattatagagatttcttccgtgtcaccagaatctttaaac

SEQ ID NO: 141774 - DNA, 46 bp, Artificial Sequence
  Description of Artificial Sequence: Synthetic oligonucleotide
tgagctaattatagagatttcttccgtgtcaccagaatctttaaac

SEQ ID NO: 141775 - DNA, 45 bp, Artificial Sequence
  Description of Artificial Sequence: Synthetic oligonucleotide
gagctaattatagagatttcttccgtgtcaccagaatctttaaac

SEQ ID NO: 141776 - DNA, 47 bp, Artificial Sequence
  Description of Artificial Sequence: Synthetic oligonucleotide
agctaattatagagatttcttccgtgtcaccagaatctttaaactac

SEQ ID NO: 141777 - DNA, 46 bp, Artificial Sequence
  Description of Artificial Sequence: Synthetic oligonucleotide
gctaattatagagatttcttccgtgtcaccagaatctttaaactac

SEQ ID NO: 141778 - DNA, 47 bp, Artificial Sequence
  Description of Artificial Sequence: Synthetic oligonucleotide
ctaattatagagatttcttccgtgtcaccagaatctttaaactactg

SEQ ID NO: 141779 - DNA, 49 bp, Artificial Sequence
  Description of Artificial Sequence: Synthetic oligonucleotide
taattatagagatttcttccgtgtcaccagaatctttaaactactgtac

SEQ ID NO: 141780 - DNA, 48 bp, Artificial Sequence
  Description of Artificial Sequence: Synthetic oligonucleotide
aattatagagatttcttccgtgtcaccagaatctttaaactactgtac

SEQ ID NO: 141781 - DNA, 47 bp, Artificial Sequence
  Description of Artificial Sequence: Synthetic oligonucleotide
attatagagatttcttccgtgtcaccagaatctttaaactactgtac

SEQ ID NO: 141782 - DNA, 46 bp, Artificial Sequence
  Description of Artificial Sequence: Synthetic oligonucleotide
ttatagagatttcttccgtgtcaccagaatctttaaactactgtac

SEQ ID NO: 141783 - DNA, 45 bp, Artificial Sequence
  Description of Artificial Sequence: Synthetic oligonucleotide
tatagagatttcttccgtgtcaccagaatctttaaactactgtac

SEQ ID NO: 141784 - DNA, 44 bp, Artificial Sequence
  Description of Artificial Sequence: Synthetic oligonucleotide
atagagatttcttccgtgtcaccagaatctttaaactactgtac

SEQ ID NO: 141785 - DNA, 43 bp, Artificial Sequence
  Description of Artificial Sequence: Synthetic oligonucleotide
tagagatttcttccgtgtcaccagaatctttaaactactgtac

SEQ ID NO: 141786 - DNA, 42 bp, Artificial Sequence
  Description of Artificial Sequence: Synthetic oligonucleotide
agagatttcttccgtgtcaccagaatctttaaactactgtac

SEQ ID NO: 141787 - DNA, 41 bp, Artificial Sequence
  Description of Artificial Sequence: Synthetic oligonucleotide
gagatttcttccgtgtcaccagaatctttaaactactgtac

SEQ ID NO: 141788 - DNA, 41 bp, Artificial Sequence
  Description of Artificial Sequence: Synthetic oligonucleotide
agatttcttccgtgtcaccagaatctttaaactactgtacc

SEQ ID NO: 141789 - DNA, 40 bp, Artificial Sequence
  Description of Artificial Sequence: Synthetic oligonucleotide
gatttcttccgtgtcaccagaatctttaaactactgtacc

SEQ ID NO: 141790 - DNA, 41 bp, Artificial Sequence
  Description of Artificial Sequence: Synthetic oligonucleotide
atttcttccgtgtcaccagaatctttaaactactgtaccac

SEQ ID NO: 141791 - DNA, 40 bp, Artificial Sequence
  Description of Artificial Sequence: Synthetic oligonucleotide
tttcttccgtgtcaccagaatctttaaactactgtaccac

SEQ ID NO: 141792 - DNA, 39 bp, Artificial Sequence
  Description of Artificial Sequence: Synthetic oligonucleotide
ttcttccgtgtcaccagaatctttaaactactgtaccac

SEQ ID NO: 141793 - DNA, 38 bp, Artificial Sequence
  Description of Artificial Sequence: Synthetic oligonucleotide
tcttccgtgtcaccagaatctttaaactactgtaccac

SEQ ID NO: 141794 - DNA, 37 bp, Artificial Sequence
  Description of Artificial Sequence: Synthetic oligonucleotide
cttccgtgtcaccagaatctttaaactactgtaccac

SEQ ID NO: 141795 - DNA, 39 bp, Artificial Sequence
  Description of Artificial Sequence: Synthetic oligonucleotide
ttccgtgtcaccagaatctttaaactactgtaccacaag

SEQ ID NO: 141796 - DNA, 38 bp, Artificial Sequence
  Description of Artificial Sequence: Synthetic oligonucleotide
tccgtgtcaccagaatctttaaactactgtaccacaag

SEQ ID NO: 141797 - DNA, 37 bp, Artificial Sequence
  Description of Artificial Sequence: Synthetic oligonucleotide
ccgtgtcaccagaatctttaaactactgtaccacaag

SEQ ID NO: 141798 - DNA, 38 bp, Artificial Sequence
  Description of Artificial Sequence: Synthetic oligonucleotide
cgtgtcaccagaatctttaaactactgtaccacaagtg

SEQ ID NO: 141799 - DNA, 38 bp, Artificial Sequence
  Description of Artificial Sequence: Synthetic oligonucleotide
gtgtcaccagaatctttaaactactgtaccacaagtgg

SEQ ID NO: 141800 - DNA, 41 bp, Artificial Sequence
  Description of Artificial Sequence: Synthetic oligonucleotide
tgtcaccagaatctttaaactactgtaccacaagtggattg

SEQ ID NO: 141801 - DNA, 40 bp, Artificial Sequence
  Description of Artificial Sequence: Synthetic oligonucleotide
gtcaccagaatctttaaactactgtaccacaagtggattg

SEQ ID NO: 141802 - DNA, 40 bp, Artificial Sequence
  Description of Artificial Sequence: Synthetic oligonucleotide
tcaccagaatctttaaactactgtaccacaagtggattgg

SEQ ID NO: 141803 - DNA, 39 bp, Artificial Sequence
  Description of Artificial Sequence: Synthetic oligonucleotide
caccagaatctttaaactactgtaccacaagtggattgg

SEQ ID NO: 141804 - DNA, 42 bp, Artificial Sequence
  Description of Artificial Sequence: Synthetic oligonucleotide
accagaatctttaaactactgtaccacaagtggattggtaac

SEQ ID NO: 141805 - DNA, 41 bp, Artificial Sequence
  Description of Artificial Sequence: Synthetic oligonucleotide
ccagaatctttaaactactgtaccacaagtggattggtaac

SEQ ID NO: 141806 - DNA, 41 bp, Artificial Sequence
  Description of Artificial Sequence: Synthetic oligonucleotide
cagaatctttaaactactgtaccacaagtggattggtaacc

SEQ ID NO: 141807 - DNA, 41 bp, Artificial Sequence
  Description of Artificial Sequence: Synthetic oligonucleotide
agaatctttaaactactgtaccacaagtggattggtaaccc

SEQ ID NO: 141808 - DNA, 40 bp, Artificial Sequence
  Description of Artificial Sequence: Synthetic oligonucleotide
gaatctttaaactactgtaccacaagtggattggtaaccc

SEQ ID NO: 141809 - DNA, 41 bp, Artificial Sequence
  Description of Artificial Sequence: Synthetic oligonucleotide
aatctttaaactactgtaccacaagtggattggtaacccag

SEQ ID NO: 141810 - DNA, 40 bp, Artificial Sequence
  Description of Artificial Sequence: Synthetic oligonucleotide
atctttaaactactgtaccacaagtggattggtaacccag

SEQ ID NO: 141811 - DNA, 39 bp, Artificial Sequence
  Description of Artificial Sequence: Synthetic oligonucleotide
tctttaaactactgtaccacaagtggattggtaacccag

SEQ ID NO: 141812 - DNA, 38 bp, Artificial Sequence
  Description of Artificial Sequence: Synthetic oligonucleotide
ctttaaactactgtaccacaagtggattggtaacccag

SEQ ID NO: 141813 - DNA, 38 bp, Artificial Sequence
  Description of Artificial Sequence: Synthetic oligonucleotide
tttaaactactgtaccacaagtggattggtaacccagc

SEQ ID NO: 141814 - DNA, 37 bp, Artificial Sequence
  Description of Artificial Sequence: Synthetic oligonucleotide
ttaaactactgtaccacaagtggattggtaacccagc

SEQ ID NO: 141815 - DNA, 36 bp, Artificial Sequence
  Description of Artificial Sequence: Synthetic oligonucleotide
taaactactgtaccacaagtggattggtaacccagc

SEQ ID NO: 141816 - DNA, 35 bp, Artificial Sequence
  Description of Artificial Sequence: Synthetic oligonucleotide
aaactactgtaccacaagtggattggtaacccagc

SEQ ID NO: 141817 - DNA, 34 bp, Artificial Sequence
  Description of Artificial Sequence: Synthetic oligonucleotide
aactactgtaccacaagtggattggtaacccagc

SEQ ID NO: 141818 - DNA, 33 bp, Artificial Sequence
  Description of Artificial Sequence: Synthetic oligonucleotide
actactgtaccacaagtggattggtaacccagc

SEQ ID NO: 141819 - DNA, 32 bp, Artificial Sequence
  Description of Artificial Sequence: Synthetic oligonucleotide
ctactgtaccacaagtggattggtaacccagc

SEQ ID NO: 141820 - DNA, 33 bp, Artificial Sequence
  Description of Artificial Sequence: Synthetic oligonucleotide
tactgtaccacaagtggattggtaacccagctc

SEQ ID NO: 141821 - DNA, 32 bp, Artificial Sequence
  Description of Artificial Sequence: Synthetic oligonucleotide
actgtaccacaagtggattggtaacccagctc

SEQ ID NO: 141822 - DNA, 31 bp, Artificial Sequence
  Description of Artificial Sequence: Synthetic oligonucleotide
ctgtaccacaagtggattggtaacccagctc

SEQ ID NO: 141823 - DNA, 31 bp, Artificial Sequence
  Description of Artificial Sequence: Synthetic oligonucleotide
tgtaccacaagtggattggtaacccagctcc

SEQ ID NO: 141824 - DNA, 30 bp, Artificial Sequence
  Description of Artificial Sequence: Synthetic oligonucleotide
gtaccacaagtggattggtaacccagctcc

SEQ ID NO: 141825 - DNA, 31 bp, Artificial Sequence
  Description of Artificial Sequence: Synthetic oligonucleotide
taccacaagtggattggtaacccagctcctg

SEQ ID NO: 141826 - DNA, 30 bp, Artificial Sequence
  Description of Artificial Sequence: Synthetic oligonucleotide
accacaagtggattggtaacccagctcctg

SEQ ID NO: 141827 - DNA, 29 bp, Artificial Sequence
  Description of Artificial Sequence: Synthetic oligonucleotide
ccacaagtggattggtaacccagctcctg

SEQ ID NO: 141828 - DNA, 30 bp, Artificial Sequence
  Description of Artificial Sequence: Synthetic oligonucleotide
cacaagtggattggtaacccagctcctgag

SEQ ID NO: 141829 - DNA, 31 bp, Artificial Sequence
  Description of Artificial Sequence: Synthetic oligonucleotide
acaagtggattggtaacccagctcctgagag

SEQ ID NO: 141830 - DNA, 30 bp, Artificial Sequence
  Description of Artificial Sequence: Synthetic oligonucleotide
caagtggattggtaacccagctcctgagag

SEQ ID NO: 141831 - DNA, 31 bp, Artificial Sequence
  Description of Artificial Sequence: Synthetic oligonucleotide
aagtggattggtaacccagctcctgagagag

SEQ ID NO: 141832 - DNA, 30 bp, Artificial Sequence
  Description of Artificial Sequence: Synthetic oligonucleotide
agtggattggtaacccagctcctgagagag

SEQ ID NO: 141833 - DNA, 29 bp, Artificial Sequence
  Description of Artificial Sequence: Synthetic oligonucleotide
gtggattggtaacccagctcctgagagag

SEQ ID NO: 141834 - DNA, 29 bp, Artificial Sequence
  Description of Artificial Sequence: Synthetic oligonucleotide
tggattggtaacccagctcctgagagagc

SEQ ID NO: 141835 - DNA, 28 bp, Artificial Sequence
  Description of Artificial Sequence: Synthetic oligonucleotide
ggattggtaacccagctcctgagagagc

SEQ ID NO: 141836 - DNA, 29 bp, Artificial Sequence
  Description of Artificial Sequence: Synthetic oligonucleotide
gattggtaacccagctcctgagagagctg

SEQ ID NO: 141837 - DNA, 30 bp, Artificial Sequence
  Description of Artificial Sequence: Synthetic oligonucleotide
attggtaacccagctcctgagagagctgac

SEQ ID NO: 141838 - DNA, 29 bp, Artificial Sequence
  Description of Artificial Sequence: Synthetic oligonucleotide
ttggtaacccagctcctgagagagctgac

SEQ ID NO: 141839 - DNA, 28 bp, Artificial Sequence
  Description of Artificial Sequence: Synthetic oligonucleotide
tggtaacccagctcctgagagagctgac

SEQ ID NO: 141840 - DNA, 27 bp, Artificial Sequence
  Description of Artificial Sequence: Synthetic oligonucleotide
ggtaacccagctcctgagagagctgac

SEQ ID NO: 141841 - DNA, 28 bp, Artificial Sequence
  Description of Artificial Sequence: Synthetic oligonucleotide
gtaacccagctcctgagagagctgactg

SEQ ID NO: 141842 - DNA, 28 bp, Artificial Sequence
  Description of Artificial Sequence: Synthetic oligonucleotide
taacccagctcctgagagagctgactgg

SEQ ID NO: 141843 - DNA, 27 bp, Artificial Sequence
  Description of Artificial Sequence: Synthetic oligonucleotide
aacccagctcctgagagagctgactgg

SEQ ID NO: 141844 - DNA, 27 bp, Artificial Sequence
  Description of Artificial Sequence: Synthetic oligonucleotide
acccagctcctgagagagctgactggt

SEQ ID NO: 141845 - DNA, 26 bp, Artificial Sequence
  Description of Artificial Sequence: Synthetic oligonucleotide
cccagctcctgagagagctgactggt

SEQ ID NO: 141846 - DNA, 27 bp, Artificial Sequence
  Description of Artificial Sequence: Synthetic oligonucleotide
ccagctcctgagagagctgactggtga

SEQ ID NO: 141847 - DNA, 27 bp, Artificial Sequence
  Description of Artificial Sequence: Synthetic oligonucleotide
cagctcctgagagagctgactggtgag

SEQ ID NO: 141848 - DNA, 27 bp, Artificial Sequence
  Description of Artificial Sequence: Synthetic oligonucleotide
agctcctgagagagctgactggtgagg

SEQ ID NO: 141849 - DNA, 27 bp, Artificial Sequence
  Description of Artificial Sequence: Synthetic oligonucleotide
gctcctgagagagctgactggtgagga

SEQ ID NO: 141850 - DNA, 28 bp, Artificial Sequence
  Description of Artificial Sequence: Synthetic oligonucleotide
ctcctgagagagctgactggtgaggatg

SEQ ID NO: 141851 - DNA, 29 bp, Artificial Sequence
  Description of Artificial Sequence: Synthetic oligonucleotide
tcctgagagagctgactggtgaggatgtg

SEQ ID NO: 141852 - DNA, 28 bp, Artificial Sequence
  Description of Artificial Sequence: Synthetic oligonucleotide
cctgagagagctgactggtgaggatgtg

SEQ ID NO: 141853 - DNA, 30 bp, Artificial Sequence
  Description of Artificial Sequence: Synthetic oligonucleotide
ctgagagagctgactggtgaggatgtgttg

SEQ ID NO: 141854 - DNA, 30 bp, Artificial Sequence
  Description of Artificial Sequence: Synthetic oligonucleotide
tgagagagctgactggtgaggatgtgttgg

SEQ ID NO: 141855 - DNA, 29 bp, Artificial Sequence
  Description of Artificial Sequence: Synthetic oligonucleotide
gagagagctgactggtgaggatgtgttgg

SEQ ID NO: 141856 - DNA, 30 bp, Artificial Sequence
  Description of Artificial Sequence: Synthetic oligonucleotide
agagagctgactggtgaggatgtgttggtc

SEQ ID NO: 141857 - DNA, 29 bp, Artificial Sequence
  Description of Artificial Sequence: Synthetic oligonucleotide
gagagctgactggtgaggatgtgttggtc

SEQ ID NO: 141858 - DNA, 30 bp, Artificial Sequence
  Description of Artificial Sequence: Synthetic oligonucleotide
agagctgactggtgaggatgtgttggtcag

SEQ ID NO: 141859 - DNA, 29 bp, Artificial Sequence
  Description of Artificial Sequence: Synthetic oligonucleotide
gagctgactggtgaggatgtgttggtcag

SEQ ID NO: 141860 - DNA, 30 bp, Artificial Sequence
  Description of Artificial Sequence: Synthetic oligonucleotide
agctgactggtgaggatgtgttggtcagag

SEQ ID NO: 141861 - DNA, 29 bp, Artificial Sequence
  Description of Artificial Sequence: Synthetic oligonucleotide
gctgactggtgaggatgtgttggtcagag

SEQ ID NO: 141862 - DNA, 29 bp, Artificial Sequence
  Description of Artificial Sequence: Synthetic oligonucleotide
ctgactggtgaggatgtgttggtcagagc

SEQ ID NO: 141863 - DNA, 29 bp, Artificial Sequence
  Description of Artificial Sequence: Synthetic oligonucleotide
tgactggtgaggatgtgttggtcagagcc

SEQ ID NO: 141864 - DNA, 28 bp, Artificial Sequence
  Description of Artificial Sequence: Synthetic oligonucleotide
gactggtgaggatgtgttggtcagagcc

SEQ ID NO: 141865 - DNA, 29 bp, Artificial Sequence
  Description of Artificial Sequence: Synthetic oligonucleotide
actggtgaggatgtgttggtcagagccac

SEQ ID NO: 141866 - DNA, 28 bp, Artificial Sequence
  Description of Artificial Sequence: Synthetic oligonucleotide
ctggtgaggatgtgttggtcagagccac

SEQ ID NO: 141867 - DNA, 28 bp, Artificial Sequence
  Description of Artificial Sequence: Synthetic oligonucleotide
tggtgaggatgtgttggtcagagccacc

SEQ ID NO: 141868 - DNA, 27 bp, Artificial Sequence
  Description of Artificial Sequence: Synthetic oligonucleotide
ggtgaggatgtgttggtcagagccacc

SEQ ID NO: 141869 - DNA, 28 bp, Artificial Sequence
  Description of Artificial Sequence: Synthetic oligonucleotide
gtgaggatgtgttggtcagagccacctg

SEQ ID NO: 141870 - DNA, 32 bp, Artificial Sequence
  Description of Artificial Sequence: Synthetic oligonucleotide
tgaggatgtgttggtcagagccacctgtatag

SEQ ID NO: 141871 - DNA, 31 bp, Artificial Sequence
  Description of Artificial Sequence: Synthetic oligonucleotide
gaggatgtgttggtcagagccacctgtatag

SEQ ID NO: 141872 - DNA, 35 bp, Artificial Sequence
  Description of Artificial Sequence: Synthetic oligonucleotide
aggatgtgttggtcagagccacctgtatagaaatg

SEQ ID NO: 141873 - DNA, 34 bp, Artificial Sequence
  Description of Artificial Sequence: Synthetic oligonucleotide
ggatgtgttggtcagagccacctgtatagaaatg

SEQ ID NO: 141874 - DNA, 34 bp, Artificial Sequence
  Description of Artificial Sequence: Synthetic oligonucleotide
gatgtgttggtcagagccacctgtatagaaatgg

SEQ ID NO: 141875 - DNA, 35 bp, Artificial Sequence
  Description of Artificial Sequence: Synthetic oligonucleotide
atgtgttggtcagagccacctgtatagaaatggtg

SEQ ID NO: 141876 - DNA, 34 bp, Artificial Sequence
  Description of Artificial Sequence: Synthetic oligonucleotide
tgtgttggtcagagccacctgtatagaaatggtg

SEQ ID NO: 141877 - DNA, 33 bp, Artificial Sequence
  Description of Artificial Sequence: Synthetic oligonucleotide
gtgttggtcagagccacctgtatagaaatggtg

SEQ ID NO: 141878 - DNA, 34 bp, Artificial Sequence
  Description of Artificial Sequence: Synthetic oligonucleotide
tgttggtcagagccacctgtatagaaatggtgac

SEQ ID NO: 141879 - DNA, 33 bp, Artificial Sequence
  Description of Artificial Sequence: Synthetic oligonucleotide
gttggtcagagccacctgtatagaaatggtgac

SEQ ID NO: 141880 - DNA, 35 bp, Artificial Sequence
  Description of Artificial Sequence: Synthetic oligonucleotide
ttggtcagagccacctgtatagaaatggtgacatc

SEQ ID NO: 141881 - DNA, 34 bp, Artificial Sequence
  Description of Artificial Sequence: Synthetic oligonucleotide
tggtcagagccacctgtatagaaatggtgacatc

SEQ ID NO: 141882 - DNA, 33 bp, Artificial Sequence
  Description of Artificial Sequence: Synthetic oligonucleotide
ggtcagagccacctgtatagaaatggtgacatc

SEQ ID NO: 141883 - DNA, 34 bp, Artificial Sequence
  Description of Artificial Sequence: Synthetic oligonucleotide
gtcagagccacctgtatagaaatggtgacatcac

SEQ ID NO: 141884 - DNA, 35 bp, Artificial Sequence
  Description of Artificial Sequence: Synthetic oligonucleotide
tcagagccacctgtatagaaatggtgacatcactg

SEQ ID NO: 141885 - DNA, 34 bp, Artificial Sequence
  Description of Artificial Sequence: Synthetic oligonucleotide
cagagccacctgtatagaaatggtgacatcactg

SEQ ID NO: 141886 - DNA, 34 bp, Artificial Sequence
  Description of Artificial Sequence: Synthetic oligonucleotide
agagccacctgtatagaaatggtgacatcactgg

SEQ ID NO: 141887 - DNA, 33 bp, Artificial Sequence
  Description of Artificial Sequence: Synthetic oligonucleotide
gagccacctgtatagaaatggtgacatcactgg

SEQ ID NO: 141888 - DNA, 33 bp, Artificial Sequence
  Description of Artificial Sequence: Synthetic oligonucleotide
agccacctgtatagaaatggtgacatcactggc

SEQ ID NO: 141889 - DNA, 32 bp, Artificial Sequence
  Description of Artificial Sequence: Synthetic oligonucleotide
gccacctgtatagaaatggtgacatcactggc

SEQ ID NO: 141890 - DNA, 37 bp, Artificial Sequence
  Description of Artificial Sequence: Synthetic oligonucleotide
ccacctgtatagaaatggtgacatcactggcatatac

SEQ ID NO: 141891 - DNA, 38 bp, Artificial Sequence
  Description of Artificial Sequence: Synthetic oligonucleotide
cacctgtatagaaatggtgacatcactggcatatactc

SEQ ID NO: 141892 - DNA, 40 bp, Artificial Sequence
  Description of Artificial Sequence: Synthetic oligonucleotide
acctgtatagaaatggtgacatcactggcatatactcatc

SEQ ID NO: 141893 - DNA, 39 bp, Artificial Sequence
  Description of Artificial Sequence: Synthetic oligonucleotide
cctgtatagaaatggtgacatcactggcatatactcatc

SEQ ID NO: 141894 - DNA, 41 bp, Artificial Sequence
  Description of Artificial Sequence: Synthetic oligonucleotide
ctgtatagaaatggtgacatcactggcatatactcatcatg

SEQ ID NO: 141895 - DNA, 41 bp, Artificial Sequence
  Description of Artificial Sequence: Synthetic oligonucleotide
tgtatagaaatggtgacatcactggcatatactcatcatgg

SEQ ID NO: 141896 - DNA, 40 bp, Artificial Sequence
  Description of Artificial Sequence: Synthetic oligonucleotide
gtatagaaatggtgacatcactggcatatactcatcatgg

SEQ ID NO: 141897 - DNA, 40 bp, Artificial Sequence
  Description of Artificial Sequence: Synthetic oligonucleotide
tatagaaatggtgacatcactggcatatactcatcatggg

SEQ ID NO: 141898 - DNA, 39 bp, Artificial Sequence
  Description of Artificial Sequence: Synthetic oligonucleotide
atagaaatggtgacatcactggcatatactcatcatggg

SEQ ID NO: 141899 - DNA, 38 bp, Artificial Sequence
  Description of Artificial Sequence: Synthetic oligonucleotide
tagaaatggtgacatcactggcatatactcatcatggg

SEQ ID NO: 141900 - DNA, 37 bp, Artificial Sequence
  Description of Artificial Sequence: Synthetic oligonucleotide
agaaatggtgacatcactggcatatactcatcatggg

SEQ ID NO: 141901 - DNA, 36 bp, Artificial Sequence
  Description of Artificial Sequence: Synthetic oligonucleotide
gaaatggtgacatcactggcatatactcatcatggg

SEQ ID NO: 141902 - DNA, 36 bp, Artificial Sequence
  Description of Artificial Sequence: Synthetic oligonucleotide
aaatggtgacatcactggcatatactcatcatgggc

SEQ ID NO: 141903 - DNA, 35 bp, Artificial Sequence
  Description of Artificial Sequence: Synthetic oligonucleotide
aatggtgacatcactggcatatactcatcatgggc

SEQ ID NO: 141904 - DNA, 34 bp, Artificial Sequence
  Description of Artificial Sequence: Synthetic oligonucleotide
atggtgacatcactggcatatactcatcatgggc

SEQ ID NO: 141905 - DNA, 33 bp, Artificial Sequence
  Description of Artificial Sequence: Synthetic oligonucleotide
tggtgacatcactggcatatactcatcatgggc

SEQ ID NO: 141906 - DNA, 32 bp, Artificial Sequence
  Description of Artificial Sequence: Synthetic oligonucleotide
ggtgacatcactggcatatactcatcatgggc

SEQ ID NO: 141907 - DNA, 32 bp, Artificial Sequence
  Description of Artificial Sequence: Synthetic oligonucleotide
gtgacatcactggcatatactcatcatgggcg

SEQ ID NO: 141908 - DNA, 33 bp, Artificial Sequence
  Description of Artificial Sequence: Synthetic oligonucleotide
tgacatcactggcatatactcatcatgggcgac

SEQ ID NO: 141909 - DNA, 32 bp, Artificial Sequence
  Description of Artificial Sequence: Synthetic oligonucleotide
gacatcactggcatatactcatcatgggcgac

SEQ ID NO: 141910 - DNA, 37 bp, Artificial Sequence
  Description of Artificial Sequence: Synthetic oligonucleotide
acatcactggcatatactcatcatgggcgacaatatc

SEQ ID NO: 141911 - DNA, 36 bp, Artificial Sequence
  Description of Artificial Sequence: Synthetic oligonucleotide
catcactggcatatactcatcatgggcgacaatatc

SEQ ID NO: 141912 - DNA, 38 bp, Artificial Sequence
  Description of Artificial Sequence: Synthetic oligonucleotide
atcactggcatatactcatcatgggcgacaatatcttg

SEQ ID NO: 141913 - DNA, 37 bp, Artificial Sequence
  Description of Artificial Sequence: Synthetic oligonucleotide
tcactggcatatactcatcatgggcgacaatatcttg

SEQ ID NO: 141914 - DNA, 36 bp, Artificial Sequence
  Description of Artificial Sequence: Synthetic oligonucleotide
cactggcatatactcatcatgggcgacaatatcttg

SEQ ID NO: 141915 - DNA, 36 bp, Artificial Sequence
  Description of Artificial Sequence: Synthetic oligonucleotide
actggcatatactcatcatgggcgacaatatcttgc

SEQ ID NO: 141916 - DNA, 35 bp, Artificial Sequence
  Description of Artificial Sequence: Synthetic oligonucleotide
ctggcatatactcatcatgggcgacaatatcttgc

SEQ ID NO: 141917 - DNA, 36 bp, Artificial Sequence
  Description of Artificial Sequence: Synthetic oligonucleotide
tggcatatactcatcatgggcgacaatatcttgctc

SEQ ID NO: 141918 - DNA, 35 bp, Artificial Sequence
  Description of Artificial Sequence: Synthetic oligonucleotide
ggcatatactcatcatgggcgacaatatcttgctc

SEQ ID NO: 141919 - DNA, 37 bp, Artificial Sequence
  Description of Artificial Sequence: Synthetic oligonucleotide
gcatatactcatcatgggcgacaatatcttgctcaag

SEQ ID NO: 141920 - DNA, 39 bp, Artificial Sequence
  Description of Artificial Sequence: Synthetic oligonucleotide
catatactcatcatgggcgacaatatcttgctcaagaag

SEQ ID NO: 141921 - DNA, 39 bp, Artificial Sequence
  Description of Artificial Sequence: Synthetic oligonucleotide
atatactcatcatgggcgacaatatcttgctcaagaagg

SEQ ID NO: 141922 - DNA, 38 bp, Artificial Sequence
  Description of Artificial Sequence: Synthetic oligonucleotide
tatactcatcatgggcgacaatatcttgctcaagaagg

SEQ ID NO: 141923 - DNA, 37 bp, Artificial Sequence
  Description of Artificial Sequence: Synthetic oligonucleotide
atactcatcatgggcgacaatatcttgctcaagaagg

SEQ ID NO: 141924 - DNA, 36 bp, Artificial Sequence
  Description of Artificial Sequence: Synthetic oligonucleotide
tactcatcatgggcgacaatatcttgctcaagaagg

SEQ ID NO: 141925 - DNA, 35 bp, Artificial Sequence
  Description of Artificial Sequence: Synthetic oligonucleotide
actcatcatgggcgacaatatcttgctcaagaagg

SEQ ID NO: 141926 - DNA, 34 bp, Artificial Sequence
  Description of Artificial Sequence: Synthetic oligonucleotide
ctcatcatgggcgacaatatcttgctcaagaagg

SEQ ID NO: 141927 - DNA, 35 bp, Artificial Sequence
  Description of Artificial Sequence: Synthetic oligonucleotide
tcatcatgggcgacaatatcttgctcaagaaggag

SEQ ID NO: 141928 - DNA, 34 bp, Artificial Sequence
  Description of Artificial Sequence: Synthetic oligonucleotide
catcatgggcgacaatatcttgctcaagaaggag

SEQ ID NO: 141929 - DNA, 39 bp, Artificial Sequence
  Description of Artificial Sequence: Synthetic oligonucleotide
atcatgggcgacaatatcttgctcaagaaggagtaattg

SEQ ID NO: 141930 - DNA, 38 bp, Artificial Sequence
  Description of Artificial Sequence: Synthetic oligonucleotide
tcatgggcgacaatatcttgctcaagaaggagtaattg

SEQ ID NO: 141931 - DNA, 37 bp, Artificial Sequence
  Description of Artificial Sequence: Synthetic oligonucleotide
catgggcgacaatatcttgctcaagaaggagtaattg

SEQ ID NO: 141932 - DNA, 38 bp, Artificial Sequence
  Description of Artificial Sequence: Synthetic oligonucleotide
atgggcgacaatatcttgctcaagaaggagtaattgac

SEQ ID NO: 141933 - DNA, 37 bp, Artificial Sequence
  Description of Artificial Sequence: Synthetic oligonucleotide
tgggcgacaatatcttgctcaagaaggagtaattgac

SEQ ID NO: 141934 - DNA, 36 bp, Artificial Sequence
  Description of Artificial Sequence: Synthetic oligonucleotide
gggcgacaatatcttgctcaagaaggagtaattgac

SEQ ID NO: 141935 - DNA, 36 bp, Artificial Sequence
  Description of Artificial Sequence: Synthetic oligonucleotide
ggcgacaatatcttgctcaagaaggagtaattgacc

SEQ ID NO: 141936 - DNA, 42 bp, Artificial Sequence
  Description of Artificial Sequence: Synthetic oligonucleotide
gcgacaatatcttgctcaagaaggagtaattgaccaaatttc

SEQ ID NO: 141937 - DNA, 52 bp, Artificial Sequence
  Description of Artificial Sequence: Synthetic oligonucleotide
cgacaatatcttgctcaagaaggagtaattgaccaaatttctaatataattg

SEQ ID NO: 141938 - DNA, 54 bp, Artificial Sequence
  Description of Artificial Sequence: Synthetic oligonucleotide
gacaatatcttgctcaagaaggagtaattgaccaaatttctaatataattgttg

SEQ ID NO: 141939 - DNA, 54 bp, Artificial Sequence
  Description of Artificial Sequence: Synthetic oligonucleotide
acaatatcttgctcaagaaggagtaattgaccaaatttctaatataattgttgg

SEQ ID NO: 141940 - DNA, 53 bp, Artificial Sequence
  Description of Artificial Sequence: Synthetic oligonucleotide
caatatcttgctcaagaaggagtaattgaccaaatttctaatataattgttgg

SEQ ID NO: 141941 - DNA, 53 bp, Artificial Sequence
  Description of Artificial Sequence: Synthetic oligonucleotide
aatatcttgctcaagaaggagtaattgaccaaatttctaatataattgttggg

SEQ ID NO: 141942 - DNA, 52 bp, Artificial Sequence
  Description of Artificial Sequence: Synthetic oligonucleotide
atatcttgctcaagaaggagtaattgaccaaatttctaatataattgttggg

SEQ ID NO: 141943 - DNA, 51 bp, Artificial Sequence
  Description of Artificial Sequence: Synthetic oligonucleotide
tatcttgctcaagaaggagtaattgaccaaatttctaatataattgttggg

SEQ ID NO: 141944 - DNA, 50 bp, Artificial Sequence
  Description of Artificial Sequence: Synthetic oligonucleotide
atcttgctcaagaaggagtaattgaccaaatttctaatataattgttggg

SEQ ID NO: 141945 - DNA, 49 bp, Artificial Sequence
  Description of Artificial Sequence: Synthetic oligonucleotide
tcttgctcaagaaggagtaattgaccaaatttctaatataattgttggg

SEQ ID NO: 141946 - DNA, 48 bp, Artificial Sequence
  Description of Artificial Sequence: Synthetic oligonucleotide
cttgctcaagaaggagtaattgaccaaatttctaatataattgttggg

SEQ ID NO: 141947 - DNA, 48 bp, Artificial Sequence
  Description of Artificial Sequence: Synthetic oligonucleotide
ttgctcaagaaggagtaattgaccaaatttctaatataattgttgggg

SEQ ID NO: 141948 - DNA, 47 bp, Artificial Sequence
  Description of Artificial Sequence: Synthetic oligonucleotide
tgctcaagaaggagtaattgaccaaatttctaatataattgttgggg

SEQ ID NO: 141949 - DNA, 46 bp, Artificial Sequence
  Description of Artificial Sequence: Synthetic oligonucleotide
gctcaagaaggagtaattgaccaaatttctaatataattgttgggg

SEQ ID NO: 141950 - DNA, 46 bp, Artificial Sequence
  Description of Artificial Sequence: Synthetic oligonucleotide
ctcaagaaggagtaattgaccaaatttctaatataattgttggggc

SEQ ID NO: 141951 - DNA, 47 bp, Artificial Sequence
  Description of Artificial Sequence: Synthetic oligonucleotide
tcaagaaggagtaattgaccaaatttctaatataattgttggggcag

SEQ ID NO: 141952 - DNA, 46 bp, Artificial Sequence
  Description of Artificial Sequence: Synthetic oligonucleotide
caagaaggagtaattgaccaaatttctaatataattgttggggcag

SEQ ID NO: 141953 - DNA, 49 bp, Artificial Sequence
  Description of Artificial Sequence: Synthetic oligonucleotide
aagaaggagtaattgaccaaatttctaatataattgttggggcagattc

SEQ ID NO: 141954 - DNA, 48 bp, Artificial Sequence
  Description of Artificial Sequence: Synthetic oligonucleotide
agaaggagtaattgaccaaatttctaatataattgttggggcagattc

SEQ ID NO: 141955 - DNA, 47 bp, Artificial Sequence
  Description of Artificial Sequence: Synthetic oligonucleotide
gaaggagtaattgaccaaatttctaatataattgttggggcagattc

SEQ ID NO: 141956 - DNA, 48 bp, Artificial Sequence
  Description of Artificial Sequence: Synthetic oligonucleotide
aaggagtaattgaccaaatttctaatataattgttggggcagattcag

SEQ ID NO: 141957 - DNA, 47 bp, Artificial Sequence
  Description of Artificial Sequence: Synthetic oligonucleotide
aggagtaattgaccaaatttctaatataattgttggggcagattcag

SEQ ID NO: 141958 - DNA, 46 bp, Artificial Sequence
  Description of Artificial Sequence: Synthetic oligonucleotide
ggagtaattgaccaaatttctaatataattgttggggcagattcag

SEQ ID NO: 141959 - DNA, 47 bp, Artificial Sequence
  Description of Artificial Sequence: Synthetic oligonucleotide
gagtaattgaccaaatttctaatataattgttggggcagattcagac

SEQ ID NO: 141960 - DNA, 47 bp, Artificial Sequence
  Description of Artificial Sequence: Synthetic oligonucleotide
agtaattgaccaaatttctaatataattgttggggcagattcagacc

SEQ ID NO: 141961 - DNA, 46 bp, Artificial Sequence
  Description of Artificial Sequence: Synthetic oligonucleotide
gtaattgaccaaatttctaatataattgttggggcagattcagacc

SEQ ID NO: 141962 - DNA, 46 bp, Artificial Sequence
  Description of Artificial Sequence: Synthetic oligonucleotide
taattgaccaaatttctaatataattgttggggcagattcagaccc

SEQ ID NO: 141963 - DNA, 45 bp, Artificial Sequence
  Description of Artificial Sequence: Synthetic oligonucleotide
aattgaccaaatttctaatataattgttggggcagattcagaccc

SEQ ID NO: 141964 - DNA, 44 bp, Artificial Sequence
  Description of Artificial Sequence: Synthetic oligonucleotide
attgaccaaatttctaatataattgttggggcagattcagaccc

SEQ ID NO: 141965 - DNA, 43 bp, Artificial Sequence
  Description of Artificial Sequence: Synthetic oligonucleotide
ttgaccaaatttctaatataattgttggggcagattcagaccc

SEQ ID NO: 141966 - DNA, 42 bp, Artificial Sequence
  Description of Artificial Sequence: Synthetic oligonucleotide
tgaccaaatttctaatataattgttggggcagattcagaccc

SEQ ID NO: 141967 - DNA, 41 bp, Artificial Sequence
  Description of Artificial Sequence: Synthetic oligonucleotide
gaccaaatttctaatataattgttggggcagattcagaccc

SEQ ID NO: 141968 - DNA, 44 bp, Artificial Sequence
  Description of Artificial Sequence: Synthetic oligonucleotide
accaaatttctaatataattgttggggcagattcagaccctttc

SEQ ID NO: 141969 - DNA, 43 bp, Artificial Sequence
  Description of Artificial Sequence: Synthetic oligonucleotide
ccaaatttctaatataattgttggggcagattcagaccctttc

SEQ ID NO: 141970 - DNA, 44 bp, Artificial Sequence
  Description of Artificial Sequence: Synthetic oligonucleotide
caaatttctaatataattgttggggcagattcagaccctttctc

SEQ ID NO: 141971 - DNA, 46 bp, Artificial Sequence
  Description of Artificial Sequence: Synthetic oligonucleotide
aaatttctaatataattgttggggcagattcagaccctttctctag

SEQ ID NO: 141972 - DNA, 45 bp, Artificial Sequence
  Description of Artificial Sequence: Synthetic oligonucleotide
aatttctaatataattgttggggcagattcagaccctttctctag

SEQ ID NO: 141973 - DNA, 44 bp, Artificial Sequence
  Description of Artificial Sequence: Synthetic oligonucleotide
atttctaatataattgttggggcagattcagaccctttctctag

SEQ ID NO: 141974 - DNA, 43 bp, Artificial Sequence
  Description of Artificial Sequence: Synthetic oligonucleotide
tttctaatataattgttggggcagattcagaccctttctctag

SEQ ID NO: 141975 - DNA, 42 bp, Artificial Sequence
  Description of Artificial Sequence: Synthetic oligonucleotide
ttctaatataattgttggggcagattcagaccctttctctag

SEQ ID NO: 141976 - DNA, 41 bp, Artificial Sequence
  Description of Artificial Sequence: Synthetic oligonucleotide
tctaatataattgttggggcagattcagaccctttctctag

SEQ ID NO: 141977 - DNA, 40 bp, Artificial Sequence
  Description of Artificial Sequence: Synthetic oligonucleotide
ctaatataattgttggggcagattcagaccctttctctag

SEQ ID NO: 141978 - DNA, 40 bp, Artificial Sequence
  Description of Artificial Sequence: Synthetic oligonucleotide
taatataattgttggggcagattcagaccctttctctagc

SEQ ID NO: 141979 - DNA, 39 bp, Artificial Sequence
  Description of Artificial Sequence: Synthetic oligonucleotide
aatataattgttggggcagattcagaccctttctctagc

SEQ ID NO: 141980 - DNA, 38 bp, Artificial Sequence
  Description of Artificial Sequence: Synthetic oligonucleotide
atataattgttggggcagattcagaccctttctctagc

SEQ ID NO: 141981 - DNA, 37 bp, Artificial Sequence
  Description of Artificial Sequence: Synthetic oligonucleotide
tataattgttggggcagattcagaccctttctctagc

SEQ ID NO: 141982 - DNA, 36 bp, Artificial Sequence
  Description of Artificial Sequence: Synthetic oligonucleotide
ataattgttggggcagattcagaccctttctctagc

SEQ ID NO: 141983 - DNA, 35 bp, Artificial Sequence
  Description of Artificial Sequence: Synthetic oligonucleotide
taattgttggggcagattcagaccctttctctagc

SEQ ID NO: 141984 - DNA, 34 bp, Artificial Sequence
  Description of Artificial Sequence: Synthetic oligonucleotide
aattgttggggcagattcagaccctttctctagc

SEQ ID NO: 141985 - DNA, 33 bp, Artificial Sequence
  Description of Artificial Sequence: Synthetic oligonucleotide
attgttggggcagattcagaccctttctctagc

SEQ ID NO: 141986 - DNA, 32 bp, Artificial Sequence
  Description of Artificial Sequence: Synthetic oligonucleotide
ttgttggggcagattcagaccctttctctagc

SEQ ID NO: 141987 - DNA, 31 bp, Artificial Sequence
  Description of Artificial Sequence: Synthetic oligonucleotide
tgttggggcagattcagaccctttctctagc

SEQ ID NO: 141988 - DNA, 30 bp, Artificial Sequence
  Description of Artificial Sequence: Synthetic oligonucleotide
gttggggcagattcagaccctttctctagc

SEQ ID NO: 141989 - DNA, 32 bp, Artificial Sequence
  Description of Artificial Sequence: Synthetic oligonucleotide
ttggggcagattcagaccctttctctagcttc

SEQ ID NO: 141990 - DNA, 31 bp, Artificial Sequence
  Description of Artificial Sequence: Synthetic oligonucleotide
tggggcagattcagaccctttctctagcttc

SEQ ID NO: 141991 - DNA, 30 bp, Artificial Sequence
  Description of Artificial Sequence: Synthetic oligonucleotide
ggggcagattcagaccctttctctagcttc

SEQ ID NO: 141992 - DNA, 33 bp, Artificial Sequence
  Description of Artificial Sequence: Synthetic oligonucleotide
gggcagattcagaccctttctctagcttctatc

SEQ ID NO: 141993 - DNA, 34 bp, Artificial Sequence
  Description of Artificial Sequence: Synthetic oligonucleotide
ggcagattcagaccctttctctagcttctatctg

SEQ ID NO: 141994 - DNA, 34 bp, Artificial Sequence
  Description of Artificial Sequence: Synthetic oligonucleotide
gcagattcagaccctttctctagcttctatctgc

SEQ ID NO: 141995 - DNA, 34 bp, Artificial Sequence
  Description of Artificial Sequence: Synthetic oligonucleotide
cagattcagaccctttctctagcttctatctgcc

SEQ ID NO: 141996 - DNA, 35 bp, Artificial Sequence
  Description of Artificial Sequence: Synthetic oligonucleotide
agattcagaccctttctctagcttctatctgccag

SEQ ID NO: 141997 - DNA, 34 bp, Artificial Sequence
  Description of Artificial Sequence: Synthetic oligonucleotide
gattcagaccctttctctagcttctatctgccag

SEQ ID NO: 141998 - DNA, 34 bp, Artificial Sequence
  Description of Artificial Sequence: Synthetic oligonucleotide
attcagaccctttctctagcttctatctgccagg

SEQ ID NO: 141999 - DNA, 33 bp, Artificial Sequence
  Description of Artificial Sequence: Synthetic oligonucleotide
ttcagaccctttctctagcttctatctgccagg

SEQ ID NO: 142000 - DNA, 32 bp, Artificial Sequence
  Description of Artificial Sequence: Synthetic oligonucleotide
tcagaccctttctctagcttctatctgccagg

SEQ ID NO: 142001 - DNA, 31 bp, Artificial Sequence
  Description of Artificial Sequence: Synthetic oligonucleotide
cagaccctttctctagcttctatctgccagg

SEQ ID NO: 142002 - DNA, 34 bp, Artificial Sequence
  Description of Artificial Sequence: Synthetic oligonucleotide
agaccctttctctagcttctatctgccaggattc

SEQ ID NO: 142003 - DNA, 33 bp, Artificial Sequence
  Description of Artificial Sequence: Synthetic oligonucleotide
gaccctttctctagcttctatctgccaggattc

SEQ ID NO: 142004 - DNA, 33 bp, Artificial Sequence
  Description of Artificial Sequence: Synthetic oligonucleotide
accctttctctagcttctatctgccaggattcg

SEQ ID NO: 142005 - DNA, 32 bp, Artificial Sequence
  Description of Artificial Sequence: Synthetic oligonucleotide
ccctttctctagcttctatctgccaggattcg

SEQ ID NO: 142006 - DNA, 33 bp, Artificial Sequence
  Description of Artificial Sequence: Synthetic oligonucleotide
cctttctctagcttctatctgccaggattcgtg

SEQ ID NO: 142007 - DNA, 35 bp, Artificial Sequence
  Description of Artificial Sequence: Synthetic oligonucleotide
ctttctctagcttctatctgccaggattcgtgaag

SEQ ID NO: 142008 - DNA, 41 bp, Artificial Sequence
  Description of Artificial Sequence: Synthetic oligonucleotide
tttctctagcttctatctgccaggattcgtgaagttttttg

SEQ ID NO: 142009 - DNA, 40 bp, Artificial Sequence
  Description of Artificial Sequence: Synthetic oligonucleotide
ttctctagcttctatctgccaggattcgtgaagttttttg

SEQ ID NO: 142010 - DNA, 39 bp, Artificial Sequence
  Description of Artificial Sequence: Synthetic oligonucleotide
tctctagcttctatctgccaggattcgtgaagttttttg

SEQ ID NO: 142011 - DNA, 38 bp, Artificial Sequence
  Description of Artificial Sequence: Synthetic oligonucleotide
ctctagcttctatctgccaggattcgtgaagttttttg

SEQ ID NO: 142012 - DNA, 38 bp, Artificial Sequence
  Description of Artificial Sequence: Synthetic oligonucleotide
tctagcttctatctgccaggattcgtgaagttttttgg

SEQ ID NO: 142013 - DNA, 37 bp, Artificial Sequence
  Description of Artificial Sequence: Synthetic oligonucleotide
ctagcttctatctgccaggattcgtgaagttttttgg

SEQ ID NO: 142014 - DNA, 40 bp, Artificial Sequence
  Description of Artificial Sequence: Synthetic oligonucleotide
tagcttctatctgccaggattcgtgaagttttttggaaac

SEQ ID NO: 142015 - DNA, 39 bp, Artificial Sequence
  Description of Artificial Sequence: Synthetic oligonucleotide
agcttctatctgccaggattcgtgaagttttttggaaac

SEQ ID NO: 142016 - DNA, 38 bp, Artificial Sequence
  Description of Artificial Sequence: Synthetic oligonucleotide
gcttctatctgccaggattcgtgaagttttttggaaac

SEQ ID NO: 142017 - DNA, 38 bp, Artificial Sequence
  Description of Artificial Sequence: Synthetic oligonucleotide
cttctatctgccaggattcgtgaagttttttggaaacc

SEQ ID NO: 142018 - DNA, 39 bp, Artificial Sequence
  Description of Artificial Sequence: Synthetic oligonucleotide
ttctatctgccaggattcgtgaagttttttggaaacctg

SEQ ID NO: 142019 - DNA, 38 bp, Artificial Sequence
  Description of Artificial Sequence: Synthetic oligonucleotide
tctatctgccaggattcgtgaagttttttggaaacctg

SEQ ID NO: 142020 - DNA, 37 bp, Artificial Sequence
  Description of Artificial Sequence: Synthetic oligonucleotide
ctatctgccaggattcgtgaagttttttggaaacctg

SEQ ID NO: 142021 - DNA, 37 bp, Artificial Sequence
  Description of Artificial Sequence: Synthetic oligonucleotide
tatctgccaggattcgtgaagttttttggaaacctgg

SEQ ID NO: 142022 - DNA, 36 bp, Artificial Sequence
  Description of Artificial Sequence: Synthetic oligonucleotide
atctgccaggattcgtgaagttttttggaaacctgg

SEQ ID NO: 142023 - DNA, 35 bp, Artificial Sequence
  Description of Artificial Sequence: Synthetic oligonucleotide
tctgccaggattcgtgaagttttttggaaacctgg

SEQ ID NO: 142024 - DNA, 34 bp, Artificial Sequence
  Description of Artificial Sequence: Synthetic oligonucleotide
ctgccaggattcgtgaagttttttggaaacctgg

SEQ ID NO: 142025 - DNA, 34 bp, Artificial Sequence
  Description of Artificial Sequence: Synthetic oligonucleotide
tgccaggattcgtgaagttttttggaaacctggc

SEQ ID NO: 142026 - DNA, 33 bp, Artificial Sequence
  Description of Artificial Sequence: Synthetic oligonucleotide
gccaggattcgtgaagttttttggaaacctggc

SEQ ID NO: 142027 - DNA, 34 bp, Artificial Sequence
  Description of Artificial Sequence: Synthetic oligonucleotide
ccaggattcgtgaagttttttggaaacctggctg

SEQ ID NO: 142028 - DNA, 35 bp, Artificial Sequence
  Description of Artificial Sequence: Synthetic oligonucleotide
caggattcgtgaagttttttggaaacctggctgtc

SEQ ID NO: 142029 - DNA, 37 bp, Artificial Sequence
  Description of Artificial Sequence: Synthetic oligonucleotide
aggattcgtgaagttttttggaaacctggctgtcatg

SEQ ID NO: 142030 - DNA, 36 bp, Artificial Sequence
  Description of Artificial Sequence: Synthetic oligonucleotide
ggattcgtgaagttttttggaaacctggctgtcatg

SEQ ID NO: 142031 - DNA, 36 bp, Artificial Sequence
  Description of Artificial Sequence: Synthetic oligonucleotide
gattcgtgaagttttttggaaacctggctgtcatgg

SEQ ID NO: 142032 - DNA, 39 bp, Artificial Sequence
  Description of Artificial Sequence: Synthetic oligonucleotide
attcgtgaagttttttggaaacctggctgtcatggatag

SEQ ID NO: 142033 - DNA, 38 bp, Artificial Sequence
  Description of Artificial Sequence: Synthetic oligonucleotide
ttcgtgaagttttttggaaacctggctgtcatggatag

SEQ ID NO: 142034 - DNA, 37 bp, Artificial Sequence
  Description of Artificial Sequence: Synthetic oligonucleotide
tcgtgaagttttttggaaacctggctgtcatggatag

SEQ ID NO: 142035 - DNA, 36 bp, Artificial Sequence
  Description of Artificial Sequence: Synthetic oligonucleotide
cgtgaagttttttggaaacctggctgtcatggatag

SEQ ID NO: 142036 - DNA, 37 bp, Artificial Sequence
  Description of Artificial Sequence: Synthetic oligonucleotide
gtgaagttttttggaaacctggctgtcatggatagtc

SEQ ID NO: 142037 - DNA, 37 bp, Artificial Sequence
  Description of Artificial Sequence: Synthetic oligonucleotide
tgaagttttttggaaacctggctgtcatggatagtcc

SEQ ID NO: 142038 - DNA, 36 bp, Artificial Sequence
  Description of Artificial Sequence: Synthetic oligonucleotide
gaagttttttggaaacctggctgtcatggatagtcc

SEQ ID NO: 142039 - DNA, 37 bp, Artificial Sequence
  Description of Artificial Sequence: Synthetic oligonucleotide
aagttttttggaaacctggctgtcatggatagtcctc

SEQ ID NO: 142040 - DNA, 36 bp, Artificial Sequence
  Description of Artificial Sequence: Synthetic oligonucleotide
agttttttggaaacctggctgtcatggatagtcctc

SEQ ID NO: 142041 - DNA, 35 bp, Artificial Sequence
  Description of Artificial Sequence: Synthetic oligonucleotide
gttttttggaaacctggctgtcatggatagtcctc

SEQ ID NO: 142042 - DNA, 37 bp, Artificial Sequence
  Description of Artificial Sequence: Synthetic oligonucleotide
ttttttggaaacctggctgtcatggatagtcctcaac

SEQ ID NO: 142043 - DNA, 36 bp, Artificial Sequence
  Description of Artificial Sequence: Synthetic oligonucleotide
tttttggaaacctggctgtcatggatagtcctcaac

SEQ ID NO: 142044 - DNA, 35 bp, Artificial Sequence
  Description of Artificial Sequence: Synthetic oligonucleotide
ttttggaaacctggctgtcatggatagtcctcaac

SEQ ID NO: 142045 - DNA, 34 bp, Artificial Sequence
  Description of Artificial Sequence: Synthetic oligonucleotide
tttggaaacctggctgtcatggatagtcctcaac

SEQ ID NO: 142046 - DNA, 33 bp, Artificial Sequence
  Description of Artificial Sequence: Synthetic oligonucleotide
ttggaaacctggctgtcatggatagtcctcaac

SEQ ID NO: 142047 - DNA, 32 bp, Artificial Sequence
  Description of Artificial Sequence: Synthetic oligonucleotide
tggaaacctggctgtcatggatagtcctcaac

SEQ ID NO: 142048 - DNA, 31 bp, Artificial Sequence
  Description of Artificial Sequence: Synthetic oligonucleotide
ggaaacctggctgtcatggatagtcctcaac

SEQ ID NO: 142049 - DNA, 32 bp, Artificial Sequence
  Description of Artificial Sequence: Synthetic oligonucleotide
gaaacctggctgtcatggatagtcctcaacag

SEQ ID NO: 142050 - DNA, 34 bp, Artificial Sequence
  Description of Artificial Sequence: Synthetic oligonucleotide
aaacctggctgtcatggatagtcctcaacagatc

SEQ ID NO: 142051 - DNA, 33 bp, Artificial Sequence
  Description of Artificial Sequence: Synthetic oligonucleotide
aacctggctgtcatggatagtcctcaacagatc

SEQ ID NO: 142052 - DNA, 32 bp, Artificial Sequence
  Description of Artificial Sequence: Synthetic oligonucleotide
acctggctgtcatggatagtcctcaacagatc

SEQ ID NO: 142053 - DNA, 31 bp, Artificial Sequence
  Description of Artificial Sequence: Synthetic oligonucleotide
cctggctgtcatggatagtcctcaacagatc

SEQ ID NO: 142054 - DNA, 32 bp, Artificial Sequence
  Description of Artificial Sequence: Synthetic oligonucleotide
ctggctgtcatggatagtcctcaacagatctg

SEQ ID NO: 142055 - DNA, 33 bp, Artificial Sequence
  Description of Artificial Sequence: Synthetic oligonucleotide
tggctgtcatggatagtcctcaacagatctgtg

SEQ ID NO: 142056 - DNA, 32 bp, Artificial Sequence
  Description of Artificial Sequence: Synthetic oligonucleotide
ggctgtcatggatagtcctcaacagatctgtg

SEQ ID NO: 142057 - DNA, 33 bp, Artificial Sequence
  Description of Artificial Sequence: Synthetic oligonucleotide
gctgtcatggatagtcctcaacagatctgtgag

SEQ ID NO: 142058 - DNA, 33 bp, Artificial Sequence
  Description of Artificial Sequence: Synthetic oligonucleotide
ctgtcatggatagtcctcaacagatctgtgagc

SEQ ID NO: 142059 - DNA, 33 bp, Artificial Sequence
  Description of Artificial Sequence: Synthetic oligonucleotide
tgtcatggatagtcctcaacagatctgtgagcg

SEQ ID NO: 142060 - DNA, 32 bp, Artificial Sequence
  Description of Artificial Sequence: Synthetic oligonucleotide
gtcatggatagtcctcaacagatctgtgagcg

SEQ ID NO: 142061 - DNA, 36 bp, Artificial Sequence
  Description of Artificial Sequence: Synthetic oligonucleotide
tcatggatagtcctcaacagatctgtgagcgttatc

SEQ ID NO: 142062 - DNA, 35 bp, Artificial Sequence
  Description of Artificial Sequence: Synthetic oligonucleotide
catggatagtcctcaacagatctgtgagcgttatc

SEQ ID NO: 142063 - DNA, 35 bp, Artificial Sequence
  Description of Artificial Sequence: Synthetic oligonucleotide
atggatagtcctcaacagatctgtgagcgttatcc

SEQ ID NO: 142064 - DNA, 34 bp, Artificial Sequence
  Description of Artificial Sequence: Synthetic oligonucleotide
tggatagtcctcaacagatctgtgagcgttatcc

SEQ ID NO: 142065 - DNA, 33 bp, Artificial Sequence
  Description of Artificial Sequence: Synthetic oligonucleotide
ggatagtcctcaacagatctgtgagcgttatcc

SEQ ID NO: 142066 - DNA, 36 bp, Artificial Sequence
  Description of Artificial Sequence: Synthetic oligonucleotide
gatagtcctcaacagatctgtgagcgttatcctatc

SEQ ID NO: 142067 - DNA, 39 bp, Artificial Sequence
  Description of Artificial Sequence: Synthetic oligonucleotide
atagtcctcaacagatctgtgagcgttatcctatctttg

SEQ ID NO: 142068 - DNA, 38 bp, Artificial Sequence
  Description of Artificial Sequence: Synthetic oligonucleotide
tagtcctcaacagatctgtgagcgttatcctatctttg

SEQ ID NO: 142069 - DNA, 37 bp, Artificial Sequence
  Description of Artificial Sequence: Synthetic oligonucleotide
agtcctcaacagatctgtgagcgttatcctatctttg

SEQ ID NO: 142070 - DNA, 36 bp, Artificial Sequence
  Description of Artificial Sequence: Synthetic oligonucleotide
gtcctcaacagatctgtgagcgttatcctatctttg

SEQ ID NO: 142071 - DNA, 37 bp, Artificial Sequence
  Description of Artificial Sequence: Synthetic oligonucleotide
tcctcaacagatctgtgagcgttatcctatctttgtg

SEQ ID NO: 142072 - DNA, 36 bp, Artificial Sequence
  Description of Artificial Sequence: Synthetic oligonucleotide
cctcaacagatctgtgagcgttatcctatctttgtg

SEQ ID NO: 142073 - DNA, 36 bp, Artificial Sequence
  Description of Artificial Sequence: Synthetic oligonucleotide
ctcaacagatctgtgagcgttatcctatctttgtgg

SEQ ID NO: 142074 - DNA, 41 bp, Artificial Sequence
  Description of Artificial Sequence: Synthetic oligonucleotide
tcaacagatctgtgagcgttatcctatctttgtggaaaaag

SEQ ID NO: 142075 - DNA, 40 bp, Artificial Sequence
  Description of Artificial Sequence: Synthetic oligonucleotide
caacagatctgtgagcgttatcctatctttgtggaaaaag

SEQ ID NO: 142076 - DNA, 41 bp, Artificial Sequence
  Description of Artificial Sequence: Synthetic oligonucleotide
aacagatctgtgagcgttatcctatctttgtggaaaaagtc

SEQ ID NO: 142077 - DNA, 40 bp, Artificial Sequence
  Description of Artificial Sequence: Synthetic oligonucleotide
acagatctgtgagcgttatcctatctttgtggaaaaagtc

SEQ ID NO: 142078 - DNA, 39 bp, Artificial Sequence
  Description of Artificial Sequence: Synthetic oligonucleotide
cagatctgtgagcgttatcctatctttgtggaaaaagtc

SEQ ID NO: 142079 - DNA, 42 bp, Artificial Sequence
  Description of Artificial Sequence: Synthetic oligonucleotide
agatctgtgagcgttatcctatctttgtggaaaaagtctttg

SEQ ID NO: 142080 - DNA, 41 bp, Artificial Sequence
  Description of Artificial Sequence: Synthetic oligonucleotide
gatctgtgagcgttatcctatctttgtggaaaaagtctttg

SEQ ID NO: 142081 - DNA, 45 bp, Artificial Sequence
  Description of Artificial Sequence: Synthetic oligonucleotide
atctgtgagcgttatcctatctttgtggaaaaagtctttgaaatg

SEQ ID NO: 142082 - DNA, 44 bp, Artificial Sequence
  Description of Artificial Sequence: Synthetic oligonucleotide
tctgtgagcgttatcctatctttgtggaaaaagtctttgaaatg

SEQ ID NO: 142083 - DNA, 43 bp, Artificial Sequence
  Description of Artificial Sequence: Synthetic oligonucleotide
ctgtgagcgttatcctatctttgtggaaaaagtctttgaaatg

SEQ ID NO: 142084 - DNA, 46 bp, Artificial Sequence
  Description of Artificial Sequence: Synthetic oligonucleotide
tgtgagcgttatcctatctttgtggaaaaagtctttgaaatgatag

SEQ ID NO: 142085 - DNA, 45 bp, Artificial Sequence
  Description of Artificial Sequence: Synthetic oligonucleotide
gtgagcgttatcctatctttgtggaaaaagtctttgaaatgatag

SEQ ID NO: 142086 - DNA, 48 bp, Artificial Sequence
  Description of Artificial Sequence: Synthetic oligonucleotide
tgagcgttatcctatctttgtggaaaaagtctttgaaatgatagaaag

SEQ ID NO: 142087 - DNA, 47 bp, Artificial Sequence
  Description of Artificial Sequence: Synthetic oligonucleotide
gagcgttatcctatctttgtggaaaaagtctttgaaatgatagaaag

SEQ ID NO: 142088 - DNA, 48 bp, Artificial Sequence
  Description of Artificial Sequence: Synthetic oligonucleotide
agcgttatcctatctttgtggaaaaagtctttgaaatgatagaaagtc

SEQ ID NO: 142089 - DNA, 47 bp, Artificial Sequence
  Description of Artificial Sequence: Synthetic oligonucleotide
gcgttatcctatctttgtggaaaaagtctttgaaatgatagaaagtc

SEQ ID NO: 142090 - DNA, 48 bp, Artificial Sequence
  Description of Artificial Sequence: Synthetic oligonucleotide
cgttatcctatctttgtggaaaaagtctttgaaatgatagaaagtcag

SEQ ID NO: 142091 - DNA, 48 bp, Artificial Sequence
  Description of Artificial Sequence: Synthetic oligonucleotide
gttatcctatctttgtggaaaaagtctttgaaatgatagaaagtcagg

SEQ ID NO: 142092 - DNA, 49 bp, Artificial Sequence
  Description of Artificial Sequence: Synthetic oligonucleotide
ttatcctatctttgtggaaaaagtctttgaaatgatagaaagtcaggac

SEQ ID NO: 142093 - DNA, 48 bp, Artificial Sequence
  Description of Artificial Sequence: Synthetic oligonucleotide
tatcctatctttgtggaaaaagtctttgaaatgatagaaagtcaggac

SEQ ID NO: 142094 - DNA, 47 bp, Artificial Sequence
  Description of Artificial Sequence: Synthetic oligonucleotide
atcctatctttgtggaaaaagtctttgaaatgatagaaagtcaggac

SEQ ID NO: 142095 - DNA, 46 bp, Artificial Sequence
  Description of Artificial Sequence: Synthetic oligonucleotide
tcctatctttgtggaaaaagtctttgaaatgatagaaagtcaggac

SEQ ID NO: 142096 - DNA, 45 bp, Artificial Sequence
  Description of Artificial Sequence: Synthetic oligonucleotide
cctatctttgtggaaaaagtctttgaaatgatagaaagtcaggac

SEQ ID NO: 142097 - DNA, 45 bp, Artificial Sequence
  Description of Artificial Sequence: Synthetic oligonucleotide
ctatctttgtggaaaaagtctttgaaatgatagaaagtcaggacc

SEQ ID NO: 142098 - DNA, 45 bp, Artificial Sequence
  Description of Artificial Sequence: Synthetic oligonucleotide
tatctttgtggaaaaagtctttgaaatgatagaaagtcaggaccc

SEQ ID NO: 142099 - DNA, 44 bp, Artificial Sequence
  Description of Artificial Sequence: Synthetic oligonucleotide
atctttgtggaaaaagtctttgaaatgatagaaagtcaggaccc

SEQ ID NO: 142100 - DNA, 43 bp, Artificial Sequence
  Description of Artificial Sequence: Synthetic oligonucleotide
tctttgtggaaaaagtctttgaaatgatagaaagtcaggaccc

SEQ ID NO: 142101 - DNA, 42 bp, Artificial Sequence
  Description of Artificial Sequence: Synthetic oligonucleotide
ctttgtggaaaaagtctttgaaatgatagaaagtcaggaccc

SEQ ID NO: 142102 - DNA, 42 bp, Artificial Sequence
  Description of Artificial Sequence: Synthetic oligonucleotide
tttgtggaaaaagtctttgaaatgatagaaagtcaggacccc

SEQ ID NO: 142103 - DNA, 41 bp, Artificial Sequence
  Description of Artificial Sequence: Synthetic oligonucleotide
ttgtggaaaaagtctttgaaatgatagaaagtcaggacccc

SEQ ID NO: 142104 - DNA, 40 bp, Artificial Sequence
  Description of Artificial Sequence: Synthetic oligonucleotide
tgtggaaaaagtctttgaaatgatagaaagtcaggacccc

SEQ ID NO: 142105 - DNA, 39 bp, Artificial Sequence
  Description of Artificial Sequence: Synthetic oligonucleotide
gtggaaaaagtctttgaaatgatagaaagtcaggacccc

SEQ ID NO: 142106 - DNA, 40 bp, Artificial Sequence
  Description of Artificial Sequence: Synthetic oligonucleotide
tggaaaaagtctttgaaatgatagaaagtcaggaccccac

SEQ ID NO: 142107 - DNA, 39 bp, Artificial Sequence
  Description of Artificial Sequence: Synthetic oligonucleotide
ggaaaaagtctttgaaatgatagaaagtcaggaccccac

SEQ ID NO: 142108 - DNA, 42 bp, Artificial Sequence
  Description of Artificial Sequence: Synthetic oligonucleotide
gaaaaagtctttgaaatgatagaaagtcaggaccccactatg

SEQ ID NO: 142109 - DNA, 45 bp, Artificial Sequence
  Description of Artificial Sequence: Synthetic oligonucleotide
aaaaagtctttgaaatgatagaaagtcaggaccccactatgattg

SEQ ID NO: 142110 - DNA, 44 bp, Artificial Sequence
  Description of Artificial Sequence: Synthetic oligonucleotide
aaaagtctttgaaatgatagaaagtcaggaccccactatgattg

SEQ ID NO: 142111 - DNA, 43 bp, Artificial Sequence
  Description of Artificial Sequence: Synthetic oligonucleotide
aaagtctttgaaatgatagaaagtcaggaccccactatgattg

SEQ ID NO: 142112 - DNA, 42 bp, Artificial Sequence
  Description of Artificial Sequence: Synthetic oligonucleotide
aagtctttgaaatgatagaaagtcaggaccccactatgattg

SEQ ID NO: 142113 - DNA, 41 bp, Artificial Sequence
  Description of Artificial Sequence: Synthetic oligonucleotide
agtctttgaaatgatagaaagtcaggaccccactatgattg

SEQ ID NO: 142114 - DNA, 40 bp, Artificial Sequence
  Description of Artificial Sequence: Synthetic oligonucleotide
gtctttgaaatgatagaaagtcaggaccccactatgattg

SEQ ID NO: 142115 - DNA, 40 bp, Artificial Sequence
  Description of Artificial Sequence: Synthetic oligonucleotide
tctttgaaatgatagaaagtcaggaccccactatgattgg

SEQ ID NO: 142116 - DNA, 39 bp, Artificial Sequence
  Description of Artificial Sequence: Synthetic oligonucleotide
ctttgaaatgatagaaagtcaggaccccactatgattgg

SEQ ID NO: 142117 - DNA, 40 bp, Artificial Sequence
  Description of Artificial Sequence: Synthetic oligonucleotide
tttgaaatgatagaaagtcaggaccccactatgattggtg

SEQ ID NO: 142118 - DNA, 39 bp, Artificial Sequence
  Description of Artificial Sequence: Synthetic oligonucleotide
ttgaaatgatagaaagtcaggaccccactatgattggtg

SEQ ID NO: 142119 - DNA, 38 bp, Artificial Sequence
  Description of Artificial Sequence: Synthetic oligonucleotide
tgaaatgatagaaagtcaggaccccactatgattggtg

SEQ ID NO: 142120 - DNA, 37 bp, Artificial Sequence
  Description of Artificial Sequence: Synthetic oligonucleotide
gaaatgatagaaagtcaggaccccactatgattggtg

SEQ ID NO: 142121 - DNA, 39 bp, Artificial Sequence
  Description of Artificial Sequence: Synthetic oligonucleotide
aaatgatagaaagtcaggaccccactatgattggtgtag

SEQ ID NO: 142122 - DNA, 38 bp, Artificial Sequence
  Description of Artificial Sequence: Synthetic oligonucleotide
aatgatagaaagtcaggaccccactatgattggtgtag

SEQ ID NO: 142123 - DNA, 37 bp, Artificial Sequence
  Description of Artificial Sequence: Synthetic oligonucleotide
atgatagaaagtcaggaccccactatgattggtgtag

SEQ ID NO: 142124 - DNA, 36 bp, Artificial Sequence
  Description of Artificial Sequence: Synthetic oligonucleotide
tgatagaaagtcaggaccccactatgattggtgtag

SEQ ID NO: 142125 - DNA, 35 bp, Artificial Sequence
  Description of Artificial Sequence: Synthetic oligonucleotide
gatagaaagtcaggaccccactatgattggtgtag

SEQ ID NO: 142126 - DNA, 35 bp, Artificial Sequence
  Description of Artificial Sequence: Synthetic oligonucleotide
atagaaagtcaggaccccactatgattggtgtagc

SEQ ID NO: 142127 - DNA, 34 bp, Artificial Sequence
  Description of Artificial Sequence: Synthetic oligonucleotide
tagaaagtcaggaccccactatgattggtgtagc

SEQ ID NO: 142128 - DNA, 33 bp, Artificial Sequence
  Description of Artificial Sequence: Synthetic oligonucleotide
agaaagtcaggaccccactatgattggtgtagc

SEQ ID NO: 142129 - DNA, 32 bp, Artificial Sequence
  Description of Artificial Sequence: Synthetic oligonucleotide
gaaagtcaggaccccactatgattggtgtagc

SEQ ID NO: 142130 - DNA, 33 bp, Artificial Sequence
  Description of Artificial Sequence: Synthetic oligonucleotide
aaagtcaggaccccactatgattggtgtagctg

SEQ ID NO: 142131 - DNA, 32 bp, Artificial Sequence
  Description of Artificial Sequence: Synthetic oligonucleotide
aagtcaggaccccactatgattggtgtagctg

SEQ ID NO: 142132 - DNA, 31 bp, Artificial Sequence
  Description of Artificial Sequence: Synthetic oligonucleotide
agtcaggaccccactatgattggtgtagctg

SEQ ID NO: 142133 - DNA, 30 bp, Artificial Sequence
  Description of Artificial Sequence: Synthetic oligonucleotide
gtcaggaccccactatgattggtgtagctg

SEQ ID NO: 142134 - DNA, 32 bp, Artificial Sequence
  Description of Artificial Sequence: Synthetic oligonucleotide
tcaggaccccactatgattggtgtagctgtag

SEQ ID NO: 142135 - DNA, 31 bp, Artificial Sequence
  Description of Artificial Sequence: Synthetic oligonucleotide
caggaccccactatgattggtgtagctgtag

SEQ ID NO: 142136 - DNA, 32 bp, Artificial Sequence
  Description of Artificial Sequence: Synthetic oligonucleotide
aggaccccactatgattggtgtagctgtagac

SEQ ID NO: 142137 - DNA, 31 bp, Artificial Sequence
  Description of Artificial Sequence: Synthetic oligonucleotide
ggaccccactatgattggtgtagctgtagac

SEQ ID NO: 142138 - DNA, 32 bp, Artificial Sequence
  Description of Artificial Sequence: Synthetic oligonucleotide
gaccccactatgattggtgtagctgtagacac

SEQ ID NO: 142139 - DNA, 33 bp, Artificial Sequence
  Description of Artificial Sequence: Synthetic oligonucleotide
accccactatgattggtgtagctgtagacacag

SEQ ID NO: 142140 - DNA, 32 bp, Artificial Sequence
  Description of Artificial Sequence: Synthetic oligonucleotide
ccccactatgattggtgtagctgtagacacag

SEQ ID NO: 142141 - DNA, 34 bp, Artificial Sequence
  Description of Artificial Sequence: Synthetic oligonucleotide
cccactatgattggtgtagctgtagacacagttg

SEQ ID NO: 142142 - DNA, 34 bp, Artificial Sequence
  Description of Artificial Sequence: Synthetic oligonucleotide
ccactatgattggtgtagctgtagacacagttgg

SEQ ID NO: 142143 - DNA, 37 bp, Artificial Sequence
  Description of Artificial Sequence: Synthetic oligonucleotide
cactatgattggtgtagctgtagacacagttggaatc

SEQ ID NO: 142144 - DNA, 39 bp, Artificial Sequence
  Description of Artificial Sequence: Synthetic oligonucleotide
actatgattggtgtagctgtagacacagttggaatcttg

SEQ ID NO: 142145 - DNA, 38 bp, Artificial Sequence
  Description of Artificial Sequence: Synthetic oligonucleotide
ctatgattggtgtagctgtagacacagttggaatcttg

SEQ ID NO: 142146 - DNA, 38 bp, Artificial Sequence
  Description of Artificial Sequence: Synthetic oligonucleotide
tatgattggtgtagctgtagacacagttggaatcttgg

SEQ ID NO: 142147 - DNA, 37 bp, Artificial Sequence
  Description of Artificial Sequence: Synthetic oligonucleotide
atgattggtgtagctgtagacacagttggaatcttgg

SEQ ID NO: 142148 - DNA, 36 bp, Artificial Sequence
  Description of Artificial Sequence: Synthetic oligonucleotide
tgattggtgtagctgtagacacagttggaatcttgg

SEQ ID NO: 142149 - DNA, 35 bp, Artificial Sequence
  Description of Artificial Sequence: Synthetic oligonucleotide
gattggtgtagctgtagacacagttggaatcttgg

SEQ ID NO: 142150 - DNA, 35 bp, Artificial Sequence
  Description of Artificial Sequence: Synthetic oligonucleotide
attggtgtagctgtagacacagttggaatcttggg

SEQ ID NO: 142151 - DNA, 34 bp, Artificial Sequence
  Description of Artificial Sequence: Synthetic oligonucleotide
ttggtgtagctgtagacacagttggaatcttggg

SEQ ID NO: 142152 - DNA, 33 bp, Artificial Sequence
  Description of Artificial Sequence: Synthetic oligonucleotide
tggtgtagctgtagacacagttggaatcttggg

SEQ ID NO: 142153 - DNA, 32 bp, Artificial Sequence
  Description of Artificial Sequence: Synthetic oligonucleotide
ggtgtagctgtagacacagttggaatcttggg

SEQ ID NO: 142154 - DNA, 34 bp, Artificial Sequence
  Description of Artificial Sequence: Synthetic oligonucleotide
gtgtagctgtagacacagttggaatcttgggatc

SEQ ID NO: 142155 - DNA, 34 bp, Artificial Sequence
  Description of Artificial Sequence: Synthetic oligonucleotide
tgtagctgtagacacagttggaatcttgggatcc

SEQ ID NO: 142156 - DNA, 33 bp, Artificial Sequence
  Description of Artificial Sequence: Synthetic oligonucleotide
gtagctgtagacacagttggaatcttgggatcc

SEQ ID NO: 142157 - DNA, 36 bp, Artificial Sequence
  Description of Artificial Sequence: Synthetic oligonucleotide
tagctgtagacacagttggaatcttgggatccaatg

SEQ ID NO: 142158 - DNA, 35 bp, Artificial Sequence
  Description of Artificial Sequence: Synthetic oligonucleotide
agctgtagacacagttggaatcttgggatccaatg

SEQ ID NO: 142159 - DNA, 34 bp, Artificial Sequence
  Description of Artificial Sequence: Synthetic oligonucleotide
gctgtagacacagttggaatcttgggatccaatg

SEQ ID NO: 142160 - DNA, 36 bp, Artificial Sequence
  Description of Artificial Sequence: Synthetic oligonucleotide
ctgtagacacagttggaatcttgggatccaatgttg

SEQ ID NO: 142161 - DNA, 38 bp, Artificial Sequence
  Description of Artificial Sequence: Synthetic oligonucleotide
tgtagacacagttggaatcttgggatccaatgttgaag

SEQ ID NO: 142162 - DNA, 37 bp, Artificial Sequence
  Description of Artificial Sequence: Synthetic oligonucleotide
gtagacacagttggaatcttgggatccaatgttgaag

SEQ ID NO: 142163 - DNA, 37 bp, Artificial Sequence
  Description of Artificial Sequence: Synthetic oligonucleotide
tagacacagttggaatcttgggatccaatgttgaagg

SEQ ID NO: 142164 - DNA, 36 bp, Artificial Sequence
  Description of Artificial Sequence: Synthetic oligonucleotide
agacacagttggaatcttgggatccaatgttgaagg

SEQ ID NO: 142165 - DNA, 35 bp, Artificial Sequence
  Description of Artificial Sequence: Synthetic oligonucleotide
gacacagttggaatcttgggatccaatgttgaagg

SEQ ID NO: 142166 - DNA, 39 bp, Artificial Sequence
  Description of Artificial Sequence: Synthetic oligonucleotide
acacagttggaatcttgggatccaatgttgaaggaaaac

SEQ ID NO: 142167 - DNA, 38 bp, Artificial Sequence
  Description of Artificial Sequence: Synthetic oligonucleotide
cacagttggaatcttgggatccaatgttgaaggaaaac

SEQ ID NO: 142168 - DNA, 39 bp, Artificial Sequence
  Description of Artificial Sequence: Synthetic oligonucleotide
acagttggaatcttgggatccaatgttgaaggaaaacag

SEQ ID NO: 142169 - DNA, 38 bp, Artificial Sequence
  Description of Artificial Sequence: Synthetic oligonucleotide
cagttggaatcttgggatccaatgttgaaggaaaacag

SEQ ID NO: 142170 - DNA, 38 bp, Artificial Sequence
  Description of Artificial Sequence: Synthetic oligonucleotide
agttggaatcttgggatccaatgttgaaggaaaacagg

SEQ ID NO: 142171 - DNA, 37 bp, Artificial Sequence
  Description of Artificial Sequence: Synthetic oligonucleotide
gttggaatcttgggatccaatgttgaaggaaaacagg

SEQ ID NO: 142172 - DNA, 42 bp, Artificial Sequence
  Description of Artificial Sequence: Synthetic oligonucleotide
ttggaatcttgggatccaatgttgaaggaaaacaggttttac

SEQ ID NO: 142173 - DNA, 41 bp, Artificial Sequence
  Description of Artificial Sequence: Synthetic oligonucleotide
tggaatcttgggatccaatgttgaaggaaaacaggttttac

SEQ ID NO: 142174 - DNA, 40 bp, Artificial Sequence
  Description of Artificial Sequence: Synthetic oligonucleotide
ggaatcttgggatccaatgttgaaggaaaacaggttttac

SEQ ID NO: 142175 - DNA, 41 bp, Artificial Sequence
  Description of Artificial Sequence: Synthetic oligonucleotide
gaatcttgggatccaatgttgaaggaaaacaggttttacag

SEQ ID NO: 142176 - DNA, 45 bp, Artificial Sequence
  Description of Artificial Sequence: Synthetic oligonucleotide
aatcttgggatccaatgttgaaggaaaacaggttttacagaaaac

SEQ ID NO: 142177 - DNA, 44 bp, Artificial Sequence
  Description of Artificial Sequence: Synthetic oligonucleotide
atcttgggatccaatgttgaaggaaaacaggttttacagaaaac

SEQ ID NO: 142178 - DNA, 43 bp, Artificial Sequence
  Description of Artificial Sequence: Synthetic oligonucleotide
tcttgggatccaatgttgaaggaaaacaggttttacagaaaac

SEQ ID NO: 142179 - DNA, 42 bp, Artificial Sequence
  Description of Artificial Sequence: Synthetic oligonucleotide
cttgggatccaatgttgaaggaaaacaggttttacagaaaac

SEQ ID NO: 142180 - DNA, 43 bp, Artificial Sequence
  Description of Artificial Sequence: Synthetic oligonucleotide
ttgggatccaatgttgaaggaaaacaggttttacagaaaacag

SEQ ID NO: 142181 - DNA, 42 bp, Artificial Sequence
  Description of Artificial Sequence: Synthetic oligonucleotide
tgggatccaatgttgaaggaaaacaggttttacagaaaacag

SEQ ID NO: 142182 - DNA, 41 bp, Artificial Sequence
  Description of Artificial Sequence: Synthetic oligonucleotide
gggatccaatgttgaaggaaaacaggttttacagaaaacag

SEQ ID NO: 142183 - DNA, 41 bp, Artificial Sequence
  Description of Artificial Sequence: Synthetic oligonucleotide
ggatccaatgttgaaggaaaacaggttttacagaaaacagg

SEQ ID NO: 142184 - DNA, 43 bp, Artificial Sequence
  Description of Artificial Sequence: Synthetic oligonucleotide
gatccaatgttgaaggaaaacaggttttacagaaaacaggaac

SEQ ID NO: 142185 - DNA, 44 bp, Artificial Sequence
  Description of Artificial Sequence: Synthetic oligonucleotide
atccaatgttgaaggaaaacaggttttacagaaaacaggaactc

SEQ ID NO: 142186 - DNA, 43 bp, Artificial Sequence
  Description of Artificial Sequence: Synthetic oligonucleotide
tccaatgttgaaggaaaacaggttttacagaaaacaggaactc

SEQ ID NO: 142187 - DNA, 42 bp, Artificial Sequence
  Description of Artificial Sequence: Synthetic oligonucleotide
ccaatgttgaaggaaaacaggttttacagaaaacaggaactc

SEQ ID NO: 142188 - DNA, 42 bp, Artificial Sequence
  Description of Artificial Sequence: Synthetic oligonucleotide
caatgttgaaggaaaacaggttttacagaaaacaggaactcg

SEQ ID NO: 142189 - DNA, 42 bp, Artificial Sequence
  Description of Artificial Sequence: Synthetic oligonucleotide
aatgttgaaggaaaacaggttttacagaaaacaggaactcgc

SEQ ID NO: 142190 - DNA, 41 bp, Artificial Sequence
  Description of Artificial Sequence: Synthetic oligonucleotide
atgttgaaggaaaacaggttttacagaaaacaggaactcgc

SEQ ID NO: 142191 - DNA, 40 bp, Artificial Sequence
  Description of Artificial Sequence: Synthetic oligonucleotide
tgttgaaggaaaacaggttttacagaaaacaggaactcgc

SEQ ID NO: 142192 - DNA, 39 bp, Artificial Sequence
  Description of Artificial Sequence: Synthetic oligonucleotide
gttgaaggaaaacaggttttacagaaaacaggaactcgc

SEQ ID NO: 142193 - DNA, 42 bp, Artificial Sequence
  Description of Artificial Sequence: Synthetic oligonucleotide
ttgaaggaaaacaggttttacagaaaacaggaactcgctttg

SEQ ID NO: 142194 - DNA, 41 bp, Artificial Sequence
  Description of Artificial Sequence: Synthetic oligonucleotide
tgaaggaaaacaggttttacagaaaacaggaactcgctttg

SEQ ID NO: 142195 - DNA, 40 bp, Artificial Sequence
  Description of Artificial Sequence: Synthetic oligonucleotide
gaaggaaaacaggttttacagaaaacaggaactcgctttg

SEQ ID NO: 142196 - DNA, 42 bp, Artificial Sequence
  Description of Artificial Sequence: Synthetic oligonucleotide
aaggaaaacaggttttacagaaaacaggaactcgctttgaac

SEQ ID NO: 142197 - DNA, 41 bp, Artificial Sequence
  Description of Artificial Sequence: Synthetic oligonucleotide
aggaaaacaggttttacagaaaacaggaactcgctttgaac

SEQ ID NO: 142198 - DNA, 40 bp, Artificial Sequence
  Description of Artificial Sequence: Synthetic oligonucleotide
ggaaaacaggttttacagaaaacaggaactcgctttgaac

SEQ ID NO: 142199 - DNA, 40 bp, Artificial Sequence
  Description of Artificial Sequence: Synthetic oligonucleotide
gaaaacaggttttacagaaaacaggaactcgctttgaacg

SEQ ID NO: 142200 - DNA, 40 bp, Artificial Sequence
  Description of Artificial Sequence: Synthetic oligonucleotide
aaaacaggttttacagaaaacaggaactcgctttgaacgc

SEQ ID NO: 142201 - DNA, 39 bp, Artificial Sequence
  Description of Artificial Sequence: Synthetic oligonucleotide
aaacaggttttacagaaaacaggaactcgctttgaacgc

SEQ ID NO: 142202 - DNA, 38 bp, Artificial Sequence
  Description of Artificial Sequence: Synthetic oligonucleotide
aacaggttttacagaaaacaggaactcgctttgaacgc

SEQ ID NO: 142203 - DNA, 37 bp, Artificial Sequence
  Description of Artificial Sequence: Synthetic oligonucleotide
acaggttttacagaaaacaggaactcgctttgaacgc

SEQ ID NO: 142204 - DNA, 36 bp, Artificial Sequence
  Description of Artificial Sequence: Synthetic oligonucleotide
caggttttacagaaaacaggaactcgctttgaacgc

SEQ ID NO: 142205 - DNA, 38 bp, Artificial Sequence
  Description of Artificial Sequence: Synthetic oligonucleotide
aggttttacagaaaacaggaactcgctttgaacgcttg

SEQ ID NO: 142206 - DNA, 37 bp, Artificial Sequence
  Description of Artificial Sequence: Synthetic oligonucleotide
ggttttacagaaaacaggaactcgctttgaacgcttg

SEQ ID NO: 142207 - DNA, 37 bp, Artificial Sequence
  Description of Artificial Sequence: Synthetic oligonucleotide
gttttacagaaaacaggaactcgctttgaacgcttgc

SEQ ID NO: 142208 - DNA, 41 bp, Artificial Sequence
  Description of Artificial Sequence: Synthetic oligonucleotide
ttttacagaaaacaggaactcgctttgaacgcttgcttatg

SEQ ID NO: 142209 - DNA, 40 bp, Artificial Sequence
  Description of Artificial Sequence: Synthetic oligonucleotide
tttacagaaaacaggaactcgctttgaacgcttgcttatg

SEQ ID NO: 142210 - DNA, 39 bp, Artificial Sequence
  Description of Artificial Sequence: Synthetic oligonucleotide
ttacagaaaacaggaactcgctttgaacgcttgcttatg

SEQ ID NO: 142211 - DNA, 38 bp, Artificial Sequence
  Description of Artificial Sequence: Synthetic oligonucleotide
tacagaaaacaggaactcgctttgaacgcttgcttatg

SEQ ID NO: 142212 - DNA, 37 bp, Artificial Sequence
  Description of Artificial Sequence: Synthetic oligonucleotide
acagaaaacaggaactcgctttgaacgcttgcttatg

SEQ ID NO: 142213 - DNA, 36 bp, Artificial Sequence
  Description of Artificial Sequence: Synthetic oligonucleotide
cagaaaacaggaactcgctttgaacgcttgcttatg

SEQ ID NO: 142214 - DNA, 37 bp, Artificial Sequence
  Description of Artificial Sequence: Synthetic oligonucleotide
agaaaacaggaactcgctttgaacgcttgcttatgag

SEQ ID NO: 142215 - DNA, 36 bp, Artificial Sequence
  Description of Artificial Sequence: Synthetic oligonucleotide
gaaaacaggaactcgctttgaacgcttgcttatgag

SEQ ID NO: 142216 - DNA, 40 bp, Artificial Sequence
  Description of Artificial Sequence: Synthetic oligonucleotide
aaaacaggaactcgctttgaacgcttgcttatgagaatag

SEQ ID NO: 142217 - DNA, 39 bp, Artificial Sequence
  Description of Artificial Sequence: Synthetic oligonucleotide
aaacaggaactcgctttgaacgcttgcttatgagaatag

SEQ ID NO: 142218 - DNA, 38 bp, Artificial Sequence
  Description of Artificial Sequence: Synthetic oligonucleotide
aacaggaactcgctttgaacgcttgcttatgagaatag

SEQ ID NO: 142219 - DNA, 37 bp, Artificial Sequence
  Description of Artificial Sequence: Synthetic oligonucleotide
acaggaactcgctttgaacgcttgcttatgagaatag

SEQ ID NO: 142220 - DNA, 36 bp, Artificial Sequence
  Description of Artificial Sequence: Synthetic oligonucleotide
caggaactcgctttgaacgcttgcttatgagaatag

SEQ ID NO: 142221 - DNA, 36 bp, Artificial Sequence
  Description of Artificial Sequence: Synthetic oligonucleotide
aggaactcgctttgaacgcttgcttatgagaatagg

SEQ ID NO: 142222 - DNA, 35 bp, Artificial Sequence
  Description of Artificial Sequence: Synthetic oligonucleotide
ggaactcgctttgaacgcttgcttatgagaatagg

SEQ ID NO: 142223 - DNA, 36 bp, Artificial Sequence
  Description of Artificial Sequence: Synthetic oligonucleotide
gaactcgctttgaacgcttgcttatgagaataggac

SEQ ID NO: 142224 - DNA, 38 bp, Artificial Sequence
  Description of Artificial Sequence: Synthetic oligonucleotide
aactcgctttgaacgcttgcttatgagaataggacatc

SEQ ID NO: 142225 - DNA, 37 bp, Artificial Sequence
  Description of Artificial Sequence: Synthetic oligonucleotide
actcgctttgaacgcttgcttatgagaataggacatc

SEQ ID NO: 142226 - DNA, 36 bp, Artificial Sequence
  Description of Artificial Sequence: Synthetic oligonucleotide
ctcgctttgaacgcttgcttatgagaataggacatc

SEQ ID NO: 142227 - DNA, 39 bp, Artificial Sequence
  Description of Artificial Sequence: Synthetic oligonucleotide
tcgctttgaacgcttgcttatgagaataggacatcaatc

SEQ ID NO: 142228 - DNA, 38 bp, Artificial Sequence
  Description of Artificial Sequence: Synthetic oligonucleotide
cgctttgaacgcttgcttatgagaataggacatcaatc

SEQ ID NO: 142229 - DNA, 41 bp, Artificial Sequence
  Description of Artificial Sequence: Synthetic oligonucleotide
gctttgaacgcttgcttatgagaataggacatcaatcaaag

SEQ ID NO: 142230 - DNA, 44 bp, Artificial Sequence
  Description of Artificial Sequence: Synthetic oligonucleotide
ctttgaacgcttgcttatgagaataggacatcaatcaaagaatg

SEQ ID NO: 142231 - DNA, 44 bp, Artificial Sequence
  Description of Artificial Sequence: Synthetic oligonucleotide
tttgaacgcttgcttatgagaataggacatcaatcaaagaatgc

SEQ ID NO: 142232 - DNA, 43 bp, Artificial Sequence
  Description of Artificial Sequence: Synthetic oligonucleotide
ttgaacgcttgcttatgagaataggacatcaatcaaagaatgc

SEQ ID NO: 142233 - DNA, 42 bp, Artificial Sequence
  Description of Artificial Sequence: Synthetic oligonucleotide
tgaacgcttgcttatgagaataggacatcaatcaaagaatgc

SEQ ID NO: 142234 - DNA, 41 bp, Artificial Sequence
  Description of Artificial Sequence: Synthetic oligonucleotide
gaacgcttgcttatgagaataggacatcaatcaaagaatgc

SEQ ID NO: 142235 - DNA, 41 bp, Artificial Sequence
  Description of Artificial Sequence: Synthetic oligonucleotide
aacgcttgcttatgagaataggacatcaatcaaagaatgcc

SEQ ID NO: 142236 - DNA, 40 bp, Artificial Sequence
  Description of Artificial Sequence: Synthetic oligonucleotide
acgcttgcttatgagaataggacatcaatcaaagaatgcc

SEQ ID NO: 142237 - DNA, 39 bp, Artificial Sequence
  Description of Artificial Sequence: Synthetic oligonucleotide
cgcttgcttatgagaataggacatcaatcaaagaatgcc

SEQ ID NO: 142238 - DNA, 39 bp, Artificial Sequence
  Description of Artificial Sequence: Synthetic oligonucleotide
gcttgcttatgagaataggacatcaatcaaagaatgccc

SEQ ID NO: 142239 - DNA, 39 bp, Artificial Sequence
  Description of Artificial Sequence: Synthetic oligonucleotide
cttgcttatgagaataggacatcaatcaaagaatgcccc

SEQ ID NO: 142240 - DNA, 40 bp, Artificial Sequence
  Description of Artificial Sequence: Synthetic oligonucleotide
ttgcttatgagaataggacatcaatcaaagaatgccccag

SEQ ID NO: 142241 - DNA, 39 bp, Artificial Sequence
  Description of Artificial Sequence: Synthetic oligonucleotide
tgcttatgagaataggacatcaatcaaagaatgccccag

SEQ ID NO: 142242 - DNA, 38 bp, Artificial Sequence
  Description of Artificial Sequence: Synthetic oligonucleotide
gcttatgagaataggacatcaatcaaagaatgccccag

SEQ ID NO: 142243 - DNA, 39 bp, Artificial Sequence
  Description of Artificial Sequence: Synthetic oligonucleotide
cttatgagaataggacatcaatcaaagaatgccccagtg

SEQ ID NO: 142244 - DNA, 39 bp, Artificial Sequence
  Description of Artificial Sequence: Synthetic oligonucleotide
ttatgagaataggacatcaatcaaagaatgccccagtgg

SEQ ID NO: 142245 - DNA, 38 bp, Artificial Sequence
  Description of Artificial Sequence: Synthetic oligonucleotide
tatgagaataggacatcaatcaaagaatgccccagtgg

SEQ ID NO: 142246 - DNA, 37 bp, Artificial Sequence
  Description of Artificial Sequence: Synthetic oligonucleotide
atgagaataggacatcaatcaaagaatgccccagtgg

SEQ ID NO: 142247 - DNA, 36 bp, Artificial Sequence
  Description of Artificial Sequence: Synthetic oligonucleotide
tgagaataggacatcaatcaaagaatgccccagtgg

SEQ ID NO: 142248 - DNA, 35 bp, Artificial Sequence
  Description of Artificial Sequence: Synthetic oligonucleotide
gagaataggacatcaatcaaagaatgccccagtgg

SEQ ID NO: 142249 - DNA, 36 bp, Artificial Sequence
  Description of Artificial Sequence: Synthetic oligonucleotide
agaataggacatcaatcaaagaatgccccagtggag

SEQ ID NO: 142250 - DNA, 35 bp, Artificial Sequence
  Description of Artificial Sequence: Synthetic oligonucleotide
gaataggacatcaatcaaagaatgccccagtggag

SEQ ID NO: 142251 - DNA, 35 bp, Artificial Sequence
  Description of Artificial Sequence: Synthetic oligonucleotide
aataggacatcaatcaaagaatgccccagtggagc

SEQ ID NO: 142252 - DNA, 34 bp, Artificial Sequence
  Description of Artificial Sequence: Synthetic oligonucleotide
ataggacatcaatcaaagaatgccccagtggagc

SEQ ID NO: 142253 - DNA, 33 bp, Artificial Sequence
  Description of Artificial Sequence: Synthetic oligonucleotide
taggacatcaatcaaagaatgccccagtggagc

SEQ ID NO: 142254 - DNA, 32 bp, Artificial Sequence
  Description of Artificial Sequence: Synthetic oligonucleotide
aggacatcaatcaaagaatgccccagtggagc

SEQ ID NO: 142255 - DNA, 31 bp, Artificial Sequence
  Description of Artificial Sequence: Synthetic oligonucleotide
ggacatcaatcaaagaatgccccagtggagc

SEQ ID NO: 142256 - DNA, 40 bp, Artificial Sequence
  Description of Artificial Sequence: Synthetic oligonucleotide
gacatcaatcaaagaatgccccagtggagctaaaaattag

SEQ ID NO: 142257 - DNA, 42 bp, Artificial Sequence
  Description of Artificial Sequence: Synthetic oligonucleotide
acatcaatcaaagaatgccccagtggagctaaaaattagatg

SEQ ID NO: 142258 - DNA, 41 bp, Artificial Sequence
  Description of Artificial Sequence: Synthetic oligonucleotide
catcaatcaaagaatgccccagtggagctaaaaattagatg

SEQ ID NO: 142259 - DNA, 44 bp, Artificial Sequence
  Description of Artificial Sequence: Synthetic oligonucleotide
atcaatcaaagaatgccccagtggagctaaaaattagatgtttg

SEQ ID NO: 142260 - DNA, 43 bp, Artificial Sequence
  Description of Artificial Sequence: Synthetic oligonucleotide
tcaatcaaagaatgccccagtggagctaaaaattagatgtttg

SEQ ID NO: 142261 - DNA, 42 bp, Artificial Sequence
  Description of Artificial Sequence: Synthetic oligonucleotide
caatcaaagaatgccccagtggagctaaaaattagatgtttg

SEQ ID NO: 142262 - DNA, 42 bp, Artificial Sequence
  Description of Artificial Sequence: Synthetic oligonucleotide
aatcaaagaatgccccagtggagctaaaaattagatgtttgg

SEQ ID NO: 142263 - DNA, 41 bp, Artificial Sequence
  Description of Artificial Sequence: Synthetic oligonucleotide
atcaaagaatgccccagtggagctaaaaattagatgtttgg

SEQ ID NO: 142264 - DNA, 40 bp, Artificial Sequence
  Description of Artificial Sequence: Synthetic oligonucleotide
tcaaagaatgccccagtggagctaaaaattagatgtttgg

SEQ ID NO: 142265 - DNA, 39 bp, Artificial Sequence
  Description of Artificial Sequence: Synthetic oligonucleotide
caaagaatgccccagtggagctaaaaattagatgtttgg

SEQ ID NO: 142266 - DNA, 41 bp, Artificial Sequence
  Description of Artificial Sequence: Synthetic oligonucleotide
aaagaatgccccagtggagctaaaaattagatgtttggatg

SEQ ID NO: 142267 - DNA, 40 bp, Artificial Sequence
  Description of Artificial Sequence: Synthetic oligonucleotide
aagaatgccccagtggagctaaaaattagatgtttggatg

SEQ ID NO: 142268 - DNA, 39 bp, Artificial Sequence
  Description of Artificial Sequence: Synthetic oligonucleotide
agaatgccccagtggagctaaaaattagatgtttggatg

SEQ ID NO: 142269 - DNA, 38 bp, Artificial Sequence
  Description of Artificial Sequence: Synthetic oligonucleotide
gaatgccccagtggagctaaaaattagatgtttggatg

SEQ ID NO: 142270 - DNA, 38 bp, Artificial Sequence
  Description of Artificial Sequence: Synthetic oligonucleotide
aatgccccagtggagctaaaaattagatgtttggatgc

SEQ ID NO: 142271 - DNA, 37 bp, Artificial Sequence
  Description of Artificial Sequence: Synthetic oligonucleotide
atgccccagtggagctaaaaattagatgtttggatgc

SEQ ID NO: 142272 - DNA, 36 bp, Artificial Sequence
  Description of Artificial Sequence: Synthetic oligonucleotide
tgccccagtggagctaaaaattagatgtttggatgc

SEQ ID NO: 142273 - DNA, 35 bp, Artificial Sequence
  Description of Artificial Sequence: Synthetic oligonucleotide
gccccagtggagctaaaaattagatgtttggatgc

SEQ ID NO: 142274 - DNA, 40 bp, Artificial Sequence
  Description of Artificial Sequence: Synthetic oligonucleotide
ccccagtggagctaaaaattagatgtttggatgcaatttc

SEQ ID NO: 142275 - DNA, 42 bp, Artificial Sequence
  Description of Artificial Sequence: Synthetic oligonucleotide
cccagtggagctaaaaattagatgtttggatgcaatttcatc

SEQ ID NO: 142276 - DNA, 43 bp, Artificial Sequence
  Description of Artificial Sequence: Synthetic oligonucleotide
ccagtggagctaaaaattagatgtttggatgcaatttcatctc

SEQ ID NO: 142277 - DNA, 45 bp, Artificial Sequence
  Description of Artificial Sequence: Synthetic oligonucleotide
cagtggagctaaaaattagatgtttggatgcaatttcatctcttc

SEQ ID NO: 142278 - DNA, 46 bp, Artificial Sequence
  Description of Artificial Sequence: Synthetic oligonucleotide
agtggagctaaaaattagatgtttggatgcaatttcatctcttctg

SEQ ID NO: 142279 - DNA, 45 bp, Artificial Sequence
  Description of Artificial Sequence: Synthetic oligonucleotide
gtggagctaaaaattagatgtttggatgcaatttcatctcttctg

SEQ ID NO: 142280 - DNA, 47 bp, Artificial Sequence
  Description of Artificial Sequence: Synthetic oligonucleotide
tggagctaaaaattagatgtttggatgcaatttcatctcttctgtac

SEQ ID NO: 142281 - DNA, 46 bp, Artificial Sequence
  Description of Artificial Sequence: Synthetic oligonucleotide
ggagctaaaaattagatgtttggatgcaatttcatctcttctgtac

SEQ ID NO: 142282 - DNA, 49 bp, Artificial Sequence
  Description of Artificial Sequence: Synthetic oligonucleotide
gagctaaaaattagatgtttggatgcaatttcatctcttctgtacttac

SEQ ID NO: 142283 - DNA, 49 bp, Artificial Sequence
  Description of Artificial Sequence: Synthetic oligonucleotide
agctaaaaattagatgtttggatgcaatttcatctcttctgtacttacc

SEQ ID NO: 142284 - DNA, 48 bp, Artificial Sequence
  Description of Artificial Sequence: Synthetic oligonucleotide
gctaaaaattagatgtttggatgcaatttcatctcttctgtacttacc

SEQ ID NO: 142285 - DNA, 49 bp, Artificial Sequence
  Description of Artificial Sequence: Synthetic oligonucleotide
ctaaaaattagatgtttggatgcaatttcatctcttctgtacttaccac

SEQ ID NO: 142286 - DNA, 49 bp, Artificial Sequence
  Description of Artificial Sequence: Synthetic oligonucleotide
taaaaattagatgtttggatgcaatttcatctcttctgtacttaccacc

SEQ ID NO: 142287 - DNA, 48 bp, Artificial Sequence
  Description of Artificial Sequence: Synthetic oligonucleotide
aaaaattagatgtttggatgcaatttcatctcttctgtacttaccacc

SEQ ID NO: 142288 - DNA, 47 bp, Artificial Sequence
  Description of Artificial Sequence: Synthetic oligonucleotide
aaaattagatgtttggatgcaatttcatctcttctgtacttaccacc

SEQ ID NO: 142289 - DNA, 46 bp, Artificial Sequence
  Description of Artificial Sequence: Synthetic oligonucleotide
aaattagatgtttggatgcaatttcatctcttctgtacttaccacc

SEQ ID NO: 142290 - DNA, 45 bp, Artificial Sequence
  Description of Artificial Sequence: Synthetic oligonucleotide
aattagatgtttggatgcaatttcatctcttctgtacttaccacc

SEQ ID NO: 142291 - DNA, 44 bp, Artificial Sequence
  Description of Artificial Sequence: Synthetic oligonucleotide
attagatgtttggatgcaatttcatctcttctgtacttaccacc

SEQ ID NO: 142292 - DNA, 43 bp, Artificial Sequence
  Description of Artificial Sequence: Synthetic oligonucleotide
ttagatgtttggatgcaatttcatctcttctgtacttaccacc

SEQ ID NO: 142293 - DNA, 42 bp, Artificial Sequence
  Description of Artificial Sequence: Synthetic oligonucleotide
tagatgtttggatgcaatttcatctcttctgtacttaccacc

SEQ ID NO: 142294 - DNA, 41 bp, Artificial Sequence
  Description of Artificial Sequence: Synthetic oligonucleotide
agatgtttggatgcaatttcatctcttctgtacttaccacc

SEQ ID NO: 142295 - DNA, 40 bp, Artificial Sequence
  Description of Artificial Sequence: Synthetic oligonucleotide
gatgtttggatgcaatttcatctcttctgtacttaccacc

SEQ ID NO: 142296 - DNA, 41 bp, Artificial Sequence
  Description of Artificial Sequence: Synthetic oligonucleotide
atgtttggatgcaatttcatctcttctgtacttaccacctg

SEQ ID NO: 142297 - DNA, 40 bp, Artificial Sequence
  Description of Artificial Sequence: Synthetic oligonucleotide
tgtttggatgcaatttcatctcttctgtacttaccacctg

SEQ ID NO: 142298 - DNA, 39 bp, Artificial Sequence
  Description of Artificial Sequence: Synthetic oligonucleotide
gtttggatgcaatttcatctcttctgtacttaccacctg

SEQ ID NO: 142299 - DNA, 40 bp, Artificial Sequence
  Description of Artificial Sequence: Synthetic oligonucleotide
tttggatgcaatttcatctcttctgtacttaccacctgag

SEQ ID NO: 142300 - DNA, 39 bp, Artificial Sequence
  Description of Artificial Sequence: Synthetic oligonucleotide
ttggatgcaatttcatctcttctgtacttaccacctgag

SEQ ID NO: 142301 - DNA, 38 bp, Artificial Sequence
  Description of Artificial Sequence: Synthetic oligonucleotide
tggatgcaatttcatctcttctgtacttaccacctgag

SEQ ID NO: 142302 - DNA, 37 bp, Artificial Sequence
  Description of Artificial Sequence: Synthetic oligonucleotide
ggatgcaatttcatctcttctgtacttaccacctgag

SEQ ID NO: 142303 - DNA, 37 bp, Artificial Sequence
  Description of Artificial Sequence: Synthetic oligonucleotide
gatgcaatttcatctcttctgtacttaccacctgagc

SEQ ID NO: 142304 - DNA, 38 bp, Artificial Sequence
  Description of Artificial Sequence: Synthetic oligonucleotide
atgcaatttcatctcttctgtacttaccacctgagcag

SEQ ID NO: 142305 - DNA, 37 bp, Artificial Sequence
  Description of Artificial Sequence: Synthetic oligonucleotide
tgcaatttcatctcttctgtacttaccacctgagcag

SEQ ID NO: 142306 - DNA, 36 bp, Artificial Sequence
  Description of Artificial Sequence: Synthetic oligonucleotide
gcaatttcatctcttctgtacttaccacctgagcag

SEQ ID NO: 142307 - DNA, 36 bp, Artificial Sequence
  Description of Artificial Sequence: Synthetic oligonucleotide
caatttcatctcttctgtacttaccacctgagcagc

SEQ ID NO: 142308 - DNA, 37 bp, Artificial Sequence
  Description of Artificial Sequence: Synthetic oligonucleotide
aatttcatctcttctgtacttaccacctgagcagcag

SEQ ID NO: 142309 - DNA, 36 bp, Artificial Sequence
  Description of Artificial Sequence: Synthetic oligonucleotide
atttcatctcttctgtacttaccacctgagcagcag

SEQ ID NO: 142310 - DNA, 35 bp, Artificial Sequence
  Description of Artificial Sequence: Synthetic oligonucleotide
tttcatctcttctgtacttaccacctgagcagcag

SEQ ID NO: 142311 - DNA, 34 bp, Artificial Sequence
  Description of Artificial Sequence: Synthetic oligonucleotide
ttcatctcttctgtacttaccacctgagcagcag

SEQ ID NO: 142312 - DNA, 33 bp, Artificial Sequence
  Description of Artificial Sequence: Synthetic oligonucleotide
tcatctcttctgtacttaccacctgagcagcag

SEQ ID NO: 142313 - DNA, 32 bp, Artificial Sequence
  Description of Artificial Sequence: Synthetic oligonucleotide
catctcttctgtacttaccacctgagcagcag

SEQ ID NO: 142314 - DNA, 33 bp, Artificial Sequence
  Description of Artificial Sequence: Synthetic oligonucleotide
atctcttctgtacttaccacctgagcagcagac

SEQ ID NO: 142315 - DNA, 32 bp, Artificial Sequence
  Description of Artificial Sequence: Synthetic oligonucleotide
tctcttctgtacttaccacctgagcagcagac

SEQ ID NO: 142316 - DNA, 31 bp, Artificial Sequence
  Description of Artificial Sequence: Synthetic oligonucleotide
ctcttctgtacttaccacctgagcagcagac

SEQ ID NO: 142317 - DNA, 32 bp, Artificial Sequence
  Description of Artificial Sequence: Synthetic oligonucleotide
tcttctgtacttaccacctgagcagcagactg

SEQ ID NO: 142318 - DNA, 31 bp, Artificial Sequence
  Description of Artificial Sequence: Synthetic oligonucleotide
cttctgtacttaccacctgagcagcagactg

SEQ ID NO: 142319 - DNA, 33 bp, Artificial Sequence
  Description of Artificial Sequence: Synthetic oligonucleotide
ttctgtacttaccacctgagcagcagactgatg

SEQ ID NO: 142320 - DNA, 32 bp, Artificial Sequence
  Description of Artificial Sequence: Synthetic oligonucleotide
tctgtacttaccacctgagcagcagactgatg

SEQ ID NO: 142321 - DNA, 31 bp, Artificial Sequence
  Description of Artificial Sequence: Synthetic oligonucleotide
ctgtacttaccacctgagcagcagactgatg

SEQ ID NO: 142322 - DNA, 32 bp, Artificial Sequence
  Description of Artificial Sequence: Synthetic oligonucleotide
tgtacttaccacctgagcagcagactgatgac

SEQ ID NO: 142323 - DNA, 31 bp, Artificial Sequence
  Description of Artificial Sequence: Synthetic oligonucleotide
gtacttaccacctgagcagcagactgatgac

SEQ ID NO: 142324 - DNA, 31 bp, Artificial Sequence
  Description of Artificial Sequence: Synthetic oligonucleotide
tacttaccacctgagcagcagactgatgacc

SEQ ID NO: 142325 - DNA, 30 bp, Artificial Sequence
  Description of Artificial Sequence: Synthetic oligonucleotide
acttaccacctgagcagcagactgatgacc

SEQ ID NO: 142326 - DNA, 29 bp, Artificial Sequence
  Description of Artificial Sequence: Synthetic oligonucleotide
cttaccacctgagcagcagactgatgacc

SEQ ID NO: 142327 - DNA, 31 bp, Artificial Sequence
  Description of Artificial Sequence: Synthetic oligonucleotide
ttaccacctgagcagcagactgatgaccttc

SEQ ID NO: 142328 - DNA, 30 bp, Artificial Sequence
  Description of Artificial Sequence: Synthetic oligonucleotide
taccacctgagcagcagactgatgaccttc

SEQ ID NO: 142329 - DNA, 29 bp, Artificial Sequence
  Description of Artificial Sequence: Synthetic oligonucleotide
accacctgagcagcagactgatgaccttc

SEQ ID NO: 142330 - DNA, 28 bp, Artificial Sequence
  Description of Artificial Sequence: Synthetic oligonucleotide
ccacctgagcagcagactgatgaccttc

SEQ ID NO: 142331 - DNA, 29 bp, Artificial Sequence
  Description of Artificial Sequence: Synthetic oligonucleotide
cacctgagcagcagactgatgaccttctg

SEQ ID NO: 142332 - DNA, 30 bp, Artificial Sequence
  Description of Artificial Sequence: Synthetic oligonucleotide
acctgagcagcagactgatgaccttctgag

SEQ ID NO: 142333 - DNA, 29 bp, Artificial Sequence
  Description of Artificial Sequence: Synthetic oligonucleotide
cctgagcagcagactgatgaccttctgag

SEQ ID NO: 142334 - DNA, 29 bp, Artificial Sequence
  Description of Artificial Sequence: Synthetic oligonucleotide
ctgagcagcagactgatgaccttctgagg

SEQ ID NO: 142335 - DNA, 31 bp, Artificial Sequence
  Description of Artificial Sequence: Synthetic oligonucleotide
tgagcagcagactgatgaccttctgaggatg

SEQ ID NO: 142336 - DNA, 30 bp, Artificial Sequence
  Description of Artificial Sequence: Synthetic oligonucleotide
gagcagcagactgatgaccttctgaggatg

SEQ ID NO: 142337 - DNA, 31 bp, Artificial Sequence
  Description of Artificial Sequence: Synthetic oligonucleotide
agcagcagactgatgaccttctgaggatgac

SEQ ID NO: 142338 - DNA, 30 bp, Artificial Sequence
  Description of Artificial Sequence: Synthetic oligonucleotide
gcagcagactgatgaccttctgaggatgac

SEQ ID NO: 142339 - DNA, 31 bp, Artificial Sequence
  Description of Artificial Sequence: Synthetic oligonucleotide
cagcagactgatgaccttctgaggatgacag

SEQ ID NO: 142340 - DNA, 34 bp, Artificial Sequence
  Description of Artificial Sequence: Synthetic oligonucleotide
agcagactgatgaccttctgaggatgacagaatc

SEQ ID NO: 142341 - DNA, 33 bp, Artificial Sequence
  Description of Artificial Sequence: Synthetic oligonucleotide
gcagactgatgaccttctgaggatgacagaatc

SEQ ID NO: 142342 - DNA, 33 bp, Artificial Sequence
  Description of Artificial Sequence: Synthetic oligonucleotide
cagactgatgaccttctgaggatgacagaatcc

SEQ ID NO: 142343 - DNA, 34 bp, Artificial Sequence
  Description of Artificial Sequence: Synthetic oligonucleotide
agactgatgaccttctgaggatgacagaatcctg

SEQ ID NO: 142344 - DNA, 33 bp, Artificial Sequence
  Description of Artificial Sequence: Synthetic oligonucleotide
gactgatgaccttctgaggatgacagaatcctg

SEQ ID NO: 142345 - DNA, 33 bp, Artificial Sequence
  Description of Artificial Sequence: Synthetic oligonucleotide
actgatgaccttctgaggatgacagaatcctgg

SEQ ID NO: 142346 - DNA, 32 bp, Artificial Sequence
  Description of Artificial Sequence: Synthetic oligonucleotide
ctgatgaccttctgaggatgacagaatcctgg

SEQ ID NO: 142347 - DNA, 36 bp, Artificial Sequence
  Description of Artificial Sequence: Synthetic oligonucleotide
tgatgaccttctgaggatgacagaatcctggttttc

SEQ ID NO: 142348 - DNA, 35 bp, Artificial Sequence
  Description of Artificial Sequence: Synthetic oligonucleotide
gatgaccttctgaggatgacagaatcctggttttc

SEQ ID NO: 142349 - DNA, 37 bp, Artificial Sequence
  Description of Artificial Sequence: Synthetic oligonucleotide
atgaccttctgaggatgacagaatcctggttttcttc

SEQ ID NO: 142350 - DNA, 36 bp, Artificial Sequence
  Description of Artificial Sequence: Synthetic oligonucleotide
tgaccttctgaggatgacagaatcctggttttcttc

SEQ ID NO: 142351 - DNA, 35 bp, Artificial Sequence
  Description of Artificial Sequence: Synthetic oligonucleotide
gaccttctgaggatgacagaatcctggttttcttc

SEQ ID NO: 142352 - DNA, 40 bp, Artificial Sequence
  Description of Artificial Sequence: Synthetic oligonucleotide
accttctgaggatgacagaatcctggttttcttctttatc

SEQ ID NO: 142353 - DNA, 39 bp, Artificial Sequence
  Description of Artificial Sequence: Synthetic oligonucleotide
ccttctgaggatgacagaatcctggttttcttctttatc

SEQ ID NO: 142354 - DNA, 40 bp, Artificial Sequence
  Description of Artificial Sequence: Synthetic oligonucleotide
cttctgaggatgacagaatcctggttttcttctttatctc

SEQ ID NO: 142355 - DNA, 40 bp, Artificial Sequence
  Description of Artificial Sequence: Synthetic oligonucleotide
ttctgaggatgacagaatcctggttttcttctttatctcg

SEQ ID NO: 142356 - DNA, 39 bp, Artificial Sequence
  Description of Artificial Sequence: Synthetic oligonucleotide
tctgaggatgacagaatcctggttttcttctttatctcg

SEQ ID NO: 142357 - DNA, 38 bp, Artificial Sequence
  Description of Artificial Sequence: Synthetic oligonucleotide
ctgaggatgacagaatcctggttttcttctttatctcg

SEQ ID NO: 142358 - DNA, 38 bp, Artificial Sequence
  Description of Artificial Sequence: Synthetic oligonucleotide
tgaggatgacagaatcctggttttcttctttatctcgg

SEQ ID NO: 142359 - DNA, 37 bp, Artificial Sequence
  Description of Artificial Sequence: Synthetic oligonucleotide
gaggatgacagaatcctggttttcttctttatctcgg

SEQ ID NO: 142360 - DNA, 37 bp, Artificial Sequence
  Description of Artificial Sequence: Synthetic oligonucleotide
aggatgacagaatcctggttttcttctttatctcggg

SEQ ID NO: 142361 - DNA, 36 bp, Artificial Sequence
  Description of Artificial Sequence: Synthetic oligonucleotide
ggatgacagaatcctggttttcttctttatctcggg

SEQ ID NO: 142362 - DNA, 38 bp, Artificial Sequence
  Description of Artificial Sequence: Synthetic oligonucleotide
gatgacagaatcctggttttcttctttatctcgggatc

SEQ ID NO: 142363 - DNA, 38 bp, Artificial Sequence
  Description of Artificial Sequence: Synthetic oligonucleotide
atgacagaatcctggttttcttctttatctcgggatcc

SEQ ID NO: 142364 - DNA, 37 bp, Artificial Sequence
  Description of Artificial Sequence: Synthetic oligonucleotide
tgacagaatcctggttttcttctttatctcgggatcc

SEQ ID NO: 142365 - DNA, 36 bp, Artificial Sequence
  Description of Artificial Sequence: Synthetic oligonucleotide
gacagaatcctggttttcttctttatctcgggatcc

SEQ ID NO: 142366 - DNA, 37 bp, Artificial Sequence
  Description of Artificial Sequence: Synthetic oligonucleotide
acagaatcctggttttcttctttatctcgggatccac

SEQ ID NO: 142367 - DNA, 36 bp, Artificial Sequence
  Description of Artificial Sequence: Synthetic oligonucleotide
cagaatcctggttttcttctttatctcgggatccac

SEQ ID NO: 142368 - DNA, 37 bp, Artificial Sequence
  Description of Artificial Sequence: Synthetic oligonucleotide
agaatcctggttttcttctttatctcgggatccactg

SEQ ID NO: 142369 - DNA, 36 bp, Artificial Sequence
  Description of Artificial Sequence: Synthetic oligonucleotide
gaatcctggttttcttctttatctcgggatccactg

SEQ ID NO: 142370 - DNA, 36 bp, Artificial Sequence
  Description of Artificial Sequence: Synthetic oligonucleotide
aatcctggttttcttctttatctcgggatccactgg

SEQ ID NO: 142371 - DNA, 35 bp, Artificial Sequence
  Description of Artificial Sequence: Synthetic oligonucleotide
atcctggttttcttctttatctcgggatccactgg

SEQ ID NO: 142372 - DNA, 34 bp, Artificial Sequence
  Description of Artificial Sequence: Synthetic oligonucleotide
tcctggttttcttctttatctcgggatccactgg

SEQ ID NO: 142373 - DNA, 33 bp, Artificial Sequence
  Description of Artificial Sequence: Synthetic oligonucleotide
cctggttttcttctttatctcgggatccactgg

SEQ ID NO: 142374 - DNA, 34 bp, Artificial Sequence
  Description of Artificial Sequence: Synthetic oligonucleotide
ctggttttcttctttatctcgggatccactggag

SEQ ID NO: 142375 - DNA, 34 bp, Artificial Sequence
  Description of Artificial Sequence: Synthetic oligonucleotide
tggttttcttctttatctcgggatccactggagc

SEQ ID NO: 142376 - DNA, 33 bp, Artificial Sequence
  Description of Artificial Sequence: Synthetic oligonucleotide
ggttttcttctttatctcgggatccactggagc

SEQ ID NO: 142377 - DNA, 34 bp, Artificial Sequence
  Description of Artificial Sequence: Synthetic oligonucleotide
gttttcttctttatctcgggatccactggagctc

SEQ ID NO: 142378 - DNA, 36 bp, Artificial Sequence
  Description of Artificial Sequence: Synthetic oligonucleotide
ttttcttctttatctcgggatccactggagctcttc

SEQ ID NO: 142379 - DNA, 35 bp, Artificial Sequence
  Description of Artificial Sequence: Synthetic oligonucleotide
tttcttctttatctcgggatccactggagctcttc

SEQ ID NO: 142380 - DNA, 34 bp, Artificial Sequence
  Description of Artificial Sequence: Synthetic oligonucleotide
ttcttctttatctcgggatccactggagctcttc

SEQ ID NO: 142381 - DNA, 33 bp, Artificial Sequence
  Description of Artificial Sequence: Synthetic oligonucleotide
tcttctttatctcgggatccactggagctcttc

SEQ ID NO: 142382 - DNA, 32 bp, Artificial Sequence
  Description of Artificial Sequence: Synthetic oligonucleotide
cttctttatctcgggatccactggagctcttc

SEQ ID NO: 142383 - DNA, 32 bp, Artificial Sequence
  Description of Artificial Sequence: Synthetic oligonucleotide
ttctttatctcgggatccactggagctcttcc

SEQ ID NO: 142384 - DNA, 31 bp, Artificial Sequence
  Description of Artificial Sequence: Synthetic oligonucleotide
tctttatctcgggatccactggagctcttcc

SEQ ID NO: 142385 - DNA, 30 bp, Artificial Sequence
  Description of Artificial Sequence: Synthetic oligonucleotide
ctttatctcgggatccactggagctcttcc

SEQ ID NO: 142386 - DNA, 30 bp, Artificial Sequence
  Description of Artificial Sequence: Synthetic oligonucleotide
tttatctcgggatccactggagctcttccg

SEQ ID NO: 142387 - DNA, 29 bp, Artificial Sequence
  Description of Artificial Sequence: Synthetic oligonucleotide
ttatctcgggatccactggagctcttccg

SEQ ID NO: 142388 - DNA, 28 bp, Artificial Sequence
  Description of Artificial Sequence: Synthetic oligonucleotide
tatctcgggatccactggagctcttccg

SEQ ID NO: 142389 - DNA, 27 bp, Artificial Sequence
  Description of Artificial Sequence: Synthetic oligonucleotide
atctcgggatccactggagctcttccg

SEQ ID NO: 142390 - DNA, 27 bp, Artificial Sequence
  Description of Artificial Sequence: Synthetic oligonucleotide
tctcgggatccactggagctcttccgt

SEQ ID NO: 142391 - DNA, 26 bp, Artificial Sequence
  Description of Artificial Sequence: Synthetic oligonucleotide
ctcgggatccactggagctcttccgt

SEQ ID NO: 142392 - DNA, 26 bp, Artificial Sequence
  Description of Artificial Sequence: Synthetic oligonucleotide
tcgggatccactggagctcttccgtg

SEQ ID NO: 142393 - DNA, 25 bp, Artificial Sequence
  Description of Artificial Sequence: Synthetic oligonucleotide
cgggatccactggagctcttccgtg

SEQ ID NO: 142394 - DNA, 25 bp, Artificial Sequence
  Description of Artificial Sequence: Synthetic oligonucleotide
gggatccactggagctcttccgtgg

SEQ ID NO: 142395 - DNA, 27 bp, Artificial Sequence
  Description of Artificial Sequence: Synthetic oligonucleotide
ggatccactggagctcttccgtggcat

SEQ ID NO: 142396 - DNA, 29 bp, Artificial Sequence
  Description of Artificial Sequence: Synthetic oligonucleotide
gatccactggagctcttccgtggcattag

SEQ ID NO: 142397 - DNA, 31 bp, Artificial Sequence
  Description of Artificial Sequence: Synthetic oligonucleotide
atccactggagctcttccgtggcattagtag

SEQ ID NO: 142398 - DNA, 30 bp, Artificial Sequence
  Description of Artificial Sequence: Synthetic oligonucleotide
tccactggagctcttccgtggcattagtag

SEQ ID NO: 142399 - DNA, 29 bp, Artificial Sequence
  Description of Artificial Sequence: Synthetic oligonucleotide
ccactggagctcttccgtggcattagtag

SEQ ID NO: 142400 - DNA, 30 bp, Artificial Sequence
  Description of Artificial Sequence: Synthetic oligonucleotide
cactggagctcttccgtggcattagtagtc

SEQ ID NO: 142401 - DNA, 31 bp, Artificial Sequence
  Description of Artificial Sequence: Synthetic oligonucleotide
actggagctcttccgtggcattagtagtcag

SEQ ID NO: 142402 - DNA, 30 bp, Artificial Sequence
  Description of Artificial Sequence: Synthetic oligonucleotide
ctggagctcttccgtggcattagtagtcag

SEQ ID NO: 142403 - DNA, 30 bp, Artificial Sequence
  Description of Artificial Sequence: Synthetic oligonucleotide
tggagctcttccgtggcattagtagtcagc

SEQ ID NO: 142404 - DNA, 29 bp, Artificial Sequence
  Description of Artificial Sequence: Synthetic oligonucleotide
ggagctcttccgtggcattagtagtcagc

SEQ ID NO: 142405 - DNA, 29 bp, Artificial Sequence
  Description of Artificial Sequence: Synthetic oligonucleotide
gagctcttccgtggcattagtagtcagcc

SEQ ID NO: 142406 - DNA, 29 bp, Artificial Sequence
  Description of Artificial Sequence: Synthetic oligonucleotide
agctcttccgtggcattagtagtcagccc

SEQ ID NO: 142407 - DNA, 28 bp, Artificial Sequence
  Description of Artificial Sequence: Synthetic oligonucleotide
gctcttccgtggcattagtagtcagccc

SEQ ID NO: 142408 - DNA, 30 bp, Artificial Sequence
  Description of Artificial Sequence: Synthetic oligonucleotide
ctcttccgtggcattagtagtcagcccttc

SEQ ID NO: 142409 - DNA, 30 bp, Artificial Sequence
  Description of Artificial Sequence: Synthetic oligonucleotide
tcttccgtggcattagtagtcagcccttcc

SEQ ID NO: 142410 - DNA, 29 bp, Artificial Sequence
  Description of Artificial Sequence: Synthetic oligonucleotide
cttccgtggcattagtagtcagcccttcc

SEQ ID NO: 142411 - DNA, 29 bp, Artificial Sequence
  Description of Artificial Sequence: Synthetic oligonucleotide
ttccgtggcattagtagtcagcccttccc

SEQ ID NO: 142412 - DNA, 28 bp, Artificial Sequence
  Description of Artificial Sequence: Synthetic oligonucleotide
tccgtggcattagtagtcagcccttccc

SEQ ID NO: 142413 - DNA, 27 bp, Artificial Sequence
  Description of Artificial Sequence: Synthetic oligonucleotide
ccgtggcattagtagtcagcccttccc

SEQ ID NO: 142414 - DNA, 28 bp, Artificial Sequence
  Description of Artificial Sequence: Synthetic oligonucleotide
cgtggcattagtagtcagcccttccctg

SEQ ID NO: 142415 - DNA, 30 bp, Artificial Sequence
  Description of Artificial Sequence: Synthetic oligonucleotide
gtggcattagtagtcagcccttccctgaac

SEQ ID NO: 142416 - DNA, 32 bp, Artificial Sequence
  Description of Artificial Sequence: Synthetic oligonucleotide
tggcattagtagtcagcccttccctgaactac

SEQ ID NO: 142417 - DNA, 31 bp, Artificial Sequence
  Description of Artificial Sequence: Synthetic oligonucleotide
ggcattagtagtcagcccttccctgaactac

SEQ ID NO: 142418 - DNA, 32 bp, Artificial Sequence
  Description of Artificial Sequence: Synthetic oligonucleotide
gcattagtagtcagcccttccctgaactacac

SEQ ID NO: 142419 - DNA, 33 bp, Artificial Sequence
  Description of Artificial Sequence: Synthetic oligonucleotide
cattagtagtcagcccttccctgaactacactg

SEQ ID NO: 142420 - DNA, 34 bp, Artificial Sequence
  Description of Artificial Sequence: Synthetic oligonucleotide
attagtagtcagcccttccctgaactacactgtg

SEQ ID NO: 142421 - DNA, 33 bp, Artificial Sequence
  Description of Artificial Sequence: Synthetic oligonucleotide
ttagtagtcagcccttccctgaactacactgtg

SEQ ID NO: 142422 - DNA, 32 bp, Artificial Sequence
  Description of Artificial Sequence: Synthetic oligonucleotide
tagtagtcagcccttccctgaactacactgtg

SEQ ID NO: 142423 - DNA, 31 bp, Artificial Sequence
  Description of Artificial Sequence: Synthetic oligonucleotide
agtagtcagcccttccctgaactacactgtg

SEQ ID NO: 142424 - DNA, 30 bp, Artificial Sequence
  Description of Artificial Sequence: Synthetic oligonucleotide
gtagtcagcccttccctgaactacactgtg

SEQ ID NO: 142425 - DNA, 30 bp, Artificial Sequence
  Description of Artificial Sequence: Synthetic oligonucleotide
tagtcagcccttccctgaactacactgtgc

SEQ ID NO: 142426 - DNA, 29 bp, Artificial Sequence
  Description of Artificial Sequence: Synthetic oligonucleotide
agtcagcccttccctgaactacactgtgc

SEQ ID NO: 142427 - DNA, 28 bp, Artificial Sequence
  Description of Artificial Sequence: Synthetic oligonucleotide
gtcagcccttccctgaactacactgtgc

SEQ ID NO: 142428 - DNA, 29 bp, Artificial Sequence
  Description of Artificial Sequence: Synthetic oligonucleotide
tcagcccttccctgaactacactgtgctg

SEQ ID NO: 142429 - DNA, 28 bp, Artificial Sequence
  Description of Artificial Sequence: Synthetic oligonucleotide
cagcccttccctgaactacactgtgctg

SEQ ID NO: 142430 - DNA, 28 bp, Artificial Sequence
  Description of Artificial Sequence: Synthetic oligonucleotide
agcccttccctgaactacactgtgctgc

SEQ ID NO: 142431 - DNA, 27 bp, Artificial Sequence
  Description of Artificial Sequence: Synthetic oligonucleotide
gcccttccctgaactacactgtgctgc

SEQ ID NO: 142432 - DNA, 27 bp, Artificial Sequence
  Description of Artificial Sequence: Synthetic oligonucleotide
cccttccctgaactacactgtgctgcc

SEQ ID NO: 142433 - DNA, 33 bp, Artificial Sequence
  Description of Artificial Sequence: Synthetic oligonucleotide
ccttccctgaactacactgtgctgccttaaaag

SEQ ID NO: 142434 - DNA, 34 bp, Artificial Sequence
  Description of Artificial Sequence: Synthetic oligonucleotide
cttccctgaactacactgtgctgccttaaaagtg

SEQ ID NO: 142435 - DNA, 38 bp, Artificial Sequence
  Description of Artificial Sequence: Synthetic oligonucleotide
ttccctgaactacactgtgctgccttaaaagtgtttac

SEQ ID NO: 142436 - DNA, 37 bp, Artificial Sequence
  Description of Artificial Sequence: Synthetic oligonucleotide
tccctgaactacactgtgctgccttaaaagtgtttac

SEQ ID NO: 142437 - DNA, 36 bp, Artificial Sequence
  Description of Artificial Sequence: Synthetic oligonucleotide
ccctgaactacactgtgctgccttaaaagtgtttac

SEQ ID NO: 142438 - DNA, 36 bp, Artificial Sequence
  Description of Artificial Sequence: Synthetic oligonucleotide
cctgaactacactgtgctgccttaaaagtgtttacg

SEQ ID NO: 142439 - DNA, 36 bp, Artificial Sequence
  Description of Artificial Sequence: Synthetic oligonucleotide
ctgaactacactgtgctgccttaaaagtgtttacgg

SEQ ID NO: 142440 - DNA, 36 bp, Artificial Sequence
  Description of Artificial Sequence: Synthetic oligonucleotide
tgaactacactgtgctgccttaaaagtgtttacggc

SEQ ID NO: 142441 - DNA, 35 bp, Artificial Sequence
  Description of Artificial Sequence: Synthetic oligonucleotide
gaactacactgtgctgccttaaaagtgtttacggc

SEQ ID NO: 142442 - DNA, 35 bp, Artificial Sequence
  Description of Artificial Sequence: Synthetic oligonucleotide
aactacactgtgctgccttaaaagtgtttacggcc

SEQ ID NO: 142443 - DNA, 34 bp, Artificial Sequence
  Description of Artificial Sequence: Synthetic oligonucleotide
actacactgtgctgccttaaaagtgtttacggcc

SEQ ID NO: 142444 - DNA, 33 bp, Artificial Sequence
  Description of Artificial Sequence: Synthetic oligonucleotide
ctacactgtgctgccttaaaagtgtttacggcc

SEQ ID NO: 142445 - DNA, 36 bp, Artificial Sequence
  Description of Artificial Sequence: Synthetic oligonucleotide
tacactgtgctgccttaaaagtgtttacggccattg

SEQ ID NO: 142446 - DNA, 35 bp, Artificial Sequence
  Description of Artificial Sequence: Synthetic oligonucleotide
acactgtgctgccttaaaagtgtttacggccattg

SEQ ID NO: 142447 - DNA, 34 bp, Artificial Sequence
  Description of Artificial Sequence: Synthetic oligonucleotide
cactgtgctgccttaaaagtgtttacggccattg

SEQ ID NO: 142448 - DNA, 34 bp, Artificial Sequence
  Description of Artificial Sequence: Synthetic oligonucleotide
actgtgctgccttaaaagtgtttacggccattgc

SEQ ID NO: 142449 - DNA, 33 bp, Artificial Sequence
  Description of Artificial Sequence: Synthetic oligonucleotide
ctgtgctgccttaaaagtgtttacggccattgc

SEQ ID NO: 142450 - DNA, 36 bp, Artificial Sequence
  Description of Artificial Sequence: Synthetic oligonucleotide
tgtgctgccttaaaagtgtttacggccattgcaaac

SEQ ID NO: 142451 - DNA, 35 bp, Artificial Sequence
  Description of Artificial Sequence: Synthetic oligonucleotide
gtgctgccttaaaagtgtttacggccattgcaaac

SEQ ID NO: 142452 - DNA, 35 bp, Artificial Sequence
  Description of Artificial Sequence: Synthetic oligonucleotide
tgctgccttaaaagtgtttacggccattgcaaacc

SEQ ID NO: 142453 - DNA, 34 bp, Artificial Sequence
  Description of Artificial Sequence: Synthetic oligonucleotide
gctgccttaaaagtgtttacggccattgcaaacc

SEQ ID NO: 142454 - DNA, 36 bp, Artificial Sequence
  Description of Artificial Sequence: Synthetic oligonucleotide
ctgccttaaaagtgtttacggccattgcaaaccaac

SEQ ID NO: 142455 - DNA, 36 bp, Artificial Sequence
  Description of Artificial Sequence: Synthetic oligonucleotide
tgccttaaaagtgtttacggccattgcaaaccaacc

SEQ ID NO: 142456 - DNA, 35 bp, Artificial Sequence
  Description of Artificial Sequence: Synthetic oligonucleotide
gccttaaaagtgtttacggccattgcaaaccaacc

SEQ ID NO: 142457 - DNA, 35 bp, Artificial Sequence
  Description of Artificial Sequence: Synthetic oligonucleotide
ccttaaaagtgtttacggccattgcaaaccaaccc

SEQ ID NO: 142458 - DNA, 36 bp, Artificial Sequence
  Description of Artificial Sequence: Synthetic oligonucleotide
cttaaaagtgtttacggccattgcaaaccaaccctg

SEQ ID NO: 142459 - DNA, 36 bp, Artificial Sequence
  Description of Artificial Sequence: Synthetic oligonucleotide
ttaaaagtgtttacggccattgcaaaccaaccctgg

SEQ ID NO: 142460 - DNA, 35 bp, Artificial Sequence
  Description of Artificial Sequence: Synthetic oligonucleotide
taaaagtgtttacggccattgcaaaccaaccctgg

SEQ ID NO: 142461 - DNA, 34 bp, Artificial Sequence
  Description of Artificial Sequence: Synthetic oligonucleotide
aaaagtgtttacggccattgcaaaccaaccctgg

SEQ ID NO: 142462 - DNA, 33 bp, Artificial Sequence
  Description of Artificial Sequence: Synthetic oligonucleotide
aaagtgtttacggccattgcaaaccaaccctgg

SEQ ID NO: 142463 - DNA, 32 bp, Artificial Sequence
  Description of Artificial Sequence: Synthetic oligonucleotide
aagtgtttacggccattgcaaaccaaccctgg

SEQ ID NO: 142464 - DNA, 31 bp, Artificial Sequence
  Description of Artificial Sequence: Synthetic oligonucleotide
agtgtttacggccattgcaaaccaaccctgg

SEQ ID NO: 142465 - DNA, 30 bp, Artificial Sequence
  Description of Artificial Sequence: Synthetic oligonucleotide
gtgtttacggccattgcaaaccaaccctgg

SEQ ID NO: 142466 - DNA, 30 bp, Artificial Sequence
  Description of Artificial Sequence: Synthetic oligonucleotide
tgtttacggccattgcaaaccaaccctggg

SEQ ID NO: 142467 - DNA, 29 bp, Artificial Sequence
  Description of Artificial Sequence: Synthetic oligonucleotide
gtttacggccattgcaaaccaaccctggg

SEQ ID NO: 142468 - DNA, 29 bp, Artificial Sequence
  Description of Artificial Sequence: Synthetic oligonucleotide
tttacggccattgcaaaccaaccctgggc

SEQ ID NO: 142469 - DNA, 28 bp, Artificial Sequence
  Description of Artificial Sequence: Synthetic oligonucleotide
ttacggccattgcaaaccaaccctgggc

SEQ ID NO: 142470 - DNA, 27 bp, Artificial Sequence
  Description of Artificial Sequence: Synthetic oligonucleotide
tacggccattgcaaaccaaccctgggc

SEQ ID NO: 142471 - DNA, 27 bp, Artificial Sequence
  Description of Artificial Sequence: Synthetic oligonucleotide
acggccattgcaaaccaaccctgggct

SEQ ID NO: 142472 - DNA, 26 bp, Artificial Sequence
  Description of Artificial Sequence: Synthetic oligonucleotide
cggccattgcaaaccaaccctgggct

SEQ ID NO: 142473 - DNA, 27 bp, Artificial Sequence
  Description of Artificial Sequence: Synthetic oligonucleotide
ggccattgcaaaccaaccctgggctca

SEQ ID NO: 142474 - DNA, 27 bp, Artificial Sequence
  Description of Artificial Sequence: Synthetic oligonucleotide
gccattgcaaaccaaccctgggctcag

SEQ ID NO: 142475 - DNA, 30 bp, Artificial Sequence
  Description of Artificial Sequence: Synthetic oligonucleotide
ccattgcaaaccaaccctgggctcagaaac

SEQ ID NO: 142476 - DNA, 34 bp, Artificial Sequence
  Description of Artificial Sequence: Synthetic oligonucleotide
cattgcaaaccaaccctgggctcagaaacttatg

SEQ ID NO: 142477 - DNA, 39 bp, Artificial Sequence
  Description of Artificial Sequence: Synthetic oligonucleotide
attgcaaaccaaccctgggctcagaaacttatgtttaac

SEQ ID NO: 142478 - DNA, 38 bp, Artificial Sequence
  Description of Artificial Sequence: Synthetic oligonucleotide
ttgcaaaccaaccctgggctcagaaacttatgtttaac

SEQ ID NO: 142479 - DNA, 37 bp, Artificial Sequence
  Description of Artificial Sequence: Synthetic oligonucleotide
tgcaaaccaaccctgggctcagaaacttatgtttaac

SEQ ID NO: 142480 - DNA, 36 bp, Artificial Sequence
  Description of Artificial Sequence: Synthetic oligonucleotide
gcaaaccaaccctgggctcagaaacttatgtttaac

SEQ ID NO: 142481 - DNA, 37 bp, Artificial Sequence
  Description of Artificial Sequence: Synthetic oligonucleotide
caaaccaaccctgggctcagaaacttatgtttaacag

SEQ ID NO: 142482 - DNA, 38 bp, Artificial Sequence
  Description of Artificial Sequence: Synthetic oligonucleotide
aaaccaaccctgggctcagaaacttatgtttaacagtc

SEQ ID NO: 142483 - DNA, 37 bp, Artificial Sequence
  Description of Artificial Sequence: Synthetic oligonucleotide
aaccaaccctgggctcagaaacttatgtttaacagtc

SEQ ID NO: 142484 - DNA, 36 bp, Artificial Sequence
  Description of Artificial Sequence: Synthetic oligonucleotide
accaaccctgggctcagaaacttatgtttaacagtc

SEQ ID NO: 142485 - DNA, 35 bp, Artificial Sequence
  Description of Artificial Sequence: Synthetic oligonucleotide
ccaaccctgggctcagaaacttatgtttaacagtc

SEQ ID NO: 142486 - DNA, 35 bp, Artificial Sequence
  Description of Artificial Sequence: Synthetic oligonucleotide
caaccctgggctcagaaacttatgtttaacagtcc

SEQ ID NO: 142487 - DNA, 36 bp, Artificial Sequence
  Description of Artificial Sequence: Synthetic oligonucleotide
aaccctgggctcagaaacttatgtttaacagtccag

SEQ ID NO: 142488 - DNA, 35 bp, Artificial Sequence
  Description of Artificial Sequence: Synthetic oligonucleotide
accctgggctcagaaacttatgtttaacagtccag

SEQ ID NO: 142489 - DNA, 34 bp, Artificial Sequence
  Description of Artificial Sequence: Synthetic oligonucleotide
ccctgggctcagaaacttatgtttaacagtccag

SEQ ID NO: 142490 - DNA, 34 bp, Artificial Sequence
  Description of Artificial Sequence: Synthetic oligonucleotide
cctgggctcagaaacttatgtttaacagtccagg

SEQ ID NO: 142491 - DNA, 38 bp, Artificial Sequence
  Description of Artificial Sequence: Synthetic oligonucleotide
ctgggctcagaaacttatgtttaacagtccaggttttg

SEQ ID NO: 142492 - DNA, 40 bp, Artificial Sequence
  Description of Artificial Sequence: Synthetic oligonucleotide
tgggctcagaaacttatgtttaacagtccaggttttgtag

SEQ ID NO: 142493 - DNA, 39 bp, Artificial Sequence
  Description of Artificial Sequence: Synthetic oligonucleotide
gggctcagaaacttatgtttaacagtccaggttttgtag

SEQ ID NO: 142494 - DNA, 44 bp, Artificial Sequence
  Description of Artificial Sequence: Synthetic oligonucleotide
ggctcagaaacttatgtttaacagtccaggttttgtagaatatg

SEQ ID NO: 142495 - DNA, 45 bp, Artificial Sequence
  Description of Artificial Sequence: Synthetic oligonucleotide
gctcagaaacttatgtttaacagtccaggttttgtagaatatgtg

SEQ ID NO: 142496 - DNA, 45 bp, Artificial Sequence
  Description of Artificial Sequence: Synthetic oligonucleotide
ctcagaaacttatgtttaacagtccaggttttgtagaatatgtgg

SEQ ID NO: 142497 - DNA, 46 bp, Artificial Sequence
  Description of Artificial Sequence: Synthetic oligonucleotide
tcagaaacttatgtttaacagtccaggttttgtagaatatgtggtg

SEQ ID NO: 142498 - DNA, 45 bp, Artificial Sequence
  Description of Artificial Sequence: Synthetic oligonucleotide
cagaaacttatgtttaacagtccaggttttgtagaatatgtggtg

SEQ ID NO: 142499 - DNA, 45 bp, Artificial Sequence
  Description of Artificial Sequence: Synthetic oligonucleotide
agaaacttatgtttaacagtccaggttttgtagaatatgtggtgg

SEQ ID NO: 142500 - DNA, 44 bp, Artificial Sequence
  Description of Artificial Sequence: Synthetic oligonucleotide
gaaacttatgtttaacagtccaggttttgtagaatatgtggtgg

SEQ ID NO: 142501 - DNA, 45 bp, Artificial Sequence
  Description of Artificial Sequence: Synthetic oligonucleotide
aaacttatgtttaacagtccaggttttgtagaatatgtggtggac

SEQ ID NO: 142502 - DNA, 44 bp, Artificial Sequence
  Description of Artificial Sequence: Synthetic oligonucleotide
aacttatgtttaacagtccaggttttgtagaatatgtggtggac

SEQ ID NO: 142503 - DNA, 43 bp, Artificial Sequence
  Description of Artificial Sequence: Synthetic oligonucleotide
acttatgtttaacagtccaggttttgtagaatatgtggtggac

SEQ ID NO: 142504 - DNA, 42 bp, Artificial Sequence
  Description of Artificial Sequence: Synthetic oligonucleotide
cttatgtttaacagtccaggttttgtagaatatgtggtggac

SEQ ID NO: 142505 - DNA, 42 bp, Artificial Sequence
  Description of Artificial Sequence: Synthetic oligonucleotide
ttatgtttaacagtccaggttttgtagaatatgtggtggacc

SEQ ID NO: 142506 - DNA, 41 bp, Artificial Sequence
  Description of Artificial Sequence: Synthetic oligonucleotide
tatgtttaacagtccaggttttgtagaatatgtggtggacc

SEQ ID NO: 142507 - DNA, 40 bp, Artificial Sequence
  Description of Artificial Sequence: Synthetic oligonucleotide
atgtttaacagtccaggttttgtagaatatgtggtggacc

SEQ ID NO: 142508 - DNA, 39 bp, Artificial Sequence
  Description of Artificial Sequence: Synthetic oligonucleotide
tgtttaacagtccaggttttgtagaatatgtggtggacc

SEQ ID NO: 142509 - DNA, 38 bp, Artificial Sequence
  Description of Artificial Sequence: Synthetic oligonucleotide
gtttaacagtccaggttttgtagaatatgtggtggacc

SEQ ID NO: 142510 - DNA, 38 bp, Artificial Sequence
  Description of Artificial Sequence: Synthetic oligonucleotide
tttaacagtccaggttttgtagaatatgtggtggaccg

SEQ ID NO: 142511 - DNA, 37 bp, Artificial Sequence
  Description of Artificial Sequence: Synthetic oligonucleotide
ttaacagtccaggttttgtagaatatgtggtggaccg

SEQ ID NO: 142512 - DNA, 36 bp, Artificial Sequence
  Description of Artificial Sequence: Synthetic oligonucleotide
taacagtccaggttttgtagaatatgtggtggaccg

SEQ ID NO: 142513 - DNA, 35 bp, Artificial Sequence
  Description of Artificial Sequence: Synthetic oligonucleotide
aacagtccaggttttgtagaatatgtggtggaccg

SEQ ID NO: 142514 - DNA, 34 bp, Artificial Sequence
  Description of Artificial Sequence: Synthetic oligonucleotide
acagtccaggttttgtagaatatgtggtggaccg

SEQ ID NO: 142515 - DNA, 33 bp, Artificial Sequence
  Description of Artificial Sequence: Synthetic oligonucleotide
cagtccaggttttgtagaatatgtggtggaccg

SEQ ID NO: 142516 - DNA, 33 bp, Artificial Sequence
  Description of Artificial Sequence: Synthetic oligonucleotide
agtccaggttttgtagaatatgtggtggaccgg

SEQ ID NO: 142517 - DNA, 32 bp, Artificial Sequence
  Description of Artificial Sequence: Synthetic oligonucleotide
gtccaggttttgtagaatatgtggtggaccgg

SEQ ID NO: 142518 - DNA, 33 bp, Artificial Sequence
  Description of Artificial Sequence: Synthetic oligonucleotide
tccaggttttgtagaatatgtggtggaccggtc

SEQ ID NO: 142519 - DNA, 32 bp, Artificial Sequence
  Description of Artificial Sequence: Synthetic oligonucleotide
ccaggttttgtagaatatgtggtggaccggtc

SEQ ID NO: 142520 - DNA, 33 bp, Artificial Sequence
  Description of Artificial Sequence: Synthetic oligonucleotide
caggttttgtagaatatgtggtggaccggtctg

SEQ ID NO: 142521 - DNA, 34 bp, Artificial Sequence
  Description of Artificial Sequence: Synthetic oligonucleotide
aggttttgtagaatatgtggtggaccggtctgtg

SEQ ID NO: 142522 - DNA, 33 bp, Artificial Sequence
  Description of Artificial Sequence: Synthetic oligonucleotide
ggttttgtagaatatgtggtggaccggtctgtg

SEQ ID NO: 142523 - DNA, 33 bp, Artificial Sequence
  Description of Artificial Sequence: Synthetic oligonucleotide
gttttgtagaatatgtggtggaccggtctgtgg

SEQ ID NO: 142524 - DNA, 34 bp, Artificial Sequence
  Description of Artificial Sequence: Synthetic oligonucleotide
ttttgtagaatatgtggtggaccggtctgtggag

SEQ ID NO: 142525 - DNA, 33 bp, Artificial Sequence
  Description of Artificial Sequence: Synthetic oligonucleotide
tttgtagaatatgtggtggaccggtctgtggag

SEQ ID NO: 142526 - DNA, 32 bp, Artificial Sequence
  Description of Artificial Sequence: Synthetic oligonucleotide
ttgtagaatatgtggtggaccggtctgtggag

SEQ ID NO: 142527 - DNA, 31 bp, Artificial Sequence
  Description of Artificial Sequence: Synthetic oligonucleotide
tgtagaatatgtggtggaccggtctgtggag

SEQ ID NO: 142528 - DNA, 30 bp, Artificial Sequence
  Description of Artificial Sequence: Synthetic oligonucleotide
gtagaatatgtggtggaccggtctgtggag

SEQ ID NO: 142529 - DNA, 30 bp, Artificial Sequence
  Description of Artificial Sequence: Synthetic oligonucleotide
tagaatatgtggtggaccggtctgtggagc

SEQ ID NO: 142530 - DNA, 29 bp, Artificial Sequence
  Description of Artificial Sequence: Synthetic oligonucleotide
agaatatgtggtggaccggtctgtggagc

SEQ ID NO: 142531 - DNA, 28 bp, Artificial Sequence
  Description of Artificial Sequence: Synthetic oligonucleotide
gaatatgtggtggaccggtctgtggagc

SEQ ID NO: 142532 - DNA, 30 bp, Artificial Sequence
  Description of Artificial Sequence: Synthetic oligonucleotide
aatatgtggtggaccggtctgtggagcatg

SEQ ID NO: 142533 - DNA, 29 bp, Artificial Sequence
  Description of Artificial Sequence: Synthetic oligonucleotide
atatgtggtggaccggtctgtggagcatg

SEQ ID NO: 142534 - DNA, 28 bp, Artificial Sequence
  Description of Artificial Sequence: Synthetic oligonucleotide
tatgtggtggaccggtctgtggagcatg

SEQ ID NO: 142535 - DNA, 27 bp, Artificial Sequence
  Description of Artificial Sequence: Synthetic oligonucleotide
atgtggtggaccggtctgtggagcatg

SEQ ID NO: 142536 - DNA, 27 bp, Artificial Sequence
  Description of Artificial Sequence: Synthetic oligonucleotide
tgtggtggaccggtctgtggagcatga

SEQ ID NO: 142537 - DNA, 26 bp, Artificial Sequence
  Description of Artificial Sequence: Synthetic oligonucleotide
gtggtggaccggtctgtggagcatga

SEQ ID NO: 142538 - DNA, 27 bp, Artificial Sequence
  Description of Artificial Sequence: Synthetic oligonucleotide
tggtggaccggtctgtggagcatgaca

SEQ ID NO: 142539 - DNA, 27 bp, Artificial Sequence
  Description of Artificial Sequence: Synthetic oligonucleotide
ggtggaccggtctgtggagcatgacaa

SEQ ID NO: 142540 - DNA, 28 bp, Artificial Sequence
  Description of Artificial Sequence: Synthetic oligonucleotide
gtggaccggtctgtggagcatgacaaag

SEQ ID NO: 142541 - DNA, 28 bp, Artificial Sequence
  Description of Artificial Sequence: Synthetic oligonucleotide
tggaccggtctgtggagcatgacaaagc

SEQ ID NO: 142542 - DNA, 27 bp, Artificial Sequence
  Description of Artificial Sequence: Synthetic oligonucleotide
ggaccggtctgtggagcatgacaaagc

SEQ ID NO: 142543 - DNA, 29 bp, Artificial Sequence
  Description of Artificial Sequence: Synthetic oligonucleotide
gaccggtctgtggagcatgacaaagcttc

SEQ ID NO: 142544 - DNA, 32 bp, Artificial Sequence
  Description of Artificial Sequence: Synthetic oligonucleotide
accggtctgtggagcatgacaaagcttcaaag

SEQ ID NO: 142545 - DNA, 31 bp, Artificial Sequence
  Description of Artificial Sequence: Synthetic oligonucleotide
ccggtctgtggagcatgacaaagcttcaaag

SEQ ID NO: 142546 - DNA, 31 bp, Artificial Sequence
  Description of Artificial Sequence: Synthetic oligonucleotide
cggtctgtggagcatgacaaagcttcaaagg

SEQ ID NO: 142547 - DNA, 33 bp, Artificial Sequence
  Description of Artificial Sequence: Synthetic oligonucleotide
ggtctgtggagcatgacaaagcttcaaaggatg

SEQ ID NO: 142548 - DNA, 33 bp, Artificial Sequence
  Description of Artificial Sequence: Synthetic oligonucleotide
gtctgtggagcatgacaaagcttcaaaggatgc

SEQ ID NO: 142549 - DNA, 33 bp, Artificial Sequence
  Description of Artificial Sequence: Synthetic oligonucleotide
tctgtggagcatgacaaagcttcaaaggatgcc

SEQ ID NO: 142550 - DNA, 32 bp, Artificial Sequence
  Description of Artificial Sequence: Synthetic oligonucleotide
ctgtggagcatgacaaagcttcaaaggatgcc

SEQ ID NO: 142551 - DNA, 38 bp, Artificial Sequence
  Description of Artificial Sequence: Synthetic oligonucleotide
tgtggagcatgacaaagcttcaaaggatgccaaatatg

SEQ ID NO: 142552 - DNA, 37 bp, Artificial Sequence
  Description of Artificial Sequence: Synthetic oligonucleotide
gtggagcatgacaaagcttcaaaggatgccaaatatg

SEQ ID NO: 142553 - DNA, 39 bp, Artificial Sequence
  Description of Artificial Sequence: Synthetic oligonucleotide
tggagcatgacaaagcttcaaaggatgccaaatatgaac

SEQ ID NO: 142554 - DNA, 38 bp, Artificial Sequence
  Description of Artificial Sequence: Synthetic oligonucleotide
ggagcatgacaaagcttcaaaggatgccaaatatgaac

SEQ ID NO: 142555 - DNA, 40 bp, Artificial Sequence
  Description of Artificial Sequence: Synthetic oligonucleotide
gagcatgacaaagcttcaaaggatgccaaatatgaactag

SEQ ID NO: 142556 - DNA, 41 bp, Artificial Sequence
  Description of Artificial Sequence: Synthetic oligonucleotide
agcatgacaaagcttcaaaggatgccaaatatgaactagtg

SEQ ID NO: 142557 - DNA, 40 bp, Artificial Sequence
  Description of Artificial Sequence: Synthetic oligonucleotide
gcatgacaaagcttcaaaggatgccaaatatgaactagtg

SEQ ID NO: 142558 - DNA, 43 bp, Artificial Sequence
  Description of Artificial Sequence: Synthetic oligonucleotide
catgacaaagcttcaaaggatgccaaatatgaactagtgaaag

SEQ ID NO: 142559 - DNA, 43 bp, Artificial Sequence
  Description of Artificial Sequence: Synthetic oligonucleotide
atgacaaagcttcaaaggatgccaaatatgaactagtgaaagc

SEQ ID NO: 142560 - DNA, 42 bp, Artificial Sequence
  Description of Artificial Sequence: Synthetic oligonucleotide
tgacaaagcttcaaaggatgccaaatatgaactagtgaaagc

SEQ ID NO: 142561 - DNA, 41 bp, Artificial Sequence
  Description of Artificial Sequence: Synthetic oligonucleotide
gacaaagcttcaaaggatgccaaatatgaactagtgaaagc

SEQ ID NO: 142562 - DNA, 42 bp, Artificial Sequence
  Description of Artificial Sequence: Synthetic oligonucleotide
acaaagcttcaaaggatgccaaatatgaactagtgaaagcac

SEQ ID NO: 142563 - DNA, 41 bp, Artificial Sequence
  Description of Artificial Sequence: Synthetic oligonucleotide
caaagcttcaaaggatgccaaatatgaactagtgaaagcac

SEQ ID NO: 142564 - DNA, 43 bp, Artificial Sequence
  Description of Artificial Sequence: Synthetic oligonucleotide
aaagcttcaaaggatgccaaatatgaactagtgaaagcacttg

SEQ ID NO: 142565 - DNA, 42 bp, Artificial Sequence
  Description of Artificial Sequence: Synthetic oligonucleotide
aagcttcaaaggatgccaaatatgaactagtgaaagcacttg

SEQ ID NO: 142566 - DNA, 41 bp, Artificial Sequence
  Description of Artificial Sequence: Synthetic oligonucleotide
agcttcaaaggatgccaaatatgaactagtgaaagcacttg

SEQ ID NO: 142567 - DNA, 40 bp, Artificial Sequence
  Description of Artificial Sequence: Synthetic oligonucleotide
gcttcaaaggatgccaaatatgaactagtgaaagcacttg

SEQ ID NO: 142568 - DNA, 40 bp, Artificial Sequence
  Description of Artificial Sequence: Synthetic oligonucleotide
cttcaaaggatgccaaatatgaactagtgaaagcacttgc

SEQ ID NO: 142569 - DNA, 40 bp, Artificial Sequence
  Description of Artificial Sequence: Synthetic oligonucleotide
ttcaaaggatgccaaatatgaactagtgaaagcacttgcc

SEQ ID NO: 142570 - DNA, 39 bp, Artificial Sequence
  Description of Artificial Sequence: Synthetic oligonucleotide
tcaaaggatgccaaatatgaactagtgaaagcacttgcc

SEQ ID NO: 142571 - DNA, 38 bp, Artificial Sequence
  Description of Artificial Sequence: Synthetic oligonucleotide
caaaggatgccaaatatgaactagtgaaagcacttgcc

SEQ ID NO: 142572 - DNA, 42 bp, Artificial Sequence
  Description of Artificial Sequence: Synthetic oligonucleotide
aaaggatgccaaatatgaactagtgaaagcacttgccaattc

SEQ ID NO: 142573 - DNA, 41 bp, Artificial Sequence
  Description of Artificial Sequence: Synthetic oligonucleotide
aaggatgccaaatatgaactagtgaaagcacttgccaattc

SEQ ID NO: 142574 - DNA, 40 bp, Artificial Sequence
  Description of Artificial Sequence: Synthetic oligonucleotide
aggatgccaaatatgaactagtgaaagcacttgccaattc

SEQ ID NO: 142575 - DNA, 39 bp, Artificial Sequence
  Description of Artificial Sequence: Synthetic oligonucleotide
ggatgccaaatatgaactagtgaaagcacttgccaattc

SEQ ID NO: 142576 - DNA, 39 bp, Artificial Sequence
  Description of Artificial Sequence: Synthetic oligonucleotide
gatgccaaatatgaactagtgaaagcacttgccaattcc

SEQ ID NO: 142577 - DNA, 41 bp, Artificial Sequence
  Description of Artificial Sequence: Synthetic oligonucleotide
atgccaaatatgaactagtgaaagcacttgccaattccaag

SEQ ID NO: 142578 - DNA, 40 bp, Artificial Sequence
  Description of Artificial Sequence: Synthetic oligonucleotide
tgccaaatatgaactagtgaaagcacttgccaattccaag

SEQ ID NO: 142579 - DNA, 39 bp, Artificial Sequence
  Description of Artificial Sequence: Synthetic oligonucleotide
gccaaatatgaactagtgaaagcacttgccaattccaag

SEQ ID NO: 142580 - DNA, 40 bp, Artificial Sequence
  Description of Artificial Sequence: Synthetic oligonucleotide
ccaaatatgaactagtgaaagcacttgccaattccaagac

SEQ ID NO: 142581 - DNA, 44 bp, Artificial Sequence
  Description of Artificial Sequence: Synthetic oligonucleotide
caaatatgaactagtgaaagcacttgccaattccaagacaattg

SEQ ID NO: 142582 - DNA, 44 bp, Artificial Sequence
  Description of Artificial Sequence: Synthetic oligonucleotide
aaatatgaactagtgaaagcacttgccaattccaagacaattgc

SEQ ID NO: 142583 - DNA, 43 bp, Artificial Sequence
  Description of Artificial Sequence: Synthetic oligonucleotide
aatatgaactagtgaaagcacttgccaattccaagacaattgc

SEQ ID NO: 142584 - DNA, 42 bp, Artificial Sequence
  Description of Artificial Sequence: Synthetic oligonucleotide
atatgaactagtgaaagcacttgccaattccaagacaattgc

SEQ ID NO: 142585 - DNA, 41 bp, Artificial Sequence
  Description of Artificial Sequence: Synthetic oligonucleotide
tatgaactagtgaaagcacttgccaattccaagacaattgc

SEQ ID NO: 142586 - DNA, 40 bp, Artificial Sequence
  Description of Artificial Sequence: Synthetic oligonucleotide
atgaactagtgaaagcacttgccaattccaagacaattgc

SEQ ID NO: 142587 - DNA, 39 bp, Artificial Sequence
  Description of Artificial Sequence: Synthetic oligonucleotide
tgaactagtgaaagcacttgccaattccaagacaattgc

SEQ ID NO: 142588 - DNA, 38 bp, Artificial Sequence
  Description of Artificial Sequence: Synthetic oligonucleotide
gaactagtgaaagcacttgccaattccaagacaattgc

SEQ ID NO: 142589 - DNA, 39 bp, Artificial Sequence
  Description of Artificial Sequence: Synthetic oligonucleotide
aactagtgaaagcacttgccaattccaagacaattgcag

SEQ ID NO: 142590 - DNA, 38 bp, Artificial Sequence
  Description of Artificial Sequence: Synthetic oligonucleotide
actagtgaaagcacttgccaattccaagacaattgcag

SEQ ID NO: 142591 - DNA, 37 bp, Artificial Sequence
  Description of Artificial Sequence: Synthetic oligonucleotide
ctagtgaaagcacttgccaattccaagacaattgcag

SEQ ID NO: 142592 - DNA, 41 bp, Artificial Sequence
  Description of Artificial Sequence: Synthetic oligonucleotide
tagtgaaagcacttgccaattccaagacaattgcagaaatc

SEQ ID NO: 142593 - DNA, 40 bp, Artificial Sequence
  Description of Artificial Sequence: Synthetic oligonucleotide
agtgaaagcacttgccaattccaagacaattgcagaaatc

SEQ ID NO: 142594 - DNA, 39 bp, Artificial Sequence
  Description of Artificial Sequence: Synthetic oligonucleotide
gtgaaagcacttgccaattccaagacaattgcagaaatc

SEQ ID NO: 142595 - DNA, 42 bp, Artificial Sequence
  Description of Artificial Sequence: Synthetic oligonucleotide
tgaaagcacttgccaattccaagacaattgcagaaatctttg

SEQ ID NO: 142596 - DNA, 41 bp, Artificial Sequence
  Description of Artificial Sequence: Synthetic oligonucleotide
gaaagcacttgccaattccaagacaattgcagaaatctttg

SEQ ID NO: 142597 - DNA, 41 bp, Artificial Sequence
  Description of Artificial Sequence: Synthetic oligonucleotide
aaagcacttgccaattccaagacaattgcagaaatctttgg

SEQ ID NO: 142598 - DNA, 40 bp, Artificial Sequence
  Description of Artificial Sequence: Synthetic oligonucleotide
aagcacttgccaattccaagacaattgcagaaatctttgg

SEQ ID NO: 142599 - DNA, 39 bp, Artificial Sequence
  Description of Artificial Sequence: Synthetic oligonucleotide
agcacttgccaattccaagacaattgcagaaatctttgg

SEQ ID NO: 142600 - DNA, 38 bp, Artificial Sequence
  Description of Artificial Sequence: Synthetic oligonucleotide
gcacttgccaattccaagacaattgcagaaatctttgg

SEQ ID NO: 142601 - DNA, 38 bp, Artificial Sequence
  Description of Artificial Sequence: Synthetic oligonucleotide
cacttgccaattccaagacaattgcagaaatctttggg

SEQ ID NO: 142602 - DNA, 40 bp, Artificial Sequence
  Description of Artificial Sequence: Synthetic oligonucleotide
acttgccaattccaagacaattgcagaaatctttgggaac

SEQ ID NO: 142603 - DNA, 39 bp, Artificial Sequence
  Description of Artificial Sequence: Synthetic oligonucleotide
cttgccaattccaagacaattgcagaaatctttgggaac

SEQ ID NO: 142604 - DNA, 39 bp, Artificial Sequence
  Description of Artificial Sequence: Synthetic oligonucleotide
ttgccaattccaagacaattgcagaaatctttgggaacc

SEQ ID NO: 142605 - DNA, 38 bp, Artificial Sequence
  Description of Artificial Sequence: Synthetic oligonucleotide
tgccaattccaagacaattgcagaaatctttgggaacc

SEQ ID NO: 142606 - DNA, 37 bp, Artificial Sequence
  Description of Artificial Sequence: Synthetic oligonucleotide
gccaattccaagacaattgcagaaatctttgggaacc

SEQ ID NO: 142607 - DNA, 37 bp, Artificial Sequence
  Description of Artificial Sequence: Synthetic oligonucleotide
ccaattccaagacaattgcagaaatctttgggaaccc

SEQ ID NO: 142608 - DNA, 46 bp, Artificial Sequence
  Description of Artificial Sequence: Synthetic oligonucleotide
caattccaagacaattgcagaaatctttgggaacccaaattatttg

SEQ ID NO: 142609 - DNA, 47 bp, Artificial Sequence
  Description of Artificial Sequence: Synthetic oligonucleotide
aattccaagacaattgcagaaatctttgggaacccaaattatttgag

SEQ ID NO: 142610 - DNA, 46 bp, Artificial Sequence
  Description of Artificial Sequence: Synthetic oligonucleotide
attccaagacaattgcagaaatctttgggaacccaaattatttgag

SEQ ID NO: 142611 - DNA, 45 bp, Artificial Sequence
  Description of Artificial Sequence: Synthetic oligonucleotide
ttccaagacaattgcagaaatctttgggaacccaaattatttgag

SEQ ID NO: 142612 - DNA, 44 bp, Artificial Sequence
  Description of Artificial Sequence: Synthetic oligonucleotide
tccaagacaattgcagaaatctttgggaacccaaattatttgag

SEQ ID NO: 142613 - DNA, 43 bp, Artificial Sequence
  Description of Artificial Sequence: Synthetic oligonucleotide
ccaagacaattgcagaaatctttgggaacccaaattatttgag

SEQ ID NO: 142614 - DNA, 43 bp, Artificial Sequence
  Description of Artificial Sequence: Synthetic oligonucleotide
caagacaattgcagaaatctttgggaacccaaattatttgagg

SEQ ID NO: 142615 - DNA, 43 bp, Artificial Sequence
  Description of Artificial Sequence: Synthetic oligonucleotide
aagacaattgcagaaatctttgggaacccaaattatttgaggc

SEQ ID NO: 142616 - DNA, 42 bp, Artificial Sequence
  Description of Artificial Sequence: Synthetic oligonucleotide
agacaattgcagaaatctttgggaacccaaattatttgaggc

SEQ ID NO: 142617 - DNA, 41 bp, Artificial Sequence
  Description of Artificial Sequence: Synthetic oligonucleotide
gacaattgcagaaatctttgggaacccaaattatttgaggc

SEQ ID NO: 142618 - DNA, 42 bp, Artificial Sequence
  Description of Artificial Sequence: Synthetic oligonucleotide
acaattgcagaaatctttgggaacccaaattatttgaggctc

SEQ ID NO: 142619 - DNA, 41 bp, Artificial Sequence
  Description of Artificial Sequence: Synthetic oligonucleotide
caattgcagaaatctttgggaacccaaattatttgaggctc

SEQ ID NO: 142620 - DNA, 42 bp, Artificial Sequence
  Description of Artificial Sequence: Synthetic oligonucleotide
aattgcagaaatctttgggaacccaaattatttgaggctcag

SEQ ID NO: 142621 - DNA, 41 bp, Artificial Sequence
  Description of Artificial Sequence: Synthetic oligonucleotide
attgcagaaatctttgggaacccaaattatttgaggctcag

SEQ ID NO: 142622 - DNA, 40 bp, Artificial Sequence
  Description of Artificial Sequence: Synthetic oligonucleotide
ttgcagaaatctttgggaacccaaattatttgaggctcag

SEQ ID NO: 142623 - DNA, 39 bp, Artificial Sequence
  Description of Artificial Sequence: Synthetic oligonucleotide
tgcagaaatctttgggaacccaaattatttgaggctcag

SEQ ID NO: 142624 - DNA, 38 bp, Artificial Sequence
  Description of Artificial Sequence: Synthetic oligonucleotide
gcagaaatctttgggaacccaaattatttgaggctcag

SEQ ID NO: 142625 - DNA, 40 bp, Artificial Sequence
  Description of Artificial Sequence: Synthetic oligonucleotide
cagaaatctttgggaacccaaattatttgaggctcagaac

SEQ ID NO: 142626 - DNA, 43 bp, Artificial Sequence
  Description of Artificial Sequence: Synthetic oligonucleotide
agaaatctttgggaacccaaattatttgaggctcagaacttac

SEQ ID NO: 142627 - DNA, 42 bp, Artificial Sequence
  Description of Artificial Sequence: Synthetic oligonucleotide
gaaatctttgggaacccaaattatttgaggctcagaacttac

SEQ ID NO: 142628 - DNA, 42 bp, Artificial Sequence
  Description of Artificial Sequence: Synthetic oligonucleotide
aaatctttgggaacccaaattatttgaggctcagaacttacc

SEQ ID NO: 142629 - DNA, 41 bp, Artificial Sequence
  Description of Artificial Sequence: Synthetic oligonucleotide
aatctttgggaacccaaattatttgaggctcagaacttacc

SEQ ID NO: 142630 - DNA, 40 bp, Artificial Sequence
  Description of Artificial Sequence: Synthetic oligonucleotide
atctttgggaacccaaattatttgaggctcagaacttacc

SEQ ID NO: 142631 - DNA, 39 bp, Artificial Sequence
  Description of Artificial Sequence: Synthetic oligonucleotide
tctttgggaacccaaattatttgaggctcagaacttacc

SEQ ID NO: 142632 - DNA, 38 bp, Artificial Sequence
  Description of Artificial Sequence: Synthetic oligonucleotide
ctttgggaacccaaattatttgaggctcagaacttacc

SEQ ID NO: 142633 - DNA, 39 bp, Artificial Sequence
  Description of Artificial Sequence: Synthetic oligonucleotide
tttgggaacccaaattatttgaggctcagaacttacctg

SEQ ID NO: 142634 - DNA, 38 bp, Artificial Sequence
  Description of Artificial Sequence: Synthetic oligonucleotide
ttgggaacccaaattatttgaggctcagaacttacctg

SEQ ID NO: 142635 - DNA, 37 bp, Artificial Sequence
  Description of Artificial Sequence: Synthetic oligonucleotide
tgggaacccaaattatttgaggctcagaacttacctg

SEQ ID NO: 142636 - DNA, 36 bp, Artificial Sequence
  Description of Artificial Sequence: Synthetic oligonucleotide
gggaacccaaattatttgaggctcagaacttacctg

SEQ ID NO: 142637 - DNA, 37 bp, Artificial Sequence
  Description of Artificial Sequence: Synthetic oligonucleotide
ggaacccaaattatttgaggctcagaacttacctgag

SEQ ID NO: 142638 - DNA, 38 bp, Artificial Sequence
  Description of Artificial Sequence: Synthetic oligonucleotide
gaacccaaattatttgaggctcagaacttacctgagtg

SEQ ID NO: 142639 - DNA, 40 bp, Artificial Sequence
  Description of Artificial Sequence: Synthetic oligonucleotide
aacccaaattatttgaggctcagaacttacctgagtgaag

SEQ ID NO: 142640 - DNA, 39 bp, Artificial Sequence
  Description of Artificial Sequence: Synthetic oligonucleotide
acccaaattatttgaggctcagaacttacctgagtgaag

SEQ ID NO: 142641 - DNA, 38 bp, Artificial Sequence
  Description of Artificial Sequence: Synthetic oligonucleotide
cccaaattatttgaggctcagaacttacctgagtgaag

SEQ ID NO: 142642 - DNA, 38 bp, Artificial Sequence
  Description of Artificial Sequence: Synthetic oligonucleotide
ccaaattatttgaggctcagaacttacctgagtgaagg

SEQ ID NO: 142643 - DNA, 38 bp, Artificial Sequence
  Description of Artificial Sequence: Synthetic oligonucleotide
caaattatttgaggctcagaacttacctgagtgaaggg

SEQ ID NO: 142644 - DNA, 38 bp, Artificial Sequence
  Description of Artificial Sequence: Synthetic oligonucleotide
aaattatttgaggctcagaacttacctgagtgaagggc

SEQ ID NO: 142645 - DNA, 37 bp, Artificial Sequence
  Description of Artificial Sequence: Synthetic oligonucleotide
aattatttgaggctcagaacttacctgagtgaagggc

SEQ ID NO: 142646 - DNA, 36 bp, Artificial Sequence
  Description of Artificial Sequence: Synthetic oligonucleotide
attatttgaggctcagaacttacctgagtgaagggc

SEQ ID NO: 142647 - DNA, 35 bp, Artificial Sequence
  Description of Artificial Sequence: Synthetic oligonucleotide
ttatttgaggctcagaacttacctgagtgaagggc

SEQ ID NO: 142648 - DNA, 34 bp, Artificial Sequence
  Description of Artificial Sequence: Synthetic oligonucleotide
tatttgaggctcagaacttacctgagtgaagggc

SEQ ID NO: 142649 - DNA, 33 bp, Artificial Sequence
  Description of Artificial Sequence: Synthetic oligonucleotide
atttgaggctcagaacttacctgagtgaagggc

SEQ ID NO: 142650 - DNA, 32 bp, Artificial Sequence
  Description of Artificial Sequence: Synthetic oligonucleotide
tttgaggctcagaacttacctgagtgaagggc

SEQ ID NO: 142651 - DNA, 31 bp, Artificial Sequence
  Description of Artificial Sequence: Synthetic oligonucleotide
ttgaggctcagaacttacctgagtgaagggc

SEQ ID NO: 142652 - DNA, 30 bp, Artificial Sequence
  Description of Artificial Sequence: Synthetic oligonucleotide
tgaggctcagaacttacctgagtgaagggc

SEQ ID NO: 142653 - DNA, 29 bp, Artificial Sequence
  Description of Artificial Sequence: Synthetic oligonucleotide
gaggctcagaacttacctgagtgaagggc

SEQ ID NO: 142654 - DNA, 29 bp, Artificial Sequence
  Description of Artificial Sequence: Synthetic oligonucleotide
aggctcagaacttacctgagtgaagggcc

SEQ ID NO: 142655 - DNA, 28 bp, Artificial Sequence
  Description of Artificial Sequence: Synthetic oligonucleotide
ggctcagaacttacctgagtgaagggcc

SEQ ID NO: 142656 - DNA, 31 bp, Artificial Sequence
  Description of Artificial Sequence: Synthetic oligonucleotide
gctcagaacttacctgagtgaagggccatac

SEQ ID NO: 142657 - DNA, 34 bp, Artificial Sequence
  Description of Artificial Sequence: Synthetic oligonucleotide
ctcagaacttacctgagtgaagggccatactatg

SEQ ID NO: 142658 - DNA, 35 bp, Artificial Sequence
  Description of Artificial Sequence: Synthetic oligonucleotide
tcagaacttacctgagtgaagggccatactatgtg

SEQ ID NO: 142659 - DNA, 34 bp, Artificial Sequence
  Description of Artificial Sequence: Synthetic oligonucleotide
cagaacttacctgagtgaagggccatactatgtg

SEQ ID NO: 142660 - DNA, 37 bp, Artificial Sequence
  Description of Artificial Sequence: Synthetic oligonucleotide
agaacttacctgagtgaagggccatactatgtgaaac

SEQ ID NO: 142661 - DNA, 36 bp, Artificial Sequence
  Description of Artificial Sequence: Synthetic oligonucleotide
gaacttacctgagtgaagggccatactatgtgaaac

SEQ ID NO: 142662 - DNA, 36 bp, Artificial Sequence
  Description of Artificial Sequence: Synthetic oligonucleotide
aacttacctgagtgaagggccatactatgtgaaacc

SEQ ID NO: 142663 - DNA, 35 bp, Artificial Sequence
  Description of Artificial Sequence: Synthetic oligonucleotide
acttacctgagtgaagggccatactatgtgaaacc

SEQ ID NO: 142664 - DNA, 34 bp, Artificial Sequence
  Description of Artificial Sequence: Synthetic oligonucleotide
cttacctgagtgaagggccatactatgtgaaacc

SEQ ID NO: 142665 - DNA, 35 bp, Artificial Sequence
  Description of Artificial Sequence: Synthetic oligonucleotide
ttacctgagtgaagggccatactatgtgaaacctg

SEQ ID NO: 142666 - DNA, 34 bp, Artificial Sequence
  Description of Artificial Sequence: Synthetic oligonucleotide
tacctgagtgaagggccatactatgtgaaacctg

SEQ ID NO: 142667 - DNA, 33 bp, Artificial Sequence
  Description of Artificial Sequence: Synthetic oligonucleotide
acctgagtgaagggccatactatgtgaaacctg

SEQ ID NO: 142668 - DNA, 32 bp, Artificial Sequence
  Description of Artificial Sequence: Synthetic oligonucleotide
cctgagtgaagggccatactatgtgaaacctg

SEQ ID NO: 142669 - DNA, 35 bp, Artificial Sequence
  Description of Artificial Sequence: Synthetic oligonucleotide
ctgagtgaagggccatactatgtgaaacctgtttc

SEQ ID NO: 142670 - DNA, 35 bp, Artificial Sequence
  Description of Artificial Sequence: Synthetic oligonucleotide
tgagtgaagggccatactatgtgaaacctgtttcc

SEQ ID NO: 142671 - DNA, 34 bp, Artificial Sequence
  Description of Artificial Sequence: Synthetic oligonucleotide
gagtgaagggccatactatgtgaaacctgtttcc

SEQ ID NO: 142672 - DNA, 35 bp, Artificial Sequence
  Description of Artificial Sequence: Synthetic oligonucleotide
agtgaagggccatactatgtgaaacctgtttccac

SEQ ID NO: 142673 - DNA, 34 bp, Artificial Sequence
  Description of Artificial Sequence: Synthetic oligonucleotide
gtgaagggccatactatgtgaaacctgtttccac

SEQ ID NO: 142674 - DNA, 34 bp, Artificial Sequence
  Description of Artificial Sequence: Synthetic oligonucleotide
tgaagggccatactatgtgaaacctgtttccacg

SEQ ID NO: 142675 - DNA, 33 bp, Artificial Sequence
  Description of Artificial Sequence: Synthetic oligonucleotide
gaagggccatactatgtgaaacctgtttccacg

SEQ ID NO: 142676 - DNA, 34 bp, Artificial Sequence
  Description of Artificial Sequence: Synthetic oligonucleotide
aagggccatactatgtgaaacctgtttccacgac

SEQ ID NO: 142677 - DNA, 33 bp, Artificial Sequence
  Description of Artificial Sequence: Synthetic oligonucleotide
agggccatactatgtgaaacctgtttccacgac

SEQ ID NO: 142678 - DNA, 32 bp, Artificial Sequence
  Description of Artificial Sequence: Synthetic oligonucleotide
gggccatactatgtgaaacctgtttccacgac

SEQ ID NO: 142679 - DNA, 33 bp, Artificial Sequence
  Description of Artificial Sequence: Synthetic oligonucleotide
ggccatactatgtgaaacctgtttccacgacag

SEQ ID NO: 142680 - DNA, 33 bp, Artificial Sequence
  Description of Artificial Sequence: Synthetic oligonucleotide
gccatactatgtgaaacctgtttccacgacagc

SEQ ID NO: 142681 - DNA, 34 bp, Artificial Sequence
  Description of Artificial Sequence: Synthetic oligonucleotide
ccatactatgtgaaacctgtttccacgacagcag

SEQ ID NO: 142682 - DNA, 36 bp, Artificial Sequence
  Description of Artificial Sequence: Synthetic oligonucleotide
catactatgtgaaacctgtttccacgacagcagtag

SEQ ID NO: 142683 - DNA, 38 bp, Artificial Sequence
  Description of Artificial Sequence: Synthetic oligonucleotide
atactatgtgaaacctgtttccacgacagcagtagaag

SEQ ID NO: 142684 - DNA, 37 bp, Artificial Sequence
  Description of Artificial Sequence: Synthetic oligonucleotide
tactatgtgaaacctgtttccacgacagcagtagaag

SEQ ID NO: 142685 - DNA, 36 bp, Artificial Sequence
  Description of Artificial Sequence: Synthetic oligonucleotide
actatgtgaaacctgtttccacgacagcagtagaag

SEQ ID NO: 142686 - DNA, 35 bp, Artificial Sequence
  Description of Artificial Sequence: Synthetic oligonucleotide
ctatgtgaaacctgtttccacgacagcagtagaag

SEQ ID NO: 142687 - DNA, 35 bp, Artificial Sequence
  Description of Artificial Sequence: Synthetic oligonucleotide
tatgtgaaacctgtttccacgacagcagtagaagg

SEQ ID NO: 142688 - DNA, 34 bp, Artificial Sequence
  Description of Artificial Sequence: Synthetic oligonucleotide
atgtgaaacctgtttccacgacagcagtagaagg

SEQ ID NO: 142689 - DNA, 33 bp, Artificial Sequence
  Description of Artificial Sequence: Synthetic oligonucleotide
tgtgaaacctgtttccacgacagcagtagaagg

SEQ ID NO: 142690 - DNA, 32 bp, Artificial Sequence
  Description of Artificial Sequence: Synthetic oligonucleotide
gtgaaacctgtttccacgacagcagtagaagg

SEQ ID NO: 142691 - DNA, 33 bp, Artificial Sequence
  Description of Artificial Sequence: Synthetic oligonucleotide
tgaaacctgtttccacgacagcagtagaaggag

SEQ ID NO: 142692 - DNA, 32 bp, Artificial Sequence
  Description of Artificial Sequence: Synthetic oligonucleotide
gaaacctgtttccacgacagcagtagaaggag

SEQ ID NO: 142693 - DNA, 32 bp, Artificial Sequence
  Description of Artificial Sequence: Synthetic oligonucleotide
aaacctgtttccacgacagcagtagaaggagc

SEQ ID NO: 142694 - DNA, 31 bp, Artificial Sequence
  Description of Artificial Sequence: Synthetic oligonucleotide
aacctgtttccacgacagcagtagaaggagc

SEQ ID NO: 142695 - DNA, 30 bp, Artificial Sequence
  Description of Artificial Sequence: Synthetic oligonucleotide
acctgtttccacgacagcagtagaaggagc

SEQ ID NO: 142696 - DNA, 29 bp, Artificial Sequence
  Description of Artificial Sequence: Synthetic oligonucleotide
cctgtttccacgacagcagtagaaggagc

SEQ ID NO: 142697 - DNA, 29 bp, Artificial Sequence
  Description of Artificial Sequence: Synthetic oligonucleotide
ctgtttccacgacagcagtagaaggagcc

SEQ ID NO: 142698 - DNA, 29 bp, Artificial Sequence
  Description of Artificial Sequence: Synthetic oligonucleotide
tgtttccacgacagcagtagaaggagccg

SEQ ID NO: 142699 - DNA, 28 bp, Artificial Sequence
  Description of Artificial Sequence: Synthetic oligonucleotide
gtttccacgacagcagtagaaggagccg

SEQ ID NO: 142700 - DNA, 31 bp, Artificial Sequence
  Description of Artificial Sequence: Synthetic oligonucleotide
tttccacgacagcagtagaaggagccgaatg

SEQ ID NO: 142701 - DNA, 30 bp, Artificial Sequence
  Description of Artificial Sequence: Synthetic oligonucleotide
ttccacgacagcagtagaaggagccgaatg

SEQ ID NO: 142702 - DNA, 29 bp, Artificial Sequence
  Description of Artificial Sequence: Synthetic oligonucleotide
tccacgacagcagtagaaggagccgaatg

SEQ ID NO: 142703 - DNA, 28 bp, Artificial Sequence
  Description of Artificial Sequence: Synthetic oligonucleotide
ccacgacagcagtagaaggagccgaatg

SEQ ID NO: 142704 - DNA, 26 bp, Artificial Sequence
  Description of Artificial Sequence: Synthetic oligonucleotide
atgccgctggagaacctggaggagga

SEQ ID NO: 142705 - DNA, 25 bp, Artificial Sequence
  Description of Artificial Sequence: Synthetic oligonucleotide
tgccgctggagaacctggaggagga

SEQ ID NO: 142706 - DNA, 24 bp, Artificial Sequence
  Description of Artificial Sequence: Synthetic oligonucleotide
gccgctggagaacctggaggagga

SEQ ID NO: 142707 - DNA, 24 bp, Artificial Sequence
  Description of Artificial Sequence: Synthetic oligonucleotide
ccgctggagaacctggaggaggag

SEQ ID NO: 142708 - DNA, 24 bp, Artificial Sequence
  Description of Artificial Sequence: Synthetic oligonucleotide
cgctggagaacctggaggaggagg

SEQ ID NO: 142709 - DNA, 25 bp, Artificial Sequence
  Description of Artificial Sequence: Synthetic oligonucleotide
gctggagaacctggaggaggagggt

SEQ ID NO: 142710 - DNA, 26 bp, Artificial Sequence
  Description of Artificial Sequence: Synthetic oligonucleotide
ctggagaacctggaggaggagggtct

SEQ ID NO: 142711 - DNA, 26 bp, Artificial Sequence
  Description of Artificial Sequence: Synthetic oligonucleotide
tggagaacctggaggaggagggtctg

SEQ ID NO: 142712 - DNA, 25 bp, Artificial Sequence
  Description of Artificial Sequence: Synthetic oligonucleotide
ggagaacctggaggaggagggtctg

SEQ ID NO: 142713 - DNA, 25 bp, Artificial Sequence
  Description of Artificial Sequence: Synthetic oligonucleotide
gagaacctggaggaggagggtctgc

SEQ ID NO: 142714 - DNA, 25 bp, Artificial Sequence
  Description of Artificial Sequence: Synthetic oligonucleotide
agaacctggaggaggagggtctgcc

SEQ ID NO: 142715 - DNA, 24 bp, Artificial Sequence
  Description of Artificial Sequence: Synthetic oligonucleotide
gaacctggaggaggagggtctgcc

SEQ ID NO: 142716 - DNA, 26 bp, Artificial Sequence
  Description of Artificial Sequence: Synthetic oligonucleotide
aacctggaggaggagggtctgcccaa

SEQ ID NO: 142717 - DNA, 25 bp, Artificial Sequence
  Description of Artificial Sequence: Synthetic oligonucleotide
acctggaggaggagggtctgcccaa

SEQ ID NO: 142718 - DNA, 24 bp, Artificial Sequence
  Description of Artificial Sequence: Synthetic oligonucleotide
cctggaggaggagggtctgcccaa

SEQ ID NO: 142719 - DNA, 26 bp, Artificial Sequence
  Description of Artificial Sequence: Synthetic oligonucleotide
ctggaggaggagggtctgcccaagaa

SEQ ID NO: 142720 - DNA, 26 bp, Artificial Sequence
  Description of Artificial Sequence: Synthetic oligonucleotide
tggaggaggagggtctgcccaagaac

SEQ ID NO: 142721 - DNA, 25 bp, Artificial Sequence
  Description of Artificial Sequence: Synthetic oligonucleotide
ggaggaggagggtctgcccaagaac

SEQ ID NO: 142722 - DNA, 25 bp, Artificial Sequence
  Description of Artificial Sequence: Synthetic oligonucleotide
gaggaggagggtctgcccaagaacc

SEQ ID NO: 142723 - DNA, 25 bp, Artificial Sequence
  Description of Artificial Sequence: Synthetic oligonucleotide
aggaggagggtctgcccaagaaccc

SEQ ID NO: 142724 - DNA, 24 bp, Artificial Sequence
  Description of Artificial Sequence: Synthetic oligonucleotide
ggaggagggtctgcccaagaaccc

SEQ ID NO: 142725 - DNA, 24 bp, Artificial Sequence
  Description of Artificial Sequence: Synthetic oligonucleotide
gaggagggtctgcccaagaacccc

SEQ ID NO: 142726 - DNA, 25 bp, Artificial Sequence
  Description of Artificial Sequence: Synthetic oligonucleotide
aggagggtctgcccaagaaccccga

SEQ ID NO: 142727 - DNA, 24 bp, Artificial Sequence
  Description of Artificial Sequence: Synthetic oligonucleotide
ggagggtctgcccaagaaccccga

SEQ ID NO: 142728 - DNA, 26 bp, Artificial Sequence
  Description of Artificial Sequence: Synthetic oligonucleotide
gagggtctgcccaagaaccccgactt

SEQ ID NO: 142729 - DNA, 26 bp, Artificial Sequence
  Description of Artificial Sequence: Synthetic oligonucleotide
agggtctgcccaagaaccccgacttg

SEQ ID NO: 142730 - DNA, 25 bp, Artificial Sequence
  Description of Artificial Sequence: Synthetic oligonucleotide
gggtctgcccaagaaccccgacttg

SEQ ID NO: 142731 - DNA, 25 bp, Artificial Sequence
  Description of Artificial Sequence: Synthetic oligonucleotide
ggtctgcccaagaaccccgacttgc

SEQ ID NO: 142732 - DNA, 27 bp, Artificial Sequence
  Description of Artificial Sequence: Synthetic oligonucleotide
gtctgcccaagaaccccgacttgcgta

SEQ ID NO: 142733 - DNA, 28 bp, Artificial Sequence
  Description of Artificial Sequence: Synthetic oligonucleotide
tctgcccaagaaccccgacttgcgtatc

SEQ ID NO: 142734 - DNA, 27 bp, Artificial Sequence
  Description of Artificial Sequence: Synthetic oligonucleotide
ctgcccaagaaccccgacttgcgtatc

SEQ ID NO: 142735 - DNA, 27 bp, Artificial Sequence
  Description of Artificial Sequence: Synthetic oligonucleotide
tgcccaagaaccccgacttgcgtatcg

SEQ ID NO: 142736 - DNA, 26 bp, Artificial Sequence
  Description of Artificial Sequence: Synthetic oligonucleotide
gcccaagaaccccgacttgcgtatcg

SEQ ID NO: 142737 - DNA, 26 bp, Artificial Sequence
  Description of Artificial Sequence: Synthetic oligonucleotide
cccaagaaccccgacttgcgtatcgc

SEQ ID NO: 142738 - DNA, 26 bp, Artificial Sequence
  Description of Artificial Sequence: Synthetic oligonucleotide
ccaagaaccccgacttgcgtatcgcg

SEQ ID NO: 142739 - DNA, 27 bp, Artificial Sequence
  Description of Artificial Sequence: Synthetic oligonucleotide
caagaaccccgacttgcgtatcgcgca

SEQ ID NO: 142740 - DNA, 27 bp, Artificial Sequence
  Description of Artificial Sequence: Synthetic oligonucleotide
aagaaccccgacttgcgtatcgcgcag

SEQ ID NO: 142741 - DNA, 26 bp, Artificial Sequence
  Description of Artificial Sequence: Synthetic oligonucleotide
agaaccccgacttgcgtatcgcgcag

SEQ ID NO: 142742 - DNA, 25 bp, Artificial Sequence
  Description of Artificial Sequence: Synthetic oligonucleotide
gaaccccgacttgcgtatcgcgcag

SEQ ID NO: 142743 - DNA, 26 bp, Artificial Sequence
  Description of Artificial Sequence: Synthetic oligonucleotide
aaccccgacttgcgtatcgcgcagct

SEQ ID NO: 142744 - DNA, 25 bp, Artificial Sequence
  Description of Artificial Sequence: Synthetic oligonucleotide
accccgacttgcgtatcgcgcagct

SEQ ID NO: 142745 - DNA, 24 bp, Artificial Sequence
  Description of Artificial Sequence: Synthetic oligonucleotide
ccccgacttgcgtatcgcgcagct

SEQ ID NO: 142746 - DNA, 24 bp, Artificial Sequence
  Description of Artificial Sequence: Synthetic oligonucleotide
cccgacttgcgtatcgcgcagctg

SEQ ID NO: 142747 - DNA, 24 bp, Artificial Sequence
  Description of Artificial Sequence: Synthetic oligonucleotide
ccgacttgcgtatcgcgcagctgc

SEQ ID NO: 142748 - DNA, 24 bp, Artificial Sequence
  Description of Artificial Sequence: Synthetic oligonucleotide
cgacttgcgtatcgcgcagctgcg

SEQ ID NO: 142749 - DNA, 26 bp, Artificial Sequence
  Description of Artificial Sequence: Synthetic oligonucleotide
gacttgcgtatcgcgcagctgcgctt

SEQ ID NO: 142750 - DNA, 26 bp, Artificial Sequence
  Description of Artificial Sequence: Synthetic oligonucleotide
acttgcgtatcgcgcagctgcgcttc

SEQ ID NO: 142751 - DNA, 25 bp, Artificial Sequence
  Description of Artificial Sequence: Synthetic oligonucleotide
cttgcgtatcgcgcagctgcgcttc

SEQ ID NO: 142752 - DNA, 26 bp, Artificial Sequence
  Description of Artificial Sequence: Synthetic oligonucleotide
ttgcgtatcgcgcagctgcgcttcct

SEQ ID NO: 142753 - DNA, 25 bp, Artificial Sequence
  Description of Artificial Sequence: Synthetic oligonucleotide
tgcgtatcgcgcagctgcgcttcct

SEQ ID NO: 142754 - DNA, 24 bp, Artificial Sequence
  Description of Artificial Sequence: Synthetic oligonucleotide
gcgtatcgcgcagctgcgcttcct

SEQ ID NO: 142755 - DNA, 24 bp, Artificial Sequence
  Description of Artificial Sequence: Synthetic oligonucleotide
cgtatcgcgcagctgcgcttcctg

SEQ ID NO: 142756 - DNA, 25 bp, Artificial Sequence
  Description of Artificial Sequence: Synthetic oligonucleotide
gtatcgcgcagctgcgcttcctgct

SEQ ID NO: 142757 - DNA, 26 bp, Artificial Sequence
  Description of Artificial Sequence: Synthetic oligonucleotide
tatcgcgcagctgcgcttcctgctca

SEQ ID NO: 142758 - DNA, 25 bp, Artificial Sequence
  Description of Artificial Sequence: Synthetic oligonucleotide
atcgcgcagctgcgcttcctgctca

SEQ ID NO: 142759 - DNA, 24 bp, Artificial Sequence
  Description of Artificial Sequence: Synthetic oligonucleotide
tcgcgcagctgcgcttcctgctca

SEQ ID NO: 142760 - DNA, 23 bp, Artificial Sequence
  Description of Artificial Sequence: Synthetic oligonucleotide
cgcgcagctgcgcttcctgctca

SEQ ID NO: 142761 - DNA, 23 bp, Artificial Sequence
  Description of Artificial Sequence: Synthetic oligonucleotide
gcgcagctgcgcttcctgctcag

SEQ ID NO: 142762 - DNA, 23 bp, Artificial Sequence
  Description of Artificial Sequence: Synthetic oligonucleotide
cgcagctgcgcttcctgctcagc

SEQ ID NO: 142763 - DNA, 24 bp, Artificial Sequence
  Description of Artificial Sequence: Synthetic oligonucleotide
gcagctgcgcttcctgctcagcct

SEQ ID NO: 142764 - DNA, 24 bp, Artificial Sequence
  Description of Artificial Sequence: Synthetic oligonucleotide
cagctgcgcttcctgctcagcctg

SEQ ID NO: 142765 - DNA, 24 bp, Artificial Sequence
  Description of Artificial Sequence: Synthetic oligonucleotide
agctgcgcttcctgctcagcctgc

SEQ ID NO: 142766 - DNA, 23 bp, Artificial Sequence
  Description of Artificial Sequence: Synthetic oligonucleotide
gctgcgcttcctgctcagcctgc

SEQ ID NO: 142767 - DNA, 23 bp, Artificial Sequence
  Description of Artificial Sequence: Synthetic oligonucleotide
ctgcgcttcctgctcagcctgcc

SEQ ID NO: 142768 - DNA, 23 bp, Artificial Sequence
  Description of Artificial Sequence: Synthetic oligonucleotide
tgcgcttcctgctcagcctgccc

SEQ ID NO: 142769 - DNA, 22 bp, Artificial Sequence
  Description of Artificial Sequence: Synthetic oligonucleotide
gcgcttcctgctcagcctgccc

SEQ ID NO: 142770 - DNA, 23 bp, Artificial Sequence
  Description of Artificial Sequence: Synthetic oligonucleotide
cgcttcctgctcagcctgcccga

SEQ ID NO: 142771 - DNA, 23 bp, Artificial Sequence
  Description of Artificial Sequence: Synthetic oligonucleotide
gcttcctgctcagcctgcccgag

SEQ ID NO: 142772 - DNA, 24 bp, Artificial Sequence
  Description of Artificial Sequence: Synthetic oligonucleotide
cttcctgctcagcctgcccgagca

SEQ ID NO: 142773 - DNA, 24 bp, Artificial Sequence
  Description of Artificial Sequence: Synthetic oligonucleotide
ttcctgctcagcctgcccgagcac

SEQ ID NO: 142774 - DNA, 23 bp, Artificial Sequence
  Description of Artificial Sequence: Synthetic oligonucleotide
tcctgctcagcctgcccgagcac

SEQ ID NO: 142775 - DNA, 22 bp, Artificial Sequence
  Description of Artificial Sequence: Synthetic oligonucleotide
cctgctcagcctgcccgagcac

SEQ ID NO: 142776 - DNA, 22 bp, Artificial Sequence
  Description of Artificial Sequence: Synthetic oligonucleotide
ctgctcagcctgcccgagcacc

SEQ ID NO: 142777 - DNA, 22 bp, Artificial Sequence
  Description of Artificial Sequence: Synthetic oligonucleotide
tgctcagcctgcccgagcaccg

SEQ ID NO: 142778 - DNA, 21 bp, Artificial Sequence
  Description of Artificial Sequence: Synthetic oligonucleotide
gctcagcctgcccgagcaccg

SEQ ID NO: 142779 - DNA, 21 bp, Artificial Sequence
  Description of Artificial Sequence: Synthetic oligonucleotide
ctcagcctgcccgagcaccgc

SEQ ID NO: 142780 - DNA, 21 bp, Artificial Sequence
  Description of Artificial Sequence: Synthetic oligonucleotide
tcagcctgcccgagcaccgcg

SEQ ID NO: 142781 - DNA, 20 bp, Artificial Sequence
  Description of Artificial Sequence: Synthetic oligonucleotide
cagcctgcccgagcaccgcg

SEQ ID NO: 142782 - DNA, 21 bp, Artificial Sequence
  Description of Artificial Sequence: Synthetic oligonucleotide
agcctgcccgagcaccgcgga

SEQ ID NO: 142783 - DNA, 20 bp, Artificial Sequence
  Description of Artificial Sequence: Synthetic oligonucleotide
gcctgcccgagcaccgcgga

SEQ ID NO: 142784 - DNA, 21 bp, Artificial Sequence
  Description of Artificial Sequence: Synthetic oligonucleotide
cctgcccgagcaccgcggaga

SEQ ID NO: 142785 - DNA, 21 bp, Artificial Sequence
  Description of Artificial Sequence: Synthetic oligonucleotide
ctgcccgagcaccgcggagac

SEQ ID NO: 142786 - DNA, 21 bp, Artificial Sequence
  Description of Artificial Sequence: Synthetic oligonucleotide
tgcccgagcaccgcggagacg

SEQ ID NO: 142787 - DNA, 20 bp, Artificial Sequence
  Description of Artificial Sequence: Synthetic oligonucleotide
gcccgagcaccgcggagacg

SEQ ID NO: 142788 - DNA, 21 bp, Artificial Sequence
  Description of Artificial Sequence: Synthetic oligonucleotide
cccgagcaccgcggagacgct

SEQ ID NO: 142789 - DNA, 21 bp, Artificial Sequence
  Description of Artificial Sequence: Synthetic oligonucleotide
ccgagcaccgcggagacgctg

SEQ ID NO: 142790 - DNA, 21 bp, Artificial Sequence
  Description of Artificial Sequence: Synthetic oligonucleotide
cgagcaccgcggagacgctgc

SEQ ID NO: 142791 - DNA, 21 bp, Artificial Sequence
  Description of Artificial Sequence: Synthetic oligonucleotide
gagcaccgcggagacgctgcc

SEQ ID NO: 142792 - DNA, 22 bp, Artificial Sequence
  Description of Artificial Sequence: Synthetic oligonucleotide
agcaccgcggagacgctgccgt

SEQ ID NO: 142793 - DNA, 21 bp, Artificial Sequence
  Description of Artificial Sequence: Synthetic oligonucleotide
gcaccgcggagacgctgccgt

SEQ ID NO: 142794 - DNA, 21 bp, Artificial Sequence
  Description of Artificial Sequence: Synthetic oligonucleotide
caccgcggagacgctgccgtg

SEQ ID NO: 142795 - DNA, 21 bp, Artificial Sequence
  Description of Artificial Sequence: Synthetic oligonucleotide
accgcggagacgctgccgtgc

SEQ ID NO: 142796 - DNA, 20 bp, Artificial Sequence
  Description of Artificial Sequence: Synthetic oligonucleotide
ccgcggagacgctgccgtgc

SEQ ID NO: 142797 - DNA, 20 bp, Artificial Sequence
  Description of Artificial Sequence: Synthetic oligonucleotide
cgcggagacgctgccgtgcg

SEQ ID NO: 142798 - DNA, 20 bp, Artificial Sequence
  Description of Artificial Sequence: Synthetic oligonucleotide
gcggagacgctgccgtgcgc

SEQ ID NO: 142799 - DNA, 21 bp, Artificial Sequence
  Description of Artificial Sequence: Synthetic oligonucleotide
cggagacgctgccgtgcgcga

SEQ ID NO: 142800 - DNA, 21 bp, Artificial Sequence
  Description of Artificial Sequence: Synthetic oligonucleotide
ggagacgctgccgtgcgcgac

SEQ ID NO: 142801 - DNA, 22 bp, Artificial Sequence
  Description of Artificial Sequence: Synthetic oligonucleotide
gagacgctgccgtgcgcgacga

SEQ ID NO: 142802 - DNA, 22 bp, Artificial Sequence
  Description of Artificial Sequence: Synthetic oligonucleotide
agacgctgccgtgcgcgacgag

SEQ ID NO: 142803 - DNA, 21 bp, Artificial Sequence
  Description of Artificial Sequence: Synthetic oligonucleotide
gacgctgccgtgcgcgacgag

SEQ ID NO: 142804 - DNA, 22 bp, Artificial Sequence
  Description of Artificial Sequence: Synthetic oligonucleotide
acgctgccgtgcgcgacgagct

SEQ ID NO: 142805 - DNA, 21 bp, Artificial Sequence
  Description of Artificial Sequence: Synthetic oligonucleotide
cgctgccgtgcgcgacgagct

SEQ ID NO: 142806 - DNA, 23 bp, Artificial Sequence
  Description of Artificial Sequence: Synthetic oligonucleotide
gctgccgtgcgcgacgagctgat

SEQ ID NO: 142807 - DNA, 23 bp, Artificial Sequence
  Description of Artificial Sequence: Synthetic oligonucleotide
ctgccgtgcgcgacgagctgatg

SEQ ID NO: 142808 - DNA, 23 bp, Artificial Sequence
  Description of Artificial Sequence: Synthetic oligonucleotide
tgccgtgcgcgacgagctgatgg

SEQ ID NO: 142809 - DNA, 22 bp, Artificial Sequence
  Description of Artificial Sequence: Synthetic oligonucleotide
gccgtgcgcgacgagctgatgg

SEQ ID NO: 142810 - DNA, 22 bp, Artificial Sequence
  Description of Artificial Sequence: Synthetic oligonucleotide
ccgtgcgcgacgagctgatggc

SEQ ID NO: 142811 - DNA, 22 bp, Artificial Sequence
  Description of Artificial Sequence: Synthetic oligonucleotide
cgtgcgcgacgagctgatggcg

SEQ ID NO: 142812 - DNA, 22 bp, Artificial Sequence
  Description of Artificial Sequence: Synthetic oligonucleotide
gtgcgcgacgagctgatggcgg

SEQ ID NO: 142813 - DNA, 22 bp, Artificial Sequence
  Description of Artificial Sequence: Synthetic oligonucleotide
tgcgcgacgagctgatggcggc

SEQ ID NO: 142814 - DNA, 21 bp, Artificial Sequence
  Description of Artificial Sequence: Synthetic oligonucleotide
gcgcgacgagctgatggcggc

SEQ ID NO: 142815 - DNA, 21 bp, Artificial Sequence
  Description of Artificial Sequence: Synthetic oligonucleotide
cgcgacgagctgatggcggcc

SEQ ID NO: 142816 - DNA, 22 bp, Artificial Sequence
  Description of Artificial Sequence: Synthetic oligonucleotide
gcgacgagctgatggcggccgt

SEQ ID NO: 142817 - DNA, 22 bp, Artificial Sequence
  Description of Artificial Sequence: Synthetic oligonucleotide
cgacgagctgatggcggccgtc

SEQ ID NO: 142818 - DNA, 22 bp, Artificial Sequence
  Description of Artificial Sequence: Synthetic oligonucleotide
gacgagctgatggcggccgtcc

SEQ ID NO: 142819 - DNA, 22 bp, Artificial Sequence
  Description of Artificial Sequence: Synthetic oligonucleotide
acgagctgatggcggccgtccg

SEQ ID NO: 142820 - DNA, 21 bp, Artificial Sequence
  Description of Artificial Sequence: Synthetic oligonucleotide
cgagctgatggcggccgtccg

SEQ ID NO: 142821 - DNA, 21 bp, Artificial Sequence
  Description of Artificial Sequence: Synthetic oligonucleotide
gagctgatggcggccgtccgc

SEQ ID NO: 142822 - DNA, 25 bp, Artificial Sequence
  Description of Artificial Sequence: Synthetic oligonucleotide
agctgatggcggccgtccgcgataa

SEQ ID NO: 142823 - DNA, 24 bp, Artificial Sequence
  Description of Artificial Sequence: Synthetic oligonucleotide
gctgatggcggccgtccgcgataa

SEQ ID NO: 142824 - DNA, 26 bp, Artificial Sequence
  Description of Artificial Sequence: Synthetic oligonucleotide
ctgatggcggccgtccgcgataacaa

SEQ ID NO: 142825 - DNA, 27 bp, Artificial Sequence
  Description of Artificial Sequence: Synthetic oligonucleotide
tgatggcggccgtccgcgataacaaca

SEQ ID NO: 142826 - DNA, 27 bp, Artificial Sequence
  Description of Artificial Sequence: Synthetic oligonucleotide
gatggcggccgtccgcgataacaacat

SEQ ID NO: 142827 - DNA, 27 bp, Artificial Sequence
  Description of Artificial Sequence: Synthetic oligonucleotide
atggcggccgtccgcgataacaacatg

SEQ ID NO: 142828 - DNA, 26 bp, Artificial Sequence
  Description of Artificial Sequence: Synthetic oligonucleotide
tggcggccgtccgcgataacaacatg

SEQ ID NO: 142829 - DNA, 25 bp, Artificial Sequence
  Description of Artificial Sequence: Synthetic oligonucleotide
ggcggccgtccgcgataacaacatg

SEQ ID NO: 142830 - DNA, 25 bp, Artificial Sequence
  Description of Artificial Sequence: Synthetic oligonucleotide
gcggccgtccgcgataacaacatgg

SEQ ID NO: 142831 - DNA, 26 bp, Artificial Sequence
  Description of Artificial Sequence: Synthetic oligonucleotide
cggccgtccgcgataacaacatggct

SEQ ID NO: 142832 - DNA, 26 bp, Artificial Sequence
  Description of Artificial Sequence: Synthetic oligonucleotide
ggccgtccgcgataacaacatggctc

SEQ ID NO: 142833 - DNA, 27 bp, Artificial Sequence
  Description of Artificial Sequence: Synthetic oligonucleotide
gccgtccgcgataacaacatggctcct

SEQ ID NO: 142834 - DNA, 29 bp, Artificial Sequence
  Description of Artificial Sequence: Synthetic oligonucleotide
ccgtccgcgataacaacatggctccttac

SEQ ID NO: 142835 - DNA, 32 bp, Artificial Sequence
  Description of Artificial Sequence: Synthetic oligonucleotide
cgtccgcgataacaacatggctccttactatg

SEQ ID NO: 142836 - DNA, 34 bp, Artificial Sequence
  Description of Artificial Sequence: Synthetic oligonucleotide
gtccgcgataacaacatggctccttactatgaag

SEQ ID NO: 142837 - DNA, 34 bp, Artificial Sequence
  Description of Artificial Sequence: Synthetic oligonucleotide
tccgcgataacaacatggctccttactatgaagc

SEQ ID NO: 142838 - DNA, 33 bp, Artificial Sequence
  Description of Artificial Sequence: Synthetic oligonucleotide
ccgcgataacaacatggctccttactatgaagc

SEQ ID NO: 142839 - DNA, 33 bp, Artificial Sequence
  Description of Artificial Sequence: Synthetic oligonucleotide
cgcgataacaacatggctccttactatgaagcc

SEQ ID NO: 142840 - DNA, 35 bp, Artificial Sequence
  Description of Artificial Sequence: Synthetic oligonucleotide
gcgataacaacatggctccttactatgaagccttg

SEQ ID NO: 142841 - DNA, 36 bp, Artificial Sequence
  Description of Artificial Sequence: Synthetic oligonucleotide
cgataacaacatggctccttactatgaagccttgtg

SEQ ID NO: 142842 - DNA, 36 bp, Artificial Sequence
  Description of Artificial Sequence: Synthetic oligonucleotide
gataacaacatggctccttactatgaagccttgtgc

SEQ ID NO: 142843 - DNA, 40 bp, Artificial Sequence
  Description of Artificial Sequence: Synthetic oligonucleotide
ataacaacatggctccttactatgaagccttgtgcaaatc

SEQ ID NO: 142844 - DNA, 39 bp, Artificial Sequence
  Description of Artificial Sequence: Synthetic oligonucleotide
taacaacatggctccttactatgaagccttgtgcaaatc

SEQ ID NO: 142845 - DNA, 38 bp, Artificial Sequence
  Description of Artificial Sequence: Synthetic oligonucleotide
aacaacatggctccttactatgaagccttgtgcaaatc

SEQ ID NO: 142846 - DNA, 37 bp, Artificial Sequence
  Description of Artificial Sequence: Synthetic oligonucleotide
acaacatggctccttactatgaagccttgtgcaaatc

SEQ ID NO: 142847 - DNA, 36 bp, Artificial Sequence
  Description of Artificial Sequence: Synthetic oligonucleotide
caacatggctccttactatgaagccttgtgcaaatc

SEQ ID NO: 142848 - DNA, 36 bp, Artificial Sequence
  Description of Artificial Sequence: Synthetic oligonucleotide
aacatggctccttactatgaagccttgtgcaaatcc

SEQ ID NO: 142849 - DNA, 35 bp, Artificial Sequence
  Description of Artificial Sequence: Synthetic oligonucleotide
acatggctccttactatgaagccttgtgcaaatcc

SEQ ID NO: 142850 - DNA, 34 bp, Artificial Sequence
  Description of Artificial Sequence: Synthetic oligonucleotide
catggctccttactatgaagccttgtgcaaatcc

SEQ ID NO: 142851 - DNA, 34 bp, Artificial Sequence
  Description of Artificial Sequence: Synthetic oligonucleotide
atggctccttactatgaagccttgtgcaaatccc

SEQ ID NO: 142852 - DNA, 33 bp, Artificial Sequence
  Description of Artificial Sequence: Synthetic oligonucleotide
tggctccttactatgaagccttgtgcaaatccc

SEQ ID NO: 142853 - DNA, 32 bp, Artificial Sequence
  Description of Artificial Sequence: Synthetic oligonucleotide
ggctccttactatgaagccttgtgcaaatccc

SEQ ID NO: 142854 - DNA, 33 bp, Artificial Sequence
  Description of Artificial Sequence: Synthetic oligonucleotide
gctccttactatgaagccttgtgcaaatccctc

SEQ ID NO: 142855 - DNA, 33 bp, Artificial Sequence
  Description of Artificial Sequence: Synthetic oligonucleotide
ctccttactatgaagccttgtgcaaatccctcg

SEQ ID NO: 142856 - DNA, 34 bp, Artificial Sequence
  Description of Artificial Sequence: Synthetic oligonucleotide
tccttactatgaagccttgtgcaaatccctcgac

SEQ ID NO: 142857 - DNA, 33 bp, Artificial Sequence
  Description of Artificial Sequence: Synthetic oligonucleotide
ccttactatgaagccttgtgcaaatccctcgac

SEQ ID NO: 142858 - DNA, 34 bp, Artificial Sequence
  Description of Artificial Sequence: Synthetic oligonucleotide
cttactatgaagccttgtgcaaatccctcgactg

SEQ ID NO: 142859 - DNA, 34 bp, Artificial Sequence
  Description of Artificial Sequence: Synthetic oligonucleotide
ttactatgaagccttgtgcaaatccctcgactgg

SEQ ID NO: 142860 - DNA, 33 bp, Artificial Sequence
  Description of Artificial Sequence: Synthetic oligonucleotide
tactatgaagccttgtgcaaatccctcgactgg

SEQ ID NO: 142861 - DNA, 32 bp, Artificial Sequence
  Description of Artificial Sequence: Synthetic oligonucleotide
actatgaagccttgtgcaaatccctcgactgg

SEQ ID NO: 142862 - DNA, 31 bp, Artificial Sequence
  Description of Artificial Sequence: Synthetic oligonucleotide
ctatgaagccttgtgcaaatccctcgactgg

SEQ ID NO: 142863 - DNA, 31 bp, Artificial Sequence
  Description of Artificial Sequence: Synthetic oligonucleotide
tatgaagccttgtgcaaatccctcgactggc

SEQ ID NO: 142864 - DNA, 30 bp, Artificial Sequence
  Description of Artificial Sequence: Synthetic oligonucleotide
atgaagccttgtgcaaatccctcgactggc

SEQ ID NO: 142865 - DNA, 29 bp, Artificial Sequence
  Description of Artificial Sequence: Synthetic oligonucleotide
tgaagccttgtgcaaatccctcgactggc

SEQ ID NO: 142866 - DNA, 28 bp, Artificial Sequence
  Description of Artificial Sequence: Synthetic oligonucleotide
gaagccttgtgcaaatccctcgactggc

SEQ ID NO: 142867 - DNA, 29 bp, Artificial Sequence
  Description of Artificial Sequence: Synthetic oligonucleotide
aagccttgtgcaaatccctcgactggcag

SEQ ID NO: 142868 - DNA, 28 bp, Artificial Sequence
  Description of Artificial Sequence: Synthetic oligonucleotide
agccttgtgcaaatccctcgactggcag

SEQ ID NO: 142869 - DNA, 27 bp, Artificial Sequence
  Description of Artificial Sequence: Synthetic oligonucleotide
gccttgtgcaaatccctcgactggcag

SEQ ID NO: 142870 - DNA, 30 bp, Artificial Sequence
  Description of Artificial Sequence: Synthetic oligonucleotide
ccttgtgcaaatccctcgactggcagatag

SEQ ID NO: 142871 - DNA, 31 bp, Artificial Sequence
  Description of Artificial Sequence: Synthetic oligonucleotide
cttgtgcaaatccctcgactggcagatagac

SEQ ID NO: 142872 - DNA, 31 bp, Artificial Sequence
  Description of Artificial Sequence: Synthetic oligonucleotide
ttgtgcaaatccctcgactggcagatagacg

SEQ ID NO: 142873 - DNA, 30 bp, Artificial Sequence
  Description of Artificial Sequence: Synthetic oligonucleotide
tgtgcaaatccctcgactggcagatagacg

SEQ ID NO: 142874 - DNA, 29 bp, Artificial Sequence
  Description of Artificial Sequence: Synthetic oligonucleotide
gtgcaaatccctcgactggcagatagacg

SEQ ID NO: 142875 - DNA, 30 bp, Artificial Sequence
  Description of Artificial Sequence: Synthetic oligonucleotide
tgcaaatccctcgactggcagatagacgtg

SEQ ID NO: 142876 - DNA, 29 bp, Artificial Sequence
  Description of Artificial Sequence: Synthetic oligonucleotide
gcaaatccctcgactggcagatagacgtg

SEQ ID NO: 142877 - DNA, 29 bp, Artificial Sequence
  Description of Artificial Sequence: Synthetic oligonucleotide
caaatccctcgactggcagatagacgtgg

SEQ ID NO: 142878 - DNA, 30 bp, Artificial Sequence
  Description of Artificial Sequence: Synthetic oligonucleotide
aaatccctcgactggcagatagacgtggac

SEQ ID NO: 142879 - DNA, 29 bp, Artificial Sequence
  Description of Artificial Sequence: Synthetic oligonucleotide
aatccctcgactggcagatagacgtggac

SEQ ID NO: 142880 - DNA, 28 bp, Artificial Sequence
  Description of Artificial Sequence: Synthetic oligonucleotide
atccctcgactggcagatagacgtggac

SEQ ID NO: 142881 - DNA, 27 bp, Artificial Sequence
  Description of Artificial Sequence: Synthetic oligonucleotide
tccctcgactggcagatagacgtggac

SEQ ID NO: 142882 - DNA, 26 bp, Artificial Sequence
  Description of Artificial Sequence: Synthetic oligonucleotide
ccctcgactggcagatagacgtggac

SEQ ID NO: 142883 - DNA, 27 bp, Artificial Sequence
  Description of Artificial Sequence: Synthetic oligonucleotide
cctcgactggcagatagacgtggacct

SEQ ID NO: 142884 - DNA, 28 bp, Artificial Sequence
  Description of Artificial Sequence: Synthetic oligonucleotide
ctcgactggcagatagacgtggacctac

SEQ ID NO: 142885 - DNA, 29 bp, Artificial Sequence
  Description of Artificial Sequence: Synthetic oligonucleotide
tcgactggcagatagacgtggacctactc

SEQ ID NO: 142886 - DNA, 28 bp, Artificial Sequence
  Description of Artificial Sequence: Synthetic oligonucleotide
cgactggcagatagacgtggacctactc

SEQ ID NO: 142887 - DNA, 36 bp, Artificial Sequence
  Description of Artificial Sequence: Synthetic oligonucleotide
gactggcagatagacgtggacctactcaataaaatg

SEQ ID NO: 142888 - DNA, 38 bp, Artificial Sequence
  Description of Artificial Sequence: Synthetic oligonucleotide
actggcagatagacgtggacctactcaataaaatgaag

SEQ ID NO: 142889 - DNA, 37 bp, Artificial Sequence
  Description of Artificial Sequence: Synthetic oligonucleotide
ctggcagatagacgtggacctactcaataaaatgaag

SEQ ID NO: 142890 - DNA, 39 bp, Artificial Sequence
  Description of Artificial Sequence: Synthetic oligonucleotide
tggcagatagacgtggacctactcaataaaatgaagaag

SEQ ID NO: 142891 - DNA, 38 bp, Artificial Sequence
  Description of Artificial Sequence: Synthetic oligonucleotide
ggcagatagacgtggacctactcaataaaatgaagaag

SEQ ID NO: 142892 - DNA, 38 bp, Artificial Sequence
  Description of Artificial Sequence: Synthetic oligonucleotide
gcagatagacgtggacctactcaataaaatgaagaagg

SEQ ID NO: 142893 - DNA, 38 bp, Artificial Sequence
  Description of Artificial Sequence: Synthetic oligonucleotide
cagatagacgtggacctactcaataaaatgaagaaggc

SEQ ID NO: 142894 - DNA, 42 bp, Artificial Sequence
  Description of Artificial Sequence: Synthetic oligonucleotide
agatagacgtggacctactcaataaaatgaagaaggcaaatg

SEQ ID NO: 142895 - DNA, 41 bp, Artificial Sequence
  Description of Artificial Sequence: Synthetic oligonucleotide
gatagacgtggacctactcaataaaatgaagaaggcaaatg

SEQ ID NO: 142896 - DNA, 43 bp, Artificial Sequence
  Description of Artificial Sequence: Synthetic oligonucleotide
atagacgtggacctactcaataaaatgaagaaggcaaatgaag

SEQ ID NO: 142897 - DNA, 42 bp, Artificial Sequence
  Description of Artificial Sequence: Synthetic oligonucleotide
tagacgtggacctactcaataaaatgaagaaggcaaatgaag

SEQ ID NO: 142898 - DNA, 41 bp, Artificial Sequence
  Description of Artificial Sequence: Synthetic oligonucleotide
agacgtggacctactcaataaaatgaagaaggcaaatgaag

SEQ ID NO: 142899 - DNA, 40 bp, Artificial Sequence
  Description of Artificial Sequence: Synthetic oligonucleotide
gacgtggacctactcaataaaatgaagaaggcaaatgaag

SEQ ID NO: 142900 - DNA, 42 bp, Artificial Sequence
  Description of Artificial Sequence: Synthetic oligonucleotide
acgtggacctactcaataaaatgaagaaggcaaatgaagatg

SEQ ID NO: 142901 - DNA, 41 bp, Artificial Sequence
  Description of Artificial Sequence: Synthetic oligonucleotide
cgtggacctactcaataaaatgaagaaggcaaatgaagatg

SEQ ID NO: 142902 - DNA, 42 bp, Artificial Sequence
  Description of Artificial Sequence: Synthetic oligonucleotide
gtggacctactcaataaaatgaagaaggcaaatgaagatgag

SEQ ID NO: 142903 - DNA, 44 bp, Artificial Sequence
  Description of Artificial Sequence: Synthetic oligonucleotide
tggacctactcaataaaatgaagaaggcaaatgaagatgagttg

SEQ ID NO: 142904 - DNA, 43 bp, Artificial Sequence
  Description of Artificial Sequence: Synthetic oligonucleotide
ggacctactcaataaaatgaagaaggcaaatgaagatgagttg

SEQ ID NO: 142905 - DNA, 45 bp, Artificial Sequence
  Description of Artificial Sequence: Synthetic oligonucleotide
gacctactcaataaaatgaagaaggcaaatgaagatgagttgaag

SEQ ID NO: 142906 - DNA, 45 bp, Artificial Sequence
  Description of Artificial Sequence: Synthetic oligonucleotide
acctactcaataaaatgaagaaggcaaatgaagatgagttgaagc

SEQ ID NO: 142907 - DNA, 44 bp, Artificial Sequence
  Description of Artificial Sequence: Synthetic oligonucleotide
cctactcaataaaatgaagaaggcaaatgaagatgagttgaagc

SEQ ID NO: 142908 - DNA, 44 bp, Artificial Sequence
  Description of Artificial Sequence: Synthetic oligonucleotide
ctactcaataaaatgaagaaggcaaatgaagatgagttgaagcg

SEQ ID NO: 142909 - DNA, 47 bp, Artificial Sequence
  Description of Artificial Sequence: Synthetic oligonucleotide
tactcaataaaatgaagaaggcaaatgaagatgagttgaagcgtttg

SEQ ID NO: 142910 - DNA, 46 bp, Artificial Sequence
  Description of Artificial Sequence: Synthetic oligonucleotide
actcaataaaatgaagaaggcaaatgaagatgagttgaagcgtttg

SEQ ID NO: 142911 - DNA, 45 bp, Artificial Sequence
  Description of Artificial Sequence: Synthetic oligonucleotide
ctcaataaaatgaagaaggcaaatgaagatgagttgaagcgtttg

SEQ ID NO: 142912 - DNA, 45 bp, Artificial Sequence
  Description of Artificial Sequence: Synthetic oligonucleotide
tcaataaaatgaagaaggcaaatgaagatgagttgaagcgtttgg

SEQ ID NO: 142913 - DNA, 44 bp, Artificial Sequence
  Description of Artificial Sequence: Synthetic oligonucleotide
caataaaatgaagaaggcaaatgaagatgagttgaagcgtttgg

SEQ ID NO: 142914 - DNA, 46 bp, Artificial Sequence
  Description of Artificial Sequence: Synthetic oligonucleotide
aataaaatgaagaaggcaaatgaagatgagttgaagcgtttggatg

SEQ ID NO: 142915 - DNA, 45 bp, Artificial Sequence
  Description of Artificial Sequence: Synthetic oligonucleotide
ataaaatgaagaaggcaaatgaagatgagttgaagcgtttggatg

SEQ ID NO: 142916 - DNA, 44 bp, Artificial Sequence
  Description of Artificial Sequence: Synthetic oligonucleotide
taaaatgaagaaggcaaatgaagatgagttgaagcgtttggatg

SEQ ID NO: 142917 - DNA, 43 bp, Artificial Sequence
  Description of Artificial Sequence: Synthetic oligonucleotide
aaaatgaagaaggcaaatgaagatgagttgaagcgtttggatg

SEQ ID NO: 142918 - DNA, 42 bp, Artificial Sequence
  Description of Artificial Sequence: Synthetic oligonucleotide
aaatgaagaaggcaaatgaagatgagttgaagcgtttggatg

SEQ ID NO: 142919 - DNA, 41 bp, Artificial Sequence
  Description of Artificial Sequence: Synthetic oligonucleotide
aatgaagaaggcaaatgaagatgagttgaagcgtttggatg

SEQ ID NO: 142920 - DNA, 40 bp, Artificial Sequence
  Description of Artificial Sequence: Synthetic oligonucleotide
atgaagaaggcaaatgaagatgagttgaagcgtttggatg

SEQ ID NO: 142921 - DNA, 39 bp, Artificial Sequence
  Description of Artificial Sequence: Synthetic oligonucleotide
tgaagaaggcaaatgaagatgagttgaagcgtttggatg

SEQ ID NO: 142922 - DNA, 38 bp, Artificial Sequence
  Description of Artificial Sequence: Synthetic oligonucleotide
gaagaaggcaaatgaagatgagttgaagcgtttggatg

SEQ ID NO: 142923 - DNA, 39 bp, Artificial Sequence
  Description of Artificial Sequence: Synthetic oligonucleotide
aagaaggcaaatgaagatgagttgaagcgtttggatgag

SEQ ID NO: 142924 - DNA, 38 bp, Artificial Sequence
  Description of Artificial Sequence: Synthetic oligonucleotide
agaaggcaaatgaagatgagttgaagcgtttggatgag

SEQ ID NO: 142925 - DNA, 37 bp, Artificial Sequence
  Description of Artificial Sequence: Synthetic oligonucleotide
gaaggcaaatgaagatgagttgaagcgtttggatgag

SEQ ID NO: 142926 - DNA, 37 bp, Artificial Sequence
  Description of Artificial Sequence: Synthetic oligonucleotide
aaggcaaatgaagatgagttgaagcgtttggatgagg

SEQ ID NO: 142927 - DNA, 36 bp, Artificial Sequence
  Description of Artificial Sequence: Synthetic oligonucleotide
aggcaaatgaagatgagttgaagcgtttggatgagg

SEQ ID NO: 142928 - DNA, 35 bp, Artificial Sequence
  Description of Artificial Sequence: Synthetic oligonucleotide
ggcaaatgaagatgagttgaagcgtttggatgagg

SEQ ID NO: 142929 - DNA, 36 bp, Artificial Sequence
  Description of Artificial Sequence: Synthetic oligonucleotide
gcaaatgaagatgagttgaagcgtttggatgaggag

SEQ ID NO: 142930 - DNA, 36 bp, Artificial Sequence
  Description of Artificial Sequence: Synthetic oligonucleotide
caaatgaagatgagttgaagcgtttggatgaggagc

SEQ ID NO: 142931 - DNA, 37 bp, Artificial Sequence
  Description of Artificial Sequence: Synthetic oligonucleotide
aaatgaagatgagttgaagcgtttggatgaggagctg

SEQ ID NO: 142932 - DNA, 36 bp, Artificial Sequence
  Description of Artificial Sequence: Synthetic oligonucleotide
aatgaagatgagttgaagcgtttggatgaggagctg

SEQ ID NO: 142933 - DNA, 35 bp, Artificial Sequence
  Description of Artificial Sequence: Synthetic oligonucleotide
atgaagatgagttgaagcgtttggatgaggagctg

SEQ ID NO: 142934 - DNA, 34 bp, Artificial Sequence
  Description of Artificial Sequence: Synthetic oligonucleotide
tgaagatgagttgaagcgtttggatgaggagctg

SEQ ID NO: 142935 - DNA, 33 bp, Artificial Sequence
  Description of Artificial Sequence: Synthetic oligonucleotide
gaagatgagttgaagcgtttggatgaggagctg

SEQ ID NO: 142936 - DNA, 33 bp, Artificial Sequence
  Description of Artificial Sequence: Synthetic oligonucleotide
aagatgagttgaagcgtttggatgaggagctgg

SEQ ID NO: 142937 - DNA, 32 bp, Artificial Sequence
  Description of Artificial Sequence: Synthetic oligonucleotide
agatgagttgaagcgtttggatgaggagctgg

SEQ ID NO: 142938 - DNA, 31 bp, Artificial Sequence
  Description of Artificial Sequence: Synthetic oligonucleotide
gatgagttgaagcgtttggatgaggagctgg

SEQ ID NO: 142939 - DNA, 33 bp, Artificial Sequence
  Description of Artificial Sequence: Synthetic oligonucleotide
atgagttgaagcgtttggatgaggagctggaag

SEQ ID NO: 142940 - DNA, 32 bp, Artificial Sequence
  Description of Artificial Sequence: Synthetic oligonucleotide
tgagttgaagcgtttggatgaggagctggaag

SEQ ID NO: 142941 - DNA, 31 bp, Artificial Sequence
  Description of Artificial Sequence: Synthetic oligonucleotide
gagttgaagcgtttggatgaggagctggaag

SEQ ID NO: 142942 - DNA, 33 bp, Artificial Sequence
  Description of Artificial Sequence: Synthetic oligonucleotide
agttgaagcgtttggatgaggagctggaagatg

SEQ ID NO: 142943 - DNA, 32 bp, Artificial Sequence
  Description of Artificial Sequence: Synthetic oligonucleotide
gttgaagcgtttggatgaggagctggaagatg

SEQ ID NO: 142944 - DNA, 32 bp, Artificial Sequence
  Description of Artificial Sequence: Synthetic oligonucleotide
ttgaagcgtttggatgaggagctggaagatgc

SEQ ID NO: 142945 - DNA, 31 bp, Artificial Sequence
  Description of Artificial Sequence: Synthetic oligonucleotide
tgaagcgtttggatgaggagctggaagatgc

SEQ ID NO: 142946 - DNA, 30 bp, Artificial Sequence
  Description of Artificial Sequence: Synthetic oligonucleotide
gaagcgtttggatgaggagctggaagatgc

SEQ ID NO: 142947 - DNA, 31 bp, Artificial Sequence
  Description of Artificial Sequence: Synthetic oligonucleotide
aagcgtttggatgaggagctggaagatgcag

SEQ ID NO: 142948 - DNA, 30 bp, Artificial Sequence
  Description of Artificial Sequence: Synthetic oligonucleotide
agcgtttggatgaggagctggaagatgcag

SEQ ID NO: 142949 - DNA, 29 bp, Artificial Sequence
  Description of Artificial Sequence: Synthetic oligonucleotide
gcgtttggatgaggagctggaagatgcag

SEQ ID NO: 142950 - DNA, 30 bp, Artificial Sequence
  Description of Artificial Sequence: Synthetic oligonucleotide
cgtttggatgaggagctggaagatgcagag

SEQ ID NO: 142951 - DNA, 32 bp, Artificial Sequence
  Description of Artificial Sequence: Synthetic oligonucleotide
gtttggatgaggagctggaagatgcagagaag

SEQ ID NO: 142952 - DNA, 35 bp, Artificial Sequence
  Description of Artificial Sequence: Synthetic oligonucleotide
tttggatgaggagctggaagatgcagagaagaatc

SEQ ID NO: 142953 - DNA, 34 bp, Artificial Sequence
  Description of Artificial Sequence: Synthetic oligonucleotide
ttggatgaggagctggaagatgcagagaagaatc

SEQ ID NO: 142954 - DNA, 33 bp, Artificial Sequence
  Description of Artificial Sequence: Synthetic oligonucleotide
tggatgaggagctggaagatgcagagaagaatc

SEQ ID NO: 142955 - DNA, 32 bp, Artificial Sequence
  Description of Artificial Sequence: Synthetic oligonucleotide
ggatgaggagctggaagatgcagagaagaatc

SEQ ID NO: 142956 - DNA, 34 bp, Artificial Sequence
  Description of Artificial Sequence: Synthetic oligonucleotide
gatgaggagctggaagatgcagagaagaatctag

SEQ ID NO: 142957 - DNA, 34 bp, Artificial Sequence
  Description of Artificial Sequence: Synthetic oligonucleotide
atgaggagctggaagatgcagagaagaatctagg

SEQ ID NO: 142958 - DNA, 33 bp, Artificial Sequence
  Description of Artificial Sequence: Synthetic oligonucleotide
tgaggagctggaagatgcagagaagaatctagg

SEQ ID NO: 142959 - DNA, 32 bp, Artificial Sequence
  Description of Artificial Sequence: Synthetic oligonucleotide
gaggagctggaagatgcagagaagaatctagg

SEQ ID NO: 142960 - DNA, 33 bp, Artificial Sequence
  Description of Artificial Sequence: Synthetic oligonucleotide
aggagctggaagatgcagagaagaatctaggag

SEQ ID NO: 142961 - DNA, 32 bp, Artificial Sequence
  Description of Artificial Sequence: Synthetic oligonucleotide
ggagctggaagatgcagagaagaatctaggag

SEQ ID NO: 142962 - DNA, 33 bp, Artificial Sequence
  Description of Artificial Sequence: Synthetic oligonucleotide
gagctggaagatgcagagaagaatctaggagag

SEQ ID NO: 142963 - DNA, 34 bp, Artificial Sequence
  Description of Artificial Sequence: Synthetic oligonucleotide
agctggaagatgcagagaagaatctaggagagag

SEQ ID NO: 142964 - DNA, 33 bp, Artificial Sequence
  Description of Artificial Sequence: Synthetic oligonucleotide
gctggaagatgcagagaagaatctaggagagag

SEQ ID NO: 142965 - DNA, 33 bp, Artificial Sequence
  Description of Artificial Sequence: Synthetic oligonucleotide
ctggaagatgcagagaagaatctaggagagagc

SEQ ID NO: 142966 - DNA, 33 bp, Artificial Sequence
  Description of Artificial Sequence: Synthetic oligonucleotide
tggaagatgcagagaagaatctaggagagagcg

SEQ ID NO: 142967 - DNA, 32 bp, Artificial Sequence
  Description of Artificial Sequence: Synthetic oligonucleotide
ggaagatgcagagaagaatctaggagagagcg

SEQ ID NO: 142968 - DNA, 37 bp, Artificial Sequence
  Description of Artificial Sequence: Synthetic oligonucleotide
gaagatgcagagaagaatctaggagagagcgaaattc

SEQ ID NO: 142969 - DNA, 37 bp, Artificial Sequence
  Description of Artificial Sequence: Synthetic oligonucleotide
aagatgcagagaagaatctaggagagagcgaaattcg

SEQ ID NO: 142970 - DNA, 36 bp, Artificial Sequence
  Description of Artificial Sequence: Synthetic oligonucleotide
agatgcagagaagaatctaggagagagcgaaattcg

SEQ ID NO: 142971 - DNA, 35 bp, Artificial Sequence
  Description of Artificial Sequence: Synthetic oligonucleotide
gatgcagagaagaatctaggagagagcgaaattcg

SEQ ID NO: 142972 - DNA, 35 bp, Artificial Sequence
  Description of Artificial Sequence: Synthetic oligonucleotide
atgcagagaagaatctaggagagagcgaaattcgc

SEQ ID NO: 142973 - DNA, 34 bp, Artificial Sequence
  Description of Artificial Sequence: Synthetic oligonucleotide
tgcagagaagaatctaggagagagcgaaattcgc

SEQ ID NO: 142974 - DNA, 33 bp, Artificial Sequence
  Description of Artificial Sequence: Synthetic oligonucleotide
gcagagaagaatctaggagagagcgaaattcgc

SEQ ID NO: 142975 - DNA, 33 bp, Artificial Sequence
  Description of Artificial Sequence: Synthetic oligonucleotide
cagagaagaatctaggagagagcgaaattcgcg

SEQ ID NO: 142976 - DNA, 35 bp, Artificial Sequence
  Description of Artificial Sequence: Synthetic oligonucleotide
agagaagaatctaggagagagcgaaattcgcgatg

SEQ ID NO: 142977 - DNA, 34 bp, Artificial Sequence
  Description of Artificial Sequence: Synthetic oligonucleotide
gagaagaatctaggagagagcgaaattcgcgatg

SEQ ID NO: 142978 - DNA, 34 bp, Artificial Sequence
  Description of Artificial Sequence: Synthetic oligonucleotide
agaagaatctaggagagagcgaaattcgcgatgc

SEQ ID NO: 142979 - DNA, 33 bp, Artificial Sequence
  Description of Artificial Sequence: Synthetic oligonucleotide
gaagaatctaggagagagcgaaattcgcgatgc

SEQ ID NO: 142980 - DNA, 36 bp, Artificial Sequence
  Description of Artificial Sequence: Synthetic oligonucleotide
aagaatctaggagagagcgaaattcgcgatgcaatg

SEQ ID NO: 142981 - DNA, 35 bp, Artificial Sequence
  Description of Artificial Sequence: Synthetic oligonucleotide
agaatctaggagagagcgaaattcgcgatgcaatg

SEQ ID NO: 142982 - DNA, 34 bp, Artificial Sequence
  Description of Artificial Sequence: Synthetic oligonucleotide
gaatctaggagagagcgaaattcgcgatgcaatg

SEQ ID NO: 142983 - DNA, 36 bp, Artificial Sequence
  Description of Artificial Sequence: Synthetic oligonucleotide
aatctaggagagagcgaaattcgcgatgcaatgatg

SEQ ID NO: 142984 - DNA, 35 bp, Artificial Sequence
  Description of Artificial Sequence: Synthetic oligonucleotide
atctaggagagagcgaaattcgcgatgcaatgatg

SEQ ID NO: 142985 - DNA, 34 bp, Artificial Sequence
  Description of Artificial Sequence: Synthetic oligonucleotide
tctaggagagagcgaaattcgcgatgcaatgatg

SEQ ID NO: 142986 - DNA, 33 bp, Artificial Sequence
  Description of Artificial Sequence: Synthetic oligonucleotide
ctaggagagagcgaaattcgcgatgcaatgatg

SEQ ID NO: 142987 - DNA, 33 bp, Artificial Sequence
  Description of Artificial Sequence: Synthetic oligonucleotide
taggagagagcgaaattcgcgatgcaatgatgg

SEQ ID NO: 142988 - DNA, 32 bp, Artificial Sequence
  Description of Artificial Sequence: Synthetic oligonucleotide
aggagagagcgaaattcgcgatgcaatgatgg

SEQ ID NO: 142989 - DNA, 31 bp, Artificial Sequence
  Description of Artificial Sequence: Synthetic oligonucleotide
ggagagagcgaaattcgcgatgcaatgatgg

SEQ ID NO: 142990 - DNA, 31 bp, Artificial Sequence
  Description of Artificial Sequence: Synthetic oligonucleotide
gagagagcgaaattcgcgatgcaatgatggc

SEQ ID NO: 142991 - DNA, 34 bp, Artificial Sequence
  Description of Artificial Sequence: Synthetic oligonucleotide
agagagcgaaattcgcgatgcaatgatggcaaag

SEQ ID NO: 142992 - DNA, 33 bp, Artificial Sequence
  Description of Artificial Sequence: Synthetic oligonucleotide
gagagcgaaattcgcgatgcaatgatggcaaag

SEQ ID NO: 142993 - DNA, 33 bp, Artificial Sequence
  Description of Artificial Sequence: Synthetic oligonucleotide
agagcgaaattcgcgatgcaatgatggcaaagg

SEQ ID NO: 142994 - DNA, 32 bp, Artificial Sequence
  Description of Artificial Sequence: Synthetic oligonucleotide
gagcgaaattcgcgatgcaatgatggcaaagg

SEQ ID NO: 142995 - DNA, 32 bp, Artificial Sequence
  Description of Artificial Sequence: Synthetic oligonucleotide
agcgaaattcgcgatgcaatgatggcaaaggc

SEQ ID NO: 142996 - DNA, 31 bp, Artificial Sequence
  Description of Artificial Sequence: Synthetic oligonucleotide
gcgaaattcgcgatgcaatgatggcaaaggc

SEQ ID NO: 142997 - DNA, 31 bp, Artificial Sequence
  Description of Artificial Sequence: Synthetic oligonucleotide
cgaaattcgcgatgcaatgatggcaaaggcc

SEQ ID NO: 142998 - DNA, 31 bp, Artificial Sequence
  Description of Artificial Sequence: Synthetic oligonucleotide
gaaattcgcgatgcaatgatggcaaaggccg

SEQ ID NO: 142999 - DNA, 32 bp, Artificial Sequence
  Description of Artificial Sequence: Synthetic oligonucleotide
aaattcgcgatgcaatgatggcaaaggccgag

SEQ ID NO: 143000 - DNA, 31 bp, Artificial Sequence
  Description of Artificial Sequence: Synthetic oligonucleotide
aattcgcgatgcaatgatggcaaaggccgag

SEQ ID NO: 143001 - DNA, 30 bp, Artificial Sequence
  Description of Artificial Sequence: Synthetic oligonucleotide
attcgcgatgcaatgatggcaaaggccgag

SEQ ID NO: 143002 - DNA, 29 bp, Artificial Sequence
  Description of Artificial Sequence: Synthetic oligonucleotide
ttcgcgatgcaatgatggcaaaggccgag

SEQ ID NO: 143003 - DNA, 28 bp, Artificial Sequence
  Description of Artificial Sequence: Synthetic oligonucleotide
tcgcgatgcaatgatggcaaaggccgag

SEQ ID NO: 143004 - DNA, 27 bp, Artificial Sequence
  Description of Artificial Sequence: Synthetic oligonucleotide
cgcgatgcaatgatggcaaaggccgag

SEQ ID NO: 143005 - DNA, 29 bp, Artificial Sequence
  Description of Artificial Sequence: Synthetic oligonucleotide
gcgatgcaatgatggcaaaggccgagtac

SEQ ID NO: 143006 - DNA, 29 bp, Artificial Sequence
  Description of Artificial Sequence: Synthetic oligonucleotide
cgatgcaatgatggcaaaggccgagtacc

SEQ ID NO: 143007 - DNA, 30 bp, Artificial Sequence
  Description of Artificial Sequence: Synthetic oligonucleotide
gatgcaatgatggcaaaggccgagtacctc

SEQ ID NO: 143008 - DNA, 31 bp, Artificial Sequence
  Description of Artificial Sequence: Synthetic oligonucleotide
atgcaatgatggcaaaggccgagtacctctg

SEQ ID NO: 143009 - DNA, 30 bp, Artificial Sequence
  Description of Artificial Sequence: Synthetic oligonucleotide
tgcaatgatggcaaaggccgagtacctctg

SEQ ID NO: 143010 - DNA, 29 bp, Artificial Sequence
  Description of Artificial Sequence: Synthetic oligonucleotide
gcaatgatggcaaaggccgagtacctctg

SEQ ID NO: 143011 - DNA, 29 bp, Artificial Sequence
  Description of Artificial Sequence: Synthetic oligonucleotide
caatgatggcaaaggccgagtacctctgc

SEQ ID NO: 143012 - DNA, 29 bp, Artificial Sequence
  Description of Artificial Sequence: Synthetic oligonucleotide
aatgatggcaaaggccgagtacctctgcc

SEQ ID NO: 143013 - DNA, 28 bp, Artificial Sequence
  Description of Artificial Sequence: Synthetic oligonucleotide
atgatggcaaaggccgagtacctctgcc

SEQ ID NO: 143014 - DNA, 27 bp, Artificial Sequence
  Description of Artificial Sequence: Synthetic oligonucleotide
tgatggcaaaggccgagtacctctgcc

SEQ ID NO: 143015 - DNA, 26 bp, Artificial Sequence
  Description of Artificial Sequence: Synthetic oligonucleotide
gatggcaaaggccgagtacctctgcc

SEQ ID NO: 143016 - DNA, 26 bp, Artificial Sequence
  Description of Artificial Sequence: Synthetic oligonucleotide
atggcaaaggccgagtacctctgccg

SEQ ID NO: 143017 - DNA, 25 bp, Artificial Sequence
  Description of Artificial Sequence: Synthetic oligonucleotide
tggcaaaggccgagtacctctgccg

SEQ ID NO: 143018 - DNA, 24 bp, Artificial Sequence
  Description of Artificial Sequence: Synthetic oligonucleotide
ggcaaaggccgagtacctctgccg

SEQ ID NO: 143019 - DNA, 27 bp, Artificial Sequence
  Description of Artificial Sequence: Synthetic oligonucleotide
gcaaaggccgagtacctctgccggata

SEQ ID NO: 143020 - DNA, 27 bp, Artificial Sequence
  Description of Artificial Sequence: Synthetic oligonucleotide
caaaggccgagtacctctgccggatag

SEQ ID NO: 143021 - DNA, 27 bp, Artificial Sequence
  Description of Artificial Sequence: Synthetic oligonucleotide
aaaggccgagtacctctgccggatagg

SEQ ID NO: 143022 - DNA, 27 bp, Artificial Sequence
  Description of Artificial Sequence: Synthetic oligonucleotide
aaggccgagtacctctgccggataggt

SEQ ID NO: 143023 - DNA, 26 bp, Artificial Sequence
  Description of Artificial Sequence: Synthetic oligonucleotide
aggccgagtacctctgccggataggt

SEQ ID NO: 143024 - DNA, 25 bp, Artificial Sequence
  Description of Artificial Sequence: Synthetic oligonucleotide
ggccgagtacctctgccggataggt

SEQ ID NO: 143025 - DNA, 26 bp, Artificial Sequence
  Description of Artificial Sequence: Synthetic oligonucleotide
gccgagtacctctgccggataggtga

SEQ ID NO: 143026 - DNA, 27 bp, Artificial Sequence
  Description of Artificial Sequence: Synthetic oligonucleotide
ccgagtacctctgccggataggtgaca

SEQ ID NO: 143027 - DNA, 29 bp, Artificial Sequence
  Description of Artificial Sequence: Synthetic oligonucleotide
cgagtacctctgccggataggtgacaaag

SEQ ID NO: 143028 - DNA, 30 bp, Artificial Sequence
  Description of Artificial Sequence: Synthetic oligonucleotide
gagtacctctgccggataggtgacaaagag

SEQ ID NO: 143029 - DNA, 30 bp, Artificial Sequence
  Description of Artificial Sequence: Synthetic oligonucleotide
agtacctctgccggataggtgacaaagagg

SEQ ID NO: 143030 - DNA, 29 bp, Artificial Sequence
  Description of Artificial Sequence: Synthetic oligonucleotide
gtacctctgccggataggtgacaaagagg

SEQ ID NO: 143031 - DNA, 29 bp, Artificial Sequence
  Description of Artificial Sequence: Synthetic oligonucleotide
tacctctgccggataggtgacaaagaggg

SEQ ID NO: 143032 - DNA, 28 bp, Artificial Sequence
  Description of Artificial Sequence: Synthetic oligonucleotide
acctctgccggataggtgacaaagaggg

SEQ ID NO: 143033 - DNA, 27 bp, Artificial Sequence
  Description of Artificial Sequence: Synthetic oligonucleotide
cctctgccggataggtgacaaagaggg

SEQ ID NO: 143034 - DNA, 28 bp, Artificial Sequence
  Description of Artificial Sequence: Synthetic oligonucleotide
ctctgccggataggtgacaaagagggag

SEQ ID NO: 143035 - DNA, 28 bp, Artificial Sequence
  Description of Artificial Sequence: Synthetic oligonucleotide
tctgccggataggtgacaaagagggagc

SEQ ID NO: 143036 - DNA, 27 bp, Artificial Sequence
  Description of Artificial Sequence: Synthetic oligonucleotide
ctgccggataggtgacaaagagggagc

SEQ ID NO: 143037 - DNA, 28 bp, Artificial Sequence
  Description of Artificial Sequence: Synthetic oligonucleotide
tgccggataggtgacaaagagggagctc

SEQ ID NO: 143038 - DNA, 27 bp, Artificial Sequence
  Description of Artificial Sequence: Synthetic oligonucleotide
gccggataggtgacaaagagggagctc

SEQ ID NO: 143039 - DNA, 28 bp, Artificial Sequence
  Description of Artificial Sequence: Synthetic oligonucleotide
ccggataggtgacaaagagggagctctg

SEQ ID NO: 143040 - DNA, 29 bp, Artificial Sequence
  Description of Artificial Sequence: Synthetic oligonucleotide
cggataggtgacaaagagggagctctgac

SEQ ID NO: 143041 - DNA, 30 bp, Artificial Sequence
  Description of Artificial Sequence: Synthetic oligonucleotide
ggataggtgacaaagagggagctctgacag

SEQ ID NO: 143042 - DNA, 30 bp, Artificial Sequence
  Description of Artificial Sequence: Synthetic oligonucleotide
gataggtgacaaagagggagctctgacagc

SEQ ID NO: 143043 - DNA, 30 bp, Artificial Sequence
  Description of Artificial Sequence: Synthetic oligonucleotide
ataggtgacaaagagggagctctgacagcc

SEQ ID NO: 143044 - DNA, 29 bp, Artificial Sequence
  Description of Artificial Sequence: Synthetic oligonucleotide
taggtgacaaagagggagctctgacagcc

SEQ ID NO: 143045 - DNA, 28 bp, Artificial Sequence
  Description of Artificial Sequence: Synthetic oligonucleotide
aggtgacaaagagggagctctgacagcc

SEQ ID NO: 143046 - DNA, 27 bp, Artificial Sequence
  Description of Artificial Sequence: Synthetic oligonucleotide
ggtgacaaagagggagctctgacagcc

SEQ ID NO: 143047 - DNA, 30 bp, Artificial Sequence
  Description of Artificial Sequence: Synthetic oligonucleotide
gtgacaaagagggagctctgacagcctttc

SEQ ID NO: 143048 - DNA, 30 bp, Artificial Sequence
  Description of Artificial Sequence: Synthetic oligonucleotide
tgacaaagagggagctctgacagcctttcg

SEQ ID NO: 143049 - DNA, 29 bp, Artificial Sequence
  Description of Artificial Sequence: Synthetic oligonucleotide
gacaaagagggagctctgacagcctttcg

SEQ ID NO: 143050 - DNA, 29 bp, Artificial Sequence
  Description of Artificial Sequence: Synthetic oligonucleotide
acaaagagggagctctgacagcctttcgc

SEQ ID NO: 143051 - DNA, 28 bp, Artificial Sequence
  Description of Artificial Sequence: Synthetic oligonucleotide
caaagagggagctctgacagcctttcgc

SEQ ID NO: 143052 - DNA, 30 bp, Artificial Sequence
  Description of Artificial Sequence: Synthetic oligonucleotide
aaagagggagctctgacagcctttcgcaag

SEQ ID NO: 143053 - DNA, 29 bp, Artificial Sequence
  Description of Artificial Sequence: Synthetic oligonucleotide
aagagggagctctgacagcctttcgcaag

SEQ ID NO: 143054 - DNA, 28 bp, Artificial Sequence
  Description of Artificial Sequence: Synthetic oligonucleotide
agagggagctctgacagcctttcgcaag

SEQ ID NO: 143055 - DNA, 27 bp, Artificial Sequence
  Description of Artificial Sequence: Synthetic oligonucleotide
gagggagctctgacagcctttcgcaag

SEQ ID NO: 143056 - DNA, 28 bp, Artificial Sequence
  Description of Artificial Sequence: Synthetic oligonucleotide
agggagctctgacagcctttcgcaagac

SEQ ID NO: 143057 - DNA, 27 bp, Artificial Sequence
  Description of Artificial Sequence: Synthetic oligonucleotide
gggagctctgacagcctttcgcaagac

SEQ ID NO: 143058 - DNA, 31 bp, Artificial Sequence
  Description of Artificial Sequence: Synthetic oligonucleotide
ggagctctgacagcctttcgcaagacatatg

SEQ ID NO: 143059 - DNA, 32 bp, Artificial Sequence
  Description of Artificial Sequence: Synthetic oligonucleotide
gagctctgacagcctttcgcaagacatatgac

SEQ ID NO: 143060 - DNA, 36 bp, Artificial Sequence
  Description of Artificial Sequence: Synthetic oligonucleotide
agctctgacagcctttcgcaagacatatgacaaaac

SEQ ID NO: 143061 - DNA, 35 bp, Artificial Sequence
  Description of Artificial Sequence: Synthetic oligonucleotide
gctctgacagcctttcgcaagacatatgacaaaac

SEQ ID NO: 143062 - DNA, 36 bp, Artificial Sequence
  Description of Artificial Sequence: Synthetic oligonucleotide
ctctgacagcctttcgcaagacatatgacaaaactg

SEQ ID NO: 143063 - DNA, 37 bp, Artificial Sequence
  Description of Artificial Sequence: Synthetic oligonucleotide
tctgacagcctttcgcaagacatatgacaaaactgtg

SEQ ID NO: 143064 - DNA, 36 bp, Artificial Sequence
  Description of Artificial Sequence: Synthetic oligonucleotide
ctgacagcctttcgcaagacatatgacaaaactgtg

SEQ ID NO: 143065 - DNA, 36 bp, Artificial Sequence
  Description of Artificial Sequence: Synthetic oligonucleotide
tgacagcctttcgcaagacatatgacaaaactgtgg

SEQ ID NO: 143066 - DNA, 35 bp, Artificial Sequence
  Description of Artificial Sequence: Synthetic oligonucleotide
gacagcctttcgcaagacatatgacaaaactgtgg

SEQ ID NO: 143067 - DNA, 35 bp, Artificial Sequence
  Description of Artificial Sequence: Synthetic oligonucleotide
acagcctttcgcaagacatatgacaaaactgtggc

SEQ ID NO: 143068 - DNA, 34 bp, Artificial Sequence
  Description of Artificial Sequence: Synthetic oligonucleotide
cagcctttcgcaagacatatgacaaaactgtggc

SEQ ID NO: 143069 - DNA, 34 bp, Artificial Sequence
  Description of Artificial Sequence: Synthetic oligonucleotide
agcctttcgcaagacatatgacaaaactgtggcc

SEQ ID NO: 143070 - DNA, 33 bp, Artificial Sequence
  Description of Artificial Sequence: Synthetic oligonucleotide
gcctttcgcaagacatatgacaaaactgtggcc

SEQ ID NO: 143071 - DNA, 33 bp, Artificial Sequence
  Description of Artificial Sequence: Synthetic oligonucleotide
cctttcgcaagacatatgacaaaactgtggccc

SEQ ID NO: 143072 - DNA, 34 bp, Artificial Sequence
  Description of Artificial Sequence: Synthetic oligonucleotide
ctttcgcaagacatatgacaaaactgtggccctg

SEQ ID NO: 143073 - DNA, 34 bp, Artificial Sequence
  Description of Artificial Sequence: Synthetic oligonucleotide
tttcgcaagacatatgacaaaactgtggccctgg

SEQ ID NO: 143074 - DNA, 33 bp, Artificial Sequence
  Description of Artificial Sequence: Synthetic oligonucleotide
ttcgcaagacatatgacaaaactgtggccctgg

SEQ ID NO: 143075 - DNA, 32 bp, Artificial Sequence
  Description of Artificial Sequence: Synthetic oligonucleotide
tcgcaagacatatgacaaaactgtggccctgg

SEQ ID NO: 143076 - DNA, 31 bp, Artificial Sequence
  Description of Artificial Sequence: Synthetic oligonucleotide
cgcaagacatatgacaaaactgtggccctgg

SEQ ID NO: 143077 - DNA, 31 bp, Artificial Sequence
  Description of Artificial Sequence: Synthetic oligonucleotide
gcaagacatatgacaaaactgtggccctggg

SEQ ID NO: 143078 - DNA, 32 bp, Artificial Sequence
  Description of Artificial Sequence: Synthetic oligonucleotide
caagacatatgacaaaactgtggccctgggtc

SEQ ID NO: 143079 - DNA, 33 bp, Artificial Sequence
  Description of Artificial Sequence: Synthetic oligonucleotide
aagacatatgacaaaactgtggccctgggtcac

SEQ ID NO: 143080 - DNA, 32 bp, Artificial Sequence
  Description of Artificial Sequence: Synthetic oligonucleotide
agacatatgacaaaactgtggccctgggtcac

SEQ ID NO: 143081 - DNA, 31 bp, Artificial Sequence
  Description of Artificial Sequence: Synthetic oligonucleotide
gacatatgacaaaactgtggccctgggtcac

SEQ ID NO: 143082 - DNA, 31 bp, Artificial Sequence
  Description of Artificial Sequence: Synthetic oligonucleotide
acatatgacaaaactgtggccctgggtcacc

SEQ ID NO: 143083 - DNA, 30 bp, Artificial Sequence
  Description of Artificial Sequence: Synthetic oligonucleotide
catatgacaaaactgtggccctgggtcacc

SEQ ID NO: 143084 - DNA, 30 bp, Artificial Sequence
  Description of Artificial Sequence: Synthetic oligonucleotide
atatgacaaaactgtggccctgggtcaccg

SEQ ID NO: 143085 - DNA, 29 bp, Artificial Sequence
  Description of Artificial Sequence: Synthetic oligonucleotide
tatgacaaaactgtggccctgggtcaccg

SEQ ID NO: 143086 - DNA, 28 bp, Artificial Sequence
  Description of Artificial Sequence: Synthetic oligonucleotide
atgacaaaactgtggccctgggtcaccg

SEQ ID NO: 143087 - DNA, 27 bp, Artificial Sequence
  Description of Artificial Sequence: Synthetic oligonucleotide
tgacaaaactgtggccctgggtcaccg

SEQ ID NO: 143088 - DNA, 27 bp, Artificial Sequence
  Description of Artificial Sequence: Synthetic oligonucleotide
gacaaaactgtggccctgggtcaccga

SEQ ID NO: 143089 - DNA, 29 bp, Artificial Sequence
  Description of Artificial Sequence: Synthetic oligonucleotide
acaaaactgtggccctgggtcaccgattg

SEQ ID NO: 143090 - DNA, 28 bp, Artificial Sequence
  Description of Artificial Sequence: Synthetic oligonucleotide
caaaactgtggccctgggtcaccgattg

SEQ ID NO: 143091 - DNA, 28 bp, Artificial Sequence
  Description of Artificial Sequence: Synthetic oligonucleotide
aaaactgtggccctgggtcaccgattgg

SEQ ID NO: 143092 - DNA, 27 bp, Artificial Sequence
  Description of Artificial Sequence: Synthetic oligonucleotide
aaactgtggccctgggtcaccgattgg

SEQ ID NO: 143093 - DNA, 27 bp, Artificial Sequence
  Description of Artificial Sequence: Synthetic oligonucleotide
aactgtggccctgggtcaccgattgga

SEQ ID NO: 143094 - DNA, 27 bp, Artificial Sequence
  Description of Artificial Sequence: Synthetic oligonucleotide
actgtggccctgggtcaccgattggat

SEQ ID NO: 143095 - DNA, 27 bp, Artificial Sequence
  Description of Artificial Sequence: Synthetic oligonucleotide
ctgtggccctgggtcaccgattggata

SEQ ID NO: 143096 - DNA, 29 bp, Artificial Sequence
  Description of Artificial Sequence: Synthetic oligonucleotide
tgtggccctgggtcaccgattggatattg

SEQ ID NO: 143097 - DNA, 28 bp, Artificial Sequence
  Description of Artificial Sequence: Synthetic oligonucleotide
gtggccctgggtcaccgattggatattg

SEQ ID NO: 143098 - DNA, 32 bp, Artificial Sequence
  Description of Artificial Sequence: Synthetic oligonucleotide
tggccctgggtcaccgattggatattgtattc

SEQ ID NO: 143099 - DNA, 31 bp, Artificial Sequence
  Description of Artificial Sequence: Synthetic oligonucleotide
ggccctgggtcaccgattggatattgtattc

SEQ ID NO: 143100 - DNA, 34 bp, Artificial Sequence
  Description of Artificial Sequence: Synthetic oligonucleotide
gccctgggtcaccgattggatattgtattctatc

SEQ ID NO: 143101 - DNA, 35 bp, Artificial Sequence
  Description of Artificial Sequence: Synthetic oligonucleotide
ccctgggtcaccgattggatattgtattctatctc

SEQ ID NO: 143102 - DNA, 35 bp, Artificial Sequence
  Description of Artificial Sequence: Synthetic oligonucleotide
cctgggtcaccgattggatattgtattctatctcc

SEQ ID NO: 143103 - DNA, 38 bp, Artificial Sequence
  Description of Artificial Sequence: Synthetic oligonucleotide
ctgggtcaccgattggatattgtattctatctccttag

SEQ ID NO: 143104 - DNA, 38 bp, Artificial Sequence
  Description of Artificial Sequence: Synthetic oligonucleotide
tgggtcaccgattggatattgtattctatctccttagg

SEQ ID NO: 143105 - DNA, 37 bp, Artificial Sequence
  Description of Artificial Sequence: Synthetic oligonucleotide
gggtcaccgattggatattgtattctatctccttagg

SEQ ID NO: 143106 - DNA, 40 bp, Artificial Sequence
  Description of Artificial Sequence: Synthetic oligonucleotide
ggtcaccgattggatattgtattctatctccttaggattg

SEQ ID NO: 143107 - DNA, 40 bp, Artificial Sequence
  Description of Artificial Sequence: Synthetic oligonucleotide
gtcaccgattggatattgtattctatctccttaggattgg

SEQ ID NO: 143108 - DNA, 40 bp, Artificial Sequence
  Description of Artificial Sequence: Synthetic oligonucleotide
tcaccgattggatattgtattctatctccttaggattggc

SEQ ID NO: 143109 - DNA, 39 bp, Artificial Sequence
  Description of Artificial Sequence: Synthetic oligonucleotide
caccgattggatattgtattctatctccttaggattggc

SEQ ID NO: 143110 - DNA, 50 bp, Artificial Sequence
  Description of Artificial Sequence: Synthetic oligonucleotide
accgattggatattgtattctatctccttaggattggcttattttatatg

SEQ ID NO: 143111 - DNA, 49 bp, Artificial Sequence
  Description of Artificial Sequence: Synthetic oligonucleotide
ccgattggatattgtattctatctccttaggattggcttattttatatg

SEQ ID NO: 143112 - DNA, 49 bp, Artificial Sequence
  Description of Artificial Sequence: Synthetic oligonucleotide
cgattggatattgtattctatctccttaggattggcttattttatatgg

SEQ ID NO: 143113 - DNA, 54 bp, Artificial Sequence
  Description of Artificial Sequence: Synthetic oligonucleotide
gattggatattgtattctatctccttaggattggcttattttatatggataatg

SEQ ID NO: 143114 - DNA, 56 bp, Artificial Sequence
  Description of Artificial Sequence: Synthetic oligonucleotide
attggatattgtattctatctccttaggattggcttattttatatggataatgatc

SEQ ID NO: 143115 - DNA, 55 bp, Artificial Sequence
  Description of Artificial Sequence: Synthetic oligonucleotide
ttggatattgtattctatctccttaggattggcttattttatatggataatgatc

SEQ ID NO: 143116 - DNA, 54 bp, Artificial Sequence
  Description of Artificial Sequence: Synthetic oligonucleotide
tggatattgtattctatctccttaggattggcttattttatatggataatgatc

SEQ ID NO: 143117 - DNA, 53 bp, Artificial Sequence
  Description of Artificial Sequence: Synthetic oligonucleotide
ggatattgtattctatctccttaggattggcttattttatatggataatgatc

SEQ ID NO: 143118 - DNA, 54 bp, Artificial Sequence
  Description of Artificial Sequence: Synthetic oligonucleotide
gatattgtattctatctccttaggattggcttattttatatggataatgatctc

SEQ ID NO: 143119 - DNA, 56 bp, Artificial Sequence
  Description of Artificial Sequence: Synthetic oligonucleotide
atattgtattctatctccttaggattggcttattttatatggataatgatctcatc

SEQ ID NO: 143120 - DNA, 55 bp, Artificial Sequence
  Description of Artificial Sequence: Synthetic oligonucleotide
tattgtattctatctccttaggattggcttattttatatggataatgatctcatc

SEQ ID NO: 143121 - DNA, 54 bp, Artificial Sequence
  Description of Artificial Sequence: Synthetic oligonucleotide
attgtattctatctccttaggattggcttattttatatggataatgatctcatc

SEQ ID NO: 143122 - DNA, 53 bp, Artificial Sequence
  Description of Artificial Sequence: Synthetic oligonucleotide
ttgtattctatctccttaggattggcttattttatatggataatgatctcatc

SEQ ID NO: 143123 - DNA, 52 bp, Artificial Sequence
  Description of Artificial Sequence: Synthetic oligonucleotide
tgtattctatctccttaggattggcttattttatatggataatgatctcatc

SEQ ID NO: 143124 - DNA, 51 bp, Artificial Sequence
  Description of Artificial Sequence: Synthetic oligonucleotide
gtattctatctccttaggattggcttattttatatggataatgatctcatc

SEQ ID NO: 143125 - DNA, 52 bp, Artificial Sequence
  Description of Artificial Sequence: Synthetic oligonucleotide
tattctatctccttaggattggcttattttatatggataatgatctcatcac

SEQ ID NO: 143126 - DNA, 51 bp, Artificial Sequence
  Description of Artificial Sequence: Synthetic oligonucleotide
attctatctccttaggattggcttattttatatggataatgatctcatcac

SEQ ID NO: 143127 - DNA, 50 bp, Artificial Sequence
  Description of Artificial Sequence: Synthetic oligonucleotide
ttctatctccttaggattggcttattttatatggataatgatctcatcac

SEQ ID NO: 143128 - DNA, 49 bp, Artificial Sequence
  Description of Artificial Sequence: Synthetic oligonucleotide
tctatctccttaggattggcttattttatatggataatgatctcatcac

SEQ ID NO: 143129 - DNA, 48 bp, Artificial Sequence
  Description of Artificial Sequence: Synthetic oligonucleotide
ctatctccttaggattggcttattttatatggataatgatctcatcac

SEQ ID NO: 143130 - DNA, 49 bp, Artificial Sequence
  Description of Artificial Sequence: Synthetic oligonucleotide
tatctccttaggattggcttattttatatggataatgatctcatcacac

SEQ ID NO: 143131 - DNA, 48 bp, Artificial Sequence
  Description of Artificial Sequence: Synthetic oligonucleotide
atctccttaggattggcttattttatatggataatgatctcatcacac

SEQ ID NO: 143132 - DNA, 47 bp, Artificial Sequence
  Description of Artificial Sequence: Synthetic oligonucleotide
tctccttaggattggcttattttatatggataatgatctcatcacac

SEQ ID NO: 143133 - DNA, 46 bp, Artificial Sequence
  Description of Artificial Sequence: Synthetic oligonucleotide
ctccttaggattggcttattttatatggataatgatctcatcacac

SEQ ID NO: 143134 - DNA, 46 bp, Artificial Sequence
  Description of Artificial Sequence: Synthetic oligonucleotide
tccttaggattggcttattttatatggataatgatctcatcacacg

SEQ ID NO: 143135 - DNA, 45 bp, Artificial Sequence
  Description of Artificial Sequence: Synthetic oligonucleotide
ccttaggattggcttattttatatggataatgatctcatcacacg

SEQ ID NO: 143136 - DNA, 48 bp, Artificial Sequence
  Description of Artificial Sequence: Synthetic oligonucleotide
cttaggattggcttattttatatggataatgatctcatcacacgaaac

SEQ ID NO: 143137 - DNA, 49 bp, Artificial Sequence
  Description of Artificial Sequence: Synthetic oligonucleotide
ttaggattggcttattttatatggataatgatctcatcacacgaaacac

SEQ ID NO: 143138 - DNA, 48 bp, Artificial Sequence
  Description of Artificial Sequence: Synthetic oligonucleotide
taggattggcttattttatatggataatgatctcatcacacgaaacac

SEQ ID NO: 143139 - DNA, 47 bp, Artificial Sequence
  Description of Artificial Sequence: Synthetic oligonucleotide
aggattggcttattttatatggataatgatctcatcacacgaaacac

SEQ ID NO: 143140 - DNA, 46 bp, Artificial Sequence
  Description of Artificial Sequence: Synthetic oligonucleotide
ggattggcttattttatatggataatgatctcatcacacgaaacac

SEQ ID NO: 143141 - DNA, 47 bp, Artificial Sequence
  Description of Artificial Sequence: Synthetic oligonucleotide
gattggcttattttatatggataatgatctcatcacacgaaacacag

SEQ ID NO: 143142 - DNA, 51 bp, Artificial Sequence
  Description of Artificial Sequence: Synthetic oligonucleotide
attggcttattttatatggataatgatctcatcacacgaaacacagaaaag

SEQ ID NO: 143143 - DNA, 50 bp, Artificial Sequence
  Description of Artificial Sequence: Synthetic oligonucleotide
ttggcttattttatatggataatgatctcatcacacgaaacacagaaaag

SEQ ID NO: 143144 - DNA, 49 bp, Artificial Sequence
  Description of Artificial Sequence: Synthetic oligonucleotide
tggcttattttatatggataatgatctcatcacacgaaacacagaaaag

SEQ ID NO: 143145 - DNA, 48 bp, Artificial Sequence
  Description of Artificial Sequence: Synthetic oligonucleotide
ggcttattttatatggataatgatctcatcacacgaaacacagaaaag

SEQ ID NO: 143146 - DNA, 48 bp, Artificial Sequence
  Description of Artificial Sequence: Synthetic oligonucleotide
gcttattttatatggataatgatctcatcacacgaaacacagaaaagg

SEQ ID NO: 143147 - DNA, 48 bp, Artificial Sequence
  Description of Artificial Sequence: Synthetic oligonucleotide
cttattttatatggataatgatctcatcacacgaaacacagaaaaggc

SEQ ID NO: 143148 - DNA, 48 bp, Artificial Sequence
  Description of Artificial Sequence: Synthetic oligonucleotide
ttattttatatggataatgatctcatcacacgaaacacagaaaaggcc

SEQ ID NO: 143149 - DNA, 47 bp, Artificial Sequence
  Description of Artificial Sequence: Synthetic oligonucleotide
tattttatatggataatgatctcatcacacgaaacacagaaaaggcc

SEQ ID NO: 143150 - DNA, 46 bp, Artificial Sequence
  Description of Artificial Sequence: Synthetic oligonucleotide
attttatatggataatgatctcatcacacgaaacacagaaaaggcc

SEQ ID NO: 143151 - DNA, 45 bp, Artificial Sequence
  Description of Artificial Sequence: Synthetic oligonucleotide
ttttatatggataatgatctcatcacacgaaacacagaaaaggcc

SEQ ID NO: 143152 - DNA, 44 bp, Artificial Sequence
  Description of Artificial Sequence: Synthetic oligonucleotide
tttatatggataatgatctcatcacacgaaacacagaaaaggcc

SEQ ID NO: 143153 - DNA, 43 bp, Artificial Sequence
  Description of Artificial Sequence: Synthetic oligonucleotide
ttatatggataatgatctcatcacacgaaacacagaaaaggcc

SEQ ID NO: 143154 - DNA, 42 bp, Artificial Sequence
  Description of Artificial Sequence: Synthetic oligonucleotide
tatatggataatgatctcatcacacgaaacacagaaaaggcc

SEQ ID NO: 143155 - DNA, 41 bp, Artificial Sequence
  Description of Artificial Sequence: Synthetic oligonucleotide
atatggataatgatctcatcacacgaaacacagaaaaggcc

SEQ ID NO: 143156 - DNA, 40 bp, Artificial Sequence
  Description of Artificial Sequence: Synthetic oligonucleotide
tatggataatgatctcatcacacgaaacacagaaaaggcc

SEQ ID NO: 143157 - DNA, 39 bp, Artificial Sequence
  Description of Artificial Sequence: Synthetic oligonucleotide
atggataatgatctcatcacacgaaacacagaaaaggcc

SEQ ID NO: 143158 - DNA, 38 bp, Artificial Sequence
  Description of Artificial Sequence: Synthetic oligonucleotide
tggataatgatctcatcacacgaaacacagaaaaggcc

SEQ ID NO: 143159 - DNA, 37 bp, Artificial Sequence
  Description of Artificial Sequence: Synthetic oligonucleotide
ggataatgatctcatcacacgaaacacagaaaaggcc

SEQ ID NO: 143160 - DNA, 41 bp, Artificial Sequence
  Description of Artificial Sequence: Synthetic oligonucleotide
gataatgatctcatcacacgaaacacagaaaaggccaaaag

SEQ ID NO: 143161 - DNA, 41 bp, Artificial Sequence
  Description of Artificial Sequence: Synthetic oligonucleotide
ataatgatctcatcacacgaaacacagaaaaggccaaaagc

SEQ ID NO: 143162 - DNA, 40 bp, Artificial Sequence
  Description of Artificial Sequence: Synthetic oligonucleotide
taatgatctcatcacacgaaacacagaaaaggccaaaagc

SEQ ID NO: 143163 - DNA, 39 bp, Artificial Sequence
  Description of Artificial Sequence: Synthetic oligonucleotide
aatgatctcatcacacgaaacacagaaaaggccaaaagc

SEQ ID NO: 143164 - DNA, 38 bp, Artificial Sequence
  Description of Artificial Sequence: Synthetic oligonucleotide
atgatctcatcacacgaaacacagaaaaggccaaaagc

SEQ ID NO: 143165 - DNA, 37 bp, Artificial Sequence
  Description of Artificial Sequence: Synthetic oligonucleotide
tgatctcatcacacgaaacacagaaaaggccaaaagc

SEQ ID NO: 143166 - DNA, 36 bp, Artificial Sequence
  Description of Artificial Sequence: Synthetic oligonucleotide
gatctcatcacacgaaacacagaaaaggccaaaagc

SEQ ID NO: 143167 - DNA, 42 bp, Artificial Sequence
  Description of Artificial Sequence: Synthetic oligonucleotide
atctcatcacacgaaacacagaaaaggccaaaagcttaatag

SEQ ID NO: 143168 - DNA, 41 bp, Artificial Sequence
  Description of Artificial Sequence: Synthetic oligonucleotide
tctcatcacacgaaacacagaaaaggccaaaagcttaatag

SEQ ID NO: 143169 - DNA, 40 bp, Artificial Sequence
  Description of Artificial Sequence: Synthetic oligonucleotide
ctcatcacacgaaacacagaaaaggccaaaagcttaatag

SEQ ID NO: 143170 - DNA, 42 bp, Artificial Sequence
  Description of Artificial Sequence: Synthetic oligonucleotide
tcatcacacgaaacacagaaaaggccaaaagcttaatagaag

SEQ ID NO: 143171 - DNA, 41 bp, Artificial Sequence
  Description of Artificial Sequence: Synthetic oligonucleotide
catcacacgaaacacagaaaaggccaaaagcttaatagaag

SEQ ID NO: 143172 - DNA, 43 bp, Artificial Sequence
  Description of Artificial Sequence: Synthetic oligonucleotide
atcacacgaaacacagaaaaggccaaaagcttaatagaagaag

SEQ ID NO: 143173 - DNA, 42 bp, Artificial Sequence
  Description of Artificial Sequence: Synthetic oligonucleotide
tcacacgaaacacagaaaaggccaaaagcttaatagaagaag

SEQ ID NO: 143174 - DNA, 41 bp, Artificial Sequence
  Description of Artificial Sequence: Synthetic oligonucleotide
cacacgaaacacagaaaaggccaaaagcttaatagaagaag

SEQ ID NO: 143175 - DNA, 41 bp, Artificial Sequence
  Description of Artificial Sequence: Synthetic oligonucleotide
acacgaaacacagaaaaggccaaaagcttaatagaagaagg

SEQ ID NO: 143176 - DNA, 40 bp, Artificial Sequence
  Description of Artificial Sequence: Synthetic oligonucleotide
cacgaaacacagaaaaggccaaaagcttaatagaagaagg

SEQ ID NO: 143177 - DNA, 41 bp, Artificial Sequence
  Description of Artificial Sequence: Synthetic oligonucleotide
acgaaacacagaaaaggccaaaagcttaatagaagaaggag

SEQ ID NO: 143178 - DNA, 40 bp, Artificial Sequence
  Description of Artificial Sequence: Synthetic oligonucleotide
cgaaacacagaaaaggccaaaagcttaatagaagaaggag

SEQ ID NO: 143179 - DNA, 40 bp, Artificial Sequence
  Description of Artificial Sequence: Synthetic oligonucleotide
gaaacacagaaaaggccaaaagcttaatagaagaaggagg

SEQ ID NO: 143180 - DNA, 41 bp, Artificial Sequence
  Description of Artificial Sequence: Synthetic oligonucleotide
aaacacagaaaaggccaaaagcttaatagaagaaggaggag

SEQ ID NO: 143181 - DNA, 40 bp, Artificial Sequence
  Description of Artificial Sequence: Synthetic oligonucleotide
aacacagaaaaggccaaaagcttaatagaagaaggaggag

SEQ ID NO: 143182 - DNA, 39 bp, Artificial Sequence
  Description of Artificial Sequence: Synthetic oligonucleotide
acacagaaaaggccaaaagcttaatagaagaaggaggag

SEQ ID NO: 143183 - DNA, 38 bp, Artificial Sequence
  Description of Artificial Sequence: Synthetic oligonucleotide
cacagaaaaggccaaaagcttaatagaagaaggaggag

SEQ ID NO: 143184 - DNA, 39 bp, Artificial Sequence
  Description of Artificial Sequence: Synthetic oligonucleotide
acagaaaaggccaaaagcttaatagaagaaggaggagac

SEQ ID NO: 143185 - DNA, 38 bp, Artificial Sequence
  Description of Artificial Sequence: Synthetic oligonucleotide
cagaaaaggccaaaagcttaatagaagaaggaggagac

SEQ ID NO: 143186 - DNA, 39 bp, Artificial Sequence
  Description of Artificial Sequence: Synthetic oligonucleotide
agaaaaggccaaaagcttaatagaagaaggaggagactg

SEQ ID NO: 143187 - DNA, 38 bp, Artificial Sequence
  Description of Artificial Sequence: Synthetic oligonucleotide
gaaaaggccaaaagcttaatagaagaaggaggagactg

SEQ ID NO: 143188 - DNA, 38 bp, Artificial Sequence
  Description of Artificial Sequence: Synthetic oligonucleotide
aaaaggccaaaagcttaatagaagaaggaggagactgg

SEQ ID NO: 143189 - DNA, 37 bp, Artificial Sequence
  Description of Artificial Sequence: Synthetic oligonucleotide
aaaggccaaaagcttaatagaagaaggaggagactgg

SEQ ID NO: 143190 - DNA, 36 bp, Artificial Sequence
  Description of Artificial Sequence: Synthetic oligonucleotide
aaggccaaaagcttaatagaagaaggaggagactgg

SEQ ID NO: 143191 - DNA, 35 bp, Artificial Sequence
  Description of Artificial Sequence: Synthetic oligonucleotide
aggccaaaagcttaatagaagaaggaggagactgg

SEQ ID NO: 143192 - DNA, 34 bp, Artificial Sequence
  Description of Artificial Sequence: Synthetic oligonucleotide
ggccaaaagcttaatagaagaaggaggagactgg

SEQ ID NO: 143193 - DNA, 34 bp, Artificial Sequence
  Description of Artificial Sequence: Synthetic oligonucleotide
gccaaaagcttaatagaagaaggaggagactggg

SEQ ID NO: 143194 - DNA, 35 bp, Artificial Sequence
  Description of Artificial Sequence: Synthetic oligonucleotide
ccaaaagcttaatagaagaaggaggagactgggac

SEQ ID NO: 143195 - DNA, 36 bp, Artificial Sequence
  Description of Artificial Sequence: Synthetic oligonucleotide
caaaagcttaatagaagaaggaggagactgggacag

SEQ ID NO: 143196 - DNA, 36 bp, Artificial Sequence
  Description of Artificial Sequence: Synthetic oligonucleotide
aaaagcttaatagaagaaggaggagactgggacagg

SEQ ID NO: 143197 - DNA, 35 bp, Artificial Sequence
  Description of Artificial Sequence: Synthetic oligonucleotide
aaagcttaatagaagaaggaggagactgggacagg

SEQ ID NO: 143198 - DNA, 34 bp, Artificial Sequence
  Description of Artificial Sequence: Synthetic oligonucleotide
aagcttaatagaagaaggaggagactgggacagg

SEQ ID NO: 143199 - DNA, 33 bp, Artificial Sequence
  Description of Artificial Sequence: Synthetic oligonucleotide
agcttaatagaagaaggaggagactgggacagg

SEQ ID NO: 143200 - DNA, 32 bp, Artificial Sequence
  Description of Artificial Sequence: Synthetic oligonucleotide
gcttaatagaagaaggaggagactgggacagg

SEQ ID NO: 143201 - DNA, 33 bp, Artificial Sequence
  Description of Artificial Sequence: Synthetic oligonucleotide
cttaatagaagaaggaggagactgggacaggag

SEQ ID NO: 143202 - DNA, 36 bp, Artificial Sequence
  Description of Artificial Sequence: Synthetic oligonucleotide
ttaatagaagaaggaggagactgggacaggagaaac

SEQ ID NO: 143203 - DNA, 35 bp, Artificial Sequence
  Description of Artificial Sequence: Synthetic oligonucleotide
taatagaagaaggaggagactgggacaggagaaac

SEQ ID NO: 143204 - DNA, 34 bp, Artificial Sequence
  Description of Artificial Sequence: Synthetic oligonucleotide
aatagaagaaggaggagactgggacaggagaaac

SEQ ID NO: 143205 - DNA, 33 bp, Artificial Sequence
  Description of Artificial Sequence: Synthetic oligonucleotide
atagaagaaggaggagactgggacaggagaaac

SEQ ID NO: 143206 - DNA, 32 bp, Artificial Sequence
  Description of Artificial Sequence: Synthetic oligonucleotide
tagaagaaggaggagactgggacaggagaaac

SEQ ID NO: 143207 - DNA, 31 bp, Artificial Sequence
  Description of Artificial Sequence: Synthetic oligonucleotide
agaagaaggaggagactgggacaggagaaac

SEQ ID NO: 143208 - DNA, 30 bp, Artificial Sequence
  Description of Artificial Sequence: Synthetic oligonucleotide
gaagaaggaggagactgggacaggagaaac

SEQ ID NO: 143209 - DNA, 30 bp, Artificial Sequence
  Description of Artificial Sequence: Synthetic oligonucleotide
aagaaggaggagactgggacaggagaaacc

SEQ ID NO: 143210 - DNA, 29 bp, Artificial Sequence
  Description of Artificial Sequence: Synthetic oligonucleotide
agaaggaggagactgggacaggagaaacc

SEQ ID NO: 143211 - DNA, 28 bp, Artificial Sequence
  Description of Artificial Sequence: Synthetic oligonucleotide
gaaggaggagactgggacaggagaaacc

SEQ ID NO: 143212 - DNA, 28 bp, Artificial Sequence
  Description of Artificial Sequence: Synthetic oligonucleotide
aaggaggagactgggacaggagaaaccg

SEQ ID NO: 143213 - DNA, 27 bp, Artificial Sequence
  Description of Artificial Sequence: Synthetic oligonucleotide
aggaggagactgggacaggagaaaccg

SEQ ID NO: 143214 - DNA, 26 bp, Artificial Sequence
  Description of Artificial Sequence: Synthetic oligonucleotide
ggaggagactgggacaggagaaaccg

SEQ ID NO: 143215 - DNA, 26 bp, Artificial Sequence
  Description of Artificial Sequence: Synthetic oligonucleotide
gaggagactgggacaggagaaaccgc

SEQ ID NO: 143216 - DNA, 27 bp, Artificial Sequence
  Description of Artificial Sequence: Synthetic oligonucleotide
aggagactgggacaggagaaaccgcct

SEQ ID NO: 143217 - DNA, 27 bp, Artificial Sequence
  Description of Artificial Sequence: Synthetic oligonucleotide
ggagactgggacaggagaaaccgccta

SEQ ID NO: 143218 - DNA, 30 bp, Artificial Sequence
  Description of Artificial Sequence: Synthetic oligonucleotide
gagactgggacaggagaaaccgcctaaaag

SEQ ID NO: 143219 - DNA, 31 bp, Artificial Sequence
  Description of Artificial Sequence: Synthetic oligonucleotide
agactgggacaggagaaaccgcctaaaagtg

SEQ ID NO: 143220 - DNA, 30 bp, Artificial Sequence
  Description of Artificial Sequence: Synthetic oligonucleotide
gactgggacaggagaaaccgcctaaaagtg

SEQ ID NO: 143221 - DNA, 33 bp, Artificial Sequence
  Description of Artificial Sequence: Synthetic oligonucleotide
actgggacaggagaaaccgcctaaaagtgtatc

SEQ ID NO: 143222 - DNA, 32 bp, Artificial Sequence
  Description of Artificial Sequence: Synthetic oligonucleotide
ctgggacaggagaaaccgcctaaaagtgtatc

SEQ ID NO: 143223 - DNA, 33 bp, Artificial Sequence
  Description of Artificial Sequence: Synthetic oligonucleotide
tgggacaggagaaaccgcctaaaagtgtatcag

SEQ ID NO: 143224 - DNA, 32 bp, Artificial Sequence
  Description of Artificial Sequence: Synthetic oligonucleotide
gggacaggagaaaccgcctaaaagtgtatcag

SEQ ID NO: 143225 - DNA, 32 bp, Artificial Sequence
  Description of Artificial Sequence: Synthetic oligonucleotide
ggacaggagaaaccgcctaaaagtgtatcagg

SEQ ID NO: 143226 - DNA, 32 bp, Artificial Sequence
  Description of Artificial Sequence: Synthetic oligonucleotide
gacaggagaaaccgcctaaaagtgtatcaggg

SEQ ID NO: 143227 - DNA, 33 bp, Artificial Sequence
  Description of Artificial Sequence: Synthetic oligonucleotide
acaggagaaaccgcctaaaagtgtatcagggtc

SEQ ID NO: 143228 - DNA, 32 bp, Artificial Sequence
  Description of Artificial Sequence: Synthetic oligonucleotide
caggagaaaccgcctaaaagtgtatcagggtc

SEQ ID NO: 143229 - DNA, 38 bp, Artificial Sequence
  Description of Artificial Sequence: Synthetic oligonucleotide
aggagaaaccgcctaaaagtgtatcagggtctttattg

SEQ ID NO: 143230 - DNA, 37 bp, Artificial Sequence
  Description of Artificial Sequence: Synthetic oligonucleotide
ggagaaaccgcctaaaagtgtatcagggtctttattg

SEQ ID NO: 143231 - DNA, 38 bp, Artificial Sequence
  Description of Artificial Sequence: Synthetic oligonucleotide
gagaaaccgcctaaaagtgtatcagggtctttattgtg

SEQ ID NO: 143232 - DNA, 39 bp, Artificial Sequence
  Description of Artificial Sequence: Synthetic oligonucleotide
agaaaccgcctaaaagtgtatcagggtctttattgtgtg

SEQ ID NO: 143233 - DNA, 38 bp, Artificial Sequence
  Description of Artificial Sequence: Synthetic oligonucleotide
gaaaccgcctaaaagtgtatcagggtctttattgtgtg

SEQ ID NO: 143234 - DNA, 38 bp, Artificial Sequence
  Description of Artificial Sequence: Synthetic oligonucleotide
aaaccgcctaaaagtgtatcagggtctttattgtgtgg

SEQ ID NO: 143235 - DNA, 37 bp, Artificial Sequence
  Description of Artificial Sequence: Synthetic oligonucleotide
aaccgcctaaaagtgtatcagggtctttattgtgtgg

SEQ ID NO: 143236 - DNA, 36 bp, Artificial Sequence
  Description of Artificial Sequence: Synthetic oligonucleotide
accgcctaaaagtgtatcagggtctttattgtgtgg

SEQ ID NO: 143237 - DNA, 35 bp, Artificial Sequence
  Description of Artificial Sequence: Synthetic oligonucleotide
ccgcctaaaagtgtatcagggtctttattgtgtgg

SEQ ID NO: 143238 - DNA, 35 bp, Artificial Sequence
  Description of Artificial Sequence: Synthetic oligonucleotide
cgcctaaaagtgtatcagggtctttattgtgtggc

SEQ ID NO: 143239 - DNA, 39 bp, Artificial Sequence
  Description of Artificial Sequence: Synthetic oligonucleotide
gcctaaaagtgtatcagggtctttattgtgtggctattc

SEQ ID NO: 143240 - DNA, 39 bp, Artificial Sequence
  Description of Artificial Sequence: Synthetic oligonucleotide
cctaaaagtgtatcagggtctttattgtgtggctattcg

SEQ ID NO: 143241 - DNA, 40 bp, Artificial Sequence
  Description of Artificial Sequence: Synthetic oligonucleotide
ctaaaagtgtatcagggtctttattgtgtggctattcgtg

SEQ ID NO: 143242 - DNA, 44 bp, Artificial Sequence
  Description of Artificial Sequence: Synthetic oligonucleotide
taaaagtgtatcagggtctttattgtgtggctattcgtgatttc

SEQ ID NO: 143243 - DNA, 43 bp, Artificial Sequence
  Description of Artificial Sequence: Synthetic oligonucleotide
aaaagtgtatcagggtctttattgtgtggctattcgtgatttc

SEQ ID NO: 143244 - DNA, 42 bp, Artificial Sequence
  Description of Artificial Sequence: Synthetic oligonucleotide
aaagtgtatcagggtctttattgtgtggctattcgtgatttc

SEQ ID NO: 143245 - DNA, 41 bp, Artificial Sequence
  Description of Artificial Sequence: Synthetic oligonucleotide
aagtgtatcagggtctttattgtgtggctattcgtgatttc

SEQ ID NO: 143246 - DNA, 40 bp, Artificial Sequence
  Description of Artificial Sequence: Synthetic oligonucleotide
agtgtatcagggtctttattgtgtggctattcgtgatttc

SEQ ID NO: 143247 - DNA, 39 bp, Artificial Sequence
  Description of Artificial Sequence: Synthetic oligonucleotide
gtgtatcagggtctttattgtgtggctattcgtgatttc

SEQ ID NO: 143248 - DNA, 42 bp, Artificial Sequence
  Description of Artificial Sequence: Synthetic oligonucleotide
tgtatcagggtctttattgtgtggctattcgtgatttcaaac

SEQ ID NO: 143249 - DNA, 41 bp, Artificial Sequence
  Description of Artificial Sequence: Synthetic oligonucleotide
gtatcagggtctttattgtgtggctattcgtgatttcaaac

SEQ ID NO: 143250 - DNA, 42 bp, Artificial Sequence
  Description of Artificial Sequence: Synthetic oligonucleotide
tatcagggtctttattgtgtggctattcgtgatttcaaacag

SEQ ID NO: 143251 - DNA, 41 bp, Artificial Sequence
  Description of Artificial Sequence: Synthetic oligonucleotide
atcagggtctttattgtgtggctattcgtgatttcaaacag

SEQ ID NO: 143252 - DNA, 40 bp, Artificial Sequence
  Description of Artificial Sequence: Synthetic oligonucleotide
tcagggtctttattgtgtggctattcgtgatttcaaacag

SEQ ID NO: 143253 - DNA, 39 bp, Artificial Sequence
  Description of Artificial Sequence: Synthetic oligonucleotide
cagggtctttattgtgtggctattcgtgatttcaaacag

SEQ ID NO: 143254 - DNA, 39 bp, Artificial Sequence
  Description of Artificial Sequence: Synthetic oligonucleotide
agggtctttattgtgtggctattcgtgatttcaaacagg

SEQ ID NO: 143255 - DNA, 38 bp, Artificial Sequence
  Description of Artificial Sequence: Synthetic oligonucleotide
gggtctttattgtgtggctattcgtgatttcaaacagg

SEQ ID NO: 143256 - DNA, 38 bp, Artificial Sequence
  Description of Artificial Sequence: Synthetic oligonucleotide
ggtctttattgtgtggctattcgtgatttcaaacaggc

SEQ ID NO: 143257 - DNA, 39 bp, Artificial Sequence
  Description of Artificial Sequence: Synthetic oligonucleotide
gtctttattgtgtggctattcgtgatttcaaacaggcag

SEQ ID NO: 143258 - DNA, 39 bp, Artificial Sequence
  Description of Artificial Sequence: Synthetic oligonucleotide
tctttattgtgtggctattcgtgatttcaaacaggcagc

SEQ ID NO: 143259 - DNA, 38 bp, Artificial Sequence
  Description of Artificial Sequence: Synthetic oligonucleotide
ctttattgtgtggctattcgtgatttcaaacaggcagc

SEQ ID NO: 143260 - DNA, 39 bp, Artificial Sequence
  Description of Artificial Sequence: Synthetic oligonucleotide
tttattgtgtggctattcgtgatttcaaacaggcagctg

SEQ ID NO: 143261 - DNA, 38 bp, Artificial Sequence
  Description of Artificial Sequence: Synthetic oligonucleotide
ttattgtgtggctattcgtgatttcaaacaggcagctg

SEQ ID NO: 143262 - DNA, 37 bp, Artificial Sequence
  Description of Artificial Sequence: Synthetic oligonucleotide
tattgtgtggctattcgtgatttcaaacaggcagctg

SEQ ID NO: 143263 - DNA, 36 bp, Artificial Sequence
  Description of Artificial Sequence: Synthetic oligonucleotide
attgtgtggctattcgtgatttcaaacaggcagctg

SEQ ID NO: 143264 - DNA, 35 bp, Artificial Sequence
  Description of Artificial Sequence: Synthetic oligonucleotide
ttgtgtggctattcgtgatttcaaacaggcagctg

SEQ ID NO: 143265 - DNA, 34 bp, Artificial Sequence
  Description of Artificial Sequence: Synthetic oligonucleotide
tgtgtggctattcgtgatttcaaacaggcagctg

SEQ ID NO: 143266 - DNA, 33 bp, Artificial Sequence
  Description of Artificial Sequence: Synthetic oligonucleotide
gtgtggctattcgtgatttcaaacaggcagctg

SEQ ID NO: 143267 - DNA, 35 bp, Artificial Sequence
  Description of Artificial Sequence: Synthetic oligonucleotide
tgtggctattcgtgatttcaaacaggcagctgaac

SEQ ID NO: 143268 - DNA, 34 bp, Artificial Sequence
  Description of Artificial Sequence: Synthetic oligonucleotide
gtggctattcgtgatttcaaacaggcagctgaac

SEQ ID NO: 143269 - DNA, 35 bp, Artificial Sequence
  Description of Artificial Sequence: Synthetic oligonucleotide
tggctattcgtgatttcaaacaggcagctgaactc

SEQ ID NO: 143270 - DNA, 34 bp, Artificial Sequence
  Description of Artificial Sequence: Synthetic oligonucleotide
ggctattcgtgatttcaaacaggcagctgaactc

SEQ ID NO: 143271 - DNA, 36 bp, Artificial Sequence
  Description of Artificial Sequence: Synthetic oligonucleotide
gctattcgtgatttcaaacaggcagctgaactcttc

SEQ ID NO: 143272 - DNA, 36 bp, Artificial Sequence
  Description of Artificial Sequence: Synthetic oligonucleotide
ctattcgtgatttcaaacaggcagctgaactcttcc

SEQ ID NO: 143273 - DNA, 38 bp, Artificial Sequence
  Description of Artificial Sequence: Synthetic oligonucleotide
tattcgtgatttcaaacaggcagctgaactcttccttg

SEQ ID NO: 143274 - DNA, 37 bp, Artificial Sequence
  Description of Artificial Sequence: Synthetic oligonucleotide
attcgtgatttcaaacaggcagctgaactcttccttg

SEQ ID NO: 143275 - DNA, 36 bp, Artificial Sequence
  Description of Artificial Sequence: Synthetic oligonucleotide
ttcgtgatttcaaacaggcagctgaactcttccttg

SEQ ID NO: 143276 - DNA, 35 bp, Artificial Sequence
  Description of Artificial Sequence: Synthetic oligonucleotide
tcgtgatttcaaacaggcagctgaactcttccttg

SEQ ID NO: 143277 - DNA, 34 bp, Artificial Sequence
  Description of Artificial Sequence: Synthetic oligonucleotide
cgtgatttcaaacaggcagctgaactcttccttg

SEQ ID NO: 143278 - DNA, 35 bp, Artificial Sequence
  Description of Artificial Sequence: Synthetic oligonucleotide
gtgatttcaaacaggcagctgaactcttccttgac

SEQ ID NO: 143279 - DNA, 36 bp, Artificial Sequence
  Description of Artificial Sequence: Synthetic oligonucleotide
tgatttcaaacaggcagctgaactcttccttgacac

SEQ ID NO: 143280 - DNA, 35 bp, Artificial Sequence
  Description of Artificial Sequence: Synthetic oligonucleotide
gatttcaaacaggcagctgaactcttccttgacac

SEQ ID NO: 143281 - DNA, 36 bp, Artificial Sequence
  Description of Artificial Sequence: Synthetic oligonucleotide
atttcaaacaggcagctgaactcttccttgacactg

SEQ ID NO: 143282 - DNA, 35 bp, Artificial Sequence
  Description of Artificial Sequence: Synthetic oligonucleotide
tttcaaacaggcagctgaactcttccttgacactg

SEQ ID NO: 143283 - DNA, 34 bp, Artificial Sequence
  Description of Artificial Sequence: Synthetic oligonucleotide
ttcaaacaggcagctgaactcttccttgacactg

SEQ ID NO: 143284 - DNA, 33 bp, Artificial Sequence
  Description of Artificial Sequence: Synthetic oligonucleotide
tcaaacaggcagctgaactcttccttgacactg

SEQ ID NO: 143285 - DNA, 32 bp, Artificial Sequence
  Description of Artificial Sequence: Synthetic oligonucleotide
caaacaggcagctgaactcttccttgacactg

SEQ ID NO: 143286 - DNA, 35 bp, Artificial Sequence
  Description of Artificial Sequence: Synthetic oligonucleotide
aaacaggcagctgaactcttccttgacactgtttc

SEQ ID NO: 143287 - DNA, 34 bp, Artificial Sequence
  Description of Artificial Sequence: Synthetic oligonucleotide
aacaggcagctgaactcttccttgacactgtttc

SEQ ID NO: 143288 - DNA, 33 bp, Artificial Sequence
  Description of Artificial Sequence: Synthetic oligonucleotide
acaggcagctgaactcttccttgacactgtttc

SEQ ID NO: 143289 - DNA, 32 bp, Artificial Sequence
  Description of Artificial Sequence: Synthetic oligonucleotide
caggcagctgaactcttccttgacactgtttc

SEQ ID NO: 143290 - DNA, 34 bp, Artificial Sequence
  Description of Artificial Sequence: Synthetic oligonucleotide
aggcagctgaactcttccttgacactgtttcaac

SEQ ID NO: 143291 - DNA, 33 bp, Artificial Sequence
  Description of Artificial Sequence: Synthetic oligonucleotide
ggcagctgaactcttccttgacactgtttcaac

SEQ ID NO: 143292 - DNA, 38 bp, Artificial Sequence
  Description of Artificial Sequence: Synthetic oligonucleotide
gcagctgaactcttccttgacactgtttcaacatttac

SEQ ID NO: 143293 - DNA, 40 bp, Artificial Sequence
  Description of Artificial Sequence: Synthetic oligonucleotide
cagctgaactcttccttgacactgtttcaacatttacatc

SEQ ID NO: 143294 - DNA, 40 bp, Artificial Sequence
  Description of Artificial Sequence: Synthetic oligonucleotide
agctgaactcttccttgacactgtttcaacatttacatcc

SEQ ID NO: 143295 - DNA, 39 bp, Artificial Sequence
  Description of Artificial Sequence: Synthetic oligonucleotide
gctgaactcttccttgacactgtttcaacatttacatcc

SEQ ID NO: 143296 - DNA, 42 bp, Artificial Sequence
  Description of Artificial Sequence: Synthetic oligonucleotide
ctgaactcttccttgacactgtttcaacatttacatcctatg

SEQ ID NO: 143297 - DNA, 44 bp, Artificial Sequence
  Description of Artificial Sequence: Synthetic oligonucleotide
tgaactcttccttgacactgtttcaacatttacatcctatgaac

SEQ ID NO: 143298 - DNA, 43 bp, Artificial Sequence
  Description of Artificial Sequence: Synthetic oligonucleotide
gaactcttccttgacactgtttcaacatttacatcctatgaac

SEQ ID NO: 143299 - DNA, 44 bp, Artificial Sequence
  Description of Artificial Sequence: Synthetic oligonucleotide
aactcttccttgacactgtttcaacatttacatcctatgaactc

SEQ ID NO: 143300 - DNA, 43 bp, Artificial Sequence
  Description of Artificial Sequence: Synthetic oligonucleotide
actcttccttgacactgtttcaacatttacatcctatgaactc

SEQ ID NO: 143301 - DNA, 42 bp, Artificial Sequence
  Description of Artificial Sequence: Synthetic oligonucleotide
ctcttccttgacactgtttcaacatttacatcctatgaactc

SEQ ID NO: 143302 - DNA, 44 bp, Artificial Sequence
  Description of Artificial Sequence: Synthetic oligonucleotide
tcttccttgacactgtttcaacatttacatcctatgaactcatg

SEQ ID NO: 143303 - DNA, 43 bp, Artificial Sequence
  Description of Artificial Sequence: Synthetic oligonucleotide
cttccttgacactgtttcaacatttacatcctatgaactcatg

SEQ ID NO: 143304 - DNA, 43 bp, Artificial Sequence
  Description of Artificial Sequence: Synthetic oligonucleotide
ttccttgacactgtttcaacatttacatcctatgaactcatgg

SEQ ID NO: 143305 - DNA, 42 bp, Artificial Sequence
  Description of Artificial Sequence: Synthetic oligonucleotide
tccttgacactgtttcaacatttacatcctatgaactcatgg

SEQ ID NO: 143306 - DNA, 41 bp, Artificial Sequence
  Description of Artificial Sequence: Synthetic oligonucleotide
ccttgacactgtttcaacatttacatcctatgaactcatgg

SEQ ID NO: 143307 - DNA, 50 bp, Artificial Sequence
  Description of Artificial Sequence: Synthetic oligonucleotide
cttgacactgtttcaacatttacatcctatgaactcatggattataaaac

SEQ ID NO: 143308 - DNA, 54 bp, Artificial Sequence
  Description of Artificial Sequence: Synthetic oligonucleotide
ttgacactgtttcaacatttacatcctatgaactcatggattataaaacatttg

SEQ ID NO: 143309 - DNA, 53 bp, Artificial Sequence
  Description of Artificial Sequence: Synthetic oligonucleotide
tgacactgtttcaacatttacatcctatgaactcatggattataaaacatttg

SEQ ID NO: 143310 - DNA, 52 bp, Artificial Sequence
  Description of Artificial Sequence: Synthetic oligonucleotide
gacactgtttcaacatttacatcctatgaactcatggattataaaacatttg

SEQ ID NO: 143311 - DNA, 53 bp, Artificial Sequence
  Description of Artificial Sequence: Synthetic oligonucleotide
acactgtttcaacatttacatcctatgaactcatggattataaaacatttgtg

SEQ ID NO: 143312 - DNA, 52 bp, Artificial Sequence
  Description of Artificial Sequence: Synthetic oligonucleotide
cactgtttcaacatttacatcctatgaactcatggattataaaacatttgtg

SEQ ID NO: 143313 - DNA, 53 bp, Artificial Sequence
  Description of Artificial Sequence: Synthetic oligonucleotide
actgtttcaacatttacatcctatgaactcatggattataaaacatttgtgac

SEQ ID NO: 143314 - DNA, 52 bp, Artificial Sequence
  Description of Artificial Sequence: Synthetic oligonucleotide
ctgtttcaacatttacatcctatgaactcatggattataaaacatttgtgac

SEQ ID NO: 143315 - DNA, 57 bp, Artificial Sequence
  Description of Artificial Sequence: Synthetic oligonucleotide
tgtttcaacatttacatcctatgaactcatggattataaaacatttgtgacttatac

SEQ ID NO: 143316 - DNA, 56 bp, Artificial Sequence
  Description of Artificial Sequence: Synthetic oligonucleotide
gtttcaacatttacatcctatgaactcatggattataaaacatttgtgacttatac

SEQ ID NO: 143317 - DNA, 57 bp, Artificial Sequence
  Description of Artificial Sequence: Synthetic oligonucleotide
tttcaacatttacatcctatgaactcatggattataaaacatttgtgacttatactg

SEQ ID NO: 143318 - DNA, 56 bp, Artificial Sequence
  Description of Artificial Sequence: Synthetic oligonucleotide
ttcaacatttacatcctatgaactcatggattataaaacatttgtgacttatactg

SEQ ID NO: 143319 - DNA, 55 bp, Artificial Sequence
  Description of Artificial Sequence: Synthetic oligonucleotide
tcaacatttacatcctatgaactcatggattataaaacatttgtgacttatactg

SEQ ID NO: 143320 - DNA, 54 bp, Artificial Sequence
  Description of Artificial Sequence: Synthetic oligonucleotide
caacatttacatcctatgaactcatggattataaaacatttgtgacttatactg

SEQ ID NO: 143321 - DNA, 55 bp, Artificial Sequence
  Description of Artificial Sequence: Synthetic oligonucleotide
aacatttacatcctatgaactcatggattataaaacatttgtgacttatactgtc

SEQ ID NO: 143322 - DNA, 54 bp, Artificial Sequence
  Description of Artificial Sequence: Synthetic oligonucleotide
acatttacatcctatgaactcatggattataaaacatttgtgacttatactgtc

SEQ ID NO: 143323 - DNA, 53 bp, Artificial Sequence
  Description of Artificial Sequence: Synthetic oligonucleotide
catttacatcctatgaactcatggattataaaacatttgtgacttatactgtc

SEQ ID NO: 143324 - DNA, 56 bp, Artificial Sequence
  Description of Artificial Sequence: Synthetic oligonucleotide
atttacatcctatgaactcatggattataaaacatttgtgacttatactgtctatg

SEQ ID NO: 143325 - DNA, 55 bp, Artificial Sequence
  Description of Artificial Sequence: Synthetic oligonucleotide
tttacatcctatgaactcatggattataaaacatttgtgacttatactgtctatg

SEQ ID NO: 143326 - DNA, 54 bp, Artificial Sequence
  Description of Artificial Sequence: Synthetic oligonucleotide
ttacatcctatgaactcatggattataaaacatttgtgacttatactgtctatg

SEQ ID NO: 143327 - DNA, 53 bp, Artificial Sequence
  Description of Artificial Sequence: Synthetic oligonucleotide
tacatcctatgaactcatggattataaaacatttgtgacttatactgtctatg

SEQ ID NO: 143328 - DNA, 52 bp, Artificial Sequence
  Description of Artificial Sequence: Synthetic oligonucleotide
acatcctatgaactcatggattataaaacatttgtgacttatactgtctatg

SEQ ID NO: 143329 - DNA, 51 bp, Artificial Sequence
  Description of Artificial Sequence: Synthetic oligonucleotide
catcctatgaactcatggattataaaacatttgtgacttatactgtctatg

SEQ ID NO: 143330 - DNA, 52 bp, Artificial Sequence
  Description of Artificial Sequence: Synthetic oligonucleotide
atcctatgaactcatggattataaaacatttgtgacttatactgtctatgtc

SEQ ID NO: 143331 - DNA, 51 bp, Artificial Sequence
  Description of Artificial Sequence: Synthetic oligonucleotide
tcctatgaactcatggattataaaacatttgtgacttatactgtctatgtc

SEQ ID NO: 143332 - DNA, 50 bp, Artificial Sequence
  Description of Artificial Sequence: Synthetic oligonucleotide
cctatgaactcatggattataaaacatttgtgacttatactgtctatgtc

SEQ ID NO: 143333 - DNA, 51 bp, Artificial Sequence
  Description of Artificial Sequence: Synthetic oligonucleotide
ctatgaactcatggattataaaacatttgtgacttatactgtctatgtcag

SEQ ID NO: 143334 - DNA, 54 bp, Artificial Sequence
  Description of Artificial Sequence: Synthetic oligonucleotide
tatgaactcatggattataaaacatttgtgacttatactgtctatgtcagtatg

SEQ ID NO: 143335 - DNA, 53 bp, Artificial Sequence
  Description of Artificial Sequence: Synthetic oligonucleotide
atgaactcatggattataaaacatttgtgacttatactgtctatgtcagtatg

SEQ ID NO: 143336 - DNA, 52 bp, Artificial Sequence
  Description of Artificial Sequence: Synthetic oligonucleotide
tgaactcatggattataaaacatttgtgacttatactgtctatgtcagtatg

SEQ ID NO: 143337 - DNA, 51 bp, Artificial Sequence
  Description of Artificial Sequence: Synthetic oligonucleotide
gaactcatggattataaaacatttgtgacttatactgtctatgtcagtatg

SEQ ID NO: 143338 - DNA, 54 bp, Artificial Sequence
  Description of Artificial Sequence: Synthetic oligonucleotide
aactcatggattataaaacatttgtgacttatactgtctatgtcagtatgattg

SEQ ID NO: 143339 - DNA, 53 bp, Artificial Sequence
  Description of Artificial Sequence: Synthetic oligonucleotide
actcatggattataaaacatttgtgacttatactgtctatgtcagtatgattg

SEQ ID NO: 143340 - DNA, 52 bp, Artificial Sequence
  Description of Artificial Sequence: Synthetic oligonucleotide
ctcatggattataaaacatttgtgacttatactgtctatgtcagtatgattg

SEQ ID NO: 143341 - DNA, 52 bp, Artificial Sequence
  Description of Artificial Sequence: Synthetic oligonucleotide
tcatggattataaaacatttgtgacttatactgtctatgtcagtatgattgc

SEQ ID NO: 143342 - DNA, 51 bp, Artificial Sequence
  Description of Artificial Sequence: Synthetic oligonucleotide
catggattataaaacatttgtgacttatactgtctatgtcagtatgattgc

SEQ ID NO: 143343 - DNA, 51 bp, Artificial Sequence
  Description of Artificial Sequence: Synthetic oligonucleotide
atggattataaaacatttgtgacttatactgtctatgtcagtatgattgcc

SEQ ID NO: 143344 - DNA, 50 bp, Artificial Sequence
  Description of Artificial Sequence: Synthetic oligonucleotide
tggattataaaacatttgtgacttatactgtctatgtcagtatgattgcc

SEQ ID NO: 143345 - DNA, 49 bp, Artificial Sequence
  Description of Artificial Sequence: Synthetic oligonucleotide
ggattataaaacatttgtgacttatactgtctatgtcagtatgattgcc

SEQ ID NO: 143346 - DNA, 52 bp, Artificial Sequence
  Description of Artificial Sequence: Synthetic oligonucleotide
gattataaaacatttgtgacttatactgtctatgtcagtatgattgccttag

SEQ ID NO: 143347 - DNA, 55 bp, Artificial Sequence
  Description of Artificial Sequence: Synthetic oligonucleotide
attataaaacatttgtgacttatactgtctatgtcagtatgattgccttagaaag

SEQ ID NO: 143348 - DNA, 54 bp, Artificial Sequence
  Description of Artificial Sequence: Synthetic oligonucleotide
ttataaaacatttgtgacttatactgtctatgtcagtatgattgccttagaaag

SEQ ID NO: 143349 - DNA, 53 bp, Artificial Sequence
  Description of Artificial Sequence: Synthetic oligonucleotide
tataaaacatttgtgacttatactgtctatgtcagtatgattgccttagaaag

SEQ ID NO: 143350 - DNA, 52 bp, Artificial Sequence
  Description of Artificial Sequence: Synthetic oligonucleotide
ataaaacatttgtgacttatactgtctatgtcagtatgattgccttagaaag

SEQ ID NO: 143351 - DNA, 51 bp, Artificial Sequence
  Description of Artificial Sequence: Synthetic oligonucleotide
taaaacatttgtgacttatactgtctatgtcagtatgattgccttagaaag

SEQ ID NO: 143352 - DNA, 50 bp, Artificial Sequence
  Description of Artificial Sequence: Synthetic oligonucleotide
aaaacatttgtgacttatactgtctatgtcagtatgattgccttagaaag

SEQ ID NO: 143353 - DNA, 49 bp, Artificial Sequence
  Description of Artificial Sequence: Synthetic oligonucleotide
aaacatttgtgacttatactgtctatgtcagtatgattgccttagaaag

SEQ ID NO: 143354 - DNA, 48 bp, Artificial Sequence
  Description of Artificial Sequence: Synthetic oligonucleotide
aacatttgtgacttatactgtctatgtcagtatgattgccttagaaag

SEQ ID NO: 143355 - DNA, 47 bp, Artificial Sequence
  Description of Artificial Sequence: Synthetic oligonucleotide
acatttgtgacttatactgtctatgtcagtatgattgccttagaaag

SEQ ID NO: 143356 - DNA, 46 bp, Artificial Sequence
  Description of Artificial Sequence: Synthetic oligonucleotide
catttgtgacttatactgtctatgtcagtatgattgccttagaaag

SEQ ID NO: 143357 - DNA, 47 bp, Artificial Sequence
  Description of Artificial Sequence: Synthetic oligonucleotide
atttgtgacttatactgtctatgtcagtatgattgccttagaaagac

SEQ ID NO: 143358 - DNA, 46 bp, Artificial Sequence
  Description of Artificial Sequence: Synthetic oligonucleotide
tttgtgacttatactgtctatgtcagtatgattgccttagaaagac

SEQ ID NO: 143359 - DNA, 45 bp, Artificial Sequence
  Description of Artificial Sequence: Synthetic oligonucleotide
ttgtgacttatactgtctatgtcagtatgattgccttagaaagac

SEQ ID NO: 143360 - DNA, 44 bp, Artificial Sequence
  Description of Artificial Sequence: Synthetic oligonucleotide
tgtgacttatactgtctatgtcagtatgattgccttagaaagac

SEQ ID NO: 143361 - DNA, 43 bp, Artificial Sequence
  Description of Artificial Sequence: Synthetic oligonucleotide
gtgacttatactgtctatgtcagtatgattgccttagaaagac

SEQ ID NO: 143362 - DNA, 43 bp, Artificial Sequence
  Description of Artificial Sequence: Synthetic oligonucleotide
tgacttatactgtctatgtcagtatgattgccttagaaagacc

SEQ ID NO: 143363 - DNA, 42 bp, Artificial Sequence
  Description of Artificial Sequence: Synthetic oligonucleotide
gacttatactgtctatgtcagtatgattgccttagaaagacc

SEQ ID NO: 143364 - DNA, 43 bp, Artificial Sequence
  Description of Artificial Sequence: Synthetic oligonucleotide
acttatactgtctatgtcagtatgattgccttagaaagaccag

SEQ ID NO: 143365 - DNA, 42 bp, Artificial Sequence
  Description of Artificial Sequence: Synthetic oligonucleotide
cttatactgtctatgtcagtatgattgccttagaaagaccag

SEQ ID NO: 143366 - DNA, 44 bp, Artificial Sequence
  Description of Artificial Sequence: Synthetic oligonucleotide
ttatactgtctatgtcagtatgattgccttagaaagaccagatc

SEQ ID NO: 143367 - DNA, 43 bp, Artificial Sequence
  Description of Artificial Sequence: Synthetic oligonucleotide
tatactgtctatgtcagtatgattgccttagaaagaccagatc

SEQ ID NO: 143368 - DNA, 42 bp, Artificial Sequence
  Description of Artificial Sequence: Synthetic oligonucleotide
atactgtctatgtcagtatgattgccttagaaagaccagatc

SEQ ID NO: 143369 - DNA, 41 bp, Artificial Sequence
  Description of Artificial Sequence: Synthetic oligonucleotide
tactgtctatgtcagtatgattgccttagaaagaccagatc

SEQ ID NO: 143370 - DNA, 40 bp, Artificial Sequence
  Description of Artificial Sequence: Synthetic oligonucleotide
actgtctatgtcagtatgattgccttagaaagaccagatc

SEQ ID NO: 143371 - DNA, 39 bp, Artificial Sequence
  Description of Artificial Sequence: Synthetic oligonucleotide
ctgtctatgtcagtatgattgccttagaaagaccagatc

SEQ ID NO: 143372 - DNA, 40 bp, Artificial Sequence
  Description of Artificial Sequence: Synthetic oligonucleotide
tgtctatgtcagtatgattgccttagaaagaccagatctc

SEQ ID NO: 143373 - DNA, 39 bp, Artificial Sequence
  Description of Artificial Sequence: Synthetic oligonucleotide
gtctatgtcagtatgattgccttagaaagaccagatctc

SEQ ID NO: 143374 - DNA, 40 bp, Artificial Sequence
  Description of Artificial Sequence: Synthetic oligonucleotide
tctatgtcagtatgattgccttagaaagaccagatctcag

SEQ ID NO: 143375 - DNA, 39 bp, Artificial Sequence
  Description of Artificial Sequence: Synthetic oligonucleotide
ctatgtcagtatgattgccttagaaagaccagatctcag

SEQ ID NO: 143376 - DNA, 39 bp, Artificial Sequence
  Description of Artificial Sequence: Synthetic oligonucleotide
tatgtcagtatgattgccttagaaagaccagatctcagg

SEQ ID NO: 143377 - DNA, 38 bp, Artificial Sequence
  Description of Artificial Sequence: Synthetic oligonucleotide
atgtcagtatgattgccttagaaagaccagatctcagg

SEQ ID NO: 143378 - DNA, 37 bp, Artificial Sequence
  Description of Artificial Sequence: Synthetic oligonucleotide
tgtcagtatgattgccttagaaagaccagatctcagg

SEQ ID NO: 143379 - DNA, 36 bp, Artificial Sequence
  Description of Artificial Sequence: Synthetic oligonucleotide
gtcagtatgattgccttagaaagaccagatctcagg

SEQ ID NO: 143380 - DNA, 36 bp, Artificial Sequence
  Description of Artificial Sequence: Synthetic oligonucleotide
tcagtatgattgccttagaaagaccagatctcaggg

SEQ ID NO: 143381 - DNA, 35 bp, Artificial Sequence
  Description of Artificial Sequence: Synthetic oligonucleotide
cagtatgattgccttagaaagaccagatctcaggg

SEQ ID NO: 143382 - DNA, 39 bp, Artificial Sequence
  Description of Artificial Sequence: Synthetic oligonucleotide
agtatgattgccttagaaagaccagatctcagggaaaag

SEQ ID NO: 143383 - DNA, 38 bp, Artificial Sequence
  Description of Artificial Sequence: Synthetic oligonucleotide
gtatgattgccttagaaagaccagatctcagggaaaag

SEQ ID NO: 143384 - DNA, 38 bp, Artificial Sequence
  Description of Artificial Sequence: Synthetic oligonucleotide
tatgattgccttagaaagaccagatctcagggaaaagg

SEQ ID NO: 143385 - DNA, 37 bp, Artificial Sequence
  Description of Artificial Sequence: Synthetic oligonucleotide
atgattgccttagaaagaccagatctcagggaaaagg

SEQ ID NO: 143386 - DNA, 36 bp, Artificial Sequence
  Description of Artificial Sequence: Synthetic oligonucleotide
tgattgccttagaaagaccagatctcagggaaaagg

SEQ ID NO: 143387 - DNA, 35 bp, Artificial Sequence
  Description of Artificial Sequence: Synthetic oligonucleotide
gattgccttagaaagaccagatctcagggaaaagg

SEQ ID NO: 143388 - DNA, 36 bp, Artificial Sequence
  Description of Artificial Sequence: Synthetic oligonucleotide
attgccttagaaagaccagatctcagggaaaaggtc

SEQ ID NO: 143389 - DNA, 35 bp, Artificial Sequence
  Description of Artificial Sequence: Synthetic oligonucleotide
ttgccttagaaagaccagatctcagggaaaaggtc

SEQ ID NO: 143390 - DNA, 34 bp, Artificial Sequence
  Description of Artificial Sequence: Synthetic oligonucleotide
tgccttagaaagaccagatctcagggaaaaggtc

SEQ ID NO: 143391 - DNA, 33 bp, Artificial Sequence
  Description of Artificial Sequence: Synthetic oligonucleotide
gccttagaaagaccagatctcagggaaaaggtc

SEQ ID NO: 143392 - DNA, 39 bp, Artificial Sequence
  Description of Artificial Sequence: Synthetic oligonucleotide
ccttagaaagaccagatctcagggaaaaggtcattaaag

SEQ ID NO: 143393 - DNA, 39 bp, Artificial Sequence
  Description of Artificial Sequence: Synthetic oligonucleotide
cttagaaagaccagatctcagggaaaaggtcattaaagg

SEQ ID NO: 143394 - DNA, 40 bp, Artificial Sequence
  Description of Artificial Sequence: Synthetic oligonucleotide
ttagaaagaccagatctcagggaaaaggtcattaaaggag

SEQ ID NO: 143395 - DNA, 39 bp, Artificial Sequence
  Description of Artificial Sequence: Synthetic oligonucleotide
tagaaagaccagatctcagggaaaaggtcattaaaggag

SEQ ID NO: 143396 - DNA, 38 bp, Artificial Sequence
  Description of Artificial Sequence: Synthetic oligonucleotide
agaaagaccagatctcagggaaaaggtcattaaaggag

SEQ ID NO: 143397 - DNA, 37 bp, Artificial Sequence
  Description of Artificial Sequence: Synthetic oligonucleotide
gaaagaccagatctcagggaaaaggtcattaaaggag

SEQ ID NO: 143398 - DNA, 37 bp, Artificial Sequence
  Description of Artificial Sequence: Synthetic oligonucleotide
aaagaccagatctcagggaaaaggtcattaaaggagc

SEQ ID NO: 143399 - DNA, 36 bp, Artificial Sequence
  Description of Artificial Sequence: Synthetic oligonucleotide
aagaccagatctcagggaaaaggtcattaaaggagc

SEQ ID NO: 143400 - DNA, 35 bp, Artificial Sequence
  Description of Artificial Sequence: Synthetic oligonucleotide
agaccagatctcagggaaaaggtcattaaaggagc

SEQ ID NO: 143401 - DNA, 34 bp, Artificial Sequence
  Description of Artificial Sequence: Synthetic oligonucleotide
gaccagatctcagggaaaaggtcattaaaggagc

SEQ ID NO: 143402 - DNA, 35 bp, Artificial Sequence
  Description of Artificial Sequence: Synthetic oligonucleotide
accagatctcagggaaaaggtcattaaaggagcag

SEQ ID NO: 143403 - DNA, 34 bp, Artificial Sequence
  Description of Artificial Sequence: Synthetic oligonucleotide
ccagatctcagggaaaaggtcattaaaggagcag

SEQ ID NO: 143404 - DNA, 35 bp, Artificial Sequence
  Description of Artificial Sequence: Synthetic oligonucleotide
cagatctcagggaaaaggtcattaaaggagcagag

SEQ ID NO: 143405 - DNA, 38 bp, Artificial Sequence
  Description of Artificial Sequence: Synthetic oligonucleotide
agatctcagggaaaaggtcattaaaggagcagagattc

SEQ ID NO: 143406 - DNA, 37 bp, Artificial Sequence
  Description of Artificial Sequence: Synthetic oligonucleotide
gatctcagggaaaaggtcattaaaggagcagagattc

SEQ ID NO: 143407 - DNA, 39 bp, Artificial Sequence
  Description of Artificial Sequence: Synthetic oligonucleotide
atctcagggaaaaggtcattaaaggagcagagattcttg

SEQ ID NO: 143408 - DNA, 38 bp, Artificial Sequence
  Description of Artificial Sequence: Synthetic oligonucleotide
tctcagggaaaaggtcattaaaggagcagagattcttg

SEQ ID NO: 143409 - DNA, 37 bp, Artificial Sequence
  Description of Artificial Sequence: Synthetic oligonucleotide
ctcagggaaaaggtcattaaaggagcagagattcttg

SEQ ID NO: 143410 - DNA, 39 bp, Artificial Sequence
  Description of Artificial Sequence: Synthetic oligonucleotide
tcagggaaaaggtcattaaaggagcagagattcttgaag

SEQ ID NO: 143411 - DNA, 38 bp, Artificial Sequence
  Description of Artificial Sequence: Synthetic oligonucleotide
cagggaaaaggtcattaaaggagcagagattcttgaag

SEQ ID NO: 143412 - DNA, 39 bp, Artificial Sequence
  Description of Artificial Sequence: Synthetic oligonucleotide
agggaaaaggtcattaaaggagcagagattcttgaagtg

SEQ ID NO: 143413 - DNA, 38 bp, Artificial Sequence
  Description of Artificial Sequence: Synthetic oligonucleotide
gggaaaaggtcattaaaggagcagagattcttgaagtg

SEQ ID NO: 143414 - DNA, 40 bp, Artificial Sequence
  Description of Artificial Sequence: Synthetic oligonucleotide
ggaaaaggtcattaaaggagcagagattcttgaagtgttg

SEQ ID NO: 143415 - DNA, 40 bp, Artificial Sequence
  Description of Artificial Sequence: Synthetic oligonucleotide
gaaaaggtcattaaaggagcagagattcttgaagtgttgc

SEQ ID NO: 143416 - DNA, 41 bp, Artificial Sequence
  Description of Artificial Sequence: Synthetic oligonucleotide
aaaaggtcattaaaggagcagagattcttgaagtgttgcac

SEQ ID NO: 143417 - DNA, 40 bp, Artificial Sequence
  Description of Artificial Sequence: Synthetic oligonucleotide
aaaggtcattaaaggagcagagattcttgaagtgttgcac

SEQ ID NO: 143418 - DNA, 39 bp, Artificial Sequence
  Description of Artificial Sequence: Synthetic oligonucleotide
aaggtcattaaaggagcagagattcttgaagtgttgcac

SEQ ID NO: 143419 - DNA, 38 bp, Artificial Sequence
  Description of Artificial Sequence: Synthetic oligonucleotide
aggtcattaaaggagcagagattcttgaagtgttgcac

SEQ ID NO: 143420 - DNA, 37 bp, Artificial Sequence
  Description of Artificial Sequence: Synthetic oligonucleotide
ggtcattaaaggagcagagattcttgaagtgttgcac

SEQ ID NO: 143421 - DNA, 38 bp, Artificial Sequence
  Description of Artificial Sequence: Synthetic oligonucleotide
gtcattaaaggagcagagattcttgaagtgttgcacag

SEQ ID NO: 143422 - DNA, 39 bp, Artificial Sequence
  Description of Artificial Sequence: Synthetic oligonucleotide
tcattaaaggagcagagattcttgaagtgttgcacagtc

SEQ ID NO: 143423 - DNA, 38 bp, Artificial Sequence
  Description of Artificial Sequence: Synthetic oligonucleotide
cattaaaggagcagagattcttgaagtgttgcacagtc

SEQ ID NO: 143424 - DNA, 40 bp, Artificial Sequence
  Description of Artificial Sequence: Synthetic oligonucleotide
attaaaggagcagagattcttgaagtgttgcacagtcttc

SEQ ID NO: 143425 - DNA, 39 bp, Artificial Sequence
  Description of Artificial Sequence: Synthetic oligonucleotide
ttaaaggagcagagattcttgaagtgttgcacagtcttc

SEQ ID NO: 143426 - DNA, 38 bp, Artificial Sequence
  Description of Artificial Sequence: Synthetic oligonucleotide
taaaggagcagagattcttgaagtgttgcacagtcttc

SEQ ID NO: 143427 - DNA, 37 bp, Artificial Sequence
  Description of Artificial Sequence: Synthetic oligonucleotide
aaaggagcagagattcttgaagtgttgcacagtcttc

SEQ ID NO: 143428 - DNA, 36 bp, Artificial Sequence
  Description of Artificial Sequence: Synthetic oligonucleotide
aaggagcagagattcttgaagtgttgcacagtcttc

SEQ ID NO: 143429 - DNA, 35 bp, Artificial Sequence
  Description of Artificial Sequence: Synthetic oligonucleotide
aggagcagagattcttgaagtgttgcacagtcttc

SEQ ID NO: 143430 - DNA, 34 bp, Artificial Sequence
  Description of Artificial Sequence: Synthetic oligonucleotide
ggagcagagattcttgaagtgttgcacagtcttc

SEQ ID NO: 143431 - DNA, 34 bp, Artificial Sequence
  Description of Artificial Sequence: Synthetic oligonucleotide
gagcagagattcttgaagtgttgcacagtcttcc

SEQ ID NO: 143432 - DNA, 35 bp, Artificial Sequence
  Description of Artificial Sequence: Synthetic oligonucleotide
agcagagattcttgaagtgttgcacagtcttccag

SEQ ID NO: 143433 - DNA, 34 bp, Artificial Sequence
  Description of Artificial Sequence: Synthetic oligonucleotide
gcagagattcttgaagtgttgcacagtcttccag

SEQ ID NO: 143434 - DNA, 34 bp, Artificial Sequence
  Description of Artificial Sequence: Synthetic oligonucleotide
cagagattcttgaagtgttgcacagtcttccagc

SEQ ID NO: 143435 - DNA, 35 bp, Artificial Sequence
  Description of Artificial Sequence: Synthetic oligonucleotide
agagattcttgaagtgttgcacagtcttccagcag

SEQ ID NO: 143436 - DNA, 34 bp, Artificial Sequence
  Description of Artificial Sequence: Synthetic oligonucleotide
gagattcttgaagtgttgcacagtcttccagcag

SEQ ID NO: 143437 - DNA, 36 bp, Artificial Sequence
  Description of Artificial Sequence: Synthetic oligonucleotide
agattcttgaagtgttgcacagtcttccagcagttc

SEQ ID NO: 143438 - DNA, 35 bp, Artificial Sequence
  Description of Artificial Sequence: Synthetic oligonucleotide
gattcttgaagtgttgcacagtcttccagcagttc

SEQ ID NO: 143439 - DNA, 35 bp, Artificial Sequence
  Description of Artificial Sequence: Synthetic oligonucleotide
attcttgaagtgttgcacagtcttccagcagttcg

SEQ ID NO: 143440 - DNA, 34 bp, Artificial Sequence
  Description of Artificial Sequence: Synthetic oligonucleotide
ttcttgaagtgttgcacagtcttccagcagttcg

SEQ ID NO: 143441 - DNA, 33 bp, Artificial Sequence
  Description of Artificial Sequence: Synthetic oligonucleotide
tcttgaagtgttgcacagtcttccagcagttcg

SEQ ID NO: 143442 - DNA, 32 bp, Artificial Sequence
  Description of Artificial Sequence: Synthetic oligonucleotide
cttgaagtgttgcacagtcttccagcagttcg

SEQ ID NO: 143443 - DNA, 32 bp, Artificial Sequence
  Description of Artificial Sequence: Synthetic oligonucleotide
ttgaagtgttgcacagtcttccagcagttcgg

SEQ ID NO: 143444 - DNA, 31 bp, Artificial Sequence
  Description of Artificial Sequence: Synthetic oligonucleotide
tgaagtgttgcacagtcttccagcagttcgg

SEQ ID NO: 143445 - DNA, 30 bp, Artificial Sequence
  Description of Artificial Sequence: Synthetic oligonucleotide
gaagtgttgcacagtcttccagcagttcgg

SEQ ID NO: 143446 - DNA, 30 bp, Artificial Sequence
  Description of Artificial Sequence: Synthetic oligonucleotide
aagtgttgcacagtcttccagcagttcggc

SEQ ID NO: 143447 - DNA, 29 bp, Artificial Sequence
  Description of Artificial Sequence: Synthetic oligonucleotide
agtgttgcacagtcttccagcagttcggc

SEQ ID NO: 143448 - DNA, 28 bp, Artificial Sequence
  Description of Artificial Sequence: Synthetic oligonucleotide
gtgttgcacagtcttccagcagttcggc

SEQ ID NO: 143449 - DNA, 29 bp, Artificial Sequence
  Description of Artificial Sequence: Synthetic oligonucleotide
tgttgcacagtcttccagcagttcggcag

SEQ ID NO: 143450 - DNA, 28 bp, Artificial Sequence
  Description of Artificial Sequence: Synthetic oligonucleotide
gttgcacagtcttccagcagttcggcag

SEQ ID NO: 143451 - DNA, 31 bp, Artificial Sequence
  Description of Artificial Sequence: Synthetic oligonucleotide
ttgcacagtcttccagcagttcggcagtatc

SEQ ID NO: 143452 - DNA, 30 bp, Artificial Sequence
  Description of Artificial Sequence: Synthetic oligonucleotide
tgcacagtcttccagcagttcggcagtatc

SEQ ID NO: 143453 - DNA, 29 bp, Artificial Sequence
  Description of Artificial Sequence: Synthetic oligonucleotide
gcacagtcttccagcagttcggcagtatc

SEQ ID NO: 143454 - DNA, 30 bp, Artificial Sequence
  Description of Artificial Sequence: Synthetic oligonucleotide
cacagtcttccagcagttcggcagtatctg

SEQ ID NO: 143455 - DNA, 34 bp, Artificial Sequence
  Description of Artificial Sequence: Synthetic oligonucleotide
acagtcttccagcagttcggcagtatctgttttc

SEQ ID NO: 143456 - DNA, 33 bp, Artificial Sequence
  Description of Artificial Sequence: Synthetic oligonucleotide
cagtcttccagcagttcggcagtatctgttttc

SEQ ID NO: 143457 - DNA, 34 bp, Artificial Sequence
  Description of Artificial Sequence: Synthetic oligonucleotide
agtcttccagcagttcggcagtatctgttttcac

SEQ ID NO: 143458 - DNA, 33 bp, Artificial Sequence
  Description of Artificial Sequence: Synthetic oligonucleotide
gtcttccagcagttcggcagtatctgttttcac

SEQ ID NO: 143459 - DNA, 34 bp, Artificial Sequence
  Description of Artificial Sequence: Synthetic oligonucleotide
tcttccagcagttcggcagtatctgttttcactc

SEQ ID NO: 143460 - DNA, 33 bp, Artificial Sequence
  Description of Artificial Sequence: Synthetic oligonucleotide
cttccagcagttcggcagtatctgttttcactc

SEQ ID NO: 143461 - DNA, 36 bp, Artificial Sequence
  Description of Artificial Sequence: Synthetic oligonucleotide
ttccagcagttcggcagtatctgttttcactctatg

SEQ ID NO: 143462 - DNA, 35 bp, Artificial Sequence
  Description of Artificial Sequence: Synthetic oligonucleotide
tccagcagttcggcagtatctgttttcactctatg

SEQ ID NO: 143463 - DNA, 34 bp, Artificial Sequence
  Description of Artificial Sequence: Synthetic oligonucleotide
ccagcagttcggcagtatctgttttcactctatg

SEQ ID NO: 143464 - DNA, 37 bp, Artificial Sequence
  Description of Artificial Sequence: Synthetic oligonucleotide
cagcagttcggcagtatctgttttcactctatgaatg

SEQ ID NO: 143465 - DNA, 37 bp, Artificial Sequence
  Description of Artificial Sequence: Synthetic oligonucleotide
agcagttcggcagtatctgttttcactctatgaatgc

SEQ ID NO: 143466 - DNA, 36 bp, Artificial Sequence
  Description of Artificial Sequence: Synthetic oligonucleotide
gcagttcggcagtatctgttttcactctatgaatgc

SEQ ID NO: 143467 - DNA, 36 bp, Artificial Sequence
  Description of Artificial Sequence: Synthetic oligonucleotide
cagttcggcagtatctgttttcactctatgaatgcc

SEQ ID NO: 143468 - DNA, 36 bp, Artificial Sequence
  Description of Artificial Sequence: Synthetic oligonucleotide
agttcggcagtatctgttttcactctatgaatgccg

SEQ ID NO: 143469 - DNA, 35 bp, Artificial Sequence
  Description of Artificial Sequence: Synthetic oligonucleotide
gttcggcagtatctgttttcactctatgaatgccg

SEQ ID NO: 143470 - DNA, 38 bp, Artificial Sequence
  Description of Artificial Sequence: Synthetic oligonucleotide
ttcggcagtatctgttttcactctatgaatgccgttac

SEQ ID NO: 143471 - DNA, 37 bp, Artificial Sequence
  Description of Artificial Sequence: Synthetic oligonucleotide
tcggcagtatctgttttcactctatgaatgccgttac

SEQ ID NO: 143472 - DNA, 36 bp, Artificial Sequence
  Description of Artificial Sequence: Synthetic oligonucleotide
cggcagtatctgttttcactctatgaatgccgttac

SEQ ID NO: 143473 - DNA, 37 bp, Artificial Sequence
  Description of Artificial Sequence: Synthetic oligonucleotide
ggcagtatctgttttcactctatgaatgccgttactc

SEQ ID NO: 143474 - DNA, 38 bp, Artificial Sequence
  Description of Artificial Sequence: Synthetic oligonucleotide
gcagtatctgttttcactctatgaatgccgttactctg

SEQ ID NO: 143475 - DNA, 42 bp, Artificial Sequence
  Description of Artificial Sequence: Synthetic oligonucleotide
cagtatctgttttcactctatgaatgccgttactctgttttc

SEQ ID NO: 143476 - DNA, 44 bp, Artificial Sequence
  Description of Artificial Sequence: Synthetic oligonucleotide
agtatctgttttcactctatgaatgccgttactctgttttcttc

SEQ ID NO: 143477 - DNA, 43 bp, Artificial Sequence
  Description of Artificial Sequence: Synthetic oligonucleotide
gtatctgttttcactctatgaatgccgttactctgttttcttc

SEQ ID NO: 143478 - DNA, 43 bp, Artificial Sequence
  Description of Artificial Sequence: Synthetic oligonucleotide
tatctgttttcactctatgaatgccgttactctgttttcttcc

SEQ ID NO: 143479 - DNA, 42 bp, Artificial Sequence
  Description of Artificial Sequence: Synthetic oligonucleotide
atctgttttcactctatgaatgccgttactctgttttcttcc

SEQ ID NO: 143480 - DNA, 41 bp, Artificial Sequence
  Description of Artificial Sequence: Synthetic oligonucleotide
tctgttttcactctatgaatgccgttactctgttttcttcc

SEQ ID NO: 143481 - DNA, 40 bp, Artificial Sequence
  Description of Artificial Sequence: Synthetic oligonucleotide
ctgttttcactctatgaatgccgttactctgttttcttcc

SEQ ID NO: 143482 - DNA, 43 bp, Artificial Sequence
  Description of Artificial Sequence: Synthetic oligonucleotide
tgttttcactctatgaatgccgttactctgttttcttccaatc

SEQ ID NO: 143483 - DNA, 42 bp, Artificial Sequence
  Description of Artificial Sequence: Synthetic oligonucleotide
gttttcactctatgaatgccgttactctgttttcttccaatc

SEQ ID NO: 143484 - DNA, 46 bp, Artificial Sequence
  Description of Artificial Sequence: Synthetic oligonucleotide
ttttcactctatgaatgccgttactctgttttcttccaatcattag

SEQ ID NO: 143485 - DNA, 45 bp, Artificial Sequence
  Description of Artificial Sequence: Synthetic oligonucleotide
tttcactctatgaatgccgttactctgttttcttccaatcattag

SEQ ID NO: 143486 - DNA, 44 bp, Artificial Sequence
  Description of Artificial Sequence: Synthetic oligonucleotide
ttcactctatgaatgccgttactctgttttcttccaatcattag

SEQ ID NO: 143487 - DNA, 43 bp, Artificial Sequence
  Description of Artificial Sequence: Synthetic oligonucleotide
tcactctatgaatgccgttactctgttttcttccaatcattag

SEQ ID NO: 143488 - DNA, 42 bp, Artificial Sequence
  Description of Artificial Sequence: Synthetic oligonucleotide
cactctatgaatgccgttactctgttttcttccaatcattag

SEQ ID NO: 143489 - DNA, 42 bp, Artificial Sequence
  Description of Artificial Sequence: Synthetic oligonucleotide
actctatgaatgccgttactctgttttcttccaatcattagc

SEQ ID NO: 143490 - DNA, 41 bp, Artificial Sequence
  Description of Artificial Sequence: Synthetic oligonucleotide
ctctatgaatgccgttactctgttttcttccaatcattagc

SEQ ID NO: 143491 - DNA, 41 bp, Artificial Sequence
  Description of Artificial Sequence: Synthetic oligonucleotide
tctatgaatgccgttactctgttttcttccaatcattagcg

SEQ ID NO: 143492 - DNA, 40 bp, Artificial Sequence
  Description of Artificial Sequence: Synthetic oligonucleotide
ctatgaatgccgttactctgttttcttccaatcattagcg

SEQ ID NO: 143493 - DNA, 40 bp, Artificial Sequence
  Description of Artificial Sequence: Synthetic oligonucleotide
tatgaatgccgttactctgttttcttccaatcattagcgg

SEQ ID NO: 143494 - DNA, 39 bp, Artificial Sequence
  Description of Artificial Sequence: Synthetic oligonucleotide
atgaatgccgttactctgttttcttccaatcattagcgg

SEQ ID NO: 143495 - DNA, 38 bp, Artificial Sequence
  Description of Artificial Sequence: Synthetic oligonucleotide
tgaatgccgttactctgttttcttccaatcattagcgg

SEQ ID NO: 143496 - DNA, 37 bp, Artificial Sequence
  Description of Artificial Sequence: Synthetic oligonucleotide
gaatgccgttactctgttttcttccaatcattagcgg

SEQ ID NO: 143497 - DNA, 39 bp, Artificial Sequence
  Description of Artificial Sequence: Synthetic oligonucleotide
aatgccgttactctgttttcttccaatcattagcggttg

SEQ ID NO: 143498 - DNA, 38 bp, Artificial Sequence
  Description of Artificial Sequence: Synthetic oligonucleotide
atgccgttactctgttttcttccaatcattagcggttg

SEQ ID NO: 143499 - DNA, 37 bp, Artificial Sequence
  Description of Artificial Sequence: Synthetic oligonucleotide
tgccgttactctgttttcttccaatcattagcggttg

SEQ ID NO: 143500 - DNA, 36 bp, Artificial Sequence
  Description of Artificial Sequence: Synthetic oligonucleotide
gccgttactctgttttcttccaatcattagcggttg

SEQ ID NO: 143501 - DNA, 37 bp, Artificial Sequence
  Description of Artificial Sequence: Synthetic oligonucleotide
ccgttactctgttttcttccaatcattagcggttgtg

SEQ ID NO: 143502 - DNA, 37 bp, Artificial Sequence
  Description of Artificial Sequence: Synthetic oligonucleotide
cgttactctgttttcttccaatcattagcggttgtgg

SEQ ID NO: 143503 - DNA, 39 bp, Artificial Sequence
  Description of Artificial Sequence: Synthetic oligonucleotide
gttactctgttttcttccaatcattagcggttgtggaac

SEQ ID NO: 143504 - DNA, 40 bp, Artificial Sequence
  Description of Artificial Sequence: Synthetic oligonucleotide
ttactctgttttcttccaatcattagcggttgtggaacag

SEQ ID NO: 143505 - DNA, 39 bp, Artificial Sequence
  Description of Artificial Sequence: Synthetic oligonucleotide
tactctgttttcttccaatcattagcggttgtggaacag

SEQ ID NO: 143506 - DNA, 38 bp, Artificial Sequence
  Description of Artificial Sequence: Synthetic oligonucleotide
actctgttttcttccaatcattagcggttgtggaacag

SEQ ID NO: 143507 - DNA, 37 bp, Artificial Sequence
  Description of Artificial Sequence: Synthetic oligonucleotide
ctctgttttcttccaatcattagcggttgtggaacag

SEQ ID NO: 143508 - DNA, 37 bp, Artificial Sequence
  Description of Artificial Sequence: Synthetic oligonucleotide
tctgttttcttccaatcattagcggttgtggaacagg

SEQ ID NO: 143509 - DNA, 36 bp, Artificial Sequence
  Description of Artificial Sequence: Synthetic oligonucleotide
ctgttttcttccaatcattagcggttgtggaacagg

SEQ ID NO: 143510 - DNA, 40 bp, Artificial Sequence
  Description of Artificial Sequence: Synthetic oligonucleotide
tgttttcttccaatcattagcggttgtggaacaggaaatg

SEQ ID NO: 143511 - DNA, 39 bp, Artificial Sequence
  Description of Artificial Sequence: Synthetic oligonucleotide
gttttcttccaatcattagcggttgtggaacaggaaatg

SEQ ID NO: 143512 - DNA, 44 bp, Artificial Sequence
  Description of Artificial Sequence: Synthetic oligonucleotide
ttttcttccaatcattagcggttgtggaacaggaaatgaaaaag

SEQ ID NO: 143513 - DNA, 43 bp, Artificial Sequence
  Description of Artificial Sequence: Synthetic oligonucleotide
tttcttccaatcattagcggttgtggaacaggaaatgaaaaag

SEQ ID NO: 143514 - DNA, 42 bp, Artificial Sequence
  Description of Artificial Sequence: Synthetic oligonucleotide
ttcttccaatcattagcggttgtggaacaggaaatgaaaaag

SEQ ID NO: 143515 - DNA, 41 bp, Artificial Sequence
  Description of Artificial Sequence: Synthetic oligonucleotide
tcttccaatcattagcggttgtggaacaggaaatgaaaaag

SEQ ID NO: 143516 - DNA, 40 bp, Artificial Sequence
  Description of Artificial Sequence: Synthetic oligonucleotide
cttccaatcattagcggttgtggaacaggaaatgaaaaag

SEQ ID NO: 143517 - DNA, 40 bp, Artificial Sequence
  Description of Artificial Sequence: Synthetic oligonucleotide
ttccaatcattagcggttgtggaacaggaaatgaaaaagg

SEQ ID NO: 143518 - DNA, 39 bp, Artificial Sequence
  Description of Artificial Sequence: Synthetic oligonucleotide
tccaatcattagcggttgtggaacaggaaatgaaaaagg

SEQ ID NO: 143519 - DNA, 38 bp, Artificial Sequence
  Description of Artificial Sequence: Synthetic oligonucleotide
ccaatcattagcggttgtggaacaggaaatgaaaaagg

SEQ ID NO: 143520 - DNA, 39 bp, Artificial Sequence
  Description of Artificial Sequence: Synthetic oligonucleotide
caatcattagcggttgtggaacaggaaatgaaaaaggac

SEQ ID NO: 143521 - DNA, 40 bp, Artificial Sequence
  Description of Artificial Sequence: Synthetic oligonucleotide
aatcattagcggttgtggaacaggaaatgaaaaaggactg

SEQ ID NO: 143522 - DNA, 39 bp, Artificial Sequence
  Description of Artificial Sequence: Synthetic oligonucleotide
atcattagcggttgtggaacaggaaatgaaaaaggactg

SEQ ID NO: 143523 - DNA, 38 bp, Artificial Sequence
  Description of Artificial Sequence: Synthetic oligonucleotide
tcattagcggttgtggaacaggaaatgaaaaaggactg

SEQ ID NO: 143524 - DNA, 37 bp, Artificial Sequence
  Description of Artificial Sequence: Synthetic oligonucleotide
cattagcggttgtggaacaggaaatgaaaaaggactg

SEQ ID NO: 143525 - DNA, 37 bp, Artificial Sequence
  Description of Artificial Sequence: Synthetic oligonucleotide
attagcggttgtggaacaggaaatgaaaaaggactgg

SEQ ID NO: 143526 - DNA, 36 bp, Artificial Sequence
  Description of Artificial Sequence: Synthetic oligonucleotide
ttagcggttgtggaacaggaaatgaaaaaggactgg

SEQ ID NO: 143527 - DNA, 35 bp, Artificial Sequence
  Description of Artificial Sequence: Synthetic oligonucleotide
tagcggttgtggaacaggaaatgaaaaaggactgg

SEQ ID NO: 143528 - DNA, 34 bp, Artificial Sequence
  Description of Artificial Sequence: Synthetic oligonucleotide
agcggttgtggaacaggaaatgaaaaaggactgg

SEQ ID NO: 143529 - DNA, 33 bp, Artificial Sequence
  Description of Artificial Sequence: Synthetic oligonucleotide
gcggttgtggaacaggaaatgaaaaaggactgg

SEQ ID NO: 143530 - DNA, 33 bp, Artificial Sequence
  Description of Artificial Sequence: Synthetic oligonucleotide
cggttgtggaacaggaaatgaaaaaggactggc

SEQ ID NO: 143531 - DNA, 38 bp, Artificial Sequence
  Description of Artificial Sequence: Synthetic oligonucleotide
ggttgtggaacaggaaatgaaaaaggactggctttttg

SEQ ID NO: 143532 - DNA, 38 bp, Artificial Sequence
  Description of Artificial Sequence: Synthetic oligonucleotide
gttgtggaacaggaaatgaaaaaggactggctttttgc

SEQ ID NO: 143533 - DNA, 38 bp, Artificial Sequence
  Description of Artificial Sequence: Synthetic oligonucleotide
ttgtggaacaggaaatgaaaaaggactggctttttgcc

SEQ ID NO: 143534 - DNA, 37 bp, Artificial Sequence
  Description of Artificial Sequence: Synthetic oligonucleotide
tgtggaacaggaaatgaaaaaggactggctttttgcc

SEQ ID NO: 143535 - DNA, 36 bp, Artificial Sequence
  Description of Artificial Sequence: Synthetic oligonucleotide
gtggaacaggaaatgaaaaaggactggctttttgcc

SEQ ID NO: 143536 - DNA, 36 bp, Artificial Sequence
  Description of Artificial Sequence: Synthetic oligonucleotide
tggaacaggaaatgaaaaaggactggctttttgccc

SEQ ID NO: 143537 - DNA, 35 bp, Artificial Sequence
  Description of Artificial Sequence: Synthetic oligonucleotide
ggaacaggaaatgaaaaaggactggctttttgccc

SEQ ID NO: 143538 - DNA, 35 bp, Artificial Sequence
  Description of Artificial Sequence: Synthetic oligonucleotide
gaacaggaaatgaaaaaggactggctttttgcccc

SEQ ID NO: 143539 - DNA, 36 bp, Artificial Sequence
  Description of Artificial Sequence: Synthetic oligonucleotide
aacaggaaatgaaaaaggactggctttttgcccctc

SEQ ID NO: 143540 - DNA, 35 bp, Artificial Sequence
  Description of Artificial Sequence: Synthetic oligonucleotide
acaggaaatgaaaaaggactggctttttgcccctc

SEQ ID NO: 143541 - DNA, 34 bp, Artificial Sequence
  Description of Artificial Sequence: Synthetic oligonucleotide
caggaaatgaaaaaggactggctttttgcccctc

SEQ ID NO: 143542 - DNA, 39 bp, Artificial Sequence
  Description of Artificial Sequence: Synthetic oligonucleotide
aggaaatgaaaaaggactggctttttgcccctcattatc

SEQ ID NO: 143543 - DNA, 38 bp, Artificial Sequence
  Description of Artificial Sequence: Synthetic oligonucleotide
ggaaatgaaaaaggactggctttttgcccctcattatc

SEQ ID NO: 143544 - DNA, 38 bp, Artificial Sequence
  Description of Artificial Sequence: Synthetic oligonucleotide
gaaatgaaaaaggactggctttttgcccctcattatcg

SEQ ID NO: 143545 - DNA, 41 bp, Artificial Sequence
  Description of Artificial Sequence: Synthetic oligonucleotide
aaatgaaaaaggactggctttttgcccctcattatcgatac

SEQ ID NO: 143546 - DNA, 40 bp, Artificial Sequence
  Description of Artificial Sequence: Synthetic oligonucleotide
aatgaaaaaggactggctttttgcccctcattatcgatac

SEQ ID NO: 143547 - DNA, 39 bp, Artificial Sequence
  Description of Artificial Sequence: Synthetic oligonucleotide
atgaaaaaggactggctttttgcccctcattatcgatac

SEQ ID NO: 143548 - DNA, 38 bp, Artificial Sequence
  Description of Artificial Sequence: Synthetic oligonucleotide
tgaaaaaggactggctttttgcccctcattatcgatac

SEQ ID NO: 143549 - DNA, 37 bp, Artificial Sequence
  Description of Artificial Sequence: Synthetic oligonucleotide
gaaaaaggactggctttttgcccctcattatcgatac

SEQ ID NO: 143550 - DNA, 40 bp, Artificial Sequence
  Description of Artificial Sequence: Synthetic oligonucleotide
aaaaaggactggctttttgcccctcattatcgatactatg

SEQ ID NO: 143551 - DNA, 39 bp, Artificial Sequence
  Description of Artificial Sequence: Synthetic oligonucleotide
aaaaggactggctttttgcccctcattatcgatactatg

SEQ ID NO: 143552 - DNA, 38 bp, Artificial Sequence
  Description of Artificial Sequence: Synthetic oligonucleotide
aaaggactggctttttgcccctcattatcgatactatg

SEQ ID NO: 143553 - DNA, 37 bp, Artificial Sequence
  Description of Artificial Sequence: Synthetic oligonucleotide
aaggactggctttttgcccctcattatcgatactatg

SEQ ID NO: 143554 - DNA, 36 bp, Artificial Sequence
  Description of Artificial Sequence: Synthetic oligonucleotide
aggactggctttttgcccctcattatcgatactatg

SEQ ID NO: 143555 - DNA, 35 bp, Artificial Sequence
  Description of Artificial Sequence: Synthetic oligonucleotide
ggactggctttttgcccctcattatcgatactatg

SEQ ID NO: 143556 - DNA, 38 bp, Artificial Sequence
  Description of Artificial Sequence: Synthetic oligonucleotide
gactggctttttgcccctcattatcgatactatgtaag

SEQ ID NO: 143557 - DNA, 39 bp, Artificial Sequence
  Description of Artificial Sequence: Synthetic oligonucleotide
actggctttttgcccctcattatcgatactatgtaagag

SEQ ID NO: 143558 - DNA, 38 bp, Artificial Sequence
  Description of Artificial Sequence: Synthetic oligonucleotide
ctggctttttgcccctcattatcgatactatgtaagag

SEQ ID NO: 143559 - DNA, 42 bp, Artificial Sequence
  Description of Artificial Sequence: Synthetic oligonucleotide
tggctttttgcccctcattatcgatactatgtaagagaaatg

SEQ ID NO: 143560 - DNA, 41 bp, Artificial Sequence
  Description of Artificial Sequence: Synthetic oligonucleotide
ggctttttgcccctcattatcgatactatgtaagagaaatg

SEQ ID NO: 143561 - DNA, 42 bp, Artificial Sequence
  Description of Artificial Sequence: Synthetic oligonucleotide
gctttttgcccctcattatcgatactatgtaagagaaatgag

SEQ ID NO: 143562 - DNA, 46 bp, Artificial Sequence
  Description of Artificial Sequence: Synthetic oligonucleotide
ctttttgcccctcattatcgatactatgtaagagaaatgagaattc

SEQ ID NO: 143563 - DNA, 48 bp, Artificial Sequence
  Description of Artificial Sequence: Synthetic oligonucleotide
tttttgcccctcattatcgatactatgtaagagaaatgagaattcatg

SEQ ID NO: 143564 - DNA, 47 bp, Artificial Sequence
  Description of Artificial Sequence: Synthetic oligonucleotide
ttttgcccctcattatcgatactatgtaagagaaatgagaattcatg

SEQ ID NO: 143565 - DNA, 46 bp, Artificial Sequence
  Description of Artificial Sequence: Synthetic oligonucleotide
tttgcccctcattatcgatactatgtaagagaaatgagaattcatg

SEQ ID NO: 143566 - DNA, 45 bp, Artificial Sequence
  Description of Artificial Sequence: Synthetic oligonucleotide
ttgcccctcattatcgatactatgtaagagaaatgagaattcatg

SEQ ID NO: 143567 - DNA, 44 bp, Artificial Sequence
  Description of Artificial Sequence: Synthetic oligonucleotide
tgcccctcattatcgatactatgtaagagaaatgagaattcatg

SEQ ID NO: 143568 - DNA, 43 bp, Artificial Sequence
  Description of Artificial Sequence: Synthetic oligonucleotide
gcccctcattatcgatactatgtaagagaaatgagaattcatg

SEQ ID NO: 143569 - DNA, 43 bp, Artificial Sequence
  Description of Artificial Sequence: Synthetic oligonucleotide
cccctcattatcgatactatgtaagagaaatgagaattcatgc

SEQ ID NO: 143570 - DNA, 46 bp, Artificial Sequence
  Description of Artificial Sequence: Synthetic oligonucleotide
ccctcattatcgatactatgtaagagaaatgagaattcatgcatac

SEQ ID NO: 143571 - DNA, 47 bp, Artificial Sequence
  Description of Artificial Sequence: Synthetic oligonucleotide
cctcattatcgatactatgtaagagaaatgagaattcatgcatacag

SEQ ID NO: 143572 - DNA, 48 bp, Artificial Sequence
  Description of Artificial Sequence: Synthetic oligonucleotide
ctcattatcgatactatgtaagagaaatgagaattcatgcatacagtc

SEQ ID NO: 143573 - DNA, 49 bp, Artificial Sequence
  Description of Artificial Sequence: Synthetic oligonucleotide
tcattatcgatactatgtaagagaaatgagaattcatgcatacagtcag

SEQ ID NO: 143574 - DNA, 48 bp, Artificial Sequence
  Description of Artificial Sequence: Synthetic oligonucleotide
cattatcgatactatgtaagagaaatgagaattcatgcatacagtcag

SEQ ID NO: 143575 - DNA, 48 bp, Artificial Sequence
  Description of Artificial Sequence: Synthetic oligonucleotide
attatcgatactatgtaagagaaatgagaattcatgcatacagtcagc

SEQ ID NO: 143576 - DNA, 47 bp, Artificial Sequence
  Description of Artificial Sequence: Synthetic oligonucleotide
ttatcgatactatgtaagagaaatgagaattcatgcatacagtcagc

SEQ ID NO: 143577 - DNA, 46 bp, Artificial Sequence
  Description of Artificial Sequence: Synthetic oligonucleotide
tatcgatactatgtaagagaaatgagaattcatgcatacagtcagc

SEQ ID NO: 143578 - DNA, 45 bp, Artificial Sequence
  Description of Artificial Sequence: Synthetic oligonucleotide
atcgatactatgtaagagaaatgagaattcatgcatacagtcagc

SEQ ID NO: 143579 - DNA, 44 bp, Artificial Sequence
  Description of Artificial Sequence: Synthetic oligonucleotide
tcgatactatgtaagagaaatgagaattcatgcatacagtcagc

SEQ ID NO: 143580 - DNA, 43 bp, Artificial Sequence
  Description of Artificial Sequence: Synthetic oligonucleotide
cgatactatgtaagagaaatgagaattcatgcatacagtcagc

SEQ ID NO: 143581 - DNA, 44 bp, Artificial Sequence
  Description of Artificial Sequence: Synthetic oligonucleotide
gatactatgtaagagaaatgagaattcatgcatacagtcagctg

SEQ ID NO: 143582 - DNA, 44 bp, Artificial Sequence
  Description of Artificial Sequence: Synthetic oligonucleotide
atactatgtaagagaaatgagaattcatgcatacagtcagctgc

SEQ ID NO: 143583 - DNA, 43 bp, Artificial Sequence
  Description of Artificial Sequence: Synthetic oligonucleotide
tactatgtaagagaaatgagaattcatgcatacagtcagctgc

SEQ ID NO: 143584 - DNA, 42 bp, Artificial Sequence
  Description of Artificial Sequence: Synthetic oligonucleotide
actatgtaagagaaatgagaattcatgcatacagtcagctgc

SEQ ID NO: 143585 - DNA, 41 bp, Artificial Sequence
  Description of Artificial Sequence: Synthetic oligonucleotide
ctatgtaagagaaatgagaattcatgcatacagtcagctgc

SEQ ID NO: 143586 - DNA, 42 bp, Artificial Sequence
  Description of Artificial Sequence: Synthetic oligonucleotide
tatgtaagagaaatgagaattcatgcatacagtcagctgctg

SEQ ID NO: 143587 - DNA, 41 bp, Artificial Sequence
  Description of Artificial Sequence: Synthetic oligonucleotide
atgtaagagaaatgagaattcatgcatacagtcagctgctg

SEQ ID NO: 143588 - DNA, 40 bp, Artificial Sequence
  Description of Artificial Sequence: Synthetic oligonucleotide
tgtaagagaaatgagaattcatgcatacagtcagctgctg

SEQ ID NO: 143589 - DNA, 39 bp, Artificial Sequence
  Description of Artificial Sequence: Synthetic oligonucleotide
gtaagagaaatgagaattcatgcatacagtcagctgctg

SEQ ID NO: 143590 - DNA, 39 bp, Artificial Sequence
  Description of Artificial Sequence: Synthetic oligonucleotide
taagagaaatgagaattcatgcatacagtcagctgctgg

SEQ ID NO: 143591 - DNA, 38 bp, Artificial Sequence
  Description of Artificial Sequence: Synthetic oligonucleotide
aagagaaatgagaattcatgcatacagtcagctgctgg

SEQ ID NO: 143592 - DNA, 37 bp, Artificial Sequence
  Description of Artificial Sequence: Synthetic oligonucleotide
agagaaatgagaattcatgcatacagtcagctgctgg

SEQ ID NO: 143593 - DNA, 36 bp, Artificial Sequence
  Description of Artificial Sequence: Synthetic oligonucleotide
gagaaatgagaattcatgcatacagtcagctgctgg

SEQ ID NO: 143594 - DNA, 39 bp, Artificial Sequence
  Description of Artificial Sequence: Synthetic oligonucleotide
agaaatgagaattcatgcatacagtcagctgctggaatc

SEQ ID NO: 143595 - DNA, 38 bp, Artificial Sequence
  Description of Artificial Sequence: Synthetic oligonucleotide
gaaatgagaattcatgcatacagtcagctgctggaatc

SEQ ID NO: 143596 - DNA, 43 bp, Artificial Sequence
  Description of Artificial Sequence: Synthetic oligonucleotide
aaatgagaattcatgcatacagtcagctgctggaatcatatag

SEQ ID NO: 143597 - DNA, 42 bp, Artificial Sequence
  Description of Artificial Sequence: Synthetic oligonucleotide
aatgagaattcatgcatacagtcagctgctggaatcatatag

SEQ ID NO: 143598 - DNA, 41 bp, Artificial Sequence
  Description of Artificial Sequence: Synthetic oligonucleotide
atgagaattcatgcatacagtcagctgctggaatcatatag

SEQ ID NO: 143599 - DNA, 40 bp, Artificial Sequence
  Description of Artificial Sequence: Synthetic oligonucleotide
tgagaattcatgcatacagtcagctgctggaatcatatag

SEQ ID NO: 143600 - DNA, 39 bp, Artificial Sequence
  Description of Artificial Sequence: Synthetic oligonucleotide
gagaattcatgcatacagtcagctgctggaatcatatag

SEQ ID NO: 143601 - DNA, 39 bp, Artificial Sequence
  Description of Artificial Sequence: Synthetic oligonucleotide
agaattcatgcatacagtcagctgctggaatcatatagg

SEQ ID NO: 143602 - DNA, 38 bp, Artificial Sequence
  Description of Artificial Sequence: Synthetic oligonucleotide
gaattcatgcatacagtcagctgctggaatcatatagg

SEQ ID NO: 143603 - DNA, 39 bp, Artificial Sequence
  Description of Artificial Sequence: Synthetic oligonucleotide
aattcatgcatacagtcagctgctggaatcatataggtc

SEQ ID NO: 143604 - DNA, 38 bp, Artificial Sequence
  Description of Artificial Sequence: Synthetic oligonucleotide
attcatgcatacagtcagctgctggaatcatataggtc

SEQ ID NO: 143605 - DNA, 37 bp, Artificial Sequence
  Description of Artificial Sequence: Synthetic oligonucleotide
ttcatgcatacagtcagctgctggaatcatataggtc

SEQ ID NO: 143606 - DNA, 36 bp, Artificial Sequence
  Description of Artificial Sequence: Synthetic oligonucleotide
tcatgcatacagtcagctgctggaatcatataggtc

SEQ ID NO: 143607 - DNA, 35 bp, Artificial Sequence
  Description of Artificial Sequence: Synthetic oligonucleotide
catgcatacagtcagctgctggaatcatataggtc

SEQ ID NO: 143608 - DNA, 40 bp, Artificial Sequence
  Description of Artificial Sequence: Synthetic oligonucleotide
atgcatacagtcagctgctggaatcatataggtcattaac

SEQ ID NO: 143609 - DNA, 39 bp, Artificial Sequence
  Description of Artificial Sequence: Synthetic oligonucleotide
tgcatacagtcagctgctggaatcatataggtcattaac

SEQ ID NO: 143610 - DNA, 38 bp, Artificial Sequence
  Description of Artificial Sequence: Synthetic oligonucleotide
gcatacagtcagctgctggaatcatataggtcattaac

SEQ ID NO: 143611 - DNA, 38 bp, Artificial Sequence
  Description of Artificial Sequence: Synthetic oligonucleotide
catacagtcagctgctggaatcatataggtcattaacc

SEQ ID NO: 143612 - DNA, 38 bp, Artificial Sequence
  Description of Artificial Sequence: Synthetic oligonucleotide
atacagtcagctgctggaatcatataggtcattaaccc

SEQ ID NO: 143613 - DNA, 37 bp, Artificial Sequence
  Description of Artificial Sequence: Synthetic oligonucleotide
tacagtcagctgctggaatcatataggtcattaaccc

SEQ ID NO: 143614 - DNA, 36 bp, Artificial Sequence
  Description of Artificial Sequence: Synthetic oligonucleotide
acagtcagctgctggaatcatataggtcattaaccc

SEQ ID NO: 143615 - DNA, 35 bp, Artificial Sequence
  Description of Artificial Sequence: Synthetic oligonucleotide
cagtcagctgctggaatcatataggtcattaaccc

SEQ ID NO: 143616 - DNA, 37 bp, Artificial Sequence
  Description of Artificial Sequence: Synthetic oligonucleotide
agtcagctgctggaatcatataggtcattaacccttg

SEQ ID NO: 143617 - DNA, 36 bp, Artificial Sequence
  Description of Artificial Sequence: Synthetic oligonucleotide
gtcagctgctggaatcatataggtcattaacccttg

SEQ ID NO: 143618 - DNA, 36 bp, Artificial Sequence
  Description of Artificial Sequence: Synthetic oligonucleotide
tcagctgctggaatcatataggtcattaacccttgg

SEQ ID NO: 143619 - DNA, 35 bp, Artificial Sequence
  Description of Artificial Sequence: Synthetic oligonucleotide
cagctgctggaatcatataggtcattaacccttgg

SEQ ID NO: 143620 - DNA, 35 bp, Artificial Sequence
  Description of Artificial Sequence: Synthetic oligonucleotide
agctgctggaatcatataggtcattaacccttggc

SEQ ID NO: 143621 - DNA, 34 bp, Artificial Sequence
  Description of Artificial Sequence: Synthetic oligonucleotide
gctgctggaatcatataggtcattaacccttggc

SEQ ID NO: 143622 - DNA, 39 bp, Artificial Sequence
  Description of Artificial Sequence: Synthetic oligonucleotide
ctgctggaatcatataggtcattaacccttggctatatg

SEQ ID NO: 143623 - DNA, 39 bp, Artificial Sequence
  Description of Artificial Sequence: Synthetic oligonucleotide
tgctggaatcatataggtcattaacccttggctatatgg

SEQ ID NO: 143624 - DNA, 38 bp, Artificial Sequence
  Description of Artificial Sequence: Synthetic oligonucleotide
gctggaatcatataggtcattaacccttggctatatgg

SEQ ID NO: 143625 - DNA, 38 bp, Artificial Sequence
  Description of Artificial Sequence: Synthetic oligonucleotide
ctggaatcatataggtcattaacccttggctatatggc

SEQ ID NO: 143626 - DNA, 39 bp, Artificial Sequence
  Description of Artificial Sequence: Synthetic oligonucleotide
tggaatcatataggtcattaacccttggctatatggcag

SEQ ID NO: 143627 - DNA, 38 bp, Artificial Sequence
  Description of Artificial Sequence: Synthetic oligonucleotide
ggaatcatataggtcattaacccttggctatatggcag

SEQ ID NO: 143628 - DNA, 40 bp, Artificial Sequence
  Description of Artificial Sequence: Synthetic oligonucleotide
gaatcatataggtcattaacccttggctatatggcagaag

SEQ ID NO: 143629 - DNA, 40 bp, Artificial Sequence
  Description of Artificial Sequence: Synthetic oligonucleotide
aatcatataggtcattaacccttggctatatggcagaagc

SEQ ID NO: 143630 - DNA, 39 bp, Artificial Sequence
  Description of Artificial Sequence: Synthetic oligonucleotide
atcatataggtcattaacccttggctatatggcagaagc

SEQ ID NO: 143631 - DNA, 38 bp, Artificial Sequence
  Description of Artificial Sequence: Synthetic oligonucleotide
tcatataggtcattaacccttggctatatggcagaagc

SEQ ID NO: 143632 - DNA, 37 bp, Artificial Sequence
  Description of Artificial Sequence: Synthetic oligonucleotide
catataggtcattaacccttggctatatggcagaagc

SEQ ID NO: 143633 - DNA, 37 bp, Artificial Sequence
  Description of Artificial Sequence: Synthetic oligonucleotide
atataggtcattaacccttggctatatggcagaagcg

SEQ ID NO: 143634 - DNA, 36 bp, Artificial Sequence
  Description of Artificial Sequence: Synthetic oligonucleotide
tataggtcattaacccttggctatatggcagaagcg

SEQ ID NO: 143635 - DNA, 35 bp, Artificial Sequence
  Description of Artificial Sequence: Synthetic oligonucleotide
ataggtcattaacccttggctatatggcagaagcg

SEQ ID NO: 143636 - DNA, 34 bp, Artificial Sequence
  Description of Artificial Sequence: Synthetic oligonucleotide
taggtcattaacccttggctatatggcagaagcg

SEQ ID NO: 143637 - DNA, 33 bp, Artificial Sequence
  Description of Artificial Sequence: Synthetic oligonucleotide
aggtcattaacccttggctatatggcagaagcg

SEQ ID NO: 143638 - DNA, 32 bp, Artificial Sequence
  Description of Artificial Sequence: Synthetic oligonucleotide
ggtcattaacccttggctatatggcagaagcg

SEQ ID NO: 143639 - DNA, 35 bp, Artificial Sequence
  Description of Artificial Sequence: Synthetic oligonucleotide
gtcattaacccttggctatatggcagaagcgtttg

SEQ ID NO: 143640 - DNA, 35 bp, Artificial Sequence
  Description of Artificial Sequence: Synthetic oligonucleotide
tcattaacccttggctatatggcagaagcgtttgg

SEQ ID NO: 143641 - DNA, 34 bp, Artificial Sequence
  Description of Artificial Sequence: Synthetic oligonucleotide
cattaacccttggctatatggcagaagcgtttgg

SEQ ID NO: 143642 - DNA, 35 bp, Artificial Sequence
  Description of Artificial Sequence: Synthetic oligonucleotide
attaacccttggctatatggcagaagcgtttggtg

SEQ ID NO: 143643 - DNA, 34 bp, Artificial Sequence
  Description of Artificial Sequence: Synthetic oligonucleotide
ttaacccttggctatatggcagaagcgtttggtg

SEQ ID NO: 143644 - DNA, 33 bp, Artificial Sequence
  Description of Artificial Sequence: Synthetic oligonucleotide
taacccttggctatatggcagaagcgtttggtg

SEQ ID NO: 143645 - DNA, 32 bp, Artificial Sequence
  Description of Artificial Sequence: Synthetic oligonucleotide
aacccttggctatatggcagaagcgtttggtg

SEQ ID NO: 143646 - DNA, 31 bp, Artificial Sequence
  Description of Artificial Sequence: Synthetic oligonucleotide
acccttggctatatggcagaagcgtttggtg

SEQ ID NO: 143647 - DNA, 30 bp, Artificial Sequence
  Description of Artificial Sequence: Synthetic oligonucleotide
cccttggctatatggcagaagcgtttggtg

SEQ ID NO: 143648 - DNA, 32 bp, Artificial Sequence
  Description of Artificial Sequence: Synthetic oligonucleotide
ccttggctatatggcagaagcgtttggtgttg

SEQ ID NO: 143649 - DNA, 32 bp, Artificial Sequence
  Description of Artificial Sequence: Synthetic oligonucleotide
cttggctatatggcagaagcgtttggtgttgg

SEQ ID NO: 143650 - DNA, 33 bp, Artificial Sequence
  Description of Artificial Sequence: Synthetic oligonucleotide
ttggctatatggcagaagcgtttggtgttggtg

SEQ ID NO: 143651 - DNA, 32 bp, Artificial Sequence
  Description of Artificial Sequence: Synthetic oligonucleotide
tggctatatggcagaagcgtttggtgttggtg

SEQ ID NO: 143652 - DNA, 31 bp, Artificial Sequence
  Description of Artificial Sequence: Synthetic oligonucleotide
ggctatatggcagaagcgtttggtgttggtg

SEQ ID NO: 143653 - DNA, 32 bp, Artificial Sequence
  Description of Artificial Sequence: Synthetic oligonucleotide
gctatatggcagaagcgtttggtgttggtgtg

SEQ ID NO: 143654 - DNA, 32 bp, Artificial Sequence
  Description of Artificial Sequence: Synthetic oligonucleotide
ctatatggcagaagcgtttggtgttggtgtgg

SEQ ID NO: 143655 - DNA, 36 bp, Artificial Sequence
  Description of Artificial Sequence: Synthetic oligonucleotide
tatatggcagaagcgtttggtgttggtgtggaattc

SEQ ID NO: 143656 - DNA, 35 bp, Artificial Sequence
  Description of Artificial Sequence: Synthetic oligonucleotide
atatggcagaagcgtttggtgttggtgtggaattc

SEQ ID NO: 143657 - DNA, 34 bp, Artificial Sequence
  Description of Artificial Sequence: Synthetic oligonucleotide
tatggcagaagcgtttggtgttggtgtggaattc

SEQ ID NO: 143658 - DNA, 33 bp, Artificial Sequence
  Description of Artificial Sequence: Synthetic oligonucleotide
atggcagaagcgtttggtgttggtgtggaattc

SEQ ID NO: 143659 - DNA, 32 bp, Artificial Sequence
  Description of Artificial Sequence: Synthetic oligonucleotide
tggcagaagcgtttggtgttggtgtggaattc

SEQ ID NO: 143660 - DNA, 31 bp, Artificial Sequence
  Description of Artificial Sequence: Synthetic oligonucleotide
ggcagaagcgtttggtgttggtgtggaattc

SEQ ID NO: 143661 - DNA, 34 bp, Artificial Sequence
  Description of Artificial Sequence: Synthetic oligonucleotide
gcagaagcgtttggtgttggtgtggaattcattg

SEQ ID NO: 143662 - DNA, 36 bp, Artificial Sequence
  Description of Artificial Sequence: Synthetic oligonucleotide
cagaagcgtttggtgttggtgtggaattcattgatc

SEQ ID NO: 143663 - DNA, 37 bp, Artificial Sequence
  Description of Artificial Sequence: Synthetic oligonucleotide
agaagcgtttggtgttggtgtggaattcattgatcag

SEQ ID NO: 143664 - DNA, 36 bp, Artificial Sequence
  Description of Artificial Sequence: Synthetic oligonucleotide
gaagcgtttggtgttggtgtggaattcattgatcag

SEQ ID NO: 143665 - DNA, 36 bp, Artificial Sequence
  Description of Artificial Sequence: Synthetic oligonucleotide
aagcgtttggtgttggtgtggaattcattgatcagg

SEQ ID NO: 143666 - DNA, 35 bp, Artificial Sequence
  Description of Artificial Sequence: Synthetic oligonucleotide
agcgtttggtgttggtgtggaattcattgatcagg

SEQ ID NO: 143667 - DNA, 34 bp, Artificial Sequence
  Description of Artificial Sequence: Synthetic oligonucleotide
gcgtttggtgttggtgtggaattcattgatcagg

SEQ ID NO: 143668 - DNA, 36 bp, Artificial Sequence
  Description of Artificial Sequence: Synthetic oligonucleotide
cgtttggtgttggtgtggaattcattgatcaggaac

SEQ ID NO: 143669 - DNA, 37 bp, Artificial Sequence
  Description of Artificial Sequence: Synthetic oligonucleotide
gtttggtgttggtgtggaattcattgatcaggaactg

SEQ ID NO: 143670 - DNA, 38 bp, Artificial Sequence
  Description of Artificial Sequence: Synthetic oligonucleotide
tttggtgttggtgtggaattcattgatcaggaactgtc

SEQ ID NO: 143671 - DNA, 37 bp, Artificial Sequence
  Description of Artificial Sequence: Synthetic oligonucleotide
ttggtgttggtgtggaattcattgatcaggaactgtc

SEQ ID NO: 143672 - DNA, 36 bp, Artificial Sequence
  Description of Artificial Sequence: Synthetic oligonucleotide
tggtgttggtgtggaattcattgatcaggaactgtc

SEQ ID NO: 143673 - DNA, 35 bp, Artificial Sequence
  Description of Artificial Sequence: Synthetic oligonucleotide
ggtgttggtgtggaattcattgatcaggaactgtc

SEQ ID NO: 143674 - DNA, 35 bp, Artificial Sequence
  Description of Artificial Sequence: Synthetic oligonucleotide
gtgttggtgtggaattcattgatcaggaactgtcc

SEQ ID NO: 143675 - DNA, 36 bp, Artificial Sequence
  Description of Artificial Sequence: Synthetic oligonucleotide
tgttggtgtggaattcattgatcaggaactgtccag

SEQ ID NO: 143676 - DNA, 35 bp, Artificial Sequence
  Description of Artificial Sequence: Synthetic oligonucleotide
gttggtgtggaattcattgatcaggaactgtccag

SEQ ID NO: 143677 - DNA, 35 bp, Artificial Sequence
  Description of Artificial Sequence: Synthetic oligonucleotide
ttggtgtggaattcattgatcaggaactgtccagg

SEQ ID NO: 143678 - DNA, 34 bp, Artificial Sequence
  Description of Artificial Sequence: Synthetic oligonucleotide
tggtgtggaattcattgatcaggaactgtccagg

SEQ ID NO: 143679 - DNA, 33 bp, Artificial Sequence
  Description of Artificial Sequence: Synthetic oligonucleotide
ggtgtggaattcattgatcaggaactgtccagg

SEQ ID NO: 143680 - DNA, 39 bp, Artificial Sequence
  Description of Artificial Sequence: Synthetic oligonucleotide
gtgtggaattcattgatcaggaactgtccaggtttattg

SEQ ID NO: 143681 - DNA, 39 bp, Artificial Sequence
  Description of Artificial Sequence: Synthetic oligonucleotide
tgtggaattcattgatcaggaactgtccaggtttattgc

SEQ ID NO: 143682 - DNA, 38 bp, Artificial Sequence
  Description of Artificial Sequence: Synthetic oligonucleotide
gtggaattcattgatcaggaactgtccaggtttattgc

SEQ ID NO: 143683 - DNA, 39 bp, Artificial Sequence
  Description of Artificial Sequence: Synthetic oligonucleotide
tggaattcattgatcaggaactgtccaggtttattgctg

SEQ ID NO: 143684 - DNA, 38 bp, Artificial Sequence
  Description of Artificial Sequence: Synthetic oligonucleotide
ggaattcattgatcaggaactgtccaggtttattgctg

SEQ ID NO: 143685 - DNA, 38 bp, Artificial Sequence
  Description of Artificial Sequence: Synthetic oligonucleotide
gaattcattgatcaggaactgtccaggtttattgctgc

SEQ ID NO: 143686 - DNA, 38 bp, Artificial Sequence
  Description of Artificial Sequence: Synthetic oligonucleotide
aattcattgatcaggaactgtccaggtttattgctgcc

SEQ ID NO: 143687 - DNA, 37 bp, Artificial Sequence
  Description of Artificial Sequence: Synthetic oligonucleotide
attcattgatcaggaactgtccaggtttattgctgcc

SEQ ID NO: 143688 - DNA, 36 bp, Artificial Sequence
  Description of Artificial Sequence: Synthetic oligonucleotide
ttcattgatcaggaactgtccaggtttattgctgcc

SEQ ID NO: 143689 - DNA, 35 bp, Artificial Sequence
  Description of Artificial Sequence: Synthetic oligonucleotide
tcattgatcaggaactgtccaggtttattgctgcc

SEQ ID NO: 143690 - DNA, 34 bp, Artificial Sequence
  Description of Artificial Sequence: Synthetic oligonucleotide
cattgatcaggaactgtccaggtttattgctgcc

SEQ ID NO: 143691 - DNA, 34 bp, Artificial Sequence
  Description of Artificial Sequence: Synthetic oligonucleotide
attgatcaggaactgtccaggtttattgctgccg

SEQ ID NO: 143692 - DNA, 33 bp, Artificial Sequence
  Description of Artificial Sequence: Synthetic oligonucleotide
ttgatcaggaactgtccaggtttattgctgccg

SEQ ID NO: 143693 - DNA, 32 bp, Artificial Sequence
  Description of Artificial Sequence: Synthetic oligonucleotide
tgatcaggaactgtccaggtttattgctgccg

SEQ ID NO: 143694 - DNA, 31 bp, Artificial Sequence
  Description of Artificial Sequence: Synthetic oligonucleotide
gatcaggaactgtccaggtttattgctgccg

SEQ ID NO: 143695 - DNA, 31 bp, Artificial Sequence
  Description of Artificial Sequence: Synthetic oligonucleotide
atcaggaactgtccaggtttattgctgccgg

SEQ ID NO: 143696 - DNA, 30 bp, Artificial Sequence
  Description of Artificial Sequence: Synthetic oligonucleotide
tcaggaactgtccaggtttattgctgccgg

SEQ ID NO: 143697 - DNA, 29 bp, Artificial Sequence
  Description of Artificial Sequence: Synthetic oligonucleotide
caggaactgtccaggtttattgctgccgg

SEQ ID NO: 143698 - DNA, 29 bp, Artificial Sequence
  Description of Artificial Sequence: Synthetic oligonucleotide
aggaactgtccaggtttattgctgccggg

SEQ ID NO: 143699 - DNA, 28 bp, Artificial Sequence
  Description of Artificial Sequence: Synthetic oligonucleotide
ggaactgtccaggtttattgctgccggg

SEQ ID NO: 143700 - DNA, 29 bp, Artificial Sequence
  Description of Artificial Sequence: Synthetic oligonucleotide
gaactgtccaggtttattgctgccgggag

SEQ ID NO: 143701 - DNA, 30 bp, Artificial Sequence
  Description of Artificial Sequence: Synthetic oligonucleotide
aactgtccaggtttattgctgccgggagac

SEQ ID NO: 143702 - DNA, 29 bp, Artificial Sequence
  Description of Artificial Sequence: Synthetic oligonucleotide
actgtccaggtttattgctgccgggagac

SEQ ID NO: 143703 - DNA, 28 bp, Artificial Sequence
  Description of Artificial Sequence: Synthetic oligonucleotide
ctgtccaggtttattgctgccgggagac

SEQ ID NO: 143704 - DNA, 30 bp, Artificial Sequence
  Description of Artificial Sequence: Synthetic oligonucleotide
tgtccaggtttattgctgccgggagactac

SEQ ID NO: 143705 - DNA, 29 bp, Artificial Sequence
  Description of Artificial Sequence: Synthetic oligonucleotide
gtccaggtttattgctgccgggagactac

SEQ ID NO: 143706 - DNA, 30 bp, Artificial Sequence
  Description of Artificial Sequence: Synthetic oligonucleotide
tccaggtttattgctgccgggagactacac

SEQ ID NO: 143707 - DNA, 29 bp, Artificial Sequence
  Description of Artificial Sequence: Synthetic oligonucleotide
ccaggtttattgctgccgggagactacac

SEQ ID NO: 143708 - DNA, 30 bp, Artificial Sequence
  Description of Artificial Sequence: Synthetic oligonucleotide
caggtttattgctgccgggagactacactg

SEQ ID NO: 143709 - DNA, 30 bp, Artificial Sequence
  Description of Artificial Sequence: Synthetic oligonucleotide
aggtttattgctgccgggagactacactgc

SEQ ID NO: 143710 - DNA, 29 bp, Artificial Sequence
  Description of Artificial Sequence: Synthetic oligonucleotide
ggtttattgctgccgggagactacactgc

SEQ ID NO: 143711 - DNA, 35 bp, Artificial Sequence
  Description of Artificial Sequence: Synthetic oligonucleotide
gtttattgctgccgggagactacactgcaaaatag

SEQ ID NO: 143712 - DNA, 40 bp, Artificial Sequence
  Description of Artificial Sequence: Synthetic oligonucleotide
tttattgctgccgggagactacactgcaaaatagataaag

SEQ ID NO: 143713 - DNA, 39 bp, Artificial Sequence
  Description of Artificial Sequence: Synthetic oligonucleotide
ttattgctgccgggagactacactgcaaaatagataaag

SEQ ID NO: 143714 - DNA, 38 bp, Artificial Sequence
  Description of Artificial Sequence: Synthetic oligonucleotide
tattgctgccgggagactacactgcaaaatagataaag

SEQ ID NO: 143715 - DNA, 37 bp, Artificial Sequence
  Description of Artificial Sequence: Synthetic oligonucleotide
attgctgccgggagactacactgcaaaatagataaag

SEQ ID NO: 143716 - DNA, 36 bp, Artificial Sequence
  Description of Artificial Sequence: Synthetic oligonucleotide
ttgctgccgggagactacactgcaaaatagataaag

SEQ ID NO: 143717 - DNA, 35 bp, Artificial Sequence
  Description of Artificial Sequence: Synthetic oligonucleotide
tgctgccgggagactacactgcaaaatagataaag

SEQ ID NO: 143718 - DNA, 34 bp, Artificial Sequence
  Description of Artificial Sequence: Synthetic oligonucleotide
gctgccgggagactacactgcaaaatagataaag

SEQ ID NO: 143719 - DNA, 35 bp, Artificial Sequence
  Description of Artificial Sequence: Synthetic oligonucleotide
ctgccgggagactacactgcaaaatagataaagtg

SEQ ID NO: 143720 - DNA, 38 bp, Artificial Sequence
  Description of Artificial Sequence: Synthetic oligonucleotide
tgccgggagactacactgcaaaatagataaagtgaatg

SEQ ID NO: 143721 - DNA, 37 bp, Artificial Sequence
  Description of Artificial Sequence: Synthetic oligonucleotide
gccgggagactacactgcaaaatagataaagtgaatg

SEQ ID NO: 143722 - DNA, 42 bp, Artificial Sequence
  Description of Artificial Sequence: Synthetic oligonucleotide
ccgggagactacactgcaaaatagataaagtgaatgaaatag

SEQ ID NO: 143723 - DNA, 44 bp, Artificial Sequence
  Description of Artificial Sequence: Synthetic oligonucleotide
cgggagactacactgcaaaatagataaagtgaatgaaatagtag

SEQ ID NO: 143724 - DNA, 47 bp, Artificial Sequence
  Description of Artificial Sequence: Synthetic oligonucleotide
gggagactacactgcaaaatagataaagtgaatgaaatagtagaaac

SEQ ID NO: 143725 - DNA, 47 bp, Artificial Sequence
  Description of Artificial Sequence: Synthetic oligonucleotide
ggagactacactgcaaaatagataaagtgaatgaaatagtagaaacc

SEQ ID NO: 143726 - DNA, 49 bp, Artificial Sequence
  Description of Artificial Sequence: Synthetic oligonucleotide
gagactacactgcaaaatagataaagtgaatgaaatagtagaaaccaac

SEQ ID NO: 143727 - DNA, 50 bp, Artificial Sequence
  Description of Artificial Sequence: Synthetic oligonucleotide
agactacactgcaaaatagataaagtgaatgaaatagtagaaaccaacag

SEQ ID NO: 143728 - DNA, 49 bp, Artificial Sequence
  Description of Artificial Sequence: Synthetic oligonucleotide
gactacactgcaaaatagataaagtgaatgaaatagtagaaaccaacag

SEQ ID NO: 143729 - DNA, 50 bp, Artificial Sequence
  Description of Artificial Sequence: Synthetic oligonucleotide
actacactgcaaaatagataaagtgaatgaaatagtagaaaccaacagac

SEQ ID NO: 143730 - DNA, 49 bp, Artificial Sequence
  Description of Artificial Sequence: Synthetic oligonucleotide
ctacactgcaaaatagataaagtgaatgaaatagtagaaaccaacagac

SEQ ID NO: 143731 - DNA, 49 bp, Artificial Sequence
  Description of Artificial Sequence: Synthetic oligonucleotide
tacactgcaaaatagataaagtgaatgaaatagtagaaaccaacagacc

SEQ ID NO: 143732 - DNA, 48 bp, Artificial Sequence
  Description of Artificial Sequence: Synthetic oligonucleotide
acactgcaaaatagataaagtgaatgaaatagtagaaaccaacagacc

SEQ ID NO: 143733 - DNA, 47 bp, Artificial Sequence
  Description of Artificial Sequence: Synthetic oligonucleotide
cactgcaaaatagataaagtgaatgaaatagtagaaaccaacagacc

SEQ ID NO: 143734 - DNA, 48 bp, Artificial Sequence
  Description of Artificial Sequence: Synthetic oligonucleotide
actgcaaaatagataaagtgaatgaaatagtagaaaccaacagacctg

SEQ ID NO: 143735 - DNA, 47 bp, Artificial Sequence
  Description of Artificial Sequence: Synthetic oligonucleotide
ctgcaaaatagataaagtgaatgaaatagtagaaaccaacagacctg

SEQ ID NO: 143736 - DNA, 50 bp, Artificial Sequence
  Description of Artificial Sequence: Synthetic oligonucleotide
tgcaaaatagataaagtgaatgaaatagtagaaaccaacagacctgatag

SEQ ID NO: 143737 - DNA, 49 bp, Artificial Sequence
  Description of Artificial Sequence: Synthetic oligonucleotide
gcaaaatagataaagtgaatgaaatagtagaaaccaacagacctgatag

SEQ ID NO: 143738 - DNA, 49 bp, Artificial Sequence
  Description of Artificial Sequence: Synthetic oligonucleotide
caaaatagataaagtgaatgaaatagtagaaaccaacagacctgatagc

SEQ ID NO: 143739 - DNA, 51 bp, Artificial Sequence
  Description of Artificial Sequence: Synthetic oligonucleotide
aaaatagataaagtgaatgaaatagtagaaaccaacagacctgatagcaag

SEQ ID NO: 143740 - DNA, 50 bp, Artificial Sequence
  Description of Artificial Sequence: Synthetic oligonucleotide
aaatagataaagtgaatgaaatagtagaaaccaacagacctgatagcaag

SEQ ID NO: 143741 - DNA, 49 bp, Artificial Sequence
  Description of Artificial Sequence: Synthetic oligonucleotide
aatagataaagtgaatgaaatagtagaaaccaacagacctgatagcaag

SEQ ID NO: 143742 - DNA, 48 bp, Artificial Sequence
  Description of Artificial Sequence: Synthetic oligonucleotide
atagataaagtgaatgaaatagtagaaaccaacagacctgatagcaag

SEQ ID NO: 143743 - DNA, 47 bp, Artificial Sequence
  Description of Artificial Sequence: Synthetic oligonucleotide
tagataaagtgaatgaaatagtagaaaccaacagacctgatagcaag

SEQ ID NO: 143744 - DNA, 46 bp, Artificial Sequence
  Description of Artificial Sequence: Synthetic oligonucleotide
agataaagtgaatgaaatagtagaaaccaacagacctgatagcaag

SEQ ID NO: 143745 - DNA, 45 bp, Artificial Sequence
  Description of Artificial Sequence: Synthetic oligonucleotide
gataaagtgaatgaaatagtagaaaccaacagacctgatagcaag

SEQ ID NO: 143746 - DNA, 47 bp, Artificial Sequence
  Description of Artificial Sequence: Synthetic oligonucleotide
ataaagtgaatgaaatagtagaaaccaacagacctgatagcaagaac

SEQ ID NO: 143747 - DNA, 46 bp, Artificial Sequence
  Description of Artificial Sequence: Synthetic oligonucleotide
taaagtgaatgaaatagtagaaaccaacagacctgatagcaagaac

SEQ ID NO: 143748 - DNA, 45 bp, Artificial Sequence
  Description of Artificial Sequence: Synthetic oligonucleotide
aaagtgaatgaaatagtagaaaccaacagacctgatagcaagaac

SEQ ID NO: 143749 - DNA, 44 bp, Artificial Sequence
  Description of Artificial Sequence: Synthetic oligonucleotide
aagtgaatgaaatagtagaaaccaacagacctgatagcaagaac

SEQ ID NO: 143750 - DNA, 43 bp, Artificial Sequence
  Description of Artificial Sequence: Synthetic oligonucleotide
agtgaatgaaatagtagaaaccaacagacctgatagcaagaac

SEQ ID NO: 143751 - DNA, 42 bp, Artificial Sequence
  Description of Artificial Sequence: Synthetic oligonucleotide
gtgaatgaaatagtagaaaccaacagacctgatagcaagaac

SEQ ID NO: 143752 - DNA, 43 bp, Artificial Sequence
  Description of Artificial Sequence: Synthetic oligonucleotide
tgaatgaaatagtagaaaccaacagacctgatagcaagaactg

SEQ ID NO: 143753 - DNA, 42 bp, Artificial Sequence
  Description of Artificial Sequence: Synthetic oligonucleotide
gaatgaaatagtagaaaccaacagacctgatagcaagaactg

SEQ ID NO: 143754 - DNA, 42 bp, Artificial Sequence
  Description of Artificial Sequence: Synthetic oligonucleotide
aatgaaatagtagaaaccaacagacctgatagcaagaactgg

SEQ ID NO: 143755 - DNA, 41 bp, Artificial Sequence
  Description of Artificial Sequence: Synthetic oligonucleotide
atgaaatagtagaaaccaacagacctgatagcaagaactgg

SEQ ID NO: 143756 - DNA, 40 bp, Artificial Sequence
  Description of Artificial Sequence: Synthetic oligonucleotide
tgaaatagtagaaaccaacagacctgatagcaagaactgg

SEQ ID NO: 143757 - DNA, 39 bp, Artificial Sequence
  Description of Artificial Sequence: Synthetic oligonucleotide
gaaatagtagaaaccaacagacctgatagcaagaactgg

SEQ ID NO: 143758 - DNA, 39 bp, Artificial Sequence
  Description of Artificial Sequence: Synthetic oligonucleotide
aaatagtagaaaccaacagacctgatagcaagaactggc

SEQ ID NO: 143759 - DNA, 38 bp, Artificial Sequence
  Description of Artificial Sequence: Synthetic oligonucleotide
aatagtagaaaccaacagacctgatagcaagaactggc

SEQ ID NO: 143760 - DNA, 37 bp, Artificial Sequence
  Description of Artificial Sequence: Synthetic oligonucleotide
atagtagaaaccaacagacctgatagcaagaactggc

SEQ ID NO: 143761 - DNA, 36 bp, Artificial Sequence
  Description of Artificial Sequence: Synthetic oligonucleotide
tagtagaaaccaacagacctgatagcaagaactggc

SEQ ID NO: 143762 - DNA, 35 bp, Artificial Sequence
  Description of Artificial Sequence: Synthetic oligonucleotide
agtagaaaccaacagacctgatagcaagaactggc

SEQ ID NO: 143763 - DNA, 34 bp, Artificial Sequence
  Description of Artificial Sequence: Synthetic oligonucleotide
gtagaaaccaacagacctgatagcaagaactggc

SEQ ID NO: 143764 - DNA, 35 bp, Artificial Sequence
  Description of Artificial Sequence: Synthetic oligonucleotide
tagaaaccaacagacctgatagcaagaactggcag

SEQ ID NO: 143765 - DNA, 34 bp, Artificial Sequence
  Description of Artificial Sequence: Synthetic oligonucleotide
agaaaccaacagacctgatagcaagaactggcag

SEQ ID NO: 143766 - DNA, 33 bp, Artificial Sequence
  Description of Artificial Sequence: Synthetic oligonucleotide
gaaaccaacagacctgatagcaagaactggcag

SEQ ID NO: 143767 - DNA, 35 bp, Artificial Sequence
  Description of Artificial Sequence: Synthetic oligonucleotide
aaaccaacagacctgatagcaagaactggcagtac

SEQ ID NO: 143768 - DNA, 34 bp, Artificial Sequence
  Description of Artificial Sequence: Synthetic oligonucleotide
aaccaacagacctgatagcaagaactggcagtac

SEQ ID NO: 143769 - DNA, 33 bp, Artificial Sequence
  Description of Artificial Sequence: Synthetic oligonucleotide
accaacagacctgatagcaagaactggcagtac

SEQ ID NO: 143770 - DNA, 32 bp, Artificial Sequence
  Description of Artificial Sequence: Synthetic oligonucleotide
ccaacagacctgatagcaagaactggcagtac

SEQ ID NO: 143771 - DNA, 32 bp, Artificial Sequence
  Description of Artificial Sequence: Synthetic oligonucleotide
caacagacctgatagcaagaactggcagtacc

SEQ ID NO: 143772 - DNA, 34 bp, Artificial Sequence
  Description of Artificial Sequence: Synthetic oligonucleotide
aacagacctgatagcaagaactggcagtaccaag

SEQ ID NO: 143773 - DNA, 33 bp, Artificial Sequence
  Description of Artificial Sequence: Synthetic oligonucleotide
acagacctgatagcaagaactggcagtaccaag

SEQ ID NO: 143774 - DNA, 32 bp, Artificial Sequence
  Description of Artificial Sequence: Synthetic oligonucleotide
cagacctgatagcaagaactggcagtaccaag

SEQ ID NO: 143775 - DNA, 35 bp, Artificial Sequence
  Description of Artificial Sequence: Synthetic oligonucleotide
agacctgatagcaagaactggcagtaccaagaaac

SEQ ID NO: 143776 - DNA, 34 bp, Artificial Sequence
  Description of Artificial Sequence: Synthetic oligonucleotide
gacctgatagcaagaactggcagtaccaagaaac

SEQ ID NO: 143777 - DNA, 37 bp, Artificial Sequence
  Description of Artificial Sequence: Synthetic oligonucleotide
acctgatagcaagaactggcagtaccaagaaactatc

SEQ ID NO: 143778 - DNA, 36 bp, Artificial Sequence
  Description of Artificial Sequence: Synthetic oligonucleotide
cctgatagcaagaactggcagtaccaagaaactatc

SEQ ID NO: 143779 - DNA, 38 bp, Artificial Sequence
  Description of Artificial Sequence: Synthetic oligonucleotide
ctgatagcaagaactggcagtaccaagaaactatcaag

SEQ ID NO: 143780 - DNA, 41 bp, Artificial Sequence
  Description of Artificial Sequence: Synthetic oligonucleotide
tgatagcaagaactggcagtaccaagaaactatcaagaaag

SEQ ID NO: 143781 - DNA, 40 bp, Artificial Sequence
  Description of Artificial Sequence: Synthetic oligonucleotide
gatagcaagaactggcagtaccaagaaactatcaagaaag

SEQ ID NO: 143782 - DNA, 40 bp, Artificial Sequence
  Description of Artificial Sequence: Synthetic oligonucleotide
atagcaagaactggcagtaccaagaaactatcaagaaagg

SEQ ID NO: 143783 - DNA, 39 bp, Artificial Sequence
  Description of Artificial Sequence: Synthetic oligonucleotide
tagcaagaactggcagtaccaagaaactatcaagaaagg

SEQ ID NO: 143784 - DNA, 38 bp, Artificial Sequence
  Description of Artificial Sequence: Synthetic oligonucleotide
agcaagaactggcagtaccaagaaactatcaagaaagg

SEQ ID NO: 143785 - DNA, 37 bp, Artificial Sequence
  Description of Artificial Sequence: Synthetic oligonucleotide
gcaagaactggcagtaccaagaaactatcaagaaagg

SEQ ID NO: 143786 - DNA, 38 bp, Artificial Sequence
  Description of Artificial Sequence: Synthetic oligonucleotide
caagaactggcagtaccaagaaactatcaagaaaggag

SEQ ID NO: 143787 - DNA, 40 bp, Artificial Sequence
  Description of Artificial Sequence: Synthetic oligonucleotide
aagaactggcagtaccaagaaactatcaagaaaggagatc

SEQ ID NO: 143788 - DNA, 39 bp, Artificial Sequence
  Description of Artificial Sequence: Synthetic oligonucleotide
agaactggcagtaccaagaaactatcaagaaaggagatc

SEQ ID NO: 143789 - DNA, 38 bp, Artificial Sequence
  Description of Artificial Sequence: Synthetic oligonucleotide
gaactggcagtaccaagaaactatcaagaaaggagatc

SEQ ID NO: 143790 - DNA, 39 bp, Artificial Sequence
  Description of Artificial Sequence: Synthetic oligonucleotide
aactggcagtaccaagaaactatcaagaaaggagatctg

SEQ ID NO: 143791 - DNA, 38 bp, Artificial Sequence
  Description of Artificial Sequence: Synthetic oligonucleotide
actggcagtaccaagaaactatcaagaaaggagatctg

SEQ ID NO: 143792 - DNA, 37 bp, Artificial Sequence
  Description of Artificial Sequence: Synthetic oligonucleotide
ctggcagtaccaagaaactatcaagaaaggagatctg

SEQ ID NO: 143793 - DNA, 37 bp, Artificial Sequence
  Description of Artificial Sequence: Synthetic oligonucleotide
tggcagtaccaagaaactatcaagaaaggagatctgc

SEQ ID NO: 143794 - DNA, 36 bp, Artificial Sequence
  Description of Artificial Sequence: Synthetic oligonucleotide
ggcagtaccaagaaactatcaagaaaggagatctgc

SEQ ID NO: 143795 - DNA, 38 bp, Artificial Sequence
  Description of Artificial Sequence: Synthetic oligonucleotide
gcagtaccaagaaactatcaagaaaggagatctgctac

SEQ ID NO: 143796 - DNA, 42 bp, Artificial Sequence
  Description of Artificial Sequence: Synthetic oligonucleotide
cagtaccaagaaactatcaagaaaggagatctgctactaaac

SEQ ID NO: 143797 - DNA, 43 bp, Artificial Sequence
  Description of Artificial Sequence: Synthetic oligonucleotide
agtaccaagaaactatcaagaaaggagatctgctactaaacag

SEQ ID NO: 143798 - DNA, 42 bp, Artificial Sequence
  Description of Artificial Sequence: Synthetic oligonucleotide
gtaccaagaaactatcaagaaaggagatctgctactaaacag

SEQ ID NO: 143799 - DNA, 43 bp, Artificial Sequence
  Description of Artificial Sequence: Synthetic oligonucleotide
taccaagaaactatcaagaaaggagatctgctactaaacagag

SEQ ID NO: 143800 - DNA, 42 bp, Artificial Sequence
  Description of Artificial Sequence: Synthetic oligonucleotide
accaagaaactatcaagaaaggagatctgctactaaacagag

SEQ ID NO: 143801 - DNA, 41 bp, Artificial Sequence
  Description of Artificial Sequence: Synthetic oligonucleotide
ccaagaaactatcaagaaaggagatctgctactaaacagag

SEQ ID NO: 143802 - DNA, 43 bp, Artificial Sequence
  Description of Artificial Sequence: Synthetic oligonucleotide
caagaaactatcaagaaaggagatctgctactaaacagagttc

SEQ ID NO: 143803 - DNA, 48 bp, Artificial Sequence
  Description of Artificial Sequence: Synthetic oligonucleotide
aagaaactatcaagaaaggagatctgctactaaacagagttcaaaaac

SEQ ID NO: 143804 - DNA, 47 bp, Artificial Sequence
  Description of Artificial Sequence: Synthetic oligonucleotide
agaaactatcaagaaaggagatctgctactaaacagagttcaaaaac

SEQ ID NO: 143805 - DNA, 46 bp, Artificial Sequence
  Description of Artificial Sequence: Synthetic oligonucleotide
gaaactatcaagaaaggagatctgctactaaacagagttcaaaaac

SEQ ID NO: 143806 - DNA, 49 bp, Artificial Sequence
  Description of Artificial Sequence: Synthetic oligonucleotide
aaactatcaagaaaggagatctgctactaaacagagttcaaaaactttc

SEQ ID NO: 143807 - DNA, 48 bp, Artificial Sequence
  Description of Artificial Sequence: Synthetic oligonucleotide
aactatcaagaaaggagatctgctactaaacagagttcaaaaactttc

SEQ ID NO: 143808 - DNA, 47 bp, Artificial Sequence
  Description of Artificial Sequence: Synthetic oligonucleotide
actatcaagaaaggagatctgctactaaacagagttcaaaaactttc

SEQ ID NO: 143809 - DNA, 46 bp, Artificial Sequence
  Description of Artificial Sequence: Synthetic oligonucleotide
ctatcaagaaaggagatctgctactaaacagagttcaaaaactttc

SEQ ID NO: 143810 - DNA, 46 bp, Artificial Sequence
  Description of Artificial Sequence: Synthetic oligonucleotide
tatcaagaaaggagatctgctactaaacagagttcaaaaactttcc

SEQ ID NO: 143811 - DNA, 45 bp, Artificial Sequence
  Description of Artificial Sequence: Synthetic oligonucleotide
atcaagaaaggagatctgctactaaacagagttcaaaaactttcc

SEQ ID NO: 143812 - DNA, 44 bp, Artificial Sequence
  Description of Artificial Sequence: Synthetic oligonucleotide
tcaagaaaggagatctgctactaaacagagttcaaaaactttcc

SEQ ID NO: 143813 - DNA, 43 bp, Artificial Sequence
  Description of Artificial Sequence: Synthetic oligonucleotide
caagaaaggagatctgctactaaacagagttcaaaaactttcc

SEQ ID NO: 143814 - DNA, 44 bp, Artificial Sequence
  Description of Artificial Sequence: Synthetic oligonucleotide
aagaaaggagatctgctactaaacagagttcaaaaactttccag

SEQ ID NO: 143815 - DNA, 43 bp, Artificial Sequence
  Description of Artificial Sequence: Synthetic oligonucleotide
agaaaggagatctgctactaaacagagttcaaaaactttccag

SEQ ID NO: 143816 - DNA, 42 bp, Artificial Sequence
  Description of Artificial Sequence: Synthetic oligonucleotide
gaaaggagatctgctactaaacagagttcaaaaactttccag

SEQ ID NO: 143817 - DNA, 43 bp, Artificial Sequence
  Description of Artificial Sequence: Synthetic oligonucleotide
aaaggagatctgctactaaacagagttcaaaaactttccagag

SEQ ID NO: 143818 - DNA, 42 bp, Artificial Sequence
  Description of Artificial Sequence: Synthetic oligonucleotide
aaggagatctgctactaaacagagttcaaaaactttccagag

SEQ ID NO: 143819 - DNA, 41 bp, Artificial Sequence
  Description of Artificial Sequence: Synthetic oligonucleotide
aggagatctgctactaaacagagttcaaaaactttccagag

SEQ ID NO: 143820 - DNA, 40 bp, Artificial Sequence
  Description of Artificial Sequence: Synthetic oligonucleotide
ggagatctgctactaaacagagttcaaaaactttccagag

SEQ ID NO: 143821 - DNA, 50 bp, Artificial Sequence
  Description of Artificial Sequence: Synthetic oligonucleotide
gagatctgctactaaacagagttcaaaaactttccagagtaattaatatg

SEQ ID NO: 143822 - DNA, 26 bp, Artificial Sequence
  Description of Artificial Sequence: Synthetic oligonucleotide
atgccggagctggcagtgcagaaggt

SEQ ID NO: 143823 - DNA, 25 bp, Artificial Sequence
  Description of Artificial Sequence: Synthetic oligonucleotide
tgccggagctggcagtgcagaaggt

SEQ ID NO: 143824 - DNA, 24 bp, Artificial Sequence
  Description of Artificial Sequence: Synthetic oligonucleotide
gccggagctggcagtgcagaaggt

SEQ ID NO: 143825 - DNA, 24 bp, Artificial Sequence
  Description of Artificial Sequence: Synthetic oligonucleotide
ccggagctggcagtgcagaaggtg

SEQ ID NO: 143826 - DNA, 25 bp, Artificial Sequence
  Description of Artificial Sequence: Synthetic oligonucleotide
cggagctggcagtgcagaaggtggt

SEQ ID NO: 143827 - DNA, 25 bp, Artificial Sequence
  Description of Artificial Sequence: Synthetic oligonucleotide
ggagctggcagtgcagaaggtggtg

SEQ ID NO: 143828 - DNA, 26 bp, Artificial Sequence
  Description of Artificial Sequence: Synthetic oligonucleotide
gagctggcagtgcagaaggtggtggt

SEQ ID NO: 143829 - DNA, 26 bp, Artificial Sequence
  Description of Artificial Sequence: Synthetic oligonucleotide
agctggcagtgcagaaggtggtggtc

SEQ ID NO: 143830 - DNA, 25 bp, Artificial Sequence
  Description of Artificial Sequence: Synthetic oligonucleotide
gctggcagtgcagaaggtggtggtc

SEQ ID NO: 143831 - DNA, 26 bp, Artificial Sequence
  Description of Artificial Sequence: Synthetic oligonucleotide
ctggcagtgcagaaggtggtggtcca

SEQ ID NO: 143832 - DNA, 26 bp, Artificial Sequence
  Description of Artificial Sequence: Synthetic oligonucleotide
tggcagtgcagaaggtggtggtccac

SEQ ID NO: 143833 - DNA, 25 bp, Artificial Sequence
  Description of Artificial Sequence: Synthetic oligonucleotide
ggcagtgcagaaggtggtggtccac

SEQ ID NO: 143834 - DNA, 25 bp, Artificial Sequence
  Description of Artificial Sequence: Synthetic oligonucleotide
gcagtgcagaaggtggtggtccacc

SEQ ID NO: 143835 - DNA, 25 bp, Artificial Sequence
  Description of Artificial Sequence: Synthetic oligonucleotide
cagtgcagaaggtggtggtccaccc

SEQ ID NO: 143836 - DNA, 25 bp, Artificial Sequence
  Description of Artificial Sequence: Synthetic oligonucleotide
agtgcagaaggtggtggtccacccc

SEQ ID NO: 143837 - DNA, 24 bp, Artificial Sequence
  Description of Artificial Sequence: Synthetic oligonucleotide
gtgcagaaggtggtggtccacccc

SEQ ID NO: 143838 - DNA, 25 bp, Artificial Sequence
  Description of Artificial Sequence: Synthetic oligonucleotide
tgcagaaggtggtggtccaccccct

SEQ ID NO: 143839 - DNA, 24 bp, Artificial Sequence
  Description of Artificial Sequence: Synthetic oligonucleotide
gcagaaggtggtggtccaccccct

SEQ ID NO: 143840 - DNA, 24 bp, Artificial Sequence
  Description of Artificial Sequence: Synthetic oligonucleotide
cagaaggtggtggtccaccccctg

SEQ ID NO: 143841 - DNA, 25 bp, Artificial Sequence
  Description of Artificial Sequence: Synthetic oligonucleotide
agaaggtggtggtccaccccctggt

SEQ ID NO: 143842 - DNA, 24 bp, Artificial Sequence
  Description of Artificial Sequence: Synthetic oligonucleotide
gaaggtggtggtccaccccctggt

SEQ ID NO: 143843 - DNA, 24 bp, Artificial Sequence
  Description of Artificial Sequence: Synthetic oligonucleotide
aaggtggtggtccaccccctggtg

SEQ ID NO: 143844 - DNA, 23 bp, Artificial Sequence
  Description of Artificial Sequence: Synthetic oligonucleotide
aggtggtggtccaccccctggtg

SEQ ID NO: 143845 - DNA, 22 bp, Artificial Sequence
  Description of Artificial Sequence: Synthetic oligonucleotide
ggtggtggtccaccccctggtg

SEQ ID NO: 143846 - DNA, 23 bp, Artificial Sequence
  Description of Artificial Sequence: Synthetic oligonucleotide
gtggtggtccaccccctggtgct

SEQ ID NO: 143847 - DNA, 23 bp, Artificial Sequence
  Description of Artificial Sequence: Synthetic oligonucleotide
tggtggtccaccccctggtgctg

SEQ ID NO: 143848 - DNA, 22 bp, Artificial Sequence
  Description of Artificial Sequence: Synthetic oligonucleotide
ggtggtccaccccctggtgctg

SEQ ID NO: 143849 - DNA, 23 bp, Artificial Sequence
  Description of Artificial Sequence: Synthetic oligonucleotide
gtggtccaccccctggtgctgct

SEQ ID NO: 143850 - DNA, 24 bp, Artificial Sequence
  Description of Artificial Sequence: Synthetic oligonucleotide
tggtccaccccctggtgctgctca

SEQ ID NO: 143851 - DNA, 23 bp, Artificial Sequence
  Description of Artificial Sequence: Synthetic oligonucleotide
ggtccaccccctggtgctgctca

SEQ ID NO: 143852 - DNA, 24 bp, Artificial Sequence
  Description of Artificial Sequence: Synthetic oligonucleotide
gtccaccccctggtgctgctcagt

SEQ ID NO: 143853 - DNA, 25 bp, Artificial Sequence
  Description of Artificial Sequence: Synthetic oligonucleotide
tccaccccctggtgctgctcagtgt

SEQ ID NO: 143854 - DNA, 24 bp, Artificial Sequence
  Description of Artificial Sequence: Synthetic oligonucleotide
ccaccccctggtgctgctcagtgt

SEQ ID NO: 143855 - DNA, 24 bp, Artificial Sequence
  Description of Artificial Sequence: Synthetic oligonucleotide
caccccctggtgctgctcagtgtg

SEQ ID NO: 143856 - DNA, 25 bp, Artificial Sequence
  Description of Artificial Sequence: Synthetic oligonucleotide
accccctggtgctgctcagtgtggt

SEQ ID NO: 143857 - DNA, 24 bp, Artificial Sequence
  Description of Artificial Sequence: Synthetic oligonucleotide
ccccctggtgctgctcagtgtggt

SEQ ID NO: 143858 - DNA, 24 bp, Artificial Sequence
  Description of Artificial Sequence: Synthetic oligonucleotide
cccctggtgctgctcagtgtggtg

SEQ ID NO: 143859 - DNA, 26 bp, Artificial Sequence
  Description of Artificial Sequence: Synthetic oligonucleotide
ccctggtgctgctcagtgtggtggat

SEQ ID NO: 143860 - DNA, 27 bp, Artificial Sequence
  Description of Artificial Sequence: Synthetic oligonucleotide
cctggtgctgctcagtgtggtggatca

SEQ ID NO: 143861 - DNA, 30 bp, Artificial Sequence
  Description of Artificial Sequence: Synthetic oligonucleotide
ctggtgctgctcagtgtggtggatcatttc

SEQ ID NO: 143862 - DNA, 32 bp, Artificial Sequence
  Description of Artificial Sequence: Synthetic oligonucleotide
tggtgctgctcagtgtggtggatcatttcaac

SEQ ID NO: 143863 - DNA, 31 bp, Artificial Sequence
  Description of Artificial Sequence: Synthetic oligonucleotide
ggtgctgctcagtgtggtggatcatttcaac

SEQ ID NO: 143864 - DNA, 31 bp, Artificial Sequence
  Description of Artificial Sequence: Synthetic oligonucleotide
gtgctgctcagtgtggtggatcatttcaacc

SEQ ID NO: 143865 - DNA, 31 bp, Artificial Sequence
  Description of Artificial Sequence: Synthetic oligonucleotide
tgctgctcagtgtggtggatcatttcaaccg

SEQ ID NO: 143866 - DNA, 30 bp, Artificial Sequence
  Description of Artificial Sequence: Synthetic oligonucleotide
gctgctcagtgtggtggatcatttcaaccg

SEQ ID NO: 143867 - DNA, 33 bp, Artificial Sequence
  Description of Artificial Sequence: Synthetic oligonucleotide
ctgctcagtgtggtggatcatttcaaccgaatc

SEQ ID NO: 143868 - DNA, 33 bp, Artificial Sequence
  Description of Artificial Sequence: Synthetic oligonucleotide
tgctcagtgtggtggatcatttcaaccgaatcg

SEQ ID NO: 143869 - DNA, 32 bp, Artificial Sequence
  Description of Artificial Sequence: Synthetic oligonucleotide
gctcagtgtggtggatcatttcaaccgaatcg

SEQ ID NO: 143870 - DNA, 32 bp, Artificial Sequence
  Description of Artificial Sequence: Synthetic oligonucleotide
ctcagtgtggtggatcatttcaaccgaatcgg

SEQ ID NO: 143871 - DNA, 32 bp, Artificial Sequence
  Description of Artificial Sequence: Synthetic oligonucleotide
tcagtgtggtggatcatttcaaccgaatcggc

SEQ ID NO: 143872 - DNA, 31 bp, Artificial Sequence
  Description of Artificial Sequence: Synthetic oligonucleotide
cagtgtggtggatcatttcaaccgaatcggc

SEQ ID NO: 143873 - DNA, 33 bp, Artificial Sequence
  Description of Artificial Sequence: Synthetic oligonucleotide
agtgtggtggatcatttcaaccgaatcggcaag

SEQ ID NO: 143874 - DNA, 32 bp, Artificial Sequence
  Description of Artificial Sequence: Synthetic oligonucleotide
gtgtggtggatcatttcaaccgaatcggcaag

SEQ ID NO: 143875 - DNA, 32 bp, Artificial Sequence
  Description of Artificial Sequence: Synthetic oligonucleotide
tgtggtggatcatttcaaccgaatcggcaagg

SEQ ID NO: 143876 - DNA, 31 bp, Artificial Sequence
  Description of Artificial Sequence: Synthetic oligonucleotide
gtggtggatcatttcaaccgaatcggcaagg

SEQ ID NO: 143877 - DNA, 33 bp, Artificial Sequence
  Description of Artificial Sequence: Synthetic oligonucleotide
tggtggatcatttcaaccgaatcggcaaggttg

SEQ ID NO: 143878 - DNA, 32 bp, Artificial Sequence
  Description of Artificial Sequence: Synthetic oligonucleotide
ggtggatcatttcaaccgaatcggcaaggttg

SEQ ID NO: 143879 - DNA, 32 bp, Artificial Sequence
  Description of Artificial Sequence: Synthetic oligonucleotide
gtggatcatttcaaccgaatcggcaaggttgg

SEQ ID NO: 143880 - DNA, 35 bp, Artificial Sequence
  Description of Artificial Sequence: Synthetic oligonucleotide
tggatcatttcaaccgaatcggcaaggttggaaac

SEQ ID NO: 143881 - DNA, 34 bp, Artificial Sequence
  Description of Artificial Sequence: Synthetic oligonucleotide
ggatcatttcaaccgaatcggcaaggttggaaac

SEQ ID NO: 143882 - DNA, 34 bp, Artificial Sequence
  Description of Artificial Sequence: Synthetic oligonucleotide
gatcatttcaaccgaatcggcaaggttggaaacc

SEQ ID NO: 143883 - DNA, 35 bp, Artificial Sequence
  Description of Artificial Sequence: Synthetic oligonucleotide
atcatttcaaccgaatcggcaaggttggaaaccag

SEQ ID NO: 143884 - DNA, 34 bp, Artificial Sequence
  Description of Artificial Sequence: Synthetic oligonucleotide
tcatttcaaccgaatcggcaaggttggaaaccag

SEQ ID NO: 143885 - DNA, 33 bp, Artificial Sequence
  Description of Artificial Sequence: Synthetic oligonucleotide
catttcaaccgaatcggcaaggttggaaaccag

SEQ ID NO: 143886 - DNA, 35 bp, Artificial Sequence
  Description of Artificial Sequence: Synthetic oligonucleotide
atttcaaccgaatcggcaaggttggaaaccagaag

SEQ ID NO: 143887 - DNA, 34 bp, Artificial Sequence
  Description of Artificial Sequence: Synthetic oligonucleotide
tttcaaccgaatcggcaaggttggaaaccagaag

SEQ ID NO: 143888 - DNA, 33 bp, Artificial Sequence
  Description of Artificial Sequence: Synthetic oligonucleotide
ttcaaccgaatcggcaaggttggaaaccagaag

SEQ ID NO: 143889 - DNA, 32 bp, Artificial Sequence
  Description of Artificial Sequence: Synthetic oligonucleotide
tcaaccgaatcggcaaggttggaaaccagaag

SEQ ID NO: 143890 - DNA, 31 bp, Artificial Sequence
  Description of Artificial Sequence: Synthetic oligonucleotide
caaccgaatcggcaaggttggaaaccagaag

SEQ ID NO: 143891 - DNA, 31 bp, Artificial Sequence
  Description of Artificial Sequence: Synthetic oligonucleotide
aaccgaatcggcaaggttggaaaccagaagc

SEQ ID NO: 143892 - DNA, 30 bp, Artificial Sequence
  Description of Artificial Sequence: Synthetic oligonucleotide
accgaatcggcaaggttggaaaccagaagc

SEQ ID NO: 143893 - DNA, 29 bp, Artificial Sequence
  Description of Artificial Sequence: Synthetic oligonucleotide
ccgaatcggcaaggttggaaaccagaagc

SEQ ID NO: 143894 - DNA, 29 bp, Artificial Sequence
  Description of Artificial Sequence: Synthetic oligonucleotide
cgaatcggcaaggttggaaaccagaagcg

SEQ ID NO: 143895 - DNA, 30 bp, Artificial Sequence
  Description of Artificial Sequence: Synthetic oligonucleotide
gaatcggcaaggttggaaaccagaagcgtg

SEQ ID NO: 143896 - DNA, 32 bp, Artificial Sequence
  Description of Artificial Sequence: Synthetic oligonucleotide
aatcggcaaggttggaaaccagaagcgtgttg

SEQ ID NO: 143897 - DNA, 31 bp, Artificial Sequence
  Description of Artificial Sequence: Synthetic oligonucleotide
atcggcaaggttggaaaccagaagcgtgttg

SEQ ID NO: 143898 - DNA, 30 bp, Artificial Sequence
  Description of Artificial Sequence: Synthetic oligonucleotide
tcggcaaggttggaaaccagaagcgtgttg

SEQ ID NO: 143899 - DNA, 29 bp, Artificial Sequence
  Description of Artificial Sequence: Synthetic oligonucleotide
cggcaaggttggaaaccagaagcgtgttg

SEQ ID NO: 143900 - DNA, 31 bp, Artificial Sequence
  Description of Artificial Sequence: Synthetic oligonucleotide
ggcaaggttggaaaccagaagcgtgttgttg

SEQ ID NO: 143901 - DNA, 31 bp, Artificial Sequence
  Description of Artificial Sequence: Synthetic oligonucleotide
gcaaggttggaaaccagaagcgtgttgttgg

SEQ ID NO: 143902 - DNA, 32 bp, Artificial Sequence
  Description of Artificial Sequence: Synthetic oligonucleotide
caaggttggaaaccagaagcgtgttgttggtg

SEQ ID NO: 143903 - DNA, 33 bp, Artificial Sequence
  Description of Artificial Sequence: Synthetic oligonucleotide
aaggttggaaaccagaagcgtgttgttggtgtg

SEQ ID NO: 143904 - DNA, 32 bp, Artificial Sequence
  Description of Artificial Sequence: Synthetic oligonucleotide
aggttggaaaccagaagcgtgttgttggtgtg

SEQ ID NO: 143905 - DNA, 31 bp, Artificial Sequence
  Description of Artificial Sequence: Synthetic oligonucleotide
ggttggaaaccagaagcgtgttgttggtgtg

SEQ ID NO: 143906 - DNA, 31 bp, Artificial Sequence
  Description of Artificial Sequence: Synthetic oligonucleotide
gttggaaaccagaagcgtgttgttggtgtgc

SEQ ID NO: 143907 - DNA, 35 bp, Artificial Sequence
  Description of Artificial Sequence: Synthetic oligonucleotide
ttggaaaccagaagcgtgttgttggtgtgcttttg

SEQ ID NO: 143908 - DNA, 34 bp, Artificial Sequence
  Description of Artificial Sequence: Synthetic oligonucleotide
tggaaaccagaagcgtgttgttggtgtgcttttg

SEQ ID NO: 143909 - DNA, 33 bp, Artificial Sequence
  Description of Artificial Sequence: Synthetic oligonucleotide
ggaaaccagaagcgtgttgttggtgtgcttttg

SEQ ID NO: 143910 - DNA, 33 bp, Artificial Sequence
  Description of Artificial Sequence: Synthetic oligonucleotide
gaaaccagaagcgtgttgttggtgtgcttttgg

SEQ ID NO: 143911 - DNA, 33 bp, Artificial Sequence
  Description of Artificial Sequence: Synthetic oligonucleotide
aaaccagaagcgtgttgttggtgtgcttttggg

SEQ ID NO: 143912 - DNA, 32 bp, Artificial Sequence
  Description of Artificial Sequence: Synthetic oligonucleotide
aaccagaagcgtgttgttggtgtgcttttggg

SEQ ID NO: 143913 - DNA, 31 bp, Artificial Sequence
  Description of Artificial Sequence: Synthetic oligonucleotide
accagaagcgtgttgttggtgtgcttttggg

SEQ ID NO: 143914 - DNA, 30 bp, Artificial Sequence
  Description of Artificial Sequence: Synthetic oligonucleotide
ccagaagcgtgttgttggtgtgcttttggg

SEQ ID NO: 143915 - DNA, 30 bp, Artificial Sequence
  Description of Artificial Sequence: Synthetic oligonucleotide
cagaagcgtgttgttggtgtgcttttgggg

SEQ ID NO: 143916 - DNA, 31 bp, Artificial Sequence
  Description of Artificial Sequence: Synthetic oligonucleotide
agaagcgtgttgttggtgtgcttttggggtc

SEQ ID NO: 143917 - DNA, 30 bp, Artificial Sequence
  Description of Artificial Sequence: Synthetic oligonucleotide
gaagcgtgttgttggtgtgcttttggggtc

SEQ ID NO: 143918 - DNA, 32 bp, Artificial Sequence
  Description of Artificial Sequence: Synthetic oligonucleotide
aagcgtgttgttggtgtgcttttggggtcatg

SEQ ID NO: 143919 - DNA, 31 bp, Artificial Sequence
  Description of Artificial Sequence: Synthetic oligonucleotide
agcgtgttgttggtgtgcttttggggtcatg

SEQ ID NO: 143920 - DNA, 30 bp, Artificial Sequence
  Description of Artificial Sequence: Synthetic oligonucleotide
gcgtgttgttggtgtgcttttggggtcatg

SEQ ID NO: 143921 - DNA, 30 bp, Artificial Sequence
  Description of Artificial Sequence: Synthetic oligonucleotide
cgtgttgttggtgtgcttttggggtcatgg

SEQ ID NO: 143922 - DNA, 30 bp, Artificial Sequence
  Description of Artificial Sequence: Synthetic oligonucleotide
gtgttgttggtgtgcttttggggtcatggc

SEQ ID NO: 143923 - DNA, 34 bp, Artificial Sequence
  Description of Artificial Sequence: Synthetic oligonucleotide
tgttgttggtgtgcttttggggtcatggcaaaag

SEQ ID NO: 143924 - DNA, 33 bp, Artificial Sequence
  Description of Artificial Sequence: Synthetic oligonucleotide
gttgttggtgtgcttttggggtcatggcaaaag

SEQ ID NO: 143925 - DNA, 36 bp, Artificial Sequence
  Description of Artificial Sequence: Synthetic oligonucleotide
ttgttggtgtgcttttggggtcatggcaaaagaaag

SEQ ID NO: 143926 - DNA, 35 bp, Artificial Sequence
  Description of Artificial Sequence: Synthetic oligonucleotide
tgttggtgtgcttttggggtcatggcaaaagaaag

SEQ ID NO: 143927 - DNA, 34 bp, Artificial Sequence
  Description of Artificial Sequence: Synthetic oligonucleotide
gttggtgtgcttttggggtcatggcaaaagaaag

SEQ ID NO: 143928 - DNA, 36 bp, Artificial Sequence
  Description of Artificial Sequence: Synthetic oligonucleotide
ttggtgtgcttttggggtcatggcaaaagaaagtac

SEQ ID NO: 143929 - DNA, 35 bp, Artificial Sequence
  Description of Artificial Sequence: Synthetic oligonucleotide
tggtgtgcttttggggtcatggcaaaagaaagtac

SEQ ID NO: 143930 - DNA, 34 bp, Artificial Sequence
  Description of Artificial Sequence: Synthetic oligonucleotide
ggtgtgcttttggggtcatggcaaaagaaagtac

SEQ ID NO: 143931 - DNA, 36 bp, Artificial Sequence
  Description of Artificial Sequence: Synthetic oligonucleotide
gtgtgcttttggggtcatggcaaaagaaagtacttg

SEQ ID NO: 143932 - DNA, 38 bp, Artificial Sequence
  Description of Artificial Sequence: Synthetic oligonucleotide
tgtgcttttggggtcatggcaaaagaaagtacttgatg

SEQ ID NO: 143933 - DNA, 37 bp, Artificial Sequence
  Description of Artificial Sequence: Synthetic oligonucleotide
gtgcttttggggtcatggcaaaagaaagtacttgatg

SEQ ID NO: 143934 - DNA, 40 bp, Artificial Sequence
  Description of Artificial Sequence: Synthetic oligonucleotide
tgcttttggggtcatggcaaaagaaagtacttgatgtatc

SEQ ID NO: 143935 - DNA, 39 bp, Artificial Sequence
  Description of Artificial Sequence: Synthetic oligonucleotide
gcttttggggtcatggcaaaagaaagtacttgatgtatc

SEQ ID NO: 143936 - DNA, 39 bp, Artificial Sequence
  Description of Artificial Sequence: Synthetic oligonucleotide
cttttggggtcatggcaaaagaaagtacttgatgtatcg

SEQ ID NO: 143937 - DNA, 41 bp, Artificial Sequence
  Description of Artificial Sequence: Synthetic oligonucleotide
ttttggggtcatggcaaaagaaagtacttgatgtatcgaac

SEQ ID NO: 143938 - DNA, 40 bp, Artificial Sequence
  Description of Artificial Sequence: Synthetic oligonucleotide
tttggggtcatggcaaaagaaagtacttgatgtatcgaac

SEQ ID NO: 143939 - DNA, 39 bp, Artificial Sequence
  Description of Artificial Sequence: Synthetic oligonucleotide
ttggggtcatggcaaaagaaagtacttgatgtatcgaac

SEQ ID NO: 143940 - DNA, 38 bp, Artificial Sequence
  Description of Artificial Sequence: Synthetic oligonucleotide
tggggtcatggcaaaagaaagtacttgatgtatcgaac

SEQ ID NO: 143941 - DNA, 37 bp, Artificial Sequence
  Description of Artificial Sequence: Synthetic oligonucleotide
ggggtcatggcaaaagaaagtacttgatgtatcgaac

SEQ ID NO: 143942 - DNA, 38 bp, Artificial Sequence
  Description of Artificial Sequence: Synthetic oligonucleotide
gggtcatggcaaaagaaagtacttgatgtatcgaacag

SEQ ID NO: 143943 - DNA, 42 bp, Artificial Sequence
  Description of Artificial Sequence: Synthetic oligonucleotide
ggtcatggcaaaagaaagtacttgatgtatcgaacagttttg

SEQ ID NO: 143944 - DNA, 42 bp, Artificial Sequence
  Description of Artificial Sequence: Synthetic oligonucleotide
gtcatggcaaaagaaagtacttgatgtatcgaacagttttgc

SEQ ID NO: 143945 - DNA, 43 bp, Artificial Sequence
  Description of Artificial Sequence: Synthetic oligonucleotide
tcatggcaaaagaaagtacttgatgtatcgaacagttttgcag

SEQ ID NO: 143946 - DNA, 42 bp, Artificial Sequence
  Description of Artificial Sequence: Synthetic oligonucleotide
catggcaaaagaaagtacttgatgtatcgaacagttttgcag

SEQ ID NO: 143947 - DNA, 44 bp, Artificial Sequence
  Description of Artificial Sequence: Synthetic oligonucleotide
atggcaaaagaaagtacttgatgtatcgaacagttttgcagttc

SEQ ID NO: 143948 - DNA, 43 bp, Artificial Sequence
  Description of Artificial Sequence: Synthetic oligonucleotide
tggcaaaagaaagtacttgatgtatcgaacagttttgcagttc

SEQ ID NO: 143949 - DNA, 42 bp, Artificial Sequence
  Description of Artificial Sequence: Synthetic oligonucleotide
ggcaaaagaaagtacttgatgtatcgaacagttttgcagttc

SEQ ID NO: 143950 - DNA, 42 bp, Artificial Sequence
  Description of Artificial Sequence: Synthetic oligonucleotide
gcaaaagaaagtacttgatgtatcgaacagttttgcagttcc

SEQ ID NO: 143951 - DNA, 46 bp, Artificial Sequence
  Description of Artificial Sequence: Synthetic oligonucleotide
caaaagaaagtacttgatgtatcgaacagttttgcagttccttttg

SEQ ID NO: 143952 - DNA, 48 bp, Artificial Sequence
  Description of Artificial Sequence: Synthetic oligonucleotide
aaaagaaagtacttgatgtatcgaacagttttgcagttccttttgatg

SEQ ID NO: 143953 - DNA, 47 bp, Artificial Sequence
  Description of Artificial Sequence: Synthetic oligonucleotide
aaagaaagtacttgatgtatcgaacagttttgcagttccttttgatg

SEQ ID NO: 143954 - DNA, 46 bp, Artificial Sequence
  Description of Artificial Sequence: Synthetic oligonucleotide
aagaaagtacttgatgtatcgaacagttttgcagttccttttgatg

SEQ ID NO: 143955 - DNA, 45 bp, Artificial Sequence
  Description of Artificial Sequence: Synthetic oligonucleotide
agaaagtacttgatgtatcgaacagttttgcagttccttttgatg

SEQ ID NO: 143956 - DNA, 44 bp, Artificial Sequence
  Description of Artificial Sequence: Synthetic oligonucleotide
gaaagtacttgatgtatcgaacagttttgcagttccttttgatg

SEQ ID NO: 143957 - DNA, 46 bp, Artificial Sequence
  Description of Artificial Sequence: Synthetic oligonucleotide
aaagtacttgatgtatcgaacagttttgcagttccttttgatgaag

SEQ ID NO: 143958 - DNA, 45 bp, Artificial Sequence
  Description of Artificial Sequence: Synthetic oligonucleotide
aagtacttgatgtatcgaacagttttgcagttccttttgatgaag

SEQ ID NO: 143959 - DNA, 44 bp, Artificial Sequence
  Description of Artificial Sequence: Synthetic oligonucleotide
agtacttgatgtatcgaacagttttgcagttccttttgatgaag

SEQ ID NO: 143960 - DNA, 43 bp, Artificial Sequence
  Description of Artificial Sequence: Synthetic oligonucleotide
gtacttgatgtatcgaacagttttgcagttccttttgatgaag

SEQ ID NO: 143961 - DNA, 45 bp, Artificial Sequence
  Description of Artificial Sequence: Synthetic oligonucleotide
tacttgatgtatcgaacagttttgcagttccttttgatgaagatg

SEQ ID NO: 143962 - DNA, 44 bp, Artificial Sequence
  Description of Artificial Sequence: Synthetic oligonucleotide
acttgatgtatcgaacagttttgcagttccttttgatgaagatg

SEQ ID NO: 143963 - DNA, 43 bp, Artificial Sequence
  Description of Artificial Sequence: Synthetic oligonucleotide
cttgatgtatcgaacagttttgcagttccttttgatgaagatg

SEQ ID NO: 143964 - DNA, 44 bp, Artificial Sequence
  Description of Artificial Sequence: Synthetic oligonucleotide
ttgatgtatcgaacagttttgcagttccttttgatgaagatgac

SEQ ID NO: 143965 - DNA, 43 bp, Artificial Sequence
  Description of Artificial Sequence: Synthetic oligonucleotide
tgatgtatcgaacagttttgcagttccttttgatgaagatgac

SEQ ID NO: 143966 - DNA, 42 bp, Artificial Sequence
  Description of Artificial Sequence: Synthetic oligonucleotide
gatgtatcgaacagttttgcagttccttttgatgaagatgac

SEQ ID NO: 143967 - DNA, 45 bp, Artificial Sequence
  Description of Artificial Sequence: Synthetic oligonucleotide
atgtatcgaacagttttgcagttccttttgatgaagatgacaaag

SEQ ID NO: 143968 - DNA, 44 bp, Artificial Sequence
  Description of Artificial Sequence: Synthetic oligonucleotide
tgtatcgaacagttttgcagttccttttgatgaagatgacaaag

SEQ ID NO: 143969 - DNA, 43 bp, Artificial Sequence
  Description of Artificial Sequence: Synthetic oligonucleotide
gtatcgaacagttttgcagttccttttgatgaagatgacaaag

SEQ ID NO: 143970 - DNA, 44 bp, Artificial Sequence
  Description of Artificial Sequence: Synthetic oligonucleotide
tatcgaacagttttgcagttccttttgatgaagatgacaaagac

SEQ ID NO: 143971 - DNA, 43 bp, Artificial Sequence
  Description of Artificial Sequence: Synthetic oligonucleotide
atcgaacagttttgcagttccttttgatgaagatgacaaagac

SEQ ID NO: 143972 - DNA, 42 bp, Artificial Sequence
  Description of Artificial Sequence: Synthetic oligonucleotide
tcgaacagttttgcagttccttttgatgaagatgacaaagac

SEQ ID NO: 143973 - DNA, 41 bp, Artificial Sequence
  Description of Artificial Sequence: Synthetic oligonucleotide
cgaacagttttgcagttccttttgatgaagatgacaaagac

SEQ ID NO: 143974 - DNA, 41 bp, Artificial Sequence
  Description of Artificial Sequence: Synthetic oligonucleotide
gaacagttttgcagttccttttgatgaagatgacaaagacg

SEQ ID NO: 143975 - DNA, 44 bp, Artificial Sequence
  Description of Artificial Sequence: Synthetic oligonucleotide
aacagttttgcagttccttttgatgaagatgacaaagacgattc

SEQ ID NO: 143976 - DNA, 43 bp, Artificial Sequence
  Description of Artificial Sequence: Synthetic oligonucleotide
acagttttgcagttccttttgatgaagatgacaaagacgattc

SEQ ID NO: 143977 - DNA, 42 bp, Artificial Sequence
  Description of Artificial Sequence: Synthetic oligonucleotide
cagttttgcagttccttttgatgaagatgacaaagacgattc

SEQ ID NO: 143978 - DNA, 43 bp, Artificial Sequence
  Description of Artificial Sequence: Synthetic oligonucleotide
agttttgcagttccttttgatgaagatgacaaagacgattctg

SEQ ID NO: 143979 - DNA, 42 bp, Artificial Sequence
  Description of Artificial Sequence: Synthetic oligonucleotide
gttttgcagttccttttgatgaagatgacaaagacgattctg

SEQ ID NO: 143980 - DNA, 45 bp, Artificial Sequence
  Description of Artificial Sequence: Synthetic oligonucleotide
ttttgcagttccttttgatgaagatgacaaagacgattctgtatg

SEQ ID NO: 143981 - DNA, 44 bp, Artificial Sequence
  Description of Artificial Sequence: Synthetic oligonucleotide
tttgcagttccttttgatgaagatgacaaagacgattctgtatg

SEQ ID NO: 143982 - DNA, 43 bp, Artificial Sequence
  Description of Artificial Sequence: Synthetic oligonucleotide
ttgcagttccttttgatgaagatgacaaagacgattctgtatg

SEQ ID NO: 143983 - DNA, 42 bp, Artificial Sequence
  Description of Artificial Sequence: Synthetic oligonucleotide
tgcagttccttttgatgaagatgacaaagacgattctgtatg

SEQ ID NO: 143984 - DNA, 41 bp, Artificial Sequence
  Description of Artificial Sequence: Synthetic oligonucleotide
gcagttccttttgatgaagatgacaaagacgattctgtatg

SEQ ID NO: 143985 - DNA, 41 bp, Artificial Sequence
  Description of Artificial Sequence: Synthetic oligonucleotide
cagttccttttgatgaagatgacaaagacgattctgtatgg

SEQ ID NO: 143986 - DNA, 47 bp, Artificial Sequence
  Description of Artificial Sequence: Synthetic oligonucleotide
agttccttttgatgaagatgacaaagacgattctgtatggtttttag

SEQ ID NO: 143987 - DNA, 46 bp, Artificial Sequence
  Description of Artificial Sequence: Synthetic oligonucleotide
gttccttttgatgaagatgacaaagacgattctgtatggtttttag

SEQ ID NO: 143988 - DNA, 47 bp, Artificial Sequence
  Description of Artificial Sequence: Synthetic oligonucleotide
ttccttttgatgaagatgacaaagacgattctgtatggtttttagac

SEQ ID NO: 143989 - DNA, 46 bp, Artificial Sequence
  Description of Artificial Sequence: Synthetic oligonucleotide
tccttttgatgaagatgacaaagacgattctgtatggtttttagac

SEQ ID NO: 143990 - DNA, 45 bp, Artificial Sequence
  Description of Artificial Sequence: Synthetic oligonucleotide
ccttttgatgaagatgacaaagacgattctgtatggtttttagac

SEQ ID NO: 143991 - DNA, 45 bp, Artificial Sequence
  Description of Artificial Sequence: Synthetic oligonucleotide
cttttgatgaagatgacaaagacgattctgtatggtttttagacc

SEQ ID NO: 143992 - DNA, 47 bp, Artificial Sequence
  Description of Artificial Sequence: Synthetic oligonucleotide
ttttgatgaagatgacaaagacgattctgtatggtttttagaccatg

SEQ ID NO: 143993 - DNA, 46 bp, Artificial Sequence
  Description of Artificial Sequence: Synthetic oligonucleotide
tttgatgaagatgacaaagacgattctgtatggtttttagaccatg

SEQ ID NO: 143994 - DNA, 45 bp, Artificial Sequence
  Description of Artificial Sequence: Synthetic oligonucleotide
ttgatgaagatgacaaagacgattctgtatggtttttagaccatg

SEQ ID NO: 143995 - DNA, 44 bp, Artificial Sequence
  Description of Artificial Sequence: Synthetic oligonucleotide
tgatgaagatgacaaagacgattctgtatggtttttagaccatg

SEQ ID NO: 143996 - DNA, 43 bp, Artificial Sequence
  Description of Artificial Sequence: Synthetic oligonucleotide
gatgaagatgacaaagacgattctgtatggtttttagaccatg

SEQ ID NO: 143997 - DNA, 50 bp, Artificial Sequence
  Description of Artificial Sequence: Synthetic oligonucleotide
atgaagatgacaaagacgattctgtatggtttttagaccatgattatttg

SEQ ID NO: 143998 - DNA, 49 bp, Artificial Sequence
  Description of Artificial Sequence: Synthetic oligonucleotide
tgaagatgacaaagacgattctgtatggtttttagaccatgattatttg

SEQ ID NO: 143999 - DNA, 48 bp, Artificial Sequence
  Description of Artificial Sequence: Synthetic oligonucleotide
gaagatgacaaagacgattctgtatggtttttagaccatgattatttg

SEQ ID NO: 144000 - DNA, 48 bp, Artificial Sequence
  Description of Artificial Sequence: Synthetic oligonucleotide
aagatgacaaagacgattctgtatggtttttagaccatgattatttgg

SEQ ID NO: 144001 - DNA, 47 bp, Artificial Sequence
  Description of Artificial Sequence: Synthetic oligonucleotide
agatgacaaagacgattctgtatggtttttagaccatgattatttgg

SEQ ID NO: 144002 - DNA, 46 bp, Artificial Sequence
  Description of Artificial Sequence: Synthetic oligonucleotide
gatgacaaagacgattctgtatggtttttagaccatgattatttgg

SEQ ID NO: 144003 - DNA, 50 bp, Artificial Sequence
  Description of Artificial Sequence: Synthetic oligonucleotide
atgacaaagacgattctgtatggtttttagaccatgattatttggaaaac

SEQ ID NO: 144004 - DNA, 49 bp, Artificial Sequence
  Description of Artificial Sequence: Synthetic oligonucleotide
tgacaaagacgattctgtatggtttttagaccatgattatttggaaaac

SEQ ID NO: 144005 - DNA, 48 bp, Artificial Sequence
  Description of Artificial Sequence: Synthetic oligonucleotide
gacaaagacgattctgtatggtttttagaccatgattatttggaaaac

SEQ ID NO: 144006 - DNA, 50 bp, Artificial Sequence
  Description of Artificial Sequence: Synthetic oligonucleotide
acaaagacgattctgtatggtttttagaccatgattatttggaaaacatg

SEQ ID NO: 144007 - DNA, 49 bp, Artificial Sequence
  Description of Artificial Sequence: Synthetic oligonucleotide
caaagacgattctgtatggtttttagaccatgattatttggaaaacatg

SEQ ID NO: 144008 - DNA, 52 bp, Artificial Sequence
  Description of Artificial Sequence: Synthetic oligonucleotide
aaagacgattctgtatggtttttagaccatgattatttggaaaacatgtatg

SEQ ID NO: 144009 - DNA, 51 bp, Artificial Sequence
  Description of Artificial Sequence: Synthetic oligonucleotide
aagacgattctgtatggtttttagaccatgattatttggaaaacatgtatg

SEQ ID NO: 144010 - DNA, 50 bp, Artificial Sequence
  Description of Artificial Sequence: Synthetic oligonucleotide
agacgattctgtatggtttttagaccatgattatttggaaaacatgtatg

SEQ ID NO: 144011 - DNA, 49 bp, Artificial Sequence
  Description of Artificial Sequence: Synthetic oligonucleotide
gacgattctgtatggtttttagaccatgattatttggaaaacatgtatg

SEQ ID NO: 144012 - DNA, 49 bp, Artificial Sequence
  Description of Artificial Sequence: Synthetic oligonucleotide
acgattctgtatggtttttagaccatgattatttggaaaacatgtatgg

SEQ ID NO: 144013 - DNA, 48 bp, Artificial Sequence
  Description of Artificial Sequence: Synthetic oligonucleotide
cgattctgtatggtttttagaccatgattatttggaaaacatgtatgg

SEQ ID NO: 144014 - DNA, 51 bp, Artificial Sequence
  Description of Artificial Sequence: Synthetic oligonucleotide
gattctgtatggtttttagaccatgattatttggaaaacatgtatggaatg

SEQ ID NO: 144015 - DNA, 56 bp, Artificial Sequence
  Description of Artificial Sequence: Synthetic oligonucleotide
attctgtatggtttttagaccatgattatttggaaaacatgtatggaatgtttaag

SEQ ID NO: 144016 - DNA, 55 bp, Artificial Sequence
  Description of Artificial Sequence: Synthetic oligonucleotide
ttctgtatggtttttagaccatgattatttggaaaacatgtatggaatgtttaag

SEQ ID NO: 144017 - DNA, 54 bp, Artificial Sequence
  Description of Artificial Sequence: Synthetic oligonucleotide
tctgtatggtttttagaccatgattatttggaaaacatgtatggaatgtttaag

SEQ ID NO: 144018 - DNA, 53 bp, Artificial Sequence
  Description of Artificial Sequence: Synthetic oligonucleotide
ctgtatggtttttagaccatgattatttggaaaacatgtatggaatgtttaag

SEQ ID NO: 144019 - DNA, 56 bp, Artificial Sequence
  Description of Artificial Sequence: Synthetic oligonucleotide
tgtatggtttttagaccatgattatttggaaaacatgtatggaatgtttaagaaag

SEQ ID NO: 144020 - DNA, 55 bp, Artificial Sequence
  Description of Artificial Sequence: Synthetic oligonucleotide
gtatggtttttagaccatgattatttggaaaacatgtatggaatgtttaagaaag

SEQ ID NO: 144021 - DNA, 56 bp, Artificial Sequence
  Description of Artificial Sequence: Synthetic oligonucleotide
tatggtttttagaccatgattatttggaaaacatgtatggaatgtttaagaaagtc

SEQ ID NO: 144022 - DNA, 55 bp, Artificial Sequence
  Description of Artificial Sequence: Synthetic oligonucleotide
atggtttttagaccatgattatttggaaaacatgtatggaatgtttaagaaagtc

SEQ ID NO: 144023 - DNA, 54 bp, Artificial Sequence
  Description of Artificial Sequence: Synthetic oligonucleotide
tggtttttagaccatgattatttggaaaacatgtatggaatgtttaagaaagtc

SEQ ID NO: 144024 - DNA, 53 bp, Artificial Sequence
  Description of Artificial Sequence: Synthetic oligonucleotide
ggtttttagaccatgattatttggaaaacatgtatggaatgtttaagaaagtc

SEQ ID NO: 144025 - DNA, 56 bp, Artificial Sequence
  Description of Artificial Sequence: Synthetic oligonucleotide
gtttttagaccatgattatttggaaaacatgtatggaatgtttaagaaagtcaatg

SEQ ID NO: 144026 - DNA, 56 bp, Artificial Sequence
  Description of Artificial Sequence: Synthetic oligonucleotide
tttttagaccatgattatttggaaaacatgtatggaatgtttaagaaagtcaatgc

SEQ ID NO: 144027 - DNA, 55 bp, Artificial Sequence
  Description of Artificial Sequence: Synthetic oligonucleotide
ttttagaccatgattatttggaaaacatgtatggaatgtttaagaaagtcaatgc

SEQ ID NO: 144028 - DNA, 54 bp, Artificial Sequence
  Description of Artificial Sequence: Synthetic oligonucleotide
tttagaccatgattatttggaaaacatgtatggaatgtttaagaaagtcaatgc

SEQ ID NO: 144029 - DNA, 53 bp, Artificial Sequence
  Description of Artificial Sequence: Synthetic oligonucleotide
ttagaccatgattatttggaaaacatgtatggaatgtttaagaaagtcaatgc

SEQ ID NO: 144030 - DNA, 52 bp, Artificial Sequence
  Description of Artificial Sequence: Synthetic oligonucleotide
tagaccatgattatttggaaaacatgtatggaatgtttaagaaagtcaatgc

SEQ ID NO: 144031 - DNA, 51 bp, Artificial Sequence
  Description of Artificial Sequence: Synthetic oligonucleotide
agaccatgattatttggaaaacatgtatggaatgtttaagaaagtcaatgc

SEQ ID NO: 144032 - DNA, 50 bp, Artificial Sequence
  Description of Artificial Sequence: Synthetic oligonucleotide
gaccatgattatttggaaaacatgtatggaatgtttaagaaagtcaatgc

SEQ ID NO: 144033 - DNA, 50 bp, Artificial Sequence
  Description of Artificial Sequence: Synthetic oligonucleotide
accatgattatttggaaaacatgtatggaatgtttaagaaagtcaatgcc

SEQ ID NO: 144034 - DNA, 49 bp, Artificial Sequence
  Description of Artificial Sequence: Synthetic oligonucleotide
ccatgattatttggaaaacatgtatggaatgtttaagaaagtcaatgcc

SEQ ID NO: 144035 - DNA, 50 bp, Artificial Sequence
  Description of Artificial Sequence: Synthetic oligonucleotide
catgattatttggaaaacatgtatggaatgtttaagaaagtcaatgccag

SEQ ID NO: 144036 - DNA, 50 bp, Artificial Sequence
  Description of Artificial Sequence: Synthetic oligonucleotide
atgattatttggaaaacatgtatggaatgtttaagaaagtcaatgccagg

SEQ ID NO: 144037 - DNA, 49 bp, Artificial Sequence
  Description of Artificial Sequence: Synthetic oligonucleotide
tgattatttggaaaacatgtatggaatgtttaagaaagtcaatgccagg

SEQ ID NO: 144038 - DNA, 48 bp, Artificial Sequence
  Description of Artificial Sequence: Synthetic oligonucleotide
gattatttggaaaacatgtatggaatgtttaagaaagtcaatgccagg

SEQ ID NO: 144039 - DNA, 48 bp, Artificial Sequence
  Description of Artificial Sequence: Synthetic oligonucleotide
attatttggaaaacatgtatggaatgtttaagaaagtcaatgccaggg

SEQ ID NO: 144040 - DNA, 47 bp, Artificial Sequence
  Description of Artificial Sequence: Synthetic oligonucleotide
ttatttggaaaacatgtatggaatgtttaagaaagtcaatgccaggg

SEQ ID NO: 144041 - DNA, 46 bp, Artificial Sequence
  Description of Artificial Sequence: Synthetic oligonucleotide
tatttggaaaacatgtatggaatgtttaagaaagtcaatgccaggg

SEQ ID NO: 144042 - DNA, 45 bp, Artificial Sequence
  Description of Artificial Sequence: Synthetic oligonucleotide
atttggaaaacatgtatggaatgtttaagaaagtcaatgccaggg

SEQ ID NO: 144043 - DNA, 44 bp, Artificial Sequence
  Description of Artificial Sequence: Synthetic oligonucleotide
tttggaaaacatgtatggaatgtttaagaaagtcaatgccaggg

SEQ ID NO: 144044 - DNA, 43 bp, Artificial Sequence
  Description of Artificial Sequence: Synthetic oligonucleotide
ttggaaaacatgtatggaatgtttaagaaagtcaatgccaggg

SEQ ID NO: 144045 - DNA, 42 bp, Artificial Sequence
  Description of Artificial Sequence: Synthetic oligonucleotide
tggaaaacatgtatggaatgtttaagaaagtcaatgccaggg

SEQ ID NO: 144046 - DNA, 41 bp, Artificial Sequence
  Description of Artificial Sequence: Synthetic oligonucleotide
ggaaaacatgtatggaatgtttaagaaagtcaatgccaggg

SEQ ID NO: 144047 - DNA, 44 bp, Artificial Sequence
  Description of Artificial Sequence: Synthetic oligonucleotide
gaaaacatgtatggaatgtttaagaaagtcaatgccagggaaag

SEQ ID NO: 144048 - DNA, 48 bp, Artificial Sequence
  Description of Artificial Sequence: Synthetic oligonucleotide
aaaacatgtatggaatgtttaagaaagtcaatgccagggaaagaatag

SEQ ID NO: 144049 - DNA, 47 bp, Artificial Sequence
  Description of Artificial Sequence: Synthetic oligonucleotide
aaacatgtatggaatgtttaagaaagtcaatgccagggaaagaatag

SEQ ID NO: 144050 - DNA, 46 bp, Artificial Sequence
  Description of Artificial Sequence: Synthetic oligonucleotide
aacatgtatggaatgtttaagaaagtcaatgccagggaaagaatag

SEQ ID NO: 144051 - DNA, 45 bp, Artificial Sequence
  Description of Artificial Sequence: Synthetic oligonucleotide
acatgtatggaatgtttaagaaagtcaatgccagggaaagaatag

SEQ ID NO: 144052 - DNA, 44 bp, Artificial Sequence
  Description of Artificial Sequence: Synthetic oligonucleotide
catgtatggaatgtttaagaaagtcaatgccagggaaagaatag

SEQ ID NO: 144053 - DNA, 46 bp, Artificial Sequence
  Description of Artificial Sequence: Synthetic oligonucleotide
atgtatggaatgtttaagaaagtcaatgccagggaaagaatagttg

SEQ ID NO: 144054 - DNA, 45 bp, Artificial Sequence
  Description of Artificial Sequence: Synthetic oligonucleotide
tgtatggaatgtttaagaaagtcaatgccagggaaagaatagttg

SEQ ID NO: 144055 - DNA, 44 bp, Artificial Sequence
  Description of Artificial Sequence: Synthetic oligonucleotide
gtatggaatgtttaagaaagtcaatgccagggaaagaatagttg

SEQ ID NO: 144056 - DNA, 44 bp, Artificial Sequence
  Description of Artificial Sequence: Synthetic oligonucleotide
tatggaatgtttaagaaagtcaatgccagggaaagaatagttgg

SEQ ID NO: 144057 - DNA, 43 bp, Artificial Sequence
  Description of Artificial Sequence: Synthetic oligonucleotide
atggaatgtttaagaaagtcaatgccagggaaagaatagttgg

SEQ ID NO: 144058 - DNA, 42 bp, Artificial Sequence
  Description of Artificial Sequence: Synthetic oligonucleotide
tggaatgtttaagaaagtcaatgccagggaaagaatagttgg

SEQ ID NO: 144059 - DNA, 41 bp, Artificial Sequence
  Description of Artificial Sequence: Synthetic oligonucleotide
ggaatgtttaagaaagtcaatgccagggaaagaatagttgg

SEQ ID NO: 144060 - DNA, 41 bp, Artificial Sequence
  Description of Artificial Sequence: Synthetic oligonucleotide
gaatgtttaagaaagtcaatgccagggaaagaatagttggc

SEQ ID NO: 144061 - DNA, 42 bp, Artificial Sequence
  Description of Artificial Sequence: Synthetic oligonucleotide
aatgtttaagaaagtcaatgccagggaaagaatagttggctg

SEQ ID NO: 144062 - DNA, 41 bp, Artificial Sequence
  Description of Artificial Sequence: Synthetic oligonucleotide
atgtttaagaaagtcaatgccagggaaagaatagttggctg

SEQ ID NO: 144063 - DNA, 40 bp, Artificial Sequence
  Description of Artificial Sequence: Synthetic oligonucleotide
tgtttaagaaagtcaatgccagggaaagaatagttggctg

SEQ ID NO: 144064 - DNA, 39 bp, Artificial Sequence
  Description of Artificial Sequence: Synthetic oligonucleotide
gtttaagaaagtcaatgccagggaaagaatagttggctg

SEQ ID NO: 144065 - DNA, 39 bp, Artificial Sequence
  Description of Artificial Sequence: Synthetic oligonucleotide
tttaagaaagtcaatgccagggaaagaatagttggctgg

SEQ ID NO: 144066 - DNA, 38 bp, Artificial Sequence
  Description of Artificial Sequence: Synthetic oligonucleotide
ttaagaaagtcaatgccagggaaagaatagttggctgg

SEQ ID NO: 144067 - DNA, 37 bp, Artificial Sequence
  Description of Artificial Sequence: Synthetic oligonucleotide
taagaaagtcaatgccagggaaagaatagttggctgg

SEQ ID NO: 144068 - DNA, 36 bp, Artificial Sequence
  Description of Artificial Sequence: Synthetic oligonucleotide
aagaaagtcaatgccagggaaagaatagttggctgg

SEQ ID NO: 144069 - DNA, 35 bp, Artificial Sequence
  Description of Artificial Sequence: Synthetic oligonucleotide
agaaagtcaatgccagggaaagaatagttggctgg

SEQ ID NO: 144070 - DNA, 34 bp, Artificial Sequence
  Description of Artificial Sequence: Synthetic oligonucleotide
gaaagtcaatgccagggaaagaatagttggctgg

SEQ ID NO: 144071 - DNA, 36 bp, Artificial Sequence
  Description of Artificial Sequence: Synthetic oligonucleotide
aaagtcaatgccagggaaagaatagttggctggtac

SEQ ID NO: 144072 - DNA, 35 bp, Artificial Sequence
  Description of Artificial Sequence: Synthetic oligonucleotide
aagtcaatgccagggaaagaatagttggctggtac

SEQ ID NO: 144073 - DNA, 34 bp, Artificial Sequence
  Description of Artificial Sequence: Synthetic oligonucleotide
agtcaatgccagggaaagaatagttggctggtac

SEQ ID NO: 144074 - DNA, 33 bp, Artificial Sequence
  Description of Artificial Sequence: Synthetic oligonucleotide
gtcaatgccagggaaagaatagttggctggtac

SEQ ID NO: 144075 - DNA, 33 bp, Artificial Sequence
  Description of Artificial Sequence: Synthetic oligonucleotide
tcaatgccagggaaagaatagttggctggtacc

SEQ ID NO: 144076 - DNA, 32 bp, Artificial Sequence
  Description of Artificial Sequence: Synthetic oligonucleotide
caatgccagggaaagaatagttggctggtacc

SEQ ID NO: 144077 - DNA, 33 bp, Artificial Sequence
  Description of Artificial Sequence: Synthetic oligonucleotide
aatgccagggaaagaatagttggctggtaccac

SEQ ID NO: 144078 - DNA, 32 bp, Artificial Sequence
  Description of Artificial Sequence: Synthetic oligonucleotide
atgccagggaaagaatagttggctggtaccac

SEQ ID NO: 144079 - DNA, 31 bp, Artificial Sequence
  Description of Artificial Sequence: Synthetic oligonucleotide
tgccagggaaagaatagttggctggtaccac

SEQ ID NO: 144080 - DNA, 30 bp, Artificial Sequence
  Description of Artificial Sequence: Synthetic oligonucleotide
gccagggaaagaatagttggctggtaccac

SEQ ID NO: 144081 - DNA, 31 bp, Artificial Sequence
  Description of Artificial Sequence: Synthetic oligonucleotide
ccagggaaagaatagttggctggtaccacac

SEQ ID NO: 144082 - DNA, 32 bp, Artificial Sequence
  Description of Artificial Sequence: Synthetic oligonucleotide
cagggaaagaatagttggctggtaccacacag

SEQ ID NO: 144083 - DNA, 32 bp, Artificial Sequence
  Description of Artificial Sequence: Synthetic oligonucleotide
agggaaagaatagttggctggtaccacacagg

SEQ ID NO: 144084 - DNA, 31 bp, Artificial Sequence
  Description of Artificial Sequence: Synthetic oligonucleotide
gggaaagaatagttggctggtaccacacagg

SEQ ID NO: 144085 - DNA, 31 bp, Artificial Sequence
  Description of Artificial Sequence: Synthetic oligonucleotide
ggaaagaatagttggctggtaccacacaggc

SEQ ID NO: 144086 - DNA, 31 bp, Artificial Sequence
  Description of Artificial Sequence: Synthetic oligonucleotide
gaaagaatagttggctggtaccacacaggcc

SEQ ID NO: 144087 - DNA, 31 bp, Artificial Sequence
  Description of Artificial Sequence: Synthetic oligonucleotide
aaagaatagttggctggtaccacacaggccc

SEQ ID NO: 144088 - DNA, 30 bp, Artificial Sequence
  Description of Artificial Sequence: Synthetic oligonucleotide
aagaatagttggctggtaccacacaggccc

SEQ ID NO: 144089 - DNA, 29 bp, Artificial Sequence
  Description of Artificial Sequence: Synthetic oligonucleotide
agaatagttggctggtaccacacaggccc

SEQ ID NO: 144090 - DNA, 28 bp, Artificial Sequence
  Description of Artificial Sequence: Synthetic oligonucleotide
gaatagttggctggtaccacacaggccc

SEQ ID NO: 144091 - DNA, 32 bp, Artificial Sequence
  Description of Artificial Sequence: Synthetic oligonucleotide
aatagttggctggtaccacacaggccctaaac

SEQ ID NO: 144092 - DNA, 31 bp, Artificial Sequence
  Description of Artificial Sequence: Synthetic oligonucleotide
atagttggctggtaccacacaggccctaaac

SEQ ID NO: 144093 - DNA, 30 bp, Artificial Sequence
  Description of Artificial Sequence: Synthetic oligonucleotide
tagttggctggtaccacacaggccctaaac

SEQ ID NO: 144094 - DNA, 29 bp, Artificial Sequence
  Description of Artificial Sequence: Synthetic oligonucleotide
agttggctggtaccacacaggccctaaac

SEQ ID NO: 144095 - DNA, 28 bp, Artificial Sequence
  Description of Artificial Sequence: Synthetic oligonucleotide
gttggctggtaccacacaggccctaaac

SEQ ID NO: 144096 - DNA, 30 bp, Artificial Sequence
  Description of Artificial Sequence: Synthetic oligonucleotide
ttggctggtaccacacaggccctaaactac

SEQ ID NO: 144097 - DNA, 29 bp, Artificial Sequence
  Description of Artificial Sequence: Synthetic oligonucleotide
tggctggtaccacacaggccctaaactac

SEQ ID NO: 144098 - DNA, 28 bp, Artificial Sequence
  Description of Artificial Sequence: Synthetic oligonucleotide
ggctggtaccacacaggccctaaactac

SEQ ID NO: 144099 - DNA, 29 bp, Artificial Sequence
  Description of Artificial Sequence: Synthetic oligonucleotide
gctggtaccacacaggccctaaactacac

SEQ ID NO: 144100 - DNA, 31 bp, Artificial Sequence
  Description of Artificial Sequence: Synthetic oligonucleotide
ctggtaccacacaggccctaaactacacaag

SEQ ID NO: 144101 - DNA, 34 bp, Artificial Sequence
  Description of Artificial Sequence: Synthetic oligonucleotide
tggtaccacacaggccctaaactacacaagaatg

SEQ ID NO: 144102 - DNA, 33 bp, Artificial Sequence
  Description of Artificial Sequence: Synthetic oligonucleotide
ggtaccacacaggccctaaactacacaagaatg

SEQ ID NO: 144103 - DNA, 34 bp, Artificial Sequence
  Description of Artificial Sequence: Synthetic oligonucleotide
gtaccacacaggccctaaactacacaagaatgac

SEQ ID NO: 144104 - DNA, 37 bp, Artificial Sequence
  Description of Artificial Sequence: Synthetic oligonucleotide
taccacacaggccctaaactacacaagaatgacattg

SEQ ID NO: 144105 - DNA, 36 bp, Artificial Sequence
  Description of Artificial Sequence: Synthetic oligonucleotide
accacacaggccctaaactacacaagaatgacattg

SEQ ID NO: 144106 - DNA, 35 bp, Artificial Sequence
  Description of Artificial Sequence: Synthetic oligonucleotide
ccacacaggccctaaactacacaagaatgacattg

SEQ ID NO: 144107 - DNA, 35 bp, Artificial Sequence
  Description of Artificial Sequence: Synthetic oligonucleotide
cacacaggccctaaactacacaagaatgacattgc

SEQ ID NO: 144108 - DNA, 35 bp, Artificial Sequence
  Description of Artificial Sequence: Synthetic oligonucleotide
acacaggccctaaactacacaagaatgacattgcc

SEQ ID NO: 144109 - DNA, 34 bp, Artificial Sequence
  Description of Artificial Sequence: Synthetic oligonucleotide
cacaggccctaaactacacaagaatgacattgcc

SEQ ID NO: 144110 - DNA, 36 bp, Artificial Sequence
  Description of Artificial Sequence: Synthetic oligonucleotide
acaggccctaaactacacaagaatgacattgccatc

SEQ ID NO: 144111 - DNA, 35 bp, Artificial Sequence
  Description of Artificial Sequence: Synthetic oligonucleotide
caggccctaaactacacaagaatgacattgccatc

SEQ ID NO: 144112 - DNA, 37 bp, Artificial Sequence
  Description of Artificial Sequence: Synthetic oligonucleotide
aggccctaaactacacaagaatgacattgccatcaac

SEQ ID NO: 144113 - DNA, 36 bp, Artificial Sequence
  Description of Artificial Sequence: Synthetic oligonucleotide
ggccctaaactacacaagaatgacattgccatcaac

SEQ ID NO: 144114 - DNA, 36 bp, Artificial Sequence
  Description of Artificial Sequence: Synthetic oligonucleotide
gccctaaactacacaagaatgacattgccatcaacg

SEQ ID NO: 144115 - DNA, 38 bp, Artificial Sequence
  Description of Artificial Sequence: Synthetic oligonucleotide
ccctaaactacacaagaatgacattgccatcaacgaac

SEQ ID NO: 144116 - DNA, 39 bp, Artificial Sequence
  Description of Artificial Sequence: Synthetic oligonucleotide
cctaaactacacaagaatgacattgccatcaacgaactc

SEQ ID NO: 144117 - DNA, 41 bp, Artificial Sequence
  Description of Artificial Sequence: Synthetic oligonucleotide
ctaaactacacaagaatgacattgccatcaacgaactcatg

SEQ ID NO: 144118 - DNA, 45 bp, Artificial Sequence
  Description of Artificial Sequence: Synthetic oligonucleotide
taaactacacaagaatgacattgccatcaacgaactcatgaaaag

SEQ ID NO: 144119 - DNA, 44 bp, Artificial Sequence
  Description of Artificial Sequence: Synthetic oligonucleotide
aaactacacaagaatgacattgccatcaacgaactcatgaaaag

SEQ ID NO: 144120 - DNA, 43 bp, Artificial Sequence
  Description of Artificial Sequence: Synthetic oligonucleotide
aactacacaagaatgacattgccatcaacgaactcatgaaaag

SEQ ID NO: 144121 - DNA, 42 bp, Artificial Sequence
  Description of Artificial Sequence: Synthetic oligonucleotide
actacacaagaatgacattgccatcaacgaactcatgaaaag

SEQ ID NO: 144122 - DNA, 41 bp, Artificial Sequence
  Description of Artificial Sequence: Synthetic oligonucleotide
ctacacaagaatgacattgccatcaacgaactcatgaaaag

SEQ ID NO: 144123 - DNA, 44 bp, Artificial Sequence
  Description of Artificial Sequence: Synthetic oligonucleotide
tacacaagaatgacattgccatcaacgaactcatgaaaagatac

SEQ ID NO: 144124 - DNA, 43 bp, Artificial Sequence
  Description of Artificial Sequence: Synthetic oligonucleotide
acacaagaatgacattgccatcaacgaactcatgaaaagatac

SEQ ID NO: 144125 - DNA, 42 bp, Artificial Sequence
  Description of Artificial Sequence: Synthetic oligonucleotide
cacaagaatgacattgccatcaacgaactcatgaaaagatac

SEQ ID NO: 144126 - DNA, 43 bp, Artificial Sequence
  Description of Artificial Sequence: Synthetic oligonucleotide
acaagaatgacattgccatcaacgaactcatgaaaagatactg

SEQ ID NO: 144127 - DNA, 42 bp, Artificial Sequence
  Description of Artificial Sequence: Synthetic oligonucleotide
caagaatgacattgccatcaacgaactcatgaaaagatactg

SEQ ID NO: 144128 - DNA, 43 bp, Artificial Sequence
  Description of Artificial Sequence: Synthetic oligonucleotide
aagaatgacattgccatcaacgaactcatgaaaagatactgtc

SEQ ID NO: 144129 - DNA, 42 bp, Artificial Sequence
  Description of Artificial Sequence: Synthetic oligonucleotide
agaatgacattgccatcaacgaactcatgaaaagatactgtc

SEQ ID NO: 144130 - DNA, 41 bp, Artificial Sequence
  Description of Artificial Sequence: Synthetic oligonucleotide
gaatgacattgccatcaacgaactcatgaaaagatactgtc

SEQ ID NO: 144131 - DNA, 41 bp, Artificial Sequence
  Description of Artificial Sequence: Synthetic oligonucleotide
aatgacattgccatcaacgaactcatgaaaagatactgtcc

SEQ ID NO: 144132 - DNA, 40 bp, Artificial Sequence
  Description of Artificial Sequence: Synthetic oligonucleotide
atgacattgccatcaacgaactcatgaaaagatactgtcc

SEQ ID NO: 144133 - DNA, 39 bp, Artificial Sequence
  Description of Artificial Sequence: Synthetic oligonucleotide
tgacattgccatcaacgaactcatgaaaagatactgtcc

SEQ ID NO: 144134 - DNA, 38 bp, Artificial Sequence
  Description of Artificial Sequence: Synthetic oligonucleotide
gacattgccatcaacgaactcatgaaaagatactgtcc

SEQ ID NO: 144135 - DNA, 43 bp, Artificial Sequence
  Description of Artificial Sequence: Synthetic oligonucleotide
acattgccatcaacgaactcatgaaaagatactgtcctaattc

SEQ ID NO: 144136 - DNA, 42 bp, Artificial Sequence
  Description of Artificial Sequence: Synthetic oligonucleotide
cattgccatcaacgaactcatgaaaagatactgtcctaattc

SEQ ID NO: 144137 - DNA, 42 bp, Artificial Sequence
  Description of Artificial Sequence: Synthetic oligonucleotide
attgccatcaacgaactcatgaaaagatactgtcctaattcc

SEQ ID NO: 144138 - DNA, 41 bp, Artificial Sequence
  Description of Artificial Sequence: Synthetic oligonucleotide
ttgccatcaacgaactcatgaaaagatactgtcctaattcc

SEQ ID NO: 144139 - DNA, 40 bp, Artificial Sequence
  Description of Artificial Sequence: Synthetic oligonucleotide
tgccatcaacgaactcatgaaaagatactgtcctaattcc

SEQ ID NO: 144140 - DNA, 39 bp, Artificial Sequence
  Description of Artificial Sequence: Synthetic oligonucleotide
gccatcaacgaactcatgaaaagatactgtcctaattcc

SEQ ID NO: 144141 - DNA, 39 bp, Artificial Sequence
  Description of Artificial Sequence: Synthetic oligonucleotide
ccatcaacgaactcatgaaaagatactgtcctaattccg

SEQ ID NO: 144142 - DNA, 43 bp, Artificial Sequence
  Description of Artificial Sequence: Synthetic oligonucleotide
catcaacgaactcatgaaaagatactgtcctaattccgtattg

SEQ ID NO: 144143 - DNA, 43 bp, Artificial Sequence
  Description of Artificial Sequence: Synthetic oligonucleotide
atcaacgaactcatgaaaagatactgtcctaattccgtattgg

SEQ ID NO: 144144 - DNA, 42 bp, Artificial Sequence
  Description of Artificial Sequence: Synthetic oligonucleotide
tcaacgaactcatgaaaagatactgtcctaattccgtattgg

SEQ ID NO: 144145 - DNA, 41 bp, Artificial Sequence
  Description of Artificial Sequence: Synthetic oligonucleotide
caacgaactcatgaaaagatactgtcctaattccgtattgg

SEQ ID NO: 144146 - DNA, 42 bp, Artificial Sequence
  Description of Artificial Sequence: Synthetic oligonucleotide
aacgaactcatgaaaagatactgtcctaattccgtattggtc

SEQ ID NO: 144147 - DNA, 41 bp, Artificial Sequence
  Description of Artificial Sequence: Synthetic oligonucleotide
acgaactcatgaaaagatactgtcctaattccgtattggtc

SEQ ID NO: 144148 - DNA, 40 bp, Artificial Sequence
  Description of Artificial Sequence: Synthetic oligonucleotide
cgaactcatgaaaagatactgtcctaattccgtattggtc

SEQ ID NO: 144149 - DNA, 42 bp, Artificial Sequence
  Description of Artificial Sequence: Synthetic oligonucleotide
gaactcatgaaaagatactgtcctaattccgtattggtcatc

SEQ ID NO: 144150 - DNA, 45 bp, Artificial Sequence
  Description of Artificial Sequence: Synthetic oligonucleotide
aactcatgaaaagatactgtcctaattccgtattggtcatcattg

SEQ ID NO: 144151 - DNA, 44 bp, Artificial Sequence
  Description of Artificial Sequence: Synthetic oligonucleotide
actcatgaaaagatactgtcctaattccgtattggtcatcattg

SEQ ID NO: 144152 - DNA, 43 bp, Artificial Sequence
  Description of Artificial Sequence: Synthetic oligonucleotide
ctcatgaaaagatactgtcctaattccgtattggtcatcattg

SEQ ID NO: 144153 - DNA, 45 bp, Artificial Sequence
  Description of Artificial Sequence: Synthetic oligonucleotide
tcatgaaaagatactgtcctaattccgtattggtcatcattgatg

SEQ ID NO: 144154 - DNA, 44 bp, Artificial Sequence
  Description of Artificial Sequence: Synthetic oligonucleotide
catgaaaagatactgtcctaattccgtattggtcatcattgatg

SEQ ID NO: 144155 - DNA, 45 bp, Artificial Sequence
  Description of Artificial Sequence: Synthetic oligonucleotide
atgaaaagatactgtcctaattccgtattggtcatcattgatgtg

SEQ ID NO: 144156 - DNA, 44 bp, Artificial Sequence
  Description of Artificial Sequence: Synthetic oligonucleotide
tgaaaagatactgtcctaattccgtattggtcatcattgatgtg

SEQ ID NO: 144157 - DNA, 43 bp, Artificial Sequence
  Description of Artificial Sequence: Synthetic oligonucleotide
gaaaagatactgtcctaattccgtattggtcatcattgatgtg

SEQ ID NO: 144158 - DNA, 45 bp, Artificial Sequence
  Description of Artificial Sequence: Synthetic oligonucleotide
aaaagatactgtcctaattccgtattggtcatcattgatgtgaag

SEQ ID NO: 144159 - DNA, 44 bp, Artificial Sequence
  Description of Artificial Sequence: Synthetic oligonucleotide
aaagatactgtcctaattccgtattggtcatcattgatgtgaag

SEQ ID NO: 144160 - DNA, 43 bp, Artificial Sequence
  Description of Artificial Sequence: Synthetic oligonucleotide
aagatactgtcctaattccgtattggtcatcattgatgtgaag

SEQ ID NO: 144161 - DNA, 42 bp, Artificial Sequence
  Description of Artificial Sequence: Synthetic oligonucleotide
agatactgtcctaattccgtattggtcatcattgatgtgaag

SEQ ID NO: 144162 - DNA, 41 bp, Artificial Sequence
  Description of Artificial Sequence: Synthetic oligonucleotide
gatactgtcctaattccgtattggtcatcattgatgtgaag

SEQ ID NO: 144163 - DNA, 41 bp, Artificial Sequence
  Description of Artificial Sequence: Synthetic oligonucleotide
atactgtcctaattccgtattggtcatcattgatgtgaagc

SEQ ID NO: 144164 - DNA, 40 bp, Artificial Sequence
  Description of Artificial Sequence: Synthetic oligonucleotide
tactgtcctaattccgtattggtcatcattgatgtgaagc

SEQ ID NO: 144165 - DNA, 39 bp, Artificial Sequence
  Description of Artificial Sequence: Synthetic oligonucleotide
actgtcctaattccgtattggtcatcattgatgtgaagc

SEQ ID NO: 144166 - DNA, 38 bp, Artificial Sequence
  Description of Artificial Sequence: Synthetic oligonucleotide
ctgtcctaattccgtattggtcatcattgatgtgaagc

SEQ ID NO: 144167 - DNA, 38 bp, Artificial Sequence
  Description of Artificial Sequence: Synthetic oligonucleotide
tgtcctaattccgtattggtcatcattgatgtgaagcc

SEQ ID NO: 144168 - DNA, 37 bp, Artificial Sequence
  Description of Artificial Sequence: Synthetic oligonucleotide
gtcctaattccgtattggtcatcattgatgtgaagcc

SEQ ID NO: 144169 - DNA, 37 bp, Artificial Sequence
  Description of Artificial Sequence: Synthetic oligonucleotide
tcctaattccgtattggtcatcattgatgtgaagccg

SEQ ID NO: 144170 - DNA, 36 bp, Artificial Sequence
  Description of Artificial Sequence: Synthetic oligonucleotide
cctaattccgtattggtcatcattgatgtgaagccg

SEQ ID NO: 144171 - DNA, 38 bp, Artificial Sequence
  Description of Artificial Sequence: Synthetic oligonucleotide
ctaattccgtattggtcatcattgatgtgaagccgaag

SEQ ID NO: 144172 - DNA, 38 bp, Artificial Sequence
  Description of Artificial Sequence: Synthetic oligonucleotide
taattccgtattggtcatcattgatgtgaagccgaagg

SEQ ID NO: 144173 - DNA, 37 bp, Artificial Sequence
  Description of Artificial Sequence: Synthetic oligonucleotide
aattccgtattggtcatcattgatgtgaagccgaagg

SEQ ID NO: 144174 - DNA, 36 bp, Artificial Sequence
  Description of Artificial Sequence: Synthetic oligonucleotide
attccgtattggtcatcattgatgtgaagccgaagg

SEQ ID NO: 144175 - DNA, 35 bp, Artificial Sequence
  Description of Artificial Sequence: Synthetic oligonucleotide
ttccgtattggtcatcattgatgtgaagccgaagg

SEQ ID NO: 144176 - DNA, 34 bp, Artificial Sequence
  Description of Artificial Sequence: Synthetic oligonucleotide
tccgtattggtcatcattgatgtgaagccgaagg

SEQ ID NO: 144177 - DNA, 33 bp, Artificial Sequence
  Description of Artificial Sequence: Synthetic oligonucleotide
ccgtattggtcatcattgatgtgaagccgaagg

SEQ ID NO: 144178 - DNA, 34 bp, Artificial Sequence
  Description of Artificial Sequence: Synthetic oligonucleotide
cgtattggtcatcattgatgtgaagccgaaggac

SEQ ID NO: 144179 - DNA, 34 bp, Artificial Sequence
  Description of Artificial Sequence: Synthetic oligonucleotide
gtattggtcatcattgatgtgaagccgaaggacc

SEQ ID NO: 144180 - DNA, 36 bp, Artificial Sequence
  Description of Artificial Sequence: Synthetic oligonucleotide
tattggtcatcattgatgtgaagccgaaggacctag

SEQ ID NO: 144181 - DNA, 35 bp, Artificial Sequence
  Description of Artificial Sequence: Synthetic oligonucleotide
attggtcatcattgatgtgaagccgaaggacctag

SEQ ID NO: 144182 - DNA, 34 bp, Artificial Sequence
  Description of Artificial Sequence: Synthetic oligonucleotide
ttggtcatcattgatgtgaagccgaaggacctag

SEQ ID NO: 144183 - DNA, 33 bp, Artificial Sequence
  Description of Artificial Sequence: Synthetic oligonucleotide
tggtcatcattgatgtgaagccgaaggacctag

SEQ ID NO: 144184 - DNA, 32 bp, Artificial Sequence
  Description of Artificial Sequence: Synthetic oligonucleotide
ggtcatcattgatgtgaagccgaaggacctag

SEQ ID NO: 144185 - DNA, 32 bp, Artificial Sequence
  Description of Artificial Sequence: Synthetic oligonucleotide
gtcatcattgatgtgaagccgaaggacctagg

SEQ ID NO: 144186 - DNA, 32 bp, Artificial Sequence
  Description of Artificial Sequence: Synthetic oligonucleotide
tcatcattgatgtgaagccgaaggacctaggg

SEQ ID NO: 144187 - DNA, 31 bp, Artificial Sequence
  Description of Artificial Sequence: Synthetic oligonucleotide
catcattgatgtgaagccgaaggacctaggg

SEQ ID NO: 144188 - DNA, 31 bp, Artificial Sequence
  Description of Artificial Sequence: Synthetic oligonucleotide
atcattgatgtgaagccgaaggacctagggc

SEQ ID NO: 144189 - DNA, 30 bp, Artificial Sequence
  Description of Artificial Sequence: Synthetic oligonucleotide
tcattgatgtgaagccgaaggacctagggc

SEQ ID NO: 144190 - DNA, 29 bp, Artificial Sequence
  Description of Artificial Sequence: Synthetic oligonucleotide
cattgatgtgaagccgaaggacctagggc

SEQ ID NO: 144191 - DNA, 30 bp, Artificial Sequence
  Description of Artificial Sequence: Synthetic oligonucleotide
attgatgtgaagccgaaggacctagggctg

SEQ ID NO: 144192 - DNA, 29 bp, Artificial Sequence
  Description of Artificial Sequence: Synthetic oligonucleotide
ttgatgtgaagccgaaggacctagggctg

SEQ ID NO: 144193 - DNA, 28 bp, Artificial Sequence
  Description of Artificial Sequence: Synthetic oligonucleotide
tgatgtgaagccgaaggacctagggctg

SEQ ID NO: 144194 - DNA, 27 bp, Artificial Sequence
  Description of Artificial Sequence: Synthetic oligonucleotide
gatgtgaagccgaaggacctagggctg

SEQ ID NO: 144195 - DNA, 27 bp, Artificial Sequence
  Description of Artificial Sequence: Synthetic oligonucleotide
atgtgaagccgaaggacctagggctgc

SEQ ID NO: 144196 - DNA, 26 bp, Artificial Sequence
  Description of Artificial Sequence: Synthetic oligonucleotide
tgtgaagccgaaggacctagggctgc

SEQ ID NO: 144197 - DNA, 25 bp, Artificial Sequence
  Description of Artificial Sequence: Synthetic oligonucleotide
gtgaagccgaaggacctagggctgc

SEQ ID NO: 144198 - DNA, 27 bp, Artificial Sequence
  Description of Artificial Sequence: Synthetic oligonucleotide
tgaagccgaaggacctagggctgccta

SEQ ID NO: 144199 - DNA, 26 bp, Artificial Sequence
  Description of Artificial Sequence: Synthetic oligonucleotide
gaagccgaaggacctagggctgccta

SEQ ID NO: 144200 - DNA, 27 bp, Artificial Sequence
  Description of Artificial Sequence: Synthetic oligonucleotide
aagccgaaggacctagggctgcctaca

SEQ ID NO: 144201 - DNA, 26 bp, Artificial Sequence
  Description of Artificial Sequence: Synthetic oligonucleotide
agccgaaggacctagggctgcctaca

SEQ ID NO: 144202 - DNA, 25 bp, Artificial Sequence
  Description of Artificial Sequence: Synthetic oligonucleotide
gccgaaggacctagggctgcctaca

SEQ ID NO: 144203 - DNA, 27 bp, Artificial Sequence
  Description of Artificial Sequence: Synthetic oligonucleotide
ccgaaggacctagggctgcctacagaa

SEQ ID NO: 144204 - DNA, 27 bp, Artificial Sequence
  Description of Artificial Sequence: Synthetic oligonucleotide
cgaaggacctagggctgcctacagaag

SEQ ID NO: 144205 - DNA, 27 bp, Artificial Sequence
  Description of Artificial Sequence: Synthetic oligonucleotide
gaaggacctagggctgcctacagaagc

SEQ ID NO: 144206 - DNA, 27 bp, Artificial Sequence
  Description of Artificial Sequence: Synthetic oligonucleotide
aaggacctagggctgcctacagaagcg

SEQ ID NO: 144207 - DNA, 27 bp, Artificial Sequence
  Description of Artificial Sequence: Synthetic oligonucleotide
aggacctagggctgcctacagaagcgt

SEQ ID NO: 144208 - DNA, 27 bp, Artificial Sequence
  Description of Artificial Sequence: Synthetic oligonucleotide
ggacctagggctgcctacagaagcgta

SEQ ID NO: 144209 - DNA, 27 bp, Artificial Sequence
  Description of Artificial Sequence: Synthetic oligonucleotide
gacctagggctgcctacagaagcgtac

SEQ ID NO: 144210 - DNA, 31 bp, Artificial Sequence
  Description of Artificial Sequence: Synthetic oligonucleotide
acctagggctgcctacagaagcgtacatttc

SEQ ID NO: 144211 - DNA, 30 bp, Artificial Sequence
  Description of Artificial Sequence: Synthetic oligonucleotide
cctagggctgcctacagaagcgtacatttc

SEQ ID NO: 144212 - DNA, 31 bp, Artificial Sequence
  Description of Artificial Sequence: Synthetic oligonucleotide
ctagggctgcctacagaagcgtacatttcag

SEQ ID NO: 144213 - DNA, 32 bp, Artificial Sequence
  Description of Artificial Sequence: Synthetic oligonucleotide
tagggctgcctacagaagcgtacatttcagtg

SEQ ID NO: 144214 - DNA, 31 bp, Artificial Sequence
  Description of Artificial Sequence: Synthetic oligonucleotide
agggctgcctacagaagcgtacatttcagtg

SEQ ID NO: 144215 - DNA, 30 bp, Artificial Sequence
  Description of Artificial Sequence: Synthetic oligonucleotide
gggctgcctacagaagcgtacatttcagtg

SEQ ID NO: 144216 - DNA, 30 bp, Artificial Sequence
  Description of Artificial Sequence: Synthetic oligonucleotide
ggctgcctacagaagcgtacatttcagtgg

SEQ ID NO: 144217 - DNA, 32 bp, Artificial Sequence
  Description of Artificial Sequence: Synthetic oligonucleotide
gctgcctacagaagcgtacatttcagtggaag

SEQ ID NO: 144218 - DNA, 34 bp, Artificial Sequence
  Description of Artificial Sequence: Synthetic oligonucleotide
ctgcctacagaagcgtacatttcagtggaagaag

SEQ ID NO: 144219 - DNA, 35 bp, Artificial Sequence
  Description of Artificial Sequence: Synthetic oligonucleotide
tgcctacagaagcgtacatttcagtggaagaagtc

SEQ ID NO: 144220 - DNA, 34 bp, Artificial Sequence
  Description of Artificial Sequence: Synthetic oligonucleotide
gcctacagaagcgtacatttcagtggaagaagtc

SEQ ID NO: 144221 - DNA, 34 bp, Artificial Sequence
  Description of Artificial Sequence: Synthetic oligonucleotide
cctacagaagcgtacatttcagtggaagaagtcc

SEQ ID NO: 144222 - DNA, 36 bp, Artificial Sequence
  Description of Artificial Sequence: Synthetic oligonucleotide
ctacagaagcgtacatttcagtggaagaagtccatg

SEQ ID NO: 144223 - DNA, 38 bp, Artificial Sequence
  Description of Artificial Sequence: Synthetic oligonucleotide
tacagaagcgtacatttcagtggaagaagtccatgatg

SEQ ID NO: 144224 - DNA, 37 bp, Artificial Sequence
  Description of Artificial Sequence: Synthetic oligonucleotide
acagaagcgtacatttcagtggaagaagtccatgatg

SEQ ID NO: 144225 - DNA, 36 bp, Artificial Sequence
  Description of Artificial Sequence: Synthetic oligonucleotide
cagaagcgtacatttcagtggaagaagtccatgatg

SEQ ID NO: 144226 - DNA, 38 bp, Artificial Sequence
  Description of Artificial Sequence: Synthetic oligonucleotide
agaagcgtacatttcagtggaagaagtccatgatgatg

SEQ ID NO: 144227 - DNA, 37 bp, Artificial Sequence
  Description of Artificial Sequence: Synthetic oligonucleotide
gaagcgtacatttcagtggaagaagtccatgatgatg

SEQ ID NO: 144228 - DNA, 37 bp, Artificial Sequence
  Description of Artificial Sequence: Synthetic oligonucleotide
aagcgtacatttcagtggaagaagtccatgatgatgg

SEQ ID NO: 144229 - DNA, 36 bp, Artificial Sequence
  Description of Artificial Sequence: Synthetic oligonucleotide
agcgtacatttcagtggaagaagtccatgatgatgg

SEQ ID NO: 144230 - DNA, 35 bp, Artificial Sequence
  Description of Artificial Sequence: Synthetic oligonucleotide
gcgtacatttcagtggaagaagtccatgatgatgg

SEQ ID NO: 144231 - DNA, 37 bp, Artificial Sequence
  Description of Artificial Sequence: Synthetic oligonucleotide
cgtacatttcagtggaagaagtccatgatgatggaac

SEQ ID NO: 144232 - DNA, 38 bp, Artificial Sequence
  Description of Artificial Sequence: Synthetic oligonucleotide
gtacatttcagtggaagaagtccatgatgatggaactc

SEQ ID NO: 144233 - DNA, 38 bp, Artificial Sequence
  Description of Artificial Sequence: Synthetic oligonucleotide
tacatttcagtggaagaagtccatgatgatggaactcc

SEQ ID NO: 144234 - DNA, 37 bp, Artificial Sequence
  Description of Artificial Sequence: Synthetic oligonucleotide
acatttcagtggaagaagtccatgatgatggaactcc

SEQ ID NO: 144235 - DNA, 36 bp, Artificial Sequence
  Description of Artificial Sequence: Synthetic oligonucleotide
catttcagtggaagaagtccatgatgatggaactcc

SEQ ID NO: 144236 - DNA, 38 bp, Artificial Sequence
  Description of Artificial Sequence: Synthetic oligonucleotide
atttcagtggaagaagtccatgatgatggaactccaac

SEQ ID NO: 144237 - DNA, 37 bp, Artificial Sequence
  Description of Artificial Sequence: Synthetic oligonucleotide
tttcagtggaagaagtccatgatgatggaactccaac

SEQ ID NO: 144238 - DNA, 36 bp, Artificial Sequence
  Description of Artificial Sequence: Synthetic oligonucleotide
ttcagtggaagaagtccatgatgatggaactccaac

SEQ ID NO: 144239 - DNA, 35 bp, Artificial Sequence
  Description of Artificial Sequence: Synthetic oligonucleotide
tcagtggaagaagtccatgatgatggaactccaac

SEQ ID NO: 144240 - DNA, 34 bp, Artificial Sequence
  Description of Artificial Sequence: Synthetic oligonucleotide
cagtggaagaagtccatgatgatggaactccaac

SEQ ID NO: 144241 - DNA, 34 bp, Artificial Sequence
  Description of Artificial Sequence: Synthetic oligonucleotide
agtggaagaagtccatgatgatggaactccaacc

SEQ ID NO: 144242 - DNA, 33 bp, Artificial Sequence
  Description of Artificial Sequence: Synthetic oligonucleotide
gtggaagaagtccatgatgatggaactccaacc

SEQ ID NO: 144243 - DNA, 34 bp, Artificial Sequence
  Description of Artificial Sequence: Synthetic oligonucleotide
tggaagaagtccatgatgatggaactccaacctc

SEQ ID NO: 144244 - DNA, 33 bp, Artificial Sequence
  Description of Artificial Sequence: Synthetic oligonucleotide
ggaagaagtccatgatgatggaactccaacctc

SEQ ID NO: 144245 - DNA, 33 bp, Artificial Sequence
  Description of Artificial Sequence: Synthetic oligonucleotide
gaagaagtccatgatgatggaactccaacctcg

SEQ ID NO: 144246 - DNA, 37 bp, Artificial Sequence
  Description of Artificial Sequence: Synthetic oligonucleotide
aagaagtccatgatgatggaactccaacctcgaaaac

SEQ ID NO: 144247 - DNA, 36 bp, Artificial Sequence
  Description of Artificial Sequence: Synthetic oligonucleotide
agaagtccatgatgatggaactccaacctcgaaaac

SEQ ID NO: 144248 - DNA, 35 bp, Artificial Sequence
  Description of Artificial Sequence: Synthetic oligonucleotide
gaagtccatgatgatggaactccaacctcgaaaac

SEQ ID NO: 144249 - DNA, 39 bp, Artificial Sequence
  Description of Artificial Sequence: Synthetic oligonucleotide
aagtccatgatgatggaactccaacctcgaaaacatttg

SEQ ID NO: 144250 - DNA, 38 bp, Artificial Sequence
  Description of Artificial Sequence: Synthetic oligonucleotide
agtccatgatgatggaactccaacctcgaaaacatttg

SEQ ID NO: 144251 - DNA, 37 bp, Artificial Sequence
  Description of Artificial Sequence: Synthetic oligonucleotide
gtccatgatgatggaactccaacctcgaaaacatttg

SEQ ID NO: 144252 - DNA, 39 bp, Artificial Sequence
  Description of Artificial Sequence: Synthetic oligonucleotide
tccatgatgatggaactccaacctcgaaaacatttgaac

SEQ ID NO: 144253 - DNA, 38 bp, Artificial Sequence
  Description of Artificial Sequence: Synthetic oligonucleotide
ccatgatgatggaactccaacctcgaaaacatttgaac

SEQ ID NO: 144254 - DNA, 39 bp, Artificial Sequence
  Description of Artificial Sequence: Synthetic oligonucleotide
catgatgatggaactccaacctcgaaaacatttgaacac

SEQ ID NO: 144255 - DNA, 39 bp, Artificial Sequence
  Description of Artificial Sequence: Synthetic oligonucleotide
atgatgatggaactccaacctcgaaaacatttgaacacg

SEQ ID NO: 144256 - DNA, 38 bp, Artificial Sequence
  Description of Artificial Sequence: Synthetic oligonucleotide
tgatgatggaactccaacctcgaaaacatttgaacacg

SEQ ID NO: 144257 - DNA, 37 bp, Artificial Sequence
  Description of Artificial Sequence: Synthetic oligonucleotide
gatgatggaactccaacctcgaaaacatttgaacacg

SEQ ID NO: 144258 - DNA, 38 bp, Artificial Sequence
  Description of Artificial Sequence: Synthetic oligonucleotide
atgatggaactccaacctcgaaaacatttgaacacgtg

SEQ ID NO: 144259 - DNA, 37 bp, Artificial Sequence
  Description of Artificial Sequence: Synthetic oligonucleotide
tgatggaactccaacctcgaaaacatttgaacacgtg

SEQ ID NO: 144260 - DNA, 36 bp, Artificial Sequence
  Description of Artificial Sequence: Synthetic oligonucleotide
gatggaactccaacctcgaaaacatttgaacacgtg

SEQ ID NO: 144261 - DNA, 37 bp, Artificial Sequence
  Description of Artificial Sequence: Synthetic oligonucleotide
atggaactccaacctcgaaaacatttgaacacgtgac

SEQ ID NO: 144262 - DNA, 36 bp, Artificial Sequence
  Description of Artificial Sequence: Synthetic oligonucleotide
tggaactccaacctcgaaaacatttgaacacgtgac

SEQ ID NO: 144263 - DNA, 35 bp, Artificial Sequence
  Description of Artificial Sequence: Synthetic oligonucleotide
ggaactccaacctcgaaaacatttgaacacgtgac

SEQ ID NO: 144264 - DNA, 35 bp, Artificial Sequence
  Description of Artificial Sequence: Synthetic oligonucleotide
gaactccaacctcgaaaacatttgaacacgtgacc

SEQ ID NO: 144265 - DNA, 36 bp, Artificial Sequence
  Description of Artificial Sequence: Synthetic oligonucleotide
aactccaacctcgaaaacatttgaacacgtgaccag

SEQ ID NO: 144266 - DNA, 35 bp, Artificial Sequence
  Description of Artificial Sequence: Synthetic oligonucleotide
actccaacctcgaaaacatttgaacacgtgaccag

SEQ ID NO: 144267 - DNA, 34 bp, Artificial Sequence
  Description of Artificial Sequence: Synthetic oligonucleotide
ctccaacctcgaaaacatttgaacacgtgaccag

SEQ ID NO: 144268 - DNA, 35 bp, Artificial Sequence
  Description of Artificial Sequence: Synthetic oligonucleotide
tccaacctcgaaaacatttgaacacgtgaccagtg

SEQ ID NO: 144269 - DNA, 34 bp, Artificial Sequence
  Description of Artificial Sequence: Synthetic oligonucleotide
ccaacctcgaaaacatttgaacacgtgaccagtg

SEQ ID NO: 144270 - DNA, 39 bp, Artificial Sequence
  Description of Artificial Sequence: Synthetic oligonucleotide
caacctcgaaaacatttgaacacgtgaccagtgaaattg

SEQ ID NO: 144271 - DNA, 39 bp, Artificial Sequence
  Description of Artificial Sequence: Synthetic oligonucleotide
aacctcgaaaacatttgaacacgtgaccagtgaaattgg

SEQ ID NO: 144272 - DNA, 38 bp, Artificial Sequence
  Description of Artificial Sequence: Synthetic oligonucleotide
acctcgaaaacatttgaacacgtgaccagtgaaattgg

SEQ ID NO: 144273 - DNA, 37 bp, Artificial Sequence
  Description of Artificial Sequence: Synthetic oligonucleotide
cctcgaaaacatttgaacacgtgaccagtgaaattgg

SEQ ID NO: 144274 - DNA, 38 bp, Artificial Sequence
  Description of Artificial Sequence: Synthetic oligonucleotide
ctcgaaaacatttgaacacgtgaccagtgaaattggag

SEQ ID NO: 144275 - DNA, 38 bp, Artificial Sequence
  Description of Artificial Sequence: Synthetic oligonucleotide
tcgaaaacatttgaacacgtgaccagtgaaattggagc

SEQ ID NO: 144276 - DNA, 37 bp, Artificial Sequence
  Description of Artificial Sequence: Synthetic oligonucleotide
cgaaaacatttgaacacgtgaccagtgaaattggagc

SEQ ID NO: 144277 - DNA, 38 bp, Artificial Sequence
  Description of Artificial Sequence: Synthetic oligonucleotide
gaaaacatttgaacacgtgaccagtgaaattggagcag

SEQ ID NO: 144278 - DNA, 39 bp, Artificial Sequence
  Description of Artificial Sequence: Synthetic oligonucleotide
aaaacatttgaacacgtgaccagtgaaattggagcagag

SEQ ID NO: 144279 - DNA, 38 bp, Artificial Sequence
  Description of Artificial Sequence: Synthetic oligonucleotide
aaacatttgaacacgtgaccagtgaaattggagcagag

SEQ ID NO: 144280 - DNA, 37 bp, Artificial Sequence
  Description of Artificial Sequence: Synthetic oligonucleotide
aacatttgaacacgtgaccagtgaaattggagcagag

SEQ ID NO: 144281 - DNA, 36 bp, Artificial Sequence
  Description of Artificial Sequence: Synthetic oligonucleotide
acatttgaacacgtgaccagtgaaattggagcagag

SEQ ID NO: 144282 - DNA, 35 bp, Artificial Sequence
  Description of Artificial Sequence: Synthetic oligonucleotide
catttgaacacgtgaccagtgaaattggagcagag

SEQ ID NO: 144283 - DNA, 35 bp, Artificial Sequence
  Description of Artificial Sequence: Synthetic oligonucleotide
atttgaacacgtgaccagtgaaattggagcagagg

SEQ ID NO: 144284 - DNA, 34 bp, Artificial Sequence
  Description of Artificial Sequence: Synthetic oligonucleotide
tttgaacacgtgaccagtgaaattggagcagagg

SEQ ID NO: 144285 - DNA, 33 bp, Artificial Sequence
  Description of Artificial Sequence: Synthetic oligonucleotide
ttgaacacgtgaccagtgaaattggagcagagg

SEQ ID NO: 144286 - DNA, 32 bp, Artificial Sequence
  Description of Artificial Sequence: Synthetic oligonucleotide
tgaacacgtgaccagtgaaattggagcagagg

SEQ ID NO: 144287 - DNA, 31 bp, Artificial Sequence
  Description of Artificial Sequence: Synthetic oligonucleotide
gaacacgtgaccagtgaaattggagcagagg

SEQ ID NO: 144288 - DNA, 33 bp, Artificial Sequence
  Description of Artificial Sequence: Synthetic oligonucleotide
aacacgtgaccagtgaaattggagcagaggaag

SEQ ID NO: 144289 - DNA, 32 bp, Artificial Sequence
  Description of Artificial Sequence: Synthetic oligonucleotide
acacgtgaccagtgaaattggagcagaggaag

SEQ ID NO: 144290 - DNA, 31 bp, Artificial Sequence
  Description of Artificial Sequence: Synthetic oligonucleotide
cacgtgaccagtgaaattggagcagaggaag

SEQ ID NO: 144291 - DNA, 31 bp, Artificial Sequence
  Description of Artificial Sequence: Synthetic oligonucleotide
acgtgaccagtgaaattggagcagaggaagc

SEQ ID NO: 144292 - DNA, 30 bp, Artificial Sequence
  Description of Artificial Sequence: Synthetic oligonucleotide
cgtgaccagtgaaattggagcagaggaagc

SEQ ID NO: 144293 - DNA, 31 bp, Artificial Sequence
  Description of Artificial Sequence: Synthetic oligonucleotide
gtgaccagtgaaattggagcagaggaagctg

SEQ ID NO: 144294 - DNA, 32 bp, Artificial Sequence
  Description of Artificial Sequence: Synthetic oligonucleotide
tgaccagtgaaattggagcagaggaagctgag

SEQ ID NO: 144295 - DNA, 31 bp, Artificial Sequence
  Description of Artificial Sequence: Synthetic oligonucleotide
gaccagtgaaattggagcagaggaagctgag

SEQ ID NO: 144296 - DNA, 31 bp, Artificial Sequence
  Description of Artificial Sequence: Synthetic oligonucleotide
accagtgaaattggagcagaggaagctgagg

SEQ ID NO: 144297 - DNA, 30 bp, Artificial Sequence
  Description of Artificial Sequence: Synthetic oligonucleotide
ccagtgaaattggagcagaggaagctgagg

SEQ ID NO: 144298 - DNA, 32 bp, Artificial Sequence
  Description of Artificial Sequence: Synthetic oligonucleotide
cagtgaaattggagcagaggaagctgaggaag

SEQ ID NO: 144299 - DNA, 34 bp, Artificial Sequence
  Description of Artificial Sequence: Synthetic oligonucleotide
agtgaaattggagcagaggaagctgaggaagttg

SEQ ID NO: 144300 - DNA, 33 bp, Artificial Sequence
  Description of Artificial Sequence: Synthetic oligonucleotide
gtgaaattggagcagaggaagctgaggaagttg

SEQ ID NO: 144301 - DNA, 33 bp, Artificial Sequence
  Description of Artificial Sequence: Synthetic oligonucleotide
tgaaattggagcagaggaagctgaggaagttgg

SEQ ID NO: 144302 - DNA, 32 bp, Artificial Sequence
  Description of Artificial Sequence: Synthetic oligonucleotide
gaaattggagcagaggaagctgaggaagttgg

SEQ ID NO: 144303 - DNA, 33 bp, Artificial Sequence
  Description of Artificial Sequence: Synthetic oligonucleotide
aaattggagcagaggaagctgaggaagttggag

SEQ ID NO: 144304 - DNA, 32 bp, Artificial Sequence
  Description of Artificial Sequence: Synthetic oligonucleotide
aattggagcagaggaagctgaggaagttggag

SEQ ID NO: 144305 - DNA, 31 bp, Artificial Sequence
  Description of Artificial Sequence: Synthetic oligonucleotide
attggagcagaggaagctgaggaagttggag

SEQ ID NO: 144306 - DNA, 30 bp, Artificial Sequence
  Description of Artificial Sequence: Synthetic oligonucleotide
ttggagcagaggaagctgaggaagttggag

SEQ ID NO: 144307 - DNA, 29 bp, Artificial Sequence
  Description of Artificial Sequence: Synthetic oligonucleotide
tggagcagaggaagctgaggaagttggag

SEQ ID NO: 144308 - DNA, 28 bp, Artificial Sequence
  Description of Artificial Sequence: Synthetic oligonucleotide
ggagcagaggaagctgaggaagttggag

SEQ ID NO: 144309 - DNA, 30 bp, Artificial Sequence
  Description of Artificial Sequence: Synthetic oligonucleotide
gagcagaggaagctgaggaagttggagttg

SEQ ID NO: 144310 - DNA, 32 bp, Artificial Sequence
  Description of Artificial Sequence: Synthetic oligonucleotide
agcagaggaagctgaggaagttggagttgaac

SEQ ID NO: 144311 - DNA, 31 bp, Artificial Sequence
  Description of Artificial Sequence: Synthetic oligonucleotide
gcagaggaagctgaggaagttggagttgaac

SEQ ID NO: 144312 - DNA, 32 bp, Artificial Sequence
  Description of Artificial Sequence: Synthetic oligonucleotide
cagaggaagctgaggaagttggagttgaacac

SEQ ID NO: 144313 - DNA, 34 bp, Artificial Sequence
  Description of Artificial Sequence: Synthetic oligonucleotide
agaggaagctgaggaagttggagttgaacacttg

SEQ ID NO: 144314 - DNA, 33 bp, Artificial Sequence
  Description of Artificial Sequence: Synthetic oligonucleotide
gaggaagctgaggaagttggagttgaacacttg

SEQ ID NO: 144315 - DNA, 36 bp, Artificial Sequence
  Description of Artificial Sequence: Synthetic oligonucleotide
aggaagctgaggaagttggagttgaacacttgttac

SEQ ID NO: 144316 - DNA, 35 bp, Artificial Sequence
  Description of Artificial Sequence: Synthetic oligonucleotide
ggaagctgaggaagttggagttgaacacttgttac

SEQ ID NO: 144317 - DNA, 35 bp, Artificial Sequence
  Description of Artificial Sequence: Synthetic oligonucleotide
gaagctgaggaagttggagttgaacacttgttacg

SEQ ID NO: 144318 - DNA, 36 bp, Artificial Sequence
  Description of Artificial Sequence: Synthetic oligonucleotide
aagctgaggaagttggagttgaacacttgttacgag

SEQ ID NO: 144319 - DNA, 35 bp, Artificial Sequence
  Description of Artificial Sequence: Synthetic oligonucleotide
agctgaggaagttggagttgaacacttgttacgag

SEQ ID NO: 144320 - DNA, 34 bp, Artificial Sequence
  Description of Artificial Sequence: Synthetic oligonucleotide
gctgaggaagttggagttgaacacttgttacgag

SEQ ID NO: 144321 - DNA, 38 bp, Artificial Sequence
  Description of Artificial Sequence: Synthetic oligonucleotide
ctgaggaagttggagttgaacacttgttacgagatatc

SEQ ID NO: 144322 - DNA, 41 bp, Artificial Sequence
  Description of Artificial Sequence: Synthetic oligonucleotide
tgaggaagttggagttgaacacttgttacgagatatcaaag

SEQ ID NO: 144323 - DNA, 40 bp, Artificial Sequence
  Description of Artificial Sequence: Synthetic oligonucleotide
gaggaagttggagttgaacacttgttacgagatatcaaag

SEQ ID NO: 144324 - DNA, 41 bp, Artificial Sequence
  Description of Artificial Sequence: Synthetic oligonucleotide
aggaagttggagttgaacacttgttacgagatatcaaagac

SEQ ID NO: 144325 - DNA, 40 bp, Artificial Sequence
  Description of Artificial Sequence: Synthetic oligonucleotide
ggaagttggagttgaacacttgttacgagatatcaaagac

SEQ ID NO: 144326 - DNA, 41 bp, Artificial Sequence
  Description of Artificial Sequence: Synthetic oligonucleotide
gaagttggagttgaacacttgttacgagatatcaaagacac

SEQ ID NO: 144327 - DNA, 41 bp, Artificial Sequence
  Description of Artificial Sequence: Synthetic oligonucleotide
aagttggagttgaacacttgttacgagatatcaaagacacg

SEQ ID NO: 144328 - DNA, 40 bp, Artificial Sequence
  Description of Artificial Sequence: Synthetic oligonucleotide
agttggagttgaacacttgttacgagatatcaaagacacg

SEQ ID NO: 144329 - DNA, 39 bp, Artificial Sequence
  Description of Artificial Sequence: Synthetic oligonucleotide
gttggagttgaacacttgttacgagatatcaaagacacg

SEQ ID NO: 144330 - DNA, 40 bp, Artificial Sequence
  Description of Artificial Sequence: Synthetic oligonucleotide
ttggagttgaacacttgttacgagatatcaaagacacgac

SEQ ID NO: 144331 - DNA, 39 bp, Artificial Sequence
  Description of Artificial Sequence: Synthetic oligonucleotide
tggagttgaacacttgttacgagatatcaaagacacgac

SEQ ID NO: 144332 - DNA, 38 bp, Artificial Sequence
  Description of Artificial Sequence: Synthetic oligonucleotide
ggagttgaacacttgttacgagatatcaaagacacgac

SEQ ID NO: 144333 - DNA, 38 bp, Artificial Sequence
  Description of Artificial Sequence: Synthetic oligonucleotide
gagttgaacacttgttacgagatatcaaagacacgacg

SEQ ID NO: 144334 - DNA, 38 bp, Artificial Sequence
  Description of Artificial Sequence: Synthetic oligonucleotide
agttgaacacttgttacgagatatcaaagacacgacgg

SEQ ID NO: 144335 - DNA, 37 bp, Artificial Sequence
  Description of Artificial Sequence: Synthetic oligonucleotide
gttgaacacttgttacgagatatcaaagacacgacgg

SEQ ID NO: 144336 - DNA, 38 bp, Artificial Sequence
  Description of Artificial Sequence: Synthetic oligonucleotide
ttgaacacttgttacgagatatcaaagacacgacggtg

SEQ ID NO: 144337 - DNA, 37 bp, Artificial Sequence
  Description of Artificial Sequence: Synthetic oligonucleotide
tgaacacttgttacgagatatcaaagacacgacggtg

SEQ ID NO: 144338 - DNA, 36 bp, Artificial Sequence
  Description of Artificial Sequence: Synthetic oligonucleotide
gaacacttgttacgagatatcaaagacacgacggtg
